United States Patent 7,468,248 (METHODS AND SYSTEMS FOR INFERRING BOVINE TRAITS) - sequence listing, part 9

SEQ ID NO: 36259 - DNA, 1181 bp, Bovine  19866881157436
taattgttttactgagggttatatatatatatatatatttatatatatatatttttttactgaggagatacccccccccccacccactgaatatacatagactagtaaagagttttatgacttacttaagggaaactacttttgaattcttgaattctctgaatctggctatttaatctgctcttagttatattgagattgcctgaaggaataattttgagctggtgtttcatattgtgaagatgattctatttatagtctaagctaatagaaactgcatttttatgaagtcttcatctcagagtcctattaaatctggaaagtaccagaaatacttctcaatttttcaatgtaaaaatacatagcttttccaaggttcacaactataaactacagatttgtttggaaaagttgaaagttaggttaataaatgtacatttaaacttaagggaccagtttgaaagtttacacttatagtcaattaatccaagttaatagcaactgtctgcttatgaaactaagctgatacagagcttggcctctggcatagaaagctctggggtttcctatgctagagagtcagtttttttgctttgcttaagaaatacccgctagttactcaactgtaatttaagtttaaatatgattgatagctctcaattacatgtaatattattgttctcagtgaactgttatattttccttccatgttattctatttaaatcttcacaaaattgctgaaagatacatctcctcaccagcactcaaactaggaagaattgaagggatgggaaatgtgacagaatctagcatgacaagatagagaccatattttttctacctattaaaatcccctacaaggccacacagctctagagtgcaataaagattcattgttatggctgcctaaagaagctttcagtttttctgaagtccatatgctgtaggtgatgtgtccttccacatttatattgacatctagagataatcatcaaaatgaccttggaaatgtacagaggaaaataaatcattagtccagcccaaaggttttcctacagtctgttgctcatcactaaagaatcataacattttagagtgggaagtataccatgtttttaagcaatttaattggcattggatgcgtaggaccttgaatattctaagagctggctaaataacc

SEQ ID NO: 36260 - DNA, 1892 bp, Bovine  19866881259310
tctctctccactagattgtgcattccatttggggtgatcatgtgtgtgtaatttttgtaaccatttaaaaggtatttatcatgttcattgctctaagtctattcagtctattgtagaaaagcaaatggcatttgtttttcattgatgaatctgtcaccagtttcccaaatggttaatataatttagttaaaatattcattttatttcacaaattttcaatttcaagatcctgatgactattcactcaactgtgatgccaaaacctttctttgacactaaacactatttagctacaaaaagaataataaatgtcagctactttggacccactaattaataattgccaaagtttttaacatctataagaggtagcattaagacaatgcttataatactcaaataactaatattcactttgttaccatctattggcacatatttctaatccacaggtgagaaaagaaagaatttcttatttattaacagatttctaagaaaaatactctctctaatccagcttctgaaagtcagtattttcaaacaaatatcctcagcacatggatatttacttatgccataaataaatttatttatatattccttaaattacaaaggatgcaatagaagtttttaaaaattgaactgagaaatccacaaatattttaataactacttttaatactaaagaataacaaaacgactttttctttgaagataaacaatatatagtatgactatggggacaaaaccaatatttcatatgcttttttatttataaaaaatatttcagcctaatgccttataatgtaggaatttgcagatatgagttttaagttcagtttgcttagatatttgggtttagtgacccatcttagctgaccaaaaaaaaaaaaaagatggagatacaaatggaaaaaatatcttttttttttttactttgcatatgaaatcatcctactcatttctctatattgtccattaaagatttttgttgaaattcaagcaagctttaatcttcccctaaagtctgtcagtttttcttataaactaatcaaatgttaattatatctttaaataatggttcaaaacccactgagtcacttttgaagattttcagggtagaaaattcattttccgtgtttttaagtatgcagatttttagcaacaaaattatgtaatgatagaaacatccattttcaaaatgctctttccacagcctgcatttatttcagaaaaagagttctttttattgatcaacttcttggatcttagtagattattcctcttaattaggttgggaaataaattgcattaagagtaggaaatgtgtcagcaatgtcattttcagatggcgtacttgtggttgcattactcacaatgtcttcaatcaatctcaattccttttaagccactagtccattttctgaagacctaggtcagtgaaaatcagggggaaaaaaatccatatgttcacctaaatgagtctcagtgaactgctttgtgttataataatgttaactgatgagaatattgctatcaacctctccatgctaaagatccacctttccttccacagtaggtgactcatgactggccaggctgatgggttcattttgagggccagagtatgagaaaaacctaatgcctttcttagttttcacattaaaataaaatatttttagtttcttctttccccatctcaaatagatgtcttgaacagctcactttgaagaatgatgttgttcatccccttcaccaagtcctggtgtttcttgataaaatttcaattcctgagtcccatccagacctactggggcaatgatgggagatttaaaaacaagctttacagctatacactacaaaatgacaacttgtcttgaatcagtgattcc

SEQ ID NO: 36261 - DNA, 1748 bp, Bovine  19866881365386
ctatgaaatgtcgaagagtgtggcacccctctgtatctaaatcattacctacatttaattttgatatgaatcgtgagagcttttattcttcttaccctcatgccttcaaaccgggataaagctctcagtggtcttaaagctcttaatgtccgtagggatttgatggcaccaagttctgagtagccaagagcattggctaccaagctaaccaaagaaacctgaagaagaaacaaaaatcagtcagttcaccaggaaataaactattgactaaaggcatgagacgtaatatctcttttttagtgccaatcaaacaaagctttagacagcccttggcagccttcattttctacatagtagtgtgctcattttaccttcccagcctcattaattaattgcttttcttaccaaacatccataaggctctccagttagatattttacccatggagcccttttcagcccagacatagaccactgatgattcgagatttaattcaaaagtcatatccttcatagatctgtgtttaacatcattgattaataatcatacttcatttccaagttttgcagtatcctggttatgtgtattgcaggcactgaccataatccaggccacattaactctttatggactgaaatgaaacattcttatttcaatgtctctaataatacctggttgaatatctttagtcagtatatgttggataaataaacaaagaagaaaatattacctgcaaaaacattttatcagaccacatagtttcataacaatgaagttttttttttacctaaactattggatttatgatttagaatacaatacctctcattcagagtgatgatatatctttctgatatttacataaatgttgttttacttaaatatatgaaaggttaaagaagacatgtctttttcaggaggaagaagcactatttgctttgattttctttaatagcctggcttagtcgcttagtcatgtctgactctttgtgaccccatggactatagcctgccagactcctctgtccacggggattctgcaggcaagaatactagagtgggttgccatgccctcctccggggaagccagcattttattaaatgttgaacatttactatatgctaggttctgttctgattgtcttacacctataaatctcaagaagtgtgtagtattacgtttgccttttcactgataaagaagttgagtttctcccacacctctgctttttttttttttttaaaagatgtacagatagaaagagatgaagttagaacccaagtgattggacttcaaaactgtatcttaaccttttccctccattaccagaaattcattcttaatctgaaccacaaaactcaagaaatgacttgaatgattatcttcacttcttgtaaggattatatatagcttgatggataggagagaggataatttatgcatccactggatggcctcagggccatggtgtaaaggtgacaccaaaaccagaactgagactttaaggcagacggagccactatccccttattgttagtgttgaacagaaaaataaatgacttgaatgttagacttgactagtggctgcataatttattgagctattaatttctctctagtgttcactgctacagaagactgggaagatgggggaaggttattattagagaacacacaggccttctacattctggactcatttgcctcggaagcattcacaacttctttaagtttctgcagctgctt

SEQ ID NO: 36262 - DNA, 1579 bp, Bovine  19866881414012
aatttgtgtttgcaaccactgattatcatcagagttactttatggctatgaggaaattattactctcagaggtctaatgactcatctaaattgatattaacaatttaaaaaaaatgtatcaggctacctcacactggctttcagtgaccatgttgatacaaagaatgaagaggctcaaattaatattttatccagcaaaagatttagggactgtgatttagcctgtataaaatttattcagccagcctccatggtacaggattccagaattccctgtagctctgctgaactgactggaaacacgataaggcatttaaattctgtaggtacagccgttcctagcaaccaatttgatttttgacggacaaagggccccaggaaagtagacacctttgtacctgagaaaaaaagaaatcccaagcaagatagacatgccctaatcagtatgctctgggtatgacagcatgcaagtgagtgatctatttcgttctgaaccttggctctgtcaatgacagaacacgatttactagaacaaatcaaataaatgtatttgactcctgttttgacgtttcaaaacgctgaaccatatttccttatgcagccctctgatttcacatttttaattttgactttttcttataaaatactcttgtcagaatgagaatgcaaatagcaatgaatcagggtagaaatactttcgaacattatggaaagaattatttctgcatggatatgatagtctggcagatgtggttcaaaaaattacagccctccccgccacctccaaagaacgacttggagacctagattgtgcaatcagtggtcagatgtttcagtactctgttgttcccatgctcgttacagttacatgcgacagtgctgcagcgatgagtggaattttcaaggggaagttggaggaaattgatggctccttcccctgctcctctgtgcaggaatccaacgatgaagtttttagctgtgccagtgctgccagtgttgatagcgtcaatccatccacttctaaccattttactggtgagtgtctgaggctgtatttcagattgtactctaaactgtgttgtatagtcgattcttggaatttttatctgtatccattggcttatatttgcccctcagctgtttatcaaaacagacttaatttgtaaaacatgataccatttgggttcattaactctcagtagtctactcctgtttatctctgcagagtgagtatgagaggcagaaatgagtccaaaccaaggtaagcaaatagcaagtgaaaataatttcctgtgtgtcttcagctttctgaagcagagccatccttttgaaatctaaatcacttgagctcttttgaacgtctaatactggttaatgagttgtggaatatttgcagtactgagtacaaaacattcacttccagggtgagaaaatgatgtttgtttttaaaagaatgctactccgaaatgaaagccttggaaaccctaagattctgtaattggttgaacactggttaacctcaaaccaaaggccagattcatgcactacagtaaatggtagctttctacacatatatggg

SEQ ID NO: 36263 - DNA, 1743 bp, Bovine  19866881495155
atcctgatgctgggaaagactgaaggcaggaggagaaggggatgacaaaggatgagatggttggatggcatcaccgactcaatggacatgagtttgagtaagctctgggagttgatgatggacagggaagcctggcgtgctgtagtccatggaggtgcaaacagttggacacgactgagccactgaagtgaactgactgggggactggaggttacttttaatatgaaagaaaatgaagtctataaattgcagactttaaaatattggttatgatagtccttgttctattccattgagttggggcctgatcaagcaacttagtataataaatttaacatgtgagagtctgatccctctcaaataaatctattgtcctttcttccccaaccactgggtccactatttcctggcttgggatggtctactttcttctcagatctcaattaaagatattttcaggtctgaactctttgacaaagccttctgtgatgatccttgccatcgcaaagcaacatttccatcttgtgaactttacatacaacactttgcttgcacatttttttcacttactctttttattcctgtttgagtaaatgtcctatcactatgccatatttatcatcctaccatcgttcccaggcctccaggactcagtagaggtgtgttgggcatagttcattttacacagaaatgataacaaatgattcttgagtcagtgttacttgttcatactgtcatttctatgcaacaaatactgatgtgcttttaatggactgagatgatcactatttttttttaactccaacttgcagagatcccaaatgtgaaacattttcaagtgacaatattgttagtatttataaataaaatgaatgactgtctaatagcactgccatgctttagcataagaacggaaagataaaagccaaaaatggccctctccatggaacagtaagaggtacagagatgaagaacaactttggttcaaaagatattttaagagcttgtgttacatgtcaattacagttcaatataaagggaaaaattttaaataatgtaagcagatattaaaaagagttcatgtagatttctatagtctgatctataactgactcctgccatcatgaagaattgacacttgatttaaaaaaatatacaaaacattcctgatggttacattatcttttactgaaaatgagaaaaatgttttaccacataccaccaggtttccaatgaccatgaccatcatgaagacagtaaggcacatggtttgaccggcgacctccatgcagtcccacatggtctctatccactctccacacagcacccggaacacaatcaggaaggagtggaagaagtcatgcatgtgccagcgagggagttcacaatcattggaaatcttgcagacacattctttgtagctcttaccaaagagctgcatgccgaccacggcaaaaatgaagacgatgatggccaacaccagggtgaggttacccagagcccctacagaattgccgatgattttaattagcatattcagggtgggccaggattttgccaacttgaaaactctaagctgaaaacagaaacaaggtcattactgctctgcatttggaagaatctgtatatttgtttatagggaaaatctacagtgtctcagttttaggtgatgggttatttgtgtgccaaactattggctatattcttcattttgaaatagtatatattggaaataaaataaga

SEQ ID NO: 36264 - DNA, 965 bp, Bovine  19866881759970
atatgaaatatgggttggccaaaatttggttaatccacataatattacctagatatgtagattttggtcccatgtcttcaagtacttactatacaatactgtgatcaaccaaatggtggacactgaaatatactaacagaaaatggatctagcttttaaggtattaaacctgaaattaaataaataaactgtaaacacagatccaagctgaactaaaatgttatgaaatttatcaaccttttacctggtatcttttatgtatttgcagtataaagtattttactttacttaatctttccaactaccctgccaggagattactgacctcattttaaggattaggaactgaaacactgagactttcaggaacttgttcaaggtcccctgtgtcttaagcagtggatctgaagtttggaatttatcttttcttcccctcaaagccatgcttgtacatagtacacactccaccacatgttgcttaattcattgaataaatgaacactttcctgattttacaatgttgctttgttttaccttttcgtttctagctttctcactggtgacttaggtaaataaatgataggtagaatcaagatcagattattgagagatgatccaataatgacaggtcagagtattaagagacaatattaagagtgaggggaattgaagggtgaaagaagagccaagagaaaaacttgggattatgaagggacaaaacaggaaaggggagagagaagggagtgaaccccaacttggcctttctctgggctgcagatcgatgaaacggcaggatcccactcgtggctgctttctctgatctctggccaagcgtgtggcttggcattgtacatctaacagttagcagggttctgggagaggcccgagtcagtgactgaattacactttccggagctattcttgtattctaagcctcccctgaaggtcttttatggttaatctca

SEQ ID NO: 36265 - DNA, 1394 bp, Bovine  19866882016488
acatgcagagattcagaattcatattcacatgtaaaaacccttaatcaaaacaagaacatctactaacataagcagattgaacaggaaacagagcaagatgcaagaatttaatatttgtcctccctaaatgcaaagtaatcatttgtgtttgaaatgtacacttatcagtattctggttatccttttatatatttagtcactgattttaatatcagagttctaaggaaaggctttaatctaaaaaatatattatatactgttgagtaccttcgacttcaatttcagacttttctcacttcaaatgtgaacttgtcttaatccgttggaaagaatgtgaagatttatggagctaatttatgaaacagcacttctactgagaaaagagttctctcatatcaatactaaataaaaatatgacttagtttgatgtaaaaatttcagtcatttataggtgtttccacaatgattcttcccttaaacttgtttcaagtatattaaatatgtaacatctctatatcaacattcaaaatgcattaaagcatctaaaagtagtaaaatatcaccaaactttagctcccactcgatttccattcagtaatcaccgtcatagcatttcttttttccagacattctgtctgccaagagcaaaaccatggcaaaaatgggcataattcttaggaacagaaatcagaaataagataaagcctcataaaacaatcaaaattaaaaaaaaggtttagtaacatgagacagctatgccatcatagcaaggggctctggatagtctgtctcagggggtctgcaaaataagacaattgtgtgtgtagtggacccatctggactcaggccgaactgagtcactttgagttcagtcactttggaaagtcactttgacctttccaatagcatgagcttgtcattattcatggaggagaaagtcttttgtgtcatctacaaaatttgacctctacagctttagctttatgggaaaagtgacacgaacttactttccaggcaatgatttaagaaggaaaaatatttatgaggtacaagattgtgatgccttataattcaaggtgtaagaaaataagttttttcttcacctttagaggtttttcattggggcagataaaaatatataaatagttacatacatgtgtacattaatgaagtatttggagagttaacattttaagagctcatgtaattaatgatgtcatgcatgaactcaaagtaagaaaagtcagtgtgaatgacctttgaattgaaaaaaagcagtctcaactgtcctcagtaattattttggctgaataaagtctgaagcaatgaaagaggttttcaaagttctattacagaatccatgagactcaatatagttcgtaagcagtgaagc

SEQ ID NO: 36266 - DNA, 643 bp, Bovine  19866882084885
aaaaatagaaaactggatctgatgcctaaattaaatcttcatttttaaaaatcatctatgctttgatatagaaaaagcaacaaacaaacaagtaaatgtacagttgctggatacctatagagggttagaacgagccagggagggagggaagagacagctagatcagagaggtctaaggagcgtacgtgctctgttcctcaccttccgtaaaacaggcttcaggctccagagattcttcaggctcagcttcaggttgttccccctcagcgggagctcctatatcaactgtgctgccttcagatgaactagttgcatttagcttctgaaaatcaattccacaaaaaagcttttaaaatagtttctttaatctataatataaaaattccaaaggcgtgcccttaagtcttctgtattcatttccttgatctgtaatttaagaatctcttaaacataatgccagtctgctttggtagaggtggggggtcacaagattagattcagcaccacagtatttttttttctttaaaaatgtggtgctaaccacttaagtaatctttgattaagctcctttatagagagagattctgaaataaaatcatgcagagcttacataagctgccagagtcgtatggtagtctgcgat

SEQ ID NO: 36267 - DNA, 1629 bp, Bovine  19866880414844
actatgggggcccactgtgtcagtcccaatgatccagacctagagagaacagtaggtctacccaggctgtggagtgggatgggggtgataaaaggacagagcagtaagatggccagtaaaaccaaagccaaccctgaaggtgatggcccagggccaccttctggccaaaggggtgactggtgttcactattagatccctgtgctgtgtgctaagtcatttcgggtgttgtccgactctttgcaactccatggactgtagcccgccaggctcctctgtccatgggattctccaggtaagaatactggagtagcccttctccagggtatcattctgacccagggatcgaacccacatctgttatgtctcctgcaatggcaggcgggtgctttaccacttctgccagctgtgaagccctgacatggatgtaaaacttggccaggtgactctgtgaaacccctgcattgccccaggatagctttccaagagcttcaactttaataccatgcatgatggcagctcaaaacagagacttacgtgatgaaaatgtgagagcctcagtagactcactatttcagggtttcaatggcatggtatttgtttatggccagataagcactggcaggacataccacgcagggggcctagatagaatccaggtgacaaggtcatccctagtacctctgagcacttcctctatttcttgcatccctactctcagcagtgcctggtccagtcctcccacctggagatatacctagaagagatttgagacctgctctccaaggagtccagcaggaacctagagctaatggagaatgctgaggcatctacatcaaggatctctcctcctttgtaactaagaatgtcaaggagattcatgatgaacctatgagagcagactcaggtcatgggcaacacacacatggatgaaatcagctcttgctcccactctacttcctcacaaccgtggggtacagtggctgtgatgtccaggaccacagctgtttggaaaaactcaaccttgttgaacctggccaggagcaagagatagaacaaagcacatctctacttaactgaagggacagccacacagtccatgggtagtgatgacactggagatggtggaagagaaaagcacaaggaagcttccaaaataaacctctctctgtcttccctgggcaatgtaatcactgtcctggtgggcaacaggagcacccacatcccctattaggacaccaagctgatttggctgctctagaactctcctgggggcaaagataagatcatcatagtggccacacaggtgccagtttcttactggctacaaaaagagcctctccaaccaccactttgccaacaaagacaaggaaatcaagaacaacccctgagtgcatgaggaccccaaggacacattgctgtatgaattccaggagatcacctacctgaagtctcatctggagaagaaggagatgctggaaaactggctatggaggaagagcagcagcataaagaacactaacataaaaagtagcagtatagaaagcactatgtcagccctcggagaaagcaatggcaccccactccagtactcttgcctggaaaatccatggacagaggagcctggtagg

SEQ ID NO: 36268 - DNA, 1563 bp, Bovine  19866880428503
gcgcctccattcccacagggaccacaaagcccgacacaaaccgccgccctcgccgcgcggttttgtgccccccttagccgggtcgcagtgccactgacctcccttcccgtgcgaccgagggagggcggcgagggaacgaaatcctcccagccttcccgtccgctccctccgccttaccgtcttggcggcctccgcccaggtcctgcccttcttcctacggcccttttccctcatgtcgggtcttgaactgactgggaggctcccgtgtccgggctccggccgccctccctgcctgctctgctctgcgctgttcttcccgcggtgccgggaaaggtgggagaaaggggaagtcaggccggaggagcaccggagcagaggaagcgacgggggtggtgcgctgggggcggtctatggggcggccggtcctcctgctgccgttaccactgctaccgccgctgccatattgggtccttactgtacaggcagccgctacggtcatgtgaccgctcccgcgcggccgtcactactgtacgcagccggccgcgcgaacgagcgtgtgcgcgcccccgcctcccgcgcggggccacagggagagcgagccggccggccgcggcgtctggccactcccccgtccttccgttctcagcctctcctccagagcatgcgcaatggggaggtccgacgctacgttgcgtctggcgtccttcgctcacgcctatagcgaaaacctgcctgcggaagcggaacttgatccgtccgggaaggtttattgggtggtttgtgaccgcgtgcggggcgcggtggtgtccgtagagcctgggaagagttaggctcttccctttgggggtgactctctcagctgtcattttcaataagcctgtaacttgccttttctgtttgtccatgttaatttttttaaaggttatctttttgaaaatttgccacagttctcatctacttatttgccgcacttgatagatgaggcaatctgagattgagtgatgccacactagaatgaggtgaagccaaaaatcaaatcacaaactcagagtcctttccgtcacctcagaatgcctctcagtcttaggtaacctttattttcaggccaccaataactacattcatgctttttcatgtgaatgtctcatcaaggacacaaatggtgtcttttttatcttggtgagctcattgcctggctcagtgcctgtacatatcaggcgcccagtaaatatttgctgaatgattcagctgaatctgtggtcagaaaccattatttgtagtgaccataacgacctcctgaaagatccagaatgtggcatcttccgtcgcattgttcatgtctatatactttgcaaagtaaatagaatgtatagtaatgcctagtaatctcccaaacccacctgcttccagaacctgcttctgatctactaaattggaaaagactctgatgctgggagggattaggggtaggaggagaaggggacgacagaggatgagatggctggatggcatcactgactcgatggacgtgagtctgagtgaactccgggagtaggtgatgga

SEQ ID NO: 36269 - DNA, 846 bp, Bovine  19866880529802
ctgtttagagttgtttgtggtacttagcaaaataagctgtaagaattatatttcattttgggtaatttaactccactcagtctgtgactctcgcttctctccggggctcagtagaaatcaagtccctatttagaactgcaaattcacagcacggcgatggcagaagggatctagcagctgagaatgctgagcaagatttaatgaactgaaatggcacaccttcaacacgcactcaaaattttcataataaaatgtagttacggtttctaatcaaagttcagatttgccctggtttcccagaatgtcttctagagtggtgctctataagctttaggattggcttttgctcagttgcagctttgctccacaaagcctctcagcctgtgtgtttcgggcagctctggacgttaatgggaacaggagtttaagtgacggagctccccttttctcttccattccctgctcacctagcagggaagggccagggattcctgtctcatgtagacaagaaaggggagcagaatttggcactcagatctccagaatctggttcccaaatctcacagtgtgctctgggaagcagactagagctggatccaggggtgtgtgtgtttcccgagatgtgttatcctgtggctttcctatggcaaagggtttggggacaccaagtgccagagcccaaaggtggggagcatggctggtcaccttcctgtcatttctccctctcccctcccacacacagtttgtgaagttcgccaacatcgaggaggacaccccatcctaccatcggagctacgatttcttcgtgtctcgcttcagtgagatgtgccactccagccacgagga

SEQ ID NO: 36270 - DNA, 1236 bp, Bovine  19866880534572
tttcaaagaccttctccataggggaagggaaaaggtatgggcctgccttactgagagcctcacagtccagagaaagtctccatttggggaaacctcattgctctgggaaaagtaccctgcaaaccacaaagatgattgcaggaggagttagcaaaaaaaaaaaaaaaaaagtgctgttccagttttcagctttacggtatcgttgaaactttcttttcctcttttttcatcagaagtgaccccacaaatttaagatggtgaaacctctgagaccaaatccttgtcccagctctaccctgttcccaacctgggctcacagaatggatcctgtggcccttatgttgaggcgaacacattttctctcctgcctccttgaaagaaaggaaagtatgttttgccactgatttagccataggaaactcttctcatcacccttttctgggtctgaagctgctgtctaaaagtgccatctcgttgtgctttgtactggttactgctggagaaagcgggaagagcttatgtacaaacctgtttttaaattttatattattgtggtacattgcttctttggggttggggcacatgggtgacccctctggctgtgagagtgctctacagtctgtgggctggcagtgtgctgatctttcaaagtttctttccctacccaatccccctttttggggtgaggttctagtgaggtctgctaggtgagtgtgctgcagcttaattggcttaaaacgttctctcctttggtgtggtctctgtagggatcaattgggagaaaaaaaacaaacaagagtgtagctgttctgatactgaaaattgataacattgttctgaaataaagaaggagctcctccctgatggctcagatggtaaagaacctgcctgcaatgcaggagacatgggtttgatcccttggttgggaagatctcctggagaagggaatggcaacccactccagtgttcttggctgagaaatcccatggacagaggaccgtggtgggctacagtttgtggggtcgcaaagagttggacacgactgagtgactctgcagacacatttcccctccaaaaaagaagatcctgacagtgcgtaggaggaagaagccctaaaccaagatcagtggatggaaactgtcctttggcagcagatggacctgggattttggtactttacgtgacttctctggggcctattttctagtgtgtaaaaagagactatcatgtatgtta

SEQ ID NO: 36271 - DNA, 1413 bp, Bovine  19866880649700
ggattcaacatcattcttctgggtgtggctatccaatatcccagcacccatttattgtattctttcccccccactaatacaacattgcttttgtaaacacgttttatttaggacaacattaatgtgaatttataatctctgagcacaccctacttgcttctggcagcaatgtggcctctggagattgggaaggagagtgatttttctgtgggcgataaaacactggactagaatatgctgagtatgtgtacgatgttacatgcgatgcccgatgttagggtgcatcataatcacctaggtaaattttttaataggaattcccaagccccaccccaaactactgtatcagaatttcctggtaacattctgtctcttacatatatagaatcacagaacgttaaaactgaaagggcccttagggtcataaatatacctcctcatttttaagctgatggtcagcttttgcttctcactctctctaaacatcaaggccagactgagcaattggtttgtatcccccccaatacattcaaattcaagaatatttatgactcatgaagttttactgaaggcttcatgggagcatggagaagaggattacatcacaccccacaatgcaaaacaattagatcctccatgtgactagctagacctgttcttcctcccaaagttttctcccttgctaccctactgtcaagtctcttctcttcatttctctcaccatacatcttctgaaattcctccttttttcccaaactagtcgacgatgatctcaagtttatacccactcaacaaaagtatgctagctatctgaaaaacaatcaactacttttccccaagcatgctccttgggaaattgggaagtttcccaattcattccacagtcatagagccatatcatatgatttctcatatcctaacatttcctgaaggggcttctctggtggttcagtggtaaagaatcctcccaccaaagtaggagacttgggttcgatccctggatctggaagataccctagaaaaggaattgacaacccactccagtattcttgcctgggaagtcccatggacagaggagtctggtgggctacagtccatggggtcgcaaaagaatcggacacaacttagtgactaaacaacagtgtttcctgaaggcttactgagaacaagatactgggctaagcatctcacaaaatgacttaacgtcacatagctccttaatggcaaatctggtatagaactttaattgtaagggtcaaagcgcaacttccaaggcactcatattcatagccttcaattttttttgcttcacagttctgtaggatacatgaaaaagggtctattatttcatctttcaaaggtagggcaactgaggtccagtgacaatgagtaactttgcaactcatttagtgg

SEQ ID NO: 36272 - DNA, 1953 bp, Bovine  19866880708703
ctctgtgaccccgtggaatgtagcctgccaggctcctctctgtccatggaattctccaggcaagaatactggagtgagtagccattcccttctccaggggatcttcccaacacagggatccaacctgtgtctcctgcattgcaggcagattctttaccatctgagccaccagggaagcccaaaatgggaggggagaaaattcaagaaaaaaaaaagtcctaaaacaggtaaaatgcagaaagatcaaaataaaagtagaaatgctaaggcatattccataaattagaaaaatctaacttaatgggaacattaacagaggtaacagcaaaagtacagtcagtgggaggaggctgcaggaactaagaacaaagacagggaataaggaggcagaaaaagtgaataaatggtcaaatatcaattgatgttacaatacagtcttacagctaatttctgctacactattattcagccacctcaactaagtaggacatagctgtgactagaaagcaaaagaaaaatggattctcacaacagtcaaaactgacaatcatactacgaaagtgagtgcttctctcaatatgagcaatcacttcttttgcacttcaaaagaatacaaagaaggctggttatgtttcctccatcggtagcatatgaaaagtggaccagaagcaaagagagacttgtagagactggagcactgataataccatcatgtttaccagcgataaaggacacaaacagacaccgccaccaccgatagccagaaattcaagagctgaaaaagcacagcagtctgaaaacacgagaaggaacaaaccacccaagatttcaccatcagccctacatgtatcacagaatgacaaccctaagagatgagaagtgtttaaattatgatcagtaagctctgtttaaaacaggaggcacagactatacaaagcagtttccaccctgggtgattaaaacaaaaaagtggagataggctaaaattttaccaaatgtaaattactgattgagaactaaaattattgcagtcctctgttgtaactactagtgaaaaagtgcaaattctatttctctgtgaagtatggaagggatccaggtgacagcgggtttttgtttttgtttcgttttaatgtggcttttgaacttcttgtgccgctgtgctatgctgctcagctgtgttgaactctgcgaccttttggactgtagcctgccaggctctctgtccatgggattttttaaggcaagtacctagctgctggtacctagcataaaatctgcatataaatatagcaaatttaatcacagatactaagaatccagaatcacctagaatgtgcatttaatcaatttcatattttcaaccagcttctccagtacttatttatctggtatcatcgtcgttaaaaggcagaaaaaagcccaactttctttctgtctgtgtttcaatgaaacataatttcatccatattgtattatcttcctaagaaaaaccacactagaatttagaaaatactaagaaatttcagctccaaagggtaataccttgagataccatgtgaaaaaaactcaagagtatttaaataaaactataattttttccaccaaaactttgttttattgcagctgattttgaaaagagataaccagataacactgaccaaatatattatctaagatctttctttaggcgtctaaatctagatctaatgagccacctaactttccaacttttaatgtcatggtaacatgtaagaaaaagcacagaaaacaaatgtacctatgaagagatcttgccaaaaagcttgtacttgaatcagatgaagcctccgtatctttcaattaaagcaaaaaaacactggccatagaggaacatcacacgaaatctagtccatgagaaatgctacaggacagatgacccagttgcaacaaaccaattcacaaggtatctca

SEQ ID NO: 36273 - DNA, 1421 bp, Bovine  19866880728799
ggagttttctgaagtaacaaatgttactgtgggaaagttagggaaattatagtattttagtataaagaaggaaataagtcatgcatttaaccaagctctgttaacatttgatatattaccgccccgtcttttttatttccccaaatctgggtatttttgtttattcattcttgcacatttgctttgtaaatcttgtgcatttgttttgtaaatggtatgttttagaggattcatgaatcttaaacttgtttgtctgggttagtaggaaatgtgtaaaagttagtgaataaataaaagcacattttatttgttgagtgctttcatttacagtgtaccttcataactgtaattgctggtcgtttccctccaaagaaaaaactctagaaataattttgttgggtggtggggaaattcctccttcacaaaaggagtgaaggaggaattgttctacttgatcaacactacctcaagacctcttttaaaggatagtaaattttattcataagtaaccagatcccagtcttcattgtgttaattaattttaagtctctagaatttcatgagtactttatgaattatctctttggataaaacagtctaatctttgggagactgtgacaggaaaaatttgcatctacagtctattttcctatagtaaataattatgtttgctcatttataacaaacatttcaagccttagctagttatgtgcaagtaatatttagaagatgtaaagactggagctaatcagtagatctttgagtgagttcctgaagcgattggtgtattagtggtttggtatttttatttgattctggcaaatatataagagctcagactaaataaaaatgaattttagaaagagaatggtaacactaaaacttcttttttctagtatccaaaatctagaaaacactctactcttttttatcatctataaagtatttaaacctcagtggtcaaaggtttctgtttacaggagaaataggtagaagtaaatgtgagaagaataaacaaaagtaaatctttaatattttcagatgcagagtaatgagatcagaaagttagtggtttgacagagataactttgacctaaattaggaaactgtatattttataagattaagagaaccaggagaagcaagtcttaaacttacctcataggcattaaggccaaatgttctatgaacagagtttcagaaaggatatattaaaattattcattgagtataggcaatgtctaattcatattttattatgttcttggtacctacattgtagagctatcctgttttagagaacgttattaaaatggggttgtgttcctgaccaataatagagcaatagataaaattactcacgtatatatgtatttatatcacatatgtttgtgatttggggttttgtgtgtatgtgagag

SEQ ID NO: 36274 - DNA, 833 bp, Bovine  19866880737767
cagcccaccaggcttccccatccctgagattctccaggcaagaacactggagtgggttgccatttccttctccaaagcatgaaagtgaaaaatgaaagtgaagtcactcagtcgtgtccgactcctagtgaccccatggactgcagcctaccaggctcctccatccatggcatttgccaggcaagagtactggagcgggttgccattgccttctccccctccctccttacctatcttaaactcaaccaagaagaattttctagaaatgttgttcctcatggattgctccttgttaaagagtcgatctcagtttccaactgatgtacatccagatgtcaaacttctcagattgaaattggaaggccctccgtacctattccctccctagaacctccatgtcacccctcaacctgtctctgtgctaaccatgctagccggcacagcccccttgctcctgatcccctcgcttccatgcccccttcccagcccacacctttcatgtcaccccttattataaaggcttttcctactgacacccacatctggctacctccttggtctatgtattcctgccatttctttgctgagtttaccctcgttaatttgtacccagcatcttaccaaggtgatggttggggacacaccttaaatacatcccccttcagtgaacactgatgccaccaggctttaccagagcctcaagggcctgctgaatcatcaaaggcattgttttgcaatatggacttaacaataaatctgtttggctgctttttgacaacatcagggatgagatatctcagtgtgcccacaggctttaatccaaagaccaccat

SEQ ID NO: 36275 - DNA, 2500 bp, Bovine  19866880753661
tgagtttattgtagatagtccaagtttcataattggacattttgtagtcattaagcagagataaaaggtgataaatatacaatacacatgtattaagtgtatttagagaaacagttctaccataaatctgtatctacagatctcagaatgtattagacacactggcaatcatcactgatgctgctgctgctgctaagttgatctgagttaatgcagaaacagagcaacaattcacactgttgtgtcctacagattcctctaattctctctacacatggaagcaggatacacattcttcagttcggctctggtagccacttgtaagaatcaagagagatctaacgctggagaaagggcggcgggtgagatgactgccagaggaaactgctcacttgaagaactgcttggtttcggttaagtcatacatttctttgcaatggaaaacctccctgtcatttctgttctaaaaataatcaggctagttgaaaaaaacccttattatttcataaactacacaccaatactttcttgaataagtatccatctttctaaacacgtgggtccatttcgtgttctgcgttcaaactcagcacttctgcagctgtaagtgggtttaaggatacacagtgcatccaaatatcagagtagattggggcaacgttcagatgctacgaagagcaatatgtaaaacatcccactcaacccactgaaattgctgatacatgctgtcaggatacctctaccctattccttttacctcttggagggcccaagaaattcataatttcagaaggaagcccatggtcaatgaagcagccagtgtagctgccatcaggagaacttcaggtcacatttccccaggtcttcacaccaccatgaaagggaataaagccagaaacccataacagtctcttctgatcctttgtatttctgcatcgtctgttgtaaccgctccttcttcagttctaattttgttgctttgattcttctcttttttacttgacaagtctggctaaaggtctgtcacttttgtttaccttctcaaagaaccagctttcagttttattcatttttactattgtttctttcatttctttttcatttatttccactctgatctttttaatttccttctttctgcgaactctggggtttttttgttcttcttttcccagttgtctgagatgtaaagttaggttgtctattcagtgtttttcctgtttcttgatgtaggattgaattgctataaacctgcctctcggaactgcttttgctgggccatgtgacccagcaattccactactaggcatataccctgaggaaaccaaaattgaaaaagacacatgcaccccagtgttcactgcagcactatctgcaatagctagaacatggaagcaatctaaatgtacatcaacagatgaatggataaagaagctgtggtacatatacacagtggaatattactcagccataaaaggaatgcatttgaatcagttctaatgaggtggatgaatcgagcctattatacagagtgaagtaagtcagaaagagaaaaccaaacatcgttattaacacatctatgtgttaatctatgtgtggaatctagaaggatggtactgattaacctattttcaggctaggaatagagacacagacatagagaattgacttgtggactcagaggagatggagagggttggatgaactgagagagtacaattgacatatatgcattaccatgtgtaaaatagtatgtggagaaatgtctgtttagttctttggcccattttttgattgagtcatttatttttctggtattgagctgcatgagctgtgtgtatatttttgagcttaattctttgtcagttccttcatttgctattattcatttgctcctactctgaaggctgtcttttcacattgcttatagtttcctccattgtgcaagccttttaagtttaattaggtcccatttgtttatttttgcttttatttctattactctgaaggtgggtcacagaggatcttgctgtgatctatgtcagaaagtgttctgcctatgttttcctcttggagttttatagtttctggtcttacatttagatctttaatccattttcagtttctttttgtgtatgatgttagaaagtattctagtttcattcttttacatgtggttgaccagttttcccagcaccacttgttaaagaggttgtcttttctccattgtatatttttgcctcctttgtcaaagataaggtgtgcctaggtgtgtggatttatctctgggctttctatttttttccattgatctatatttctgtctttgtgccaataccatactctcttgataactgtagctttgtattacagtctgaagtcaggcaggttgattcctccagttccattcttctttctcaagattgctttgccaatttgaggttttttgtatttctgtacaaattgtgaaattatttgttctgtttctggaaaaatactg

SEQ ID NO: 36276 - DNA, 1452 bp, Bovine  19866880772822
ttttttaaagcagtgttgttttttttttttttcattcataccttctaggaatgaatgtactttctaggtaatgtactttctaggttataagttgagttccatgtaactcaaggcggtgttttttcttaattaaactttttcttttgatgccaatttggattcacatgcaattacaagaactactacagagaaatcccctaaccctctatcagtttttcccaatgataacatctctcaaaacttaagtgtaatatcacaagcaggttattgacactgacgtggtcaaggtacagaacatttccatcagcccatgattccccacgttgcttctcccccccgcccccgcacgttgctctcttacaatcatgctcacttctttccctgcctccccctctgccccaattactcacctgggcagctactcatctgttctccatttccatagttttcacctgtaaatagtgttaaataaattggagttgtacagtatataacctttgggggttggctttttttcattcaacataattctgtggagatccatcccagttgttaaatgtatcaataatgctttcatttttattgctgagtagtagtccatggcatggagatgtatcacctgttgaaaaacatctgggggtatttctagtttttagctacaggttaaaaaactggggccaggggagtaaccgagtcgcaccagggaatacaggcagtcacatgtaaagaaagtgagtctcaactgaagagagacagacggaaagagaggagattcgtgctcagctgtggcgggggatccagggaagagcgctgagccaccttctgaagggaacatgtattgctgactgaaaacagacatgacgaggagggacatattaactgatttgagttgttatagtaacatctagataaaacatatattcaggggccagaagagaaatggaactgaacgcagatgagcgggaggaatgggggaaatgactggaagaatatctccatagacacagagcttactcattactgaagccatgagcaaggggctctccgggagtacacagacagagatgctgggggagaccacaattagggggtaagagaagtgacgacaaaagggaggagcctcggagaggcaggggcagcggggtgagggtggagtaaatggggtagggtggagtgaaccagaggagtgaatgaaggccaaggacaaagagacttagcactgacgaagcaacagggttgaagggaaaggagtgtatttgttatctatgctgcataacaaattaacccaaatcttagtggcttaaacaacattatattatttcacagttctgtgtgtcaggaatctgtaggtagcttggtggggtccttgggctcagggtcactcacaggctgcagtcacggtgtctgactgcaatcattccaagttttaatagggaagagtccatttccaag

SEQ ID NO: 36277 - DNA, 1537 bp, Bovine  19866880871157
ccccaggtaggagttattgtccctagtttacagggtgagatatatggaaattaactaacttggctaaagatgtgggcttagtgatgaggctgtgaagcctgtaatttttgattctgtgcctcatctcattagcccatctgcacctcggaactgataggcaccctacatgttctacaagtagtgcaagcctgggacaaaagggaagagtggtgggaataaaccaaatctccagacccttatccttgagatcctgttttaaagccactcattcctcctattagctgtgggctcacttgagtggctgagctaggtggttccagaattccagtgaaacagccagagggcagaagcttacccttggctggagtctcttggagacagctttgttgttgataaggcaactgccaggtttctcttcttccttctggctgggcacctgatctccacagagtcacttctttgtgttttcagttgcctaaggctgagtgtgtgttaattagaactcttccccacaactaaagattcacttaagctggcctgagcaaaataaggacactcagaagcatgctgtggacccccaagggtaaggacagactgcgttctcaggaataacctagtaccaggggctcagaccccacaaggaccctctctatctcactgcacttctgtctgtgtgaggtgcatgatctcctcagctgctccaggccgggacttaggaaatacatctgccaacagctgtgtttacatgacttaatcattcagagagacttaaagtcccagtgccaacttcctgggaatgtgattccaattcagtggtttaggtccgatagatgggaacatgatatatgaatgtgacctccaagagtcctagttctgtaaccacacgtacatggggtgatgatggtagaaacatattcctcacaaatgttggcgggggtagcagtcagggtggagtatgctccgggcagtcaacaaaacagatgttcacaaccagtgtatccatcacacagaatggcttaagaaaaatttgctctgggatcatctttttcttttttttcctgtctatttttcttataacctgcactaaaattaccaccctcagagattctgccttattacctctaggatagatctatatggtggacactgcagtttgcctttccaatatccattcttcccttcttctttacttacacaataattttgttcaaggagggcagtgcatctaactgaaaatactcatattctcagactctgtgcagcgatgacacccctagggcatggttttggccaaggagatgtaagtggaagtcagctagagatttctggaaatgtttttgtttttcctgaacacccagttttcctcttcctgcctagaattcaaacacacctcctgaagtacattcttcactgaaaaaaaaaaaaacatttattgagcacctgtgacccttgtattctaagttctgttccaagtgcttggtgtacatcagtgaacagggcagacagaagcccctgtcttcatggggcttaactctag

SEQ ID NO: 36278 - DNA, 4655 bp, Bovine  19866880933578
ctatacataaaataaataagcaacaaagatttaccatataacacaaagaattatacctattatcttgtaataaccttaatggaatataacctgcaaaaccctgaatcattatactatatacttgagactaacacaatattataaatcaacaatacttcagtttaaaaaatatataaaaagggaagaaagaaaatgcaaattaccaatattaggagtgaaagaaaggacatcactacagagcctataaacattataaggatggcaagaatattatgaatatctttgatattatgaataaacttgatgactaggtgacaaatttcttgaaagatacaaatttacataattgacataataaatagaaaatctaaatagtcatgcatctgttaaattgaattcatagttgacttcaaaaactccaagcccaaatgtctttaactgttgaatactatcatatgtttaaggaagaaataataacaatctggcacaaactttcagaaaatagaaaaagaaggaacactttccaagtcattttatcaggtcaccataacttgaatctaaaacaatacaaggccattacaagccaagttctgtcatatgcatagatgcaaaaatccttaagaaaatattagcaaattgaatccagcaataaatagaaaggataatattccatgatcaagtgagatttatcctaggaatgcaaatttatttaacacatgaaaatcagccagtgtcattcaccatattagtgatttaaagaagaaaattataatacttcaatagatgcagaaaaggcattttaacagtcagcaagactatctaaaattcttagaggggttacaggaatcacaaaccattgggtccaatattgtcctggagttctggagtgagattagactggacaggcaggccaagatcttacaggacagtactccacagtgtattgtatactaatttatgtttactgcttcctagggaaatagttatgaaagctgccaatagagagttttgcttcatttctctctcaaaatgtaatttattcctttgggtttgtttagacttcagaatcttttccttgagaatctaataagtcatacatctgactctaacattccaactctaaaggttagggaaatggaacagaatggggggtaaaagtcttggaaaaagactagttttatttgattagtcaaaccagtcagtcacaaatatttattattttagaaattaaaatttacaaataatttttttgagatggagtagtgttgtggttggagttttaaaattaaatatacttaataccattatacagtcttactgactttagtactttttaaattttgtaaataaaagctccaaagccatttgaccctgaaaaggagatcctagtactcctttactgcaaacaagataaatctgtttacacctgatagtttctgatgccaattctctaattcatgtgaaaatgatccttgttagaatggtcttgagactaaattctgatatggcccctttcatcttcagtttattttcctaagtgtagttatcttataaatattgggtctctcagggtggagtcttcttaactagatttctattaaacagacgacttctaatctgctaatctctcactgatacaagtgctttgcataaagtgggtgtagtgctcaaaagaatttatttatagcctgccagataggctttgtattgattttttttttttcaaaacacttcacaaagaaagaccattaaatcactttagcagccggcattacaccctatgaagtgctccaacatcagaccctcacatctccccaggtggcagacatggccaccgaaacctcttccaaacagagactgatcccaaaccgagaatttgtagattgcttagatgaacccagagagcaaatttgttttcctgaagcgcctaaactcctttttaaagcagaaatacaatgtctggaaaatcttaaaatttcatcacaaacatcactagcatttgatgtagtcagatggttttttgtttatttgtaaagtttctttatgagaaaattaaaaactcactatggacaacttggaagaaaagtgaaaggaaaaggaaaccattatccattgtcatgctatctaacatttacacatttttgagactttttttccacagagccaagtcccagacttcacagcctcatcatcatgtcagctgctccacccatacactattccagatatatcctatggcttcttagaattaaagataatggtattttcatgtgtgtttggcacacatgtgatggctttaaacccctacaaaatcatcattgtcaaacctagctacatattataatcttgtgtgcagcacttaaaaaatacagagattcttggcctggcctcagatcactgaatgcagaatcaatgggtttagcagggtctattgattttcatttaaaaagcaaaaagaaaactttcagtcttttgatttacagttaccttaggaaccactgccctaaaaaacattactggatttttgagagagggaaatactaataatccatagccctccatagtctaggcaaggctgaggtgatgggagggctgccctgggatgcagtgaagtctaactgatatcaggcatatctctgtaaaactcattctgccaagttcatccagacaggaaacttccagtctctttttaggaggctccagaagtgcatcccagcagatgacagtttgctgactatgttggctttccttggtttaatggtttttgttgttcagttgctcagtcgtgtttgactctttgcaaccccatgggctgcagcatgccatccttccctatccttctctatctccaggagttcgctcaaactctttgagttggtgatgccatccaaaccatctcatcctctcccaccctcttctccttttgcctccagtctttcccagcatcagggtcttttccagtttgcccagttttgctcagtgaggttttgttccttatcctgtatttttcaactgtgtctccatctcattaaagatgatggagctctgtaagattacctaaacctgagagaatactggagtgagtagccattcccttctccagaggatcttcccgacccagggatcaaacccaggtctcccgcattgcaggctgattctttatggtctgagccaccagggaagtctaagagaatactagggtaacaggaagggatcttttcccataaatattctaattttacagacaagagaataaaggtatataggaaaataaagtagctcaaagtttacatggcgagtaagtaactgaccctaggattcctaacattgcacaaagtaaatcttccaggttggtagccaaagtacggtttgtttgtttgtaataaacttcattacagaacagtttcagatttatagaaaatttctgaagctagttcaaagagtttccatataacccatgtttcttttcccatattagtaacatcttactttagtacagcacgtttgctgcaacatgttagtatatgattattaactaaagtccatgccgcctgcagtgcaggagaccctgggttctctccctgggccgggaagatttcctggagaaggaaatggcaacccacttagtattcttacctgggaaatcccatggacagaggagcttggcaggctccagacactgaggtcgcaaaagaatcaaacttgagttagcaaccaaacaacaacaatgtgctttattcagattttgttagtttttgcctaatgtcttttttcttttctggggctccatccaaggtaccacatttcatttagctgtcatctctccttaggctcctctgatctgacgctttctctgacttttcttattgttttttgtttgttttattggaacatagttgatttgccatattgtattagtttcaggtatagagcaaagtgattcaactatacttatatgtgatatataggattattttccattatagcttattactgactttccttgtttttgatgacctggacaattttggggaaatgccctttaactgcgacttgtctatttttctcatgattagactgggattgtgggttttggggacgaagacgtaagtgccagtttcctcacttcacatcttacttgtatagtatccgcgtcacttatctctgttgatgttaaccttgatcacttggctgaggaagcgtttgtcaggtttctctgacataaagttcctcttttttcccctttccacactgtcctctttggaaggaagtcactgtggacaggccacacttaaggaacagggagttagattccacctccttaagagcagagtatgtacctatgttatttggaattaattcagtgtttccctgttcaaaatcctgcagtggcttcatgccacatgtggaatgggatggaaactccaccccctgatgaaaaggccctttgtgatctggctctcccagtttatctcccacccttgcttcacggctaactcccctccatcggtactgactgaacacacccatctggagcactgtgggccttcacccttctctctgcccagcaagcccgagccaccaacccccacaccttcagctggcggcttcctcggttcactgagtcttttaaaactacctaatttaaaaagtct

SEQ ID NO: 36279 - DNA, 896 bp, Bovine  19866881133017
atcttgccttgcctttattcctttgttcataacacttagggtctgggctgttctctaagtggttgtgatcttaaagctaagaccccctggtttcaaaatttgtccaaataacatgtgtagcagctgctatgagagaactcagataacacaaccagttatctaaattttctccaagagtaatccacacattaacacagaaatggtaataaacctgatgacttttctgatacagttcaaaaatcaatagctctactagcactcaacattgagtcaattattctaataagtgtaactctaaattctagattcaaagacaactcacctacaactgaaacctaagaggatatccaagctagggaaattcttggatgtctacttttgctctggcatatcactacatcagtccttataaagtaaccagcatgagctggcttaaaatctgtcctgccatatatggctcaatttaccaatactggggtaaaaatgattttgcctcttcaaaaagactgttgaaaaagaagctacagataattagcaagactaggtaataaaatgtatctctaagtggaaaattcatcccagggaagctgcagcaacaaagatgttattctctaaaaaaacagtttggggtaaactataaagcagaaaccaagcaggagatgagggcaaagactagcagactaaatttagtctttgctagtagaaatgaaaagcattcttttcctagtaaggagtgagctgttaaagccaatttaagtcctcaaattttagaagagagtattaaagaggtaaataacataatagcatcctaagaagggttacaggtagccaagagctgaaaataaacccaggtaaaaacctaaaagttgtccaatgtgatggcgactagccacatg

SEQ ID NO: 36280 - DNA, 693 bp, Bovine  19866881231099
cccgcatcccccggctcctcaccccagtcacccaggcaacgtaactcaaggggtcagcagttcaagcaaagtggggaggggtcgctaaagcacaaccctccttgggcaggtgactgccaggccctcacacacctggacccggggtcctgctgtggcaacttaccttcttgagtttcttggttttgacctccacctcttgctgcagggatgtgtaggtgccccggagctccatggtctcctcatcccggagcatcatctcttgctgcatttcccgctcacggcgtttctaggccagggcaggggacagggctcagaggagcagcacatactggcaagacccaagggagctctgcctgtcatggaacctggctccgtcgtggccacaggagccaggaggacacagagagtttctcacagcccaggtccatcactcccaccccatcctcagtggaggcctctctgaaccttcttctcagctcacagggccgtgcttttgcaggcactgccccatgtggaaggagaccccgcccctaaccactggggcttccaggggtgtcgaccacatccactgatgcccaggtactggcttttcagctgtctcagcctctcctgtgtagtatcacagctgatgggcaagaccaacaaactgtggttcttgatgctttcggaaacagccctacagttgttgaagaa

SEQ ID NO: 36281 - DNA, 2403 bp, Bovine  19866881234519
atcaggagggaggaagccaggccagggcttcagcagtgagaggcgatgaggcggtggagaccaaggggcgaaagcagtccccctgagcaaccactgggggactgccctcctgtgtgtctgatgagcagagagaaagcgtgttgaccaggaagggaagggacgcgccatgaattgccaccacctggggcctttcaccttcactctcactggtctttaccccaggcctacaaaggagggtgttatcccttgtacattgtgtgagagcttgctctagagaaagttccaagccaggtgggaaagagagaggctggtggctacttgattgtttccatttcctctgggatccaggaaggcagaaatttctctcctggaagagcttggaaaagggacaggacagcctctgcaaggtctctgagctttaagtgtggtctttgggatggaaatttcgttcaggacttggggctattcctctgtggtcggtgggaggggctttgctttttaactacttgttatgtgggagtctgtgcttttgctctcctttagccctggggccagaagctagatataatgccttttacacttgaagggcttccagaaatttggtgatccttaaactgtacttaaagaacatttatggaggcctgccctcagttgcaattaaaaaaaaaaaggcagtcttttcttaactcacagggaaaagtaagataatagatacattttctcaatcttaaaattgccactaaaatttatttaaaaaaattttttttggctgcaccacgtggcatgtgtgatcttagttcccgaccagggattgaaaccgtgtcccctgtggtggaagcacagagtcgtaacccctggaccaccagggaagtccccccaactaaaactcagggtgagggatccggcacctcaggcagagcatcgccaagaaacatagactaattctgcctggggtcacctttgcatcagcaagaggtggcttttggcttttaaaggatgaacttgaatttagggaaaggggaggaaaggcgaggtagaaagagacttacagtatgtgcagaagttcagaggaacaagactgtgtggtcttttcgggaatggaggtccatggtggtggatgaagaagcacaggatgcaggctcagagcagcaggagggtggctggggagctgggcttgtgtgaaggctgtggggcttcacctgaccccactctgcccctggtccacatgcctcacctgtagagccttctaccctcaaaatatccccctcggcttaatttccttttcccatgacctccctgatcactccacactgtgaggtctgctctttaccatctgagtttacctgccaccttaagctttaaaaaaaaaaacaactaagaagacttagaatatctcaaaataaatgaaatttaaaataattggatgagaaaaatggggcatttccaacccctctgccgaggcagaagtgggggttcctgcctgagctgggatgctcgtgtctgtctgtcccatctcctattctctgcacctctgtactcatccttgtaaggattaaattctgccttaatcgtgaccaggccctgcaacagagccagcaacaactctccgttgtctccctatcatgtcagaaatcctctggctgtttctcaagactttgaccctcactgtgacctccacaatggctccaccccccgaaccctgccactaccattctctaatagaacagtccctgtgagagaccgggtctcccctttctacttccttcctgcttttgtttctgctatactttcccctcttcattcttcagggttgagtccgagagctgttgcctcctccaagaagatctctggattctctctagtccacactgccctcttcccttctctgcactcctgtagtccttaccgttaatattgtggggtttagcagtcagttatatttcatagagtatttttcactaactcttacatgtcttcaccagttatgccaaacctgataattgggcagggagaacaggctctgtgaatagctgttggttggctaagcagttgggaggtgggtaaatatgagacaacttcttggggagctcgggcccaggccattggtttctgggggtgctgacaagtgtacctggagaatagtgtggggctgggggactgagggcaggctcccatgggtaaggcggtgcctgagtcttctccatcccacattcctgctgtccccactgggtcgccactgttcttgagccaaggagaacttaccttggcctggcagaactagcccagggcggggtgtggggaggagagacgagaggcaccttcccccagaggagggcagttccagactcttctttctgttttcagaacagcgtggccctgaaggagcactttaggcttaggaag

SEQ ID NO: 36282 - DNA, 691 bp, Bovine  19866881272765
cactttacatgtgaagaatcttagcccagagaggttaaggaagttgcccaagttacacagctagtcagtggcagagctggaatccaaactaggtccacctgactgctaagcctggattttaaccaccttctcatatagaacagggactcaacaaagagtggaagtgctggatcagggtaccccccacctcatcatacaagttttacttacttacccagaagcagcatttgaatttgactcactgaactttaaaatatctttgataggttctgcctgacccatcattgaattcatgtctgcattaaggactctgctctcttggaatcctgtcgtcttttggtttctaatacacaatctcagtgtttggtattcatttataaggatttttccctccgtgaggtcccggatcgttttgctgagaactagctttgaaatcctatgatgagaactaatgggacaccattttcaaatagacctgggcaaactaggagaaacaaacagaaagagggtaattctagtcttggaatttatgagcttccctatctaaaagtttaaatttcaactcgcttttgatctttgggtttatggtgagttttaagaggttgttcgtcttagacagtctcaggaacttaatatgctttcttccttccacccagaaagatacctagacacctgcctccacccttttcag

SEQ ID NO: 36283 - DNA, 709 bp, Bovine  19866881281147
tacctatcctcaacgaggaaaaagctgggagagattacagaacgactgtggagagtgggaatccaaggcttctagaataaagacagaactcagggacctgagaatggggtacagaggcagatattcatggtagaagcatggtgttgagagctgcaggagcaccttagaaaccatttccagcatctttattttccacatgaggaaactgagtctcaaagagacaaagttgcttcagtagtcttgctccagtccccatgcgcccccatcctcccacccccagagcatctttgccacaccccacaccacgcagtctggcctcccctccagtaattgagctctcttgactgggagtagccaaaggggctctttccagaccctcctgtgtgcctgactcactccatgggccagaaaccacagccctggcttttctgttgttcctttgggtttgggcctccaaccctgcccaggtcctttttctgccctggctgtgctctgagtcctggggccagcatgatataatgcctggcacacagtaggccatcaggtttgacataggcgcgaccaaatggttggagaagccctatccccgaggcagggaccccaggcacaaggtgaggcctctgagccactcctgtaactctgccgacagtccctttgttcttccctctccacaggcaaagaacagaaggagaccaacatcgaatccatg

SEQ ID NO: 36284 - DNA, 1273 bp, Bovine  19866881385413
acacatatatgttcaaagtaatataattaagatgatttccatgctcctcaaatgcctggaggtcaaaacagataaaacaggatggggcaaatgtggtttaatgagtttttctacctgtagatacagctgactgtagaacattaggtaacaggctggagagaatagggggagagagaggggctactttgtttctagtgttaaaactgtcttccaaagttccttaaattcagttcaaaaatttctgcaccttaactccgcttacccaacaaaacaccctatcactgacacttctctgttaattttctactagtatttcaaacttgtttgtaagctcccatgaatgactgaatcctcagagattattgctggaatcactgccctgcacaggggatggtgacctgaggggtctagtgaggcaactctctcttcagggcaagaagtgggagtagggaatggcagggcctcacagaccgcaagcagaatgcctggcaacaggactgggctgtggaaaccaagaaccaacgcagaactttcagagtcagaaacactaactatgaaattaatgccttatcaaaaataacaactggagcaggttccaccctaggtaaagggagtgagtaaaccctcaatctaaattctgcaaaggcttaagaatctatatgtaaagcctgcagtcagactgtcaagacataatcaacatgaacagtcatttcctcagaccattcctccactccttccttttcctagcctcttaggaaagggcagaagggaaatcactgccttttaccaggtgtggcattaaacttttcagtcacatgaagtggaacagcaatctgaagtcaaagtaatacatcattacctaaacacctggaaaaatgttaaaacaagatgtgacatatttacatgattttgtaagtgcaaacttgtcacaaattcacaaagtcttgcttgacttggacttactatacaaggtgctctttttctaaaatgtaagatctgtactctgtgttcctgattaagcaacacttgtctcttaagacaactgaaactgaaacctagtttatttctatgattccaaaagaacggcaaaaaccacatctgtcaacccttccccattcctgtctcctttacagagagctctcctttctgatctcattaccgaacaacaaggcaggagacacagagtttggaggggccaatgcaattcgtcgtggcagaaggctccgcagcccttgcacatgatcatggctttcaacccggcagtaacactttg

SEQ ID NO: 36285 - DNA, 1375 bp, Bovine  19866881455696
aaaaacattgcttttcctttttctttccataatctgaccctgtgtacgcagctacccactaaaattggatataattaacaattaccaataataaccctagcataaataactgaagcttataatcttcgtaaatgccacccactggactttgaaatgctagaagctgaacagtccacagagcagctggttcttgtcaaaaggaaagccagaagcagtgccagaaaatacaccttttgttttcagtgtcaacaagctatttgtcaggaaacaaaaggaaggctccgccagccctggtggatgtttctgaacctgaaagttggttttctgcctgattttgcttagagttagagaaaaaagcggttgcaaaagtatattaaaacctcactcctgggaactgttaggaggaaaggctgtctgagagaatgaaagccgtcacccaacacccaccccgccacacacacaccaaccagcaccacttaacttcctccagggcctcagtttccaaccgcctaagtctgcataagaatcaggcagagcaggtcccagacgaatgcacccaggctgaggtggagctgaggatgctgaaagttcccaagtgtagcacacaattcagaggcaggaagccaagtacccagggtctgaaaactacagccttgtttaggttttgttttttatttcttagaatggacttgtggacatgggatggggagctgggggagggggacgaattgagagagcagcagtgacatgtctcagttcagttcagttcagtcgctcagtcgtgtccgaccttttgtgaccccatggaccacagcacaccaggcctccctgtccaacaccaacccccggagttcactcagactcaagtccattgagtcggtgatgccatccagccatctcatcctctgtcttccccttctcctctcaccttcaatctttcccagcctcggggtcttttcaaatgagtcaggtcttcgcatcaggtagccaaagtattggagtttcaacttgacatgtatacacatataaaatagatagctacagaagaatataataaagctcctttctaatgtacttgtgctggagaacacttgaataaatggactgtttttgtgcaaaaagaagaaaaaaatagctagctagtgggaagctgctataaagcacagggagctcagctctgtgttttgaggagacagcctttctcttacatctgtatcttcaacctcacacctttgttctctctggtccactctgctccatgttggactccactctcttattttcaacccatccaacaagtcataaatttaaaaattcaaagcaaatatttagggacaatctagaattagaaagcaagctcgcacataccagaaat

SEQ ID NO: 36286 - DNA, 1436 bp, Bovine  19866881732079
tgtagaagcagtggctcatggaagagaaggtgaccagccaggatgactgcagtcttatgagtgagaacaggcagaagctgctagggatgaaggagaggacactgcaagacctatggcaggagcagaaggccatggaaccgcttgcagtcaagtacaagaccatggagagtgagcttctccattgaggcaagaacatcaagaatcacaccaaagagaagtagaagacattgaaactgaagagtgatgagactgcagagcagaaataccatgaacaggaaatacagcaggaggtgatgatctgagatgaggaggcaatgtagtttcaggctatatacacatccatgcagcaggacatagaagtcaaacccaggaaactcatgaagttccaagtcaaacagcaggttgtgaaggcagagacctggggccagcatgatgagtatatccacatgtagcagaacctgaagaaggcaaagaatgaggagacctaggaactcaggttaaagtatgtaatcactgagagcttcatcccacttgaggagaacaagattataaacctgcttttcctggactatgaagaaaagcaatagaagggccagccagttgtgccaggtggatttaataacagccaaaagaagcatcccatgtttgcagtgggctacacgaggtctatcagccagtactcttggagtgccttgccaccccagctacatggctgaaagtatgggttgacctttttggagctggatatatcccctccagctgtgtttatgttggaattctctcatggtcaagaacaagaccccccatgcactacatatggaaaggctcatgcagttaagacagatttctggaaagaacatctacctgtaaagtctgaaagtccagatcctggtcccagagtcctcagtggcctccaggtgccagcatacataccccagtggccttttctatgctgcacaccatgacaattgtggaccaaaatgacaatcttcagtcaggctacccatctgacagactcctgggatgatgcagctaagcctagggaatctgtcctgaaagcacaactggcagtgaccacgtctcctccgagctgactgatccattgaccagcaggccagacactaagttctacctgcaggggtctgccggctttgccctcagtgtgctcttgaaacaaaaggaaactccagaatcttaagttcagagtgttaggtagttagaatagggaaaaggagtccaaaatggtggtggctaacagacaaagaagggaaaagcctctgaaaatagaacaaaggaaggtccgaagactggaatgaggacctctggtaaaacaaacagcactcctggctagtccagtttacaaagggtaggcccagtgggaggagaaaaagcatatataaagaggagccaaaattgtgccggagcctctcttctct

SEQ ID NO: 36287 - DNA, 1439 bp, Bovine  19866881923912
gagctcctgtgttctgtatgaggtgagtgcctccttggtttcccctccaggaggaacgaccctgcagcagggctgtccacgcccaccttaatgccggtctgtctgtcgtctctctgtcctagggctcccggggccggctgcggggtggcctgggctgggagtccagcctccgccagcggcccatgccgcggctcaccttccaggcgggggacccctactacatcagcaagcgcaagcgggacgagtggctggcacgctggaaaagggaggtgaggtgccttctctggcctgggccccagcctgtcccacagaaccgggaaacctggaagttagcttcagccaccgtctgtggctgttgtcaggccctggctgagcctcagtttccccttccccttcaggttaacctctcactcttacagggaactgctggctccctaggcagtgactgcgcgtcctttgttatttccacaaatgttactggactctcagcgtgtaagcaggcagtgtctaggcctcatgcacgtataattcctaccctcatggagctgacattgtgatgggggacatggacagaaaacaagttagagctcttattagagttgaaatagagagtaacaaaggcctgctttaggtggggtggtgtggagaggcttcttggagaaggcggtattgaagttgagaccggaaggaataaaagagctggctctgtgagttgtggggtgggggagaatattctaggcagaggaaacagcacaagcgaggccctgacttgtttggttgtgtaaaagaccggtcttctcagagtgaaccaagcaggggagagagtggggccagacgagaggtggcgaggggaggtaagcagaggccgatcctacagagccttgagatctgggccggaagctggtttaacgctgagtatcctgagaagcccctgaaggtttctatgcagaggagtgatttgatgtagattaaaggagcagcaaaggtgaaggagagggacagatctgggcttgctaaccaatgggaaggatgtggaaggggggaggatggacacggcccacaggggtaatgcgtgtgctgctgcctcaggtgggaagactagaggaggaatgggtttggggtgggagggaagcaagtgtttagtctgagatactaaggtgcccggatcccagagcagagggaggtccaggctgtagatgcaaaggtgggaaggcatagagccacaaacactgatgagctcacctaggagactggagagaaccgagatgcatcccgggctcggtccacagaaaccctgcagttatggccacatgaggtaggggcagtggcagcagcggtattgagaaggggcctgggaggaagagcctgggagaaaggagagaaacttttccagaggcaggggccaccctgccccatggaggctgaattaaacaggctgt

SEQ ID NO: 36288 - DNA, 2263 bp, Bovine  19866880404613
ttcagctaacaagtgaatctgccacagctccacagatgctgggagtgtggaatcttagccactagaccacgagggaagtccttgtttttaattttaatagttgtaggaggcaccaggcattttatattcaatgttgctgctgctgctgctgctgctaagtcgcttcagtcgtgtccgactctatgcgaccccatagatggtggcccaccaggctcccatgtccctgggattctccaggcaagaacactggagtgggttgccatttccttctccagtgcatgaaagtgaaaagtgaaagggaagtcgctcagtcgtgtccgactcttcgcgaccccatggtctgcagcccaccaggctcctccatccatgggattttccaggcaagagtactggggtggggtgccattgccttctccatattcaatgttagtggttgtcaaacagtggtccccaaccagaagtttgttagaaatgcaagttctcagtccttacctcagaactactacagcagaatttctgggaatgagaaaagagactgacatctgaaatttaataattccatctgtgaatctgacatgagctaaagtttgacagctactgggctaagatgtgtatgtgataaataaaggagataaatggcatttatttatctactctgataagttatgtgatgttcttgcaacttaattggtcaactggtactaaagtgtttttcaaaatgaaaaagaaggatcgaagttatcattacagtcacattcaaatcatttgttccagctcagctccaactttgcagaaatataaaagcctaagttatacattaaccctgtataaattcaaaaggtttactttgggggaaatttggaggaattttaaatttcaaaaaaaaattattaacattgatttgggttcaaagattcctatacatatactatttttttaaatacattgagtagttgtaatgaattagcatcaactggtttcctgtctaatgtatatttttacatatatatcaaatttctcagaaaactataaagaaatgtatgctttttttttcaattaaattcacagtgggtgattctaaatttgacctttttaatgactctataaattttgtatattgaattatcttgtatttattgtaatcgttttcctttcactcttgtctttagaaaattaattttttcagaagctaatctcaaacacagttgctggcaagattctttctttggttcagtagtttgctagctcaaaatattaacaaaaagcctagggagttcttcttaatctaaaacaaaacaaacaaaaaaagtgctatggaaaaaatagactgttatgctttgatagttgctatggatactaagctccttcacagttttgaactgtgtgtaggagcaaaaatacttgctatttgattaacttgtgattttattcagaattgctgcaattcatgtgccatatatgtcctatctcagattaatgtcagtcacagataagacaactttgaaaagaaaactctccctctctgtttcacaatttatttggaagaatgattagaaacacatcaagaatatatgaaactttaaataataattcccgttcatgaaaacttgcatagccagcatcgtttttccctactattttgaagtggaaaacaaagaataaggttaaagaaatcttacaatatcctttagtaaaacagtttggatacaatagtttaagtaagaattgtaaataacagcattcttagcagaattatttatagtacacaattttacctttaagaagtttcatttgtgtttcatctttcaatcatattgccattgagatatttgcaattttctcttttcaatttcagacaacatcttttttatccttcatttatttaaaaaatacaatcaaatgtgcagagttatatttaacaacaatagaacgttctgagtttcgactattttaaccacctaatgacagacataaatgagtcattacgttgatgtctgacagcactgttttctattgcttctgagattgtcctgtcttatattagaaacatttaatttccatgacagagagacacgtatcacctaatagatttcaatctttaaaaacagattgataaccaacttaactctcctcctccatctctgctccatgctaactatagattacagaatagctcacagctgcccattaaacgcttataatggtccttccttccttagtcactttagttatcacctccatcattttcaacctcttttttctc

SEQ ID NO: 36289 - DNA, 1063 bp, Bovine  19866880413191
agagggtattctggcccctcttgttagaaaaggagttccaaactaattctgatgccaactgtgaatgtaataaatgatcaccttgagacattagcattggcacagctgtttatagtttaccaagctatagggaaaccataaacttttctttctaaattcagacttttaaaattttcccccaaagtctaatagcatcatttctgttgctttataataaaaatccttttacttaactcctttttagcttctcaatataaattccattcttattctggtattattgttgtgttaaatcggatccagagtattctcagggtaggcatgcactgattaataatcaacatttttgtttcttgtaggtttacaaaaaaccttgcaacattctcactaaattgaggtagtcaagcctagggattggaggctgatgcccaaggcactctcagatgggctcctctgaatatattgttagtaatgcgtgggttgtctctgggaataaagctggtgttatcagtttaacatgtttgagattgttccatgattttcaaatgtgcccaaagtgtaaaagccttgcctgttaaaaacctaactcacgacttcttttttccattcccccatttaactatggatgtagaatcactgacttttaaagatcaacctctgcgtggaaatgcatttgtaataactataatttcttgctctggactttgagttccctgggatctgaaagtagcatctgctgaaggttaacgcaggaagtaggattccatattttgaatgctctaagatacagtctacagtgataaaaatgggtctgctttatagaattcaaatgaatttcgatcttagtgcttcttgactgaaaatgaaaaaaattgcctctgtgagtgtctagaaatgtatttgtcatcatgaaccagtggtcaagcctatcctgggatttatatggaaattgccttgagccaattcctggggaattagggaatagccctctgactatgatgcatagtttaatatgaggctatttacttgggcctctagcaagcaaggatgctaaagaaacacg

SEQ ID NO: 36290 - DNA, 874 bp, Bovine  19866880586334
ttattagagcttcagcttcagcatcagtccttccaatgaatattcaggactgatttcctttaggatggactggcttgatcttcttgcggtccaagagactctcaagagccttctccagcaccaccgttcaaaaacgtcaattcttcagcactcagccttctttatgtcacctctcacatccaaacatgactattgtaaaaaccatagtgttaactatacagacctttgtgggtcaagtaatgtttctgctttttaaaatgctgtctaggtttgtcatagcttttcttccagggagcaagcgtcttttaatttcatggctgcagtcaccatctgcagtgattttggagtctaaaacataaagtctatcactgtttccattttttccccaccttttcattcccagtttgacttcttctgaagctaggattgctgatgctctccaaagcagagagacctgcaaaactctgtctttattgtgtttcccttttgcttgaatttttacgttcaagatgttctttgaaaagagatctttcctaaagtaagcaagaattctagtaatgctccaggcagacttttttttgttgttgttgtttgtttcagcttactactgacccatgtcccttgataacgaagttcttttttacccataactttaattgctttcatcactggttctttggcctgatttgtcccattttcttagatgattggccccccaaactagaattctgagagcaggaggctggttctattattcactctcttctaagccagagctgagggtggcccacagatgtggttatcttatgacaattcaggtggacaaggctttattagaagagggttttattagagcctaagctgagattcagat

SEQ ID NO: 36291 - DNA, 1630 bp, Bovine  19866880717893
attgttcagcattaggaactttaccaactttaagctgtgataaaatcatgcttgtgtttcctcaaatagaaatgttcttagtctttagacaatgacagagattcggatttgcagataaacaagggaagtaaggtttctcggcgccttggtgactgcactgcatttgccttggagttgccaagttgtttaaggtgagtgtcctaggtaatcggtgcttcactaaaggcatttgtcccctcagtcaagacacttcatttctgctgacgttactcatgggtaaatgctttaatctgttatcagctcttggcgaatattgttccacttaaattgcacttattcgtataagtaatggatttggtggcttggcatattagctattaagcaagaatctgcaatttctaataaaagaaggtaaagggcagttaattacagattaaataatctagcagcaaatcactttacgtggaatttgggatttctgtgttaaaaatggaacttagtgttatacagaaagagtcattctcaaggtgattgggttttttttaatatacaatttttttcctctcaaaggtcacagatcttcatttattctttctttatccctgcaggcaaatccctgatccaggctttagtcatctctatcctagattactttagaaccttctgtactacaaaactagcactggctctcaggatttttttttttttaatcatatttaaatgctgcctgtttattttcttttttccattaaatgcattattcaactttaaaacccatgtcccttttccatgacaaatgctacttaaatctgcttgttcacactaatgttatttttctaaaaagtgaacaagaattttaatctacccataaaatgttcgatttttttttcctataccatcttttcacccaaaataaaatagcatttggaaaactggagaacacatagattcactcatctgtctgttaatttatccactcaatacatctttattaagtggtcactaagcttctgcacagtgttacaggaaggaaaagtagaatgctgaacaagacagacatgaatcctgttctcagggaaagtaccatttcctcgggaagaacagcttcacaaatcactgcaagtgtattgagtgtgtaacagaaagtgttatgggtgttttgggaggatatcacagacaagcctaaccttctttaaggtctctgccttgtcatctaatgtgcatgagtcaggatgaattatttacactttctaatgtttaattttctaatccataaatgagattaatgttttacagtgtcctaatgagaagtaagtcatatatcctgtgaaaccacccatctatgacttgatagatggtaataaaaataactaacattgattaagtgagcactatatatctggcatagttttatatgtattgagtcatttaatccacaaaacaaccctctgagtttgggttacatactgtccttttccccttctataaatctacaaatttacagatgagcgaacttggacacagagagttaaggtgtttatctgagtcctcagatagaggcaagtggcggacgtgggaatcatcagtaggcagcccaactcccacccatgctgacaatccccgctgtctg

SEQ ID NO: 36292 - DNA, 1256 bp, Bovine  19866880740798
ttttcttccctttctcattgcacatactgtgaattctcctttgctttcacagctatttcagtcaccatgtaggtgtccagacatccatcagccacactcaccaacaactaggattccctaagtatccttttattgactccatttccagatgggcttgaccagacagatgagggcattcttgcttcatgggaagttgaggctgttatgggtgccaagacagccaggcaataagaaccaaggagtgtgatgaacgggtaggcaacctggcacctggtgtccatgtcaagtatttctttcatgggacatatggaacacagccagttggtttttcctcttacttttctcagagtgtttttatttatcaggtgttttaatttcactaagcaggcaagagagtcaggttttggaatgtttatctcttttttcctgattatatgccaattacctactgactgccagagaatcaatcaacgactaagtaaacattggcagggatgaacacgggttgggtacactcacctctaccaacctagagaggacgctgatggtgttatctaactcacaaatatgtgattatattcttgctattttgatctatttgcttggcacactccatgtgatgattaacatttatggtttccttgccaaaaagtacaatgcgtgtttggatacatgatctcaactgcagagtcatttacaatttatttctgtatgctatatcatagagctaatcacttctaggaacttagtgccaggaatgaaaaaggcgtaatggagctttatccacagctgtttaggaatcaaggattatgtctccatgagggatgtttttagaaagggaaatatggctcctttttcactactttttccttatttcaagtttaatgcatgtatatcttaaaattgtgacttataggagaaaattaaatgaatgaaattaagatattatctattttaacattctgccagaaattttgccctcttaattcacaatctttcttactataccatatctgttgcctcaaaaagattcatatgaacttaggaattcatatgcatgggatgcatgggatgtatgaaaaattattttctgcaacttggtaatttaaggggccataaacagcaaaaccatcttgaagactaaagatgaaagatatcctctaattgatattaaggaatgctgtggagtgacagggcttcccaggtggctcagtggtaaagaatcctcttgccagtgcaggagatgagggttcgat

SEQ ID NO: 36293 - DNA, 1132 bp, Bovine  19866880742693
atgatgaagcccgtctgcgcccctgaggcctggctccccatcctgtgtcatttgattcagagcctgcaggttgccgtgtgtgctcctggcagcccgccgaccctgcggtactgtctaagttaggcagcgtccctgcacagcaactcatcctgcttccggtcccagctgctgttgccttggctccttttgcgagccttggcagtcacagccccgaactatttttatataccatgccatttttcatgcatttgtttttgagaaaaagtgcatacctagtgctgaagtgtgatctggccgataaatcatacagaatacatgtgggaacttggctggtgggcccttggaagggtactaagcagccaaggaactaacagaataagcgtttggttgggattcaattaactttctaggcacagagcgaatcttctgataatctggaaataatgggctaagagtgacaagaagaagaaagggggaagaggtggaaggtcagaaggggcaaatgtcagtacaggagggagagtaaggccatgtgattctccttcatggttctcaacagtcttatcttctgggtgggggtgcctggatgtgaactccatccgcccttggtcctgaggtcaaggtcacagtctgagcttcaactaaggaaggcagttttcctgaacaaaggctgttctaaaaatatgagatcacactccagtaagttactagtagtatgtatgtatgcacgtgtgtgtgtgatataagagattagaaaatatgtcactttagcattctataatgacaatattcaggaagaataaaggagaaataaacatttctcaaataaaggaggaaatgtttatttctcctttattcgagcaaataaaacctgggaagtttcatctcagcagacatcacaggcaagttggaaatcaatgggctaaggagaattctttcatgaaggccagccaaggacattcagagaaagtggaaaaaggaaatagtaaaatagaaatataaactgtgaataaatattataagagagatgaatggcaagtcaactctggcctctgaaaatttaataaaagagaaaaaaatttaatagtaatcataaagaaaaaaagaaatttaaagtcatcaaaactaaata

SEQ ID NO: 36294 - DNA, 3304 bp, Bovine  19866880754584
gtttttcctgtggtctgtatggatgtgagagttggactatgaagaaagctgagcactgaagaactgatgcttttgaactgtggtgttagaggagactcttgagagtcccttggactgcaaggagatccaaccagtccattctgaaggagatgagccctgggatttctttggaaggaatgatgctaaagctgaaactccagtactttggctacctcatgcgaagagttgactcattggaaaagactctgatgctgggagggattgggggcaggaggagaaggggacgacagaggatgagatggctggatggcatcactgactcaatggacatgagtctgagtgaactccgggagttggtgatggacagggaggcctggcgtgctgcgattcatggggtcacaaagagtcggacacgactgagcgactgaactgaactgaactgatctgatgcaatataaacgaggtgatttccctggtggttcagactttaaagaatctgtttgcaatgcaggagacctaggttcaatccctgggtcagaaagagccccaggagaagggaacggcaatccactccagtattcttgcctggaaaatgtcatggacagaagagcctgatgggcttcagtccatggagtcccaaagagtcagacatgactaagaaactaacactttcactttcatagttacttttaagacacagagattcttatttattgaactgaaaggaaagggggccagcatatcaacagagagatgattttttcctccaatctggaatagtcaagtaattgaaacagataatataaatgatttaatgggttgagttaaatgttctctagtaataaaggcaatttttacatctgttgattcttgtcattacagaatggaaagagagtctgggaaacctggtgtctcaaagaatctgaagtggattgaattttaaatcctactcctcttcctactccattgccttaatgttgtttgggttggggtgtgattttagagcagcaacttatcaaaaatattgcattagacctcaatcatcttttcctttctagtgacttattccataaactcttaaatcacctgaaaaaatgtgaatcttgacatccttctgatacaattctcccaaatattaataataaaacaggtggtggtgggagagtgcaagaactgccattataaatccagccaggtgggaaaggatgccatgattgactgcctggcacccaagtggatcttttgggattgccatcgtgtgcaaggtgaagcgatttctcaagacttcctaacatttatccccatagatcagcatgtgagccatcaatcctgcgaaggttaaaagggacattactcaaaaactggcatggagaggcagcgtttcaagaggctgttatgtcattgggtttaaagctttaaaggggagaggagatagttattttaaagttgataccaattgcttcccctgtcattccccccaatggttttataattgtggatccaaattcatctgctggattctctttttcatttcccaatttttacaaatgattctataatgagtccacgtaagtacaagtctttttgttgttgtttagaggttcttatagaattatatccctgtttgaaatggaaataacaagtcttcaacttcttatatgcatttggttatttctgatcaaactaaaatcacaaaaatgtctgcacgtaatctacagcagatgttcttcttatccaggaataaattacagcggctactaggcagaaaattgttttgttgtgctgtttccccaagaaaggtccttaatggagaacagcagcaccttttgggtcctttggatccagagttcttttttgatctttagcctttttactgaatcagtggacgtgagtttgagcaaactccgggagatggtgaacgacagggtagcccagcacactgctgtccatggggtctcgaagagtcggacatgactttgcagctgaacaacattatgctgtacagtttaaacagacaaaggcttcattaataaatattctttgtgtcatcaggatcgagtacgtgtctataaacggtgtactcaggttttctgagagtctccctcttgaaatcaaatctctgctgttctccctgcttcttgaaatgtcactttgcttgaggctcttcctctgtttagaatgcaaataccctgactatgctaatactttactccttacctagtcttaatgtgcaagactttaaggtgaattaacctatcagatcatctaaaacacattttaataagagagaggtgaatagcacagggtgggctgtggagtgagggacaacttgattttgaaaaacaaggtgggggtgggggacagagccaaagataacctctggtatttgattatttttcttgggattagccctgcatgaaagtaaatgccctgctttactctgtagtttatcctttctttgcagacaatttacaggatgctatgaatgaatgaatgaatgagtgagtgaatgaatgaaattgccttgacaggcaccagttaagaagttaaggattaccctgatagcattctgattttttttttttcttggaatgaaaacagaagatttctcttacaatatcagctcctctttgacataacaagtctagaaagataggaactgtttcctatgggaagcatttccaaagatgaagtcaggctgaaccttctatttttctatttatgttttttacagttgtttttatttccacctattgcagtaactgcattgtatagtagcagacttgtctctcttgtctctttaggcttctcttgcttattttggtttatacacgagtctgaatttcctcttctgtacccctgggtgtgtgagcaacagtggaatgtttagctttatttccagactattatttgtaccttaaactaaattgatgcccaatttgccacaattggaatacaaaggtaagactttcaactgctattatctgaactacaaagaatcagaagcacacttgattaggattttttagccaagttttaattttcaaagtgaggattctcccacccctcacactttaagttttatctagaggattgccaattttgggtaaggactagaaattgcagaacttacaaagatgtagacaaatatttagaactataaagttctgaaaaccgttaaagctatgaagatgaactacagaacttagacattgctgcaggtggttaggaggcctttaagagacatcacagatataagttctctcctgaatcattcaagaaaaatagctcactaatatgaaaa

SEQ ID NO: 36295 - DNA, 1996 bp, Bovine  19866880859116
tggctcattgagtctttcttgagtaacacatttagggaattaaacattggttttgaatgatttcttctccttagagaattattatattttctagtaatcacagatttaagaacatttgtctagttcttagggctattgatgctgtacttcatttcttaattctgggtgactcatatgcctctccgaagaactaggcatttaaatgtaaagttttcagtagggatttcttaattagcttttaataagagaaaaaaaaaaatagcatctgtgtgtcattctttttattcaaagaaaggtaagaagttataatagaatagttagaacaccattgttctaaattttttggaaccctcaagaacaagaattgaattgataatgcaagacataggaatttgtaagtaataagatcaatacttccagttcatatagtttgcatgctttgaaattagagttaacaggatatttatgaaacctaatcaatataaaccttctttcttggacagtgaaaagaaaatgttaacagacataacagaatatatgttttgatattactggaagtggatggtcctaaataaatttaacttaatacaaaggcatttgctaatgtttccttcagttacttaacaagacattgaacttgtaaagtgccttacactgtgtggaacagagaaggtgcaacgaagtgaaaccctttgtaacctatgtaaccctcccaaaggagtttattcacttgatgtattattcaaattccatatattcatacttcatagttttgctacttccagcaatatagttcaaagttttatttttcagaatttttattttttcagaatttcatctgtctcctgccctaaagatcacaatactctttatatttggaatgtctaacattgaaacccctttctcctctcattcctgcctctttcaaataagcaagtcatcacacatttagaatacacaggcaatagtgcagctgccattaaaatcagaaagtagatgaagggttccctcaaagtaaggaaagatggggaatcaacagagatcattttcccagaaagtacactttaaaagtctcctctattggatgaggtcacttattcctacttttcagtagctttgacaaaggcagaaagaaaggtaagtttctcatggatcacactgtctcttagttaagtttatcacttctttacagaagaaactaactttcccctttttactgcattctgaaagagcctttattagaatataaagaataaacaaaaccttgttatattttagtaatatatttagtttttatagaaaaattttatatggacatgtattttatcaagcaattaataaaatttaagaatatatctttaaattttacttcaaagacattagtattgatggcacaatgaataaatgaaatgaagatcacaaagcacatctcaggattcctgaggattaattatttagtctttttgtaaaacttgtatgtatgtactatctttcatttgcattacatgattagtgtaataaataaaaattgtaacaaaggttacaaaagtagttagtagcaaacagtagttaattttttgacacaagccattacacaaataataaggaggacatttatttttaaaatatgtttatgattcctatataggagaagaaatatgattttcagaaacataaaaacaatcaaacatggatcagacatctcatggttttctcccttaatttctttatcaataagactacctcaaaaagaaatttaccattaatttaaagtttgggcaatctgtttctcttatcattaccataaaaagatccccaagaatggctttatacaaggtatgcagttcataatcctttttcatgttattgtaacatttttaattgtgacttcatttctgcaataatttcttaaccaatcccttgtctccttttttcttctttattctttgaccaaaccagactagagtttccaaaccacagctctaattatattatt

SEQ ID NO: 36296 - DNA, 1435 bp, Bovine  19866880883739
atgtgacgttcatcatcagcttgaccgtggtgatcatttcacaatgcatcacatatgtgacgcatatgaaaccatcaagttgtacagaacaattccccatttgtcacatatacctcaataaagcttaaaaaagcaacggttctcctctcaaagacactacatctgcctttaagggtggattctcgtgcgctttggtgtgaatcatgtccatctgaccactcagagaactactgacctgggattacttgttctctttttctctactctgctaaacatcacacccctgtctttcccatgggtctctaaataaaacatctggcttcttacacctttgaatgaatgtaaacttcatgtcttccagctccctgtctgctttaaaataaaggcacaaagagactgaaaacagggtcttatgtggttacttccatccatcttgagggtgcttgtcgaagtaagaagttggaaaagaagggtcaattttcaggagctgaatgctctacttaaaggaataaaaagcaaaggaactcttaaattttccttctgtgcagttgtagcatttgaacattattattgactttttccctttgagggaacattgtgatgaattgaatgattaaagaaaaccgtttccgtttgcactgttttgctcctgataatgcgaatcaggattgcattctgcaataacaaggcttaaaggaatgcattctgtcttggcaattgggagacttctctctttttttcttccttaaggaaaaactcacctaacagctcggggataatgagacacaagaccaaggagaacaatggtgctaatgtgtgtctcatccttcacactctcgttcaaagctcctgccatcaagtgctattatcctgctctgctgatgaaaaaattacccttaaaggcacaaatgagcctcacacatcagttttcctttaagtgatttctctttcttctgaagtataacaaaagcataggaaaaaatgtttgcaattacccttaccctcaaaatgccagatttagtcaacaagcatttactgagtatgcactaaattctgagcagagataattcatatgtggacttggaaggaactagatacaagaaggtgaagtgatgcatggagtggcagccgggttggggtggtcctgggaaattctagctgcaccagtctatctggccttggccccttgtatggctgagacttacaaactgtcaggatgtccttggaatactgaacacagaacgctgtgttcagattcctccaaatattgctgagaaagggtttctttcctccccatcgaaccagtgaaatgtaattaaaaattatcacatcacatttagactgtgtgggacagatgaaagacaaggagatttggttccaattcttactcagccatctgaagcaattttttagaaatgggttggatgtcagtgct

SEQ ID NO: 36297 - DNA, 771 bp, Bovine  19866881077635
cagcaaataactctttccccctcattgatattccaagtttatctggcaatcatatctctaaggccaagactcaaaacgggttctttttatgagacactttctctaaagaaatcttgatagcgagagtccctttcctctcttcctcatcttctatcagtttaacaagccatcacaatttttctcaaaatcttttctatgaagactcatttctcctcttcattttgaattatggagtcagaaaagctctactctgttgaaaagtcttaggatttgtatactttcatacccagtgaacattgttgagttcagtaaatgtatcctggaaatgtacagtaagttcccagggcaaatgagaagggctgatgtttctgtattttcaaagcgctcccaaggaagttcagagcagtattgtctggtttcccctgttttgtataatcacaaccatagctttgtctctgcagcctacttgcagtaaatgtctttagtaattaattaaactgattcagttctacttcagctttaagtaaccacagctgtttgtttattggttcacatcctaatagcaatagaagcatttatttaaatactcctttatgccagaacaccctgaagagcagaagagcaaggtatttagaaatgacagaggggcaaatggaactactttctgtaacagggacagagcatctgtatttaccaaagaacctgaaatcacttatcagggaaatcagtcttttttgcccctaggtggctactcttttgtagtggaaattg

SEQ ID NO: 36298 - DNA, 994 bp, Bovine  19866881182900
ttccccacacccagcataaccttgctgggtgagtatgccaccccacaggcataaccttgaatgctaattaccatgtcttggggtctgtttcattcagtgaccctcccttcttccactgactcaaggtcaggtgtccttagctgcctccctcctgtctccctgctcctgcaaggggcctgctcctacctcaggctaatctggaataactagttatggctgcacaagctgcaggctttgacgatcctccggttggaaaagagttcttgaaatacgttttgggaggaacctcggggaaagtggtcttaataaagttaccccgaagcagatcctgcaggaaacgcctctttgcgataatttctccaagaaggtggggcagggtgacagagagagaaaatgagtctgtctccgtgaactgagcccaactaaatggaggtgaaaactcaaagcttgtcagaacttctgatgtgcaatttctgctgataagtcttggagattcataatgggctgagaggctgtgcaatttagtttttttcaaagggaaatttttttgaagtttgagtgactgcaaactgattaatataaccccttccacatttttcttaccatcaattctccttagatcttccccctgaagttaggttttgaaagactgataactgtcccagatcagaagcctctcccatactgaatagagtgccagccagagaccccaagttctagaagaaggacttcatcttgcatcctgattagaagacaggcagcccagctcttggaaaagcttccagcagaagataccaacttgaacatcgagttgaatgtcagctcctgagcactatcacagatttggtcgtctcacttccatggaccagaccaaagtcagacatggaaatactgattgatcacacatttccacagtggacagaactgaggctgtgtgacaagctctcaagcatgaacttcccagatttctttaaatgttaaaaaaaaaaaaaat

SEQ ID NO: 36299 - DNA, 959 bp, Bovine  19866881267882
tgaataatatgcaatgcaatatgtgttataatgattgggttagtctatcaaatgagagaacagttttttagattactttaaattatataacaacttgaagttggtaagctccacagcaaaaactgagttttgtatgtcttcgtgaactagctctgacattcaaacaatatattcagtttaatattgctggtggtggccagtgatgcttttccatttcaagcatatgctttcaactgttttatgagaattgctacttaaagcaatgatgtgagacacttgatccataatcttctatcatagttttatcccttgaaaacttttcaattgatggcagtgtttatatgttcctcaaattgttctaggaatagacattatgcaattctgactgtttcatcatcttcaccacactattataatatctacattattatagtttgttctcctctctagggacacataacaaaagaggaatcttatggtgaaaactacacaacttaataaaatggataatgcagttggcactttttccagcatactgattctaaaatatttaacaaataaaatttgcattttattttgactttgctattatacaacttctcttttaacttttttccaaaagtttcttgtgtttttagaatatttaaaaatgatttaattccccaaacagaacttttaagatacttggcttgttttaggggaggatctttcaagaatatttttgatttaagattaaagaggtcaagaaactaactgatacctgtgttgactcaacatttacccaacaaatatctattgaggacttgttatatttttggctaggtgtaggataaaattttgagcaaaagagagagattatgctcctgtgaagattatagtctcctcctaaaatctgtgctttcataaaacgaaaacaaagacatctttatctggcaaactcttagtttgtataacctttg

SEQ ID NO: 36300 - DNA, 1719 bp, Bovine  19866881485222
ttgtttgtgttgctgtgtttggcagccctaggaaagcagggcaccctccccagaccaggactcagtcttctgtctctccagtggattctcccagttctgaggttagccgtcagagtccattcaactctgcaccctgccacagccttcccggggctgtgttcacagggagtcaccctcggaggactgcactttcttttcatctcagcagaaaatgcccatttggattttcagcacgtacagcttcccagccagtaaacacacacgaatgtactagttctcagcattgaatacacagctcttttaaggattgatttcatttattatcaatgaagtttcccccttatacccttttgctgttgttaataatttatcccagttttagaaatggttgcatcatctataactctctcatgtttacttttaatttttattgataatatgagacagaattagctgaactaataatggtaaagtcagctaattctatctcatgtcagtcaaagtaagtccctgacagttacatcagaccctatttccccatatcccctgatatatgtgaatgtataagaacatcaaaaacatacaaccattgaaatttttcttccccagacacgtctagtcttaaaggggatgacagaggatgagatggttggatggcatcactgactcaatggatgtgagtttgagtaaactccaggcgatggtgaaggacagggaagcctggtgtgcttcagtccagggagtgtcagagttggataagacttcacaactgagcagtaacaaaaagtaaactagcaaaacctcatgacaacgagccaaaaggacccaagtgtggcaaaggagacttctcacaaaggcaaaccagacgccataaaaataatttgtgtccacgttgtattatgtatgaaaatacttatgataaggttaaataggcagagggatataagtaattctttccagtttgttttagtgataaccattatatcattgtgaattacatgaatttccttcatttggatctaaatagccaaaataaaattcattttcctttgcatatatacattagaaagccaattcttgtaaccatagttttgtttacaacacaagtgttatgatattttatgatttaaaaaaattttttttttggttcttatatgttttacataactaattctttgtctctcatcagctaaaccttttcacatattttgcagactttcatccaaatcttagcacttcctcaaggtctatattaagcaccaaatcctccatatgtgcttatcaaacaattttaatgaatattaaaaataataatggtatatctttaagtagtttacaaattattttcttatatactttatgttcaatttttattttttgaaacattcttttggtttgagtgtgggcttccctggttgctaaagaatccccctgcagtgcaggagacttgggtttgatctctgggtcaggaagatcccctgggagagggaatggctacccactccactatttttcctgggaaatcccatggacagaggaatctggtgggaacagccaatggggctgcaaagagttggacatgactaactgactttttaaattttgggatttgtggaaaattattgaatgcagagatgaggaccttcattttgtctcttttatttatttatgatgtagacaatttttaaagtctttattgaattttttacaaaataattt

SEQ ID NO: 36301 - DNA, 1443 bp, Bovine  19866880512403
ccagatgtcagcatattttagacatggtaatattggtgatctttctggcccagggatcaaaccttctcttgcattgcaggcagattctttatcatctgagccaccagggcagtccaaaattaattaatttagagaaacagcaagctggactaggagaaatttaaaacattagcaagtttgactcttacgccagatggagaaaattgtgtaaatatataaagctcaattccatttattgatacacttttttaagtggataactcacacccacacacacacacatatatatatcccctgagtacagtagtttcttaggcttaagctttaaaactaattaacatatgctgagctataaaggctttgttaagggaattatagacaggcagtttccactgacaattgagtgacaggttcttcactttatattcttacaactggctggcttttgcttattagcatctcaggaaggaaacgatgagacaggtaggggactttatgttgagtctgtctcaggaatacaccttccttcttgtgcttgcctcaattgtagtcctttcaaattgtctttatttttcaaagcctgttttgttttaatttaacatgcttaaggcattaaaaagggggagcctatgccctttaaatttctctttgtgattccctggactgtagcccaccaggcttcttctgtccctggaattctccaggccagcatactgcagtgggttttcacaccctcctccaaggatcttcccgacctagggattgaacccagatctcctgcattgcaggcagattctttactgtctgagccaccagggaagctctttaaatttctaagccctctccagtgcctcagccaggactccagggccaggccagcctgctgcttctcctctaactctggggtctctgttaccatttctctctcttcattcatttggctcatggaacccccttctcatcaattctcccacaggttccccatctgtagctgttacgtattcctgcctttgttttttccttgcagaacctgattgaaataattgttgtcataattttaatttttaatttgtaccataattcctccttatcctattaatatgtgatctcctgcaacctgaattctgtcattcattctgggataccagcaattagtagattctcttgaaagcttgtatgactcaggtgtctaatgctgcctttagatacttggtataaaaaagattcacacgaagtgccacacaatacttagtataaaaaaagacttctgtgatcacaagcacttgtgaaatttgacattctgtaggtccctcttgaaaattcaccacgcacagtatcattttaagtaagtctgccaaaattttaattttgtttaccttagtagtatatttctcaagtgagtttgactgttgagaaactaccctttatccattaacagttagg

SEQ ID NO: 36302 - DNA, 1742 bp, Bovine  19866880570530
tatcctgactgccaggatgtatcccttttaacttgtgtgatatttaccacaggctcagctctccctttctctctctgattttatggacttgaaagttatttggtatttagagctcagataccaggaagaacatgtcacaacttagaccacaaattccctatactcatgcaccttggggctgctcaaaggcacacaaagtcacacaaagtgggataatatgccagaagcagtctttagggcagaaccagaacactgtgccctgtgctttgctgaccttgagtaacaggttaagagctgaagactgcaagtgtgttcattgaaaatcacaatggattcatggtaatttaatgaaggattcagcagtgctttcctccaaacaaccctaaaatctctgttttcaaacttcaggaagaagtggtttcaaaaccagccattctagaggctgtcctcccaagttctctaattcccaaacactcctatctggtctacagaagtatgatggcttgaccactgaacataagaatcccttcgttgatgacagcacacagtgccaatagcatatgaaagggtttacttcccataattgaggtctctggggaaagtaagacctgcttctccagcagtcaggaaatgccttaagagagaaaggagcctgggcttttataaaaaattagggggtggatttgggttcacacacaagaacaggatcttatgagggcttaacgtcttgttactgccaatagaaaggagcaccaaggcactcttatcactatgtagaggtgtgggtcaaagagaaatgaggggaagggccctgcatacattcccttctctctgaggaatctggagtttttctctggtgcatgtaaggcagaatcttcctgacaccagtatggattttaaacactggtgagtctgaaaggaccacaggtttttctgcagctttttttctagcatttgccagccccgtgcctgaaatgatttgaatactctttctccctgtgccatttcccctcccacttccacttcctgccttccactgcccttgtatgaacggagttttgtaattctagctgttgtattttgtggacctgttatttttgtttttctgtgaagcacaaatattagatgtgggaggtatatgagactccactgctcctggtcactccctttatagccagcgatcactgtcttgtttcttgtaactcaagttagattttggtctcttgctccactgcaaaaaaacaaaagacaaaaaacaaaacaaaacaaaaaaaaacacaagagaggggacaggaggaaagacctcacagctagatctgctgggtttgaggaatgattttctttcttccccatgaagaggaaaaagcttttccactggtacatttaaagctcccccaacaatagggaggtaccagttttggacaagtgccactgcaacacggaatgctcagagaacctgaacttttaaactctggaggtctaagcttgactgttggccactgctgggtctgtctggtgtttcaaaggaatactgggtgctgcaaataggaactgaaggggtaaacttattaaacccattaaacctatggaaaaaaagagagaaatgggtggagggaatgaggctttaaagttaaaagcagtcaaccatcaaaaatgggagtcagagaactctggttttgggtctggtatttaaggaactctggtggtccagtggttaggaattcgctttgcagtgcagggga

SEQ ID NO: 36303 - DNA, 1095 bp, Bovine  19866880719589
tcctttgtgtatttgatagtttgggtggtaaagagatgattgacagtgtcaaaatctttctgcaggaccttgccaggggaatcaaagactttatctggggaatttgtaccatctcaaagttaaatgcttgaattcagcagaagagacaggagcagcatcgaagaaaggcaagtggtgtcctggctcagtggagagcctagagcatagagaggaagcaggagagtgaaccaagtattgttagtagaatttttcagtactgtgcttggaatggtttagttttctggttcagtctcctcttgttttatcgagtgtttgtttattcctaatcttcattcagtaactgcccagattatttgtgatttttacatatgaaaataaaaacagaagaagaaaagaaaatacagggaaactgtactttatcaaaattaaaacatttgatgcactgaaagacattattatgaagtgaaaagttaattcccagggagaaaatacttgcaaatcatacacatttaaacatgcatattaaaatattcatacaaagggtttaacatccagaatacataataaattccaacaattcaacaaaaagacaatctaattaaaaactgagcaaagcacttgaacagacatttctccaaagaatttacacaaatactctaaaatcacatgaaaagatactcaagggacttcactagtggtccactggcaaagactttgagcttccaacacagggcgcccgagttcgattcctgttcaggaaactagatcccatgagtggcaactaagagttcacacgctgcaagtaaagattccacagctggcaactaaaggtgccacatgctgcaagtaaagatcttgcatgaaaagggaaaaaaaaagatgcttaacatcattagacataagagaaatgcaaatgaaaaaaacaatgacatactacttcacataatttaagaaggaagtaatggtagaataatatgccaagcctccagttcagcattattcatgacagctaaaaggagaaaagaactcaagtttatcaacagatgaatggataatcaaaaggggaaattaatttattttgataactgctacaat

SEQ ID NO: 36304 - DNA, 1530 bp, Bovine  19866880721328
aaatgatgatggagtgagatatatttgaggctgactcatgatttataaaaatatcttatttgagaatgtcctttactttttttagttctttacttattttttttcaagttggttgctttcattaatagtgatatttctttactcaggtttcaagttgctgtcaacaaattcctgccagcattatgtaatgcatgcgtgaaactttattttccaaatgccattttatttaagtatatgggaaatactttaattggatttaaaagtgagatttaaaagtggttaagtatctttttttgataaacattattcataacaaaataaaatagctttaggaggtactggaacttattttttttcttacagatggcttgtaccccaatcccagcttctaggtaacgaaagagtggtccacagattttatgaagccatttaaagcaggaattttgtttgtttgttcagtcactcagtcatgtttgattttttgcacaaccccgcagactgtagcccaccgggttcctctgtccatgggatttcccaggcaagaatactagagtgggttgccattttcttctccaggggatcttcccaacccaaggatctaagtggcgtttcctgcattgtcaggcagattctttaccattgagccacctgggaagcccttaaaacaggaatagatgtgtataaatttacttcctctgacttaggtgtttctcttttaattaactgctctaaaaataccaatttaaatcagggtatgagaaataataggcatggggaaacaattttggataatgaaagtaacactgacttttaactgaacaagagttaataataagcagtgttacagatttgtccactgaattaatctctcctctccctgttgcattgcgttgtgttccttctgtcctggccctcatcagcatctacagtgcgatgcatgtatgcaattctgtttctcctttttccacgaaagtgagagtctggagagctagttctttctggtattcatctttctgttctgtttagggcctgccacataataggtataaatgttaaattcatctgatctctgcaaaataatatagtgcaataacttgacaagtcactgttgacaatccttggccactacttttatattttaattttacttcagtgactcaatttttacataaaaagatcccatagatgtgtaaattttgtttacagagaaatgttttatgtactctgagggtaattactgatagttttaccatctgtttctatttatcagtatttcccatctccctgttcatttgtttggctgagtcttttatgtgtgagattctttatccatttagcttttgatgtctttgaaattttagtttttgatatttagaatatcatattttaatatgatattaatatatatttaatatgatattaaattaaattaatatgatattaataatagaatattttatgatgttctgcaagttatgtttatggtataacttgaatttgagtcccattctttaaagggaaatgtgtgtt

SEQ ID NO: 36305 - DNA, 2036 bp, Bovine  19866880722735
cacacacattgggattgaaggcagaaccctttaactgccaacattcataatacatatattcacagtttcaaatatgctccataagcatgtatatatgctccaaaaatgagtccaaataaggctatacatattcccagaaatgcattcaccctctctgaagagtcttatccagttactggccctggattcctgggtgatgcattcttcttggacatgtgcaggtatatttcctaatcatgtagaaacgtattcctcaattatacatttagtcaccccaacacagccaggaagcaggatagaggagaaaaagaatgactattaaaaatataccccttttggaaataagagaatggaaaatggcacacgtggtcactacatctagcatccgtggcctgtctctggtagggcagtgggttcttggttgggcagccttgtctctccatgggaaaatctcccccgacatcctcttccatggctacatctgaaagcagtgtcggggagcatttctctggtggatacctgacaatatttctaagggatcctaaatgtttgcctaaatatctgttgagtgagtgcctaaataaatatcagcacacggtagaacttgtgagagttatctgcctgaattactggcttgctaagtatctatcactcccacttctgagtcacagaagcaccccccagggaaaactacaatattgcattttaaggtttttttgatttaatagattctttaaaaacaaaaatgggctcaaagaaccatacttgttctatggattgtcaaatattctgtttttttcaatatatggagtaactccacagaatgctcactaagatactggggcttgccagttaaaacccacattgaaatgttataaaaaagaacagtttaccataattacagatactgtacgtaacacagcaatttgcttcttgaaagctaattacaaaaagttgttttaaataatcaggcccttattcagcagctcagggatgagaacagctgtataaataccatcccagcaatggcaagagaggaggatgggaaaaaataggttagttaagagttcaagcagagttaaaaaaacagaaaaaacaaaacacgagttcccttagatctgtaaagtaagtataaagaacattcaaggacataatgttccagggttttgatataatactgaaagacacttttggcatgacaatggattgtattagaattataaagctgagtgtccattttactgtcgttgttcagtcgctgatcgcgtctgactctttgtgaccccaaggacagcagcacaccaggctcccctgtccttcactatctcagattcatgtccattgagtcagtggtgccatccagccatctcatcccctgctgcccgcttctccttttgcttcctgtctttcccaacatcagatactaattgcatccagacttcctggagctcttccattctcgccttacatttgtgtagcatgttgattcatgttaattttctctagagaaaggatggaaaagacataccaacacaacgcacaaaggccaacaatctcactcagtggaataacttggcacgtgtaatatcatctgctctcttttgcatggccatttgtaagaataaggtgggctgacccacaggaagtgacgctttgttccaggggcataattgtgcatacctgagaaaagccagtttcttaactgagtaatcagctgtattcccagagtacaatttaatcactctatcctaccatgagataaggcccagtggcattgtccccaaaaggaataaccacagtttcacaagttagtggagtcctgaaaacccagaacttgtgccttcaatgattaaatgcaacaacagcatgaccatttcatcagggcaagctcttcaagccaccagattgctagtcataggtttcaaatatagagtaagaatcacttgatttatagcctctttgacgaacgataaagccagttcctacatttaacaataagtgcttctattgttcaaggaaatttagtttttccaaaa

SEQ ID NO: 36306 - DNA, 876 bp, Bovine  19866880731986
atgaaaactgaagtatgatttgtatcatattcaggaaccactagctatttggaaatagagtttgaaagtatcttacagtttgggtaaatgttatctattgaagttaattgactgcttggtagatgagtgaaaaaattcacatctgctttcctgcccaccctactgaaaaagcaccagatatttcaccctggccaaaaattctataacatacacgatgtcctactaaagctgagcattgagagagtgccaagcagtcattcttcccactcgttggaacgtggttatgaggcaccagaacgtggaacccacatcctctttctctcatccccttccattcccaccactgggcaagctgaaaacaattttcaaaacctctgctctgttcccagaagattagtatttctgtacttgtgattagttttaaaagctattatcctatcttgcatcatgatgatttgctttctatactacaaacaatatttcttgcttttgcttcagccataaaacaagtcttagctgcatattcttgtctaaaatgataaatgaaactcatggctcccatgtctggatggattaggttcggctatttgtagcacttcgggtgcattattttcccaaagtttagtggcataaaatgctcttcattttttattgaccagttaataataggtggctatcaggcttgctgcagtgcaatccttagattttgcaatctggtgcaatataaatagtttatgctaattacccccttcccaccttctgggagaatagagacattttgattgcaaattttgcacttggtcattaacactctggtttctagattatgcattggaccattttataatgccaaataaaatgttaaaactgttactg

SEQ ID NO: 36307 - DNA, 1268 bp, Bovine  19866880737453
atgcagctgctaccattatggtaaactgggtgaggggtacatgggatttccctgaataactttttttttttttttttcacaactttcttgtaaatatctcgtcaaaatttaaaactataaaaacacacacccacataagaacgttcatacttaaaaactcagaaatgaaccaaatttaattagtgatcatagtcaagaaacaaagtaaaatctctagttcaaagagattatcagactggatataaaattaaaacccagctaacctgtatgctgtttacaagacagacattaaaatattaaggaccaaaagagccttcaagcacaaaattagaaaaatctatattaagtaggaagatattaaccaaaagatgacaaatgctatcagacctcacaactagtttgttaacaatattcatttcatgatatattaatactttatcaacttggcaccattcctgggggggaaaaagtattagaaaaatatatgtcaatattgctgacatttctctaacttttccaatgcctaccagggtttgggaccatagtaagtactcaaatactgttaactgatcaactgaatggcaaataattctagaccttccaaataatgtgaacctccaggcaatggcggtgatgggtcagcttgataaaatatttattaccaggtctcaaccaggcctcaaggagtacaaggtatttaagttccataccagcatgcactttatcctcaaaaacatacaaatagcaagagaatactttcttaacatttaaacaaataaaataatatatttgacactcaaaaaaaactttatgttaaatcaaaatttttacctacaacttgctactgtctttttatataagagttaattttttctagttaggttaggtctatccaagaagcagttacatattataacattgctattctactccagtgtaactttcactcaatattcctagtaatcattaaatcagataattaatattttactcatttattattcatttccgtgaagtattaaaatgctacccttccaaactcttatttcaacattctgtcatattaaatgatgatacaatattcaagataccactttaaagcaaatttttcagattacattcactttataagtagtagtattatcttgattttcttatagaaatactgattttcttatagcaataaaattcacttacaaataaacacaaaattttagattcttgtcaagaatggaattctagtctttaaaaggcagttgtaaaaagga

SEQ ID NO: 36308 - DNA, 1659 bp, Bovine  19866880754907
tagttcttttcaggagatgctgggatcgaaatctcacggaagtaggttttgctcaagaatgaagcagagaagtagggtggaagctgaagatatagggaagagggaccatgtaacttatcatccaaaccaggacactgcctatggaagagggcacagtttattattatgcttatgtatctaaattgtattgaatggtcactcagtctgggtgggcaagagagatttctaaggaaccatctctttgtctctatgttttctgtctctgaagcaatttcttactttttatgacttaccaattcttagatctgttggtaatttgagtattttaatagactttggtatggaatatttgttcagaactttttaatagttttgctttgtctacatgcaatttatttcctcaatgaattgacagtttggatttccctatgcacacttaaaaaaaaaacttgcttttatatctagaagtttgtgcaatataaaaaatgaaattcagtgccctagagtttccattgtttaattgaaatacttttagggatgagagattcataataatggtctttggttctctgacaaaataactattatgtataatgactggtttgtgttttggctaatatagattttatctgagctctagtatttttaaaaaacagatcctaaaccctagataacttgttaatgcatttcagtaaatcatttttctattgtaaattatattttatttcaatgtattttcatttagagtacaggtgttcaatccttttttgatctcataccatgttagctaaagaaaaaagcaaccaattcatgtttataaaataattgcaaatgattatcattgtgatatatatacacatttttttaagacaacagcaattaaaaagtgagataaagatgaaatggacagtattttaaaataatgttgctattatgatggctttcttctatcattagcttgaggcactgggcctctcaactatggccaattagcttgaggcactggccaatctcaactatgattgcctacaggggcttccctgtagttcagatggtaaagaatctgcctgtagtgcaggagacctgtgttcaatcccctgggtctggaagatcctctggagaaggaaatggaaatcctttccagtattcttgcctggatagaagagcctggtgggctacagtctggggttgcagagtaggacatgactgagtgactaacactgcagtacaatattagactcttttacaatgctttttaaaaaaatcatgacactcatgcccttctgcagttacactgagtcagaggctctaggaaaggtgattggcttgttgttgtttgatctttgattctgatatatagggaagttgagatcactgttgtatatacttatgggtaaatacttcgcttcctctctcctccttcctttactctttcctttctctctctctctctcttctctcctttctctctttacttccctcctttttccttccttccaataagttctggccaggactaaaaagattatatttgaagcttgttaagagagaatcccttggactgaggaagcttgtgggctacagtctatggggttgcaaagagtcgggcacaactgaggactaaataacaaagttacttctagaagttaccagtttgtc

SEQ ID NO: 36309 - DNA, 1535 bp, Bovine  19866880836168
ccagttagaaaaatgcctccccagcattaggactttgaaatgctcaggcttctccaaaataaacaaaagttatcgtttctctttgttaaaaagaaaatgtgttaggtcattaaatgcactaaattctacttacagcccccaggttgcagttaaagagccaaataaagctatttttaggggaaaaaaaaaaactttctgggtttatgaaataaaaaagggccctccaaatccataaaatgtgacctgtttacattcattattggtggcaaaatgaatgatctgtgtagaactggaccaaaatttttcagtgtgaagagtccatatcagatttaaatgtgcatgcaaagagggggtggagaaggcgatggcaccccactccagtactcttgcctggaaaattccatggatggaggagcctggtgggctgcaatccatggggttgcatagagtcggacacgtctgagcgacttcactttcacttttcactttcatgcgttggagaaggaaatggcaacccactccagtgttcttgcctggagaatcccagggatgggggagcctggtgggctgccgtctatggggtcgcataaagtcagacgcgactgaagcgacttagcagcagcagcagcagcaaagagggggacactagtctgtccaaaggctgctctgagctgatgtactttgctctgttttccttcgcctcctggggccctgccctgccacctgtggatgctggtgtgcccccaaaacattcacacaagggggagaacgctggctatatatggcaaaggtcatcccaatttgttgctgaccagctgtagaacactagacaagtcatcttgtgctcacggcctcaagtaccaaaaaaaccagggttgaactttccactgtaatgttcctcaggtgacctcagttcagcatctgtatgcaaaatgccagtaatacctgtcctccgttacctctaccacagctgttgtgaagatgaaggggttaatgttgataaagagctttgacttctccatgaaagtattgaaaatttgttgtgttatcatcagcatttcatctgcatggaggcagctttaaagtggcatttgcttctatccttcaaatgtcaacagagattactgtgagtccatcaaacagatggaaatggcatagaaaagtgaagaaagaaaagaatatgtgaggtaggaaaggataattacttaacatcaatctcagacctcaggtgacatccacacaatctatgctgttttaggatttaccagtcaaatcagataacccttagcagactgacaaataaaaacatataaacactatgctcagaaaaaggcattaccatattgggaggactgttacaggattctgtgagggacaagatgaggagaatgacatgcgtgggcttggaaaaagacagtggcggcccccaaaaactgctttgaaggatgtaactcatttgaataagtttcgattaaatcagtctataaaccagcctatgtatgtgctctgtactcagctgcatctgactctttgca

SEQ ID NO: 36310 - DNA, 1184 bp, Bovine  19866880875494
ctttgcagctaagtgcagtcatttatgttgaaaaattgcagctgtcagagtgtccaaacacttcatgggatttgtttctaattttgcattttcattcacacattctgatgtataagcttctattacaagaaaaacacacacacacacacacacacacacacacacacacatcaagttctagaggtattttctaaattgtcataacctggtttgggtaccattcaacaaaagtaagaatgagcataatagattatcattaatggttcctttgcccctccccaaagtcaacaaagatcttaaggaggaaagaaatgttaaagagatctttatttgaatgaatttaggtgtcttaagaaaagaagaaaaaaatgacccacaaactgaaaaaagggattgattccaaaatataggaaaatatatacatactaacaaaaagtatgaaaggcaaagggaagccaaggcagttaaaccgagaactacaagttgctaaaaaaaggcaccaaaagtgcatagtttaagttctatatgtaagtgtcataactagtgtaacaggggggaaaagaatgacagataaaaacccacattagaatgaagagcctgccaactttgattctaataatccatttttggccactgcagccataaggtactggcccaaagatgctgtgttgcatactcaaaactcagtgacttaaaactatagccacttgctctgctcgtgcagctatagctcaggtaggatttggctaatcttagatgacttgtttcatagcacctgctgtgtcactgctctgcctcttaaaatagattggtacggcatctggatggccatgctcctgacgtctctctctggacttagtatagcacattcttctcagcgcagtgccagacactcaagatagaaaacagaaacatgccaagcctcccaggacccgcgttctgacttagtgcactgtcctctctgttcatgatcattggctgaaagtcacatggccacacctgagtcaagaggcagactctgctctggatgagtcctgcaactctgaaccacattttgtacccaagaaagtctctgctataggcagtaagataatctagatcagcctataaaatcttccagtgaaatattttggaggaaaaaaaaaaaaacccctctagtttttacacaactcatacatcaaaag

SEQ ID NO: 36311 - DNA, 1292 bp, Bovine  19866880982843
ctcactgagttcatacagagcttaaatctatctaagtatcaagattcacgtgccaccatacacaggatctaaaggtgtaagtatgtacacttgtacagttctgggaagctttctgatttgctgtgttaaagatgataccactcattcatctgctaatattaaatttacgtaacacaaaaattgccattaagtttggaggctgagatgaagagacagcaccacttgacataaacattgtctcagcatctacagctgcttttgggggcatgtttttatgcatatttaaagtttatagcagagcacggggatcagagtttcttttcatattcaaactttatagtaaagccacaactacacattaatatagcagctgtaatgtatttccagttaagctgtcataaagtctagggcttttcacatcatcacttttgaaggtcggcgccacaaagaaaaaagccatttgtactggatcaccatggaggttggtaatatacatggtaataaatatcacaatatatttcatttttatatgtttttgatgaagaggtaaaagtacatcttctacagttgcttttcagaaattgctcatctgttgggaacgagagtaaaagagactgaagctaaacattatttactgagacattaccactcttcacttacaccacagctgaaatgagaaggggatgccaatgatatttcatttacagtattgatttccagagctcgccctatgaaagtactgcacgtgtactcaagataaatgtgagaaaatggagatatgctgacaggcacggtttcctttgttttttatttttatcattcgaataatttatatccttttgaaacataattgaaaatgtctttcagatgtcatttcaccactttcatgtggtgcctgaggtttgtgagtgccctggaaatgtttaaatgctcacggatactggtgtgtatatacttacacatacatatttttaacacaagtgtagtttctagtcaaagctatggtttttccaatagtcagggatggatgtgagagttggactataaagaaagctgaccgctgaggaattgatgcttttgaactgtggtgttggagaagactcttgagagtcccttggactgcaaggagatccaaccagtttccatcctaaaggaaatcagtcctgaatattcattggaaggactgatgctgaagctgaaactccaatactctggccacctgatgtgaagaactgactcattggaagagatcctgatgctgggaaagattgaaggcgggaggagaagaggat

SEQ ID NO: 36312 - DNA, 1609 bp, Bovine  19866881025731
cccatgcctgcagcctggtcatagcatcagggggctcccaatgatactgctgctgttatttacacagtggatatttttgtctgtcccttcaagttactgaatggtttttaggcgaggctgagctgcactccatggaccctgaacttgccccagtttcaagactaaagaaagagctcagagtcagcaacagagacatcagtggtaatggttgaggggatttacaggtctgaagaaggttctggagcaactccccatcctttgcaactggcggtgggagatggcagggcaggacatgacagcgatcttcgctcctggggaggaggggagattactagttataggggaattaatatcaggcgggcccattaattatcagggaaaccagcaggtgctcactgcccctttgctaagaaaatcactattcggtcctgggtcaagtatgcaggaaggtcagtcttgtgagttgggtggaggtgaagtaggcactggtctgacaggacatagagagagcaaaagaacaaccatactgaatgatctgcataccagagattgtgtagaaaatttggatgtggatggccaattaacttagggacaaccataaattcacataagaactttaggcagttgacataactcaatttgcattttgaaaagatctttacttctctgaagagaatagatttataagagtcaagaaaggattcaagagatggttatgttagtccacataaatgattgttgtgttttgatcagaggttctggaagtgaatatggagagaaatatacaaaatcaagaaataattagaagttttcattgaaaagatttaatgattaaatgtaagacattagcttcctaacaaaggccccatgcatgctcttacctcaaagctttatcatgttaccctcccactgcccagaatgcacatttatgtatacagtagatagaataatcataacccccctacacacacacacacaaagataaccacagcctagattgcaaaagctatgaatacctgacatagcaaaaggtattttgcaaatataattaagtgtcttcagctggagagattactgtgacttactcaggtggacccaatatagtcaggcatccttataagagaggcaggaggtgttatgctggaaaaagagaagaaagcatgaactgaggaacgtggctaatgtctaaaagtggaaaagacaagtatcaaaccttccctcagcctccagagggaatgaacttcaaagctacatcttgattttagcccaagaagagccagtttggacttccaactctagaactgtaagatatttgtgttgctttgagctactagtgaaagtgaaaatgaagtcactcattcgtgtcctactcctggtgaccccatagactgtagcctaccaggctcctccatccatgggattttctaggcaagagtactggagtgggttgccatagctactaaggttttggtcatttgtcacagcagccatacaaatgtattcatcaatccagttcagtcactcagtcacgtccaactctttgcaaccccatggactgtagcacaacaggcttaccctgtccatcaccaactcccagagctgctcaaac

SEQ ID NO: 36313 - DNA, 1200 bp, Bovine  19866881063226
catttaacaataagtggaaaaaaaaaaaacccaccaaaaacagaatggtacggattttcaaaataacccatgtgtagaaggaacatctccttaaagggaagaacaggaccactttgaagaaaggtttaaaaattctgaacacaaggtacccctattaggttacaatgagggtggtgtttttttttgttgttgttgttgtttttaaaaaacaactataatagcgtccatatttacacatatcccctatctcccacccccaatacacacaccaatatgtgaaaagaaaacttgttattattttcaccacctaagaattagaaaaatctctgcatgtatacactgataaatcttagtaagtgaagggcagctgccattagaagctgattttccttctgtggctggcaacatttagttaaattaatccgaagactctgagtccttgagtttgcaaacagaagttctgatgggccatggaaatctctctgagactctggctcaatctggataactctgccagaccaactgctcacacctggggcccccttgctgatgaaatgtctgcttcccacaggaaagcatctcccttgctgctgggctccctgcttcctcttcggccccgccctctctagactccatgtccactgtggttccctgggaccgcctcccactacctcctgtgcccttcctaccagggccatcagtaccttcgacatcaaatctaataagagatgatctttctgatatctctcggcttgaacctcttgtgagactcttgaaaacaaaatcccaatggtcacagtggcttttcactgccttgtggaaaaatattgacaaaacagaaacagtagatacgtgtttaggatcaaagcagaattcattagattatgtggctatttttagaacagaatttcagttagtgagagtctgcccactgtcttttaggaaaaaccacacttacgtcacatgttttattaataacagaaatgatgtgttatagtaagggtaataaaacagtgtcttctttgtccataaatgtacaaatgtatacggcttgcttctaataaatttcatcatgacctatttccatttttaatttcctctcactgatacacaatgttaatatttcatattagaaatagcttgcatcttactatatgaatattctaatgagtctgaaaatattagctattcttaaaagca

SEQ ID NO: 36314 - DNA, 653 bp, Bovine  19866881132859
ataggctaacgatggcatcaagtgaaattagagatttcatcagcatttttaaagctattaatgccattaacaaagaacaggtcatattgaatctattttttcaagcaagtttctagatgactcagggtaaaattggagatttataaatttattcaccagaatatttaaagctaaatccaatttcagataacactggaaagaacattaggttacaagttgcaagttctcaattcaaaatatatctttgccttcttgggcaaagtacttttttccttggccttactaaaatattggcaatttgatgacttggcttctaagattccttctcaactaaacattttgtgttcctattaggtaatctaaaatcctgcttggactcaccgttccctcaaatactgttgtgtgtgtgtgttgtctcttcagttgtgtccaactctttgtcactccatggactgtagcccacaaggatcctcggtccatgggattctccaggcaagaatactggagtgggttgtcacgccctcctccaggggatctgcccaacccagggattgaaccaaagtctcttgcatatcctgcattggcaggcaggttctttaccaatagcaccacctgggaagcttatgataaatgctcaatcaatatttgttatg

SEQ ID NO: 36315 - DNA, 645 bp, Bovine  19866881235242
ttttcttggaaatcttagtgagagaacaggtcatgccatgagagcggacttcccgatataccagaaatatatctctgacaagatttttaagcttcaggagctgtcagaggaaaatctttctgggttattagttgtttatagcctgacagtgacaaatgttcccctgagacttaggaagcgcaacagcatgagtctgacatcacagggctggatttcgtccctaacacaccctgtctgtcctctctgagaagtcaatccttaagattcagggaaggaagtgtgaagaactgtggtcatctgcaccactgtattttccctacactaagaaaatgcattcttctttttttcatttcttttggtacttctagaattttatatatgattatgtaattgtaactccatgatatagacttagaagagtggttgtgatttctaacttatgccatatatcaggaagtttctttagtgtttttatttcattataatgcaattatacaaatttgggatgccctaggagtttaaaataaggaggaaaagccatctgtttcattttaactggtccatagaagtattataaaatgcagtcttctgtgtgcccccgtcctcgtctcctccctggcaccagtattaagtgaaacagactca

SEQ ID NO: 36316 - DNA, 2086 bp, Bovine  19866881296908
aagcttattcaagcctcctaagggaggaaggatctgtagctctttggcttgagggttcccacgatgggctccacaatccataattgactagaggactcatgggacttggtatatagtcagactcacagctgtgatttattacagagagaggctgggaagcagaatcagctaaggggaaaggcattgggggagaaattctggagaaaatgagtctctagtcaaaagagtcttttcccagtggagtcacagaggatgcacttaatcagattgtaagtgtgatgcgttgccaccagggaagctcactggtgacttaatgcccaaaattttactgggggccaaacaaacaacaaccataacaagacaggttctcggtataaaccgtgttgtttgtacaaatgagtcaggcacagtgagccactgttggggaaagttgtttgtttgtcagtgtggggaactgtttgccattcaggtcctccaggaccagtccaaagggcggccttgcaaacaggctataaaaaagcattctttgagcctgatgtgttaaatctttttaggcaccctcttccactgggaactcttgactctgcttttagccaagaagccatcatttgagaccctgtgctgtgttaaaatgacatttgacttctgttaatagaagtggtgcttttcttgtttgaaatgtttaaagtttttgttcaatgccatgttgaaaggaaaggttattttacaacacctagggcagtgaagattatagcagatgagaatgtctctctgtgtttgggattgaatggagaattgttgcaaggttaaattacatttattcttttcttttgtataccatgtagaaaaacagaaagagaacacttgattattttaggcaatctgtcacctaagagtttttaagagtttaatcatgtgacattcttgctgaagaaattgtttctcatcagttgtcacttgataatttctaccttgaaaagtacaaatgtttttagaagtctggtaaataaaactgaagtagcaatctaccatagtatgccttatacaataaagaggcaagtgggaaatagttacttttgtgataacatctctacagggtaaaaaaccaattttcatacctgtatcaaggaacatagatcatttagattccaattggctttatgtaactattccccttcttagcaaatttgagaacaagtttgggctaattttagatctctatctttgattattcagagtataagtcattttgcattatgcctgctgttctcttaatctggcaggctatttcttattacagagttctggtcaatgcagtttaataaaagattatggaacctcattattaaaaatgtaatatattcaattttttaagactcttgagtgtatctccctaaatatttttgaatggtatcctaacaagatggcatcactgactcagtggacatgagtttgagaaaactctgggagatagtgaaggacagggaagcctggcatgctgcagttcatggggtcacaaagagttggacacgacttagggactgaaaaacgacatacaaaaagaaaggctgcttcagtagtggagaggggaaaatagtgtgtgggagctataattttaagacaccacaaaactcatattacatgattgctttattttaaaaaaatttccaatattctaatttgatgggatagtaaatttcatgttttcagagccaacttgaaaggtgatcttgacatcttcttgccccctcctctttacccttggttgacacctatttcccatcccaaaagtgtccttttctgtcatattgtcctttagcaccttagtcctcagttgggcaaaccacttccagtacccaccctgcttcacactccagaattatctttattttcccttccactccaatgaaaggcttttccttaatgatttgttcataattaagaaggaagtatagcaagtaaattaattcacggtaagaaattcatgatgaattatctttcctagtattacattttaaaagaagaaactttttttatcctcatacaccagtaggaatattcgtattttcagctttcctagaaaaca

SEQ ID NO: 36317 - DNA, 849 bp, Bovine  19866881307555
gatacaaaaggtcttggaaaagctcagaacattttcagaattcctaaaatatttttcacctactaactcattttccattaattaaaattactttgcctcaaggagctgcttcaagataaactattaatatgttcgattagataagctaagttcaattctattgttttcagttttattcagttctcaagttaggctgctttgtttttctctctctctcacacacacgcattttgatttgttttaacacattaaattcacgaaaaaataggtcttatttgggagtagttgagattttgcttcatttgaaaacattgactctgcagggataaaactttctagctctaaatgctatcttaaatggatttctgcacacaacatagaaaaaaaaaaatctgagaggttagagaaggacataagaagtcatctaactcagctccttcattttacagaaattgaggttcagaaaggttaaagtcacatcaataattagtggcagagcaggcattggaaaccatctcttctaatataatttctttatattatgccttcagttcagttcagttcagtcgctcagtcatgaccaactctttgcgaccccaggaatcgcagcacgccaggcctccctgtccctcaccatctcccggagttcattcaaactcatgtccatccagtcagtgatgccacccagccatctcatcctctgtcatccccttctcctcctgcccccaatccctcccagcatcagagtcttttctgatgaatcaactctttgcgtgaggtggccaaagtactggagtttcagctttggcatcattccttccaaagaaatcccagggcgatctccttcag

SEQ ID NO: 36318 - DNA, 1037 bp, Bovine  19866881314542
cgcgaccctcccgctgtcgtagcaccagtataggagagagaggccgctctcattctttacagcaacactgggtttgtgtcatgtacagcagctgggtgcgttctacttgttttaaattttaacaatcaggctagtgattttttatttatcattaaaagataataccccaaactgttaaggtcagaataaaatggtgcggttctagcatcccaagctagaaggaattatttttttcagtgaaaggtccacagaagacagagagctaacattatgacatagaagcaagcgtttaaggatcaacaggaggaggtgtatgtgctggacagtacggaacctcagagctttctcagcttcaaaattacaaactgttttctgggggtacatggagtgattaataagagtgatcaggactgaatttgagacatgacccacgttagttttccaactgaatttaatacagcatatttactttaaataatgacaccccaccccaccccccgccaccgtcagagtaaaactgaaatctgtcatctacagtgctccctgaatgatcagaacatgaacagtctttaaaactagcgggcctcccaggggacaggtttagagtcctgccagccaaggtggactgttcttggtgagcatgatgttgttggcaaatgaggtatgtcagaggcacagcgacggaggtcagcactggtcagttttttatggccatggtccagagcaggggatggtccgtctctacagtcacaacaccagatccgtcgtaggtgttggacgtgctgactagtgttccaaagccaagcatctgatgtgctgtaaggacgtgagaagcaaaggtttggtgagagccaacttccctccgcgtagaatgactttgttgagagttaccaaaaagcagttaagcacacacttggaattaatagacaatctgtaagtgagattctaaagctgaaagtttctataacttgctgtgaccactcctcctagagtgggctactctgtttatccatttgcggaatatgtcagtctcaaca

SEQ ID NO: 36319 - DNA, 715 bp, Bovine  19866881421246
aaaaccacgaaacctttaattttggactaactcagctcattcagttgtcccttagaaactttacatgggaactttcaataaaaatacaataagctttaaaatgttggcatgtacaaagtatcagatcaactgcctagatttcaagcttgcataaagactgaatacacttgaaattacatgtgtaggatactaatagttacggcccacaaggatcatttgcatcattctaccacgagtttgacagtgttgccattaaaaatggagaattacttttcaaccttcagtgaaaatttagcctgctatcactacatgtgggattctgacattatgagagagaacagctctttggaaaattagttgttatcttaaaagcttaagttaagatactgaacaaagataaaagaaattaaagtaattttcaaagaaaaacctgtcaatatattccaaacttcttcaagaacactcaaatttcaatttcacattataattagctttcacaattgaaagttacaattgctcacgcacaatgacgatgtgaaaggaaaagactaaaatattataatgcagcctgtgatttattgggcaagtagagctttaatgcaaaaaaaaaaagactcgaagaagaaaactgagttggaaacacaacatgggcaatatcgactcatcaagaggattcagagcccacatatgcaccagccacaactttcactgctgt

SEQ ID NO: 36320 - DNA, 1265 bp, Bovine  19866881433697
acacagaagaaatgtgtttagtgtggtttagccatcattttccggactttaactccttttctagcattttgtttatttttctgcaccctcattcctcaagaatacgagaaatgtgttgtagaaactcaagtgaaaataatccatgtttcacaagtgtgcctttctagaaatcgtgcttaaggaaaactgggggggttcagtaatatttaacccaaaggagtgggtccactgttggagcacctgtgaaagattagtattttaagcagggaagctcctggtgtcttatgactcatatcacataatactgcctgattttaccaacattgtcatgggttaacactggccctgtttaagttcaataactgtatcaaggttgaattcaagaccacattgcttccctttgatagcaccatttttatatgctctagaatcttgcttccttaaaggcaaaatgaatgctctacctgacagtacttgctgctagcttccctttgctttttgtttttaggagagttgtaaattatgaagttagattgaagctagattgaacagagagaatatcaagagtaagacctacaatgacataataaaaaaaaatcaaatttctaatattaccaatttggaaagataccagtaaagttgaaactcttgctgacttcacagaggctctaactaagacacaattttctctgaggtgttttatgtcctttcaaacatccagaaagtcatataactttgggctgctattcaaaaatgttgagggaaaaaaaagagtttttgcacataggaaactatcaagctggtcagaagatcattgtgttatggaaactttagaaagctattacctagaaaggagcaaagtatgctttttaacgaattcaagtatcagaaaaagtgttcatcacagctgtttgataacctcaatcatgctgtgtccaggttccctttcataattagaagtgcaggaagaaaaacacgactctcccacactgcaggggatgtttcatagaacaataaagggctgctcccatatattctcagtcgacagacaataaaagagaaaattggtctactaaaaaatgatagtagggcttaggagacaagattggtggtggtggatgtgttaaacagttattttggctctaatctttctagaggacaaagaggatggagaggactttctttgccccttttatcttgttcccaaagaccccatgttgtgaaaaatcttatctaccaaaaacaagacaaaacacaaaacaaat

SEQ ID NO: 36321 - DNA, 1070 bp, Bovine  19866881565955
ctgtatgtacttattgtgtattttctggaatacataacatagaatcttactacatactgtatgtgtcatgaatgtacaagatcacgtctcttccaagtgactgtggtgtccagacatcagtcatacatcagcacctttctagttaggcttatagaaatgaatgatatttaatgtttcttagaacttggattcttttaaaaattacttgggagagaaagaaagtctcgtctgtttaaatgcttataaattggatatttttagatttgggggaaactagatgacaggtcatgttaaagctattaggacagctctccaatgtccagtgtcttgtgtataagatccaacttgaatggattttactgttgtacttttctaaaataatttctgtaaaaaatcttgttttcaaacttctaaatggttggaacatagatatgtcacgatactagaatcctcttaaacatattttaagtaatacaaatgggtttatacattcatcagcagttaggcatgattatttgaaaatatagtaagatttatggtatatcaaatctataaatatacctaactaggtatctgtcatctcttagaggtaacatgcaaaacaaggtgtgcagaaaaacttgaaacataccctttgttcatttattttgaaatgtgacattagagtgacttattcatgagaatttcataatatattagtaagcgtgctgcaggatattttggaaaagtaatgcaggcttagtgatgcaaaatatttctcctgccttctgttctaagagataaatgaggtgaggctttcttttcagttcaagatgtcagctcttcctatctataatctcatttatcacttcatcctacacattcatatagttgttttttcttttaggaatctgttccagctcttctactagactcccaggtccccttgtagacagacccagccagggttttatcatctgtgtgcaaggccccccagcagagtgcccactgaaaagtgtgtgcccgtgacaaaaagaacaggagtttgccaattgatgagggagaaagagggagaggcaaaaggatgcagg

SEQ ID NO: 36322 - DNA, 1433 bp, Bovine  19866881746589
cagatagtgaattatacctctcagaaatcaattacatttcaggacaacactaatactacacatatttttattaggaaataaaaccacaggatatggatagtaataaaactggaattattctactggcaaagtccataaaagtaaccaataatttcaaaatcaaacagaaaaacatatccagggtctgatactgaacaatattagcagtaatattttccccaagttcacattaatttcctctctccatttctgatatatggctcatatttgaaaacccgcgtgtcatttgcttactccccaggttgggaatgctgggaaactttctcacattatgctagagtcattgtcttaattctcctccctcttaattgattaatgagtgaggagtgaaggaaacaatgttagagaaatttcattaggtataaattgcaagacatttgtttgaatgaatataatatctcagctctgtcttgatgggccttgtgggaatgctttaagtattactgtaagtgccagaccaagcactgaacaatttaatggtgccattcgagcatggccttgtattcggtttttgtttcaaaacgttcttggggaaaacttcactgcctgataatagggaaccaaagaattctttcaagtttatgtgttgccaataatatttctgaagggagtcatttaaggtaaaacaacaaaaagtctctttttaaagcttaagccattctaatttacctcttctataaaaagaaaacctaaatgtttcaagcagtatctgaccagccacatgaccagtgatctgagtagatccaccaagtgacttgtgacttgtaataatacttgcagtgacccaagatttcctcaattatttttcactgtcacaaatttatgttactagttaaacaaatattgattttttttaacagatttaaggtatgtaaaagaacaatagaggataaagaataatatacacttactttttcccatctaacattgacacaccttaatattttacctcaaatctcttttagcatttttctcttaaataaaacattatagattaagctacactatccacaattctgaccatggaataaattctttgatgtttacacttccattctttaacaacaaacacatacatgcacatgttctgtaattgtgttctgtatatatgtacgtctgtattatacaattatactatatatatttcatatttgctttttataatttggcatcatgttaagctcaaaccatgtgtgtttatatagatatatataaaatatagatagatcattctagtttattctttttaattaatacaaatatttcatcataaggatactgcaatttgttcattcttgcttttatgtacaattagtttcccctctttatgtggctattaaaaatacactgcagcaaacttcctgaatatgtct

SEQ ID NO: 36323 - DNA, 819 bp, Bovine  19866881845178
ttctttctaggagccctgctgacacaattaggaagaactagagatattttgaaacaaatgtctggccagttcatcagaatttgaaaggacccggatgaaaacagatctcctccagtgcatgggaacctgtggcaggctttgaagctggttagctgcagctgccatgagctcccatcagaagcttttttgaaaacatttccagcctaagacaattggtttactgtctggagctcccattatttccaaggacccgttctagccagtggtgaacttcctcctggatctggtagtgacctcatcttgccagggctgataccaagacatgtcgagctctctgcacagtgagcaggcagcggacgttgtggttgttcagtcactgagtatctgactctttgtgactccacggactgcaacatgccagactgccctgtccttcaccatattgcttcctttatcttagcagttgaacaggtgagaatcataagatacacgagaaccgtcggtgtactttagaacattctcagagctgctgtggagaaggaaatggcaacccactgcagtattcttgcctagagaatcctgtggatggaggagcctggtgggctgctgtccatggggtcgtacagggtcagacacgactggagcgacttagcgttcatgcatgcattggagaaggaaatggcaacccactccagtgttcttggctggagaatcccagggacaggggagcctgatgggctgccgtctatggggtcacacagagtcggacacgactgaagcgacttagcagcagcagcaaagccgctgtattctacaaca

SEQ ID NO: 36324 - DNA, 1307 bp, Bovine  19866880382484
cctctgttgttcccttctcctcctgccttcaatctttcccagcttcagggtcttttcaaatgagtcagcttttcacatcaggtggccaaagtattggagtttcagcttcagcatcagtccttccaatgaatattcaggactgatttcctttaggatggactggttggatcttgctgtccaagggactctcaagagccttctccaacaccacagttcaaaagcatcaattctttggtgctcagctttctttatagtccaactctcacaagtggtcttttgttctgggtttattgcctttctcctaaaagttacagctaattcatctaaacagtcttttctctcccctccaccggacctgggttcctggtgtcaataaagatggaagaacagaagagactcaaagaatggaacaagaataaactctgtagccaaaacaaagatagcagccatccaaacacaagtcaaacttgtgtttcagttgacttcgtcctacatagagagatacccctcaaaacctctcttcttcctccaactgccaatattgttatttcagagcagctggcactgggtctctggcagccctgttcaggcctcagaagccactggggatgggagaagggagacacagcaggagaggtgggggccatctttcttccttcatcagggaaaaagcttggacaaaaggcagcagaacttagacaaggctttctccttttcatgtccagggtagcaccaagtcaggtcccaaggtgagactcaagctcatagctatgaaaactagatccaggtagcagagtgaactcatggggggagagcaccatctctgatcttgccacgcatgctcactttactcaggaaaagtgaaccaagggtcctggatggtactttaccctccccattctgaaccaaaggagtttagaggctgcccttacaaacctctaggtccctggacctacctctctgctgtccaagataagctaagacatctagtaagtgatgaataaatggatgaatcaatagttgcctctgggtctttcaggctgcatggtccacccagggttagatctttctgagtaagtccctagctggtgaggataaaggctgttcctctcaaccattccgtggaggcagctgatcttatcaagccttatagctaaataagcctcatctagggacactctgtaacccctgagccgatcctagtccacccactcaggacatgtttcctctactgggccgtccaacctagccctgcccttcccagcctggttaccccttcatccctatacctgctggcacatacccag

SEQ ID NO: 36325 - DNA, 1133 bp, Bovine  19866880461854
ctccttggccgcttcgtcctgtggtcagtcaggcaggggataatcagagagaggtgagggagggaacaccgtcacacctctccttcaccacgtgcaccacctcccacccctgcagaggaagctcttgctaaagtgtacacgaacgttaaaacatgccttctgaaaaatctaaaaggacaaataagtattgcaacagaagcggcctgactgctggctctcacacacactcagcgggaggcctcgtccagggcggggagcacatgcaaaggcagggaaacttggggagtgtgctcctcacaccccttggaccccagcgcccctgagccgggccagcgctgagggctgttcttcagggcagagagaggaggttcggtgtttgtaccaggtcgtcgctcagcgtcttcatcgtgggctccataaccacatccttcactgccaccatctgctcctcgatggccttctcctgcacttcattaaacagctacaaaagaccaaggccgagaagcagaagatgaaggagcagccgagacccagccactagttactaaaccatttagcacacgctccgcgtggtttaggagtccatgcactcgtggaggagcaggaaaacagagtggagacaaggcacactccaatcaggggtgcctctgggagagaatgttacagctgaagccccctatttctgcgtgtgtgtgagagagagaagatccgaggcaatcagaaccaaatgttaacatttctgcatctttgggcagaaaatgggccaaaaccctgccctcggctgaggttaccttcacaaccttgcggatgattcggttgaaaagtcccatcaattggcccgagggcagctcgatctccttttccagctggtccacagacttgtgctgcaggccaatccccaagagaagagcctggggacaggaaatctgttggagtggctgccagaacaggcttttatccattaaaatggcactgagaaccagagttactctcccttggtcaaaacgttgactggcactactgggaaatcttcccgctcatccaccaggaagcacgccttcctcctgaaatccccagactaacttcttatcccggcaaacagccgcttcacagctgtgtgacaatacagggtg

SEQ ID NO: 36326 - DNA, 1443 bp, Bovine  19866880464263
gtaacagggtgcccttgatgggtttcaagtaggagagtgatgtaatcagacttgtctgatggcttcagaacgatttaccccattagcgcctttcccgggggggaaagcctgtcccctggagaggaaagtatgaagagaaaggattggaattgcacccgccccttcagagcactgtctgctcaaactttccctgacctgtccaccatctgaacaaaggccccacggccagctggagaggggccttgttgattactcacaattccctttccaagaggacaggcgttgatatgttttctcttgataacactggctcctttcgagcaataggacttcctgtctgatcagagagcaattactgcacctccaaagagaaaacactttaaataaatccagttttagccctccgtccttgataatggagacgtttgctcactaatcaaccactggccctgagtttaaggaggagtgggcatttaggacaccctgtaaaccaaatcaatgtttccggatttgtttggtacaagagtccaatggccaaaggagcctttccccagggaatctggacccctctatgccagcctgggcatggagcttctggttttcctgcccccaatcctttcagtatctggggccagggacctgtgaagatcaaggccaagatttggtccgcctggggcaagtccaagcttattcaggtcaaactctgtgcggcttgaactgtttacattagggggtcacgaggaaatttgcatgaaggaaggttgtcaccccaatagtcatcattaaatactgcatttttccccaccttgggagaatttattttttttttttgaattttttacaatttgttgcttctgttttatgttttttttttaatttttattttatttttaaactttacaaaattgtattagttttgccaaatatcaaaatgaatccgccacaggtatacatgtgttccctatcctgaaccctccaccctgggagaatttaaaaatggaaaattctacccctaaatgagcattcctactagagatcattagttggcttaactgtcttctttccagtatctgctgggctatgcctcaccccttgcttgctcttttaagaccatcagaaggataagaagtggacaataatgttagttaacctttatatagcacttgcagtgtgccagatactgcaccaagcacttctcatatacttagttgtgtggttttcccaaacacctctgtgacatgggtactctgtgacagaaacttgctctctctcttttttttttttcttggctgtaccacacagcttgtgggatcttagtttccccaaccagggattgaacctgggtccttggcagtgaaagcctagatccctaaccactggaccaccagagaatttccaagaaactttctaaagttcgaatagctgatacaggcagagccagat

SEQ ID NO: 36327 - DNA, 909 bp, Bovine  19866880516985
gcctggaaaatccatggatggaggagccggtaggccgcagtccatggggtcgctaagagtcggatacgactgagcgacttcactttcacttttcactttcatgcactggagaaggaaatggcaacccactccagtgttcttgcctggagaatcccagggacgggggagcctggtgggctgccgtctatggggtcgcacagagtcggacaccactgaagtgacttagcatgtgttaaataaagatactatcgccaccttgcggccaattgatccttgaccattaggaatgtgatgaaattgcaattagttgagcctgcctggaaatagggaaggtaaagagtctagttaattttcttctgctgcttaatgaaaggtcaagccaagtctctttctgtccacttttcatggctaccaatctttatgaacataatattttgtatcggcctggttcctgggcaatccctgaagatgttttagttttctttttctttctttctcatttttttaaaaatggactcaacttacttccttggtactcactctgcttttcctccaatctctgattctagcgtgctagaacttctaggtatggaaaggtctggttagtagaggatctgggttaacagttgtagttaataaaatatcgccacgtgagtcctatggtggggcaggacctcagaggtcatttggtcccaatccctcgcccctgtccttgaggccccacgctctggacactgaccttgtgagcggatgctctggaggataaagtacagatactccccacagacgccggccgcctccatgaactcctcctgtgtcatgccgcacagctgcaggccactgatgttgaaatggcagaaagaaatgcagtttggcgtccagcttgtactggtcacagcagaactggag

SEQ ID NO: 36328 - DNA, 1083 bp, Bovine  19866880591879
aatgagtataggaaaactctttgatttgaaataaatccaatggtttatatgtttcatagacttttgtatgaaaattaaaattgtaaacattttgcagtgtgtttgtgaactcaaatagttgagatttcactactcacaaggtaattatactagctaacacattaaactggttttagaaaagactgttttgtggttataagggtagatagtgggagaaaagcaaaaggaacaaaacagaacttaacattgaatattttcatcatcatttctaacttgctttcttgttttcttttatactaaccatgaatctggttactgccagctgttgctatgtcagtcgaagactcagccagctatcaagtcatgatccgctgtggagaagacattgcaaaaaatactggctgatatccgagtgagtatttgggaaacatgtattcttgaaattgggctcttggctttcattagtgctagtctgtcttgattctcctctctaagccttgtctctttaacacctttgatggctcttcttgtgcctgccagtaaacgcaggtgttctccaagcttctgttcttggctaactgctcttctccctctgtgaagtctcctgcatgcactgctgcaatttgtagagatgccttgtatacttctaactcccaaacctgagtgtccacgccagacattgccactgaaccccagatttgtttgcataactgtctgctagactttccactggatgacccacagggttcaccaaattcagtaaattttaattaatttgatagaataaaagtgtacatgacagaaggtgggagttggaaaaggtgaaagaaagggtaggattgctaatatctttttcttaggttgaggggagtcaggtggtaactgaagttgatgaagcaagaaacagaggtttaaaaatattatttaaagctaagctattgagtagaactaaaaataacagagcctctaaacattggaaggagaaagaatgaggaagaaggaattttaagtattgcttcatcctgaccttttattgtttggggtatcagtagatagatataaaattcataaatcaaaaactag

SEQ ID NO: 36329 - DNA, 1293 bp, Bovine  19866880596914
ttcgtatcagaagcaaatgcctctggttccccaatttgaaaaatgacttaccactcccattccggtcttaggattcctctttggtggctacacttcaagtttcactgaattattttccctttgttttatgtccctttgtgacaggacaaagatgagtcatattccacatttgccatgtaatcagtatttggcagtacccatatgtatgagaagacattttcaaagatgaaatatgtaaagtgtcatagaagaatggcatggtgaaaccaagaccaaaatgtgggttttagcaccccagagctgacttttagtcctaaggctgtagcctgggtttatcaccagggagaagaattttcagaaggccagaagaaagtggctcctcactttctgagcacagtcaggagtgatgctatgctatgctaagtcacttcagtcgtgtccgactctgtgtgaccccagagatggcagcacaccaggctcccccgtccctgggattctccaggcaagaacactggagtgggttgccatttccttctccaatgcatgaaagtgaaaagtgaaatcgaagtggctcagtcgtgtccgactcctagcgaccccatggactgcagcccaccaggctcctccatccatgggattttccaggcaagtgtactggagtggggtgccattgccttctcctagtcaggagtgaagctctctataaacatcttaaatgaccatgtctgtcttcacaggtgtgaaatcccaactagcagaggaccctctgatttgtgaaggttccaggttaaactttgaaatatcagccccccaaaccccctcctcctccattttgtttgcaaatgataagacagatgtctggagaggaggagtgaccccatcaagaacactcagagcactgcatgcagcagagatgacgccagcccctgggtccggggccgggctctgctggccccctctgcctcttctctgccaggctcagtgcttgccacgcctgcgtgagaggggagtcaccgtgagaagggacaaagatgccaattttcaacaatctttccttgctccagaagtgtgtccacctggtaagaggaaagagtttagagggagaggatactcttgcccggctatctgagagggccatttggaaaggctgcccatgggagtacagtttctcctggctacagccagagttcatttggcttcttgacaaaccttcggacagaggaaagagagctcacctttggaacttctgtgaggcagaaatattcacagctaacactgtgttcaaatatttaa

SEQ ID NO: 36330 - DNA, 1220 bp, Bovine  19866880601514
cccttttctggcttcatttaatgcatcagcacttttcactaacatactctgcatttcatgactttgtgtttcttagcatctgtctcctcctctagcatgttacctcatgaaggcaaggatttctactggagtgtggcacacaggatgccctaatacaagtctcagtgatcattatccctagctctctatcaagctgatttctctggacgttcgtcccagccctgcaccatctgggacagcctccagctttccagtgaggggaagctgaatgcccgttacaaatgatttacaaggggtgcctgggaagtctctgagttggccatctacgtagacggcagagtgtgattcgggaggaacccgcttcttagaaacacagctgagtgggcgggtctcaggcctgggacagaacagactgaaccaccggttaccgcagtcgcacatcactgtggactcgggtcctgagcctgcctggcggagcactcggaacgcacctggtcatccatggtgttcaccccgtcggggcccagggcttcgatcgcctggctgatgaggtcggtccttccgcagttgagcatgcggaagcccaggtcctggttgaatttttcagtagccgctcgggcatccagcctccggaaggaactgaaacagcattcgggtctgcgcagaggagaccaggtgttcaagtctggttgtttctgctaggacatggcctcgctacaagaggtgactctgctgtgctaggccgatgtgaggcgtgagcatggtgtggacggggaggacagggaattaccatctaatcggctgtgactggccatgtcatgctgggtgacaggaagagcacacgcttcggcttttctataaacatgctaaagaagtgctctgagctcttgggagctgtcaacgatcagaaatgaaatcccccacaaaatgatctctcaggggactttctgaggtggaagaagctctggttggggtttgggccacacagagtactcggctgtgtattttttttggacagagtaggctgtacttgttctcaagaatggtcattgaggccaagttccagtcctcgatgctccatcctctcccctccgtgcttcctggtgaggcccggaagcaccaaagaaacggcagagagtggaccagactcccaggtgcagccaagccatcctaccaaggacagccaggtctgcagagggtgagccacgggctttcgatag

SEQ ID NO: 36331 - DNA, 1176 bp, Bovine  19866880605207
tgagatttttccaggcaaggatactggagtgggtcaccatttccttttccaggggatcttccccaacccggggatcgaacccggggtctcctgcactgcaggcagactctttatcgaacccgggtctcctgcactgcaggcagattctttaccaactgagctacaagggaagcccctaaaaggccctagcaacacaatatttcagatgagagtttgcagctggaacagacttttccaaagaaaagacaaactttattacaagcgtgagtagagaaaaatttgttttctagaaaaattaaaatgttacaggtattaatgtagatagcagccagaaactggagttatctctctgtcaccacttagctagacaaaccaacaagctgccaccaacttcaagaaagctgcatgtctacaaggatccctgacaacacagggtacagtcaccaaactgctagaatccaatggttaatcaaacaaaacaaaacgaatctctcctacctatccttaagagggcgactttgcctcctctgcaaatacatatggtggcccaagaaagaggcatgccaccagctgtcaagggtgtaaacagcgccatttcttccaccattccaggcagtcccaagcgctgaaggaacctggcatttaaccacccctaccagcaaccggtgtttatttttggaacagacgcgggcaacttgggaaacccaaagcatacaggagggaagatggtcacctgtatcgcaacaccggaagtcagtaccaaaacaaaatccaacatgcaaccgtgaggaagaaggctgaaaacgaaacaattatacagcagagaagattgaaagtgagcctgccagatataacgttgccgcagaagtcgcacccaggggtgagggggtcgcccggctcctctcccgcgtcccactggcccactttggcgcccgactccgaaggcctccggcccaggcagagagaagagggctctgccgccgggacggagactttttcaaagcggccaaggctgcccgggatcgggcagagacgcccgggggtcccggaggtgcgggccgcgggcgtccgcgggccggcagcggggagtagtatctccccgcttccaactgggcctcgctgaggcccgggagagagggctcttgtcgctcctcaggcctgggccccggacgcgag

SEQ ID NO: 36332 - DNA, 2619 bp, Bovine  19866880622774
catgtacggatgtgagagttggactgtgaagaaagctgagcgccgaagaattgatgcttttgaactgttgtgtctgagaagactcttgagagtcccttggactgcaaggagatccaaaccagtccattctaaaggagatcagtcctgggtgttctttggaaggaatgatgctaaagctgaaactccaatactttggccacctcatgcgaagagttgactcattggaaaagactctgatgctgggcgggattgggggcaggaggagaaggggacgacagaggaagagatggctggatggcatcaccgactcgatggacgtgagtttgagtgaactccgggagttggtgatggacagagaggcctggcgtgctgcaattcatgcggtcgcaaagagtcggacacgactaagcgactgaactgactgactgaatagtcctgaaaactgtgacttaaaatagggatctgcaaactatagtccctgaaccaagtggccctccgtctgcttttgtaaatagtttggggaggtgggggacacagccacatccattcttgtacatatttttttacggcctctcatgccacagaaccgcagagtagaggaatagtgatagagacattatgacgtgcaaaacctaaaatactgtctcatcctttacagaagaacttttccaaactctggcttaaaacaaatgacccatacccatcatggttcagcagagggctctgctcacagcactcagattcaagctgatagagaaaccatgtctcaactattgctaattactatgccacgaggagaaggaaatggcaacccactccagtgttcttgcctggagaatcccagggacgggggagcctggtgggctgccgtctctggggtcgcacagagtcggacacgactgaagcgacttagcagcagcagcagcagcatgccacgaggagaaagagcttgagggtttctcaagcagttggatactccagagagtagacttgggtcctgtgtgctcacacctcattagctaaaaagaatcacatgaccccatccaaccaagagatgctatcctatcagatgcccaaaaggaagccaggtgaaccagaaatacttggtagacataatagctgttgtgttctcacttccaacagtgttatcccagtcccatgtccttggttttctgacattcttgtagttgtttattcaggtcagcaggtccagaaagataaagcagtgtctttaacctcactcagcccaaagccaccatcccagcaaaccaaatttgcctatatcccacctgccaaaaaggcaactgaagctacatttatgtgaatttttaatactttgtctttttgccttttcttctgctgaagagccacgtggtacttggagttatagtatcactgaagaaataggaaaattaaagggttttcccggtaagccagtgggagagcagaatatgtctataaatggaaatactttctccaaaaaccctggtattaaagttatacccaatattaatatgttttaaaaacacagatctcccaagttgaagttcatttgtttaattcattagacaatagcactctgacatctccacagtctagagaagtgaataattgaaccacttaccctgatcattttggcaaaatagttcagctgcttcaactcacatcacccagtaagctaatgtttcaagcttctttgttgcagaagagaacttttgtctgaattattttaactgattttctgtgtcaagttgacggaaacctggccaagtgtgaaccaccctgctcacacagctaggattcttatttttcagtcatcttattacaagtcagaagtagacatttctatcataatttttgcagtacattctttttttatgataatataatttgtctgtgtccctgaactctgagctcttcaatggaagaaaacattttcatctctgtatctgcagaagcaataacatgcctggcacaaatattttgtcaataagtattgcctactagtatgtcattgtatcactgcaacatctatcactggtccatactgctcttttccctcttctattgtgataatcttcttttccacttacattttctgatgtccgctttttcttaattgtaatgttatgtttcaaaatccgcttcttatttaacagaggtacaatgtgtccagaatagtttttttcagatttcacaaaatagtgttgtttcttattgaacactcctagacgcgacactgttttcaacataaaaagcaaaaatactttgaccacaggcattaaaatattctgtatggccacttaagtgaattgtacattcttttaacttgatatttctatttcaatggttctcaacttgtaatattgcccccctaaagatatttggcaatgtctggagtataagttgtcacagcttgaggtggaggtgctactgacatctagtgggtggagcccacggatgcttctgaatatcccgcagtattatcaaagtccaaatgccaataatggggaagttggcaactctgttctattttatgagacttaaaatgcagtcgtttttgcagtgctttacaagtaaaaatatgaaagacatggcagaaaaaaatccttagaaagt

SEQ ID NO: 36333 - DNA, 1250 bp, Bovine  19866880677156
tgctgtactgctactactaatagtagctatatactatagtagctagggcttattgaacatttaaaatgtgctgcctcttttctcatagttttaaatccattatctcagtcaatactcacaactgctctgtaaggcattatgtcatttagcagatggttcatctgcggctccaagaggttgtgtcacttgttcaagctcacacagttttgaaagaactgaaactagcagagaattcaaactctgagtgtctagcaacaaaccctgggcactttctgctgagatggggtgctttgccacagaggaagatgccctcagctcatcctcagccccagccccatcctatacatcgtcacagcattctccctgtgccacctggggcctcacacctttaccagtttctcctggatttcaaagttctctgcgtccattcaatcatgtagggaccctgattgaaacatgtttctcttttgccagagcaacctgaagtcatctctcttctcaatatatttaagaattctttttagaataaaggggagaagtccgttatcatttttccatacctacagtatattcaggtaggaatatttagggccagttttatctatgatatactcttttagccattaaaatagatttatgtgtgctaagttgcttcagttgtgtccaactctttgtgatcctatggagtgtagcccgccaggctcctctgtccctaggatcctccaggcaagtatactggagtgggttgctgtaccctcctccagggtatcttccccgatcgagggatcaaacccaggcatcataaaaggagtatttatatattcaagcaaatatattaatctatacatgcaaatacatgaatatatttgcatacacatatgaatattccttgtatgattcaataaaacaatttttagtttatattttagaaataaaccaatccacagtgctttgtgcttcatctggattagaactgaattagttcaaaaagtagtgttttcttctgttgggagggtgaagatacactggaagccaccagggccacagagcagatcataagcagggcttcgcttgcattccctgctcccagccctaggggactgagagtcaaagccacaatctgccttcttcccagatccttgattcattcaaccacatcatccccaaactgcctcagaatactgtctcatgtgggtatttttactcctcaagcccaaggagcaattaggcattttaaataatcacttttg

SEQ ID NO: 36334 - DNA, 1366 bp, Bovine  19866880692567
cctgtgctcttggccacaactgcttaagatacctctaaacagcttgcttccttcttacaatttaaatgatgaattttgtctttgtgtttacattcaactttatcataaacttgaggatcacagatcataactgccaaaacattcccagggaaccgagagtccggatccctgagggttcccagatggctctggcgggtccgagatgccgaggccatccagagtgattagggcagagtaaggggctcatccatcaaggagaggcactttgctgctgatgtggattcgtttatcccccttcctcctctttgtctctttatcctgcctcccgctcccagccctgcacacaggcctgatgtatcggcatctcaatcacttctgcttcccctagagatcaaggcccggccttgggccctgaggcctcccagagtaaatcagtaaattgggaggaggggggcagagaagggatcaaaagaaagtggggtcctctctgctgccagctacctgtcatgtgccgcttctcccgggcgcgggggaggaagagaaggagctggcctgagggaaatctggaggggaaaggtccttctccagccctagaaattaggtctctgaaacccatcagacgaagaaacccaagtcagggagaattctgttcttaaaaagcatattaaactgaatcctgtgttttccaccctttacacgaggccaaggtggaaggcaagcgtgaattttctaaacttcaactgtcagagctaaggaaggaggaaatttccacattttctcagctgtttcaaaaatgtatttttaagcattcagatgaagtgattgttccaaaggacctcttctttcaagggatataccttgctctattttgattatttttcctccccctttttctccagcctctgtctttttccactttcccctctcccaacaagagtctccaggggtttcccaactggaagctctcctctccatggcagagcagtctcctagccctcatctctccctgcagctcctctttcccctcctggagatggacctgccctgggtctgggcagctgagaagacaggtgctgcgtttgcctcgaccaaaccgctctctcttggtttagggctttgctacctggaaagttcatgtcaaggggagacgagttgcactctgccttcctgtctttgttatctggggcacaaagactgttaagttagctaatggctggcctcttgcggctgattagtgctgttaaccagcctgagcagtctgaatcaggacaagctttgtggcaattagtgatggatggcctgttgctgcttcctaggggttgtgtcagcaggacccatgacttgtggctcaccagctttggggcct

SEQ ID NO: 36335 - DNA, 1831 bp, Bovine  19866880695201
cgaggcctaagcgtccttaatcgagggacagctgtcagcagagttcagtgtctcccaggaagaggtctgccttagcatctgcactgttttctgtcatctgggaagtgtggcctctgagtagacagtccaagaagctcgttcagagcaagcagctggggcttcccgagcttggaggtctgcgaggtgcattctttgggccataatcctctctaagcagcctgtgtgctctcctgtccgttgttctaagaaccctggagctctgccagcagacccagagccacgtcgacatgaggggtctggccgggcactgtcccgcaggctggcctcctgactggcctgcgtgtagcagctgctctcgggcactccccgatggcaaagctggcaggatgtttgtgctcatttaacacattgggatcaaatgtttcctgtcactcctatttttggctgtgctttggtcttcagagaagggaagtgggggcttcagtttccctgctgtcgtctttgtttgaagtgaagccaaacaaaagaggccctaccctgattacatctgtcctgtctttcctggttcccccctccccaggctggagaccctgcatgcacacgtccgcacatccacatatagggatttgtatgcctttgagttctggatgggtctgggcttaggaaagcctaggtttgagtttcctggatgtataaccctgggcaaacgaccatctccaccagccttgacattcttatctataaaggtgggataataaaacttacctcttagggtcattgtgaagatttcataagacaaggcacacaaagtctttaacacgcatcttggagcatagtgtgtgtatacgtgtgtgtgtgtgcgtgcgtgcaaatacacttagttgagtgtgcacacgcactcagttactcagtcacatccagctctttgcaacctcatggactgtagcctgccagactcctgtgtccatggaattttccaggaaagaatactggagtgggtttcctactccagggggatcttcccaatccagggattgaacccgcatctcttgcatctcctgcattggcacatggattctttaccactgtaccacctgggaacctccttggagcatagtacgtgctcaataaatgatactcattcatggtgtcacctactaaacacctgctatcagtatcatcattcctgccttccattgtatcttctcgtgagaacagaggtatcagaaatttctcctgttctcaagaagcatacagactagactaagaacatagagaaaaacagaaacagagaacgaaaacttgcctggggaaagaatgggaggaagagatagttagggagttcgggatggacatgtccttgctgtatatttaaaatgagtaaccaaggacctatgcatagcacagggaattctgctcaatgttacatggcagcctggataggagggaagtttgatggagaatgaatgcttgtttacgtatggctgagtccctttgctgcccacctgaaactgttataacattgttaatcggctatattccaacacaaaacaaaaagttaaaaaaagagaacacacagaaagttgctagacagtggggctggcttgggaaattttgtcacaatcaggactgtctcattcattttgtgacttctattggagctccctctgatgtctgtatattcagtctcctgagctcatggataatgtcttagacccaacacaccataatgtgtagagacggtgctcctgggcgtggtgagtgtactttccacacactgagaaaagtagaaaagagagtactggttgggagtatataaagctagaggaag

SEQ ID NO: 36336 - DNA, 2016 bp, Bovine  19866880736662
catttatccccattagatcatagactaggaaaggtgattaaagcaaatgtctttgttctcattactctttatttgtgcatagaacctgtttcttcacgggaggggaattattgaatggagaagtatgcttttaaagcagattctccattgttgctgtatactttctagttgagacatggttcatgggagggctactatatatttgctatttaagaaaagaacaacttgttaatcagattttgctatccattcttaaaacacataggtgctcacctgagcatgcacacaaatccttgtaaggacttgaattcaggtgtaaattattgccctaattttactagagttgaatcctaagagctttacagtcttgttgatcatgagagaggaagtaatatgaaagatgaatatgaagatttctgaatcctaaacttgcagcattacgtatactactgttgcttttctttctttccccattataaaaggttgtgaaatatttgcctacatacttcggctgtcagttgtttcatcctgtgactcaagacaacagaagtttgagtctcttaatgcaagttttatgagtatctaaacagcctttttgacagtaatgcaatcttatgttcgtgggatgctgtcaatagactccttggtataatactgatcccttggggctaaggaatgaaactcaagagatgacacactgattaaaatacatgcttatcaagacccatattttatttaattgttgtggaccaggaagagccaaaaaattaggggtttgctttttttttttaattaagtctttattgaatttgttacaatattgcttatgttgtttatgtcctggtttcttggccatagggcatatgggatcttagctccccgaccagggatcgaacctgcaccctctgcattggaaggcgaagtgttaaccactggaccagcagggaagtctctatttgccattaatattcttgtggtacatcagaatgcacaagattctgaaagaagagttcatacgtggcattaaaaaagaagagatttgtctattctctcaggaagagagagagataatgcctgagaaataaatacactcacatgttctctttaaaagcccagtgtcaccttggttagtggcaagtagttcttagtgcccaataccctacctccttacacatagttacactttagcttcatcactcccttcatcacatccttcatcacttcatcacttcattactgtggctcagacagtaaagaaactgcctgtaatatgggaaacatgggttcagtccctgggttgggaggatcctctggagaagggaatggctacccactctaggattcttgccaggagaattcaatggacagaggagcctgacgggctacagtccatagggttgcaaagagtctgacacgactgaacaactcatactttgttttactagcttcattgtcttcaaggttcccatcagctgtttcagtaagtcctccagacattcattcattccttattacttgccaggacctaggctcaggactgtagcaatcaagacagggtgctgttcctacttggatgcaatcactctttagaaggtgagagatacacttcctgtttgcttggggagaagcaaatccacatggccctgaagtctcattttctccctcgttttcagggtttagcaactagctgcatcagcagatctgagtgtgctgggaggcagaacaggcagttgccagacactgagttttagaggctcttgctaaatgctgtaaatggtggcctcgcatgtcccacgcgcccccaccaaccccaccatatgtaaagcatcatagtttagggtccctctgtattgaccactctctgggatgtgtccagtcttctgcctcccagtgggacagtgaaagctgtgaactgagatggggaggaagatgggagtgggtctggaagtagggcatttttgtgtattttcctccttttctctgcttgtagacccataccaacattctgtatttata

SEQ ID NO: 36337 - DNA, 1213 bp, Bovine  19866880755296
actggtgctgagttttccagagttcacctttaggtttaatttcctgaaattgatctgcttggttactctggctttactctcttgcaaaggagggaaatggcaatgaacaggctgcattttgttacatctttacttcaaaacaattaagcagccagtcatgatcttaactccttcttttaggggtgtattcatactctgggtctgggatggaactgatatgaactttaattaaacaaatcaccaaaatgcctgtgaggtggcattcctagtggagatttcatgttcaccccccactgctttgttggtctgtttttttttttttttccctctggtggcccctctctccatctaaatcttcaccctgcttggagctgcctgggaattgggtgagccagtcctgagttcagaggtgctgctgccaactggagggaagagaggcagcccagggccagctccccaagctggagccccaccagcaggcccaagactgtcaaggattccaaagagagatgaattccagcccagtattcactgtgaggtttgctttttttaccatttcttttttttaatcatctttttaaagagaatttggttctggcaacaagcatgttgcacttcatcagcctttgatcttgccctgggtcctctggcccctggctccctgggcagtcataaaccgttactattttcacagtttaatgggaagctcccagccctctgggcctctcttaaccagaagaccaccttcagccctggtggcgttctgataacttagagtggggtgttaaccagagcatggctatgtttgcttttaatttcctgaccttgaggaagaaggggaaagggcagtcctaattggactggtaagcagtgaagaaatctcctgtccctgagcttgtggacagagccccatgggagaggcagtgtggactcgaaggatgggcaggctgagtctgaatcccacttctgccactaacttggtgaccttagccaagtgaccagtgccatccaaaccacagtgtccctcactggttaaaaggggcgagtaacagtactggccgacagtgatgagaccactcccagggtcttcacaggggctcaaatgctgcttcatctgactggtagtgctgcccgtgcggggtcagccatctccattactaactcgtgggtcaaacctgcttcccaaactcaacggggacccccactcttctct

SEQ ID NO: 36338 - DNA, 1749 bp, Bovine  19866880783126
gaagaaatcctggccccgcccctccgatctacgtgtccatggacaggttacttgacctctatgttgttttttcatttgtgaaatgggagtcatgcctacctaataagttattaggaagattaaatgaactcacgtataggaagtgcttggagcagtgctggctccccgttagattcatgtaagtatttaccactagtgttgtttccttcacagtgtttatatttgcattcatgtatgttaaatgcgtttaaagtgcaactccactgaaaaggatagagtgtgcactggcgctagcaattgaaaatgaaagcatttgatctcttcctcctctcgacaggaagcttgcacaccatgccactcacatcttccttgcagtcgattcctgtcgccttggatgtagggaggctgtttccaatcctcttatcatggtgacagtacttgactggttgatagaaaaggaagatggagttaaaaaggaaacgtttgtaagcaatccttggttgacggttggctggctgcggttgggtgccactccgaggaaacactcagcacaggaagtgacctttgcaccccttcctgtggctctccctcttgaccaatgaagtgagttgacactgtcatattcataaataccacagtccagtaagattgtggggaaggcgagatgctaagtgtgtggtttgtctatttgggaaagacctgagaaagtgtcctggggcctctgcctgaaatcagaggacaagaaagttgagaatgaaacccatcaggaatatatctgccagagacaggaaattgaattggaggtgccttatcagatgcccatcttaaccctcaaagagaagcaccaacaacccaagatacagatccgcagataaggttccatttacgactggaggcttgatagctccagacccctgggtagcttagaaccccctggtgaatctgtaatgtgtctgggtaataaaccaactggcagaaatgtcccagctctcctgattggggctctgagtaccaggcttcagtaggtctggtttctgagggctggaggctccatagcattagctggtcacagggagcatcttgctttgcttgctgcccccagattttcacaagcactggcacaagttgctgacagaaatagcaggcaggccaagttgatttcaggccttagtaatctttccggctgtagtcagcccctctctggggcgtggagaatcagcaggccttctcacgccagagatgtttatgcaggaatgcctgttgtcaagtttccccggtagaacgtccactgacaggtttgaatttatctaggtttccgataggaaggtaagagtttaattttagtaaagtcagggagagattttgtatttttgttattgtagtaaaatgtacataacaaaatttagcgttttaaacataaacattttcaggtgtacagtttggtagcattagactcactcaatgatgtacagctgtgaccaccatccattaaaaattatatttttgatggacgcctcatggcataggaaaatgctccccaaatgtccagagatgggagacaagagggcagagacaggaccctgtatgctgtggtccacttctaggaaaatatacatggaatgtcttatgtatgaaactaggccaaagtgttatcaagtgattatctcaggatggtggaaacacacatagttttttgttttcttccctatactttctgcgatttgccaaattttatgccctgagcataca

SEQ ID NO: 36339 - DNA, 1626 bp, Bovine  19866880806502
tgattccagcttgtgcttcatccagcctggcatttcgcatgatgtactctgcatataagttaaataagcagggtgacgatatacagccttgacatactcctttcccaatttggaaccagcccgttgttccatgtccagttctaactgttgcctcttgatctgcacacaggttttgcaggaggcaggtcaggtggtctggtattcccacctctaagaattttccacagtttgttgtgatccacacagtcaaaggctttagcataatcaatgaagtagaaatagatgtttttctggaattctcttgctttgtctatgatccaatggatgttggcaaccataccattaatgccttataattatggttttgtctaatatttataacccttttcctcccccactcccactgtattaattgtgttttttattttctgtatcttatgatgttttgacatcctaaaaatcttgctgactaaaggcagactgacctcccaggtctagctagtttctaaagataacaaacagcttggacacacctctcatatgcaagccaaccaccccctttatctaactctcacacacagagccactacttcccctgccctgtgtcatctcagggtcaggtaccaggcaatgagagaacaccccaatggtccgaagacccccatttattgttcagatcagccagtcccaagctgtttgtcctgggccaggaagatcccctggagaaggaaatggccactctccagtattctcgcctggaaaattccatggacaaaggagcctggcaggctatagtccatggggtcacaaagagtcagacgtgactgagcaactaacactttcacttcacttttcaagctgtttactctgccctgcccaatgcaaactcagataaaatctctggcctaaatttgcctcttgctcctgcttctgcctcctgacccaaacctgatgcttccacggggacccttcatggcatggtgtgcctctttctctagggaaatgtaattaaaaaaaagaaaaacttctttccatggcattgaccttgccatggtgtcactcagtcacctccataaactgaaatcctacagtacgaatgagagacccacccagcaaaaacccaaactgaagcaaacaaacaaaaaaacccttgtgcttacatgtcttacttccaaactatttgtgcacatatttagaccatttactgaattagattcaggtcagttattccctgtctgtctctctcattcttaatcgctcagtcgtgtctgactctttgtgaccccatgaactgtagcctgccaggctcttctgtccttggagattctccaggcaagaatactagagtcagctgctacataccagtctgtaaactctgtcttttacatccttattacccagggtctagtatgacattcaataagtagaaagtttaaattcaggttgaatggataaagacagacctctcatttctatttacaagagaaccgtacctgttgatacagggtaaagttcataaaggcatttgatcctaattcatgtttgtctctctttctccctgaaatgggctacttgttttaaatctaaaagctggtaggagtttcatgcatgcccagtcacttcaat

SEQ ID NO: 36340 - DNA, 969 bp, Bovine  19866880811524
cccgatggcctttcagctttgtttctaagtgctcacaccccaccacttgaattataatgcactcgctgtactggccaagggtcatgtttagctccataaaattctgtgcctggccagagacagtcctggccagaagctcatgagtaagaactattctcatttcccttccacaagctgggggaactctagcaggatggtgctactcaaatatggttcagagacaacacaggcatcaccctggagcttgttggaaatgcagaatctcagtcctcaccccaaccaaagcatcagaatatgtgtcttaataagctacactggtgatacacacgcatataaaaattcaaaaacggctcttccgggttgtgcgaacaccaagctgtttgaagctcagggaatctatgcagaaagttgaatacttactgatctgggtctggaaaactttatccaacaacttttcatgaaattaaaccttaactaaatctgcaagggctaaaaaaagtttgtccaaaattttccaagtcattatgattaataccattttcaaaatctgtgtcggccttctctctctggtgaatgctccacactcccctctctcttatctacttcatgtttacacattggtttggcaagggggtgtggggttggtcaatatcaatgagctctggccatgattagaggctcactcttagaaaaatcaatcaactttcaattaacaattaactttcacagcaaaaagtatttttaaacctagacctgtctggcttacacatcacatgaggccatggaaaatcagataaaggataaggatagttaagcactgatggactctatagatgtagggtttgtgaaaatgaaagataactcatctctttgaggtggactagctcacaagagcttttcatgtgacagctggcagctggaatcagcctacttttgaagctctgattcctcactaagcaagaaatcatg

SEQ ID NO: 36341 - DNA, 1688 bp, Bovine  19866880846777
acttgtcctcctctgtgcctcagttactttatctttaaaatgggaataacaacagtatctacctcactgggttgctgtaaagagtatgagttactatgtataaagtgcttggcccagctaagtaaggatgagctagctaattaaaataacacaccaccaccatcacggctgccatgctacactgacatatccacatccaccccaggccctgcgctggtaaatcaccgtgtgaactgctttacatgcatcatctcacttagtgaccgtaccatccctattggggaggttctgctattatcccggcttcacagatgaggagcggagacggggactgacttgcccgacagtcacacaatttgtaagaggatggactcagatggaacccaggcctgcatgagcccagaagctcttctccctgaggcgtctcacacagggtgggagaggttgacgtgaacgtctcttgctgtgagcagttctgagcttttctgaaagctgaggcccaatccctacccgaatttaggtgggtggttaacagagccaccccctggccgggaatctcctctgtggccagtaacagcaaagtccgcagtggaaagcactattccacagctggatgctggcaagcgtttgtctggagtcccgcgatgttatttattaggttatttgtgtgtagacaagatctccttacctcataaatccttgcctagcgcccagagataaagaaatggcccgagattaatcatggctgagaggtctatctaccccacagatcattctataaacaccgaggctgagggaacaaacaggactggggcattgagagaaaagccactgagtgagaacctgactttgttttattcccctcggcacaagcttgacttctttattctccacaggtctgtatgtgattcagactataagccatcgacacgtcctgtaaggaaaaactacttttttttgcatgttggtccctccccctaaagaggttaagtcaagagacactgatgaacagatttcagggataatcatcctatcgacaccaacagacatggaggcacctttatggagcatttactaggtgtgatgcagaagtctagggggcaggcaacttgttatcccacaagttggaggcgaggagacaggctcaggggtaaagcagcttgtccgagctgccacagctacgatgggaggactaaactccagccctgtgaggctggcatccatgggcttccccaccctgctgctggaggaggaagacatctcccccaggatgaaagccctggagctcgcgtcgacagaggcaccttggggagatatgacgcccagcctgtcacctcccggagccctcctgcagcaactccctcagcgttcgtggtttcctgtcccagcacatgcctgactgtcccgccccgatgctctggctcccagcatctcccttccctgggatgccttcccccactcctctctgctgcatccacctcccactccctccctccagcacgactcaggaagaatccttccctgactgctcctgcctgacttgccaaagtccactctggcttgggttcaccaggcacctcatcacagcctctgccgtgtcagcatctcatccgagggtgccacgtgacctctacctgacctctcagctgccgtttaacttcccccaatctttcttgtggacttctaaa

SEQ ID NO: 36342 - DNA, 1072 bp, Bovine  19866880893709
agggcagggagggggcggcggcctgggggcggggaagggacaccgcgcctctctcccccggctccctcctatcttgggaaggtctattttcgctcagcttccctctgtctctggtttcatttcctttttcctgatcacgattcaaatacaatagaaggaaatcacatttaaagagacagctgcccggtccgcccccccccccccacatcttttttcttcccttttttttttaaacggggctcctggggattagcgatacaaacagcggcagccgcagcaagactgagttggcttcttaaaggggcccagcgtcggggacagggagactcgctcagagaacacctctccttggagaggcggctgggttgcctgtaaagcattctttagggctttccctcttcggcgttccccttttggttaactaagattgaaagtgaccagcgggccgctcaaggaagaaagaaaaaacgaaaatgtgaaataaacacatacagagatgtacgcgttccaagtggctttcgcgcgcgtccggggttggaggtcccaggtccgcggtcagggaacgcggagatgcccccaagacagcgcggctctgctggctgaggacttgtgactgcgtccgcgctccaaaaagacgacgggagctgtgcgagcagggaccgcacgggctgggtacgcctgagcagtaccaggggcagctaatcccgagggagggtgtttgggagggaccaagctggtctgagtctcctctccatctgctggcggcagaattccctccctcagcatctttaaaaatcggacccctgcggttaaactggcctctcctgtaaagggccaatagcactcttcacagagaaaagtgcctctccaatgatggaaagcaacgcttagagactattttgccctgggtcaggaaaagagagagaaagcagacttgtttagttcaggtttcccctctaatctcaagggcaaattccaagaagcgaagggaatgtagaaggggagaggaggaagctaatagtcttctcttcaatagagcaaagctttaggtcccttgggcctcatcagagtt

SEQ ID NO: 36343 - DNA, 1227 bp, Bovine  19866880916006
ctttctctagttgtggcgagtgggagtcgctcttctttgtggcgcacaggcttcttgcagcggtttctctggcttcagctttcgttctagagcacaggcttagtagctgtggtgcatgggcatcgttggtccatggcatgtgggatcttcctagaccggggattgaacccatgtcccctgcattgggaggtggactcttaaccactggaccaccagggaagtccaggtattgttaatactaacttttgctatttgaatgcaaggaacatagactagctcaatattttacctcaaatacatcgtattaagtcatgggaatttcttttttttttttaatattttacaggatagatttatgctttacaaaactggacttatactacatgggaatttcttattaccttgccatctaacaatttgtcttcttctgagaatagaaagtagtattggatttatgaccatagttcctgagccaagtatgccaaaggttatgttatccctttctagtaagatacttgtgagtttgcatctccctaccccctctcactcccactcaaagttgttttgttcagggatcctgctggctcacctgcagttttaggcagatgtgtttttcctttgacggtttaacctggaccctctgcctccccagctcccacttcctgcagggtcaatggctttagcccagaggagacagtacagctcaccccgatgtcctggggccagggatgaaagtcctgaacaaccaatcttatctctgctagagtgagtgacctttctttagctgaattgttggttgttccccactcccctgtttttctacccaaaatagaaatgaacaacatcagactggaccccaagaatgtctttacaatggggatttttctcctttggcagaagattgaaagcaacaacataaaatctagatgccgttgggattggggctgccacttagggttatttcagttaagcactgcatgctgctcctcatctgaaagggcaccatttacttcatagacacatttattatcctgaaaatgtttgtatgtttattattattgtttatcacaaagatatgtggtttgtatatttatcacgacttcctggcagatggcagtaaagcgtcttgttttaagaggtttagtatattttgttctgcttccatgcacaaaggaaaaatgagtcagtaatcaaaaccaataactggtctaacatcatctaaaatat

SEQ ID NO: 36344 - DNA, 835 bp, Bovine  19866881006812
gaaatgctggggagtcagaaaagcagcatgtggcacccctaattcgaggctgtaggcacttggaacaggtctccaggtgactgaaattaatgtctggccctgagtagaaggacggaaaaggagtggttgttggatctccctgggtaattttgaaatgccagtgtgcatctgcagaatgggatcataatattaagtcccttcagttggctggtatcaggactcattcctgtgtgctgggcattctcctgtgatccagtggtttgttttgatgcacatgttgcttattcgtcctgacatgccttctgctcagcagaaaagcatgccatcggatagtaagttcttacttccatcctcagctaaattcagctgctctaaaatgtgtaagacagagctgagacccaagcggatggcagtccccatctccaggcccatggcatcgaatgccagttgaaaatcaagatctcttaattcttggaaatggggtggggggtacatggggtctagttccaggggagggactaaattaaggagtgacatcaggggcctgtctagctcaatttctagcccccaccttctttaaaagccatcagtgtctttagccctagcgtgttaccaaatgacttgtcaatgtcagaggagccatgcaaagaatattcagcacgtcattaacctcattccaacatgtaattagcctaaaaggcctcttcgctgcctccattcagcgttacatcataaagaatcagatattttcaggacaccgtgaagactttaaagagttaattatgggctcagtagagcccatccccgacagcctaagatccaagaattaaacagt

SEQ ID NO: 36345 - DNA, 791 bp, Bovine  19866881010769
aacaactacccaaacagactgtaagacaggctgtaactctgactttgcagtagtacaaggtaagtccctctgacaagtctatgggaagaactgacctttgggcggctgactgcagttgctactctcctctggccctgtccccctcccccatcacctcccaaccacttggcaaggatccaccagagacccaccgccatccgaggagcaggacggcattctaatttgagttgaccattttcccagagaagcaagttgtctactgtcatgaacactgcccactcccactcccaccctccacggcataaagagccaagagcctgggggactgagctatcatttaacagtcctctggagtttcttcttccagttacacaatcaacttcctcaccacaaaagatagttaatggacacagaagatctgacaattcatatgaaaatcatcataacctcaattgctactcattacagacctttctggttgtgtgtgtgtgactcccccctacccccatcctaaggccaagtgaactcttaaagagcatctgccttttcacagtttccaaaacgtctccatctgatgaactgactccattagccggcagggaagccaagctgctgacaggaacagctcaaaggctggaaaccacaattctagggactttctgatgatccaacctagccaaggcataagggatgacttcatcactgagggggtcccaagaaaagggtttcactttcttcattgccaaccagcccccaaagagggtccctccggatcagcactagggtaatca

SEQ ID NO: 36346 - DNA, 2462 bp, Bovine  19866881072085
ggcacacttagtgttcctaggagcctggagccttggaggctgatgatctttaaggctaaaggtactttaaaaaatcaaacccaatgttcctattttacggaaattaatggaggccctgggagatgaaagtacctgtcccaaggcaacaggttagttgcaaagccacactgcgtggatcttgcttctatttatcaagggccggtggtgacgtagtggtaaagaatccacttggccaatgtgggcgacgcaagagatgtgggttcaatccctggggtgggaagatcccctgaggcagaaaatggcaacctgctccagggttctgggctggaaaaatccatggacagaggagcctggtggtttgaagtctgtgaggaagtcaagagtcagacacatctgaacacagcacagtagctcacaagtagctcaaagtaacactacctggaggctagtagtgttgggggcttggggctttgcctctttatcacctcggacacatacagccaagcaagctgagtcacctacacagagatcactcagctcagagaagtaattacatcagcaagtagagacagacagaaagccaccatcataatgaacagcccctcccagctactcttgagctcccactgccagagacaatcatctcagaactctctaaacccacaaatttgctgcttcctcaaaaggaagggccagtcctgtgatttgttccaggaacaaatctctagttctttaaagagggccctcattagagggccgcctcacagccctgccctttaaggtagtacatttaagagccagctatgaaggtatttcacaaaaaatatggggcataagtaataacacatcctgttttggaaagcctcaagcacctctgggctaggttttgtttatggcagtctggttggcccagaatttttaaggcatttcttttcaagaacttgtacctgcagctctcaaagctgaattccactagacacctgcttgcctcactctaatatccatttttatttggattttattttacaagctactcagcatagtgggggtgttttccttacagttccctgtttgaaaacacagaagccatagtttcatacatttggtccacagtcaggcaattcctttgatcaacattctgaactgtgcgtgccttccctggagaactgggaataagctaccctcagcgaggaacatggggatatgaactattaacagccacatttgttctccacttatcaggtgctacaaattatctcatttagttcttactacaccctggtggcgctactggtaaagaatccacctgccaatgcaggagacctaagagactcgggctcgatccttgggtcagaagatcccctggagtaggaaatggcaacccactcctgtattcttgcatggagaattccatggacagaggagcctggagggctgcagtccatggggtcgcagagtcggacacgactgagcaactaaacacaacacagagttactgcagttgagagtggtaggcaggtctccgctggggccccctggtatcttttaaaagttggccaagaagaggatttttaaaagaatcagctggccacagcaagaggcactttcaaagtggacataaggcattacaagaaggaaaaaaaggaaagcactggtcaaaagcaaaaccggaggaagcctcctgccccacagtcttcacaaggtgccaacaggccactctgcaatttcaaagaagtcacccaactactgccagggtgagtaaccaatcccatctcttcttcgtgtgggtagcgggctaaaggggagaactcacatgcgtcagaggagaaatacaacgttacttggtacatttccaggatccatggagaaaatcactacttaacgtctccttaaaagtcagccgtcagactccaagaagggtgcggcccaggccggcccaagaaaaccaacatcgtacttgaaatgtctaagttacgaccccaccttgctttttaaaattcaaaattcagacctccagggtaagagaagaatttccagacactcagggatgtggttataacctcctttcaaggtgcgatctgatttgcctaaattgcaagagcttcttttcagaatcgaggttcggaaggtattcccggggcgggtggcggcggaatacagggtgggtgggtggcgagggcgcgcggaacagggaatgcgtcagctcccttctcgttgcaaacaaaagaagctgggaagcttaaaggcgcgccgggaacccccggcgccgggatgctgcgggacgcgggcggagggaaggacgcgggcagagataaaggcgccgcagctcgccgtcccccagcgcggaggccggcgtggggtaagcgcgccagctctgaccctccaaacccctcagtcccgcggcccagttgctagagcagcggctcaagttctcagcgccgggctggagcgcggctccgcga

SEQ ID NO: 36347 - DNA, 1560 bp, Bovine  19866881086788
ttttaatatgattaatctaatgtaatttaaaacattcactagtcttttccagtatatttgtagaattcaaaatgggaaagggtatagaatgagccttaacaaattattttcatattcctgagggttttccctccccccattaactctttagaagggataataagcttaagagcaatactgattttttaatataacttacagtcaataaaacttcaaagagtgcttaataagaactcaaatgggatgagattcagaaactcagatgagatgaaacgatgggttttaactttgtgcttacctgtatccaattccccctaagatatattattgaaaatataatgaacaatacaaatttcctaagacacttaggaggctgaatattcaactactttctacattttatgaactggttgttaacagaacatctgttaattaactttctgagaataaatacacattctcatgtctctaagtgacgtctcccacatcacggagtcatatatatatatacataggaggttaaagaacagcagaagctagctgattaaaaatacttaacggattttgttttaatatgaagataacgatgatcagaaaacctctttcaataatattctttagggatattaagatctgaaaataaaattgccctagccagggtaatcaatgacactgtaaagctttaaaacagaagtctcattatccacatgagatgattgatactgtgcatttaaatgaaagtactttatatatggcatcttgctataccaagccacagtgccacatgtgacaaccatctcttttcaactctgctagaatatgcatttgcccacgcaaggcctcctgcagggaggataagcatcaagcatccacaaattatacagaacacttagtaccaagactcagatcttaatgggactttttaaaaagttctctgcaccacagagaggtgctcctttaaaaaatatagtctaaattgaggcataaaagttttaggtttagactacaatggtagaatgccaaaaaaaaggtataatatctcaaaaagaacaaacgattcttttaaaaacatacatagaaataatcaaattactaatatctttacacattcacaacatctgcactaatgcatagaagtttgaaacctagaaagcaattctcccccatcccatctctgaactgattcagagagaccactgtataaagaacttatttcaattcggattttaaatgtcatgaaattattttctacacagatagcaaagttagttttatatatagaaagattgtaagcacacatcatctagggattacccagtaaaccacaaatattttatctatctgcctaaaataaaacaaacatatggttgtggtacatcccaggcagatgtcatttaaagcacacaaggggaggtgctagcagaagaaatacttatttgcaaaagtaaacagataacccttccaatatgatgtaccacaaccacacatgagaaaagtcaagaacttcttttattttaaaataaacatgaagattccccccttccccaccaccctacaaaa

SEQ ID NO: 36348 - DNA, 850 bp, Bovine  19866881105270
ctgtggaggctcagatcggctgcaagcttcctgatgattatcggtgttcctatcgtatccacaatgggcagaagttagttgttcctgggtaagatgttcactgtttgggttattttttatgatacagagtattttctagaatgtaaacaaattgtagttattcttaacagattaaaggaatatgagaatttcctctcgtttgttgtagcaatccataagacaaaatataaagcttgaatttgattttgccaaaatagattatgtctcaaaagcatcatttctatcaatacatctttatagtttaaatgaagtctggttggaggtggggctatgggacatgagataggggtgtgtgtgtgtgtgtatatatataatttaactagaactgttctgaatccttgaaatgttttccttgttacaggccaggtaaattgtttgggagaacttgttgtaaattctgtgtatcatacatctaaaaagtaatttgctcagagctacgtgtacttaaccaaagaaaatctagttttgtcctattcaagcgtagcctatcattgaatagcctaatttaaacttacttccaaaagatatgaagtagtcactgtgggtccttttggtaaaagcggaacatacagtagctgtcaaattcactcctagttttaaaaggtctgttttttgaatgattctactccttttgttcccttatgaaatgaagctaattcagagactgcatttgtgacatgctaataggaatttagggagaattttgcattgttcttgttagaatttgatatctctatgtgtgtgaaacatcatgagactcttttaccattttagatcagagttgagtgag

SEQ ID NO: 36349 - DNA, 1410 bp, Bovine  19866881129407
ctttctaatgttggactggggagaagctgaattacagtagaagatctggaaaattctctgcctgtttgggtgaaaacttgcatcttcatgtgtcaccaacatccccaggatggaaattgcccaaccagagccattccactctctcaaaaccccttcctctaatttaactactgctcttttaggtcaatgtagggcttaagaggggagaaaaggggtctggaaaagacataaaaattcattcatgtattcattcattcaacagatatttattagccttgcaatgggttgggcacagttctaggaacagggagtagagcagtgattaagagttgaattaggctaaacagaaacatttatgatgatcattaacatcatcatcctggttgttcggcaaataattaggcctgaatccagcctgagtagaaggtaggagagggcaagatggggtggcaatgatgagctctgtaacagaccaccaggaggagaggcagcagagctgagttttatgaggtgatgccatagagatgagtttcgacatcagaaagagctggagtttatcccaagttccaccacttaataccagctaagttcttagctggtttgtactaagtcaaacaagttattagcctctctgaacctgtttccttttatgtaaaatacagaccattgtacccaccgtatgtattggttggggcttaagttagtctccatacctcgagcacttggcaccaaataggacataactgcatagcaggtatgttatgatgaggaggggcactatgcctatggactacctgaaccagaagtaaccgtgggcctcagtttccccgggcagaaattgaagagctagtaaattgcttttgaagttcatttccagaaatgtcttggattctcactctcagagaaaaccaacccaagtcaaactttcttttcttttcccattgagctttctagagcaatagccctaagctaagaaatcagatgggggacttgaaggcaaaagaaatcttccaggtccccagagggttggctgggagagggagagggcatggcaccagctcctgtttgctcaaggctaggcttgttccttgccagcatttgctcaactacaagcagtagaaaggttactgtttaaccctgaaagggctgaagctcagaacccagtccgtgtgccctccaggctgggggtagggttgggtgtgcaggggaggcttccctgaaattctttcacaagggtttgcctgcagggctgtttcaaagtggctatttcagtggaagtcagatctgctggggccaactatgacctacttcctcagccggctggctcagggcttctcttcaccaattccccaaaatctagaaggaagagtagggtgaggactgagcacccagctttggagttggggagag

SEQ ID NO: 36350 - DNA, 1339 bp, Bovine  19866881155006
tcagtctgagcacagagcaggaaagtacagtagagaaaggagtggcattttgagtcagagcccaaccaactctctggggatggagggtagaatcccccacttctgacacccagtgttctaaaggggaacaaaaacctccccatggggtctttagaggagactgatgacccaaagttacactaacttagtctgttagtctccatgaaaagagaaaaaaataagcttacttgtgtaacttctccagacaagactggatttatatggggccctcccttccctttgattggctatgggaaagaaaggggacactccggagtacctttgtgtaccctggctccaggcaagggcaggacaagcccttgcagaggcaaggacctaccaggaagtaaaatatctgtttggtaagtcttttttttttcctgtctgataagtctttaaaaggtctgaagtctgccgtgtaccctctgggcatgataaagttaactggaaatgagggcaactaagcacaacttggcaacagaatttgactttgctcccagaggttctacaccgtggagtctaggggattggaaatccattcattcaaattaatatttatgagcacacatcacaatcaccaggagtattttttccgcaaaatcacacatcttaatgagtttgctctgcatagtccttcagaggctactttttcctttttattgttgttcagtcgctgagtcttgtccgacgactctttgtgattccatggactgcagcataccaggcttccctgaccttcactatctcccagactttgctcaaactcaagtccactgagttgatgacgccatccaaccatctcatcctctgtcaccctctgtttatacactatacctgaaatttgctactgctaagtcttttcagtcgtgtccaactctgtgcgaccccatagacggcagcccaccaggcttccccgtccctgggattctccaggcaagaacactggagtgggttgccatttccttctccaatgcatgaaagtgaaaagtgaaagtgaagttgctcagttgtgtctgactctatcgaccccatggactgcagcctaccaggctcctccatccatgggattttccaggcaagagtactggagtggggtgccattgccttctctgatacctgaaatttaggtaacataaaaaagatgtgatggtacctgtataggactatatgtcaaactgggttgttttcccaagtcccaggtaacctcctctaatcgtttttttttttttttcctctttaagatttttgatgtggaccattttcaaagtcttaattaaatttgctacaatattgcttctgt

SEQ ID NO: 36351 - DNA, 1240 bp, Bovine  19866881161169
attgatggatagatagatagagatgatagaatggatggcagtcttgatttttacaatctaagacaagcttgatttttacaatcaagctacaagagctttccttgtagctcagtcagtaaagaatctgcttgcagtgcaggagacctgggttcgatccctgggttgggaagataccctggagaaggaaatggcaacccactccagtatccttgcctggaaaatctcacggacaaaggagcctggtaggctgccgtccatggggtcacaaagagtcagacacgactgagtgactaacactcacttacttacttacttacttgatttttaactgaaaatgccagaagttggatttgatgatgagaccttcaactgcaagagcattaaacatatcaagcatgtcattcatgggtaagtttaacagtttaaccacaaaaccattaaacataccagtctgtttatgaacacattgttaatttctcgaaagtcataaccttctcgaggagaaatcaggcaagagtctcattattccatcagagttctaacccagtataggttccatttgctctatgctcccaggatctcctggagactgataaagaccaagggaggcaatgaggtgatgagaaaaagctgactgcctaggttttaaggatgcgaagacataaaacagagaggcaaagcagcctgccctcaggtcaagattgagataataccgagaactggaaccaactctgcaaagtcaattactctgaagagaaaccttcctggtttcaagtctgtaacactgtctcagacctgtgcaaagacacagaggccttgggtcaagctgcaatgctagttcccataaaagaaagagtggggcagagcaaaccaagccggattgtgtgcagtgacctggggaccctgggttcagttgaaaagtctaccaggagatccacatctcagaatcagtgaaccccagggaccttagttcctacaccaaggccaaggcaaagaatctctctgagccaagtatcaagccctaaggggtcgagtcttaataccaacacaggctgtggttacaaggttaatgagagcaccgtgcttgctgtggggaaaaaaaaaaaaaaaaaaaggatgctggcttactttacacagcaccttttaactagaggccctatatttatttttgaaagcaaatgtgtgtttatatatgtttctgtctatcatcccctcttgatgacatggaattacctccagg

SEQ ID NO: 36352 - DNA, 1286 bp, Bovine  19866881173632
ttgttacaagcagccttgggcatacaccacagcttcccctccttgggctcccccagcaagaggcaaccctggtcaagatcagctcttagcctgctcccctcttcaggagtatagctggaggtggctggagaaaccattcccccatgaccaaattcatgacctttagcctcaggcaggcccactctctagttcatacccactccttgtcaagcccccatctcctgggcacacccagggtcctggcacgctctgtggtttatggtgggatagagccatctctgaccagaaggagacagaggtctggaggtcgggaccgatgactgggctgggctccagactgtgactcccccatcctgcgtgatggagggccgggcttgatacctgtgctgaccactgccctgcccaggccgtcggggtcgactctgcagctcccctgacactaattcacagatttaatactctctgtgggagtgaaggtattttgagaagaggttccgctgatgccgagtttttctctgaacgtgggggtggctggagaaaactggcactaaggaggagaatgatgtcgttagagccagattagtcctcagttatcagtgcccggctctgcccagggtcatagagcagagaagtgggattacactccagtctctcctgaccccagggctaccgtcctctgcttacaaagatattagccaaaatcatttaagagcattcaatttctaataacagtctagctccataactattcatatctcagcagctgctggaaacaggcacttcctccctaggctccaagcccaggtgaccttccttagcggtcaaggtcattttttaaaaccacaaatttcagagttgactctggtaggttgagtgtccacacacataggcatgcatgtgacatgtctcttgcctcttcagggtaagacacaacaggaatcaaggtgaagaagtgacagatgtccataaagtcccctccatggaggagccggtccaaatggacaggggtggaattggtgtccttctggcagggagaccaggctgggtactttgctgggagtggcaccgtcggattccctggctgcctggatgcttggcagccctgggaaaacccaagtctgcagaccaagatttctctgttaggtctcggggctctggcagcttgctgttctgtctgtccctgtgcctgccgggccagttccccacccttagccctcagttattgctccaccctcctcacttccatgggtggatgccttttttgtagcttcccaagcaccctgctc

SEQ ID NO: 36353 - DNA, 1759 bp, Bovine  19866881206983
ttcttgcagctgttttaaaaagtttccaagtaagtcttcactaaattgttcccagtcctctctcagaacgctgtggctttccctgccttcattactggggagggagtggggttattggatgaacagaaggaatccggtggactttagataaggcttcatgcagattgaagtatctatttgctttaaggcctacttagatgtgcctcccaccttccccagttcattagatctagaaaatatatggactggggttgggactcagcaaattagtatttatggcctaagttttagatatataaatcagtcgagctcagattcctactgcattcatttcaatgtacctttttgttatatgtgtaagccactctaaaccttggaaaaaacccaactctagttactagtagggatggtgctgtgcggaccattttgcccaactaaaagcccatttgcattaaataatattaaaaacaattttcgaaagcagatataatcaagatcagctaatgaaacagtcgtcagtcccgtgtccccccacagagagcatggagccatctctgtctcagcctgtgatctgaccaagcggatgcaccagtcctgcagcctgtgcgttcagccaacaaaggagtctccagctctggctccctccaggctgacagtgtgcttacagacccctcacccgccagcgaaaggctggctgggaagcagaaactggtccactcgggatgaagacatcaaagcagattctgatccaattagaaaaagatactattgtcctctgaattcccaaagttagcaggctgttatgaacacttagcccgtttccttggggattgctgtggcattgacttagatccgaagctcattgatatgcacacatctcaacagaccccagtctctgcggtgtgcagggagcctgggaagcccggcaccacagcttcctttccactcgccagatcaaggttttcagagtttgtatggtggctgtaaaatgctgtttttcctcagttggtcttaggtgagtgttagtctcttgcgtcttagaaaggagaatatgaacactttattagagaaaaaaatttataactgtttccatttatagcacttcagagaaggagcatgggaaacagtttaagctggtaattttagccattagtcctgactgtggaattcccggagacacttatccatctgtgttcaagtcacaattattctgccctctctggcacacacttttcttttgttctacttttatttccccctctgaagcttttctgaaggccgcctgtccttggatgatgtttagatgatgttcatatctgccatgtgtgactgatgagctgcttaaaatatctttctttgtaataggtggccacctattatagagaactacactcataaagtttagaaagtgttttcctggggtaacttgggttcgtatcaattgctgaggtcagggaggaattggatatattcttgacaagagaaagttgagtcttctctgctcccagtccactgtgtaacccctaactccagctgccatcttgcaaatgcagattatggaccttaaatgggactgagcaaggaagggtagctattatatttccacccaaattcaatctccctctgcaaagacacatgcctcgtccagtcgtttctatactttaatcctctaatgatttcacaatcattttgtctatatctaaataccacataactacattcttctactcaatatttctctgaaatcaattttttaaat

SEQ ID NO: 36354 - DNA, 1495 bp, Bovine  19866881232854
tttattgagcacctactatgtgccaggttctcatctgggtcctgagaatacaggatggataagataaacacagttccttctttcatggaggttctctcataaataggggagacgggacataaacaagtaattttatataactgatttattaattcatgtatttaacgagtatttactgagtacctaccacatggcacaagtgttgctaagcactgcagttcagcagtgaacaaagcatgtagacagctttgccttcaggaagattacattctaatgatgtaaatactgatttatttctagttaaaataagtagcacgaagtaaaagtacaggggacctgcctcatctgatatccctgaggaaatgacatcattttaagtgcctcagataagatgaggctttgttttgcccgccaggactgagagggcttccctggacagggcaggagtttccctgggagactaaattctggctgaggctgcccgagttccatctgctttagagagtagcctggtgggagagatgctcccggcgataggcagacagtgggtagggatttgaaactgcgtctccattagcagtcaccacccatttttgccccagtgcatgatgtcttgggatgtcctgatacagaaaaaagcaaggccgtccttcccctgtagcacagacagtaactaatggaccctcctttcccagacgggaaaaacagaacaagaaaagacaaacccagcttgagcctgaggggcctgtgctttgctgctcaggaggaagcaactgctcgatttctggtctgcccttcagactgcagagctgcaggtcgcccgcctaaaccgctttaatgcacattacgcctgggtctacatggaaatggcggaaggcacataaatggaacacccaacctttgtcctcacttcgaaaccgcaggtaagtatttaggtctgtgttgtatcgatcatgcctcccactggcaccaggaaaaacgctgtgaagcaagtcaacttcccagtgacaaggaagtcattctcctaatccgctctcactggacaatcaggttgacaaaaaccattaagttttctaagattagaaattcactgtcagagggagccatgtatagagttttccactccattacacccaggacaataaccagagaccaagtgacaggaaaaggcttcttaaagtttcctgtgtccttgggtggagggaaataaattaacaagtgcctcccttttgaaggacatgggttatatattatctcattaatcaatgcaaccacttccgaggtgggctgcgtcgttgcatttgacagaagactaagctggggctcagcaggattcagacaccatctaaaatcacctggctcattcacatgagacgggattgagaatcagaggcactgggccaagggggggggggtctaaaagctaatgacctacttgcttttgggttgaactgcactttaaccattcttaacctcatttccctctgaaagatgc

SEQ ID NO: 36355 - DNA, 945 bp, Bovine  19866881247577
ctgttcacggatggctgaaaggcagaactggctttgcatattttgacttatagctcctgaaacagaactttgttttcctctctatttcaaaagcaatccatggtacttgtaaaattaaaaggcagattggaaacatgtttgtagtgcctggcacatatttatgcatttctttattgtttttcttattcacaaacatgggatcatagtatttggcaatctttttttccaacatgtcaaatattcataatttgcataatttttaagggttacagttgtatttcattacatgcacataccgtgtttaactgtgtttacccatgcatgagtcattgtgaatttgcacagttctgtacagagccatatgaccctcccgagtcttaatcgatgagctcacgtgtacaccgtgtgtggagaccctcatctagtgtggttttgctttctgggccaggaggatgtcagtgttctgcctccttaggtgacggtgtcaggatgcccacaggacatagtaatgaaacttcccttagaaacagatgagttggttacagggttaagtgtgggcgggagtggaaacagctggcctgggcagagcaagggtagggcacaggtgaggttctgtgggtgggcgctccacctggagccggcctctctctgcaccatcctgctttccccacaggtgtgccttgagggggagatttctcgccagtccatcttgaacagcctgtctcggggcaagaaggcctcaggtgacctgattccatggacagtgtcagaacaggtggagtgctttccctggtgtgtctcggggggctaagctggtgatgttggaggctgtctttgttgctaagttacttgtgcctccctcacagttccaagacccagactttggcggtctctcaggtggaagggtggttcgcattgctgttcacccggattatcaaggggtaa

SEQ ID NO: 36356 - DNA, 1321 bp, Bovine  19866881284609
ccaaaggtctcactacgtcaaggcaaccaatgccccgagatggtgacaaacaaggaatccagtcaccagaaggcccaggtcagcctcctgtctggtcactagtttgctgttcctcagagaaaagcaacttcatctcttggggactcagcctctctgcctgatcatcaggtctgctatcacccataatgtcatgaggggaaggatccaggaaaagtgtgacgtgacttgctgtgcaccgcaggcccatccagagctccgggggtacctgatgccagcctggccgtcgccgtggtcttgttctcagcggtggtgctgacctggctctgggcactctgttggcggagctgctgaattagcttgagggacagggaccggccagtgccctcgtagctaggagaaaaagcaaaggcagttaggctcgaggtgccgaatcacctctgcaggaggggacagagaaagtagttctctgtcctcaacctgatgaaaccccagactcctgcttgctgagaacagcccttcacctctgaacttccagcagggcatgtgcatggccaaaggaagctgggctgcatggtggctcagctcggagccatctaggcctgggctcaagtcctggcatgtccgtttagtacctctgggccaggaactcaacctctctcagcctcctcctcaaaaggggactagtgtacacagctcacagggctgtactacgaactaaaagagaaagatcaaaaagatgacatgaacaaagcctgtaggataatggaactgcagcaaagatgaatggtcgattaacgagaagttgcatgcttgaaagatgaacagagagcatttccagtttggaaaaatcaagattaaacaaatccaccatcttttttttcatgactactttcccttgaaagaggacataaactagaaaatttttctaattttcaattagaaaaatgaacagaggacctgaatagatacttctccaaagaagatacactgtggccaaaaagcacatgacaggacgccccacatcagccaactaacagggacacacaaacgaaggtcacacgagccaccattcatgctcactaggacggcacagtcaaaaaggacatacaaatactagcaaagacgtggaacccttacacgctactggtgggaatgcaaaatggcactgttgctttggaaaacaagctggcagttcttcagttagaaagttcccatttgacccactagtttgacttctaggtataccctcaagagaacagaaaacgttctacacaaaaacctacacgcgaatgttcacagcagcactgtactagccaagaga

SEQ ID NO: 36357 - DNA, 933 bp, Bovine  19866881420177
attcaagtgcctcatcaagtttatatgacctagaaacacaacttgcctgaatctgatcaatcggttccttttgtggtcgttggtcagtagcatgagaaggttggtacaagggttgagatgctgtatatccctcacttgtggatgaaaccaaaggaacctaacaaagaagtaaagaaatcaaagcttcattctgttataaaccaacttcattacatatagggctaagaaatagacattcatgttaaagacactataaaacctaacaactgggaaaatacatatattattaaagctcaaagttaataaacccaagcccaattacgaagttccctataaatgcagataatatctacactaaattttaaaattatgaaatctaaactatgtcatctcaaattctcagtttgaaatttaaaaacttcattataattaaaaaccataaggattaacaaatagtttttattagtttattaaaagaaaaataaatgtaaacatgggaaataaaagttgatagctactcatgccagacttgacagtgatcaaactcacacttggttttcataagctagctaagaaagagaccaaagaacagattaaaaacaaaaactacaaaaatatttcagtcttacctgtgtagcttctggctgtacagaaacttgattaggttgagcaagtctagattcagaatgaactataaaattgaccaaaaaaatactgtcatacaaaataaaatttcttcagagatgtataaatatcttttacttagtctctaaagtcaattttctatagccaaatcctaaataaactatttagcaattaggaaaataaatggggaagtacaggaaggattttagctttcaaatgagcattttcaattaactgatactcattattattaatcaactaccacatgcctttcactttttttttttg

SEQ ID NO: 36358 - DNA, 1556 bp, Bovine  19866881587769
acattgttaaaaagaagttatgagctattatcttcctttttttttttttgcttatgcccccagtggtatgtgggggtctcagttccctgaccagggattgaacccatgcttcccacattggaagcgtggcgtcttaaccactggatggccagcgaagtccccgttatcttcctgtttgacttaaaacaaaaagtgaggaactcaacacgtgacagtttcatctataaattattcttaaattgcaaagccttttttcattcttacagcaatgagaaatcttgtgtcttcatttcaaaagtggggtttgggtcagttttgttcgtgataaaatagttatctgattccctgccttctgttttcaatgagcaggtgcggactttctatttgaaagtgctgaatgaggagcagaggaaacgcctgtgtgagaacattgcgggccatctgaaagacgcacagctttttatccagaagaaagcggtgagtgatactttgtaagccgaacagtgacacctgctggcaggatgggagagtgcagctgtgggagaaagaccttcaaaagaagtgtcatttctattttacttgagttaagcaaacttaaaaaaaaaatgagtatgaatcctccaatcaacctctgattcttttctttctatggcttacctccagtagatacactatatccatcagtcctttactctttgtccagtgtgtaataatttagtttaaggcaaatcgtctcctaatgctattcaatctgactgtagccaagttccatgttaagagagtaatatcccagtatgaaaatgtgggtcctgccacaattttgcttagactttagatgataagaaatacagattacgtctttgtggtttgaagtctgcctgactactcgacattatgatacccaatctgccttcagaagcaaatagaaacatgctgttttctggggtaaaaactgagctgcttccaaagctcaggctgaccttttaagcaaaggtgtcccagggcatttctgatggtcgctcgttgtgctgtttgctcactgttggtttcctggctgccccagggtcagcctctcataaatttaggaaccgctgcccctgtcttatctcttggctgctgcttctctgttcataagggcagctgtctggagtatgttctaaggtctggagataagtaccttgcaggctgcgcgctttctctgcaggcagagctctataaactgtgtttgatgagtgtgtatatgaaagataaccctttgattccctggacactagtacttcttgctgtttactcaggcagagagcctgactgttgctctgtgagagaggtggggtgggttttttctcatctttcttagaaaaatgagtgagactgtttgtaagcagagaattgggcccaaactcttggccttctcctcttacgtacgctaaagctgcctggcctccgtgggttcttgatgtcctacctcttgctgtctgctggggatcggcccctggtcaggaattccttctagaagtgtgcagagttgcccaacacaggccagtgtttgtacacct

SEQ ID NO: 36359 - DNA, 810 bp, Bovine  19866880378639
tcacacaggccccaggctccctagagtctccaggggtcttttgggagtgcaagggagagacactgggcatctctcatcccaggtgcccttggactccctgggagccttggagcctgtggttcctctaagactcgctcctttctgtgccctggggacagacggactgagctaggaagcccctaaggagggacaatgattgtgggcggggcggggcagactggaacaatcacacggagacccccccagagggccaggtcatgacagatgactgcattttgaccaagcagctcctggcccagccagaggccccactccccaggccccgctggggctgccaaggggaagaagcccgagcctggcactagtaccttacagaaatcgttcctctttgcagcctcgatgagctcttcacctgctcggaacaccagcctgttacactctggcacgggaggccttggcttgcatcagtgcatgaacatgtatgtgatgtattattgtgcaaagcgggcctgaggggcacgtgtgcggagggctgtggcaaacgtgactatagctatgttggtgtgaggctgtgtatgggctccacctcgccccgccccaccccactgagcctgggtcctctgatcagggaggaagcaggggccctgcagggagaggcctcacctgtagggggcgcagcgtcccctggcagtgacctgcaaacagagcagatgtgacggggtgacataatgagatgtgatgggtgacatgaggtgtgacaggatgagatctgacatgagatgtggcagggtgacatgacgagatgtgatg

SEQ ID NO: 36360 - DNA, 1301 bp, Bovine  19866880423358
accttcctgtcattatgatgtcaaaagcagacaatgcctcgtttctgcccttgccagaggcatggtggtacatgaagtcagccttcactggtcctgctagtgacaagctggaaatgacaaggatgcttttcttaagattctcttctatttccttagcttctcctaaatatcaggttccttattaggtacttggacttcacaaagatgaaccagatggggtctttattctcaaggagccgagagaggagaatgacatggagatacggaatggcagtttggtatgacgagtgttaacccagacagggtgctccctactggggagtgatcagccctgtttagaggattccacagcagggaagcagcctgcatgcagttgggtttcagggagaagagggcactccaggtaaaggcacccaggcaggagaaggccttattcgttccaggggcttggaaagtggctcagcagagtagggcttcttccctgtagaaaactgcagcgagaagaggctagagataccacatctggtcacccgctttctactgcttgtatatcatgggtcctatctttaggatttttctttaaaccaatgcttcagattccagcctgaattccacaagcatccacatgtgtggcactaaatgagcagccctgggggataagcccctatggagcttaacactgaacctaattgggtggattagacagacataccacacagctaaagaaaatacaaaacaacacatgagcaagagcataaactataagtggcccagcacacatcgctgggggaattcacaggttcttagcttgagacagagcttaaataccatctaattagagaaccgttcaaacgctcaactccccttgacaaaaccctggccaaatgagcccccgtgggatgtgggaatctcagtcagaagctagactggttgagtccaggaggccactaaccccatgccagaagcttttatggcaatacacggaggacggcttcagacaagagcaggtcctaaacaccacctttccctgctggtgaaatggacgggacagttaagggcacggcagctccgcagagtccgcatcttccactgtgattacaacctcaggagaggagcatttcatagtatactacctatctctttctgtagcccgcctcctcaaaaattaaaaacaaaacaaaacaaatatttcactgggttctttatgtatctccagactacaggcctcaagttgaggtaaggaggtattcagtttggtctctaccccaagatcccttcaggcctctggggccccagctcat

SEQ ID NO: 36361 - DNA, 967 bp, Bovine  19866880453072
cctgcctcgttcttggcatcactccttaaagtgtcctttctacctcgggaatggtagctctccattccagaaatcttcaaaagattggtgtagttaccaagtgctcttaaatctaaggcagtattgtttttttctttgttttcccttgttctctggtttcctagtgatagtcaagtttccctgcaggcagaagcatagatatcaacagttcttttctaaaccctttttgaaaaattcagcaggtggtcttgggtttgtgtaaatgccacagaccctaacttaagaaagaaaaccaagagtatagcgttaaagccctaatttgccaagccactgatctctgacagcctggctctatctgtgttctgcctgttttcctttctgcttgggcctccatctcataacactgaaggcagattgaaaagctcagtttaaaatgaaaatgataattcactggtcttgattgaaggagagggtgggggggcggcggggaaccagagcattgctgccctacatccttatgacgcctccttccctctcctctggtgttttggggcagagaggtcagttcaggcctcctgtcattcagagccctggggggtcctccaggtgtgtcatccacttccagagccagccaggtggggagactcgaactctgtacttcagtgcagaccaggctgagggctgcgtggaccagtgcaggggtccagccgattaagtgtcacatctgcctccaggccctcgcattgggcgcggagcctcgtccgaggggagctgcagagtgcagagcaggcgtggcctggctggtctgctagggtctctggtcgttgggtgtgtccacgttgcctttcgattgggcccttggtgattcttcccaaaatgtgtgtttgagtcacttctggtggaccagcaagggacaggggctgagcccggtcagccgagctaggtcagggcccaggagaaagaacgt

SEQ ID NO: 36362 - DNA, 1347 bp, Bovine  19866880470576
ctttatgctctcctgtgaaattagggattagtgtcagcaaggagctgtccagaagactgaagtctctaaatgctccagtttttttaaaggagaaaataagacaaagatgtgtgagatgatccccttctccagggtcacatagaggtggagaggagcactgtcacccccaagcaagttttacctgtatcacctttttcttggaatcagcgggtttacatttttattcatctcagttttgatcttttggacaataacagctgttgagtggctctccaggaacaatttttaataactttctccttatctcatctctcagatgatgtctcttaagtgtgagccaggactcagcaggtgcttgtggttgtgttgactctcgtttcctactacaggggtagaagagacgcatctttcggtgtcttgtgttgcttgtctcatgaccttttagttggataaggcagcctttattatttctggagagggttcggattcaggcccttagggaggcgcccccaaatgtcttgacccagcactttccacaccgttaactccagactcccttaccctctcttatttctttgtctgctgcagcctccgtgaatgtgctggtgcagaactgcaagatctacaatgatgccagctgtgacatttctgcagatggccagctcctggcagcgttcatccctagcagtcagaggggctttcctgacgaaggcatcctggcagtgtactccctggccccccataacctgggcgaaatgctctacaccaagcgatttggtaagggatgggacgcccagcatagtgacgctagtaccttggcctgggcattccctgatgaggcaccgcttaggtgggagtgatggtcacacgctacccccctgcttcacaggcgcaggtcagaggaagatgctctgtcctagctggtagcgttgcaggagagtctcagagtaagagtcctccccaccaccgtggcatcaccagcatgttcccattgtgaggggcgagggtaggggaggagctctgttctcggtcatggctcggggaagtgggcacactcacatgctgcaagccagtctggcattgtatagatttatgtacaagggtgttcacagcggtattatttgtcacagagaaaaatgtcaaattctgaagagttgcttaaataaatgatggtgcattgacaagacagaataccacttggcctttagaacgctcttacagagggatatttaatggtgaaaaatgtttgtaatgtatgaagtgaaaaaagtggatttcaaaatagcagttacagtatgataatttttaatgtgattctgtgctaatacgggttagcattcattaagt

SEQ ID NO: 36363 - DNA, 1530 bp, Bovine  19866880492018
atcttgctggtgaccagagtctggagtttctgcagctgctggagcagagtcctgaggggggcacagcggtcacccagtggctctgacccagcaggcaggtatctctgcctcctggagctctccctgggtgcgggtgcgtgtgggggaacctgggctggctctagacttggcttccacaccaggtgcccgcttcactcaaggcagaaaaggtcacttcctgcttggctcctctgtggcgtggccggggcacctggcgcccgcttcacggtgaatagctgggtcaccctgtgggagctcagaggagccccgtgaggctgcttctggccaaagcggagactggaggcgggcctagcccacctgggctgaggtcaccttctttttctttaaccccgcagcagccgcagctaaaccgaccttccctccttctaccctgagctgctaagaaggacgcgtctggcagcggcctggtacatggtgaggagtgagcgtgcgggcggcggggaggaggcgggaagctaccatttttgttaattttgtcacagcacgtgtaacacttcgttcatttacaaatctgtatgtcataccacggggtcgcaaagagtcagacacgaatgagcgactgaacaacgacgtcagtctctttcgctaactgtgggggctccctgagggcagggactgggtcctccccagcaaggactccgcccacccttggtgaacaaatgttgaaccatctcttccctcccgcccagctggtccatggggtttgcagttcccagaatgtacagcaggtggcgaaatagctccaagggcctggccctatttgggaccagagaggaatcggggccagaggaagcgggtgaggggccgaaggctccctcccctctttcctgagtcagaggggcattctccaggtcagtcatgggagtggctggatcccgctggagaagctgggggagaaggaaggaaagaaggaaagagcccttctgttgagcacctgctcaacagaacagggtgctgttttaattactcccagcgaacaattattaaagacctactgtgggctcatgactggttactaacaagaattcagaataagagcaagaaaaaagagaaggaaagttaacatgaagggagcattctcaaacgccaaggagagtgctggcccttttcttgctaggtcttatcacatcgtcacatgaatccggggagataccacttccatagtctccatgttgacagagaaactggggcccagagatgcatgacagttttcccaggatcacaaagacagcacccggagttgtgactttctgtggccaccgcatgccaggccctgtgtgggctccagactgtttctcaaacttagtcatgcacgtgaatgacttaagtgtgttgctgaaatgcagattctgattcaagttaagtgtggggagaggcccgagattctgcacttctgcaagcccctagctgatgttgacgtgcggtccgagaaactcactctgagtagtaagcatgcacaccatgtacacc

SEQ ID NO: 36364 - DNA, 1787 bp, Bovine  19866880495060
acagaggcacatgggcttgcctaagccccctgtattctgggtctgcttgttatggcagcttagcgtgtctgctagacaatacactgtgtcttgtactggtcggccaaaaagttcattcggtttctccatgttatggatgacctgtttagccaacccaacgcttctttggcatctcttaggaagctggcaagggaagaatgggtgctaggtaatcaaccagcagggtccagtatattacctgcctctgaggccctctgactttgggagggggatgggtttaaataggtcactataggccaacatgataaacggtaaacgagcagcaatatctaagttccagtgaaaacagccgaaagaatgaagagaaggcttctcagaagggacaaagagtatcatgagttcatttttttctgagtcttacaggctatgtgggaattcccccaaatgattttggttgggaaagagcctttcagacagagaacagcaaaatcacagagacgggaaggcccacggggtctggctagtggtctggtgtggctcgggagtgggagggacgctgagggtagtgaaggaaggccacctgagagcctggggaggcagcggcctggctgccaggcctctggaagccgcgcagggtttgtgagctagcagagacatggggagatatgcgtctttctctgaggtagaggctggaagatgactcgttaggaagctatttcacaaatttggctgagtaatgaggagagcctgcagcggggctgtggtggtgggaagggagacaaccagatagtctgcagggagattttggtggcagaactgacagcacttggtaactgggtgactgaggggggtgagcaaggataaggaagggggttgggtgtggttaaatatgatcctaagtctacatgcttatgctagaaatctagagaaggagtacaaggaaaacaagtgttgggggtgagaggagaaaacgatcacccacccttctgagcctggtccatggaagacttctttgggtccctgaaagtatgacattccttcctaactcagggcttctgaacactgtccctactccatggaacactgcctcgtcctcaaatctccaattggctaattcctcatttcctctaagacttcctttcttcttgtccttttttttttttttttaatttaaatatttatttatttggctgttctgagatctacgctctttgttgcagcatgcgggatctttagttgtggcatgtgggatctagttccctgaccagggattgaaccttggccccctgtattgggagcatggagtcttagccactgggctatcaggaaagtcccctaaaagcctttctcgatagccccctctgacctagatgagaaaccctcttcgattttcttatagtatcccaggtcttttttttacaagtctctcaatcagggtggtttagtcactcagtcatttccatgagggaccacaccagccttgctcatggcttcattctcaacaccttgtccagtgcctggtacactgtgggcacttgtgctgggtttgagatattcaatagttgtcttttgaaataggagttggacaatagttttcaccagggcccattcaggtgtgaagcaatgaggccaccatggggacagttgattgcgaccccttttataggcctggatcactctagaccagtggttttcaatcagggggtgattttctcagcccaggacatttggcatgtctgggagacgtttttgggtaaccctgacttgggtgcatttgggtggggggg

SEQ ID NO: 36365 - DNA, 1589 bp, Bovine  19866880518712
tgtatttaaaaatttttaagttcctgacagttgctactaaagtaactatttcacatttgatctaatgtacatatttttttcaaatgatctaaagtttgatcaccggatatcatggagtctggcaagatggcttctcccaagagcatgccgaaagatgcacagatgatggcacaaatcctgaaggatatggggattacagaatatgaaccaagagttataaatcagatgttggagtttgccttccgatatgtgaccacaattctagatgatgcaaaaatttattcaagtcatgctaagaaagctactgtcgatgcagatgatgtgcgattggcaatccagtgtcgtgctgaccagtcttttacctctcctccaccaagagattttttattggatattgcaaggcaaagaaatcaaacccctttgccattgatcaagccttattcaggtcctagattgccacctgataggtattgcttgactgctccaaattatagacttaagtctttacaaaaaaaggcatctacttctgcaggaagaataacagttccgcggttaagtggtggttcagttaccagcagaccaagtactcccacgcttggcacaccaaccccaccagccatgtccgtttcaactaaagtagggactccagtgtccctcacagggcaaaggttcacagtacagatgcccacttcacagtccccagctgtaaaagcttcaattcctgcaacatcagcagttcagaatgttctaattaatctgtcgttaattgggtccaaaaatattcttattaccactaacatggtctcatcacaaaatactgccagtgaagcatcaaatgcattgaaaagaaaacatgatgatgacgacgatgatgacgacgatgactatgataatttgtaatctagccttgacgcatgtaacatgtatacttggttttgaatctattgtactgagattaaacatgcatgctagatgtttccatgttgtgttctagaaaaaatagtatttaatgagtaaatatgcttaccatacttttcgattgagctgttgtgttagattttctttaataggattagtaatggtttctcctcagcctttaagtgtaaaaaataaagttgcaattcgtgcatttaaaaaaaaaaagaaattatgggattcttacagcaagagctaagcagtattggttacaagttgactatttcacattttacaattttacatgactcataacttttatgtggggagtataactgaaacaaactatcaaacttgaagtggcctcgggccctgtctctgaaggagaatgttgaaaagagttctgctcctctgaaatcttttctgtttgtttcttaattgggcagtctgtgatgggaggggtttttttgtgtgtgtgcgcatcgatagactccgtcaaagaatattgcaaacaaaggcagacaaggttaaggtctagtctacttcccagagaaatccatgcccattcctttctcagcataggacttgtacattaaacatgaacatttcacttatgttttcccttggcttcggtattcataaatggtgcacgttaggaactaccaagaagtcac

SEQ ID NO: 36366 - DNA, 1100 bp, Bovine  19866880532734
ggatatgtttttaaaaaatgaatgaaatgcatatgtatcaacctggagaatttcacaatattgggcaaaaaaggaaatatgagctgcagaaaaatatattaaaactggtgaaaaattgttggtggatagttatgtaagtggtaaagttataaaggaaaaagaataattaaaaacataataactaactcttcggcagaaggagacggatgcagttggggaggggcccagggatgcaaagatattgataataactgtttattagagaatatacacatacatatacattcatacatacatatgcacacacacatgtataaatcattcttgtataaatcattcactgtattaaaatcattaatggccagtaaatacgaagtgatactcattttcactaatcaaataattatgttagaacaataatgaaatatttttatcaaactggtaaaagtattttgaagatgtcaagtccatgtatttgtaaggaatagacaacaggcagtttacatactactgatgagaatattcagcctctagggagagcagttttgtaataggaatccaagttttaaattggcttaccctttaacctagcaacctaacttctaagaatttattctcaggaaagactcaggtaaatgaaaaaagatgttcatttttagtaacagtggggaattgaaaacaaccttcattgtagcagattggttaaatgaagtatggtgtattcgtaagtgcaactgttaaaaagaagtaggtaatatatatattgatgtggaacacgtccatgacatgttgttaaataaagtaagggcagaacagtgtgatagacagttccaatactgttatgtaaaattaggaaaacatcagaaaggataaatcaagtaacagtgcttatctctgaggcagacaggtgattatttgatacttaattattttgaaaaattttaaatgaaattgtattatgtttatatacaggaaaatatgagggtatcccccccctttttttttcttttgagattgatgttattttgtctagcaggatccttgggacactggacattgcaatggagttaatctaagtaaaactctagtatctttccttg

SEQ ID NO: 36367 - DNA, 1580 bp, Bovine  19866880537765
cctttcatttcccagccaaatgatgccaattagtaataccaaagggaatgaacgtgactcatggatgttcccagttctgacagctgattgccataaattcccagatccctagagtttgctccaccttctcctttctgactggtctccaaaaatcatcacccagaaagtcacgcttccttcgtgcttttctccaggagacttctgaagggacctctgcaggtctgtttacaagagcacactcagtccctttgcccatctcccagccagactcagagaaagacttgattttagtgtcctcatgtgtatttttgcatgtatgggcatatgtttttctagtatctattaaacaggtaatctttggccatcctcacctgcccccggtcctactcactggccactcctgccttccccagggctgtgtctgcccgtcataaactcagcggctccgtcatcatcacaagcccatagcgccagcaggcagtggcttgctagcctgggatacatcgctgaagtggcattctactcagaaggaaacgaccccctgatcccttcgctcccaagagctcgagcctcatccttctctctgctttcctgtccatcccttagatgagagtaggactctggactcagaggatcgcttgctttttctgagggaaggagggggaataaattcggttgaccgtgaaatattgtcataaggtactgaactcatggccccacagtgtaaggactcatgttgctctaaaaatgcgatcatgcaggacttccctggagatccagtagctaagactctgtgcgtccagtgcagagcgcacagtttccatccctggtcagggagctagtatcccacatgccacaggctgcagccaaaaacaaataaacaaacagtcaaagtgtgagcatgttttggtgaggatgggccaggggaaaggagaactctcacttacagtaatatttccccctaactttctgaaacaggcatatttttcctgaactgaggtagtttgtttaaagtgtagttaaatgtgattggaatgtatagctttgtatagactctaaaaaaaaaaaaaaaaaagtcctttgtcagactgtgtgccctgatgtgggattcagaaaacatgatccctgtaacaggagaacactgtatcctcaagtccgggagctgcgttgacgggttcaaggagctgaaggtagggtggaggacatgaaaatactttgtaaagaccttccaagatgcagatgcaagcgttgcatcatcatcttcatatcatcactattagcaataacaagtgactcggggggaccttttcaaacgcaaatctgatcacattgtgcctttcatccgaggcctccccccgtcttaggacagaagccagagcggcgccacagccctcaggccctgcgtggcctggtgtcctgcccatccacccactccctcacattccctgggcccccacgcaggccttctctccccttgaatcgaccacactcctcccagccccaggacctttgcacactccttttgcctagaactcctgtccctccctcctggttaactctctctttttgtcccagcatca

SEQ ID NO: 36368 - DNA, 1385 bp, Bovine  19866880555056
cacagcaagcttttccacgaagacgcaatggaagctcaggagatcagaaccagatgcgtgggtccccgacactccagatgcagccaccgagacccacagggctgaagaagaggcaccaggagaaaaaggggcgtgggaggagaccgggaggcctctgcttacctcctgagagaatcctcctcagagctctcctccggcagatcctgatgtaaggcctcctgtgacacagttccagatcggctggcctgggtgtaaatgcgttcccagtggcccgtctcctggttgaaggccacccccacagtcctctcctcctgtgggctggcagagttgcccaactccagcctgctggagctggccgtctggccctcagtccgctcgagagggggcagctggctgccactcgcggccatgccctcaaaggtgccggggacctgccaggaggcgctggcctcgccagaggagtagttaggtgtgcttctttcccagcgcagagtgtcgttgttgaaggtcagcagattgtggcaagcgcggcagcggttcaagtggccacgggacaggttggagttgttctcgctgctgtgcggggtgggctggtgggacggccctggccgttcggattcaaggttattgttgagcatttcctgggcctgctgggcctggggggcctccccgctgaggctctggtccagctcctgaagccggtcatactccagaaagaagcgtctcaggtcacactgaagctcgtggcggatgctgcccgagttgttttggctggagccgttccctccatctgactcagctgccaaccccgaggctggaaaacccctcccttctgtggctgaagtgtacacagaggcttgagagccaccttcctgctgtcgcagcacagagagtagactcaccgaagaggcgctggtcctgggcgggggcatggactccgcctcggagcgagagttcagactgagcactgtccgggtccactcagatcccgtcagcccggaggctatgtcccggtggtacctggaagggtggccagacagagggcctcccagggagcgccgcgggggacccaggctgaggttgcggagcgtgttgccggcggtgctgctctggaccgtactgaaggcagacggccggctcaggaggcccgggtcgtgcggcgctgacgaggcctgctccggggggtggaagggctcggtctgcacaaaagaaaaggaaggggtagtagccctggcagaagcaggggggacactgtcctggtgtggcaagagggaaggaactcgagtgcccgagcagcggctgcaaaggcacaggatcccaaggtgctggcagcactcggctgtggggtaactgacccgctgtcggagccggatgtaagcggaagt

SEQ ID NO: 36369 - DNA, 746 bp, Bovine  19866880598354
ctaacttcataaaatacaaaactagggagggttgaaggtaggagggagacttgtaaaatacaatatcttagggactggcaataataaaaaataaggctcattatttacaaacaatttctgttcttggtctctgtacagtgagggggggcggggcggggcttagtgggtaggtctgttgatgtgtctgtgtgtgtatgtggtcggggtggggcagggaggcagtggtcctcttggtcattatgagaaaggaggtgggtaacccagtgagtggtttatctgagaaggacggatggttgtgggagggagggggtgagaacagagtggttggcccaagggaacagtccaaatgtggggggagggggggccccagtcaagatctggggcaaagaggggctggtgggggatggggagtggaaccctttctcctgggaggggaccccagggggcaggggtacaagccggatccgggttggtgagcaggacgacccctcttctgagtaccagagggtacgccctgtgtcctgggtcttggcacggcctaggagagcttgacggtggtgttgggacccagatccctggagagagaagagaagttagggatgactctgtccgggaaggaccctctcgcccgtctgcaagctgggtttggacttgggagggatggggccgtgggagggtgtggctgacagcatggagaccagggctgggcagagcctggggccccaggaagggaaggggccacccac

SEQ ID NO: 36370 - DNA, 964 bp, Bovine  19866880612517
tatatgtatgtgtaggttaggaggtaggaatctaaataactttcattgaacagaaaatatttaattaatattgggattctcttggagaatgtaaaatgtcattcaaaatgataaaacagctagctccctataaaggcggtcaatctaatgcagaggtactgtaaatataggaaaaatatgaagaggcattatatattatggtgtcatagaggaacattatatattaaagaataaagaagtgtctttgacattttcttattttacagttttatggtaacataacacatgccataccctagatattaaggtttttgtacctataactatatatgattgtctctgatattctggaatttgacagtatttcaaagaacataatgaacctgccccacaaagggctacttgaatagctttctcatccaatctccctaactcctacctgtccttcactccaactctgtccttttttctactccaggttgaaaagtaaccccattgtgttttaaaaggtcactctaaagaagattttaacactggaaatctgaaggtcctacctcttcactgaggcaaggaagtaactattggaattgctttctaatttttattgggctgcaataagtgaaagcctggcttgtaccaacaaaatacttaaataagtagagaagatatatcaatgtgatttttaaagaattatgacagaaaatccgcagtggctagcagaagctgaatgtatgatctttctcccctctgtctcaatggtttctgatcttttaaaaatctccttgactcgcttgtgtgtgcttttatggtaagctgaaattatcattggaaatgggtcagatataactggtatataaataaatattggtgaataagcagtcaaccttctcaagagtactttcaatttcactaccttgtcatgatcaccaaataagcagtttaatcctaagcaacttcaggtata

SEQ ID NO: 36371 - DNA, 1689 bp, Bovine  19866880626876
cacacttcctgaatgctgatgcatgttgggtactatgcttgctaccatctcgtgtgctcagaagctcagtcatgcctgactctgcaaccccgtggactgcagcccaccaggctcccctgttcatgggattttctaggcaagaacactggagtgggttgacgtttccttctccatcttacctcttgacaaaaaggaagaacagagtctccggctcctgacaggggtcattacacaaagcaaaatattacaaagacggcaatgtaggagatattaatccagaactggcctcaaccatacgggcacagtatcaatcatttcatctatctttcctatcatgaccaagtctctctgtgttctcagacagtaactgcccttaagtaaccgcttttatctagaattcaccacactcttcccttcctcaggaggctatttatttaggtgctattcccctaaaataaaaaaggtctttccctttccagatcctacccttctttcaaggcttgatttcgcaacgccttctttgatgatacttccctttctctgaaattagactacactgagtctcagtaccacacaatggagcatttggctcatttacattttttatataattacatgtaaataagtcttgcctctacaacaacactctatactgccagtgggcaaagaccaggtattgagcttcttttctattcctgacagtgcccagcacagtgctgggaaaaaaaaatgtaattcaacaagacttattaactgggcaactctctaaagcatcctcccaaaataacaagtacatgatgtgcacaatccatattcccacccttgttagaagcttatgtcagagaaatttcagttgcttcaacagaggatgcaatgcagagaaatatgctgcttgaatccaacaggcatattctgggagtcggtgattacgctagatctgacctttacagaattacagaaagaagtccctaataaatcaagatagatgcgcacgcagccatatacggaacacgaggtgggcgatcaactacacccacgctgtgtcttccatgaaagagctgcctgggatgccgagccgagtatggagaggccttccttctatgaatctcttcttccccatctgcaggtgatgtccctctggaagatctactcaaaaaatcttaagtaacttactgtccaaaacatatatatatatagctacaggaaaaaaatagtcctcaatacatatctatacactcttttattctccttttgtcaagttgcaatgttccaaaagatgaggtttaagaaattgtccaaagcaatacaaagacccaatacactaatctgtcccaagtacagctctcttctactatcagaaatttttttccctctagcctctctgggatattgtgttgtttaacgataaccagccctgcacagacaatccttttaggaggccaaaaagcagagtggaggaagttcatggttctacctcctcacgcctctctaagctcacccacaactctcctttaaggctacacgtcacgtgagccgagccagagtcacatgagagagcagtgtcgctggactcaggctgccaggccttatcctctctctgccaccacagcaagcttttccacgaagacgcaatggaagctcagggagatcagaaccagatgccgtgggtcccagacactccagatgcag

SEQ ID NO: 36372 - DNA, 1946 bp, Bovine  19866880672959
ccagccaagccatcaccagacagagagagccatcaagctcactcagatcagagaaatatatgttggatccacagaattgtaagcaacaacactttttaaaagccagtgaattttggggtggtttgtgtggccaaggctacaccccctccgaggggtctgtgcaaccctcaacctgataacagagacactcttctcctttctctgctctagttcaacaagcatgcctaagaggtcacaggcagttttctgtcctctgaatcataaaacaaaacgattaaattaggcttatgtcttctttcaatccagatctagggatgactgctgaaatttcacagaagtcagccttataatctcaacagaaccagagaggggcttcctgctccacaactagaagctatacacacaagacatatataatagatgtatatacatacacacacttgaatgtgggggaaagatttgaaggaaggaccaatctctgatagagcaaaagctgctggggatgacagggaaatttcactgctacctaactgcctcttcttcaagtacaaagacccatgagggcttgagggcacaccttctaagcaggggtctctaacccttcattagccaaatacatttcttcaaatgggctcatcctcaaatctgctgatacttaaaggtctggaaagcggtgggaggaaaacgctaagagcaagttaatgtcctcttggctcttttggctgacttccctgtgcctgggccttgcctattaattgaatgctattcggattccatctcaaaaacaaatgaggatggagaccagaggcctgccttccccagactgataagagcagcacagtgcaattatactcgaacagctttgttttggaatgtaatcaccgccccagccttcttcccaatgggatggcaacagtgtaattaccgcttcaggagtcattgtttgggaatgtatttcttctacagggttcttgcgaggggaaaggagctgcaacaagaatataagagaatttgcagcccgctccccagtagcggtttcataagctgaacaaattattttttgttttcttacagaaacaccagagtttaacttttcagcctctttttctgccaacaaggcatcaccctataccccatgacggttctgtttgagaagtcccaacctaaagctagacagcctgagttctgattcctactctgtcaagtacaagctgtggttgtgggcaaactacttcatctgcttatgcctctgtttccttatttgtaaacaggagtaataccaaggcatcactggaatactgtgaagactaagtgaaataatatgtgaacagtgcttagagctctccctggcacaaggaagtgctcttgggtctttgttttcagcccatttgaagcactgcattccaccacagtcaccacattttgcaaatatgatctaacatcgtgctcagtcgtgcctgactctttgtgaccccatggactgtagcccaccaggctcctctgtccatggcattttccaggtgaaaacactgcagtgggttgccatttcctcctccagggggatctccccaacccagagagtgaacccacgtctcctgcgtctcctgcattggcaggcagattctttaccactccactaccttagttcatggtactaagcttgagttattgcattatttctgtccacaacccttttaccagttcagcgtgaagagaaatgttttggaaaattttaaatgctgctatagaactgtcacagtctctaagctaatttactctattgagtaagagttactagatatgtccccgtcagtcctcagttgtttactagtccagggaaattacaataaagacactgttgtgagcttcctgttggaaaaatgagcaagtactaccaaagctgccactggctggcaatatggcagattcagaagaaaattcacctt

SEQ ID NO: 36373 - DNA, 1174 bp, Bovine  19866880697632
aatcacatgtggccggaagaacctattcaggcaggctagaggacttcccaaaggagttcgtaggttgaaacactatcacacccaggaactttgttaactggagctgtaagttaactcttttttcagagagaggtagtgggggacagcccccccgtaaagtcagaggtgtaggtgagagcacaaagcagaaagtaggcagactctggttttgggggtagatgctcgagaatttccagggggactcctgaggctggatcccgcctttgcgtatgccgagcctccttcctcatgacctttgccacggccagacttcctcccgctggctcccagcattacctgacccagtataccagttgcggaggttgagaaaccctgagtcttggctcattccattctgctgtgactgagaaaacctcgagccctcaccctcaccgtgctgtcagggtttggttaccaaggctaagtgcctcctctgtaaatactttgctgtaactccgtccattaattcactctggcacctttcctataccttcagcttagcggccggaggcctgttaaatggttgggggttttttgttactgtttttttaataaggtgatactttttcttcctgatgtttccaagagacaggctcagttggcctgcagttcttatggaagagaacctggtgacgatactccaatctgttgctagcatctttagctccctaatctgtgtttacacggccctgaaaatcaactctcccaggtgccaggctccattccacctcagcactctggcaccactggcagagaatacttccccagtctcttccccacagtccgaccacgcatgatggttttattgcccagctgttctccagaagatgtctcttgaggcgtggacctgtggggtacttctggagctgtgggttggagtctcagtcatttgcgttccagttgcagatagagccacagtgctcttaaagcatctggtattttctgtaactgttttcctgtttgtagctctcgtcctcttccccagattttaagctcctacaatatggagtttgtttcttcagatttttttttccctattagcaactagcatttctttcatcatataccaagaaaatcaacttggcttcttccattttgggttatgtgcttgtttgctaaaagttgaaggaaattt

SEQ ID NO: 36374 - DNA, 825 bp, Bovine  19866880713079
cacctaaggtctgaccacccttctaggcagaagaggcagcaggcccccagggacaggtatggggtgaccgccaccgccgtgacctctagtccggggtctggaggctgaggtgaagctgctacccgtcctcctccggcccagacagcgttcagagacacacgagtgtacacagatgcatgcacacacaacaggtggccctccttcctccgcacgcgcacacacacgcacacacgttcgctccgtctctgcaggtgatcagcagctctgcaggttgcactccgctgccacggtggcggcttgggcacccaagctttgctcacggagccacggcactgcagctgcaagagagacaggggcgaaaaggagcgttcaggagactctccgttgcctgggacacggctcctctggcggcttctctggggaaccagggagcgcccagagcgaagcacacgagccgcagcgcctggggacaaggtggctgctgggatgccagcgggacctggacgctggccctcttccgaggtgctgacatggaccagctctccctggcggactctctgggcctcctccgccccaggcctgaggacggcagaggaggggtcactacctgaggccttgggtgacacttattcagatacgacaagggcagtttctgtatcaaggcacagggtctgctgccagagatggagaatcaggaaaaaaaaaaaatggcttggaagagaagccagccaggaccagtaattctgaagatgaaagcaatgactgagtttggaatcagcgggtgagcgaacttccacatagagataaaagcaagctggcactgtg

SEQ ID NO: 36375 - DNA, 949 bp, Bovine  19866880751018
ctagcagctggcatacaggtgtgggccagaactgaaggcatccttcatcattcttttccaaagtttccttggttacatatgggtgaacatcaggaatcaatctgtcaaattcctcaaaatatccactggaattctgaatgaaatactattaaattaaattctgaatgaaatactattatatttctagatttcagaagaattagcttctttaagatgttgactctatccagaaagaaggtatagatctttctttattcaaatccttttatattcctaggtaaagataaaggtacacatatcatacatttcctattaagtttacttctgtcttttataagatttcttgctttagtaactagaaaattcctttccattattatttcctcacaaaatactgctgatataaaggaaacttcttagctttgactttatcctatatttggccaccttatgggaaagactgagggcaggaggagaagggggtgacagagaatgagatggtaggatggcaccaccaaatcaggggacatgagtttgaccaaaccccaggaaatagtgaaggacatagaagcctggagtgctcaagtccagggggtcacagagagtggacacaagtgaacaacaataacagttataagcagtagcaatgctcactgattttcttggtttctttaggtagaaaagcacatcatctgcaaaaatgaaatacacatctattgtttcaacggtatttttcatttccttttcctatgttaaggaaatactacctagaacttctagaataatcaactcattttccccctttgtcagtatagctaatgatttgttaatttttcttcgtaacttccaagaatttaacttctagtttttgttttctgattctttaattctgactaatctgactgaagcacatccaacggtttttcagacaaaaatttttttcaaaggg

SEQ ID NO: 36376 - DNA, 1043 bp, Bovine  19866880752769
tatgttaatactgcatgaaaattattgtttatttatttcttcagtagcatatgtttccttctttgtatcgtgtgtgtgcatgtggccatactgtttcgtggactttcatatcatcttacttgtgtattgaattttttgaacagttacctttggtgagaatgttgaaatagacctttcgttaggaataactcttatattgcttgtctatcaattgagtcttaaactgggaaggtggtgaactcttccccttaagagataatctgtgtttcagtcatcctttgagtttttctaaagcaactttcttacactagacacttgttaggcagtttgaatgcccctccatttctctccctccaacacactgcagactgcacacctctgccccctttttaaagaaaaaatagtgagcaggtctcagctggaggaaactattctttcctatattttggaatcatctatggaaatgtttttctgctttttaaagtagacaaaaaaagtgaaccgataatttggagataggaaagggatggggcctaacaggttgatgatctaggttatattttgactttgtttgtgggcctaggggagaaaaataacttaaacacagaagccaaaaagatgggttttgttttattgttttggctgcattgagaatacaaactgtcagtacttgaggagaaggagcagcagagaggaattgatttttttctgctgcagatccaagtattgttaaccatgtggatctctaaagcagcatacttacaaatcaaacagtagttgattctctgactcaattaacagtcagaaccctagactgttttttaaaattttaaataagtaccaaaaacttcagagtaatgacaataatttcctgatcaaagtgggtgatagtaaccatggcaactgctctctctggccttatggacagtatgttgtattgatgaagcttcagatcctctagtagcctgtcacttttatggtgaaatgtagtagcatgtgctgcaggtgatttttagctggattgtgttaaatttgtgtgccag

SEQ ID NO: 36377 - DNA, 1567 bp, Bovine  19866880753293
gtcatgaagcagaagatgtttttctagaaataaccgtggtcatctctcccttgtctgaaagagcagtcccaaagtgctcttgattgcccctacacccgcctcttgatgccaccctcagtgacatgtgttcactgcacccccgtctgcttcagtcttcacatccatcccacctgttctcatctccacccaagtctcccttctggctcagttctcccctacacagctccagacacagccactggtgacctcattatcaaagcgaatggacaccttgtcttctgatctttcccagcctctcagacggcatctgacagctgtgagctctgctcctagaagctctctccatccacttccgagatactcacctctcccagtttttctcccctctctgtgcgttcctgcacagccttcctgtttactcctcttcttccactgtctcttaaagtccaccttccccgtagttctgcccctaagtctcttttccctttacgcagatccaagattttaacataccacctggacgctgacaatttcctaatctccgcctgggatccctctccgccaagtcctagacttgcatgctaatgtgaacactctacaggcagctcaaatgcaagatgtgctaaaaggaattctttttctctccaaacctgcccctcctccggcattccctgtctcagcaaatggtcttatctaccaccatggcctcgaagtcagacatctaaatgtcatgccaggctccagcctcactcttgcaccccacagccaatttgatgtcaaagcctgttgataattccttctaattatctctggaatctgtctcatcttcactctatgccctgtagagccccaggacaggcaaatctgattatctcactgtctggtttaaaaacattcagtaactctctatcaccttcaggataaaatattttttctctttagatcccttcaagggccatactttccatcagggccaggaggaggctgaggcaagtgtgacactttagagtgccacgtttaaggaggtactcattcccagggctgtacaagggcctccttaagtttgcaccctaaccaccctttgcctcatcccagtcctagctcagctcttcatggctacatgtctgcatgacattctctgcaccccaaacgctctaagcccttctgtacctctccgactcctacccacgctataagacgcagtcaagggactttcctggtggtccagtggttaagaacccaccctgcaatgcagggatgtgagtttgatacttggtcagggaactaagatctcacatgccgcggaacagctaagccagtgcaccacaactagagagcccgtgcacctcgacgaaatatcctgcatgtcgcaacaaagatcctgagtgctgcaattaaggcctgatgcagcccaatgcacacatacatacatatttaaaaaaaaaaagactcagtcaaaggtcgcctcctctaagttgccctccctgatccgtggaatctgaactacatgacactcttctgtatttcttagcacccctccctcacgctgggcctgatgactggttca

SEQ ID NO: 36378 - DNA, 1273 bp, Bovine  19866880755563
ctattatttcactaaataaaagtttaaaaaatataacacaaaaaatcaattattgagaactatataactaaaaaatcttcaataagcatgaactatccaattgaaagtcaccttatcgttttggttcacacattcacctactccaaaaccgagccttttaaccagagggagaatggtggggaaggaacaagaaaacaaatgctctgtcagattaccacagacgtttacttatactctgtcaattgtcacactccacctggtggcaggagctgcctgaactggtgaagtggagctcattatacaagaaattccaaagaacacttgctagatgtacttggggaagaaagcaagatgttcttttttttttttttttttggtcctacacagaatatatctaacaagcctccaccaaagttttttttcacataatagtaggtcagtatctaataaagattaacataaaggaatgacaataatcagaatgggagacctacttaaaccattctctccacggtaagttaaatgtcatctcaagcctttaatacaggtaacaaggcacatccagcaactttaagattctctgtcacacactctcactaacatgctttgcccccaccttctatgggtaaactatggagtttaattaacacagtcaacagcagcctgccacacggctgttagatatttgccactaacatatactcatgggatactctagagactgatttcaactgaaaataaaaatagataaacagagctcaaaaaaaattaaaactgagtctggctgcccacacttactttcacacatgaggaaaaatagcagttctcctagaagcctcgagcagacatatctttagaacacaatgttaaaaatatgccccccctcctttttcccctacctgtttctcactcaaagctgtgattttggcttggagttcatgaagctgtttctttaaatcagcattctgattggaaagaaaaaatatctgtgaggaagatatttcatttgttaacaggatagtagcaaggagactttatgcatactgtattacaaatgatgaagcaaccttaaagcatttagcccatcatatttgtcatgcattaaactgtagtcatgttaccaccacctagcgcatagatcctaaatgtaggctgctaacacaaggacaggggtaaattcctttgtgattatttcaaattaaaagatattttatattttagcattttgtagtgtaatagtactcctttctactaaaatagctattcttcataa

SEQ ID NO: 36379 - DNA, 1093 bp, Bovine  19866880759720
tttgcttgcttctcgcactagaatgtgaagcctgtgaggacagcaggggtttgtcatgtgtattgctcactgttgttttatcagtgcctcaaagaatacctggcgtataataagtcctcaataaacatttgcttaatgggttattactgtactcacatagacgaggcaaaggatgggttcaaactcagggcttcatgactcaaagctcgtgttctgaacgactgtgctccactgccactgtgttgaatattgaatatctgatgcgttcttccaaatggctatttcctacactctggcagttttctatttcttggctctcgctggagttgatttttctgagttagtgaggactctctatgaactgcatcctaatatttcctcaagatcattgcattgcaaaataggctgaaataagactgcccactgcattacctgcagagctctctctccttcatctcgcttcactgcagcctgtctgccggctaaggtcagaactgcctgcttctggccaaacgcaatctcgggttaaggagttgatatgctgcaatctgcaaagtaaattagaaaaacccaaatgaccaataacagcccctcaggtttgcatgtttaacagccttccaagtgccttcaaacacattatctattttgatgcttataatgaccgaccggatagatcactgctcactccatggcttagatgaataaacagaggtctcaattagcagcagtgctaggactggaatatggatcttctgatccaaaaagcccaaattctcctcaaactgagcttccttccacggatttcaatcctgcttattactcgctttagttttagagttctgccagcttttcatatacagcaccccggagtcttggtagacaagtagactgtgtaactggggagagattgggggtgttttgaacacatgtggtttttggctgcccaacattctgctcccttattttggcaagagccccaatttctgttttggacaattgcttctaccccagtggttgcagtctcagttgggttgttaatcaaggtggcaaaggagagggcgtttactcaagccaagccagtcagattcaagga

SEQ ID NO: 36380 - DNA, 927 bp, Bovine  19866880780848
attgagggttggtagatggtgtatgtcctttgttttaagatagtaggcttttaacatgcgattccttcttacaggcgtttcttgctgcctgaatacttgccttatgctgggatttttcatgaacgtggacagcctggcttggctactcactcttctgttaacagggtcctggcaggtaagaaggagttgtttctttggattttgacattttaaaggaagagggagtcaaggagagctttcctttctttacctgcgttgttacgatggcatcttggcatctggtggaaagtctcgtactcagatgccttacttcagggcaggaaactactgatggagggaagctgctgctttttatccatcccctcttccttcagacatttttttgttttaatttgtttaaaccatttgtttcttaatccagcaaatagacttttttaaatggaatgataaaggtgccttgttcatgttttattggcaaggaactcatgagccagatcctctgatttaattaggagctgaaggcacacctctctgacccttgtctgctgccagcacatggagttcccaggccctgtggagtcttcagaggaagcagagagacccttggaggagctggcttaaaaatttccatagaatagaaagtgggctggacaagccggctgaggcagttaccctggtggttgagtagcagtgaccagtgtttggggcctaagatgtatgacatgactgggctgagacacagggtgtcctgctgcttctgggcagtctctagagaaggaaacaaagcagatgcatttttttttccaacaaaaggtttttctctttcctccccttcttcgtctgccctacccccacttccactgccaacttgtaaatttatgtacgtgaaggcattaaaaactataaaaatcaagccacatcttggtg

SEQ ID NO: 36381 - DNA, 1903 bp, Bovine  19866880860810
atgcacctgagaaggcagagaaattcagatttaaaatttgggagctctttccccattgaaatccagtcagcagggatcataaaaatttctctgaaatttaagtttggtaaaatgaaaaaatgagaaactttcattttaaaagttagatctaaaaatgtgactagaagcagggcccacttgtatcacccactaccatattctctttgcttactttttctttttcacagttactcaggccaaatcattttcccttaaaacaacatccttctggaaatccacttaggttcccttaacatggagaacataaaatctccacgctaatgttgtcgtaccctcagttggttttgctctgtgatctttttggttttgcctagaccgctgagacaaggatgctccaggatgaaatgagctgtctttaggcgcagttagtcacgaagcttaggttcgagcgtttcacctttgaataagagtcagttcccatcaacccactgatgtttatcataggaaatgtagtcttcacccagattggaattggaatgagtttttcttttctattaggtgaacatcaacaacacaatgtacttggaagaaagaagtttgcgcttatgctaattgaggaagtaatatgaaaataaaatgtttgtggctctgagaccccaaatccctgtacctttggggaatcaaaagtccccaggtgggtgttggaaaatgcttcttgttttttaattctcactctcaataagttaggagaacgtattgctgattctggtcccgacttctctgtgttatctccccgtccaccagtgcagttctcagcccaaagtccgtaacccactactgcctctagtttcattcacccactcagatgctgggatggtagaagtagtgttattttaaattaaatgaaaatgtaacgaattcctctttctttcacttacagcactgctgctgctaagtcgcttcagtcgtgtccgactctgtgcgaccccatagatggcagcccaccaggctcccccgtccctgggatccttcaggcaagaacactggagtgggttgccatttccttcttcaatgcatgaaagtgaaaagtgaaagtgaagtctctcagtcgtgtccaactcctagcgaccccgtggactgcagcccaccaggctcctccgtccatgggattcgccaggcaagagtactggagtggggtgccattgccttctccacttacagcactagtcttcagtaaacgcagtcttttgcaatttctatctcatcagttctctgcagacaaagagagagacatgaacagtatatggcgtgtccattttacagatgggaataacagtggactgtacatcaaagctgagaacaacttctctcccattcatcaacattatactgtggaagagatttgacttattcatgccaatgaagtataaaacacgagtgatcaacctctgtttagccctggggaagaagtgatacagctttcatcaatagacatctatagacataatgctttgagttcagagagccttcaaaacatttattattcgaatagttttcttagcattaccacctgtatgaaatacttttccgtttcagagatgacgctaaaaggaaagtaggctgactggactgaaagaacagagtctagggcttctgcttctccactgccaccacactggggtgtggttctctgtgttctagcttggatgcacacagatgatgagtttaacaagaatgggtgtcaggttcatccagagatcatgacctcaggacgtaaattattcagcagcgaggttgatgtgactatttataggtcataaatcagttataaactcagaaatatgagaacaggtccctaaatagggaggcaattgttacctatccagggtttaatttcaataag

SEQ ID NO: 36382 - DNA, 1562 bp, Bovine  19866880869941
ttactgattactatggatctaatatgctagtagataaaacatatctttaacttttaactaccagtgctaaaaatgatgcacaaatgtgaaaattttaataacttatgaaaactaacatttactaacatgaatcaataagatgacattaaaaaaatatataatgtttattttcttattttcatggtggtatttctttggtgacactccataggtcaacaggaaatgctactgcacaaagaacttgatgttggaggctatactttgagtctggcaaggttactatgctcaagtactggtattataggtgctgacaaacctgagctagtaagactgatgcttcttaaccactgaatttacacacatacacacacacacaattcgattaatgatatctaaaagtatgaatgcctttgagtataaaatatgtatctttcctttggtttcttgggtgtaagggggccagatccttgttaaaaagaaaaaaaaaaaaaaaaaacagggaatacctgcacaagtcataccattccagcacaagggagtggtattttcggtcgagtcagggtttccccacagcccctcttctgcacaggtctgctgtagtgagtgtcctgccccactccctaccaccagtgttcattctaagatacagtttctacctccacttcctggctccaggcctggcagacacacatacactcttctatttgctacttttctttacagaaattgagcatgtctactaaactcttcccaactatacccaacaacaagaacactgaagcaaattcaaaaatgcacagaaattcaaaatgaaggaggctgaagagaagagttgtataaaagcattttagaaagtgttgccatatttaccagaatgctttttaatgataaatattttactacacaaaggagaacataagagaggacggtagtcttggtatactaatcagtacttaacagaagtagaagttacgggagagagatttcagatcaatttaaggaagagctaaggattagagctgtacaaaaaaggaatgggttaccttatgaggtagtgggctccctgtcaatagaagtattcaagaatgctgcatatcatatccccctcttggagattcacaatgcacattagcatattaaaggttctgagaagtcctgcagtaaagaaacctgtttaactttgtttaaagcagcattttccaaattatttgaccacagaacattttccccaccctcccacctcaataatatttattaatttctgtggaaattacagttcctcagaacacattacagaaatatgagctatattctttaaaatgtagaatttaatacatcagggatatatctgaataacaatatgtcagggatgtaagagaagaaactgccacacctggtaaatggttcaaagagaaggcccttaacattccttcttctttaagaaatgtatgattccattgcatctcaaactaaagggctatggggtcttgattatttatttttattggttccatgagagaaaggcaagtagataaaaaggtagtataatctaagattaactg

SEQ ID NO: 36383 - DNA, 2180 bp, Bovine  19866880930913
ctggtggggaaacggggcaagaagaaacaggaggactcttcccaggggacttctttctctgaccagtagaagttgacttggaggaggggtgggcacccctgttgatgcttcatcctcaaaggccagggcgtgggtatgagtggggtgcctggaatttctgaagtctgtatctgctatggttgggtgtggctgttcagttgggtgcggctgttagtttccacccttctggggttaaggacacagggagggagatgaggtcatggtttatgagagcttcaactacgtggctttggaaagatgtaacgtaaaatgcggataaaatgtttatgcacgacattggcaataatacgaagcccctcagttaaaataaaagtcatcagagttgtttcctggagttggaggagctaagtgagctgttaactgggaattgtaagcctgctgcatggtactggtgctcaggctgttaaatagaaatacctgccttccatatgtgtgcactgctgtcttcatgcatccgaatttctaatttctgctggggattctaaagaccattgtgctgctttctctacattcacagtgattataactttaatcttttatctgtatcctgtaataacgtcatccaagtgttctttaaacggtggtgctggaaaacgcacctgaaaatcgacaacattggaaaggaagtgagatgtgatagaaaaaaaacgttatgaagaagaccaaaccaccggcaggaaatgctgccctgttaatttagctgagagcgtgttgtgaaatattagaggtaatgccgggaaaataaaaagtggcattgaagcaagaatatgctacaatgggggttatgcagcacagcccttccactttgcattcatttctatggcgaaattactctggaattatgcatgttttgaatcatgcaaggtcttcaggaacacacgctttgcataaaatccgactgttctgcgcttatcagtgggtgggggaggatgggtcagttattctagggttttcttagaggaggcaactttctctttttgtcttggcttgggccttggtgacttcacttgtaaaatgggacaggctggtttatctcgatctattagattttgtcgaaataggcaccatcattttctgccccaaaggtgtctttttggagaccgagtccacaccatgcactaaatccatcttgattcattgtgagactgacttttcaaatactaggtgccatagaggatccctcacttatcctgatgggattcatccaggtggaacgatccctggagacaagagcccgttatctccacccctgtagtcccaccaagatgtgccctggtggtgacaggtggtggccgattgaaaaggtccacggacgggcgggagaaagccgggtgtgatggggacccggcaccactagagggcagcaccagcacacggctgaggcggcctctgctagggcctcgccgggaggggaggcttccctccagtcactgcagccctcgggaaggccaggcccagttctgagtgcaagtgataccaatgcgggagatggggacaccccaggaccctgctcttatgagacttacatcctcttggaggagacaagataaacatgtgagtgcatcataaacaaggctctttcaagtgcagtaaccagcagtgtgcgtgcgtgtgcgctgagttgtgtctctttgcgaccccatggactgcagcctgcctggcgcgtctgtcggtgcagttttacaggcaagaatactggagtgggctgctgtttcctactccagggaagtagcaataaagtgatgcaaataaaatagtgatggaggaggcacccgcaggggccttcccaggtggtgccagtggtacagaacccgcctgccaatgcaggagacataagagaaacgccgtttcgatcccttggtggggaagatgcccggagaaggaaatggcaacccactccaggattcttgcctggagaatgccacggacagaggagtctggcaggctacagtccatggggtcacagagtgggacacgactgaagccctttagaaggcacacaggaaccggctgaggaggactgcctggggaggtgacagcatgagccctaaatggggaggaagagcagtgatctgaagatctaggcgtacatgggcacaggaaggggtctgtctgggggc

SEQ ID NO: 36384 - DNA, 5320 bp, Bovine  19866880941680
taattttaaaactttgtacataaaaattagaagcaagctaaacactgtaggtccttcagtctgtctacacttgcagacaaccaaatcagtcatggcttcagtagttcccctacatcctgggatccacactaaaactacttccaccacactctcccttgcactatttttttgtttgtttttaaacttgacaatccttatacctgacctgcttattaccactggaaagaatccttaaaccaggccacaggctctgcctgaagttcatgccatctttaccctcaccttctggtcacccttagtgatcatctatcaatatccctcaaaagctattcaaatctttgtcttccttgacttctttgcacaagtgtactgttgaccatgctcttcctgggatcctctgctcacctgtcactattacttaccattatttagttgtttctctttcccacagccctgaaagttccttgaggcttagatccttttacagtcatatgctttttaaagttcctatcctaaaccctctttctctccctctctacactcatttccttggttatcttcattcaaaatcaatgctgcagttatctcctttgtcagacaatggaagaccataggacctggatagaattttggtccttacgactagcatactgtatggtctcaggcaagttaattaacttcaatctgtttactcacctcttaaatgtggatagcagtatctattacaccttacaaggctactgtgagtattaagtgaggtcagtataaggtacctacctaatagtcttggcctctcctgaatccctacaaccatatatctaatttatatgatagacatatctaccttaccacttcaccaacactgaaaagttgggctagctcaagaccaaaatgcacccctgtcttcctcccttgcagtttcctatcttaataacaccctactagctcaagctgggaaccctaatcactccttcaatcttatgcctaattagtccttgcactgtcttgtacttctgtgccactgccgtgagttaggcctcttaccaggacaatttataacatcttcctaactggtaatctctcccatctagagcacacaggtccttttgctgatagaatactttctcaaaaagggatctcactatgtcatttctctgcttaaaatttcccgtgttttctacctagtaactatggaataaagcctagactcctaggtgaggcattaaaggctgttaacaattgtacttcgttcattccttcagccactctgaattatctgcttgataactgaaatgcctgaaatgcttcttcctgcctctgtacctttgcttaaatcagttcttcctttccatccaacacctctcctacctgtctatacacctctcattcctgaagacctaaaacaaacactgttttttacacaaatcttttcctaattccctactcaggattaatatctccttctctctgtttgcagaacacgctgtttataactctataaaggcatgtaccataatctactgtatatttcaatttatatgttatacatctctctcttcttctatgctaccagtgacctgagaacaggaaaccaggtcctaagcattcagtagtccattgcctggaagctggtagtcctcacagatgtttattaaactgaacagaataattatatgattctatcatctagaatgcagaaccgtagcacttaaaaaaataacaaaacacaaactacctcaaccaatcatcaaactcagcatcactgataacggggcaaatggtcatgctgtgccctcctgtgatgaaggcacaaaatagtgtaagaagtattcttaaaccaagaaagtttaatgtggatttaatcatgaggagctaaatcagataaaatcgcaggacaatcagcattgcaaccaggccacaggctctgcctgaagatcatgccatcttcaccctcaccttctggacacccttagtgatcacctatcattttttcccaatttgatttttcttcaaaaatttcaacaatgtacctctcccctctcccctccatgcgccccaccaaaaggccatgaaactgctgtagattaaagatcaaagaaaaatggcaaccaaatgcaatgtgtgattcttgactggatcttagattaaaaatataaaggcttctaaagaatacagtggtcacctactagggaaatgtgattttgagattagtgctacccaaaagtatagtccatggacccatgctgatctgtaaactattaatgataagtactaagataagtataaaacttgagaatgtacatttacaaatgtttagagaaatgtgacagtaattttatgtctgtttaataataaagcaattgggcctgtgctttgtccatatgatgttttttgtaatttcattttttctagtaatccattttgttgtacatcataaaaactttactgatgaactggaagtttaaaaacagatgcttttccacagatagtctgagaagtactctattagagaaaattatcaatcttaaattccctgagtgtgatccttatggttatcttggagataaatgtctacaaaaagcagcaaaaatcaatttaagtaaacatgtatacaaagaaagtatacagctatatagaaaaaagttaactagacttttacatccaaaacatgtacatctgttaagctttaaatgaaacatttgctatcctatagctctagtacagtgacaaatgagatttttattagcgctaagaatgaagaaagaggcagaagatgtcagagtatactgaaagctagcaagactacaccccactgctcgcacacagtacttggatgtatttattcccttcctgccctgtgggtgtggactgcagatagtctctctactctgtctgcagtggtggtgttctatgaagctgtttcataagatgaaattcttgacaatgaaaagctccaggtttttaagtaacatgtcaagatttgctctattgaaaaaccccaacactaaactggaaaagaaatcattatccttactattttatttctaatttctatgcaattaacaaagattatacagatcaaaatgtaagtgtgtttgtccctgaaaactgtgaattataaacatgtactggttaggaaaaactaatcttctccttaaaagtaaccagggttcaacataaaagactatcaaataaagaagtataaggcaatcagctgcctgaatcgtatgttgctgtacttttttctctataactttgtaatctcaattagtgtaaaaaaattttttttgctattttggctaattaaattaattagctagctgtaggggttttagaaatatgtcctgtgcttattctgtgctgtgctgtcaaatccaactctttgccactccatggactgtaacccaccaggctcctctgtccatgaaatgctttttttcaggcaagaatattgaagcaagctgtcatttcctattccaggggatcttctggacccagggattgaacctgtgtcctatggttaaagcttccttataaagacatcaaaatataacacctaagaatgccctcaagacctgttagttgggtatcctgcaagtctggactcaagctcactgtcatcttcagaagaatgcacactattaccatctaactttttctaactgggcaatctataggggaaaaataaatgcatcttcctaaaattgaaagaaaattgtcagaagacttcatctcttgtcacttcagagaaaaaacaactatgctgaaatggccatcagtgtataatttaatttatgtgcctttaaaaatctcactaacctatttgactcaatttctcatggaagggatttcacagaattacaagtatatatcacatgactccaaaaaagacaatttgacaaatctgaacaaaatcctgaaacagacaccaaaccaaaaaaaaaaaaaaacaacagaaactgagacagcaattgatgcttgtagaaaaaatgatgatgctgtactgagaatgactgcaggtaggagcagatggcaataactggcttaatggcactgcttactgcataccatgacacactctcacagatgcacatcaccaatctctaaaataacatctcagagcaatgcaatccagtgcaagactttttatgacaaaatcaatgtatcatcactgtaagcagctgaacacacaaatcatgtaagaagctaaaattgtgtttaaagacaaactcatttggtcaaaactaaggcaagaaaaagaaagggagaataaaataagactttcccattctggaagcttagtctactttgggttttttgcttttaaaaaaaaaaaaaatttggagcctttgaaactcacatactcccattttcgaactttcgtggatgctaatttctcagttattggtttctgctttattttctctgaagaggcaaagaaagaactgctttttaacgtgttccaggagatgggagaaaagactgtcagcttttaaacttggcaggaaaggtactttttgatgactgtgggatctaagtttcaaacaaagtcatatcaaaattaagcataacatcaaatcaatctcaactgttttcacttgagatttagactaacctagaagctaacttttattgataaatatacatgcatgtatacagcctttaaaaaactaagtaggaatgaactaggcccacacttggatatgaccaattctagacaacttctgctgaaagcaggcatcagaggagtttaaaagacattctgccatactcctaagtaagttctggagttggtactacagagtatcatgctcgtactgacgctataaactgcactttatccaccgaaatgaactttttcaagacctaaacattttacttttgtattaacttaggcagtcagactacattccaatcttggtaatgaagttgagtctcatcgtctacttggatttgactggctcctttatttttatttttcgtatttcagcttgagacttaaatagcactctgctctataaatgctagcatgacactgaaatatgggttacatttcctaggtagcaaaggatcaaataaccagaaaaagcaggaaaaccagtgtgctcgactttcagggttcctaataaacttaaccatcatgtcatagcatttcagatctttttcctttaaggacttatcactaattcctacattttaactcctttttggggctatcattttggaagagactgcttgacctgaatgaggggaattcaagcaaactctgataagcaaagctactctagtgagagcaagtcttctccaactccattttatt

SEQ ID NO: 36385 - DNA, 3756 bp, Bovine  19866881049133
ccccgctctcctgggctttgatccagtttctagcccagacggtggcacttggtgcaccttccagcaccttctgcagagatcacgttcatcccccttatctaccgtcagcatcccgcctgcatggcctcgcctcccctctctcctcggcctctgctcccctacgcccgaaattcttcacttcgtccatgcctgaagtcccgctattagccctttcttaaacaaaacaaaacaaacgcccctgaaagaagcgatcagtcaaacacttgatgagaattcggctgtccaatctctgtccctcccagaggcctacttgcaggaacgagaggtttaatagggaagagaataaagaattctcttcagtcggagtcagatgagcccacagagatcagcccgtccagcccccctcatttcacgctcagggaagttgagacccggagcatctggcgacctgcgatcagatgtgggttggaggacgcgcactcgggtctgtgactccgactgcagccgcactccccaccctgctcctcactccttcctagaacctgggaagagggatctacactaccctacactcagacccgccctctcgagaggccctggggctcaaaggtctcagcaaagaatgtgctccttcagcttggaccccctcaagggcagaagagataaactcaggaaggtgctgactctacctaccttcccctccaggtctgaagggctctcctaaccagccttatcccctctcctgagttgtggcagaggatctaggtatgatgcccacagaaaagcagaagtcttcacttgccaacaatgccacgaggtaggggtgatgaccatccccattttacagatgaggcaactgaggtgcagaaagataaccaaccaaccagctgggctgtccctaaccccaaaacctggactcctcccactgccccagaagaaggactaaggactcccagcacagtgctcccagtgcgggcttctgtaagactaagaaccccacgcagctctgataaggctgacttcctaccaccctgacgccagctgccgcctcggcccctgctgagcccactgtgtgtaatttggtgccaattaggaatgagtgggaaccattagtgcatttaattcccaacctagaaacaggctctgggaagctaagctgcaattagctgagttgcctccccccaggctgccccagccacccttttctcaccgctgagcccctgcctttgatgggaaccatccaccaaccacttcgagaacccctcctagggatccaggagatccggatgggaatttgacgtggaccctgcccttgagcaggaaatgaaaatggagcattgaggtagctgccaaaacccttgttgccaaagactcagtttccccatctgtagaatgggaataaaaccactcagcacctcattgggttgttataaagagtcatttcttaatttatcacacaaactcttttgatctcctcagcaccagctgtggctccagctacagaggacacaggaaaatcaagccctggctcatggagccttcactctgatgggaaagacagacaacagacagtaaagccataataaaaaatatccatgaaagtgaagcagtgtgatgagacatggagggactggagggggtgaccaaaaaatggtggtccctattgttttcatgactactattttatgtgttcagttgggtcttgaaagcccaatgggacagatcagcgcagggagaattccaggtggaggaaagagcgtgcaaaggcaggaaggggcttaacgagttcctgccactggcggctctaggatctggaatgggcatgtgatccacaggggacccagcaaggctggagaggtggggattctggccgcaaagggctgtgaatgcaatgctcagagacagaaccttatcccatgggcagcagagggccatcaaaaagacctcagaagagagtcgaacggcaagactgatgcttccaaaggccagatgtggctgcagcctggttggaggggcgtggggagggaggctgcccacggaggctgtcagcactcagagaccgagcgcaatcccaaggagaggctggggccaggcctgagggtggctgtgggcagggagagaggagaggtgttcgagaggcagatgagaaaagggctcgctgactgatgggatgtgggaggcgagcgatgacttgagcactatgaataacggcgtcttctcgctaccgcgggggagcagcccaccatgccggcagccccagccctgatgcaaagtggctgcaggagcactgggcagacactgctcctccatggcacacgcgtgtgcctcggctccttggatgccaggccttcgcgtgcactccctctgcctttgggacacgtcccttttggacggggccccactcagcaacgactcctctgggaagccttccctgacagcccctcagttattcactcccctctccaggtttcatcaggaccccactcacagagatgttagcccttcccccaggggaggtctttgtccctttcttggttcgtctcctcgagtagcctacgaactgctccaggacaggagtgtctgtcccttattgttgtctggtgaccagtacgctctggacatgtttgctgaatgaatgggtgaaacagagtgggaccacccactaagatgtggaatccaggcgaaggtggtgagtcgatctaggctccgctgggtacgaaggcgatgtgtccacatggatgcatgaggcagctggatataaggatccaaagctcagggaggtgagctgccaggtcatctgacccccacccccagccctgcctggcctccctgcctctcccaccccgagagccacttctgctgcagtgatccatgagccgccagaacagagggatcaagagagtgcgggaatgtggcactgtccaccgagctcctcagggagcctttagggatttgctttccataaataaatgaggtttggggttaattgctcctcccttcgtatatggagggatgtggggtgaatctgctcttcctccctgctcatcctcactaggaaaatgagagcagacccaggaccactactcttgggggaagaaggaatgacattttccctttacattggaaatacttaaaagtcccgagaatagatttataggaatattttaaccttttctttgatccttgaaatgtcattgttctgtgggctgaatcgccaaatgtgaccttttcctgtagccatagggcgggggaaccccactgggtctttgaaaggagcttcagatgttctcctggcagcttcctcagcagcccacccaccctggagctctgagctagcaggatgggtgagtgggagaggcaagcaggggccagccagggagcgccgggcagcactctgcttgcctcatccacggaagatgagctaagtgtgggtccatcgctagttaattcactctgtggccttgggttaagcttcttttttttctctctctctttaggcctctgtttcctataaaatggggaaaattgtggtacctactttaaagagttgttgcaaagactaaataagactattcgtgttgtattagttcttgcagaacaaaagctgaaaataaacaaccccccaaattcagtggctgacaaccgtgaacacttattcgactcacaggtctgcagggtaacccaggttgggtggactgggctgggtttggctgggttgagtcttctctgtgtgtgctctgctcatgctggggccca

SEQ ID NO: 36386 - DNA, 1570 bp, Bovine  19866881055661
ctccatgcggctgatgatggcctgaaagcgcttgtaggtaaggggcggcttctgcccattcagctcaatgatcctgggaatcccaaagacgcctgccgtcactctcgaggcccttcgtctcaggtctctgcccgcccagaaaacagcccagactgcgcaggcttggagggtggccttcctcatccgctctgggtcccacccctagggggaaaggaggggacaaggaggctacgtctccatgttaccgagagggaaatgaagcccagattgctggagcaggtgccttgggtaacagagcaagtcagggccaaatctggggttcaattccaggttccctggtgccggtgtggagccgcctaaagacagacactgaccagatctctcttatcacagaaaagtccccactggccttcacggtccttggcctgcctgtccaagccacagggtgccctgtggactgtctctaccccactgtaagcctccaggaagttctttgataagagctgcaaacgtgttccttgggtggaaattcattctctccttgggccctagttactagaacagagaggtggggaacagcctgtccctccctaaatcggaggctcggggttcatagtcacaactcaaccttaaagatttttttgcagtttacaaaaacacagctgcactcaggtaagaaaaaaagctagaggagagtttagaggcgaattgaggctgtttatgtaaggatgaattcggatgggctggagccagactcccggggcccctgttggccaagcagcagctgacgacaagccagaacttgccgggctagttcatctcagttcctctctcctcccctccattagcggaggcagaaggttggctgctgctccggcagtgcctccgcctcctcctccggcacgtggcgggaggaggcgctccacacccagcgcctcctgtgagcccagctcacatgcagagctgtgtgacctggcctcccagcagccaccaccagtctggggaaggcgggcgggaagccttggtgacggcagcagcccaagagggacagccctggcagggaaggaaggggaggagggggtttcctcctggcctctctgaaagcacagggcccccacagtgatctctcaagcctccagggcaacacctaaatgtgaggcctggaaacccaagagccaggagagcccagggaacgcagctgggtaacagaagctgtgcctgtgagagcagatatctactgtgaggggccacagacagggccccactgaggtcagagggcagtttctgagcagcaggatggaagcaggagcatgtggggtaggtgggcctggagcgtgttaggagcagatctatgaagatcctgcttgcgtctcttgggcctaatgagcctctctgcacccaaatttggagaaggcaatggcaccccactccagtacttttgcctagaaaaccccatggatggaggagcctggtaggctgcagtccatggggttgctagagtcggacacaactgagcgacttcactttcacttttcattttcatgcatggagaaggaaaggcaacccactc

SEQ ID NO: 36387 - DNA, 1443 bp, Bovine  19866881068313
tctgaattgtaagggtcttgctacttattacagctctacttagcttcagctaagcaacaggattaacatcttaaagttccagaaagatcttgagtaagtccattgaaaaattccattcgctattagaagctgaaatttgtgattgctttttacctgcttacaatattacacaaagtagattgcttatggtggacagcttaaggatgctgcccttaggtacagagtactgttagaaatattttgcttggaaaataattagtctcatattggagttactttcatattggtgagtggagtgttgaacacgtttttaaaaattatgtgctgtggatggctataaacaaaagtagttaatacgacttgggacttttgactttgaggtcatctttataatattgagtgagatatagagtacttgaactattattggaaagggagatattgtatggaaaaattcttagactttctgtgtttttttccttcccatctgtggacagtaatccgaatagataaattcttaggccctcaactttataaatacatgcagttaatgtgtttgagttggcctccaaagaccgagattcttgaactagaagtaaagttctgtctgtgggtataggtcattgctgatatggctgttagtaacacaacaataattgcataaagatggaagtattttcgtagcatttatagcacatggtcctttgaaactcttgttagtcttaggtgaattgatttatcactggaaatattatggtactgtggtggcttgtaaagttttatatcaaagttttaaaaacttaagaatgtgtagcaaatttgatgaacttgtttgaattttgtttgttttttggaaataatgctgtacttttttctcagtaagatcaaatgatataatacatgtgaaagttctttgtaaattgtcagcagccatgcagatgttaagttgttgagataggtggctaattaatacatgggcagaagctcctggctttaaaatattaactttattcatatgatttgggaaacgagtgcattaaaagtgcacccagaacactttatgaacttttttttaatactgctctggttaccaaaaagctctttgttagaatattgaagctttgtttaaaaatgctgtctaggcagtttcccctaataaaaaataaataataaatttttccttttgtagaccctgtgaaatgtgtatctcctgttaaagtttttcttcattctccattgatgtgatagtacttgattttagtgattattttaaagttcctgtatttttctatagacttttagtaacacacagagtaaccagatgtcatggttaatattttgattgttttgactgatcctgctaactttctgaaaaattcttgctgactaaaccattcaaacttgttcagagtgaaaaagacatgtatctgtatgcgttagtat

SEQ ID NO: 36388 - DNA, 2572 bp, Bovine  19866881103923
ggccgagagggaaatgcccaggtccataactagtaggtggctgaggtaagatcaggaagatccgtctgactctaaagccctggctcttttcactatgcttcactgcttcctacaagagaagagaagacagaaccttcatgtggcttagtttccaatgcatgaaaggaacaataagccaaagggcactggctagacacagtagttaattaactgctcaatcaactctacaaaataaatgaacctcttgagagcttgatttggggtattttctgaattcttcctttggattatcttcaacttaatgagataatcttcaaactggccctggaatcaaagttaagacaacactttggctttcaagggcactactgagagccttacaaaccagaaatgaaagcccaggaaaatttttatatcttggtagaattggatgctgagcatttagagacaaatcaatatcagggatcttggaagttgatccattaaaagtcagtacttggtttttatcttcccagaagagacagcatactgctgttttctttaacagagcaaatttctttgacttgaaactctacagatgaagggagatgcaagaaaagagagataagatcatatggaaagtgaaaaggggattataaagaacgagatcagaagttcctgaccagtagaccgcaactctggggaacgcacaaattattataaggagcagcttattatcaaacaaaaaaggcagctcccaaactaagtatattattatttttcaatatgtagattcaagttgtgatcaaagtaccaattcagttaaaagtacaagggaattcatgacagctcttcacatattttacttatcaatgggcactgaaagtgcaactaattatcatgagaggagttagaaaatattttgaagttttaagggttctaagggggaaaaaggggtcctaagcctcaaaacggtcaaaaattaagttacagaaagaagcatcatgggacaaatccaattactttattctacagctatgagagagagctggccttcccagaaccacaacgcggagctgacaatttacttctgaacaagggccaaagagccctctccctctggacaataaacagcactctatctggcataagcagacttgaagagcaggaaaggggggtgggcagtgcaggaggcagcggttgttgtttagttgccaagtcatgtctgactctttttcgacccaatagaccatagcctgccaggctcctctgtctgtgggaattcccaggcaagaatactggagcgggcagccattcccttctccaagggaacttcctgacccaggggtggaacctgcctctcctgcattggcaggcaaattcttcaccactgagccaccagggaagcccgtaggagacagtacgaaacagcaactgccagaacccaaacaagacacacagccgggtgaaaggacatatgaagataacgcagaaagatggacgaacactgtggctgggagaaaatgtgggctcctgtgacatatttcctatggctcttttcattgttattaaaacctaaaaacaattaacttccttctgattcaatttctccttccatttaaaaaaagaagggaggaaggaggaccaaaacgtggtcagagataatggctttatgttacttagagattactggaagagtagtatacagagtgtaactagtagtagtagctatatcttccagtaatctctgagtaacatatcataacaatctccttatatatatatacacacatagagagagaggaaaataagatgcatacacggggaaatcagctggctcagatacaagcagtctcagactgacggttacattaggaaccacaaaaaaggcaatatattaagtgattggagatgtagctaacattttgattaatgacagagaagtcggagttaaacagcatttcaataaaatgtagagaagacttcaaattcaaattgttgggcacaccagcaaagaagcagaaatgacagaactgtacacagactgattggaaaagtggaccgtggtgaacacacaaatgagatgctgcctatgggaaaaaaaaaaatcacaaaggcacctgggagaaaacagcctctaacagtaacaactcaaacatttcctgactggaagaaacttgaaaacataaatgagcaaggtggcaaaggccagaatgcccaaccagtggacaagttaagcaggaagagggcacaagacccaggttttcctgctggcacacaaaaaaccttgactaaaggcatggttccaataagcgagaggtgaaaagagcaactaatgactctagctgctagttcttctatagttcagaaaggagagaaaattcaaaataaggagctgagatggggaaacatatttcaatgtaaaggacattggcaaaggctcggcggagggggtgggttagaagtgaggggagaaaggaagagtggtaagagtgttaggaaaggacaaagaaattaaaaaaaaaatacttaacatgttcaattcagaaaactacagactctgccactcacttcagtgctgatacaagatcaa

SEQ ID NO: 36389 - DNA, 1795 bp, Bovine  19866881133870
gcaccagtagtgaagctggccctttctgcatggcacacagctgcactgagccaggcttcagacaaacacaggggttcctcatggtggccctgtaatatgagaaactatttttacaggctggagtatgtcactacaggatagctttctggccctgatgtgacaccccatggactgtggcctatcaggctcctccgtccatgggattttccaggcaagagtgctggagtggattgccatttccttctccaggggatcttcccaacccaggaatcgaacccgggtctcccatgttgcaggcagatgctttaccatctaagctaccagggaagcctaaacacctgaccaaaacaaacaccccccaaaagtctcaacgcttcaaaaggtccctggtcagcctcgtgcaggtgcctctccacctcatcacttacaccaagatatctatctgtgcttgctctgggcttccagctgagtgccacaaggaccctgggggaagagccagccttgtggatcagcaggtgtttaagaaaggaaattaacacccacaggttggctctactttggtagagagggtgagaggtgctgtctgccagctcccatggcatttccagccagtttggaataaatgagactgcctgaggacatgaactgagaaagggaaagaaaagccaatatgagatcagagttttaaaaagaaggaggtggaggggtagcattcctatcaaggactcagacaaaaaataatggagtagatgggataacaaggaagactatttcaagtctttccagagtatgtataagatctctaatctcaaacaaagtgaagactggctactgcctccactggaaaaaaaggggagggctttgatctcgtattgcgcttattctttcctcacgtctcctccatagctttctgtattgttgtatcgtgtgttctgaggggttgcaaaacatatcaaagcatgtactaatcataacctaagaagacagaagtaaaagggttctggcattatagtgggtccttgggagatgagagggcatcttcagttgcatctgcaagatgagaaatattcctaagaagtacacaagccacaagactcagatgctcagctctctgggtctagggaggccccaggcacagagaactcacagcacaagttacacagcaggtcccagcccggataccttgatgcccaccttctctttcaggaggaagaagggggactggcaggagactagttaggaagtgagaagaaaggctacaggtcaacttcgcctaggaagaaaactcctagcagagtcgacaagaacctgcggtcccagcaaaaaagcttaatagactcctattttccactatagagacgctggcaggttctgcactcccatggacagttttttgtgtattcttcttttttgtgtatacatttagcacaagacatactgtcctctagccatttctgagtatgatgggcttacatagtaggtggaaagtgtatggacagcagagatcatgtctttttcatctgggtactatcatatacctaacactgtgccacagaaaaaacagaagctcaatacatgtttatcaagtaaaaattgattatacgccagctgagcactctgcaggcaataacaaattcattcattccccgccccgccattactcattactcacagctccagataaagaagacttatataccaggggctcaccaggaccaatgcatcttagattccgggcacgcacactccttaaatatgttagcaaagtcgtctcttcccatttcttcctctctgc

SEQ ID NO: 36390 - DNA, 1867 bp, Bovine  19866881134231
ctaaggcctctgagctacctgagctgaagattccccaagtagcctgggacaagatcctcccgattttggtcctcagagtcacaaagcttcttgtccacacaaggaaaatgagttctccttaacaattcttaatcatatcagcatatactctcattctgtggtactttacttagaggaggaaactatagttaatatgcctctactcaggggggaaaggaaattgtccagcttctgctcccacggcgggaatgactagagaaaggagtcaacttaagccaacagaaagaagggtgatagcgggtgggaagacaggcaggaaagacagggtgaactgggaagaaagttattctgtccagaagtcagaagcgtcttgcaatgttgaagaatttaaacaatccaacaacagcttttatgttaagcctcctttcctccatatgtatttcaaactattagtaaaattctaaaactagtagccttcaaagctcgttcctctgataactgtcaaaatgagatcagtctatttagtagtgtttagtcactacactgttatgagatgacaatattcaacttgcaaggaagaaggaaaatgttttaatattaagcaatctacaaatctcagatttcaagattttatgtcctttagacaattttatttattttgtgattgtacttctttcaccatttttagtagcagaaaactgaaaataacatcagttttagaatcagaattccagaactcagtaacttattggggaccttatttttttgccttctcagtatctttggagaactactcttcccctattctcagtatatgcagttcttcctgggatgatgtcaatcttgtttctagggtggcatgcgacccagggctggtcagtgagaaggctccagttccttggccatggtgaaggatgactggtttaagaatggacctgaaaatcaagtccatgttttgtgctgatatttctagaaggaaaaaaaaaaaaatttctcttttcactggggttgataaaatggcaggttgtaaactaagagctaccagaacaactactgagtacaggacagtctctgtgcaaataacgccgaaaaggagagagtaccctacaacacagtttaagccccgagacacagccaggactgaaaccagccacatctttcaactcactagtcctttaagccaatacattctctctttttttttttgctttagcaacttgagttgtttctgtcacttgaaaccaagaatgttcattaatgcaccagccaaataaccttggacaaatcaatctcattgcctatcagttttctgaattataaggaggagtgaaaaaacatgtttgtttacctgacagaatcagaaactgctaagcactacataggaggcattgatattttaactaacacagaaggtaaggacagaagaaatgagatattcatgggctaaactgctcttaggtgctactgctaagataacgttttattagttttctcatttgccctggtggagcctatgaaatctttatcaaaccagttaatcacctagtaagtctctaagtattttccctttactactaaatctttaagtattttcccatttactttcagttgacaatatttttccgccttcctagacatctttgatcaagctacctaagtagtttaccatgatggataagcaaagggatcacagaaagggaaaactaacagtttcatcttcaagggtgtgtgtgtgtgtgtgttaagtgtccatgcatacatgtgctgggagatgaggtaaagcagtacttctcacacgaaggcaaatcaagggtgaaaagaagctactcctatacaagatgaaaacctgagggcttcaactaatgtg

SEQ ID NO: 36391 - DNA, 2034 bp, Bovine  19866881190985
gccgagggctgcttgtgcttgcccctctgttagtctccaggggctctgagaggggacagggtgagagagttagggattgtgccttttaatttctttccccaatccttttcctcaatcagaagggaaggtacacctgtaatttatagttctttcaagtacagaggcgcaggtaagttaggtgtggcctgggatcctcctagcacttagagtaccattcagagacgctgccctgctgggcttcctcgccttcccagcacaatgcgtgcctgcctctgcccctccagcatgacctcttctctctcctcccatttgcggagtcggagatcattttgcctttctccagcatgtcccatccaggtgtatagtggcctcaaaaaacaaagggagccattccccatatcccttctgttttggttctctttaatcttccatcgaatgaaagggatcagtcagctaccatatttttcatgtacactagttagtaacagacataacattgtatatttaaaaatctagtttactcgttataataaccctctgagatagtagttcctttcagtgtggtttttttaaagtaaggatactgaagcttgaccaaaattaggcatatctaagattagagatcaggagcaaacatatttagtgtctgactttattgtcctgcagatgtaaaaccctttaaaaatgatgtacaaccatatttgagtcctagctccgtgagcttgctgggggaacaagactgtctagatttatcgctcatgggggatagctttgaaggttggtcaacatcaggttaaattttccattctttgtatttggattgatgaccatcttcccagggaggcaattttctcttaccattcgtctctgtctgcagcaaggattgagactgcaggcaccccgtgtttgttaaaatgcacaaacaggacatccagaaacctgctgtcaggaggtccgtcctgaagccctcagcgtctgtctttgcataaagatgctcacaagcaggggcaggatgtggctgcccctgaccttgctgtctgcctgcttctgagctcagaccaccccactagaatgtagatggcaaagaagccgaaggaaaacacacatttttattttcaccatccctttggaaaaagatggagagaggcttctgtgaagcccaggttgagctctgtgttcccgtagttcctaagtcctgcaaaagacgtggtgtctgtgactttatgactgtagttttaactatcctcagctccttttcctcattttatctgttattctaaacgtaattacagtctcagaatcatctcctgattcttgcctctttttgtaactactttgccttccaaggcaaagataccctgtgctaatgacagtcagaactggagaagcttcagattagatcagtcacaaatatctcccaacactgggaaattatattcaacttcttaagagttgctgccagcacagagagaaatagtcgttcattcacacttgtgacactgggctgtactttgggaaaacatctcagtgcgaaatcctagtctttcagccttaagatgaagtctctttaagtctgttgcatgtattttattaactcttccaatatatctggttgtatttggtctccttttacctagaaatccatgctgtgagtaaatacgccagaccgtttccttgtgaaatgattgacagtcgtttctgagagctcaggatgggtgctggttcctcggtttggcatgatgtgtttgtcgccataccacgtccattcgtgcagaggagcctcaacctgcgggcttttcgtgttccccttgccagacgcagggaagttctagcaaggaagtcatcgaaaggtcttcttagtatatataacatagctgaggagggttctgaaggctgtcactcagctctgccatctgattgggtgtggcgtaggagaagttacttgcctttatagttcgaaatttaatattcttcgtctgcccttttgctgtgactaaaatttaattaagtcacaccaagaacatacgttagaaa

SEQ ID NO: 36392 - DNA, 989 bp, Bovine  19866881332884
gatgagctgtgcttgtcattagtgcattaccttcctatggcctgagaaaacaaataagagagccaggaaatctctccctgtgtaaattaactcatcaaaatttcagccttctgagaagaagctgcatgaacgaattgaagcagtgaccactcaccattgtaactgaacatttccatttccatgtgggaaattaatagacaacaagcagcaaatgtaaattgctaattggagctctgaaatattaatgaaactataaacacaccacccagagcttgctgaaactaccaagtcactctttgcctaccacgtcgccgtcattaggggagaagtaaaaccctggatccctagctacataccaaattgagcctgctgctggagaaactcaactttaattccagcattctcttttcacatgttatttgcatctctctctgagctcactgtaggaactgggagcagttgtgaaattgggtggagttgaggggaggggacaaaatttgggagctggccattgaattggattcatcctaatacagtacaaacacaaacgcaatggcttggatttgggggctcacagaatggtttttgtctatatgcccagtttttcaggcagttagagccaaacttttcagaagaagaaaaaccttacttgtaatatcctccccacccccagcccaccttagaaattaatctggaagttggatagcattgctggctcaacggacgtgagtttgagcaaactgcaggagatagtgaaggacagggaagcctggcacattgcggtcagcggggtcacaagggtcggacacgccttagtgactgaaccacagcagtcttcgtggtgcttctctcatgttggtgggtgagttctgaggggtcagtgcaggcttctggtatgtttaaactggcaggttaacacgtatgaaccagagctctacaacaacaagatagaaaagcctactttcataaaatactcacatgcatttttg

SEQ ID NO: 36393 - DNA, 954 bp, Bovine  19866881338837
ttggcctgcatgttatacggagagtcttagtcttacaaagtgagaagcagcagctttatctttctctctaggaccttccccacctgaaggagtagttgttgggttccttttcccaacattcaacttactgttgtacttggatgggagatgctgctgtgatacccattaatgcctatcttagtgtcaccttggtcataaagaaacattggttggcttggtttcataccatttcatagccatcttcacagaacagcctagggatgactgatgataatgattattaccataggttcattaaaatggaccacagaaaagacttggcatccagagtactcaaatcagtcataactaaattggagctgagaccctgggtcaggaagggtggccagtgctgtcagcacttgacaagcattatgtaactagcatctgtaggctcttttggcctgtccttgctccagtcttcaacatatactctttaccatggcttcctccttgccttgaatttagcctgtgatcacatccaatcatctgcacttacttagattctaaaagtctgatattcaaacatgacctataactctagttcaatccagagtattctccagaaatcttcagagaactgagcctcttcttaatcttgtctggccttgggagtggcagacacagaaaataaagagattttatttttgtatcctggaagggtactatttcttcaaggagagatggggataaaagagagacagctttgttgtcagaaatgatttactccttcctaagatttttgtcctcattaattttcttaaagctgcttgtcagttgattaaaagccgcttccgctgcaattatcttaaagttgacttcagagatgtggttgcaaagcatccatcctcggaaagttcctttcttcagcacgtcgtaggaaagggggaggaggtagggagaagtcaggggtgt

SEQ ID NO: 36394 - DNA, 1146 bp, Bovine  19866881481721
ctattttataatggtggttattactgttattctaacagaccgtaaagaaaacactaaacattttttctttttgctaaaatgacctagcttaggattgcattgtctgatcatcttcaccattgttaacttttcagtctctaaaagaaaggactgcctagtctttttcttgtgttgtttttctttcgcatatcaataatttttccataccacagacctaaacaggtgtatttagagataatcagttgttgaatgaaatcgatgggagaatttttcttccttcaggatcctctaaagccaaagtttctctcatcttttgatctagaaaacaaaaagtttatatatatccattctaaatccctttagaagatctaaacttgatttcagtttcacacgctgcagagttcagagaccacattaacccaagaaaaatcttccttcttactgaactgttagtaaatgctcataaattttttaatcgaggttctccagaaatgcagtatatgaatgtgccactcaagttagtaagcaaccaggatgactgatttctccggggccctcactgaagggcaggactttagtttggggcgtcttgtctctggggctggtgtctgcttctgctttcgtgactctctcacgtgcagtctttttctttttctccagggacagtggtgacagatccaggcaccgagctcctcgcaatgcccgcatgtctgcaccttcgcttggacgctttgtcccaaggtaagaaccgggtagtcagctcttaggcttttctaaaggagcctttacgagagactgggatttttaaacctacttcctggtctggattgtccatatctggaattatgtcctagggagcctacagtcaagccctgccacctaaaaacttcccagaagatgattaaccacaatgaaaaggcatagaaaagtggcattgggagcatcctgttcaagaataggaggccccccacccgccacccctccaagaaaagaagccccaggaaaccttagaagcatgatccaggaagaagatgtgacatgtgttaagggatgtgtcttagaaatttcactctgctctaggtttctatggattcctaggcttagtggatcccttatcttgattgagggtggtagatggtgtatgtc

SEQ ID NO: 36395 - DNA, 906 bp, Bovine  19866881667095
cccgtctaaagaggacgagatgactaacctataataaggaagatgtctctgggaattgataacaaaagatgcttcaagatacattgttcagagtgggaaaaagcaagcagcagaacaatatatatagcaaggctaccttttgaaaaagaggagaaactaatgggcatttatttgagactgaagggacaaggtgaccagagacaaagatggaagctggacttctcagtgttccccttttgtcattttcattttttaaattacctattcaaactttattcttaaaatatttgatgatgtgaagaaaatgttaaatgataaagacaaaacataaaatttatatatacagtgtgatctcaattttgttttttaaaaaaactttaagaataatgatgcaaaaaattataaaaagcattaaccatggttctctttgggtggtaggattatagatgacttcatcatcagaaaaggcactgttgatttttaaatttaaaaagtaataactgcttattgtaaaaagtcaaacaataataaactctttacatttcaggaaaggttgcaatctaaaaagtacacaataagacacatccaaatacagtagggaaaatacttatttgcctgtgccgaaatgagatttctctttggaacattaaaatagaaagtcggaaggagcctacagaaagatgtaactctgagttcctagctgcatatggcacaaagttcgtcaggagtgactaaggaacacactccggcctgtatcctcggagcacagttctcacccaccagcagcacacaaatgtaaggatgcacacactgactgtgccaacacggtgccagccagcctcccgcaaaagctaaggacgaactaactcaaaggaaattgtctccttggtgactgacaactcaggg

SEQ ID NO: 36396 - DNA, 802 bp, Bovine  19866881939057
taaaattaagcaattttatagcaggttgtgtagtttttttttttttttttttttcaattaaaaaattatcttactttacaatagccagagtggtcaggaagtcaagtttgcacttttagaattagcatagcaggcgtatagtgtgtgtcctgtgttctcttcatttcagtctgtgttcaggatctgtaaaacttgcttctcttgggtgaatggaattgtaaaaagtttagaagtgtattttattttaacaaacaggggagttagaagtggatgctaaatggcctctttggggttgatttaaagaattacacaattttgaaaatcatgtccctgcctcatttgtaaaaggtgggctacttttgactgctgtcacacttgtgcaggagcctgtctggttcgtggtaagtcagctactttgcagagatgctgccatcaacccctccatttcttttgctctcccctcttctttattatctttgaactttcatctgtgcttatgccattccctgtctgctgttcatcactccttccaaagcaaccaccatcttattctgtttctcttaaaaacagaacattatttcaatgattactttttaaacagagagacttgttattatagacctcaaagcttgacagtttgtgaacctctgcattttggcccctcagccaggagttggataatagcttaaaatcacttctaaagtaaccgaagatttgtgaaacatttcatatctgaacaagggagagaatagaaaaagacctttttacctcaaaagttgctttattttctgataggagggga

SEQ ID NO: 36397 - DNA, 3628 bp, Bovine  19866880187816
gctatggtttttccgtggtctgtatggatgtgagagttggactgtgaagaaagctgagtgccgaagaattgatgcttttgaactgtggtgttggagaagactcttgagagtcccttagactgcaaggagatccaaacagtccattctgaaggagatcagccctgggatttctttggaaggaatgatgctaaagctgaaactccagtactttggccacctcatgcgaagcattgactcattggaaaagaccctggtgctgggagggactgggggcaggaggagaaggggacaacagaggatgagatggctggatggcatcactgactcgatggacgtgagtctgagtgaactccaggagttggtgatggacagggaggcctagcatgctgcgattcatggggtggcaaagagtcagacatgactgagcgactgaactcaactaaactgaactgaaacctcagaagtgagaatgaaggtatggatccacgttactgtcttcaaacaaaggaagaggaattctgaggaaacagtaaacacattattacttgagaagaagggatcaaagaaacaagaacactgtcaatttatttccaggaagaagtaagatttaaaacagcccatagataaagcatggcatttaaaatctcattcctttgagactttttttactccagaggtagatgacagaagccgttatgaaacacttgtctatcaacaatagtcatgctttaattggtctactgtgtatctaacatggggtttccttggtgaatctagtaacatcttgtcaagtggtatgatgaaatgatctctcaatgaaaaaaatgggaaatatacaaaatttgtgagttaactataatagtttagggatatgctattcaatatggggtctgcagagtgagcacaacctgggagcttatcaaaaatgcagaatctcaagccctaccacaagaatcagaatctgtattttaacatttcacaagattcctaggtgattcatatgtgtattagtttttaatttttttatttttctattgaagggtaattgctttacaatgttgtgttagtttctacgatatagaatcagctctaagtatacatataagcccttcctcttgagcctccctgccaccccccatcccatccccctaagtcatcacagagcgcagagttgagctccctgtgctgtaccgcaatttcccactgtctattttacacacggtggtgtatacatgtccactctactctcccagttcatcccaccctcttcttccccatctgtgtccacaagtccatgctctacatctgagtctctattcctgccctgcaaatagattcatcagtaccatttttctagattccttatccatgtatcaatatacaatatttgcttttctctttccgacttcattgtgtatgacagaacactcattgtgttcacatgtgcatgttaattttaagagcaccagtttaaagaagtccttggtctttatatggacaagatatgaggctctaggaaagcctcaggcatgacagcttgggctacaccctgagccagtccaatgtccagtcatattttttggattccatcagctaaaagggtgacaaaattttgcctctgtaatcttgacatttgcttcattcaaaccttcgatttcatgtgataataatgattgaccatatcacaaatgaaagcttagagataacaaaccaaagttagagtaactaaacaaccaactctgtcccaggctattactgctgctccagtataatggttaataatgtcctgttcctccctcaaacctatctgtgtttgaatgataaagtatatggtactccaagaatgggtcatatacatatttatatgtgtgcttgataataaatgcatttgtgtttatcatgaaataaaaacaaacaaaaagactctttcaggatatttacatacaccatgcgtgtacatgcacacacacgttttttggtagtaacagaagacagatgagcttgacagagataagagcatccctcagaggagctgactgccgtcacatttattccctttaaaggacaattcaaacagcttcccaagaacaagtgacagcctacctcagaggagcgttcaagcctctgactcttgcaagacaggtacacacttctgattttgaaatgtcacttctttccagattcttctcatttagaccacaaagcatttaaatcgtgttgggtcaacttctattctggattcaggttgaaggtatttatgttccccaccttccacattctctaaggaaagaaagattgccaactggttggccaagaagctcagtgtttgataataggggggatattttgttcctcatcatcttttctccatgtggcagaatctctacagtgactcctatcacacacttttatctttcataggttatctaacctgattgaaaaaaaaaaaatctctgcttgcttaagaatgaacattgtcacgtcggtttcatcctaccatatcatctttttagattttacaaacgctttggtaaaatcattattgccccctacccacttccaacaaatatttcaacccccaaaaagaaaaatagttaaaatttctcaaaacaagacaacaagagaggaaactccagaactggccatctatagtaaacctcacatcaaaagagaatattttacataccacaataatcatttccaattcagtagtcttttctttgtggtattaaatacttatttcacaaaaccttcaaaatattgtctagagagataaacacatagccaaatgataggcatatttttataataaaagaattctgttttccctcgacagtgccagaaaaataataagaaagctttcgcagagcaaactgtgcaataataatcaatacaacttatgttgctactcatgtattcaccccaaaacattgttaacaatgatttccaacatcacataacacattttccctgttggtaccaccctctttctatgttagtcacccaagagaataggatgagaaagaagaatcagatcaccaccctgctgtatctgttgaattttctttgaaattaattatttaactcttgtatctgtttcatgtttgtttagaagtaacaatctgcttctctacaaggtatttgaaatggattataataaaatcactttcatgccagtgtaaatggtatgcagagattcagaggaaaacagatattgacatcttgcagtcagccatggctcagatggtaaagaatccgcctgaaatgcaggagacctgggttggatccctggattaggaagacaccctggagaagggaatggcaacctactctagtattcttgcctggagaatcccatggacagaggagcctggtgggctacagtccatgaggttgcaaagagtcagacacgcttgagcaactaactctttcactttcataataaaatcacctttatgccagtgtaaatgatatgcagagagtccaagaaaaatagactgatattgttaatattaatagaaaagtggtaattgtattgagaggcagagctgagtcatactctcagtatattgcaccccatgcttcctggcagccaatgcaaagagggaaagtatgagacagagggaag

SEQ ID NO: 36398 - DNA, 2263 bp, Bovine  19866880477358
tatatattttttagtgcttctctaatgggctcactgactatcacacctaaagcagtctgcactgctaaggtacatgttcacaatataattcaacaaagatcacactctctttttgtgtgatatctttttgatatgttctcttattagacagatttttttaatttattttagtaatatcttggtaaggctgggagtgtggagtaatttgaatcctctcagaaatgaggtccatggaccattactacacactttgcaatgtataatttactttcctctggctcagatggtaaagaatctgcctgcaaagtggaagacctgggtttgattgctgggttgggaaaatcccctggagaaggaaatggcaaccaactccagaatttatgcctggagaatcccatggacagagaagcctggtgggctacagtccatggggtcgaaaagaatcagacacgactgagcgactaagcacagcacaaccaacagtgcatcgttttatacatataacaggctcagtaactaaacatgtcatatgctcttccacattctcttttccaagtaagatgatcattttttctgaatccaaatttataaaacatcatgaaaaaacaattaagatgttgtctgtcttgtaaaatcaggctcatttttctatgtttactgaagagctttacttcacatgatgtgtgtaccatctgaaatcatacataggatttatcaccactcctaattcaatttagatagtttctaaaataatttccatatctttaatgagttttgtaaatcacctatgagaacacacagactaacactctttgtgatgctactagaagagagatactcataaaaagaagctatgctaatgagggaattgtactggaatttttcactgtatgtgttccattattttaatcaagtgacagagtctccatacttgttggacaatacaacagcaacacctgaagaaaaatgaagactgtgacagttaacaaattacaaaatattatgtatgttaacatgagcaatattttcagggctgaaaataaatcctcaatgctgtaagagaaaaggtttgtattgttattcacagcagtgaagcatataattataacagacccagaaatccagtcaacataatcactgtctcttagttgtctagggttaaaaaaataagagaaaaaaaaaaaaactacaacgacattagaaaacatttttgttcagagagttattaatcagaaaaaatgtcctccatggaaagaaagaaaaaaaagttcctactaaaaagtggaataatttttctattaattatccccattgagacttcctcagtgacacagaaaaatgtacatcttcatatgccagataattataatgtccccaagaatgagactttaggagctttagtctatatgtgttctggtttcaaggcatcagaactattttgcaaagagttttcactttgtcttaaagaaatgataaaagatacagatgttaaagaagtaagtgtaatggtctcagaaaaataacttccaaagtgtgaatagtccttaataattctggtataagaaaggtacttgagtttagatttgtccatactacttgctatgtgacatcacatcaaactgtagcaaattactgagcatattttatgctacctttcttaagatactgaattctttttctaaccttcttcaaataggtaaatttaagtttagaatatgaaaagttcttaaatgtattcagtacataaacactatcaaaaaaccttaagattaatgagaactggaaaattcgactcctataacttataaactccaaattaaaattttgatacaaagaatcagtgaaggggttatattgaaacattaaacctgtgaatatgcaaacgtacgtttaccttctatctttttggtaaactcatctttagatgtaccacaagaagagtcaatattctatgtgtgcacaaacagaaattaggatgaagcaagtatcaaaaagttctttagggctgttttgaaacagacacctcagtagatttattatttttattaatctacattattaatatattttggtggtagtttagtcaggcttctctggtagctcagttggtaaagaatctgcctgtaatccaggagaccctggttcaatccctgggtcaggaagatcccctggagaaggaaatggcaacacactacaattttctcgcctggaaaatcctatggacagaggagcctggcaggctactgtttatagggtcgcaaga

SEQ ID NO: 36399 - DNA, 3543 bp, Bovine  19866880545150
tgaaaagatagccttataatgggagaaaataatagcaaatgaagcaactgacaaagaatttacctcaaaaatacacaagcaactcctgcagctcaattccagaaaaataaatgaaccaatcaaaaaatgggccaaagaactaaacagacatttctccaaagaagacatacagatggctaacaaacacatgaaaagatgctcaacatcactcattatcagagaaatgcaaaccaaaaccacaatgaggtaccatttcacgccagtcagaatggctgtgatccaaaagtctacaagcaataaatgctgtagagggagtggagaaaaggcaccctcttacactgttggaatgcaaactagtacagccactatggacaacagtgtggagattccttaaaaacctgaaaatagagctccatatgacccagcaatcccactgctgggcatacacaccaaggaaaccagaatcgaaagagacacgtgcaccccaatgttcgtcgcagcactgtttataatagctaggacatggaagcaacctagatgtccatcagccaataaatggataagaaagcagtggtacatatacacaatggagtattactcagccattaaaaagaatacatttgaatcagttgtaatgaggtggatgaacctggagcctattatacagagtgaagtaagccagaaagaaaaacaccagtacagtatactaacacatatatatggaatttagaaagatggtaacgataaccctgtatgggagaatctttcacttttaaaaaatatatttactggacttgccaggtggttcagtggttaataattcatctaccagtgccggggtcataggtttgatccctggtctaggcagattccacatgctgcaaggcaactaaggccatgcaccacaactattgagtccatgcaccctagaccccatactccacaacacaagaagccacttcaatgagaagttcatgcactccagctacagagtagcccctgcccaccacaactagagaaaagccctcgcagcgtgaagatccagcacagtcaaaaataaatttgtaaaatgtatttacttacagctataggacctcattgaggacatttagccttgcaaggcagaagagtggcatttctataatcttggaaagaacacagaatttccagaaagaaattgtggttccaatcccagttttgattcccttattatgtacctcttctctacctgccctcagctcactgtaaaatgaaaggcttgaagtccatacctgtctctgaggtctctactatctatccaactctaacgtgccctatgtctggtaagaattttttttttaagtttcccaggtaatatgcaaaaaaaatttcggatgctcatccctgtggtgacatttagatgtctaggaattcctttcaggcagtgacatctatcaagaaggatgatagctctgaacaacagttaaaacgagagaaaatttatcaaccttcctattaactgcaaatttataggatgtttgaaagttgcaagcgaactcttagggccatgttaacgaggtggcctttaacttgaaagagatgtgtagctgaactgtgtctttgagagttggcattttaatgaagtttcatcccatttgaacaaaggcaaggaaggccagcaaaaatgccatatctgctcgacacttgatgatttctgtcctgagggagaaaaggttaggctatgtcagagcccacatgcttttagccatttatctgttccttccagtacttgaaggctttcatgcttcccaggtcacctcctcgggttctccaatgtgcaacagtatctaaggatgaggagctaatggacatatccaaacttatgacaccccattaccaattcatttacttccctgacatttcaaagtgatcttctacctttgtgacctttagaacaatagattatttatgtaggtatttcagaagatgtacagtgcattaaaattactgaagcatttcatagactggtgggggcacagggaagcctcaagtgtaaggaaaatagtgttcctcttctagttacttttgaaatggcttaaatcatccacagaataaaggttacactaataaatgtctcatttgttttaaatgctctgaaatgtgaacacttctgtggaacatataaaatcatatacggtaaatgggctatggtgagatacagtgaatggtaatcatttctttttgagttactctttaatcctcctgccccttgaccaagtttcaaattggtgtagagtaggagtaaaggaaattaaccctgaatattcataggaaggactgatgctgaacctgaagctccagtactttggctacatgatgcaaagaagcaagtcattggaaaagcccctgatgctgggaaagattgagggcaggaggagaagggggtggcagaggatgagatggttggatggcatcaccaactcaatggacatgagtttgagcaagctccaggagatagtgaaggacagggaagcctggaatgctgcagtccatggatttgcaaagagtcagacataacttggtgactgaacaatcaggagtaaggaatacagagtgaggcagacattgggatctttgaggttggaggcagtatgcagctgacttcagtctagttttctttactagcatggcacaaagggaggctgtgaagtgaatgtgctgggttctccaacatattcttctatcattttcctccacattctttactagtaaggaataccaacaaactagttctccaaacatgccatgctttttggatgttttatctgatatccattcccttgtctaccttctcatcttctgtttagcctttgaaacccaactattctaagaaacacactgctacatagcaatcataattttctctacattaactctgtatcaagagtgtattttcacactgtacactgtaaagtttaaccacatggatttagaagtcaaactgtcagattgcaaactgtggctttattgtatctgttgtagaattgtgggtaaatttctaaacctatctgtatcttttactcatacacataaaaattaaaataaaaattatcaatttcacatactttgtgtaaagattctaaagacatatacatcaaaatgttttaaagtaatacttggtacaaagtgttcaatgaatgttattaatagctctttttcattctatcaccatattagatatatcacacagaaaaaaatacatgaaacctcctacattaggatcagctcagttattagtatcttaactggaatactgtggctctttgccactctaattcaaggctaagttgccaattctttgacccccatttggcatcagttttgtccgactctcaggcctcatttaactcaaggaatattgactttcttttcttcttttttttttccacagaaagtattattcaatcagagaaataatatccctggtcttatattttcctccaaacattataatctggggttttatgtctttggaatgttttggttataccacagttctagaat

SEQ ID NO: 36400 - DNA, 943 bp, Bovine  19866880565276
aggatttcctcccttcttccctaggggagatgggcgggggctctctcacgcaggcctgcctccttaccatccatcatttcaaagagacatatatcgcctccaaagtgcttcaaggcagctgcaagcaaatgtcactttgagttaaatgcattattaaactgttgggaaatttcacatcatgggtcatttatctatgctaaattgggtcaaaagcctcagcacatgcctagataaatgagagagaagcgcaaaattctcccttgggaagtggtactttgacaagctttatgagtatggcttatgtatttattgagtcgccatggggaaaggaggctctcttgtttgtgtgtgtgtatgtttgtgtagttatttaagatgtactcaaacactgtataggagtcctctgataaatccagttaggtattcaccatctctctagaattagaggttgtgcaaaacacatatcattaaatattcattcatttgataaagtgtttgagtctgttctgtgtgtcatgtactatgaagaaaagagggcaaaaattatttcttttaggcacgactctactgtggagaactttctagcatggtgtatccaaattttctttttttataaggacagcagtcagattggattagggcccatctaactgcccacattaacttaaccatatatttacagccatatctccaaatttagtgtcattcaggcttcaacaaattagctggggagggacacaattgattccattgcaagggctgtgggaagagacattgtcttgtatcacctctgatgggggaatggaggctcaagctgccagtgtgagacctatgacagagaaatatagatgtcccagctggatgtcagatcagtgcacggtggaactgtgagagcaagaggatatgggtggggcaatacaatatcaactacatctgcagacaa

SEQ ID NO: 36401 - DNA, 955 bp, Bovine  19866881127286
tactgtgaaaagcattttaatttatctgttttatccacagcaaaaatttactcctaactacacaaatgttttcattgaagctgacatacaaaaagagttctatgcgtacattataatcataaactagtccatgaagattcgaaactatatcacaccttcagctaatgctttctgtgtggtcagctatttccaaagtggtatcacaaatttctgagcttgacacagaggtgtcaagagaggtgtcacagaggtgaagttttcttcaaagcaaacaacaatactgcattctctgcttctttcacagagacatttactttaactctcaagagttctataaagacccacaaccaaaaagtcacgaatcccctattcagtctattgtgagcatcccttctgagcatcacaataacctttctctgggataaaaaatagaacacccatgttctgccctccatcccttatgaggtgaccactggtgtgttcctaggtataaggctctttaagagaagaaactatactgattgaatttgcttctgcacagcgtgtacaaggaaacagagctaaaaaagagccttaatcaatattgactaaagatgataatttgagaggtgaaggaaaatctatgaggatttctttggaaaagcctgaaccatcagaaacaagataacaacttagagcttaatctgtggtaacaaatttataacaaaataactttttaaagtactccactattatgtcagcatattttttttaataccacagcaaactgggcactaggattgtggattccattattaagacactcatctgatctggaggaatattcttacaggagaacagtctatattagtgctttctaggatgcctatattttaacatattcaagaagtataagaaaaagtgatttaagtttaaatatttgaatgaaaacataagcccaagtctgcatgtaaat

SEQ ID NO: 36402 - DNA, 1334 bp, Bovine  19866881204712
aactgagttgctttcagtagttataaacttttatgacttttttctggttattactgacaatatgcttttccttcagtgccttggtggttaaactcgcatgttactatctatctggcctcttagtagaaatgcgatcatttgcataatctgttccttgtacagtgtttatttcctggaccagctttggattaattataatgcctgtgtttaatgttcttatgggtactgttctaaaatcatttttaagtcagttattaaaaacaatagatgacataaaaatggttgttcttgtattttttttatgaaaaatctcatttaaaattcccaagttctaactcaaggacagaaattaattttgtggattgaagttggggataatttatggactctaacaaagataaataaaacattattatttttcctaaaaaacaatctgtgtttatccttattaggctgtcctgcccttttggggggcttcccaggtggtgctagtggtaaagaactcacctgccaatgcaggagacataagagatgagggttcgatccctgggtcgggaagatcccctggaggaaggcaaggcaacccgctctagtgttcttgcctgaagtatcccagggacagaggaccttggaagactacagtccttggggttacaaagggcctgatctgactaaagtgacttagcactgccttctttcaaacagccattctagagactatatccaaatgcaagatctggaggaaggtatacggcaggtggagactgcgttgtgcaagcagagtacaaaacaagcctgcattggcagtgaactgcaagtaagcggcgagttggaaaccaccagcgaagacgggaaacaaagcagagtggatgaaaaacaggaaaaacaaaagaacagaaacatgaaagtcctgcccgaacttctggggatgttccaggaggaaggtttcactgcatccagagccaaatatgagggaacaggtaagaatgttcaagacatcttccctgcaaaggacttggaacacaactttatagaagcacctaaaaaaggtcaaagatcctagacactcactgtaaacaaacaaacaaacaaaacaaaacaaaaaatcctgaaccaggaatcaaatgtaatcctccacatggtatttactggacactccacttcatggtctctgtctttgaggagctcgcagtccaccgtactaggagtggagacggcagtggaaaggacgttttcagtgtaacaactaagtgttgcacaaaagagagaaaagactgaagccactagaaagactgaggctgctatagaacgcgtggttaatcctgcccaggaaa

SEQ ID NO: 36403 - DNA, 1450 bp, Bovine  19866881350967
tgttacatcgcctgcactggcaggcaggttcttttcccactcgtgccagctgggtagcccagcaagaactttaaacctggacgtaggagaaagctatgtacaactcagaagactcttctctgtgctccttcactgttcattctgagctttatttccttagcttatattgtagaaaatggcagctacacttgtactttgtgtgaacgttgaggataaggctaaagagtgagagaaggaagatgaaaacacatggcatagatctgagcatgctgtagctatttaaaacatcacgtgaattgtttattgactaaaaattaatcatactgtttgagaaagaaagctagtaaagaaaacaaatgtgggcataacagatatgggcattaaaactattttaagaattgggcatgtgcaattctcaaagggagacagaaatgtacttattaaattttgtcatactgtttttcctattaattttaattagatcctattaaatattcaaggattctttttagtggttaccaggcttactatttagatgtattattaattgtagatggaacttccctcttgttagatgtgctgtctttgagggaattttgtttcatttaagtgttgttcaaatgtagcaccccgtggcaggtctcctaggaacacatcacaatgctgtatatattgtgcagagactataggtatttgtctcgatggggactttgctctggctacagtaactctggtcagaactcttgttaagtcagatatctaataccaatgctcagtgatggtcacaggtgcaggaagttaacaccggtcattaaaacaaaaatgatcttgctagagaactaaataatgttcttctccaatgatgatttgtgtattgcatatttatgacctcttcaaaaataatctatccaaataggaaatttgtccctacaagagaagcatttaagtatgaaaaaaaatttatggaggctgagatctaaactctcatcctatagatagagatgatgacaaaaactgaaacttaagactgtgggagataggtgaattaagtattctgcttactgaattttttattcacttgtttctctttcatttgtgcattttccacagtggattacagtaacagaaaagttttcctgaaggaaataacaaggctttagtgggaaacaaaaaagtaaggtattcctaattcctatactcggaagcagtttgaaatggcctattaactggaaattccagagatgaagagtaatttagagctagtaggaaaaaagcacctttgatgagtggctacaaataaggtcagagaactgtgcagtgctgcgtcatggaaggacttctgtgctgaattatgaagtttgaaatgtgttcagaaaattacaaagaggaattgaaagataatgcattagtgttctaatactgctataaaaaattaccacaaattcggtca

SEQ ID NO: 36404 - DNA, 1551 bp, Bovine  19866881364534
ttctggatcctgctggaaccgctgcacgtttacatctttgaaagctgtaatccaatgaagacataaaagtaatactggaatagcctatttgtcaaaaagaatcaacaggacttgaaagccagttttcagtcttaatcattttcctgtgagacacagtccttcagcaagcatttgttaaatgactgttgatataagtattgtgctggaggcaggaaaacaaacttgaacgcaaaagaattctttttttcaagaagcatattgtccagagttaaaaaaaggaaaacagacagatacacaatagttaccatcattagatgtttccatgctatatcaaacatcaatgataggcacagtttatcttcattcagagaagactttctggaagaagtgaggtccaaatggtatttaaagcaatagcaggatttaagatgcaaaaggcaaaaaagtaatgtaacaggtatataggggacagaggatagaacttttcaggcagagttaacagttgagaagattcggaagctctgaattttctatatttttagagtaacattgaagtggtagggggtaaaactagggagacggataaataagcagacaatggggaaagtagaggcaatggggaagcattgtagacctgtgttgcagggcacactgtctcctattgggaatctcatagcactgaatgatataaaaaaaaaggaggagggcatggtcagagttgtttatcacaaattgcatgctagatgtcctataggcaatgtttataactaggtcaaagctagaggcaactagactagccagcaggcaatttttatacactatgagaagagaaaaacaaagttgatgaaggccataatgacattctatttttgagatcttattgataattccacatgcaaatgtctcgctatctgatggctcgacctcatcataactactatttttaattagagttttctttcattttatcttaagtaacctaaatctcctcagtaacaagtctgcctaaatgaagacttggtgatccttcatcttctgaaaggcagctgacagttgcaaaaaaactaagaaatgacattcagtttaaaatatgggctatctccatgcaacataaaataaaaaaatatgcctcaaaaagatggttctcagggcttccaaacacttttcttcttctctggagttgactcacctttctcaaaacactagttatgcataggctgcaagtttcaatgtcatagagagtgacttaagcaagatggaggaataaagaagtccagcccttgtttcccatggaaacacccgaggtaatataaggaataaaacgccttacaagcaggtcctgttttacttaagaaattgtagtatcctagggactttccttggtggtcaggtagttaaggtggtccaattcagggggtacacattcagtccctggtcagggaacctaagatccctcatgtctcacagctgaaaaccaaacacaaaacagaagcaatataacaagcaatgcaatacaacctttaaaaaattggtccagaccaaaaaaaaaaa

SEQ ID NO: 36405 - DNA, 1138 bp, Bovine  19866881468113
tgaaccccgtcccctgagttgcagggcaaattcttaacccctggcccacccagggaagtcccagggtctgatatcttgaggctaatagagaaacaagattcaaattcttcagttgaaggccaagtttcacttttattttcctgaaccagcctgtctgctttatcttcagccttgtggaaagcacagctgggatttctaagaaggctttctgaaaacagccctgtcttaaaatgcagagattattttctctgggttaaatcaaatgagcatctattccccatcatgtacctccaagtagacactgcttcattggctctgcttaattctttctccctctcacctttgcacttggcttctgagtcttgaaatgacactagagctctttatgtttagagatcaaattaactatttagccaaatcactaaagtggagggtataatgctcagaaataagcatttcatttacaaaaatgcacgttatctaatgcaataaatagtgatagtgtgtctttaggctctggctattccagtgttggggaaaataataaagacttttcattttctcccttagatcataagggctgtgttattagtgtcatctcagcgttaaaccaggttgcaagctgcttattcttcaaaatgaagctttatttttcagtttaattgcttttgcaggagcattattaacttccagaaatggagaaaaaagttaaagcagctgaagctgtaatttagtatatttgaagctaaaaaatactttcaaaaaccaacacaacaatactataccattatcaagaataatattaagaaatacacatacacgcctatgtatggtttaataattatagaaagtgatatcttttaaataccaggtgtgagaacaatctatattttcctgttaggtgttcttaacatgttgaataaagaattatactagtatcccgagagaccataatgcccaaactctctgaacttctcaaaaatgaatctccattaaactttatatcccagtcaatcaccaaactctcaattcagctttattaatagctctcaaatgcatcatcttcccattttcacagatatccaacttgtgtcaaatctgagccatttgctgccatattgccctacccccaaaacag

SEQ ID NO: 36406 - DNA, 806 bp, Bovine  19866881500402
atgcctataagaaatactatccataaggttctgattgtgcatgatatgataaacagacttagtttggaagctcagggtatttaagaagtaactacaggagggaggaaggctcaagaaggaagggatataagtatacatgtagctgattcaccttttgtacatcagaaaccaacacaacattgtagagcaattttactccaataaaaaaatgagaaaaaaaagaagcaactagaataactaggttaaaactggagagcaatagaggcattctagattgtggggacagtataggcaacagttttgaaactggagggaacacagcaaagagcatgtaaagtcttagacatggtacagtcatttcacacatattatctcatttaaccctcacctttttcctgtaaggtaggcattgttctttcctctggtgtaaaataaggtgacagataattaacgagaatgagtaacttgcccaaggtcacacagtttactgaactcgtatctaaattcagatctcctgtttctgatggtgatggctcaaactcaatggaaatacaagagtttactaacaaacaagcataggaagcttcctgagttagtctggcttgcaaatttgatgaaaagataagatttaagcaaccagataaatcaagttattctatatcccaaaagttcaaaataactcccaagaagcttttgttcattattcatttgtggaataaaaattaggtattagaaatcagccagcattctacacttttgttgcaagtaaagattaactttgaaattatttaagaaggctgacagat

SEQ ID NO: 36407 - DNA, 2458 bp, Bovine  19866880551610
ccctaagtaaattttaaatatgaatcagttgatgtcatgtaattatggtctgttatgtgaaatatctgcttaaattgtgatgaaaaaatagttgggcctctaacactgtttctaggacacttataaagaaatcactaaagtgggaaaagataatactttttgttatgaatctgtaaagaaagagggtatctggaacaccttgggggctacatcaaagtttataattgtacaatctaccatatctatcaggaaaacagagatataattgttatgctattctgtccaccattgatgaatgtgtttgctactgtttgatgcttgctaacaaattggggtcttctgctgtcaacatgactataagagagcagttctaatatgttctcattaacataatgctaaaatcaacgttaagaagacattttccatgagaatttatgagattctgtgcaattaagcatgtaacaatatggacagaaattttgcaggggctgtataagagtaaaaattaaaagtaaaatatttgtagaagtaatctgtgacctgagactttagactgttgattgctggcttgttgatgtgttaatgtaaagtaattattccagtgaattgaagctgaaagtcaacatgtatattcattaatttagtgtaagcttccttattgttaaccacagttgaggtgtctgttttcagcaaactgatccaaactttcccattatgctttgccaaccataaaatttaaacattctttcttgtcaactttccaatttctaactaggaaatgctttcttgatcatttaaaattagaagcactcgtttgtctttaaaattaagaatagatttttgtcagaaatctgtttaatattgtatataatttgtgttttggtatcacaaatatattcacaatgcttttttttctgtcagcatgttcatttgttaaagcattccatatttcttactaattaggtagtgtattctggcatatacagcagtatgcgttcatcagttccccctcttaataactctgtcatctggataaaatttaccagcattctttgtagctggatagggtcatgtgtcttacttctggctactaacaatgtaggttaaagtgatacatgtctctcccacaaattaaatgaccttccatgtctgccaagccctctcccatctttcctctcatactctaatgatgaaactccagtggaaaactgcaaaatcctctaggcattttatgcatggagaagcataaaatgaaaatatcatagattctagaatgaccggatacagaggtaagtccctcgttgtctacattcaactatgaagtgggtgataataaaatgagtaggttattaaacctgtattaagcaaatgaaatttgggtttttattgcagctattggtctagtatttctgagattagtaatatactggaagttggagaaaattaagaacaatagcatctccccacagtgtatatgcatatatttttaggtggcaagttaaaattcactataggaaggcatagtttatggtgacactatcgtgttggtcaaagcaactgtactatgatacagtaagaactggcaaaactaaaggctagtaaacagaaactgttttacacttcaaaattgagtattgtatctcattataataaaattaaaaatgcgaacagtcatctagtgatcaaatcatatgatagataatgtatatacatatatatatcaatgggctttgctgatagctcagttggtaaagaatccacctgcaatgcgggagaccctggttcgattcctgggttgggaagatactctggagaagggataggctacccactccagtattcttaggcttcccttgtggctcagctggtaaagaatccacccgcaatgcgggagacctaggtttgatccctgtgttgggacgatcccctggagaagggaaaggctacccactccagtattctggcctggagaatttcatgacctgtatagttcatgggattgcaaaaagtcggacatgactgagcaactttcttataatcagtagcacagaggaggttaacatttgctaagcaattctgatgaacacaagtaatagaaaagataccaggtttttatgggatataatatatttctctctgattatctccccaaaataacaaagataataatgattacttattctttaaatgctttctaggtaccagggtactctggaaccctattatacacatgtcctatttaatgaacacaactgatttagtgatggtagacaaagtcacagaggctacttgacttgcttagattagatagctcttgtgtgataaggctgagacttactcccaggccccatctgttctacatatagcacattgttcattgtactgtgagagacaataacttggaagaaggaaccaaggaagttgagttaaataacctaaggcatatattccaaatatt

SEQ ID NO: 36408 - DNA, 1545 bp, Bovine  19866880582789
cacacacagtgattttggagcccaagaaaagaaagtctgtcactgtttccactgtttccccatctatttgccatgaagtgatatcttcatagcatatgaagcacatatcttaaatcattagttcaagagaaaacacaagcacaaggtacttccctaaatggaatccagggctttcacaccaaaaccaagtcttttatccactgagttctgctttgtacatgcaaagagaatcctaaagaacagaagaatctccaagctggggaacagaaacattacttagtgccaatgacatctttgtaagttaggtaaggaaatcacaaaaatattaaaacataaaaacactcatgactcaatttttaattattttgttctgctcatcatgaagggaattatattaataatgaaaataaaactaggtagcatccatttgttgtttactacataagtgcaattatgttgaaatcttttaaagtattttcatatttaatactgtctataacctaataggttatatactattgctattcttatcaaatagatgaaaaactaaataatcaaatttttgtcttgctcaaggtcataaactgggaaatagcatatctgcacttgaatgcaagtcagtctgacactacgtattactaatcaatgtccctggcaaaatcaatgaatgtacctcattctgtttataacaaaatgactccatttgtaggacaaaagtcttatgggagaaaaataaaacaaaaatatctcaaaaagtggtaaaagtgacataatccacactgtatttttcaagtcattgtaattatgagaatacaataaggatgaaatcaaagtactatcacatatattattttaataaatggaaaataaagatacatagcaagagaaaaaggtatgtaatactaaagggagaaacccctgacaaataaaaatgaagaaatatccatctttacagttaaaagttgagaatataaagaaaactattttagaatatggaatatgcctcaaaaaacctgtaattttgaaggctaaattctcaacaatagaactatacattaaaaagatgtttatcattagggcacaatccattcctttaaagacaaccactcctttttaaaatggaatcttgaggggctgttatcacagatttccagatacatgaatcaaatattaaataccaaagaatcaaggaaaaagtaacatgatactagaagaggcatatcactggttcaaaatatgcttggggagatattaataaagaaaagaatgataaaagggcaacatataaaaagtcttagtggctataaaagttatatatatcactagagcttacttctcaaccgtgcattctatacaaaagagaaattttatctgcaaagtatcctgctgagggacttgtattgctgaaaaggtaaggtgctctctcttatcataagaaaagagaagagaaaagaaaggcaggggaaaagcaacctgggaaggataagccaaaataatggtgaaaactggtgatatttgtgctcatttttgagggaaaattggagt

SEQ ID NO: 36409 - DNA, 845 bp, Bovine  19866880685176
tcttttttctctttattctcattctctttcttttcatccctccctcacctccctaactgctcttagcattacaccattcattccaatgatttcagctgctgaatataccatgatgctgagttacagatgcaaattcctaaattcgtatagaacaaatagacatggttgttctaaagtcacatggacagtgacactatttttaaagtgaactaatattccctgccacttcggttccttctccccaatacattatagtaattactctatcaccattcacacattcaagatagaaactcaagcattcttcacctcttctttcctacatttgttttatctgcctagcaataaatatctgttcattttctttgtcttcattcataattcagcaaagtcatccctggattatttaaactgcctcctgtttaggcgttcagtaatattttgttctaaatatacaaaacttcctttctgaagtaaagatatatcattccttttctcaaaaacagaacaaaaatatttaagtaactatccattaaatacaagacaaatgcattttatggtcctttaataactgactttaatttcagttctgtcatgcagtactatccaacacatggcctatttccaactacatccaagtattcttcacacacactggtgaagcaggtcagaattgaggcttatctttcaaggatcagctcaaatattaccttgttcattcactctacttttcagtaaatcttctgtcaaggaattagttctgcttttcagtgctctcagcagcatggttcacaggaccagagagcattttcccaattatataagatcagcttatatataaacat

SEQ ID NO: 36410 - DNA, 1931 bp, Bovine  19866880755905
ttccaatttatatatcacctggctatcaccagccaacacaatagtggcttttaacacatacattttggggaagataaagggaaaaaaagtaagggacaggaggttgtcttcactctatctgcccagggtatacttccccttccctttcaagcaaatgagaatgggtttaaaaaagagagatctgtcttgctggaaacagtagtctggtgtctgaaaattgagaggcttgctaaagcacccagggtcagcagagtaaaggttgaggctggaaaatttctgcactcccacgaagcaagctaaatgtatgcttatctcatgtatcaaatgcaccccaaaggagaaagaaacaatctgattttttttttttttcccccttagatcatgtccgaaatgacaagttggatggtctgggagatgattgctgaaagagattggagttacaatactaaaaccccagaggagaaagtgggaattatctgtaaacagccactgaagattcacatgacatcaaagatactttaagggaaggtccccagcaaagtagcatctctgtatccaagaaaatgccctcaggaaaattcacctttaaatatttatatcatccagggacaatctccattagctgttttcaggcaaatgagaatgtttttgtgaataacatctaacttgggaacttgtttgaggttccattcccagcacggagcacaatggtaaacttagttaggtatgaatatggacatattagatattttttccttgaaaggagtcccagtttgggtgaatattggtaacaattggttatggaaaaatactgaattcgcttttataagcatacaatattaaaatactaaccagatatagaaaaaaaactactaaaagaatagcatgcttgtaactcagataacactttaattaaaatagaataaaatcggactgtcaacaattttatattttgtagttttttttctacagaaattgggagaaattctaaaatggctttcccctatttttcccatgaaactatgcttctttagtaggcttcttagactaaaaatcaagattatggtaagaagcatcctattatagaaattttgtatattttattttctatcctgacatggtccaatgttagtgtgaggtatcccttacataatttcaatagaaattaaactgtgaataatcataagtataaaaagttaaatggtcaaatcttaaacttaatttaaaactgaagtaagatacatattaattcacctttcagtaagacatcatctggttaaaaagaaaagtgggaaaatgaaccaatttaattatatcagaattttggatttaaaaacctctttttgacccattcaccttgttgtggcttagtattacccttctacttgtcagtttagaattaactgtcaaatttttctagttacatgtcattctttctcttcatttttaagcagttttattttaagaggtatgtatagtaaaaagtgccttagataaaccctttgctctagcactggtaagatatgtgacattattttttgagttttacatttttaaatgaaaaacaatactttctataaactcattgttgattaaattaaatgaataagtgggtaaaatacctagcatgaattaggtgttcaataaatatattttctctgccccatatggaactatccctttgaattttgaaaatgtgatagttttatcaattttaatataatttgacaaaattcatataagaaaattaaaggataaatatatatcagaatgagtcaatactgcaacaaataaatgactgatacttccattatttctaaatatagattttattaataattcttaaatattttactgtattctctaagcactgagaaaaataacaacttttatttatattacaaattttacattagataccactagaggga

SEQ ID NO: 36411 - DNA, 2217 bp, Bovine  19866881094475
ttttgactgaagtagaagacgtcaggggttattcttgctttcttctcaggccacagcaccttagctttccagaaacacatctcctgtcttttgtattggtgattgctgtctcacatgctcacattttgaaccggtgtaatttcctcttctgtgaattaaatatctatttaggagtatcatttgtcttgtcagctcttgattacaattcactgtttaaaacagggaaagttaagctatgcttgttgttcttgttacggcagtttcggtttaattttcttcttcaacagctttgcttgttcacaaaaaaagaacactatatttttccactgacaacttatttttacctataaatattttccattcacttttttctcatcctctgactgccaagactcaaattactcttacattatctttcagtgtaactatctcaaaaataatgatagtttcctgactgaaataaacaactgattaccctcacaaaatattttgaaaatattcaattattcaagtgaagcatactaattaaaattatctaaatactcattttaaaatcttttgatgtttttaaaaatttgcattaaaaatactaaatttcacagttgataaaaatatacattaagaggtctcttttttaacttagaatggcaaaatgctgtcagtattgaagaaaacaatgtctatcattcaccaatcaaactctaactttcctttaatggtattcctgataatttcccaactcatgcaagtatgtgtgttgttgaagtatgccatgtttgttctagatcttagattatagcagtaaataaacaattatgattgctctcatgaaatttttctttggtgtcaaatattattaattttaaaaatatttattaaaaaataatatttggtactttaattggaaacaacataaatagcagattttgttatcatttggttatgtcaaacaatatttgtgtgtagattataaatcactaagatataatttactagcaatttaaattaattaaatttagcaatttaaattaaattcaagtgaatgaaattttaagagtatattagatttacatttcacatttaaaaagaatctgaaataagcatattaattatataaatacattaatcatctaacaaaaagttgctacttttccattgctaatgatgtttttgatgaagtaaaactgaagaaaaactcttttatcatgaaaaactttcattgatttcctttctcagtctttttagtgtagatattcctcaaacttccacagagcaatcattgatatcaaagggattccttttgatgccaaaagtcagctatcaaacatatggctttgccatgttaaatatgtagttaactttttcttccctaaaacatcaaggaaaaatgtaacagtagttactatatattttaagcgtttataaaactcagaacattgtaaggaaatacaactaacaaattatgcatcttttttagtaggtctttttgtgttccagttatttggattatgaagaaaaacacttcactataagaggttccaatgtgttcagatggaaatatattgtaatgaaaaagataagtccatatgctatgaattggcaacagctgtttcactttcatcctatgggatgagggaggaacagaaactggagcaccttgatgaatattaagatgctaagaaataaggtactggcaagataagtctgcagattttaagttctttatggtaatatcattaaacccaatggcagaatgatgtgatagtatacccacagtacaattatctgaaaatagaaaaacttcaatcagtgtaataatagtatatatgtgtgtatactaatacagtttgaatttctttgagttattttactgaattagccaggtgtctcaatacattgcagacacaatcttagcaagagcatatgtttaaatcctaacatcaaccaatacattttttaaagctaaaataaactttgtgtagggtctttatcacataatgtaataggtaaaatcatttgcctttgaaacaaagtgtttcaggaagtatagaaaattacatattatgctttttttagggagtagctttgttctgtattctcaatacaatttccatctgcctaacagtacctataaagctgcattagtggttaaagatgcaagatttcaatttagatgccagaaatcaaaatcagattttaccattgccttatttaaga

SEQ ID NO: 36412 - DNA, 791 bp, Bovine  19866881202414
tttctgctcagaggattagggtatccttctgggacatacgggctaaacatagtggaggagcaggcagccctgttttgggtattcacagctgactggctgtccctcctgagagctggcctgtgtgtgaagctgctgctgacgctattacattacaccttcctcttgtcctaacataagattgaggcctaaattattttgccttcagctcacaattttcaaaagactcttgggtcaattccacatatttagacatttcaaaaacaaagaataaaactccagactactttaccttacaaaaaaatgttatagaattaaaaaaggatgaagcacaagatcaaagtggtattcatgtgagtcagtggctgcagcagggagctgcttcactttgccactctgctattacagctacctttttgctacctactgtctgctctgagggctcacctgctgagatcaagctggcagggagctacattgctaggccaagtcatcataccagccctatgctgcctgcggtagagaataggagcagtatggaggttgtcaggattttaatttgatctgattgtacacagggcagtacgtctgatcttactgcttgtatctggatgtagacaagcgtatgcttttctactcaaagccttgtctgagattaaaaaatctacagtctctcctggtgagtaaccttgcctgctttgaaagctggggagttctgcaatggctggaaataaacatggatctatggggaagcaaacataccatgtactggtgccccagctcagcagaaagtt

SEQ ID NO: 36413 - DNA, 1422 bp, Bovine  19866881205636
cctgatgctgggaaagattgaaggtaggaggagaagggaaacgacagagtatgagatggttgtatggcatcactgacttgatggacatgtgtttgagcaagctgaggaagttggtgatggacagggagtcctggcatgctgcagcccaagtcaccaagagttggacacaactgaacgactgaactgaactgaactgaattaactcacacacacaatgagacggttggattgaatcactgattaaatgggcatctacttgggcaaactcctggagacaaaaagccacatggaagcctggcatgctgcagaacatggggttgcaaagggtagaacacaacttactgacttaacaaaaacaacaagaaatcacacctatcactctttccccagttaggagcaatactttattttggctctaactctttcaaagaagtatatattaaatacatggaaaatatgtgtgtattgggccacttgaaaaaaaaatactgatgtacagttgaaacattaatgtgtcttgttcaatctcctgtcttttttcctatacaatgtctcagtgggatgaaagcagcagatgggaccattatagaggatgtttatttgttacatggctttgatatgcaaatatttgttctaaaagaatgagaaatgaactgaccaccgggatattctcataagagaactcctctaagtaaaacagagagagagagaggaaagactgtgcagtctgagagggataagctttgacattttcctttcctatggaacatacttgaatataaaatagtgcctccattaaaatgcacaagaaatcaattccagagtatgaagtgtaaattttgcaatagagtcattctgctaatcttacagataattctttactcagtctgatatttgtctttatgcataattgaattttgtggctccgtagagagaaaatgggacatttatctatttaaggatttttatctgaatgaatataagcagaaaaccattttaaaagaaacactataaaatagtatttttttaaaacttaagaatttactatcaatgtttatataatataaaatttaaaaatatattttccctgacaatagcttttagtcttatttgcttatatctgaaatttggtgaatagtatagacagttgatgtttcaaggcagtgaataggtttgatcttcctcagagaatgacttttgattctggggtaaaagaaagcctggccagattctgtaatccttaaatcaaacagagtctaataaaccaaagtgaatatttaaaatataatcaatctatttttcagatttgtgaatagttggattaaagaataaaaaaacagggttttcaactagaaaataatcttatcaagttaatatatagtagtaaaatcagaacagcaaaatagacttttagaaggcaga

SEQ ID NO: 36414 - DNA, 1081 bp, Bovine  19866881410095
ggtgaaatgttttatgcagcaacagcagacactcaaagattcataacttgtgattcactgctttcaccagctctatatggctgtttgatcagcagaaactaagatgtgcaggttttacagatgcacagatgtcatgtgtctgatcagaatatggcctctttatttggcttatatctagttctacacaagtagaaccattccatatattaatgctcttggccagagcctgaatttcccagtatgtatttacacccaggcagatcatatataagctggtgtttggataatccagttttcatgacaaacaggagtggactataaaaccagttacaacatttcatgaacttgtaataagtgtttttatttgaaaactaggaaccacagaagaactttgctattacagagctataaattccattaatcagaagctgtgtacatgcaaaatttttgtgtagttcttttgtatatatcattttgtgtaaatcctctgtatacatatttataagtattttaaacacagtaaagcaattcttagcagaccttcatttatgcaattccaaactctaattaatctactttatacacttacatgggcttctctggtggttcagatggtcagatttccttaaattgggacattctagacactaagatcaaagaagctactggaccaagtgactgctctatgaacatacacaaattggtctgtctgtgctctctgttgcaagtgcatattacaatattacacatgcctacattatagcaggtttttttctttgcagtggtttgattccatgacctagtcaatagtgtgtgaacacttgcaagaataaaatatatatatgtgttaaaattctcatcctctaacagtgcttagtacatattgggtgctcaataagtatttgttaaataattgattaaattagtggtctttgatattctttgacttataaaaccaaaattttaatattacaaatttattagtttgtaatttaatagttaatattacaaaattattagtaatctgatacagctttttttaacggggcaggaacacttgcaaagcaccggaattaacata

SEQ ID NO: 36415 - DNA, 1582 bp, Bovine  19866881513832
gtctcctgcattgcaggcagattctttacctctgagcccttgggaagcctagtggtagactgggtgagagttaatgtcaaaccccataatgcccacaaaggtagatatacatgactgtaaaataactgaatgtgtccaaataaatctcattagctacataaatattattttcacttcactttattagtaaaagatgtacaatatatctgctcaggcagaagagataatattcagggtaagttttatatagaatgagtttagttttaccagggaaaggagtggacaaaaggagattcagggaaaggaagcaaatgctttagtgtgtctggagcctatgatgccagcatgctttgaaaatatcttttggattgtattgaaatgaggatgagaagttaagagaggattattttccctatttattttaagtaagagcatgacaaatgagatttgcatttttaaatatactgagttacttttatgaaaagagcaacacacataactccacatactgcaaatgtttttcattcccctttaaaactgctttacattttagaaagaatattctggaagagtgaactggagggagaaagaaatagaagcaggaaataattacgcagaagagagtatcatcaagacaaaataacaatgttgtgaactacaaacggagaagagttttgaaagagagatagaggcagaatctgcaggatgcgggtagaatagaatatggaaaataagacaatcaaaggagagacggtatcactgtatttctacttagttgataaggtatttactagtgtgagttgcctacaataggtaatataagagacaaaaagtaaaggggtaagaagatgtgaaaatatttctcttttgaacagactgggtttaaaatgcctgagtttgaggacatattgcagagacacccaataatttggtacttactggaaatggagctaaggagagagatgagctgaggatatagtttagtagacattaccatatagatagcattggaaataataaaagtagatgatatctcccagcagcacatataatgagaaaagaaggctgtctttggaattctctgaaaccaccctcatttactgcatgagtggagactagccagcaaaagatatggagaaagaacagcaagcaaaagtacagtaaaaccaagaaaactttatcacagaaaccagattgcaggtttaatattcaaggacagagatgcaaaaagcagagacaggtcaacagtgccaaagctacaaataggtcagttcacataggtacataattttagaataaataagaggagtaattaaaggatctattaaacattaaattttaaatgttttttgtataaatttgctaattatgaaagtgaatcaacttaaaaacctttatgaagcatacatttatggaaaaaactaatactacataattctttgagactttaccattttaacactaagttctattatgtatgtttccaataaaggtagatcacaatgcttaaaaattcaacaaagcctactagaaacgtttccagttagtaaaagtgtaacaagaattttacaaccagcacatt

SEQ ID NO: 36416 - DNA, 694 bp, Bovine  19866882231657
ccattttcttgaaaatgctgttttgttatattgattattttgagctataggcacttgaaaaacagcaaatgcaggccaaggcatcctctgaactcgccttatctccctagacagattctctaaaaagaactccaatgtcataaatcgctttctcaggagtttcatcagtcagggaagattgacccttatcacagaagagactagaagtagacaccacacccagacacactttgtcacaagctatcatgcctctcatctattcttctaagggcccattcatctttcctaaaaatcatttactctccccaaaaaggcctgcatcctctctcccctttccctattaggatgatatttaatttgaattctaagccacttagaggagttactcattttcccctgggtatctcacatgtatacatgaggcatacatgttaataaacttctgtgtgttttcctcttgttaacctgtcttctattatagggtctcagctaagaactcagacaggtatggagaacaattatttttcctcctctacactattcatcacaactctgggcatgggaaagtgttatgacacagcagacaatgacattatttcctataaaattttatttattacataaaaaattctatacatttgttagactaaaatacagttttcattataattctggcaactgagttagtacacag

SEQ ID NO: 36417 - DNA, 1615 bp, Bovine  19866880424569
tttttctttccttggggcttagcacagaggtaatagtgaaagcagcatctaatatttttagctaaaaggtgccagatgggaaataactcccttcaaggggaaaattcaagtctgaatgttcgctcacactctacacctattgtttctttccaccatcaccttgctacctcacataaagcacttcgatgacgacagtgcagaagctgccaccctgctaagagtaagtcatgctaagccaaagtggataatagcaacgcaaggccacataatgagctgcatctgatgatagcctcacaagctgttcccaataataagtggtttttattaaggaaaattcagggaaaggcaattattttctaactcctaaactaaaaataaatcagatttttgttatatatgtagtctgatctgtgactctgatttgttattttaaatctatgatatgcatctttttctgctgtaatttctaaagactgaagtttgtaaattaaaaatatgtacagttcaactatacagaggaatgaccctcttttgaagatcaaaatgcactttaaagtaaaatataaagagcttcttgatgagggtgaaagaagagagtgaaaaagctggcttgaaacccaacattaaaaaaactaagatcagacatctggtcacatcacttcatggcaaatagaagatgaaaaagcgcagcctaaactcaacacagggggaacaatagggctgatgaccctaattgtcctggggggtgggtttcagggctgatgattgcagataccttgtggggggcttacctttgaatcagcctatctgggcaccacttgtcggggtccagccctggtggatccagggaaattcgaaggagagatggcattggcgaatacactggctttaattagatattaattagagatataaaaagtaatagaatgaggatagctcagcaggaaaattcagtggagaaaagaggctgagtagcttggtttatgcaggaaaccaataaaacttcaagacaagaagtttgcaccacttacgtaggccacaggcgtccttctgttctcccgaaggagaggagacactgagacctccccggttggatcttagaagcccaggcataattagtaagcatggcgggttccgcgctccagatggagactcagccagagtttgagagagacaggtgtcatgcggagaccagtatttcgagaaactgatcccaattctttattttccagaatctgtttttatacactgagatgttatacaaaagttacacggggtcagtagtcctgacttttattaaagtcagatgcttcatacagatgtatacagaggtcttaggggtgttacatcatcttctggccagggggcctgctgacaatttatgaccctctccttgtgacagcggccagtcaacacttatttctccaggggtgattatttttgaaacagacgccaccttccgaaggtaccagataaagttacattcctatagggtgagggtgtagtggattttaattaaggaaagaatttacttagcctaaggtctaacgtgattaatatcaaaggttaatacttatttcttctatatattcattaatgtgtataagggcagggg

SEQ ID NO: 36418 - DNA, 2556 bp, Bovine  19866880466156
cattttctcttatgctaagtgaaagctaaatgcacatgaatcaatataaagattatctgtattttgtggacatgggtggtccagacacccatgaggagataaataaatgtttgaggtgggtccttcaatgatttttacaaccgatgccaatttggcaagcttgaccgggccctaccagtacgaggaaccatgattttggtatgatgttggggaattcgtggcttccatctgctggttatctcacaaaatgtggagctgagaaaaatcacatactgattaaatcatagaatcccacacttggaagggacttcatgagatgatctgggcccgcctcctgaaggtcaatgcataaatcatcttgtgcagatggctgtttatactatttttaaagctctttaaggatggagattacacagcttcccttggtagtctgatcttcatggtcaagaacttccttttttaaaagcccagcttctctttgcagtttggcccatttcctttttctcagttctctgtgagtatggagaatacacgatcaacctttttctgttaattatctctggctgacactcttactttcacaattaattattaagatgtatgctgtaccttccccctcccccacaagctacaacggttgaaaatcacttatttttcagaagacatttttctcctctatatatgacgatttttgtaattaagaatttttctccttggagtctattctatactttgctatataaaactggtaatggcatttcttcctaagtccaaatcagctgtaaataaacagcatagttttcttcttatcttaccccagtatcatatttgctgtttaaattacagcatttcctttctgtttctggcacatattatgttccacaataaatcccaagccttttactgtcaaactgctattttctatatgtcatatctgtgtaacatgtcttgggtcttgctgtagactgatgaatggccccctcaaaatgtcacatcccaatccccaaaaccagtgactatataaccttacacggaacaggggactttgcagatgatattgaattaaagatcttgaaaagcagaagttatctggattatctaggtggacccaatgtaatcaaggagatccaaccagtccatcctaaaggagatcagtcctgggtgttcattggaaggactgatgttgaagctgaaactccaatactttggccacctgatgcgaagagctgactcatttgaaaagaccctgatgccgggaaagattgggggcaggaggagaaagggacgacagaggatgagatgattagatggcatcaccgactcaatgcacatgagtttgggtaaactccaggagttggtgatggacagggaggcctggcatgctgcgtttcatggggtcctaaagagtcagacacgatggagcgactgaactcaactgaatgtagtcacaagtgtacttacaaaaaggagatgagagattaaggctcagcagcaaaagagatatgatgacaagagtagagattagagagaggcacttggaagatggagaaagaggcaggaatgcagaggaatgcagacagtcaatttccaagaaattggaagaaggagggaaccaaaatttccccagggccactggaaggagtgtggtgctgccagtactttgggcttctgacctgtagaagtgtaagataataaattcatgttgtaataagccacgaaatttgtggtaatttgttacagcaggaataagaaactaacacagctttatttatatatctgtgcttgtcttcaaattcatgattttatacaatagaccagttttggacttatcaaggttgtttagtattatgttctcaccatccaaagccacaacaataccagtgggtatttattagactattggtaaccttaacttcttatcaactgttttgaaataatttaagtaatagaagagtccatcctaaaggaaatcagtcctgaatgttcattggaaggactgatgctgaagctgaaactccaatactttggccatctgatgctacgaatcaactcattggaaaagaccctgatactgggaaagattgaagggaggagaagaaggggacgacagaggatgagattgttgaatggcatcacccacacgatgcacatgagtttaagtaagctctaggagttggtattctccagtactcttgcttggaggatcccagggatgggggagcctagttggcttccatctatggggtcgcacagagtcggacacgactgaagcgacttagcagcagcagcagcaggagttgatgatggacagggaagcctggcgtgctgcagtccatggggttgcagagagtcggccatgaatgagtgagtgaactgaactgaactgtgtgccggggacagcaccatgagcttggaatgtgctatctcagttaagtgccaagacataaccatgaagtaggggttattataccactttattcaccaacagagctgtcatgcaagtcccagtctgcctgattttagagctcatctcctttcaacttacctgccactgct

SEQ ID NO: 36419 - DNA, 2552 bp, Bovine  19866880563113
ttctatctacctacacttcctttctctccacagggtcagaagcccaatcttctcagagtctcattcttcttgatgatctcttccaaatgatctacacaatcataataaatcctgtccttcacctctccccactactaccttcttgaatcattccacaatgactttcagaattcttattgtgtctttctctgagcattgcaaatcttttattctgtgatcctactacctacaagaactttcttatctatactagatttcttgatccagtactatcatcactttttttttcgtttgcaaacatcataactacctaatccctttctactgctatgaaaattgtctaataaaatcccagcccagattaatctaactatacacttactctacaccactgcagctaaaagttgtcagtgatattacgtaactggattgactggactcactttaattttatggacacttatctgaaatgtacgctctctacttggttttcttcttcgttttcatttgctggtatgttcttctctactacatctataattgctgaattactcctgtttttgccattagttctttcctttccaggactcattctctttgcaagaaatctctctaagggcttaaaataatacaaaattttgaggatgatcaaattttatctctactttagacttttctctagttttggactatccaattgtcttattaatatatgtaattagatatataataggcatctcaaacttaaaacattaacgaaataactactgtgtatgaaaaaatatattttctatcaaatttctgtatttcaatacataccattctgggagtcagcctgtattccttacacctttaatttattagctatacttcaaaaatatattttctatcaaatttctgtatttcagtacataccattctgggagtcagcctgtattccttacacctttaatttattagttatacttccatgtatctcaagccaacctttcttactaccaccatctctcctccaaccctaatgcaagttcttctatgaccttgtgtggatgacaaaacccttcttgcatcctccagtaccatctttacagagcaattcaggctttctttcagaagtgtaaatcaaactctcactctcatgcaaaaagctttccaatggttccatcttacactttactgaaatctccaaatccctcatcatggcctacatattttattattttccatgtggctttatctctctctacttatcttctcatcttctggacttagctagaacagctacgtttctttcctcaaactccaggataatttgtgtctcaggacctctgcaattgtttccgtttggaacactctgtgcctttgaatgagtattcagttctcatcattcagggctcaactaatatttcacttcctcagagtaactggttttaactacttgataaatcaggttccttgtcccagataactctatcacatcatcttgttttattttccggatggcacccattggtatccaaagctctcctttttatgtattttgttttgggtttatcttttcctcccaatagaatgtaataatttattatcttttaatgacctttaatttacgtaaagaagacatggattctgccttttaaggttttgaaaacaacagtgggacctatcaactcatccagttaagaaatctctttgaaggtccctccaaacttgtttgacctaaatagaaagcgatctttagaagtaaatgggtttatttcacattattattcatttatgaaataaatataaatttctgatcctctcagatataggacttaggaaaccaaccaggagaagagccaaatgttccagttcctctgttcctattgatatagttgcataagacagtaactaacaaaaaagagataaaacagaaagaacaaaattaaattttcactagaatcaagtcagttccagtttctatttctatgtctaagagatgtgcaactgccacagctgacattccctggagcttttgaagtaattttaaatgaaatccagagctaaatggtgcaaacagaagtaccttggagagttccagtagttactactatcatgggttttaaatttgaaataaaaatgaagtcttccaaagtaacttcacagaaaactcttcttgttctgtactaccacacaagcttcattttctgatagtatactcactctctaatttcatatgtcttatgtttccctgagaaacatcatccatgcttagagaatttgcaaggttatcatttatgaaaaaacaaaagcaaaaaataacaccattggttaaagatagaaaatattttttatctaaatgtaaaagaaaattctaaaacattattctatagcacaaattcattattttaatctggtaacttttttagttgtgccaaaaacttagttaactgaacataaagatatttgcatatttatatgtaatgaatgtgaagagataccccatggccaaggtaaaagaaacccaagtaaaatggtaggtgtggcgagagggcatcagagagcagaca

SEQ ID NO: 36420 - DNA, 2014 bp, Bovine  19866880611282
ttttgccattgatattaaatgtcgcttccacatttcacaaagacagaaaataagtgaaggtaataagacttccttattatttgtaattgccctggtatctcccttgatagagtgtcaggcaatgactattggctattcttcatttcctaggtgtagagagcaaatggggagtaaattatgcagaaatgtcttgggtttgctttgcagactgctccctgtggaagaaaagacaacagcaatagcttccctctgaccctcagagcatcagctgttgcgtagatgtgcagaggggctatggccagtcctgaatctgtaggggtgttgctcaggccccctgacatccacaacgtgcccttcctgacaggtgaggtgggcctctgtgacctgaatgggagcatgatttcagaaagtcataggagaaagagttctggactaagaaagatcagaaaactctagaagatgctatggtatatgacctttgagggcccttggagctgtaagtttccatgcctcttatagttacatagcctgacagaggttgagggtctcctgtctaccactgggcaggatcaagccaagggtggggagaaatcatccagggtaatccaatgctggaaaccatgccaatgaaaagtcccctcagcggtggtttcatggatactttcaacattcatataagagatatcttatggtgacctggtgtggacctttttaattctatggtcatcacagagatggcacactagctgtgtttctaattgacagggacagttcctggcagagcgttgcctttgggattgcagacgttatggtacttctggtatttttttctttttcaaataaacttatagaacaaaaaccccagaataatctcatagacgtaacattttccttctctagctattgatgtccattttgtttaattttttgttttatttagtttggtgtggcgtagcaatctgaaaacagttaccattactcattctaaaaaggaatctaaaataggaacatttccaaatttgaagcatttcttaaaaggagcctggattcaacattctgactttatctttatcaaatgcttttgacaataagaaatcttctggggagaaatttaataaacatttcttggagggacagcacagagagcaaacgtcagggtgcctctacaaaatgtattgccaacctgatttctgaacaatgctttcgcacactctgagctatttttttccagcatttggaattctatttacaaaaatcccaaactgcttctagattcttctcctccatgaccacccctattattcaagcatttgcttaacacaagcatttctttctctgatagaaactggaacctgaaaggaaggaacacagagaaaataatagcattttaacttctgattttattcttttccctgcaaatgaacaggtaacaaaacactgtttgtgtccaaagcaaaaggcagggcctccttttctcttctttcacagagtgccagaatatgtaaacaatatttaggttgaacttctgagtcctctgaatcttctgtcagccttcagaacaacattcgtgtgtttgtttataccaacatttaacagcataaagagtgaaacaagtaaacggtctgaggcatttataggaagtgttcagattgtgatacagtcttgtatctgtattgttttagtctgacaaagaaaaacactgctttaggaagtgggtcatgtgagtgtataagtgcttcgtagataggccggataggccatggttctggtccgagtaccactgaaacacaaagggaagaaacttattttattcctgcaaccccacagtgcatctggctttgacttttttgtgctctcagaacctggtaatttttctaatattaccattgaaatacctaagaatacttgcataaataaaataatttacatgtatacgtgaagaacaagaagatttaaagcccttttactaactttcaccattgtttcatattttttaaacctatatgtgagatcg

SEQ ID NO: 36421 - DNA, 2203 bp, Bovine  19866880662490
ttccatttgtgtccatccagtcattactgcctcatgagcatcttctaggtcttcttttgatcagctctgggctttctaagagtaaaggatccctactctgttccctcaatccctgtatagtatatctgctactacagtcaaagctatggtttttccagttgtcatgtatagatgtgagagttggaccataaacaaggttgagaattgaagaattgatgctttcaaactatggttctggagaaaactcttgagagtctcccttgaatgcaaggagatccaaccagtaaatcctaaaggaaatcagtcctgagtattcattggaaggactgatgctgaaattgaaactccaatactttgatgcaaagaattgactcattggaaaagaccctgatgctgggaaagattgaatgcgggaggagaaggggacgacagaggatgagaagtttgtatggcatcaccgacttgatagacatgagtttaagcacactctgggagatagtgaaagacaaggaagcctggtgtgctgcagtccgtggggtctcaaagagtgggacatgactgagggacatgtactgaaatgaactgattagcaactatataattaaatcatggctattattttctgaatgtcttctatgtgccatgtttctcataagaaaacttgatctcaaagaattttctcaaatatgtaataggaccaggctttgaactcagacatttctcagatcttcctcctacatcagtgtttcccaaacagtgagatgagaactgactttcctggaaaggactttctggaatggtcatttgggaaatgttctcctgtaaaaaagatgctcaatgcacattattgtattagaagttttgagaagttctgtaaaagcaagtacatatttactttgtttaacacagcacttcccaaattaatctgattctgaaatgctattttagaaaaatttgcaataacatccagctccttagaaagccattggaaaacactaaattgggttatctccctccctgttttaaagacatccttctgagacggaggaaagtaaatatcagtaaatatcataggtcgcctaaacacttattggagaggaaggaactataggcaacatggggctgaagcaggaggggaaagacaatggcaaagatgacatcacctactcagtatactctgcttggtgttggtccttatttgagttctcagaaatccaactaaaatagcatcaacatattttataatacatattgtagcaattagtcttcccacaaactaaaatatgatatagtgtttcacatacaaggtccagtccatactatatgagagagatcacgttttaaagcacaaaagccctcatttgataatccattacttttctgcaccagatattgcatgactgacatgtacaaggaaatattttcacactgtttcctcacagtctttcttcttcattttcaaaatgtgaacatatgtgaacgtataataatttgttgactcttgctcgttgccactgacatatcctcctttaacattaatgctcaagcattaggttctcatcatacttgtaaacttgaccattggggaaaaaagcaagttcaactgtctttctagacttgataaaccactaagaattcattttggaattgaaataaggaagaaaaacttttacaccatgtctgactcataaattacatagtctctttagatgtaccaacaggcttcccttgtggctcagctggtaaagaatctgcctgcaatgcggaagacctgggttcgatccctgggttggaaagatcacctggagaaggaaacgctacccactccagtattctggcctggagaattccatggactgtatgtagtctttggggttgcaaagagtcagacacgactgaacgactttcactttagatgtactattaagattacccactccccagccctggctctcatttaatttttgagcattttgaattgaattactgtattgggacagatgagtattagaacagctgaggctgatttgcaggctaaccaagtctacatttgtaatcaggaattttgagccatgtttgtgataactttttagtactttgtggcttttacacccaggtaaatgtttatgcggttcaattttttttttttttttaataagacgtactcatgttactgaacctctaaagcaaatccacccaccaa

SEQ ID NO: 36422 - DNA, 3513 bp, Bovine  19866880756385
cgtatctctggtatgtactgtaagaaaaactggtgtagaatcttctgtattatctgcaaaactttaaacctaaaaaaagacttttaacctaaccccgtcaatcacttcacttggcaaatataatatagtgacacttttaataatggtaaatacatgaagtgatagccatacaattctcttctgtgtgcagtgacattttttaattggccaaataactcagtagaggaatgtttaagtttgtttaaatgtaaataaaatatatagctgtatttttttaatatcatgatttttaaatactgtatttcttaaatatctgctcctgctgtttagttgctaagtcttgtctgacactttgcaaccccatggactgtagctttccaggtcctgtgtacagtttcccaggcaagaatactgaagtggattgctgtttccttttccaggggatcttccaaacccagggatggaacctgagtctcctgcttggcaggtggattctttactactgagccacctgggaagctttctaaaatacctatagggatttttatttatttatttttttgccacatatacactggattctagcagttcaaaagactatttatgtatctgaatatctgtagattgtatttgcatttaaatccttcaggtgattctttgtataattatagggattttcctcactgtgtccttaacttgctgtaaaatgtcacttttttgtaagatttcatctcttttgttgcatccttagcttataaacaaagaaaagctctatggtaacttccacattaacttcatagaaggaatcacccaaattcctgtttagcacacagctggattctgaataatttaacttgtgtatacagtgttggtttcagtagcttccttaccatgggagaaatattgatatctgcagcactggctgtttccttgacatgagagtaagaagaaagaaggagtaagagaacaatgaatacgggtacagggtggacaaagaggcaggggattgcttggaaatactaggatttaggggtcaaaatgatctctgggaaatagtacctgaaaagaattctaacttagatttcatcacaatttacatatccaattcaaggaatatttgacagtatcttatttccaataataagaaaaaatagatttcctaaaatgttaatttggttgggctacattctcattcccttgccctcatctcagtgttcaccctcagtaagaaaccttgctcgggctgagaaggaatggaatatgagagagagagattgacaaagattgaacatgtctgaagcaactgcacgaagccagtagttccaagaggactattcactgcttattagataacatctctgtgagttaaactataatcttcttctgaaagacagtgatagggttgtgcccactccttcctccaattctcaaggccttcacagattacaagtccaatttggaatacaataaagtagacgaatgctatacaaccagagaaaactgcagcagattgagagaaaatcaggttccaaaaggtcatggaagacagaaattcctgctcagtgtgactctactaaggccatagtcctttcctcattcttcatacgtagggttagccagtcaagtgcaagacaggaaacttaacactagacagttacacaataattgaatgaacgtgcacaatatctgagtttgtccttgggtattttgaggtatattgagtcaataaacatatacattggtatgtattgaagttaatttgattcaactatctctccttagttatgagattgaatctttgagaaacaaacaaacaaaagcaggcttattttcatttaggaatgagaactctgcaaactgaaaaacatcaaataggaatatggccctattgttgtgattagttatcaggactgaagatttgcccagaaatcaggaaaaaggggggaaaatcatattatcacagatgagaagtgacaattcttatacctgcccaaccaactcaaacttaaacaaagaacagtattaaagatgatatttcagaattacataggatgccttttctggaaacaaaaaattgctaccagtgttaaattgggccacattttttctaagttttcaggttttactaggctagactaaggttgactacattactgtaggcatttagaaatgttcaatgcattggagaaggaaatggcaacccactccagtacctggagaatcccagggacgggggagcctggtgggctgccgtctgtggggttgcacagagtcggacacgactgaagcgacacagcagcagcagcagcaacatccctactccctccgccatacagaatacctgtcaattctgtctgcctatattattatctctattatactaagaagaaaagcaaagttatttggttatatcaaaacaaatttttaaatataattcccattacttatgccaagggtcagaaaatcaaggtccttgggccaaattcagtctgcagcctattgttttatatggccctagaaatatgaatgatttttacattttcaagggattatttttttaaaacattatgcagtgacagattttatgtcatccacaaaaactaaaatatttgctctgcagccttttacctggctattaataatatagtgcctttaaaatcaacttaagtggttgactattagtaaattcaatgatttgaataaaaatggaatgtttaaacctagaaaatagaaatggaatacagatactcatttaatgtacaaaatgctatataatatgcttctgatgtaattatgatttgatcattcaatatgacataatgaattcattaatgtaatgtcaaaaacacatcagtatttgaatatccagaagaaaaaagcttttctgtttgtaaatttgtctggctcaacaaaagaaaaaaatttataagacaaacttttgccagtaaagtcaagaaatagaagccacaaaataaaatacatgtatgtgtgtaaatatatgtgaatatcatcataattacagatatacaaataaagtagtattacattgtccaataaataaataaaggtcactgcagggaaagattgtaagcattagctgcagtcaatttttgcagctttcatctgtaaaaattcatctgttgagccagatcttgatactttttcttgctgttaaatatctaagcttgccccttgtccctagctaagaatccagtttttccaaaacacattagatttttgtggaaagaccagtcacagagaaaacctgataaaatgagaatgctcactgtttttccattttccccgacacttgccaggggactatatttactaggctggactctccagtacttaatgatgtcctccctgcctctgatggctttcacctctttccttgccaatgtacttacaaacgcatcagcctccttgcctcaatataactctggtgctgattgcagattgtgggtgaaacctctgtctatcaggagactaggaatagatcaggacactcag

SEQ ID NO: 36423 - DNA, 2250 bp, Bovine  19866880813110
ttagtctatcttaatttcatgggatttcactgaaatgatctcaaacctttggtagtaagcctttacatttcttatccccaaggttggccaatgatctattggcttggaaatgctggttgttctaaaatttccagaccctttcagacctttcaaccctgccttgagacgcatgactccagcctgtgaacctgtttagtgagacctctgcaatgcccttcagcaaacaggagctaccttcaaaagtgtaatgtatgcagtagatatttagcccacagttgttaaagtgttaatcactcagttgtatttcactctttgcgatcccatggactatatagcccaccaggctcctctgtccatggaattctccaggcaagaatactggagtgggttgtcattcccttctccacggtatctttccaacccagcggtcgaaatctgggtcttctacattgcaggaagattcttcatcatctgagccaccaaggaagccttagtctgtggttggtaatatcacaaatcactacacaaggtctccatatgagagcagccagggagccagaagcatgaacaatgagaatgctagagttctaaggaaactttgataccacttaatacaacctctgatttttcaataaagcaaacataagctctgtgaaatgaggttgctcagttacccaagtaattaaagactatatggggactgaaactcaggcatctgacatgatatctacctgtcatgaggatattctgcaaatgaccttaatatattaaactgttcattaacaatcaaagtgttacaatgattacaatggtttttgaatgcatcagaatttgagttcaggtagagtgcatattaagttttatgttacttgaaacaggtattttaaaactttgtggtaaaaatactatctctttattgaaaacatactggaaaacattgatgaaaaaacctagtatttgctgatacttcataaacaggctacatatgttgtggtagtatgtttagctattctatgcatttgatttctcgtataatttccaaaatattctagaaggcagaaatacttgaaatagagtcagatggagttttaaaaatatcttgagaaagtcatagccttcttttgtcctcttgtattctgaagagctctgattggttaatattcatatttgctcaggtcttaatcaaaagattcaaagatattgttagattgaatttaattaatcaaaaaaccacagaatttactgtttactgcctccaacattttgtttctccttagtcataggaagtaactttctgtgaggcagaccatctgtgagactgggtaagtgtgggttaaaatggcctgttgtggttctgcctcgatcatgtggttcttccatgacaaaagaggctacttttctactgggagaatgttctgttgtgctgagccctgtgtctctctgcaaacgatcacacttagttcaggaacactgaaaatgtcccagacacagagaggttactcttctattaggactagggagtggtgcaggtaaacagtttctattcattttctaatgacatccagcgcctgtagcctgttggacatctccactgacgcaggtaatcttgtatgtattaataactagtctggatttaacctccgttcttttaaggtaattactgagcatagtgttatgttcatgaagggaaagctgtggaactaagccttaacctaccttatgtcttcttcttaataatactgttaggtagttagaataggaaaaaggagtccagaatggaggtggctaaaagacaaggaagagaaaagtctgctaaaatagaacaaaggaaggtctgaggactggagtaaggacctcaagtggaacaaacagcattcccggctagcccactttacaaagagcagccccagggggaggaaaaaacatataaaaagaggagccaaagggctggggggtctctctatctcccgcgcgcgctccttctctctctctctctcttctctttacatcttttgggtcggcatgccctcacacctcgaggatgtattttcctttattttctaaataaaactgatctgtccaagaactataacacggactgtccgagagctgtgacgcgctgagggccttaacatctgtcgcttcaaatctttgttgtgatgagacagaactgaggagattacacttccctgacaataccttgccttttatggtacttcatatttttcaaaatactttcatacatacata

SEQ ID NO: 36424 - DNA, 1161 bp, Bovine  19866880985635
tttcaaagacattctgttctccactgtgagcattaatagggcagggcatggttcccagatagatgaaagtgacttgtaatatcttaaagcaataaataataagctaatatttattaattatttagtgtactaagcactttatagccattattgtttttaatccctacaaaaccctttattttccttgtattttatagatgaggaaacagaaaagatccagtaatttatgcaaggtcaaacacctcagaataaagaaaggagttaaatctaaggtgtcagcacattcttacccactcttctgcttccaaactcaaaaatatcaagaaaactcttcagatgatgaaattttttaaatataatttcacattccttgtagtggtcttggaagaccaaggactgactttagatttgcagtgtcatagtatggcttagaatcacgggaagaagtctccactctaccacgtcagggtaactgaaccaccattcagcaggtgactgcttaaagggacatgttaagatccttcatacggcagcataattctgccatttctccttcccatcttattaccattcagtaaatattgtcatcctttggtatttcttatcaagatattttgtatgctactaatatatgtaaaacaaattctatcccggtggaggaatatactaaataattaaaatctatttaaattgcttatgttgtccagctcatgtaatggaggtgttcctagggctagttatttatttttttcctagtgatttgtttgtacatgttactttaatgagtgatgatcaggaaagacatatatcctatgttactctggtctgagcatcatgtaaaaaagaccaaatgcaaaaaaaaaaaaaaaaaattccagaccaaaaacaactgaaggatgctgaaaattattgctcattcctacaggcagtattctgttacgggtggcaggcgttatgccagtctaacagaaggacatattgaggcctctactttttggtatgaaatattaatagtgagggcatggttccaagctgagtacataaaaacaaattactttgtaggttcaggggatatgctatagttaatctgtcgctgagctgaattagccttcagaaataaaaattgctcccagtaacatgtttaacctaaggctcaactta

SEQ ID NO: 36425 - DNA, 1635 bp, Bovine  19866881130412
tgtgatatgagtctatggagtcagacaggcatgagttgaagttttagttccatcccttactagctgtgacttatcaagtcaattaacttttcttgagattcattttcctttactgtaaaaataatatctacctcacagggttgtgcccacaattaaatgtgataatgagtgtaaatcatcccgtgcattgtagacattcaatagaaagtttacttctggcttttcctgttggttttttttcacacatatttattgttcctaaagaactaacaatttctcctaaagagaaattgttacattctctttgctagaaattgagagatacagtgcccaatgtatttttgatggtctcatttggtgactaagaaattcaccactaaattttgtgttccattgcctcaggagagttttgattatttttcctttcatctctctatcttttgtttcctctttatgacttgtgttaaatattttggcttgtaattttgcactcaggttttcactgtgagttgtcttaaatcctttttgaaagtagtcagttactaaatcaatttagaaagatgtttttggaattccagcgttcttggagtcacccatgaagccttaagggcacttgggaaagtttttcaatatctttctcttatcaagtgtctttctcatgtgttgtcagctcctaacactaatcctaatagcagtgacaatcactggagaaaataactctagtaggaggtaccatggggcttccctggcagctcagtggcctaaagaatccacttgccaatgcaggagatgcaggagacagaggtttgtttgatacctgaattgggaaggttgcctgaaggaggaaatggcaacccactccagtattgttgcctggaaaatcctagggccacaggagcctggtgggctacagttcatggctacagtccatcacaaaaaaattggacatgacttagtgactaaacaataacaaaggaagtactatagaattctgtggagaggcctttgtttgtatgtagtgggggtaagattcgcagatcttggcatgaaggacttgtctagattaaggaatcctcctatgatgttagcccttaactgacttccttaattttcttaagtcaattacatagaactcagtagactaagatttattcattgaatctcttcctagcccagagatttggaagtcctaagtaagttagcagcattggaatctgggttatgcctaagtaaagggattttacaatgggagttataagagagggagctgtattgaaacagaggtagaggcacagtgaaagggtgggaagaaagggtagggtttaagtggatagttatccaaggcaccccttccattgtcccagccatgttgcctttcttgcttccaactgatttccttttctggtcaggtggttcctctgctaaactacctgacttggaacttcctcatttagcattcgaatagtggcattttattgagcctgagcagataaaagccttagcattttatttagtctttagcctggctaaaagagaatctgtttcaaatacataagtacaaaccgggacacaggttggtttaatgattattgcagccatgctgctacactcgacacgagcttcttgtttgtcagg

SEQ ID NO: 36426 - DNA, 1088 bp, Bovine  19866881135406
cagtatgccttaagcttgaaagtcctccacccatggggaaatttcaatatgcatgcttgtgcgctaagtcgctttagtcatgtccgactctttgtgaccctatggactgtagcctgccagcctccatctgtccatgggattctccatgcaagaatactggagtgagtttccatgctgtccttcaggggatattctcaacccaaggatcaaacccacatctcttatgtctcccgcattggcaggcgtgttctttcccactagcgccccctgggaagcccaatttcaaatatactattggcccaaaatctcactttgatgcttaagtcatcctgcaaatactcagttgactgacttgcaccatggagactttgtagttcttcagcaagaatatgttcagacttttataagtgttagagtcataggatgtcttgtttaaattttgactattatcttcttgaaatgaatagtttcatcaagaatgcttgtgtggagatgcaaaacaagacctgcctccaaggtataatgtgaggcatctgaaggaagactccttgtttgccccctccaaaaacatctctccaacctgacataggcttgctgtttctatttttcccataattttaaagtttggactcttgtgaacacttataacacatgttaccttgatttaacttactacatcacaaagtatgatgcggcctagcaaacataaagtatgctgtggcctagcaaacaatgagggaacacggcactggacagatcagctttgactgtagaaaaagtgatgcccacagaggaagaaatgttggtgttgcagtggggatcctgatcgtagaaggcattttataagcaccaggccactagaatgttcggaacagatcaacataggagggcagaggaaaaagaatgtctcagaagagaagacatttgccccaatttactgctctgtctcaaatcagtgtccatgttaccttaacatcgtaacattgctttaggtttccatatcccatggaatcatctatgcaatcatgcagacaagctgaaaatctcagcccacagtctcttcacagctggcaagccaccacagcagc

SEQ ID NO: 36427 - DNA, 1367 bp, Bovine  19866881136494
taaaggagttgaattctgaactggcataggtactgttgaggtggaaaattgacttgttaaagtttattatatctcttttgttatatattaatagacagtactggaaaacagtggaccttgctttgacctactgcaaaacagttcacctctttctagatcttatttcttgtctttctgtctttatattacatcataatgattactcttacctctagtgaacttttatatgcttttcactctctaccaaaagtaataataaacaaagaatagttttctaaaaccagtgaaaaattcaagatatacaacctaagagaaacttctttacctctactattttaaaagttcttgtcattagtttcaagatagttttatttctattttcaaaaattgaaaaaacacccactaaggtagattttcatagtgtgtctcagtattacatgaacttagatatactgtgagataactatgcattctgaaaatattctaatcagccaaaaagtaccaattataaggtagttgttggtcccatttttgacttgccgataatacaaagatagttcattgaactaaacaatggaaactaatagcctgacaaatcagaaagaagagattgatttttttttttttttggcccattttttctgagattgtgggggcagtcacttctctttattgtattatctggggaaaaacaccttaaatctttaaagagatatttaaagaaagaaaacagagttattgctagcctaaatgtcatctacaagctgtgctgtacacagctgtaactaaggaagaatgcccaggcatattagcaagcatcttgataactatagaaaaggcatttgtcacttggtacaagttatagaatcaaaagagagtggctttgactgctgaagtcagtactcactcatcctcaagacgcacctgaaggttctgtctacccccaacactttcactctcccctccctcttcctctctgtcctcctctcctcctgcagttcctttgtgccagctcctttggaactttatcatgtaccttactttttcagcttttttggtacagaaaatatgtcacttgtgtgttattctatttatttaccttctcaggaaacttactgtcatctagatttcacctcattttgacataattgtagaagaaacaccagaggtttcttttgagaggagggcaaaaaggaagcggcatatacagcagatttgattcctttccttttcatagcatcattttgctccaccatctttgtagccaaaagagttgctagtactttttatcacaatatgttattaaaacagctcatttattctgaagcatttcgcttcattaacaaaatacctatacaaatttcatt

SEQ ID NO: 36428 - DNA, 1791 bp, Bovine  19866881145042
ttaatttcctcatctgtaaagtgagtaaaataatactattctatacaaggttggaagtttaactgagataatctatttaaagtctaagagtgactcagtgaatattagttccttcttcccttccttcctcctcaccttaacaactaataaattgcaattccttaaccaatgaataaggtcttaagtgccaggtccagagaaaagaacaaaattaattggatttgaaatgacttaaactgatgctcttgataccatctgaacattcttccatttcctcaagctcattcccttcatttactctcccaaagatctctccttccctgtctgtctctctgttggttatattacctcctccaaagcatgtaacctcaaaacctagaagttacttttgattcatcagcttcctttacttcctttatccagcatcacagactactagagttgaaagaagcctgtaagatctggttttcatttattgccaagtggttctctcacctctgctgagtaacttctaatatcaagaaggtcctgcttctaacaaaagagctcaatccattctttgaacaactgacactgttagaaagacatacctgtattcatcaaaatctgtttctttgtaatccacactcattgcttagcattctttcctctgtaatatacagagtaagctaaatcctaatttttctgccttatgatagcccttcacaaagaaaagacatcaagcatcatatgactccagagggatttttcttttagtttcctgtgataaatccttccagttctcttatatgttcttaataagaccctgttaaaacacagtgtttagggttggacaaaatactgtagatacagtcagtacagaatacaggaaagatgagatgtaacgtgtgatccatgaccgggtttgccttttgtcaccaacgctggcacccacagactcatctgaagttttccataacctgagaagtctcagcttattttcatttgaagatctgttaaactagacctctcaagttatttttggaggttaattctgagcctgcatgcagacacttaggtttacatttatgtttttcatactattaatcttgattgatcttttcaagtctcatatttttgtgtgtatctcatgcaccttcctttttgtataactcctcatcctctcaatgctgtattctggctgtgaatctttcatcccgttggatcaaggtgatacttatgaattcacatttgcacccatgtttaaatgtgaaattatcctcattaattattcatatccattgctctgtagacatgtaaggccatgggtccagtttctgatctgcttccctcttgtttttccctagaaattactggacatctctccataagatcttccctaataatcgttaatttattatcccattgctttgaattctaaagtaatttaattcttttaattgaatcagataatctctgacccagtaagtcaacataacctgctttctgtatttggcccaatggcaaggcattaatattataactcttgatctagaaaggagaaatcctgtttcctaataccatttacttttgtctccctttctctatcctttccaaagttatcgccttcagatgcagggagaaatgaaaacaccaccctgtgttcccagactttctatttcctatctaggacttcaacatcatgagagagaaatcccaggttcctagatgctataatacagccccatatgattcagcagaagtgggtagcatttgggtttgattagtcttggcaggcactctgtcacatct

SEQ ID NO: 36429 - DNA, 1138 bp, Bovine  19866881218617
catcatgaataagaaaaagtgtttataactccattttgcattttatgcattttttagtatagagatttcaaattttaaatattttaatgactgaagttacttccttttacagaagcctttgaaaaattgcaatgttttaattggttcacattaaacactcttagaagcttgagggaaaaaagtctttccagatgagcaagaggttggataaatgtaatgacatatggtttgttttttatagctacaatatgcaaaaaatagaagcataacacatgtattcaatgatatatatgtatttatacatataaatatatattctgatataaattatgagatatgattattttgtatcagtgtgattttgtttttctctttcttgttccctttatgaataaaaataacaactgaaacttagaacaattttaaacatctcattatacccaggatctaacgaaagataaaatcaacgtatgcaaaaccatgatgttgcttggtcctctccaacttgtgagctaggctgttggaacaggaacagctaggctgtaggtcttggaaccttggggttgtagtgggatggtgggggggcggatactgaggaactgcctgctgatcttattacagaattttctcccacccagcaggattccacagaatcactcccgatgaatgggtcaccaactgtttcttaaatatctctcagtaacaatatatctcacatcctttggcaacaacaccccccaacacacactgcagtgttcttcttttattgcccctggatccctgaactcatcaagacactcaggagacttgaaaggcatctgatcattatgtgctatatacttaatttcaaaagtttcaaaggcttttgttaaatggctacatttttttcttcaaagttaaaaaaaaatctgagttaatgtaaagtttcctttcacatgctatagacaattttggggggtaagggggagtgagttttttgcaggctcacagactattttcagaagatccttcttatggagtctgcatgcatattgagaggatcacctctgagaaaccaaaatggacctcaaaccaaaattttcctcatcgggaaagtgttagcggtcactattaagccttcggacagggcagaggcata

SEQ ID NO: 36430 - DNA, 948 bp, Bovine  19866881282122
gagcaaaatgtccatttcaagtattggggagtttcctttaaaaattaggtgttatttttgcacgccctagcattcaaggaatcaataggataggacttaatgcactgcctgaccactgctgctttgaggaaaatatgggcccaaaatgaggtgagacactggtctgaaaacaattttaacttgacaaagtacaaaaaatacagactcacacaatctctttcaatcaacagcctcagaataatcttgtgctcgcagagaggaatgagtattgaagatctacactgaagacatattgcctttatcttattggttaaccttctcattttgcaattctgtgaaaatctcatgagcattcttaatttttcaaagtattttcctatatttcatttttaaagcaataaataattcagaactcacactttcttcagctaaaggcttgccactgttcttccattattgtcagttagcttttaaccagaggtatttcccacttcagctatcataagttatcacaagctatcataagcttttaatgttggtgcaaacatttttcctttccctagactccaaagctagacatgttattattgtacatttttcctgttttagatcgtaagcttctttacatagtttcataaaaacctatgtccttgatatcacagaaaggtttataaacaaagtcttaatttaaatccaaactagtcccaacatcagtctcctgaatttcagcaaagtgagatcaatgttatctaagcctgtttaaaaagggtcaatttaaaaactaaacataatgcttgcttaataatatttagtcttctaattttattttcttggcttttgcatctagaacaacaatttcactttttctatgcagctattcctgagatctctattcttgactgcctccctaaatttttggaaagactcataataaaaatttccatagat

SEQ ID NO: 36431 - DNA, 752 bp, Bovine  19866881306456
gagggaaaggagacattcagtatagaacaccaatgcaattggagaaaatggacttttagagtattttataggtgtagaagtacacctgaagatagtctgtcccaggaaaatcaaagcaactttgaaagttcccaaccacaacctggcaggaaagaagacatcctgtgctaggcatttattctgatgcatctgtgcgggaggagagctgcacctcctgaaattctggtaaatgcaacagctggggtgaggaaagagtgcaaatattgtaaaaaccgcaatgggaaacaaaatcagaagaagactttgagatttacgttagctctaacataggaaagagactagggttatgtggatctaaatgaatcaatgcctaattggaagtggattggaagatgacaaagaaggggacttaggtccaggaaaatagcaaagggacagaagtgcaaggctatgttctctagccttcctcatgctcatggcaaacactggagtccattcttttcctgtcatccaaattaccagcacaaaggtctctgttcaatctatcagctgcaagtctttaggttatatttccaaaatacatgctaaatccacttatcaatctccatttcaactatcatcactctagtgactacctatgtagcctagatgactgtatagcctcatttctactcttccttcatctgacctacttttctagaacctttgccggaataatttttaaaatatttaagttaaagtatgtctttaaa

SEQ ID NO: 36432 - DNA, 860 bp, Bovine  19866881474389
aaaatccatgaaagttcaccatgaagtttgttttagtcaggttgagacccatgagtgggggaaaaaacacacagtaggttaacaactgtatttatgaggaacaacagaatctatccaaaggagttccattgaagcagccaacatacactaataaactggtatgtgtgtgcatgtggacgtgtgtgtgttttaattcagactgatgtcagatgatgtcaggttgaccgattgcttgggatttatgcaaatttagccaaaatgaaattatacatatgacttacttcttttttcaaatgctttttatttattttaaaggctttataattactgttctctctcagaatatattctgagagggaagcaaaaatatcacttttgcaaagccatgttcattctttcaaaggtctgctggtaaattattcttactgatctttccatctttctggcctgtgcatacacacctaacccatactaaatttcaccagatggcattttaattctttaaagtaaagcagtcgtgggtttagacagttgaatttttaaacttctgtatttactgaaagtgcatatggtgctatatggacaaagaaattgtgctgaaagaaaaacatttctgtctgcagtacctcataatctcccagagaaagaaaaattgcagtaacatggagtctgtcttacaaaatcttatgtggctttaatcttcttcctctgctaaaagttagatatatgtatattatacacaccttaaagttatattttaaattcttcttttggttgcaaatagaaaaggttatccaaaaccccatgactttccaatatgattcataagtgatttctagaagaaaatgaacataaaccta

SEQ ID NO: 36433 - DNA, 996 bp, Bovine  19866881635326
aaaaaagtatttgattcccatggatacctctttgagatgtggtcttgaagtcaatagggagtgaaactggagtcttagaaagatactttggctgcagaatgaagaatagcctgatcttgggagagggagtggttcaaaggagtaggagggatgtaatattagcaacaaataccaagggcctgaatttatgcagtgaagaaaggggcaaaaataggtcatagttttgtgtgctcttttataatataataagcagacatctatgggaaattggagaagggaaagagaaagatgttgagaatgaccatttgggtttgtctatctattactgtgttctgtaaacatctgtttccacaaagtattagatacctttctaaactgagaaatacactaaagctaactatacaattttttctttggccagttggtcagtaagttacaaatcatacatttccctccattatccagattaagaaggggagagaagacattttcattgtaccttttcatttttctggcgcacaaaccaaattctagtagcctggattttagctacttaatagatatgtactatgcactatgtactcagccctgtgcttaggaagtgtctgttatgacagtggttctgacctggcaattttgccactcaggggacattggcaacgtctggagacactgggttgtcagaactgggggagcactactagcatctaatgagaagaggccagagatgctgtcaaatatcccacagtgcacaggacagcctccaacagaaaagaactatccagcccccaatgtcaatagtgccaaggttgaaaaaccttgatttatatgaagaaaaattaaagcaattattctgacaattgaagagcagcaggggttttgctaaattattagaataacaacctcattcatgggctttgctttgttaatatagacctagccaggtggtgttgaataagcattagttcgtgatttaatcttagttcctttctcttc

SEQ ID NO: 36434 - DNA, 931 bp, Bovine  19866881773454
taataagtatttattgaattgatgaattaataagaaaaatgacatggttgaaaacacccgaagaacattaccttgtattcttgaatattcccccaattgttatttaaaaatttttttctctagttattagtttatttctattttttgaaatccatttttttccctaaaataagttttgtgattttttttcctgagtaaagcagctatttgtattgtatttttgtttgtttgaatcttgttagtgagattttagttctttaagccagttaggatgatatcttataataaatctcattttaatctgttttatttttgtgtatataattgtgggacaattttaatttataaactaggacacatttatggcacatagtttaaaattttcccttcagttttgtactgatttcctaaattcctttacactatttgtatggatcttgtcaatcaaatttattctgtataagagattaatagagggatgctacattataagctttccagtttccttgaatgatttttagtattctataacacttttttgtaattaagatttaaatacccaatccctcaagacttgccatacagagagctgtcaatcaaggaattggcaagctctatgaacggcatgatgaaatctttatccctactctctgatgccttcaagaccagcttttgcaagttgatccttcatttcacatgtcttagaactcactcacacttcttatgcttggaaatgtaacacacagagtgacaatgtaatccacagctaataagttagcggctataaaaatgaacatccacattaacttgccaagcgtggaggctggaggtgttacactgcactcgtgtatatatgtctgccagggcaatagtacatatgcctttggaaatgcttctaagttatgcagagaagccgacaataattcttgaa

SEQ ID NO: 36435 - DNA, 1126 bp, Bovine  19866880290391
tctttcccagcatcagggtcttttcaaatgagtcagctcttcccctcaagtggccaaagtattggagtttcagcttcaacatcagtccttctaatgaacacccagggactgatctcctctaggatggactggttggatctccttgcagtccaagggactctcaagagtcttctcccaacaccacagttcaaaagcatcaattcttctgcacttggctttctttatagtccaactctcacatccatacatgaccactggaaaaaccatagccttgactagacggacctttgttgacaaagtaatgtctctgctttttaatatgctgtctaggttagtcataactttccttccaaggaataagcatcttttaatttcatggctgcaatcaccatctgcagcgattttcgacccccccaaaataaagtcagccactgtttccactgttggtagagtgttaagttccttttatcatggactttttacaaagtcataattcttccatgagaagggggaagatggttttccagaaaaggcatatatttagaaaacctaccagggatgctttagagatgatcattacattttgccacaaagtcatggtagttgtaattatttttcacaaagatcttgggtaaagcctaaaagtgcaagtaagtggaccaaagtagggcatgtcaactggagaaagttgtctggtctttggtgaggaatgtaaataattaggattgcatttcagaaagatgctcttgccttttcctctctaatgctctctgacatttgggtgttgaatgccatgatatttttggtattcacatgcatccttaacaagcacaatgctctcttggctgtcctgttttaatgctgtaattgtgagtttgacctacaaaagttatatttgcttggtagacaaatggaaaatctccttaaataaatacactgactaatactgtctggctacatcactaataacagatgacagcctttgggacatgaccatgttaaaatgcaggatctgtttcacctgcttatccatccacagacctgtttatcatcaacaactatttattgattaattaccatgtgtaggacacagtgttcaggaccatgaatgcaaggatataaaaga

SEQ ID NO: 36436 - DNA, 1563 bp, Bovine  19866880513105
tgctcagatggtacagcaacctatcacaatgaccagagagaccacaccgggcacactgcatgtgccccatgggtgccaaggcctagagaaggggactgcaccaggcatgtgaaggtctgccaaccagaccaagaccgtcctcaagctgtatgtggctacttaggatctggatggccctgcattatttttttttttttttttttttttgcactttttggccttgattttcttctcaatgaagtgaagcaagcggaccaatgacacctagagccacttattcacagtggttccagtacccctgtccagctccctccttctcccaaaggagatcagcagacacaagtactagaatgcggcttgattgctggggtggacgagcagggctcgaggcccaggctgagtcagaagacacagctccccagtgcacatgtcttcctgggagggagccccagacactgagctctttcaggaagagacaacggagtggacaagcagaatgttatgagaactggggcaacagaccaggccaggaatggactacctgggatgctgtgtgccgggcaaggacagaagcaagaagacatcaaccctggcaaataagatccccctggaggagggcatggcagctcactccagtattcttgcctggacaatcccatggacagagaagcctagcaggctacagtccatagggttgcaaagagtcagacacaattgaaacgacttcacatgcactgaagtgcagcacagggaactctactcaatattctgtaatggcctgtatgggaaaagaatctacagtgtggatatatggatatatggatatggatacagataactgattcactttgctgtacacgtgaaatcaacactacattataaatcaactgtacaccaataaaaaaaatttttaatttttcttccgaacatacaaaacatctcaagggtccactgaaggtgagggaagcgaggaaaacctcatgtaagagatttttttaaaggagtcagcacactgagcatagtttttagccctcttaaggctgaacataatggtttttttctttagaaaacaaaaacaagagtgatttttctttcagtcagtatagcccccaaatctccatcctacacccatccaaccccttctttataaaagaaaacataatattaaatttacttctctccagctgagagtttattttaagcctcatagaaatgctaatatgagttctcatttctctgtctcacttattatttctctcattatgaagcttttctacagaaataaaagaattcccttttgcacaatcaaaaaaaaaaaaaaaaaccaatggccagttttaaagagtgaaaatgaagatagaggaccacaaaaattcctggtcaggaaaaaaaggggttgttctcaagggaaaacgtgctaaatatataacatgaaattaaagcataagggaaatttgcattttgctgaatattaagatgagtctttttctgcccaagcctggatagagaacactttttgaaatcagaccattacaccatcaagaacttctaagaaatactctg

SEQ ID NO: 36437 - DNA, 1826 bp, Bovine  19866880706912
tgatattgttattgaatgttcctaatctataggttttctcaacttggtttctgaacccaaaaaacactatcgaagagcaatgataggattgaaagtgaaagtgaagttgctcagtcatgtccaactcttagcgaccccatggactgtagcctaccaggctcctccatccatgggattttccaggcaagaatactggagtgccatttccttatccaggcaatcttcccaacccagggattgaaccagggtctcccacattgtaggcagacgctttatcgtctgagccaccagggaagttcaatgataggattaggctttttcaaatatgaatagtccacccattgattttaatggaaaaataccccagagttgggaggctgtggatggggcaaatagtaccttagttttttcacctccagggttaagtgaataaaaatttaaaacaatatgagtatgctttatattttagaaaaagtaaaatatgataaaaaatgacatctttttaagaatttcatgtaaattacaattatttcttttgccatggattagctcttggattatgttagacacctttaatataagctttcataaaaccctgtgtctaacttatcactgcatttactatttgttattagaacttttttgttgattctctatgatctctatcaaaataaaagctcttcctgaataggcaccatatttatcatactcaccagtgtaatgctaacacctaatacaatagttttcacattggaaaaaaatcatgcttattttgtggttacttaaacaatttcttaattacacagattttaaaaagtattgcattttgggcttccctggtggcacagtggtaaagattccacctgcaatgcaggagacccaggtttgatccctgagtcgggaagatcccctggagaaagaaatggcaatccactccagtattcttgtctggagaatcccatggacagaggaggctggcgggctataccccatggggttgcagagggtaagacacaactgagcacacacacacacacacacacacacacacacacccctcctcttaaacagtcactcaccttctcagctgcaatagccctttccagtgaagtctccccttccctaaagcccaggattgttttcttcctgacaagctctatggtccctaagtggttaagaaccagtgctctttgtggctgaatgcccatcctacctccctgcaatttgcctgagctccagccatcctgcaaggccatttccacacatccagtctgcctcctctctcaccagcaaaaaggagaggaggagtaatgttgaagtattaaccagtggattgaaagtgaaagtgaaagtcacttagtcatttccaactctttgcaaccccatggactacacagtccatggaattctccaggccagaatactggagtgggttgccattcctttctccaggggatctttccaacccagggattgaacccagatctcccacactgcaggaagattctttaccagctgagccaccagggcagcccaattaacaagttctctacccccaaaaccaccttgtatttcaagatccctgcccctaggcctgagctactcacccttagaggagggccactacttgggctacagaaaggaagtgttaaattgtggcatttgggtttcaaaagtcataatatgggaattccctactggcccagtggttaagaatttgcctgccaaagcaggggcacgagtttgatccctggtccaagaagatcccacatgctgaggagtaactaagcccgtgcaccccagctactgagcacgtgttgcaacta

SEQ ID NO: 36438 - DNA, 1579 bp, Bovine  19866880756460
cgtcttttatttatggctgcaggattcacttgttaaatgtataagcaattaaacattactcaaagtacaatgaaaatgagtgtttttaatttttacacaaaagtacttggtttataactgaatttactaggttgcaagtggtatttgagggtttaaagaaaaatagttttttaacttctaagtttaattgaatatttgcgataattgaatattgtgataaatacataattataataaatttaaaatgttttaagtaaattataaataattacaaataattttaaaataatgtttcttaaatcagatttaaatgattgatttaggagtttgggaacttttgggtggccacttggaaaaagaaaattgatttatacgtttgaatacataaatacaaaaaacttgtgcatggcaaagtctccaaagacctgtatggaaatgtttaaagtagctttgttcataatgccttcaaattgggaaaaacaaaatatctatcaactggtaaatagataaatacatcaatatgataaaaaatattaatcagcaataaacagaactgctcttacatgcaaaaatatggttgaatctcaaaagcattatgctaaaaggaaggagcaagatttaaaaaagaactatatatattgtatgattctatttagagcatgttgaaaaaggtaaaacagaaatcaggtcagtggtaccaggggatgagggagggaaaggggactgactgcaaagcgacatgggtaaacttttggggttggtgaaaatattttatatctttattatggtgttggttatacatttatcaaatgtatgaaatcgaaaaaggataaattttattttactaaaagaatagcaagaagcctgattcagggtttccctggtggctcagtggtgaggaatctgcctcccaatgaaggagacatgggttcagtccctggtccaggaagatcccacatgctgagaagcaactaagcctgtgtgccacaatcattgagcctttgctctagagcccgggaaccacaactactgagcagcaactgcagagtagctgccaccagccacaactagagaaaagcctgcacagcaaggaagacctagcacagccaaaaataagtaaaattattttttaaaaacaaacctgatttaaaaaaaagggcaaacaaagacaaaagaaaagtgataaactggggaaaacattcataatgaatattacaacaaagggttaatctccctaaagaggttgtagaaatagagaaatgaccaacaatgaccaaaaataataatttttaaaatgagccaaaaaaaaaaagaaggaaaacaaagttcacaggaaaaaaattcacaaggcttataaacatgaaaagatgctcaatttcacatagaagaatagaaaaggacactaaaatcatgccaagctatgtattttctgttcctcatctatccagactgacaaaatcctaaggactgaaagcgcactctgttagcaaggctgtgtagaaacaggtaatctcataattatggtacaaaaagctaggaagggaaatttgggaccccagggactataacccaccaggtt

SEQ ID NO: 36439 - DNA, 1748 bp, Bovine  19866880809054
ttgcagacggggtggtgaaagaaaacattttgttcttttgtggccttattgatgagcattatagaaactaggtgccatggggtactgcaaagataatgtagcaataaagtgctaaatgaaatactgaaagtcttgaaatatatagtatatataaaaatttaaaaaaaacctcttcgctttagttagtagagaaaagcagtggaggagtagagatgtgatgggaactttttaaagcggaggatttgacggatgagggaccatcactcatggtgtcggaaagcttgagtcaaggttaggccagagtgagaagacgtctccttggacagtcatgccaggcaccgtaggaacttccccagtgtgagctggtgcagtgaaggctgaccatgcaagtagacctagaggctgctagggagcccgtgagaagagtccgtggagttttgaccaggatggcggcctgaagaattttgtcatttttaatttaagttgactcctttaaacatgtccctcttgcgtttcacgtttgtaggtttaagaaaatctaccaagaagcgcagcgaatccccgcctgccgagctccccagtttgaggcggagcacacgccaaaagaccacgggctcctgcgctagtgccaggtaataatttgggcctgtcagtgtgatattagttcatttcctgggtccagctttccccaaaggccttcattttatgagttttaaaaaaaatttcatgaaagttttctttttgaaaatcgagcaaagaaattcattctaaatagaactattatttctgtgaattcttccccaatatttaacttaactttttttccttttttgctaagctttaatcatgcctttttggggacaacacctttgtcttctgccttttcctctgttgttttacattatttgcacagagttcctgccagcagttggacatttggtggtttttggagttcctatctgccaaagagctctctaataagcatctttatgcagattcgggttatttttaaaggtagctaaatttcccagttgtgtgatgagtggatcaaaagggatgcctgttgtaatggctgtaatattgcctaattagtttctaaaagtgttggcatgagttattgagtttaatgggtgagggcgagagatgtacttcatttttattttgccttacaacacccatcctcaggggaaaatgtgggttttgtttgtgttctttcatgtctccatttttcccactttgagcccattttcagaaaatcatctacctttgacatacgacatagtatgttatttcccatattttcattaactgattgagaatcttaggttgaagttaaaaaaccttgttactccagtttcacgtcagattttcaggattggtcagttctggtgttgtgctgctaattatcacaaccatatgggacttctccctcctttatgtgtaatttgctccttttctaaatgtgccaaaaaccagtgatggcgtgggtgatttttagtttgcttttcccatctcaggtcagttgaaaggtttagtgcttctttggttcttctctaaggtaatcaacttcatacctttgactgctggtacagtaataacataaggaaacagaatgacttgttgcctaataataagtcataaggaaaggactctaggccctttaagctctgcttttccacttgttttctggttctattaggattggttaaaatattggttaaatatctggagttagtacacctgtttgc

SEQ ID NO: 36440 - DNA, 1144 bp, Bovine  19866880816045
atcttagaatcctgaagtacggtagaattttatgaagtccctagtaagatcattatatgaaagtatcagactaatattgttgttgtttagttgctaagtctttccaactctttttgtgaccccaagtactatagcccaccaggctcctctgtccctgggatttcccaggcaagaatactagagtgggttgccatttccttctccagtgaatcttcccaacccagggatcaaacacgtgtcgacaggtgtattctttacccctgagccactagggaagcccatcagactctaacgttaagagtaaagtattttttaaaagaagtgataacttaccatttaaggctatgtctttggcaatttaaactttcataagtttaaatatatattaaggtttatagttataaatgtgaatttcataaaacctagaaattttgattccttcttgaacagatgtttaccctcatatacttcagaatgaatcaaagttcaagtatcttctgctcagcctctttggatacacactagaaacttcttcagaaatattttgaggttttagaaaagatttgtgtaaaaaagacaatcgttagagtcacttttcactgttggctttgtgcctgcttaaaagttacccccaagggctatgagccacattttccccataagtctgccagctactgtttcagtgcctttaaaagcaccccagtggctttaaaggtaaatgtagtcattcccaggcactgagaattcaggttccaacagtgcccagactcaaaaatggctacaagaaatgtctggggcattaaatgacatataatacattcttagaaaattacttatagtagcaataaatgtttgctttgtgttcttgactttgtttatgtcaacttcattatgctgaatatattcttttctgttttgtagggtggatctacgacatcacccaaaaatatgacttttccttctatataagcggtttactctacatggtaggaatcctctttttactcattcaaccgtgtattcaaattatagaacaatccagaaaaaaatacatggatggtgcaaatgtgtagtgtcctgtgatgttccgtgtaagattcccttgtcatcctcatgcattcctcacatggttcctgtgaggagc

SEQ ID NO: 36441 - DNA, 1902 bp, Bovine  19866880867762
agttaatggtaaatatatattgagagagaaaaaacactgtgtccgcattgaagattacctttatcaaaaacagagagcaggatcctttcatagcaaccgaagctgtcacgattacaaacaggtcgtgttggaccgaatggagtatgacatgcaatttgttatctatcacaatttacaggcaattctagaatcagtggaggtaatattgtgtgggtatattagccatgcttctgttcctcctttccattagctgccttttatcattattgttattttggtggtctttttcattacacaacccctcccactagacattagagcaggaaataatgacgatgaaacaaaaaggaaatgtgtgcatgtaatcacttgttaacagctctgaagggtttggtggagtaaaagactgaaacagctggctaaaattagactggggtaacattctgtgactccagttactagtaccattcctgtctaatcatcaaggataattgagaatggtctgtactcactttagataaatttgacctgagacaccggcaatgatattaaaatatttgtgtgtgtgtgataagcaaatcgtgagtgaaaatttaaatagttctaaaatatgtgtaaacaagtaaggcagccagaaatttcaaaatgattctcggaagaacattttgcagtctgaaaaatgtttggcttagaaaaatagaggtctccgataaaggaagagcattattcaatgtcatgaatcatagttatcttctgtatgaaatcaatcaagagagctattttaaaaactgtgctgagctcaggcaaatgaattgtccatagcacaccaagaggcactggagaggggctgtttgttaccaccactccaatgtcaagtgcacagacgtttggaccaagggccttttgcttattatcctcacaacatgatagtcttatatttgggattagtaacatgctttacaaatgatttaaacaaccagctttacatgtcaatcagcaattagttttctactttatttactgggtaagagaaacccagaaaaaaatgtctataggccccagagcatgctgataaactaagaggccaataaaacgaataaaaatgcttgaattttagcccttgactcaatggttatacgcacaaatatgactttcactaaggatattatttatattatttatttgttaagatttgtctcagattcagtttataactatataatactgcattaggagtaatggcaaatgctatttttagagaaagatttagaaattgtatgccttagctgcagaattctttaataaaaatataaactgtgtttctttaattgtactaaatgcattgcctttgaaattagggtctgccctttgttttacactggtagcgtgattgctccctgtaacacttgctgaagtctagcattttcttgtgcttaaaattcatttacaggtttcctccaccatctgaaagcagagagcattctatgaaaccttaattgaaatggcataaagcaaagaagccatgacctccaagacacatcttgctaatggatgcacaaataaactgagatcaagcatggatgctcagagacaccatccaaagtcctggtgacttgatgctgagatgcctgtgtggttcctgggagggagcttggcactgcctctgcaaaggttcgcagcaaaacaaacgctgaacaaggttccccttttttttgtaaaagcaaaaatcctcctctagttttttcctgtgagcaaaaactaatgcaggtctttcgtaaaagcaaagtagtgaaaagcactttcaaaaagcaggggaaacctgtaactgttgagttttccagaagcacttagacaccttattttcaccttacaaagaagtaactaggttgagaagctttcatt

SEQ ID NO: 36442 - DNA, 1143 bp, Bovine  19866881045292
acattttactttttttctcaaaaaattttgaaataattctcccatacatctttatatttattgaaaaaaattcacaatttcccatttattaactgcaccttttctaaaaaagaaaataagataagcattgctagcccattttggagatacgaacagtgaacttcagaaatgtttaatttctctcacaagttcccaaaacatgaatacctgtagaaaagccagaggaagaagtgatgtctcttgacagctaacacagaacattttgtacaatcacagtgtgaactggtgcgtgtgcatgcatgtgtgtgaatgtgtgcaaaaagtttagcagcgaaggctgatgctgtgcaaagtgctagaatcccttgttgttgtttgttagcaaacttcaatcaaaaattcatcagaagcagaaccattgtttcaagttagggtgtttaatcaaagagaggattatagaatcagcttagtgggtaaaactccataaaaagcagctccaaaaacccctttttcctccaaggggagaaattgacacattttcattttaatcccaaagggtaagattcccagagaacatgacaagaaaaaacaaacaggtgtctgcctgtttgaatatttgacaaagaatcatttcattaaaataaaaaagctttccaaacaaaataacacaactttaatccttacatgtgatggaaggctcaatggaagggaggcattcctgtaccactcaccgaaaagaaaatttggcccagcagctgccacctctgatacctgcctgcttccccaaatgaaccaggaaggcaaaaacagcagcttcaataatttttttttaatttgaagtctgaagtttttttcaaatccatcagaaatacttaggtgtcttttatgtggtatccatatgctttcacgatagcaaaaaataacttcagccaggcaggacctatgattctaactctgcaggaaggtcctgcttggtaggcagcacaaggagaattttctgtgtactttatcagtcctgaagcttttcattccagctgggcacagccatctgaactgtgtttcagagcaaaacagggtgttttagagtaaagccggactcagaaatcactccatcccctcttcacgaaaagactcaaagaggtt

SEQ ID NO: 36443 - DNA, 1534 bp, Bovine  19866881083241
taaagttaaaaaacaaactataatgaggtacctccttacactggtcagggtggccactgttaaaaatgtctacaaataacaaatgctgaagagggtgtggagaaaaggtaaaccttctgcactgttggtgggaatgtaagttggtgcaaccactatggaaaacaacatggagcttctttaaaaaactaaaaacagagttgtcacgtgatccggcaatcctactcctggtcatacccggacataaccgcagctcaaaaagatacatgcagcccatgttcactattcacaacagccacagtgtggacaaatcctagacgtccatcgacagagggataaagaagatgtggcacttatatacgatggaatactacttagtcatgaaaagagtgacaatagcatttgcagcagcgtggatagacctagagattatcatattcaatgaagtaagtcagaaagagaaagacaaacatcatatgataccactgatatgtaaaatctaaaatacggcataaacgaacttatttacaaaacagaagcagactcacagacatagagagcagacttgcagtggccaaggggaaggaggggtgagggaacgattgattgagagttttggattagcagatgcaaacagttacatataggatggataaacaagaaggtcctactgtatagcacatggaactgtattcaatatcctgtgataaatcatagtagaaaagaatatgaaaaacaatatatgtatgtataactgaatcatgaccacaacattgtaaataaactatacttcaattaacatgctttttaaattaaaaaaaagaagtttcatcctatgttagaaactggttcataaatgaaaagatgttttaataataatataataaggtataaattgggaatttcacaagaatatcaatcatttctcctgggacttctactatgtgctaatataaatttctctgtgctattgcaatatgaagtgaatgtttttagacatctcaattttaaaaatagcagttctttcttagcagttctttccttcaaaacttaattttaaacctgagtctataatttggttcttagttgttatataggtctgatatttatgtttaatcaacatttcacatttttaaatgttatgaagacccattttaaatgttagctttcttagtcaaatcaaaagagaattattgtcacttactagtacccaaaatcatcagggaaaagtaatgtcacattactgtgttgagtttttcaagaaaaaatttctacttaaagatctcagattgaagagaaacacttatcttctcttttattaagcccccactaaaattttaataaaggggttggattcacaatgacaaggagaatggcaggaggcaatgagcagatgagagatttctaccaaaatctgtaagatgaaaagtggccagaggattgctaatcactgtttaagggtggagtatgctcccagaggtcaggaaagcagccagtatgtcctgcagaaccctggtggggcagtggagatcccaag

SEQ ID NO: 36444 - DNA, 3082 bp, Bovine  19866881115924
tgggaagaggaagaaggagaaagagaattagatgtacagggagtgcgggagaaggtggctggttctcagcctccggtggtaatgatgggagggagttaccctgcaggccaggggaactccaagagcagatcaagatggtctgggacagggacagccccacccaggagaactgggcctcctgtgtcatcaccatgaggttttttttttttgccatgatttcccctggttgtatactgagacctctgagggatttcattcctttctgtagaggataacaatgcctgttgtgtgatctgtaagaaagaagatccccaggaagccccgagctccccaccaagatgtgagccaggtaaggaaggggtattgtcagccctgagctgcaaggtgtcagatgtctgaattcagagctgaacagcatgaccctggttccctgctcatgttgcagttgttgtttagtcactcagctgtctccagctctgtgtgacctcatggactgcagcaagccgggcttccctgtccttctccatctcccggagcttgctcaaactcatgtccattgagtcagcgatgccatccaaccatctagtcctctgttatagtagatcagtcctaaagaaatagtctgtttttcctccacaatctttatgcttgtttacactaaagactcaatattgtgattttaactcctgtgcacctcttatttcctataaagaataaaaggtaggtatttacctagtgtttaatagtaatattatattgttataactttggatagagtttcaaagaaacttggtccttgatatctacttgtcagaaagagagaccaatgaccctaagcccacaaacagtttttgccacatattcttcatcagattgttggattatatagtgctttattgggcttctctgataattcagttggtaaagaacccacctgcaatgcaggagactctggttcaattcctgagtcgggaagatctgctggagaaggggcaagctgctcactctagtattcttgggcttcccttgtggttcagctggtaaagaatctgcctgcaatgtggaaactgggtttgatccctggattgggatcccctggagaagggaatggctacccattccagtattctggctgggagaattccatggactgtatagtccatgggggtcacaaagagtcagatatgactgacttacacttttagtgctttattctttttcaaagtactttggcaaatgagatttcctcacagaattttagttcttagccagggaaaccattattatccctccttagcaattagaatacagaagcacagaaaaaagaatatttgtttttcccttgagatcaaagtaggaggaagggtgaagaccagtgtcctgagtatctcagtacaggtggtggctgtgtgaggcttgtaggaagtcagtgtcatcacatgatgggagtccaaaggcagacctgcaacatctcaatcacgatagaacagaacccaaaccagagagccttccacttctcaaatagagactgtcggtagggagtggaagaaattaagagagagagtgaggcaagaaatgaatcctgctacagggtttgggggcttcccctgtggctcagtggtaaagaattcacctgccaattcaggagaagtaggttcgatctctgagttggaaagatctcttggagaaggaaatggcagcccatttcagtactcttgcctggaaaaccacatggacagaggagactgtgggctatagcccacgggatcacaaaacttggacatgacttagtgactaaacaacaataggatttgaaagacctagaggaatagagctggagagaataagcaaaaaaatgagagttcaagatcatcactgcggaaaaaatgtaaagataggagatgttggcgggggggagagcacacaaaatgaaagatacatcttcataattatacacaattattctcctagtgcagaagcagaaatgtttagaggcaggtctatagataggaaactgagaagcagagggcaggagaatgaggtgaatgaagtggaaacagaggcagaacaggcttcattggatctcaggtgtggtccttggagcagatgtcctttttcccaaagggcagctcacctgtgctctgaacctcctaactcagctcatttccttctttcttttttttttttttaagtggagtataattgctttacaatgttgggttagtctctgttgtacaataaattgaattagctatatgtatacatatgtcccctctctgacatcccttccatgtctgcctcccgccatcccaccagcctaggtcatcacagagctgagctgtctgagctatacagcaccttcccactatctgttttacacatggtagtatattcgggtcgttcctaatctcccaattagtccaacctcccccttccctatccctgtgtccacatgtccattctgtacatctgtatctctattcctgcatggaaataaattcctctataccattcctcatttcttttcagagtcctgtgatcctgaagcttcccaaatgactgataaagaagaacaagaggagctgcccagtcaaccactggatggagaaggtattcatgacttcaactcctatgtaactaattgaatctttttctgtctacggggaggaagatctactctactcctcttcacatgcgcacacagaagaaatacaaggtgccacgtgaaaagaatcaaaaagacggaggaaattagttgtattagaagggagtgagatggggttttgttgtgagattatgttcagcctctggtgatagtgtcaggagccttgttaacctccaggtcagctgagttcaaaggcaggagggtctacgggttgggacattcccaccttggagattctttagccaccatagtcttccccggttgtttctggtagggctttcctactatggtttccattggtcatacactgggtttctaagagatttcattctatttatcagaaggcagtggcacctgtttagaaatatgtgatgaagaagagactcaggaatccttgagctcaccaccaaaaagtgg

SEQ ID NO: 36445 - DNA, 1407 bp, Bovine  19866881430046
ctattggcataaactcatttatgaatgagtccttgacagatggggtaaatgggagtgaagtcctaatcttccatgttttcttacagttctcagaggacccctgtgtgtctttgtcccagctctggccatgagcaagccctggaatctctctctctctctttttttttttttggctctgtagaatctcaagacactatctgggtctcagagaaagcagaactgcaggaggaaaccccttttgggaagcagaggtggagaaggacccattcagatgtgttaagctgtgagcccctcccttggctgcctattgcggtctgtctcaggttaactcagcacggggcaaaacaagagaatgaaagcacatttcacaagaatagcgatcgaggagtcttttattcccaaaccatgaataagcacagtatcaaccaaggggacttcatggaccttctgtaggtgacacctcagagtaagtctctgagtttcaaaggggattatgaggaagcaaagagtagtcaaatggagacttgacatggggcaacatacaggttagcatgatccatggggacagttctagtgtccaagtgccaacagccatgatgctcttaagattcagcgttatagccataaagcagcggtagggacaattaaatcaggcaccctgatggcagagagaaaatcggcggggagtatcatggatttgtctcaattagaaaaggcaaatgacaggcctttgacatctgagctattactggtcattactgcagcacttcataaaaaggaaaactgtactcaaaagagatttacttcatgatagaatcaaagagctagaagaaacatcaaaagaaaaatggagccctgtcccctgcagtcaagaacgatttgaaattaagtcagtgagaaaggcagcaggagacatgaggtcttagatcagaaaaaacctaagttcagtctcaagtttggcctcgacaaggcaggtaggctgagctggtttctcaacctctccaagtcccctctcccacattcctcatctgtgaaatgaataagaccagcactttgcagatttactctgcaggatacaggaaataacaggtaaagccaattttattacgaagttctccatgtgatccggtgagggcaccaggtgccttcctcaggacaccacagaggggggatgaaccaaggatacctgcacatcagtaaaccagtctcctcagcattatgttaaagagcgagatgggagaaaagaagagtggtcattgttataaagagccatcaagtggggatggaaaaggagccatgaaaagggaggtgacctgaccctgcagcatctctggtgacagaaggaagctccaggcagaaagcagcatgtgaaagacagcagagagcatgagctcagctgaaggggca

SEQ ID NO: 36446 - DNA, 3109 bp, Bovine  19866880380034
ctaatttatctctctccccttgagacctttcccccttgggtaaccacaaggtttgttttctgtgtctgagtctacttctgttttgtaaataagttcatttgtatttttttttataaatttatttattggaggttaattactttacaatatggtattggttttgccaaaaaaaaaaaaaaaagtaagttcatttgtgttttctcttaatatttcacctatgagtgctgtcatatggtttttggctttctctgtctgacatgtcacttagtaggatcatctccaggcctatccatgttgctgcaaatggcattattcaaattaaatgactcttggtaaggagcccaacatagggtctagcaacaaatgaatactaaatgaactttactattttactattgttgctgttgttatcatggaaagtctttaaaaattaaattatatttagtaataaaacaaataattaaaataaacatctatgtgctgtgctgtgtgttgtattcagtcatgtccaactctttgcaaccctatggaccacagccctccaggttcctctgttcatgggtgtctccaggcaagaatacttggatataagaacatgtcagtggtgattacatgtgggcaattctcctagcctttggaagaaactgaactgaaatgactcaggacccttccctgcctgtggaacttcgattcttctgctcataatctgcttcaagttgtttttttttcccttgtactcccattctaaggtcttggaatgaaggttgtgttggcttttggaaataatttggaaagtttcctttttcctctctgcttgggaacaatttaaacagtattgaagtttctgttccttgaaggttgaaagaattcacccaggaaaccatctgtgcctggcactgttttcagggagaaagaagtctttaaaactttctcaatatcttgtatgttggcccatacagagtcttccgcatatctcaggtttaattttagtaagttgtattttcctagaaaattatccatttcatctagctattcaagtttatttcaagagagttttgtaaaatattcctatggcattctcataatctcttctgtattgatggtaatttctaagtctgtgtatgtatacttctctctttacttgattaggcaagcttggggttacctactttgtttcacttggttttccaaacaagctctagggtttacttactaattctgctatttccctattttttaagaaaccaatttctgtgttttaatttgattatttccttacttgtgcttttctcaaaattatttggtcttctttttgctaactttttgatagagatgcttgtgcatttgttttcattcattcttgtttcctaatggcagcttctagctgttttacatggcttttaatgcatagtatcatgactattacaactattgttattttttattattatggttacatgtactaaaatactcacttttattacctttgcagtgaaaattatttgaaggaatttaaaatttttttgaaataatagttttaattatttttgtttccaaactaatttcaagttgtttttgccttgcagttaaagagaagagtttgaactattcccaattatggtgtttattgggattacgtttctattagattaattacatttctattaaatcaaccttattaattatgttactcggatcctctatagctttcctacttttgtttccctgtattttattagtcctggtctaattgctgaactctcctcccaccatggggtttctgtcagtttcttctctatttcctagagattacactttaggttgttgaagctcaataactcagtgcatgaagattcatgagactatattctgaaaacacctatcatttatacattttatacatttgtttcccttgaatttcatgcagagttggaaccaggtctagaaggacctgagatttttgctattttgtgaactcttcttaggaaatgtttaaaagtacttaatttttttttattgttctttaaacctaagtaatgttttgtttgtttttaattgaagtatagttgaaatacaatgttaatttctgctgtacagcaaaatggattcagttatatacatatatacattctttcttatatatattctttgatgtactcaattttgagtaaaagtttaattacagattcttagaagagtcctatgaagtgaggggccctgaaatttcagcttaatgtcatgcgggtattctgaatctctttttttgttttctaatttatttcccccattcttccttctttacctcttcatttattagcttggtgtgaaagtaattacagcttcagacctggtaattatttaccaatgagaaataagtttgtttattcctgcagcataaaaatccatgcttcaggattcagtgaactcttggaaagcattttctgtgttctcctggttgtggaagcattttcccttcaaaatgttgtcaagatgcttgaagaagtgatagtctgttggtgagaggtcaggtgaatatggccgatgaagcaagactttgtcgcccaattcattcaacttttcaagtgttgcttgtgccaagtgcagttgggcattgtcacaggaaagaattgagccctttctgttgaccaaagccagctgtgggcactgctgctttcggtgcatctcatccatttgctgagcatgcttctcagaatgcagtggcttcactgggactcagaaagcttcagtggatcagactggcagcagaccaccaaacagtgaccatgactctttttttgattcaactttggctctgggaagtgttttcaagcttccccttggtccaaccactgagctggtcactgctggttgtagtataaaacccacttttcatcccatgtcacaattcaaaccacaatcaagaaacagcttgtggttatttcatagaataagagaaaatgatgctttaaaatggtgatttttttgatttgtggttggctcacaaggtacccacttatcgagctttttcacctttttaatttgcttcaaatgccaagtgactgttgaatggttgatgctgattttttgggcaacttctcatgtagttgta

SEQ ID NO: 36447 - DNA, 1007 bp, Bovine  19866880410520
cttttctcccctctcagctccattatttccaagtagaatatggttttggttaaaataaagacaacacacaccacctccaatagttcattcaagctgtattagcagtgtggcccatctcttctggctgtgcctattagggttcatactgaggaggtttgaaaagaaaatttcctcaatgagagataattttctaccttataactccccctacatggtgactcttgtgagcatccagccataatttttttttcaattttttttcctaaaattagaattggaaatatgagttttccaatctatttattgatttttttagtcccaaatgatgctgcctccgtgtgaaagcacggagttagagcatggaagcactaagtgaataattagtcctggtaaaacaaacacaggtcactatgaaaaactctgtgattttaaaactgtagaaagaagaaatgcataccaatcttctatcccacctctttccctgcatctgtctcctgctgctgttaacttgttcttaatcaaactgatagggactccagaccagaatgagagctaccagaatactgctgtaacccaggtccttggcaaacatcacaaacacacgtgtgcacgtgccctgaaacactcaaagagaagggtaccccctctgctaaatccatagaatagacggagagagcaggaaggcaaagacctgaagtagaggccctgcttgggaggagagggaagcacacggagcatgaggctgccttctcccagctgagcatggcctgggagcagacagctgtccaggccacttcctttgcttcctgaacccaccatactcttccatcacttcactcccatctgcagcggggactgcaacctgccatgaacacacaacactcttggagactctctggaaagtcatagacatgatctgaagacacatggtacatgccatcaaaagtctgcctgctacttcagttgtcccgtaatcaaggcacaagaaagcaccttcggcccaagaa

SEQ ID NO: 36448 - DNA, 2268 bp, Bovine  19866880434845
gtatacactcactcatacacacatacatggcattacagcagagacacatatattttgaccttctccatttctcacaaatcacaaataacagcagagtggagatgctatacacttaacttctcctttggaccctgttctcttcaaggcacagcaaatccactagaaaattaaagtcctgtatgttctgccttaaggcccaccacaaatctctgggtaagtgtcagtctagtaggggatgagggttatgctcaatgtttggttctccgatatcttctctgccacactgctgctgctgctaagtcacttcagtcttgtccgactctgtgcgaccccatagatggcagcccaccaggctcccccctgccacactgacatacactgtatatggtgctggtaaagaaaccatattttcatacaaatactcattttattaattaaggtcaatgtaatgggcatattttttactgagacaaccgctataactgtgtcaataaagcttctctctatttccaaccagatgtatattaatccttgtttcttgtctcctggggtgtaaaacaaactatttttcaatacagatgaggtgatatgccaaaagatagaacaggggttatcaaactatgacccataggtcacaatcctgcccggtctctgtttctataaataaagttttattgcaacatagccacattcattcatttacatatcatccatgacctctttggagctacaatgggagagttgagcagttgtgacagacagtatggtccagagaactgaattagaaatgacacagaatatgtactatttctccttttagaaaaaaatatgccaacccctgagattgaatcctaggtctctaaaaactacaattagagtttctatttctcttgcctattctccaccccagagtaaggcatcaattggctgcctttgcaatcagtaactcctatcttcctaaaagtacattaagagatagaaaatgcttccatcaaccactgttacttcttctctaaccaaataaggaaaagtaaaggattttaaaagttcttattttggcaaaagaagttgatttgatcttcaattgggaaaaaaaataattgataacttaattccagtccttgcacccacatttgtgatgattttgcccgctttatacagtaagtccctgacattcaaatacgttcccttctaaaagcaagtttttaacaccaacttgttcataagtcaaacaaagttggcctaggtacccaactgattagctatgtagcattgtactataataggtttataatacttttcacacaaatacacaaaaaataaacacaaaaaataaaacatttttaacctcacagtacagtaccttgaaaaatacagtaggacagtaccacagctggcatacaggggctggcaccaggtgagcagcaagaagggtcactgactggagagggagaagaggtgggagatggtagagctgaaggatcaccgcaggctgcaatttcactcattcctgacatagacggaatgcacattggcatctttgaaagttcacaagttgaagattcgtatgtaggggacttactataccatgcactggaatgtgtatatcatgaaagtgaaagtgaaagtgaagtcgctcagttgtgtcctcgtctgcggccccatggactgtagtctaccaggcttctccgtccatggaatttcccaggcaagagtactggaatgggttgctatttccctctccaggagatcttccagacccagggattgaacctgggtatcccgcattgtaggcagattgtttaccgtctgagccaccagggaagtcatgtcatagatacacatatacacaagtgtcacatgtgatactattgtctcctctaccccctcctaaaacaaatcaatcatatacaagctctcctcaggtatgtcttggttatctttcagcttcaacgataatcttcataatttgtaccacttgagatgtaccttgaaccccacacctaatgtgtaagttgaaagaacttagccatctcctctctgagctatttaaattctgttgaaagacattaggtgagaaaggttcatgctaaaataatgcagacaaatggtggctaatacaagtgaaatgataaatgaacatttgaattctgtctccagtggagatgcggagtgctgatgagctccatgtgtggtgctgaggtctcctatttgtcataattatagaatagattttaggtcatttacctagaaagagtgtctagagtt

SEQ ID NO: 36449 - DNA, 2126 bp, Bovine  19866880592270
tggtaaagaatctgcctgtcaatgcaggagatgcaggagacaagggttctgtccctgggccaggaagatcccctggaggagggcatggcaacccccttgagtatacttgcctggaaaattccaaggacagaggagactggtgagccacagtccagggagtcgcaaagagtcagacgtgacttagcacactttcaaatagatacaaaaatagaaatgttaaaaattagataaaaataaataccaagaagaagtgtgctattttcacactgcatgctataagagaagttcacagcctccttgaggaggctcttcccccataacctgctactagaaagatgttagaagcactgagtctccaactacattgtaagcttcttggggtgatgagacttcatcttatcttgatttttctctgcatctccatgaaaaataatacagatgcttgtgtctcattggcactcagttttgctaagaagagatttcacgtatagactcgctttgcactgatggacaagaggatgaattgtgaagaaaagatccttaagcatttagttgggctgagttttcaggcagaagacatacgtagatgcctgaggctgggtgagtgaatggtttcattttcaaagcacggctgtgtctgctgcctttctatgggtacaatttgctttctccagaaaactttaaaccacacttctttcttaatgggctttaacttcaaaatccggggaattatatttcagaaaatagcatctgtcagtctagtagataaagaaagtcattaaatctgccatagtctttttactctcttggtctctcaaaaagcagggaagggattatatagtaaagatgcttcacattgacaataattcataagctctttcttcaccaggaaataattttttggcttctagattatttttagtcatataaataatttctcattttattaagatagacatttattttagtcatctgtgacaaactatgagatgtctgcttcatcagcccataaaaacaggcttctttgttcattcctagaggcgacaaagctagatcaatgtctttaaaagaataaagcttaaaaaaattaaaatcacacccgaacttaataggccttgttcttacactgggggatttgttcacacaccaattcataaatttaagcaccaactgtgtgtcaggttctgagctacttcccaattaaccattaacctttgaacataagggtatgaacaatctcgctctaaaggaaaaattcatccaaatgagaaaaaggaagatgcgtgcaacgcacggaagttctgccattgcctttcctctctgtgtgccagatgtgcctccttttatctttttcttctttgttggagtcaaattgcttcacaatgctgtgttagtttctgctgtacaacatgaatcagctatgtgtgcacgtgtatctcctcccactggcacccctccatccccgccatcccacctctctaggtcatcacgagcgccaagctgagctgcctgtgctatgcagcaactcccaactagttacctattttagacatgtcatgcacagcattaaactgtttctgcctctttgctatccctagaactatagcccgccaggttcctctgtccatgggattctctaggcaagaatactagagtaggttgtcatttcctccttcagattttatacatggtagtatgtatatgccaatgctactctctcagttcctcccatcctctccttttccaactgtgtccactctctacatccgtatctctattcctgccctgcaaataggttcatctgtaccattttcctggatgtttaacagcagaagaagcttctcaggcacaggctcttctcagctcatgtcttcttgccaggaatacagtggaagactagagaatcagatggttagaacagtaaaccagaaaaggtcataaagtggccatgaatctatttttcacgctctgtacaatgcagtcttcacctgtagagtgaagcttctggaagggtttcctctccaggatcagttggcaaaagacagccctttaggcaatagcttccagtctccacttgttttccgcatatttcagcaattgtttcttatctccataagggtcatttt

SEQ ID NO: 36450 - DNA, 2061 bp, Bovine  19866880611648
ccacacctgctctgatttctagaagttctttatgaactaggagactggacatttgttgtgatgtgagttgcgaacatactttccaatgacatttatctgttgacattgtttagtatattttctttccgcagtcaatgtaatcaattatttctgtgctgatttctgctatatgacggtttaaaaagactcctacattctgaaaagaatttgtctatgtttacatctgataacattatgctttcatttttgtgtttaaattgttgaactttctattgcagaataagatacatatgtgaatgtatataaactatcattataaagctgactgaattttaaaaatggaacatacctatgtgatcagcactcagatgaagaatcagcatgttaacaggatggctgaagcccccaagacctctctcagtcacaagcacccacctctcaaggttaaacaccatcttgactttagagaaaacaatcttgagatgcctcacagaattccccttgcttcacactctgagtgcccagaaaattattcagccctggataatagtttattgagcagaaccacttacaataatcagaataattacccatattgccaatagaaatggctttgtacacacagaggagagggtatggcaggcatttatcgatgaatcaaacattgatataaaacatctggggacactgtagaagataaaaattacataaacttaaagattaaaataaaatcctgaagaggctgcctttcccatccccacaaaataatttttattcttattgaatgtgccattcctttaatgaatgacaagatttttactactttcattgttgtttaaaatgaaccaaaattattaataatgtatctttccttcctttaatgtccatctaacttgcacggcaaactccagaatttagggaggcttactgataataccttgaagaaaagcatggtttatatgctcaaagaaaggcaagaaaaccaattttgatgaggctggaagttagtcattttttactgtgtaaagtcagaggaatcaaacatttagggattcacagataaataaaaggaattggaagggagtataagataaggtcagagaagtgggctggtgagcaactcctgagaaagtggcatgtttttatcataaaaggggcaaaataaaatgtgggagacaaaaagaatatggttaaattgtgtttcacaattattgacatattgaacagatgacttctctgagtggatcaaaaatgttaaagcttatagcctgtagatggagataataaggaattttgtagctcaaaactagaggaacagcagttttgagcaaatttcaacaacttaagaaaaatctaccttcttcattgcattgacagttctattccaaggttacctgtaaccttccaattactaaatttgattcttttcaattctcatcttacttgacctctctctagttcttgatgctattgatcactgtctctttcttggaatttgtccatccattcagttcagttcagtcgctcagttgtgtccgactctttgagaccccatgagctgcagcacaccaggcctccctgtccatcaccatctcccggagttcactcaaactcacgtccatcgagttggttggtgatgccatccagccatctcatcctctgtcatccccttctcctcctgccttcaatctttcccagtccatcctttggcttttgtgaaattactttctccttttgttatcacttctgctcaatccctgttagcaagaatttgtgtccaaagattactcagaagtgacccagggaaaagaagtaacaggggagggtcgagtaaggagggaaagataataaaaggaaatgtgacttcgtttgctgctatgggatcctagagggcttccctggtggctctttgggaaagaatccacctgccaatgcaggagaggcaagttcaatccctggtctgggaagatcccctggagaaggaaatggctacccactccagtattcttgcctgggaaacaccatggacagaggtgtgtgggagggctacagtccatgggg

SEQ ID NO: 36451 - DNA, 1648 bp, Bovine  19866880710890
catcagggtcttttccaatgagtcagttcttcacatcaggtggccaaagcattggagcttccgcttcagcatcagtccttccaatgaatattcaagactgatttcctgtaggattgactggtttgatctccttgaagtccaagggactctcaagagtcttctccaataccacagttcaaaagcatcaattcttcggtgctcaacttatattaaaaaataaataaaatcaagaactctaggactagggggagggaagggaggctgaaggctcaattatatatgtataattatggctgattcacattgttgtatggcagaagccaacacaccattgaaaagcaattttcctccaattaaaaaatcaattattacaaaaagaaccctaggatcagtttgcctgagtccaagccactgacaactccaagttcaccaacaacattacctaagtaagttatgccacttttccaaactacagttaccgtctaatccagagaggttatgttaatatttataacatagagttctgcagtaacacagttcctggcatacgctatgtgctcagtgaatgaccatcagtaatattccctgatgataaaataagcaaaccatggagagaaattaaaatcagattggaaggtatggaaggtgtctcaaagaaggtggcataaggcaaatactgaaaactatgtggaaacggataactggaagaggctgtatgggaaagtgtatgaaagagttcactcagggtggaggaacatgtacccaagtactgctgggagatgggggaagatcagagaaagctttatgtactagaagattctgactgtacattaagatgatttggaagggcaactgaccagtatgtagatcaatgttttttcaaagtggtagctctgaacctggactgatgtagcctatcctgattgacatattcttgaataaaatagaataaaaggaaaggaatagactatattgtttctgcatataaattaaaagtatgtgtgtgtaccagttggtggttcattgaaatgcaaaatgtatctattaatatagaccaatcatagtgactggaaaaaagaatggactggagagagacagtgcttaccatatcagaatctgaataagtggttagattttgggctttttaattacataagaggaaatgttttgctttgatttcttttgcagtccagcaccagctttaaagtggtgaaatttgcaattctctgaatcaatcaatatgcctaagaaatgaaactttatccgtacatgaacgtgcttttcccctttggtgtgtgtgaaagcactgtgctccagacctaaaatattaagacaatatgacctaggaaggctgaaccttggatcctagacttgttccatcctgccagctgtacaagttgggcaccctctctggacttcagggagaatacgaaacagtgtgatctaacaggtcccttccaactctcaacaggtgcttctcctaggccagtttgttcatgaacgcaaatatgctgtgtgagaattcagattagaacttggggtatttgtgttgctaacccctggcatcatcaagttaggcagccattcctgtccagcatgcagacaaatataaatgttttgataaagtgcccaacatgggttctcagtg

SEQ ID NO: 36452 - DNA, 998 bp, Bovine  19866880756684
cactgtgtttgccggtgatgagcccgcctctggaagcatagcccatcagaggagcaggcagattttctgcagtttcaaacaggctttcccctccctggcatcaccaccaagacgatgtgtcataagtgtcagcaaagatgttggtactccgccaggaaaagcagaagatagtttgtattaaaacctattatcgtcactgtggctcacaggctgctgcacaatgcccatggaaaagtcaggtatactttgtcagaagaaagtgttttctaaataagtattctctccattaaaaatcattctaaaaaccaggaaaattaaataggctttgttaagtgaaaacgtgaaatgttattaagagtaagatgatattagagcaggcacttttacctttagccttgccctgaaataaattaatgtgccaagtgagccatggaaacaaggagctttggaaaattcactttttgaaaaactccagattaatcaagagaatttcagaacaatgctcctctaacaaatgagatgggatttgttgttgttgatgttactattgttttatttccattccaccatgggctgatattttagtaaaatgttatataaatgaattatttaaaaaataaaataaaaagcaaagctcaaacatgcaaaccctatttagttatagtactagattaaacagatattaaattattttgccaaccaaaatttccagctcttcactctcaatctctgcatctatctctttgtgtattggtgacaaataatacacatggttggaaaaatatgatggctaggatttaagaatagatgacctcagtccaatcagctgaatatcattgtttcaaggaaacatagtttgacgcccactattaaagtacaacactaaatgtatcatgcgtacataaacaattccaaaaataattccccttaaaatactcttagttttataatggtctttggtattgtattggttttatggctttgtttttaagttgttt

SEQ ID NO: 36453 - DNA, 1462 bp, Bovine  19866880881720
tttggaatgtacatctgtatttgcagagctcagacagagccagcacgctatacttccacaggtggggagcatccccaagggcccaggagagagctctcctcttcaagagaagaagtgagatgcttagggttcagggaagacctttcctagacctattttaattctttaaatcagaggatggcgggtgaataaggttttccacagataagctaaatgtgatggaattagtctctctaagtgtcaggggaaagaaagaggctttgcctagaaaacaaccttctaccactatctctcttgacagggaaaaatgaaagactgaaataactaacatgcataaatatacataaaaataaaatgtctcccaggtttgaatactgccttactgtaatctcctatattctgcctcctaaaaaaataaaattgctttaagaaaacatcacttcctaaatataagagaggtgaaaagatctagtgtaggaaatccctccatcccctcaaaattattaagccattaaaaaaaaacaaaagaaaaaaagacaaaacaacaataaaaaaaaggaccagagagaaaatctgggagtgttagacttattttagtaactgtatctgggctgtcttagctcttcctctgccattagtctatagaataaccaatgactcaagaactttcttattcaggattttctctttaaaatgcttttggcatagtgcttcaattcaggaaatgatctcatttggcaagttttggagcatttaaaattctgtacatctttctcatattttataaaacttagcaaattttggtgtgcatacctgaaagcaagaggttacccactggagttgtagatgatttatttttcagtaagacaaatatgatgtggttcagggaagtttctgacctattactgtagaataaagtttatgtcagcatttctcatttatatgtgtatgtatataaagataaaagtgtaaataatggatatgtatctgaagcctgctgctgctgctgcttaagtcacgtcactcgtgtccgactctgtgcgacgccatagacagcagcccaacaggctcctctgtccctgggattctccaggcaagaatactggaatgggttgccatttccttttccaatgcaggaaagtgaaaagtgaaagtgaagtcactccgtcatgtccgactcttcgcgaccccatgaactgtagcctaccaggctcctccgtccatgggattctccaggcaagagtactggagtggggtgccattgccttctccgatctgaagcctgtacttctaaagatattcaggatatgattgaggggaaacccaagtcccagtaggtatcttttctagtgatgcttgggtgtaggttaagaggatataacttctgctcttttggttactgaggttaagaggatataatttctgctactcctgtaagtagcaaagattcttcatggtatag

SEQ ID NO: 36454 - DNA, 1726 bp, Bovine  19866881068969
tgaaagtgaagtcgctcagtagtgtctgactcttagcaaccccatggactgcagcctaccaggctcctctatccatgggattttctaggcaaaagtactggagtggggtgccatatatagtaagaagtaattaacacatggtagttatcgatgctgagtgatgaaaacatgctcctttagataaatctaggtctgaggaagagtgttcaaaggaacatagcctactgcatgcttgctgggaagtgggttgctgtcagtttaagaggctcacaagttctaaaagccctcagtgacaatggtagagctctggtctggagtaccctcatgatttcagtaaaggtagtcaaagaaaatagtcaggctttaacatctcatggagctggattcaacctctaaatattacttagctttatgtgacttctgtaagatgctaaaaaactcccagatctttaatttcctcatttgaaaaatgagttctgggaccctgggtgtttattcagggtttctacacttcccacctttcctaatactaatatcctagcttctacagtagttcctatgcttgacaacttgattggctttcaactggcagtctgaactccttgaaaaaaaaaagtgccacaaagatctactgaatatctctcctctctctctctctctctctctctctcagccaaatgacatagctgtgtggcccttctgacacgtctttttggtgtggttcataagcgagaagattggtgctaatgctgatataactgaagccccatggaaatattaattaccgaactccattagatctccacccaacctgagctactttctagtaagtgagtctccagagccattttctgttaatttatgacttaatcaaatgatccttcttctttaacccttatcatctccaatcccattccaaacctactgcttatggctcctatgacagaggcttacaacacaacttccctaacaagtatgaaagtcacgagagacatgggatagatctaaggtcctgcagcagcccatgatatgcctgctaacatttccttacatcactatttgagtacactgacccagacctgagggagaactaggctggtgatggatattcctcaaaaacttccatccccctctagtatgtctcctacagcataaaattatctggcttcagagttctggttttgttattttctgcttgtgtacaaggactcaaaaaaaaaaaaatagattcagaatcagatttagtcatatttggaaaagttagataagtacgatgatattacacaattatttacctttatcacagggctttgattctgataaatgtaaagttttatgaatattaaagacacaactgaagttctaatgggttagattatgcagcaaattctataagtgcagtgttaagaggaagcaataaatctaggcttaattgtcattatctctttagaagaactttcaagttgaacctctttgcccaggctcttgattccatgctcttaactgtccacgttttgcttttctcaataattatattaaattagataaattagagtctaacgaaaacaaattttgcctaatatctcagtccatttgtgtctctaaaaacctctaagctatttctccaggcagtagggtagctaattatttaccctcccagcagccttcaaggcacttccgatcctatgtgggaacacagaaggatcccattcaattaggagaaaaa

SEQ ID NO: 36455 - DNA, 986 bp, Bovine  19866881142080
tcctgttgtgtctaatatctcctgtttaatgtgtccaagatgataggctttttgtttgtttgtttgagcaatttgactatgcatattgtctccttgacttaatacaatactgtttggggaggctgattcctaaatacatgataggaatacaattaccctgatgagatctggtttaaatgatcagaaaactttctaaatgtgtttacatactggtttgtataaaatagtcattaacgcaagatttaaggattgcgcagaaaggttgtatggcttcttaaataggttttcttatttttctttttacatgtgtaatagcagaatgttctctattaactgtgcattatgtctagactactaatgctctgtcagggaaggtaaagaaagggaaagcgagagaaatctgatatttaggagaattacttcaaggcagaaaaagattggacattttttgtttgtttgtttttgaaaaaatcagatttttgctaaatatcaatactaaacataatctcattattttagcaaaatttatttagcatgaagctctccattttaggggctcccaggtggcgctaggggtaaagaacctgcttgccaaagcaggagatgttagagatgcaggttcaatccctgggttggaaagatcccctggaggagggcatgacaacccactccagtattcttgcctggagaattccatgggcagaggagccaggcaggctacagtccatggggttgcaaagagttggacgcaaccgaagcaacttagcacagacacgtgcactgcatatgaaatgagtcttagcatagatgtttcatgtgtatcatagattacttgaggaataataatcagtgaggactaagggaacatagatggttcatcagcacatagaatcattttttcatgtaagtattcattcattcaagagagcatttactggggacttccctggtggtcccatggctgaaactcagtgttcccaatgtaa

SEQ ID NO: 36456 - DNA, 939 bp, Bovine  19866881183732
gatgccaatattacattcataagagcaatgcttccctgtgtcagaagtcactgtgatactttctggcctgtctggtgcacttcttatgaaggttatatttattctgcctgttgaggtgaaagatgtaataataaaactgtcatgggtaggaaactgtcctaagactgcgttataaaatgctgcggaatgaagtgggctcttgtcctttcttcaatcatgaccagcaccggaggttaccaagctgaagtcttagcaaagcacttgtaggcatctccaggctagctgcacctgctcagctaaatattctttgcaaaggaaagagagatcaaatttgaaactagagacaggcatatacattgggagctgtaattaataataatatgagtaatgacagcaatgttcatgatgatgataaggcccgcaattattcccaccattaacacagcagtttatccatgcccggcactgtgctgatgggttagagtatctgacttaattcgtacctttagggctggatattattaaaattatttcaataatgaggaaaccaagaaaataaataatagtagtggattgaaagccatacataaaattaatatcaggagtccagtggatataaataagtatttgaataaatacatacatatataggggagagagaaagttcttccttaaagaagaattccaaatgtagaaggaataatggaataaaaaattataagtagaactccatgttaatgattgctaggggcatgatttaatgatggatgataaaattagtgggcaaaagtttgaggagaaacatgatatttgctagtctcaaagtatatcctcaattatttattaactgcaaatgggaaaatagaaaatttacagtgggagaaactcaataagcaccacttttaccaagtgatagtagaaatataaccagtaatgaag

SEQ ID NO: 36457 - DNA, 802 bp, Bovine  19866881238384
ctgagatgttactatgctttttctcatgtgcttggttaaatggcaaagaataatgactcattctaagacctctattgatatagtatacataaaagaaagttagcatattaaaaatataccatttaatcaattttaagatatatatacaaaaaaaaccacaaaattgagatcatcattatagttacaatggagaacatatctatcactcttgaaagtttcattgtacttctttgtatactccatttgaccatagtaaataattttaatatacatctgtcagtaacaacaaataaatgtaaaaaaaaccttgtgctatatctgagtaacatgaataatgcaattgatatataaatcagtctatcttgaaactgtagaatacatatatttcaaacacacataaaacagttataaaaattaagaatatgctgagccacaaagcaagtttcaaaaaatttcaaaaagctgaaattcctttgagatattcctttataaaattagaatgaaggctttatgtcttctctaccacaaaagcatagacttaaatattcaggtctaggccatcagagataatcacacgctccagaaaatatgcagcaatcagttctcagtactattctaaatttgctttttctcctaatctgtaacctctgaaggttgtcttattttacatagatcatgcattctacccaggactctttaggtgtcctgtatcaagatgcttttcttcagtcatctcagtcactgtgttactagaattgaaaatccagttttgttactttaaaagtcatagctgtcaaaacta

SEQ ID NO: 36458 - DNA, 746 bp, Bovine  19866881259839
attttatttcttgccctggcgagtgggcatattaggtattcattttcaatgtgctgtatagcacagacatatatgatagtagtaataataaatagaaagcaatgggaaatgcatttttaatatattctactgcaaaatacagctgcaggtagaaaggggaagaaaagatcccccaaattaatataagggaaaaaaggagttaagatctttaataaggcatttcaggtcaacaaaagcacagacgaatgaagacagtagaaccacttaagcaactgacatcttggagagagtgtttcatatttctgagcagagttatgatgtttagatataaagatagcttagcgacagcaagaaacatacgagtgttgaaagaaaattggagataatctgagcacaggcaatagctgaaaacatgtgagcagtgagttcactgagggacaggaggaaaaaaaaaagcaaagggccttgaaacgccacagagttagtgagcctggtagaaaggagtgagcaaaggaaaagtatgtttatttgttggcaaaggctccagagacaagtcagctttttattgagttcgaacataagggagaagtacccaagaatgtaagcctttcatcacatttgtttcatctgtcactgtatttactttcccttgagaatttaaatggagatagatctgagtgaatttgaaatttgctattttataatgttaagtccaaaacttctaaatagttttaaaaatcatcagg

SEQ ID NO: 36459 - DNA, 719 bp, Bovine  19866881324354
attctcatactagaatctttctcaccacttggactcctgaccttgacttcagttggcgcacccttattttaaacttaaaaatattaattaatgcttttcctactcccatgttgattaaagcagaaaaaaaaatagatttttttcctttatatgcaccactgtcctcctttgttttacatttgacctgcgaagcctgccaggataaaccccatctttctcttcttccttcatcttcaatggcatttcccaagggcgtttttaaagtgcagatgaaaaagtaacactgccctctgtgaaagaagaggaaagaaatgccaagtgattaagaactgttttacctttttttccatgatctgtgtctgaaacaatagcaccagttatgtttcggttataaatagaactaagcaaactcagcaacacctataactttccagccctaaatttctgtccctgcaaagcagaagtacagtacagaccttacagacaaaacaggaggctaacacacctgagggagtgtggtgtgggatgggcaagaagaactttgcaggcggataaaaattggcttggtttccacatcaagcatttgagaattatgtcaccttgggacttgtttgttttgagcttctctcagtccgtttcttcattcattccagaaatggctactgtattagatatattggaagggtatcagtctgtaagtttacagactgagagtagag

SEQ ID NO: 36460 - DNA, 1074 bp, Bovine  19866881423058
acaaactgatggcacaatgggatggattgtggaagctaacagttcaacctaccacagttaggaaatggcacaaaagccaggtggacagggaagtcagtgtttccatatacaagtaagtacagacagctttgattttcctcaaaaacaactatcactcattatttctaacatttcctagtgaaaaataaatacttaaaatagacaatttgaattacaaaataaattatcaatttctacttataaaacactttttaattatgaatgtagacaaaactgaataagttggcaagagttgcttgttggtgattcctaaacactagtaagcataattccaagtaaatttttatttcattctgaactgatcgtattccacccaaaccttgattctttcaagatactgcaaagctgacatggcctatgagagaaaaaacaaaaaaaaaagcctctatgtttaactccagtaatttaatagtcttcctttccttacttgcagatttgtctgttaattggaaatagtattcccagctgcactgagaatgttttctgaacaaagggaggaggacatcttaaagattgcagtggaagttaaggcaaaccataatttacatttcagaatataaatgccccagggaagccttctttccctgctgcctagaactttgattggcatttcaataggatgccaccaaatgggaggttggtcccaggaaacccatcctcagggtttccaatgactgtaattccaggcatctgatctgagaaaaataatgcctaggagatcaggacatttaaaaatttaaggcatccatgaaagccaatgagaaccagaaaacgaacccaaggaggagagcaaggacatgggtcctgagggtttgcagatgcttcactctggagatcagatgtatttctaattcaagttatttcagcttgtgtggtcatcaataaaacggcacagagaagatatatgtcccacctctacctcaaaactcattctctccagaaataatgattttccatagtctcttttagattttaagcattataaaaactgcaccttgtggtatatatacaatt

SEQ ID NO: 36461 - DNA, 1307 bp, Bovine  19866881665177
aaggggaatcctagtctctagagggcagggcaacccagagccagggggagtggggccattccagccaggcagagcacagagcatcaagtcacacagaactattcttaggtcttggaatctagtggaattttgccctgctgaattgcaggcttgctttagacctgggatgcctttttcccttggagtttctcccttttagagtgggattatctatcctatgtatgcatgcctaccactgtatcctggaagcagacatcttgttttctgaatgccacatgaagcaggcagaaatgcatctatcagtcaaggaacaccaagaattaggagacactgtcagatgacaggagacaggcatggagcagcatctttctgaaatccctcagaaaaaaagcaactctactgaccctttgacttttttaaatctagcttccagaatgttgagacaacccacttctgttgtttcaaagcacatagtttgcaaaactttttaacggcagccctaagaaatgcccacattcagtctacttatacgagttagcaagaatataaactacagttctatttcaatagattttagaacttatccttagatacagttgaaagtcagaatgctcatatttttttctccatagacaatttcttgtaaagaaaaatgaaaatgtgacaaaagatacactgttgtcttcttcaaaagagtaatcatcaaggatatattttttgctcctaattcacaataaaattagaatgactataagcattaattcaaatgtcacagaactaatatacgtattatatatatatatatatatatatatatttcaaaagaaaaaggtcaagtaagattaatggatatacaatagaaataaaacagtttatagaccaaaattttataaaatagaaaaaatttataaaatagcataaagattgtccttgttttgtactgaatgtgttttcattattataatatttctctgattcaaattcacaggatggtaacacttaggaggggttcagctacataggtaatgatcaaaatgctgtgaagaaagatttttagaacatgctttcatactgtttcactagtaaatataaaaatcattttccaattgttatgataatattgtgtgtgttcttccccttagcttctttcccctgctgtctctcttaacacttaggaataattttcacaaggttacccattctaagtgtgccaataaatgtaattatatttatttcagaaggcagagttaaatttatagaagtaaaaacaacaccattttttatttataaccacagtaaattttaat

SEQ ID NO: 36462 - DNA, 1146 bp, Bovine  19866881877132
catgtgttgggcatgttaatacacactaacacatgttaacactttctgtcaaaacagggaagatgcctgctgtaggattggaaataaggatcagtgacatttagatccctgagtagaagtggtgataagatgctggggaggctggaggtaagagaatattatcaagagttcagagttgcaaaggaacaagaacaggatctctagtgaatggaagccaaggagggaatcacagtaacacagccattgttttggaagaagaagtccctccctccttaaggaactataaaagtacagttgggatatccttactggggctccatggctgagtacatccaaaggattggatacactaggataatctgggaaacggacagaccccctgcttcttccaacccactgtgtgcctgcgatggactcattggtaacccatgacatcatgggaaatacatggttcaacagagcacgactaattctcaagctgccaattatctgataggagaaatctgaaagagcagaatggctgatttcagagaacattttgttccagaaccccaaagccattaatgatttgccctgctttttgctgttcctttatgtaaatgtaaatcccttaagagaagaagaatgtctattccttaatgtgtacctaaatataattttatggaagtagctcttatgggattcggagcaattcaaatactctctaattcactcactggctttgggctataaggtacttaacttctctgttcatttgttttctcacctgtaaatttaaaccaaaggtgggaggtttaaggaggtgtcccatatgataagccacatgtaccacttgctgaacagaaagataaagctcttcctcccatcccaccttccatttcctctaagtttctcaaaatgtcctcatcataaagactagaataaaggtccttgtagcctctttgtttatacatttctgatcaaagaaaaatgctccaaaaactgaaatgcctcatgaatgccatggtgcctcatcagagaatgtagtggctgcatttgagccaacagatagttactgggcatcttctctgggtcagctggtacactagagactgcggagatgaaagcagccatgaaatagaatatctgttttaaaaaattcacaat

SEQ ID NO: 36463 - DNA, 1206 bp, Bovine  19866880560693
catctgtggcatttttcatttcacattttttttctccctctcctctggaattcctttcaatttatctaggtagtttgaggacctatgagcacaaaatggtatgctttattccaggtgcaagcctatcattcatatggaaaatactatcacatcacatctctctattctattcaatataacataagtgatacaatctctctcagtactgagtccaatagaatcctgcatgattttgtgactgagctatattgaagatttctatcaaatttgacatggtaatttatggcctcaaatatctctgcttcttcaaaagaactaatttacatatttgaagctggatgacatgttttttcctataccatgcatgttgtatcatttgcggtggcggggcggcggttactgataatagtacacaaccttctccatattctgatttgggttggctgttggtgggagcctgtttcatattctttatagcttgtagactgctctcaaggtggaaacatgcccattatatgccagatggttctggattgaaatgatggagctctaaggctagggtttcagttggttaagagtaaagaaatgtattatgaattttgttttggaaggccctgtgaggcaaatccattagggcttaatagctggttgattggttaatgtatttaaactttttaatattggtaaagggtttcattttcaaatggtttctctctttttaattttttgctccttctgccactttgctacctaaaaatctttcctttgaaaaactccaatatgatcctagataaactaggaggaaaaggactgattcatgagtagagaataggctctctcagtggagagcctattagcacaaggtgtccttcacttgcacttacatatatttaaagaatagtagtgcctgtatcagagaaggcaatggcaccccactccagtactcttgcctggaaaatcccatgaatggaggagcctggtaggctgcagtccatgaggtcgctaagagttggacacgactgagtgacttcactttcactttttactttcatgcattggagaaggaaatggcaacccactccagtgttcttgcctggagaatcccagggacgggggagcctggtgggctgccatctatggggtcgcacagagtcagacacgactgaagcgacttagcagcagcagcagcagcagtgcctatatgtg

SEQ ID NO: 36464 - DNA, 4940 bp, Bovine  19866880596669
taagattgctgttgttattgagacactccagtcatgtttgaccctttatgaacccatggtctgtgtcatgccaggcttccctgtccttcaccgtctcccagagctcactcaaaactcatgtccatcaagtaggtgattccatgcaaccatctcttcctcggtcatccccttctcctcctgccttcaatcttgctcagtgtcaggaccttttctaatgcatgatgggctcttcacatcaggtggtcagagtattggagcttcagtttcagtatcagtccttccaatgaatattcagaatttatttcctttaggattgactgatttgatcttcttgcagtccaagggactctccagagttttctccagcaccacagtttgaaagcatcagttcttcaccactcagccttctttatagtccaactctcacaaccatacatgactactggaaaaactatagcttttactatatggacctttattggcaaagtaatgtctctgctttttaatatgctacctagatttgtcatagcttttcttccaaggagcaaggatcttataattttaaggctgcagtcaccatccacagtgattttggaactcaagaaaataaagtctgtcactgtttccatttgccatgaagtgatgggaccagatgccatgtcttctctgtgtgactgttaagttttaagccagctttttcactctcatttttcacattcatcaagaggctctttaattcctatttgttatcttccataagggtggtttcatctgcatatctgaggttattggtattccttccagcaatcttgattccagcttgtgcttcatccagcccggcatttcacatgatgtgctctgcataagttatataagcagggtgacaatatacagccttggcatactcctttctcagttttgaaccagtccattgttctatatctggttctaactgttgcttcttgacctgcctacatgtgtctcaggaggcaagttaggtggtctggtattcccatctttgtcaaataaatttaccaatatcctcaatagttacaaaattaaaagcaagtcaataacttactagctaaatgttttcaaccccgattaaaatgtttctgttaggaagcagatcttttcatttttatttcatgatttattattattccaaatattctaaaacatagtccattaggtggactatagttgcatagcaaggttacttttgctagaatatttaagtctcttttacatttatttttgttttctatattcataatgtcatttatggtaaagcatccaatgcaatactcagatttcacaaattagtgaaactatttttgtttttttaacaacattagtaatttcaggaaggttttaaaactgcctttattcatctaaattataatactttattttttaacctaatcagataaagaaaaaagaaagaaaagtatcctttagtccacttagtgtgcttaaaggattatatatttctcctctctacttattaaaaaagaaaataaaactattaacatagctaccaagttaataaccacattaaatgcaagcaaaaataatgtatttatataatgattcaccaggagtagaaaaacattgaaaaaatttttttttcattttattttttttatttcattttttaactttacaacattgtattggttttgccatatatcaacatgaatctgccacaggtatacacatgttccccatcctgaaccctcctccctcctccctccctgtagcatccctctgggtcatcccagtgcaccagccccaagtatccagtatcgtgcatcgaacctggattggccactcgtttcatatatgatattatacatgtttaagtgccattctcccaaatcattccaccctctccctctctcacagagtccaaaagactattctatacatgaaaatttatctacaatgttttaaagttttacctcttgatcccaatatttatcacactatattgaaccttaaatatgctttttcagaaataaacttatatgtgaaaaagttttcaggtgtcaaattttcccctgaactttcattctttgatttcctaggaaacaatggtatggttcaatctatagtaggtagtatagttctaagcatgcttttctaagcaagttgactgcctatgttaaaatctctgctacttcacaaactgcatgtacacattaactgtgtattcctgagctgctttctcttcttatatttaaaattgaataattgtataatctaagtcacaacatactgctaaaagccaatgaaatattttctattaagtgaatatcacagcgcctaagacaaagatcataataatttctaccttaaactcatgcatcatatacaaaaaactgataagcatgaagctacttagatcagcacccataatatctctttaaacactttactgtatatccttacatactttccttatacaaatatagattgacaaaaactgtcatgcaacacctttttatattgcaatgtattatgaataccttactatgcaaagattatttttagtgagtgggcattctgaatatttttaagtttatttttggacattttgaggttgtttcaatgaaaattaaaatacttctaattataatttttaaaaatttataatgataaacactattatctacctgttgacattagatgaatatatatttttaaaaactatggagcttacagaaaaaatattgtttttttaatttatattactaactaaaaggacttttgttatgttttcagagttttgtactacaaatcctgaactaaatgttgatgagagtagttaattcttgatcctttccaagtcctgatatttgagtaattacattaaagacaggcatcagcaatactaaataactcttattatactgaatgggagatgaatgattaaaagtctacatgaagcattaatttactacctaattgtcacataatactaattgactattctatttatttttcccctttgggtagagttattttgaatgaaataaaaattgcagtggaacagtttgcaaagatcatagatagaagcactataattcatcaaggggcctagttggacagccttgtcaaaataggttagtaaatttctcatgaccgtagccagtgttgcaacatttttaaagatagcaatccattatcacttctcttctgccacctgaaaaatatcatcccacagaatctgatttcctcctgggatgacatgacactgctcgtaagacaatgaaacctccttttcccaaaatatcaaacgacaatctgtaatccagagtcatgatattatgttcctcaagtctgttgtgtattactaaggaaataagaaacttaagtaactttgatttactatgtttggatttaattttgttttgattatatctgtaataaaaacaaaatctgatgcaattatgtcctaaaatgtataacaagtcctgtggaggaatatatgatatttatagcttttacatatatatggttttatagttctatataggaaaggtatagcgttagttttgctgctatgtctaaagccaatgaacttaaggcaactgaaagctaagataattatggggaagatacatttttgtaacagggaactggtgagtttcaattttgtaatagctgccaatgcaagatgaaagagatgtgggttaaatccctgtgtcagaaaaatcctctggagtagaaaatggcaacccactccaggatccttgcctggaacgtccatggacagaggagcctgttggccaaaacccatgtggcttcaaagagttggatacacaaatacacatgcatacatatgcacatatatactatatatatataatgtacacattttagaaaacacaattttttttggcttagctaaaaaatatatgacattctggttccacctgtttgactaattatgaatagaattctagatttctaatttatattcactcaaaactttgatacagttttatttatttggcctctagcattgctgctaaaagtctagaaagcatattattttagtgatttttttaaaattgagaatccaattctgagaatataaagaaatagtatgttgtaaacaaaaatgggaaattaacatatgatagagtattattaagtacagatttgttcaagtttcacaaatttttatgctagtgtccattatttattttcataacttattcaagattccacatggtatttagttgcaatgagcagcttcagctacaggcagcaaattctgataaattatttttccatttttattctattcatatttgttacaaatattttttagttttccttgttatggtttcttaaatacagggcttcccttgtagaatacacccccatttagaagtggacatttaatttccaaatacatgggttttttaaagtattcttgatattaatttcttttttaatattaatttctcatttaaatgctttcttctctgcaatcaccttctgtgtttattcagttgtttaactttatttaggttttctatggttaagtcaaagatctctcttggtaaatgtcacattgcagttgaaaatatgtgggttattttcaaatatatttttttatgttgatttgtaacataattccatagtgataagaaaacagactgtatgatttcagtacctttagaccatgaagtttctgcaccttgttttatgtccctgaatatgttccagtgtcccctggtttattgtctatgggtactcgaatagaatttgtattgtgctgttgtgtgaaaattatataaaccttaattatgttgaattggtttatactgcttttcaggtctacttatccttttacttttctgtccattctattaatttttgagagtttgatattgaaactccaactaaaaatcttaatttatcta

SEQ ID NO: 36465 - DNA, 1114 bp, Bovine  19866880757352
atttctagtgtatgaacagagtgtagaaacacaagcctcccatggactgtggaaactagaaaacttttcttttgagattatttaaactccaaatctaaggggagaaacaccataaaactgcatgttacaatccaaaatctccccttccaagagaaaaagcctatgctatggttctaattgataacatatttgtactttttcccgcaaacaaatcttcatatttctaaacctactggttgtagattattctactcctgatggtttgagaacaccacaatttcttcccaaccaaatgattactcacccaaataatttgcttgtaaaaattaagtttttacacataatttcttaaaatgttctatacaaggtttgttttctttttttctgctttctttgctgatgaactgcttattaatctagaatattcatcctagtttcttcatgatttaactttcttgtccatgcaatagataaacagctaaatgtaaatctcaacaaaaataatgtactttctcctttttaagctaatgagtggtaaattctggcagataaaagatgaaaatggagagaaaaacttgaagttggacttattgaacgtttagcaaattgttgacctgatagagattagaaattgaggtagggatatagaaattaaaagaaagagaatttactgctgagaatagggaaaagggtgggaagtggctataaaatagtgagaactgctttccataaaccatgtaaaaaccccacctcattaccgtatagacatggggtacacacacaataaaatctttgtaatctgacatttgagaggaaattaggtgccagttaatgtcaagttatgtttaataaagacttagctcatgttgtctcaggtggtatccttcttggatttcccttatcctctcctttaagacttagacataaaagggcagtggtttctatgtataaatcatcattatttaaaaaacaaaaaccttggcatcgcagaactcgagcatcccactcttcaccagaatgaccacatggcacagaggtcctaccacttgctgtgttccatttgcaatcagcatcctcatctttgaattcttagaaaataggtacctttatctct

SEQ ID NO: 36466 - DNA, 1437 bp, Bovine  19866880806894
ttttttcacatgcagttgagctagtcttactgcagagagacctattattgctgagctttctacaacatcaaaagcaagaaaattcataggcattatttgcctctaacctgttttattccactaggtaagattttgccaaagtctggagattgcatatattgcccagaaatggcaatagaggtgagagtcaaaagtctcaggaagctctttcaaaaagccaatagattcagttgtaattttcagcatattttaaaaactcgaagttaatcccttatttaactaataatcatatccttttactagaaggagagtctaaacgatttgtttggatttctaatactttcatttatttcttcatttctaaacttgcttactgatattaatttgggggagtggagtggcaatatgaaatgattttgctctaaaacttgtaagacatcctttcagataactgaagacaccaaagaaggctacaaggctatacaaatagaaataaaaatccactatgaatcttctgcttagggagaaacatttaagcactgaagcagagtgaaccagtagaggggcatataaagaaagaaatggcaggagagacgagttagtggttagtattcttttcctaaaattttgaaaatctacagattgaacttttattttgcaaagtagttgatcttattgagtttttaaaataaagtatcacatgttaaataattttaaaatttagagattttggaaaatttcaaatttgaattttgttaagtggaactgaattttaaatatatatttaaagccatgtgttattactgatacagaaagaatgttaattttttatatcagagattaaatacttaaatcacacttactaatttaaattcatatttacgtcaatttgtatagaactcttaactcgtaaactactccatttccatgtttaaaagaaagacttccatctggtaactcttatctattgttaattttctccataaacttccagaaagtgtattttccgacacctacataaaactattcagttaatcacaatatgattctaatagacaattctccaaagtttagcttcattttttttacataagagtttgctctataaatatttaatgcaaaattagtcaaagttgttaaaatttgttatataattttacttaaatccaagaatggcttttctcttatataattttctagtatgtgttgataaaataagatatatacaagaagcaaaacacaactttggcatcagagttcttaattctgaactttgacttaagacacaattaatcttaactcttacctatctatcctgaaatgactcaaagttacatcctcggagagtacatttcttcttgagaaaccttgggataaaaaagaatttatgatattacagcaagaagttacatatgcaagaaatcaaggtaagatcaa

SEQ ID NO: 36467 - DNA, 3131 bp, Bovine  19866880950080
gcttcccaggtggctcagctggtaaagaatctacctgcaatgcaggagacctgggtttgatctctgggtggggaagatctcccagagaagggaaaggctactcactccagtattctggcttggagaattccatgacctggatagtccatggagtcacaaagagttagacacaactgagagactttcactttcactcatttgcatattataggagcattctaatttgttaccctacttccactcccgcttctgtccagcccatcttctgctcattcagtaacaagaatggtttcttgttgttgttgtttagttgctaagttgtgtccacatcttctgagaccccatgaactataacacatcaggctcctctgtccataggatttcccaggcaagcatactagagtggctggccatttccttctccagggaatcttcctgacccaggcatcaaacccacatctcttgcgtctcctgcattgcaggcagattctttactgttgagtcactgaggaacttctaaaattgtaaattaaaccatatcactcttttatttaaaaatcctccaaagatttcccattgcacttagaataaaatgcaaattcatctcaatttaacagtactgggctagaggactacaaataccaaatcccaatactatttctaactgcagagaagatgtcaaactggttccaattgccaaaaagataaattttgctatttagcagctgtgagcccaagaatgaattccctatcctgcatttagttttcttatgtatgataagaaaattactttgattaatactagtaacatcctatgaagagcaaaagttgtgtatgtctgctgttaattgacttttagtacttttagctgtgtgcctgtctattccttcacaaactaaaaattaatgataaaagatcagagtttcatctgtagatgattttgattcatccagcttttcactggagtaagcagatggcggttagctctggaaacatgctgtagtattgttatatagcttgatcctgaaagtgatactggatcttgagtttaaatattcttaatgatgctcattccaggcatatgaggtgccaaacaagtcagtacattttattatgttctgaaatgcaaactgcaccctcttggaaaaagtttatctctcttcattactcagaaaaagaagttaatacaaactggctaaattatcaaagaaacagaagttggtaaactgttcctccatgtcttctatgaagaaattagaagatatttcagaatcactgattaattgttacaagattttgaaaaattagcaagtaaaatggtgttatctactttatccatccaacatatatttatttggtgtttgtatgctttgtatataaaatattcataacatacaactttgtgcaatttattgtcaatattattatacatttcaatctgtgtaaaacacattgtgtccccaaaatccatattatacaattcttcaggctctatgaatcgcatgttttctcaataactctcattggttctttcctgacttttagtcttgtcatccaataaaacacggccttatctccaaaatccttcccatccctaaagttcctatttgccatctttggagatgtaatcggcaaagctggctgtacctaacaaacctttatatcaagtcctgtcactgctccaaagaagccattacagtgaataattttatgagtggcttggctccaaagaagctaaaagacacattatagtttattgtgtcaaaaagactggcaaaaaagaggccccccaatttgactttcaaatgtagagtgaaatcactcccccaggattggtagtgctcaagttaagagtcttccaaaactctaagatatgagtcattttattctagtttgtcagtgactcatcttatccaaaagtgcctgaatcagagccaggacgaatccctcattgattgatacaaccactctccctccagtctttgaaaatgcaaaacttcttttttaacgttcagtcatttgtcacgaattgtgtaatttgtggcagcccaaagatgctccctgataatattccatggagttggctttatttactatgtctgaattgctctaattttctagtacaataaaagcagcctgttaaccccaaagggccatatattttcttgtgaacgccctcagtgaaacaccttagtttatcatgttaacaaaattgttactttagaaatcttgaggggattatacaaaagaatatgataatgagagaaacacaaacgattttcagtggcaaaggcaactgttagaagatcatctttttcatccctccccttttatacaggagctaggtgggagttctgtgatggtccagtggctaagatttcaggggacccaggtttgatccctggtcagggaaccagatcccacctgctgcaactaaaacttccatgtgccatgactaaaatctggtgcagccaaataaaaataaataaatattcttcttaaaaagaagctaggtgattgagaaaaactgaccccacttcaagcccaagtgaactctgagggatctaagccatttaggtcattttttgattcaagtatgatagtataactaaaacctaagctaaagagaacatgggattctactcatatagtttacagtttaggagtgagcatggaaccaaattactcttgcaaaagtaaggctcgggatatttatttcatggctaggagaagaaaattcctgccttcccccagacttatgcaaaatctgggggtcatatataccatagctggcagccttgatgcaatcatgggataaaccagcctaaggacaatctgaatttgcaaaggcatgcaatgagagaccacagggacaggacaggcacctcagtgacatgatgtattaataactgggttaaactcaccctaaagctcacatttgcacagaattttctagctatataagtgaagaaatctcttactgcttgattcaagttttagagcactaaatttttgataagcagaagtcactgagatatctagacaaaggctttaaaaaaggaacaaaaagtaaacaaaatatggagagaatgaatgagagctaaagaagcttttctgatgtcctaatgtta

SEQ ID NO: 36468 - DNA, 1960 bp, Bovine  19866880960047
tttttgctttctacctagagaaatgggttgcttgctattttatgaaatgcatgagaacaggaactgacattttgaatattaccaaaaaacaaaatcttggaactagtgcccccaaacagtgccatagctaccaaaactcaaaaggacttgtattaaaacaatagttaaaagacagttatatctgtgggtttatccagaggctcctttagcgctaaatgtaagggccagaatattgcggctacaccctgcaggagaagccagccaacttttcatccctcatcactggctttcttattgcaagtctcaggtcctaaagctacaatgactgaaatcgccagagtttgtcgattaaatcttatgtaacaaaattctgatatatctctgttttgcaaataacactcttttacttgcatcttcactctcccatagatactcataagcacctatgcttttctagcattgtcctggccattttaagacatccaaatagattatgagctaggtggcaagtaggaggaacacacacatatggttttgggaaaacacatgaaaaatcattaatcacttaaaaataaagaagtatgtactctttagtttaaagaaacaggaagagaaccaaacagggataggagaactaacatcttcaaacataggttaaaaaaaaaaaaagcaaaaagaccaggcaggttagtcaatggaaattcagtcactgatgtcctgacttccatctcccaaaccacaaactgtaccttcaattttattcttgataatacatataaaatatattgacacaaagaacatgaaaatatctttgagtaaatcaagaaatatacccaaaaggacaaattaaaatcatactggaatattgtttcttcaagattattgagagtttttcttttgttttggcacaatgaaaagcagaacaaacttggggtgaacaaaagacaggcacttcaccattatgcatagtgatcatgcactggccttaggttgaatctaatattgttcgtgcatctgtcgtaatggtatctggaagttggtattcatcatcaaataaacttaccaagaaaaccaagaagctctgggtgtcaccatccaatattgctgaggtcagaggaatgatgagaaccaggaaattttaaagtttataaaacaaaagggaaaacagctgtaaaagatgagatccaaacagacaaatttgtctaaggaggaaaacagatgttgcttaaatttatttcctgtttcattcctgtcaatgatgtagctttctgaactcagacattaagcccagatggttaaggcaaaaggagacctgtggccaaaaacctcgtatcaaccaatttgtaaaaagctattaatttttatgattttattgcaatctttatttgcatgactttcaatttctgaattaaaaaaataattttaaacttttactaagaaaaaaaattcctttctggccagattcatgcaaggaattattttaatagattatcaaaatgaaattcaaggaggtagaactgtctttggcaacattcacagggaaagaaagtgtatgattaagattctagatgcaagcacatgacacaatctacgttataggggaataaaactagagtgaaatacactaatcagacaaaaaaatggttgaaacaaaataatgattgacattcaactcaaaaaatttgaaataaaaaaacaaacaaacaaaataaggacgtatttagatcaaagaagacaaaaatggattggaggaggaaatggcaacccactccagtgttcttgcctggagaatcatcccagggacgggggagcctggtgggctgccatctatggggttgcacagagtcggacatgactgaagcaacttagcagcagcagcagcagacaaaaattatagaaaattagcgaaaaaaaaatctttgaaaatagtaagtcagatgtatgataaaaccaaacaagt

SEQ ID NO: 36469 - DNA, 1704 bp, Bovine  19866881002369
caagtactgaggaaaaggataaggaagaaaagggaaggccagtgatatacatgcatttccctttccatgtatctacttgttgtgcactagaaagcctttctaccggagaatttgttgattctttctgtcctaatgacttgagggttttctcaccaactgttacttttccaagagctataagtgtagcaatctgaacctttcctctttgcctgctaccagccagattcttagctaattctccaaccccctgggttatgccctgggtcgtcaccacagaactcctttcctctagatgtcatcctccaatgccatgcagagctctttagaaatggaaacctttggagaaatggcttcataataacttacctgtaacaagattttgctatgtgcttctctgaaattgttacagtaaggaagccgggttcagtattctttttttcttttctttttttccccccacaatctctctgtaaggcacaaggtgagatgctcagaacatattgaaccaatttaaatggaaaagtctatcctagacctgagtgttttatctcctcccctgacctgtattctttttcacagaggaaggaagagaagcaggagaggagatcagcctcatatcagatattcttaaaccagagctttcagaacctagttgggggacacattaccctgcacaattaaatcaagggtcacatcctgtgttgctaccagggcagctggggctctgccttctgtctgcagtgctttccctctgattggtgtgtgaagaaaggagtctatacccttaagagcagcaaaggcagataccaagtaagataatattagattttaatagggtgaagtctaacaacaaaatggtttctttggcagggaggggtgagtgtgaaggtgaaggaaatgatccgccagtctctgtcacgctgggttgaaatggatttcagggattccccgtattgctgtgcactgctgctgctgctgctaagtcgcttcagtcgtgtccgacactgtgcgtcctaggaagcttttattcagcttctcatgtggggatttagtctttctttcatttaacactgccagggagagaatattaatttatgaaagagcagtattcttcatatcatctctcaagggcgtttttcttccttttcaagagaccttgttcttttgcatcaatttgctttactatgtacttgttggtagacagccctaggagagtctttgcttacagtaccataaatgtatcataaataactatccctcattttcttccagtatcattgatcagaatgtccacttctaatcacattgtcatggtggtgtgtgtctcttctccaggttgggtttcagactgagtttgctttatattccatctctgaaaatgtccattgacttgaatgccagttggattaaaagggaaaaaaaactcattttatgatttgtacagctgtttctgagcccagattcttattaaaggtaccccggtggcatttccttaccacaagattgacagattggggaaagctaaacattttcttttctaaagaactagtggaaaacagacctattttcaggattggcttgtccttggtaaaaagtttgaaaccactgagttgcatcatggccataaagcaaaaaagctgttccaaagtcttaatttctagtcagtgtttaagcagcgcaacagaaaaaaaaaaaaaagaattt

SEQ ID NO: 36470 - DNA, 1250 bp, Bovine  19866881040435
tctcaggacatctgctgtttgtcagctgtcgcaaatatacactgtcaatataaagccgaagcattactcttgtatttgcaatctgaggttttctactttttttaaaatttttgcttctttataacttaaaatcctcaagaatttagttatttggcgcagcttttgttctgtagtagtagagatggaatccttcagttcaaagcatcaagatggagaaagccatgtctttgatgagcaaaagaagcataagataatctagttttaatagacagctattttatctgcttttttgttttttttttaatctgatatttatttccctaaaagaagttaagcagctagcaattaggttggattgcataaccatttattattaatacagaaagcaacttaaagaccaagaattatttgttaaatcaatcttgaatttattagctgtcacacttttagcaaaaccattcagggatggttctttataagttttgtctttggaattgcttaacactcagaaataaaagaatacattttcaataggagatattttagttagaaacaactgagttcacacatactagaaactttatatgcagattttcatagatagtttatacataagccccaaaacttaaaatatcgtgtagagacattaaaacatctgaagtaaaaaccaaagtttaacttgtaaatcaatacaggatttgatatagggctatacatacaaaaaaaggaaatctttaacttttgattcatgacaagaaaaagaaaaaatagcaaggaaagaaacaagtctaagtgttgatatgtaaatataattgcaaatgtgttccttcattgtttaaatcaccctatatgaataagtgcttttgtttttcatgttcctgtgggatgtatcaggtcaaatgtcagttctggcctcaaaatgtcctcttaaaatcctgctctccttcttccaaaagcaggtgtatgaaataaaccagcaggcagtcaaagctgaaattacatttgtgtgttctaaatcatgacattcagtcttgaagagaaagaagaaagcacagatgtctttttgccaaaggacccatctctgtggaaaaaagagaggacaggaaatcacagagacacaccacattcctgtttgttccagctgagcgcttccacagacctttctttgtatccgacagaatagagaccagactctcaccaagtgttccggccaagattagtgctgcaaatgctcagcgattctctgtgct

SEQ ID NO: 36471 - DNA, 2324 bp, Bovine  19866881050038
ccatttccccaacaatttactaaacttatactatatttttagatgagtgaattcattttttctatagttatttcaaatacttatttgaatatttatctgaaaatactctttctaaatggtgatgtatttgttatactcatcttttatatttatgctagaagattccaggaagaagtgaaatggataatagcttgcaaacctttagtttatttttaaaattcaaattgctgtttgtctatgatcttagtaatataattctgaaatttactggcaagatataattatggaagatagaagttaattagagtgtaaagatgatgaatgcttgtgataatgatgtggctgtcagtccttaaatagtatcattttggtagtatcactacctttcttgcagattactcagtttggcatgttatattctctaataaaaaggacattataataggagtcaaaagactgcttattcttctgttagcttgttgttaaaccttatctgtctgcttgcacatattctcatgtttactgtcctaatgcttaacaagaaagtttggtctctagggtgtccctagaatttggcacctccaaagaatatcaggttgttggacttacggtgaaataaaaagagccaagcaattcttgtaaaatgaattgctgaaagcaatgtgtcaagctgtggatttctttagccctatgttgtagagaaaagtaagttaataaaacattcttctgacactattgattgatgatattggatcttctcagagagtacttggggagctgggaaatgacaacaatcagtgaaacataaacactaaataatcccacggctaactcctcctgtgtacaatagttttcaggcttttaaggtcatgctcttctaccagagaacttaaaaaatagtgacagaaaacccagatactagctttgatcaatttcaagctgctgtttcctctccttaaaattgagagagctttttgtacatagcaaaggttcagtatctgtgaaagtatacatcaattacctgaatcaataagttctggaatccttcataatagtgagtggtgaaagtatttccagttccagtttaacaagtgcaccggacagcctagcagatcaccactaatttccaagggcaatagtctatcttctttcttttcaaaatttttttttcaaaaatcttttaatctcaaaagcctggattatgccagtgattcacaaatctgttcaaatttgctaggaaaatgatgctgttcttctaggtagggcaaatattatcaagaaatagatataaaggaagaaaagatttattaaaccactatagttattaaaacatttcttgggagcatagaaggactaaccctgggacaggctttgttgtttagacaatgtgtaacagtgattggattctgcaggaaatttaccataatctgagaattagccatctgccttttcagcctcatcttagatatttccttcattctgtatgcttaccttctgcatgaacttcttattgcaacttagtttgaattctttaaacttgctcggtctttcacaattttagttctccttgcattttatgcaacctgtcagtaagggtgttttctcatgccttaccttacttcacacatattcattctgcaagtcttaacttgtgtcatttccttcaaaaggcaattactggtccttccattgtttcaattcaatctaaattagttcctctgtattttataatgctatatatatatatatatatatatatatatatatatgtatataaatcttgccaaagtataatttatattaatttttgtgacctgtatacctctgagctatcttgtaaaattcaccaagacaggaatcatgtctattttgttcatttcatatcctcactatttagcataattctcacatggaagatgttcagtgcatattagggaaggaaggaaggtaagaaggatgggatttgctgtaggtcatcatacaagaaatttaaaaataagtcatatatttggttttgagtacagaaaataaagaaaactttagctttaatgtagccacagatgtttatatgggaaaaaaaaaaaaaaaaacatttgtgaaacacatggatcatttacataatgaaatacatattataatttcaaatcaaacttagtaattccaagtaaagggataaaacttagtcctgtgtttaaaagttgttcataaccatcagtttatgcatgtatattattttttacttttaaaaatgattctgtcaaaatattccaccaaaaatcaggatattcatgtgcacaaatctaataaaagatattttgtctttt

SEQ ID NO: 36472 - DNA, 1032 bp, Bovine  19866881080031
tgtgagtgcaagtccgtcctttacatctgcatctccattccttccctttgaatcccaactgctcttgtgatttgctctgaccaacagtggaaacgtgccaattctaagccttggccccaaggggcgtacatgattcaagttctttctttgaaacttgctgccgccatacaaacaagcctgggctggcctgctggataaagacagcacagagttgagtcaccctgttgctgtagtcaaactgccagctgactgcagatacatggagaagtccagttaagactgatcttggccggttcagcagaccagctgacacagacttatgagaaaaaagaaaaaaaaatagttgtttcatgccacaaatatttagggtggtttgttagtcagcaatagataatgaattcaattagcctagctaatttgagaaaagagggcagaaactagggcttttattggcagacgaaactaagatacactaatgtctccgattttacaggactgtcgcaaatgctgcagaaatgcaagccagtcctcatttctatagtgctgaggttgacaaaggggtagctgtttgaatacaaagaaattgaggggataaagactgttttgtgccatagttcagcaagaaatggaaaaataaaattgctatgtagtctctatattatttttctcattgatgctacagataaaattatttccagaaatattttcactacaggacccaatgtaccatgtgaaaatcttctgaaatagaagtaaacctaataaaacaaaatttcttcaaagattcatcttaaaaaatatgtacccacaatgccttgttaaatgcaaatttactaagggtaatatgggaaggaagctgatctttctcttcatttaaatggaaatatttgggtccatatcatacttttgacttacatatcattgatcttcaacaaatgataacaataatgctggcactgaacatttccagttgtatatattttttgtagttgcctagacagtacagaattagagctgaaaagttgtcctgag

SEQ ID NO: 36473 - DNA, 881 bp, Bovine  19866881239765
ctgacaattttgtcgtagttctttgtggcaattatttgtacttccggtaacctagtgtgtacttcatgttcacacatgtcctaattatctaattattctgttctgcagtgagtgattttgaatagcttttaccatctacttacccataaaggtataataagatgattaataagaacatgtataaaacatttggaatgcagaaaggagcaatttttaaaactaatgaaatattacagggagcattcttatttctatgttttcagaaatatatttgttttggcataataatacatgaacccacacatttaagatgtcatattttaataagacatgtcctctataaaagtgaaatatctgtaattctttcattgatttattttgaagtgaaatgttattttttactacaaaataattccatttatttaaaaaagttataagtaaaaattaaaggtgaaaataatgccccctgtattcatctctgtgcaaagtgaccattgttaaaccatcagtagctgcccttccagttgatttatcagtttatatagacacatagctatttgtcacagcagttattaaataaatgcataatgatacatatataattttaatttttttgcaatgtagtgtttttatactgtatgtgtttctcttctactgctttttttcttaatgatgtattagtactttgtatactctgcagaattctgcccccttatttacttagttgcttaatgtgttttatagctaacataaccaattttctattgttaaatgttcacatagattgactttctttgttctgtttacagtccatgatgaaaatcctgccaattaagtccactgcataactttaggaaaatttctctgaaacataactacca

SEQ ID NO: 36474 - DNA, 1965 bp, Bovine  19866880370980
attagggctggggtccaagtgatgctctgtttgtgggttttctcccttttagttttttttttcctgaaaaaatgtttggattcattttggttttcagttttagttcacggttctcattttccttctcaatctctcctcaagccctacctacctcattcttactaattcttacttctctttctttttcattcttggccaccccctgttaaaaaggcatcttttcctgtaatgagccctgcaagtagcaccacaacaaaaacacacacccttactgtggatttcatattcgcttttgctgagtctgaagagctgggtagcgactctttctccagtggagtgaggcatggtgacaagcgtgtaaccagaggacctggattctcccatatattaggtgtgattaggggccagtcagcctctctatttcttcatttattaaaaaaaaagataatttttcttgtctgcctcacagaatttttacagataaatactcatgaaatctctttgtaaagcataaactgctatgcaaatattattttattattgttatccttttgcacatctggtccccctgctataaggtgccaattacatcacaggaggatgtgattgttctttgttgcacctgaccaaagaatggcagcttctcagcaatgcccatcctgtgcatttctcacttatctggaatcctcttcatcattcccaagaatgctatgattccctgacattaaccataataaagccaaactcaagaaggagaagctacttgggtaccttgaaaagtcaaggaaataccatagccatcatcaagatgcttgccacattactcagagacttttatctttgccttcaataaacttccttagatgcagatcagaaatcagatctcttccagaccactatagataaagcttgtatggcaaaaatgtgcttccagttgtagggatttctgttctgacagccttgcattcgatctcaaccccaactacatctgtttccctgttggatattaaagataattgctgctctagtttaataaaatggcaatttgcatctcctctgggctagactgcttgacagcatttcccttaaaatctcctacatgcttttattttaaaaaataattttcattgaaaaggtgataatgatttttggaaatgacacctaactaaaatctcaaatatcatataatgtaagcagtccatattttcaatataattcctcaccaactgtagaaaatttgatttctgaaaatctccaaggtagaagaatttatatttgagaaatgaaagatcatgcagaaagaaagaaaagaagaaaaaaaaaagagaaaacaggactgtagagctaggattcactgtaaaccttaaaagtttcttacaaataacctttctatcaatttcaatgaagcaattgcagtagcacgctctgtaaagacaatcaatgagatgatgttttcaccatttgaagtttgtgatggtgtgtagagtacttgttttgcctctctctccaaaaaagatacggcaggtagggacaaaagttctcctgggctggaggagggtgagcatttgccatagacttggctgtgggaggtggggatgggatggaaggcaggctgattgccttttacttcctgccagtctacatgagagcagagagcaaatataaaaatgatgccctgaagcactaaaggggaaccaggggagtatgtcaagggaatatggggtgaggtacagggcaaattaccaaagttgagacttagagtccaccagattgctgaggaaggagataaagaagtaaaaatagcaacagctcagagcagagaagtcagagacaaggaatattattatattatattaactccaaaaaaaaaaagcatcttttcctgtaatgagccctgtaagtagcattacaacaaacatacacatccttgctgtggattccaagttctcttttgctgggagtctg

SEQ ID NO: 36475 - DNA, 1972 bp, Bovine  19866880518900
tattacataacccagtctagttaccaggaggtattactgccaccattttctgtctaaccaaagaataggagagaccaaagaaagtgttctgaaacttcattaggtaagaatattcaattgtctactgtaatttaatatctatcctttataaatttatcttaagtctttctcttgaagccataaatgtttgaaacccctcatgttcatgtaattgatatgatggtttgtggttggatgctattttcctctactctggagatctagatcattattgaaaataatataaatccacatggctaattttccaaaagcttcttttaaaatccagtaaatttattcttaaataatgcaacttctgacctgcttagtattcaaaaccaaaaactgaaattttgccacactctttgcagtctattgatttgagaactacagctgctgaaattaaactttattgttagcatagagctttcagctgaggaagcaatttcaaattggtttcttttctagcccagcctaatattaagtaaatatgtgcctataagtatctctagcagtttattacctaaagtggtacaagcaactttgcaggtgcagctctgagaaactaaaatctactttggtggtgagtcttactacccaatggataaacgttaatattgaaactcaatacacagttaccctcagagctctaagagtgattgcaagttagacatttcttcatttaacatacttttaaatttagtactctaagatacgtgcatacagcaaggaaatggccacagtccctgtctttggggagtgccccatctagaaagaagacagaaacagaaataaatataatgtagcatgtcaataaagagagatttgtactttatatgatgggaaaggcttctcacttatttagggggtagttttagggaatggaaaagactcctgagaggaaatcaagtaaagattgatgagaaagatgtctttgctttatttctctaaaatagcaagatcaatttcctgtttcaagaaatagctcttattctctaaaaataataaaataatgtttcccctgctggcataaacactaactgaagtagcagaaataataacccatcattttatagacattctgaaagacaacagggaaaatgatgaatagaagaataagatgaagagctgtgaattttaaataacaagatcagtaaagataccgcctattttgatctcaaatctataggcagcaaaagtttgggaactagaggaaagaaacacaatgctttttgtgaatgccctattttttaaaagaagtaccctgctttttcaaagttagtgctttgaaatatgatgaacaaaaatctctcaaaaacttgtcttggaaatcaataaaacttgacttagtttgatattgtaccaatttaaacttacatctgaattctatcagacttcccttcttagtagagaaagccatggttactagtctaagcaaagataaatctctacctcaaaaattctcatgccaatttacctgctgtgatacattttttatgccataaaaagactaggctgagagtattgagtgaaactatttgtaaaacccacttttatcaattgactaaaaaacaaggaaaaatggtacaagctgtaccctgtgtctttataacacaaagatgagtgacagcttgtcacctttctacatgatatgaacaaaagaaaaaattaatctgggtaattcaatccaagtgtatttgagtacaagactcaggaatgaagaataagaatggaaaaccagtatatgtggtccacaaatcaaagagacaaagctataaatggcaatgaagtccagggacaactttgtctcccagtaagagtacatgggccaagccatacacacattcttatttatatgcagtgtaaccatcactacccccaccataccaactaatgtttactcagcatttatgcattttgtgccaggcactat

SEQ ID NO: 36476 - DNA, 1448 bp, Bovine  19866880556307
cgttcttttttaaaaaaacttttcagtgtttatactatatggaccatgattattttaaataaataataggttatagcaataataaccttccattatttctcagctgctagcttactagcaaggagtgcagcagaattgtctgttcagaaattttagagccattttactaagacacaggaagcaaagaggctgactctcaggaaagacaatacaagctgaccggagtctagttttttaggaccttacttagtattgagtaagtatactatcttgcctttttaaagctcttccaatcgcgtgcagacactcctcacacatgttttaaatatatctcacaaaacatagatcagcacttaggaggtagtgcttatgtcagactaaaatgagttttcgttttccttcaggtaggtgtccccaccctccaggatctaatgcctgctgatctgaagcagagacgatataataataacagaaatgggatttcccaggtggtccaatggttaagaattcacctgccaatgcaggggacatgggtttgatccgtggtctgggaggattccacatgctgtggggcaactaaagctaatacgccacagctactgagcttgcgctctaggctccacgagttgcaacctctgagcctgctctgctagagcccgtgcaccacaacaaggagtaaccctcgctcaccacaaatagagaaagtcctcacaaagcaacaatgacctagtgcagccaaaaataatttttttaaaaaattgaaatacggtgcacaataaatataatgcacttgaatcttcctgaaaccacccccctcctgcagtctgtggaagcattatctttcacaaaaccagttcctggtgccaaaaaggttggggaccactgccctaagggaattctaggctgaaagggttaagaactgaatgaaacggcagcataggaaaagcttctggagcttaaagctgccaacagccttgctctagccctgctcatgatcggcacaatgtcctcgagcctctgcatcagtgctctcggctgaggcttgaaatggattgtgtcattttaaattaatcatttccaaacttctttccatatctattttggcccagaatagacgtctggtgtttcaaattctatccaccactcgaataaaaatgactgtcttcatttgcttccatatctctcacccaggagtccatatgaagctgcattttgggcacataaaatataaatattcatttacttaaaactaggttagttttgcttgaaattgaaatcagctggggcaccacagtgtagtgggaaggccaagccaagacctctgcagttacgtagtgccagtctgtcctgggcttaaagtcctacaagtagatattgaattggccaaaaagtttgggtttttctataaaaagcccaagagactgagtattaagtattgttaccctata

SEQ ID NO: 36477 - DNA, 1146 bp, Bovine  19866880605098
ctgtaggtccgtttccatggtgctgtttcccagcttggcctggattttgtcttcccttccctcagctgaacagaactgcttcctctaactactgagctcttaaggcagcacgtgggaaatgatgacgcaagaccgaggggatttaggcaaagaaatgaagtatcaactataggaactagtagacaattacccatttctgatgtgattcagtcaagtatcatgctatttgtaaatgaaaatgttaaataataatctcacttagtagagaaagattatctaacactaagaacctactatcttctatttcagatctttgaaacaagtgtttactaacatggtatttggtgagtttttcttcattgagaaataaaaagtcaacataatcttttactgtaagcacccctttatctaaaactgttgtggactgaggacatagatctcatgagatgactaacatccataacccaggtatttaatcagaataaaataatatgctgaccctctaaaaagaaataatatgctctaacctgataaggcaagggaaaagagaaaagacacctccctttcttccctttttcgataaaaggagtttcgcatgaagctaactggtagtaaagggtatctaaaaggtccgtttatgaagagtaagtcaggaggaagcactaatatcctgaaaccctacagggttttacaaagtgccaaagaaatcactgaacaaacacatggctagcaggcatttgccccagagcctacagaagagaacttccttatttgtgagcagggtctcattttcaacagcagcttctgacctcaggcttacccctccttagccttatgtcagcaaatctctccaaagtttgcctaggaagacctgctccatttacaggtaactgaccaagatagatttgtcaactcggagccaagctcttccactttgctttttttctccacagttttccatacatcttttccatagtcaggaaagttttcctgaaggcatcagagattatacacaaaattggggttgggtgaaataaactaaaatggtccttcctctctctaaattctaagctcttttctatttttcatctggagcaacagaatacgtaaaaaaaaaaatccccctaaaaaccccagagcattttg

SEQ ID NO: 36478 - DNA, 989 bp, Bovine  19866880658274
aatctaatgctgctgctgacctaacaggaggcagagctcagcagcaatgccagagatggggagtgactgtaaatacagatgaagccttgcttgctgtgtgctgctcacctcctgctgtgtggcccagttcctaattggtcatggaccactccctggtctgtgaactggcgggtggggactcgtgggttagagtcccctgggacgggaacatagcttcttttctatgatgtctacaggagtagattcttttctgccagcaacacttcactgggtgtgtcatggaccagtgaagaagaaatctgcctttaagccttcctgaggggcaggggcctcttaattccttcctgcaactttctgtgggtttgctactgtcaaggaaaatagaggtcacaatcaggcaaaggtaaattaaaggagtgatccactgagaagaaaataaaaccctgaaggaccagtatggacataaattgggaagctggagtgagttactccaaagagaggtgcaggaatacaaccacagagaaacgagataacctgatacctttctctgcctcatgcctctgctcaaaggacgatgctgttacgtgcatactatgccctgctgctatcaccctaagccactgtcaggatgcggggtgtcggggccttacgtaaacgcccctgctgagcaacccagcacctaccaacatgctttatttcccctctaggcaccagagcatttggcacgcttgtagagagtaatttcaaggtagattgtaattgctggtaataaacacactacattgagtacaagctggactaggaaagagggtcgtaacaagagatctgtgatgatcatggtttgtaagttgatcttgactatcctaacaagataaagcttttattaaaattatgaatcaaatctcattctttctcatatgaaaaaaaaactgggaaggattattttaggtgtacttggcacaggttctttactttaggaggagtgtgtg

SEQ ID NO: 36479 - DNA, 1627 bp, Bovine  19866880663555
atatctttcttgaaagtaaatcttagagatttcccaattaaaactactttcaggtcccaaagtctaagctccccgtatgatcttaaaaggttagactcctgagcttggctcaggagcactcaatcatcctaccctccatctactctggaaaggtgggaccatttttggttggtggtaaacataagcacaaataaaaagacaataatagcaacaaggtaatagtaataatgacaaggtaatagtaataggaaaaactagtatctataccggagaaggcaatggcaccccactccagtactcttgcctggaaaatcccacggatggaggagcctggtaggatgcagtccatggggtcgcacagagtcggacatgactgaagtgacttagcagcagcagcagcagtatctatacaacatcatatagccaaaagtgctctccaacagatatctcatttgattgtgccaaccatactgtgaagaggctctggcaaccgttgctgctcttgttaattactgctcttaccagtccacttcctctattggatagaacaacaggaggtttcaacaggttcaaagggtttctttgcaagatcacacccctaagtgagagctggaatgagacgtctctgtctccctgggttctttctccccagtgctcacgatctccaagcatcactccttagatgttaaatgaatttcaaattttgaaagttggggaattgagaagcaaagcaattaaaattgtgatgtatgaaccacttgatcttaccctttgtttctgaggctttgttaaccatgtcggcctaggagattcaactgctttgaagactttgccttctggctttgccttaggagcaaaacatactttaataaaggttggcatttcaaatgctagcagtccttagacataataaggactactaaggcacagaaatttttgagaaggcttagaattcaaattgtaattactaatgacaatatttaagtaattataaatgtaaagttgctcattctatctcaatgttctcatgggtaaaatgagacggtatctgtctcctgggttgctgtgaggactgaatgaaatcctgacctaaaacactcagaatattgtctggaataccaggagcccattaatattagctagtggcattattatttctaaaggtagaataataaactatggatatcttcatccaggtctttgtttttttggggtcaaggagatttacttctaatatttagttgccttttacctagttagaaaattctatatatgttgttacagactgaatgtctatatccttccccaaatccgtacattgaaatcctaattctaaaggtgaaggtattagaaggtgggcctgtggaaggtgattaggtgatgaggacggaaccctcataaacggttctagtcttttataaaagagagtccagcagctcccttgcccctttcatgacaaagagaagacatacacctatgagaaatggtcgtcatgagaccccaaatctgctggcatcttggtcttggacttcccagcctccggagctgcaagagaaatgtgtattctatataagccattcagactggttttttggttatagcaatccaaatggactaagacgtatgt

SEQ ID NO: 36480 - DNA, 676 bp, Bovine  19866880663857
gaaagatgtgttagagaacttaatggacattcagaactcttagaataattttaccctgaaaaatttaaattttgtaggcttgctgatatatcttgatgaaaatttgacccaatcttgaacatgacagacttaagaattctaatgtctatattttgttttttcataattgcaccaaaattgaggaatctttctctgggagctgcctattgatacaccttgtaattagcaacctgcttctgtttctgaaaaagaaagcagtgtcaattggtactttcaatcatataagtgtattaaaattagctacagtctgtattcagtggggtcagaattagctacaatttatattcagttcagtacatagaatttgtcaaatttctcactagttcccaaggtttataaacttgaatgtatgtatgtgagttttaaaaatctaaggactggacaaaagagaaaaattaagaatatggatgtggtataggagaattcaagaaaagcaagggtaagtggaaataatgaagacacaaatcttcagatgttcgtttaaaagggagaaaatgaaacattcttttttttcttggccagatgtatgacagattcagtgaggcatttgtatttgactcctattgattttgaatggatttagctgtttaaactgtagaaagaagtggtgatggtg

SEQ ID NO: 36481 - DNA, 1686 bp, Bovine  19866880670969
tctatcactcatcttggcaggataactgtacccactgattgcaatataagaatatggtttagtccctaccttattgagtatgtcttctggaattatgcttgttagagcaaccacatacatataaaatgctacataacatgcaattaaaacaaaaagcaagcatgccaatgctgtagtcatttctatgtcgtcaaagcctaagtctttgcctgtgtacagacttgcagttctggttagggctttcccttttgttgtttagctgctaagtcatgtccaactctttgtgaccccgtggactattgcccaccaggctcctctgtccacgggatttttcaggcaagcatagcggagtgggttgccatttccttctccattgtccctttgggaaaatccatgacaaatgctgttcttcacataagactgctgagactcgatcttgaaataagagtaggacaagaggaaactacccaaggaatcttgttaatttcaggatggagagtcggtcatttaagggtgacaggtgcaacattcatattgattttccagattttacttctcaaagagtctggaaggaagatttgagcagctcagacaggatttctactgataaccccagggatggtttgactctggtcttctttagcccttcaattccattactcactgaggtgcctgggcctgggcctctcctttgtttaggagtgacagccacttgtctttggcggcttggcagttctgtaatgacagacagccacccagccaagggggcagcagcaggagcaaacatcccagcttgataagactgcttatgcagccgcaggggaaaaaagattctatctttctgtcttttgtggttattaccttcctctggctgtattattatgtctccgaggagagagagagagagaagtctgtcgagagccaacgtcctcaatttgggaggacaaactgcagttccttcagaggccaaaataaactgctcggcagaaagagtcctagtagtgcagtggttggtctctgacaactacaaaccggtagttattgcctcaggggccccgaattcttcagtccccatcagacactcaggaggtgaagacttaggtgttatctagccagaaccccagcctcggggcagatggatgtcctaaccctgcaggacagacaattgccaagtggcatcagaaagactgtcagaagcccctcctagcactgttcttttgaaatcacaagccagcgcccccaagtccgggcggaatcttccaggctctatcgaaaagctgccccctcccccctaattcattcttgcacggatattctatgagcctatgacaaggggaagaaactaatcataaaacctgttcataaaatccttctgatacttaaagactgcgattaaatctcccggcttcatttaaaacaaaggaggttctctattcacacccttcccaccccagcagaaaatgtattccgggcccggcgctgaccatccgaaagttgagatttctcttagtcgagggcaaagttagcgaatctgtagctgaaaagtctcaacttgggggagggggcgacagcacgggcggggggagagcggcgggaggagggactagagggagagacactgccccctacttcagcgaggtcgtcgcccgagccggtggagccgccggtttgggttttgggaggagg

SEQ ID NO: 36482 - DNA, 1033 bp, Bovine  19866880673956
gaaaatgggaggcatgaaaagatggtgaggaacaaaaagcagaactgggagactgcccatgtgttttgaaacagggccaccgtgtggtcttcattatattctatgtgttctatgtgaaatttctttggcagtcctttttgggatctttaccaaaaaatgtgcttggaccaattaagagcataaaaaaagtccctaacaaggcagcatcttgctttattgctctttcaaataaatctctcactttctatggctgatcaaccctggtagttgagttcatctgaaaagacacatggagatagtccaagtactttgtcagaaacataaaaatgttctattaaggtatttgtaggttttaaaaaacataaaaacactttctgatatgctctgatcaaaaatcattccttgcaacattcgggtgacttccattcagaggcatttcaaatgaaaattttgaattaattgctgagaaagggaatgtccaaaggataaataaaagtgttcactagtcactactcagaaggcaatatacaaaagtgcaaacatcaaggattcaagaaattaaaaaaattttaaatagacaaagtccatatctttgtcaattcaagagattaaataattttttttttaaatttatatcacctactcagaagcaatttgggtcacaacaacacttgtttcaactatctgggctcttccttgacctcttcactctcttgtttctcttttcttaagtttagatgatgcctttttggcaagagcctagaacagtagcaatccattcccaaactttgaagcatctacgggaagtaatcagaggacaaatactcctgattttcatatactaaaccaagtgatatttgctatgtgtttagcagatatgtaccaatagtattctgctatggtaagcaaggtagttagatcctggactcaaggcatttataatttaaaatcatcaataaggataaacattccaaagcacatgtcaacaagaaaggggctgcctaataaatctagaggggaaggcagagacaag

SEQ ID NO: 36483 - DNA, 4446 bp, Bovine  19866880695195
aagatgtactaggttcacattttatttttcctaccccagccctgaagtcagcctttctccaaggtactcggtttgcttttagtggaaaatgatattttttcatacagtgaaaatgtatctgtttatatttaatattataataaaatgacccaatatttgggccagggtggtcattgttactggggtgacttacttctagctctcttgaaagacagagatgaagataggttgatacctataatcccacagacacctggaggtgagatagcatcgttattatgttgtgatttctttggggttatgattcctacttatcttatatgaaacgtataggatttaagccatgttaagtagttcaaaatggagtcacagaaacccaggtgaatttccatgttagttgttttggtatgtctgtggtagggctgtgactgtcttagaatctgagttactttagagatttgtttgacaactggaacagaagaaacacctgacaaagacaaggcttccagggcacaatgattacactctactgacagattccttaaagtgatacccagcaacttgaatgaaggctctttgctgggggacctgactcttcgctgatgagagctgatccagaggatgctgccagaggccctgttggagcagagggcgattccccactcatctttgttgtgagaccctctgcaggactggagcctctgcttatgctgaaatgcccccttcccagacttctccttggagtagttctttaccaccttttcccctacttaaagtaacccgtgctgtgtgccagttgtgttcaagaaaccaagagattcatgaattgaatgttgctacctttcatacaatatcatgaaacatatctaatcccctgattcttaccttgccctgccactgggccctgccaccaacaatatgaaaccgatagggcttcctgtcagttctattgcctctttacttctgaactcctaacctttcctttagtatctcccagcccagtcttcccacctccataaatgcaatagcatagtaacttgtagtttgtgagacacttttgtggacattctttcctttgatcctcaaaacaatcttctgatagagcctgggaaacatattcttatcgatttccagacgaggaaagtaaaactcctaaaacccaagtgacaaattcagggtcacattgtaagtaagggcctaaatcccaagtctggtgttgttacagctcacattccacatgggaaagcccattggccttcgaacatggctggacactctcggtccaggtaacgtaaagggaagtcggaagttctctccccatctatgtgactactctatctcccttagcccacacctacacacgtgatgggtgagagaactgagctgcttcatatccagccttaggttgaacaatatagtttctcctccttagtttctgtccaaaatattgtggcaaacaagtaacacactgaagttcatcattttgaaaacagtcagagcccccagtggctaatgaaaatatgacataaatggaaatacaaacagtctgcatctttacaaaatcgtatcaaaaagattccatgtcttatcatttttgagcttaaagagtctctgccaataatataagtcatgagaacattacttttgagaagagctctagttacttggagataattttacagcattgtgttattatacatagtatgtgtatctatcttatctaataccattctctccacagaagtcatattgaatgaattcagttctatatccatgtttatctctagctttataactctgacatttatacaaaagatagaattttatgtgacagttgtgaaagatcatgacttcctacatttgcattacatttctcctaagaggagctctttcttgagcatagaaaattgatttgatttatctaagtaatggggcaaccacaaaacccctcagagcttcttttctttgctttgagtcgctttgcttataagaggattaatgctctccttcggggggcaaaatatctcatacctgttataggtgaaatagctgtgctgtgttagggtttcctactttatgagctttatccttttttttaaattttttatcctgctttaaacagagcttcctgattttatgggctgttgctgttctcctcattttagactacaggtagtgtatatcaccacttcctgattctgtgggagacactgtttttccgactttctccaaccatccaccatcctttccaaacacctctctcctctattgttcattcatatttaccctcacagtttatagagggatcatagttcagtaggaaaagtatggtaatggtaatggaagtcagtacgcctggattgtgtctctgctttgttcagaaatatctgcgtcacttcgagctatatcacattacttctcttggtttcagttatccaccaccatgaacatcatccttgaagttcttcaagctctgaaattctggattctatttcaagtacaatggtacatgctagtttaatggtaactagtttaataagaggaattcctccactctgcttgattctgatgtgtgcctttatgcacataaatatgaggcccaaataaaactgagtattgtgattctcacttaggaagttaggcagagagcctaagtgagagctttattcactcatctctcaagtatttttttatttctatgagccagctattcttttagatatcacatatttagcagtaaacaattgctcaaggaccctgttgtgatgaagtttccatgtttaaaatatgtggaggacaaagaataaatatatgaagatattttttaaaaacacaatttcaaatagtgataaatattataaaaaataaaacaggaaaatgagattaaaaagagccagaaagatgagcagataattcagaatgaatcatcagggaaggcttctctgggatggtcacagggaaactgggtcctctggccagttatacaaaaatttggtcatagaattctgaggcaaagggagcagcacatccaaagaaagcttttccaagatggctttgtttgttggaagaagagaatgaaagccagtcactgcagtgtagtgaatgatggcagagtgttgggacctgaggccagggtggtgagcagagcagatgaggagtccatgcagacaggagaaccccttctctgcatgtgccaggaatgatgcttccagggaagggttctttctccttgggaagaaccaagtgtgtcctaggtatgagatcaagagacatcaactgtcagaccaatgggctcatcattgatttagatctcatctacagaaaacctaaatgcaattggaaatctgaagatggaaatccaagtttcagtctaaggcatttaccatacttttcctctggaaaggcacagtgtgtcaacagaggaaacttcagcctttccctgaaaggtggattgtgaaagctggtaattgagagagagaggaaaagagagagagggagggaaagagagaaggagagaaagagagagggacagagaaagagagacagaaacagagagagagaccagtaacagatgatgcagcattaaatcatgcagctaatttgttgggagcctgggaaagacgctttacctctcttgatgtctgttttgacagctataaaatgaaggcttagacaaggtaatcttgaagttcttttcccattctgtagtgaaattgcttatttgtaactctaaaatagctttttaaaaaaggttttcttgctatttaaacaatctgccacattagacttaaaattgaataagaaacatatacttttctaagacagattgtagtttacacttctagcctcaatcctatacataagtaattcatattattcagattatttccattagcacatgtgttctcattaaatttcattatgttagcttgtcatccgtatttttagcaggataaattgaggactgagttgtgttacactccaccagagaccatgatttaaggtcactcatctaatcatatggaaacctctatatttcctttattcccattatatcatgaaaacttgcggtcactcatcaggtgagaatctacattatctccttcatcactagtatatcatacaaattctatctttaaaaaaaaaaacaaaaaaccttttgtaaaactcaaggcaacatttcccagtttctagatatccagaaactctcctattctgcaaacttccttaaaaagcagtcagctaatccatagaactaggacttgacatttattcaactcatttaacctcctggaagggtaaactcactcaaaagtaaattctctctgataactctaaacataggtaggatttcaattcttttcccccaatgtctaatctacatttctggtatggccatcaatctccatcacagagaatatagagtaaaatcaatatattcttatt

SEQ ID NO: 36484 - DNA, 1212 bp, Bovine  19866880695615
cttacccagcaggcacagcatagcaatgggaggtagcagctgagggagccacggcctatctgagtccagacaccaatgtcacttcttactgtgtgaccttgaaatgttacctaacttcgcctagattcaattttcctatctataaaatgacagtgataacaggtcattttcagcagggtggtggtgaaggttaaatgatccaatccatgtgaaacagctagataaaggcctggaccatattaaacattccttgaatgtgagctaccattgcaatttctagggggaaactggtctgcttgggacccactcttgatcctctgccccatggctcttagcgagctgggcaatattctacagatagaagaggctgcttccctgtgtctcatcttttcactgtcatttttgtctagaatggtttattctcaaaagagatgaaaataatagtgtttccatttatattgtattatccttattttctttagtccctcagaaatgctctggcattatcaaattaggcacattcgaactaatgtgccatagaactaatcaaactgaaccatattttgttccttgataataccctggactctcatccattaatgtaacagctgcactacttttaaaggagactgagaacgcacgctgcagactttcagcactcggtagctgcaatcatgattgtttactgaacactcatactctgtatgtgttatgtggtttagctttctaatgtcaacactcattcactgtagataatcatgagtctgcagcacagagaggcagccctgctcaattcaaaatcttttattctggttgagctttctaactctttatcaacactaaactctcatatcaaatttctgaatacatctaatgaaagaatcatttggaaacctttcctcttgagtaccaaactagtatttcaacattgcataaccctgctaacagtggagtgctattcaaagtttgtcattatgtctgaaacatacatctgatgtggcccgtacatttagatgtcctccttgtttgagatgtgacttacactcttatttcccctgcatacagttcagtcagttcagtcactcagttatgtccaactctttgtgactgctggactgcagcactccaggcttccctgtccattaccaactcccagagcttgctcaaactcatgtccatcaagttggtgatgccatccaaccatctcatcct

SEQ ID NO: 36485 - DNA, 1580 bp, Bovine  19866880704805
ctcctgtgaggtactgcatgttgaattatgattaaaatttcttaaaacttctgcttcttttactttctattttttgaagaaagaagccaaggtacctatattttaaataatattttgacatggtaaaagaattttatgttataatccaaggtgtggaggagaggccatggaacaatccaacaagcagggaaactaagaaacatatggtaaaaagttctttttcttttgacaacctaggttgatttaaattacaaatcaacaagatctacattacataatatgttttgtttttttatctagctgcccggatgctcagaactaaatcaaatgtttgtagcaactggtttattgcagctacttgcaatacaaatttttctctgctttgcttccttgttttgtttgcttttttctaaattgctattttgaataccatttggaagtactgatctaaattgtgaatattaattggagtgattgctaacatcatattgggcttacatgtgccgacaatgttctagaccctttatattaactcatttaatcctcactgaaactaaatatgtacctctctctggctttgggattagtgaatttatttataaaacattggtagcatcaaaggacatctgttttccctttatcaccagtataagcttactaataatttcagtgcttaaaacccatcaaagcatcgaaacagccaatttcaaaaaatcatgtacaaaaaatcaaatccctagaagtcacctctctgagcctcaactccttcttctgcaaaatgagtataaaaataatgacacaaaatactgttgtaggtagttctaatgaaaaattcatgtagaatcttattgaaaaatttaatgtgataaacaaatgttatcgttattctgcaaaaagacaagaaaaaaattgttatcatcttacacatctcatgcattccattgacaaatcattttctgcaaaaagtccagaatttgaccacttttcagcacttcacttctggtcctgggcactaccatctctcactaggaccattgccccagcgtcccaatgggtctcctggtttacacttttttcctcctccacacagcaggcagagtgattcttttaaaatacagttcagctcataccacttccctgctcaaaaccccataaggtaggcagaatactgaccttgcaaaaatatctgcgtcttaggaacttccctggttgtccagaggctaagacttctctctcccaatgcataagaaccaggttcaatccctagatctcacatgccccaactaagagtttgcaggccacaactactgcacacaaggcccagcacagtcaaataaataaataaaaatccttgattttccagatgtaatcacaagagtctttataagaaggaggcagaagtcagaggagatgtgacaacagaaatatggaggggtgccattactggaagggggccataagccaaggcttgtggggggcctccaaaagatagaaaattctctcctaatgtccccagaagaaaagcagccctgctgtcactttgattttaaccccatgttacagattaaattgggtctccc

SEQ ID NO: 36486 - DNA, 1065 bp, Bovine  19866880710824
aaaattcccagatatcctcaaagacatcttcccaagtgttgataatcccccttaatgaattgcaatcaaaatcccatgctagataaccgagatttttagataaatccttcttaaaaattctgctactgaacatagtataatcatttacaaagataagaaaaatttaataaaacaatgttgagtaatggaactcttaaaactttcatgcatgactactagatgagacctagcatctgctgaaaagtctatcatttacatgggtaagcacatttgtgattcattattaaaatggaaaaaatgatgaaaacatctctgcccaattgaaaaggtcttccttcaccttactcagcttccataatgaaacttctattattactttggtttttgtatcttattcagattctcacccaaaatattagccaagccatgtattatcagtgctttttcactatttaattaggttaaaaatctaacctttttattaagtacagattcaagggtgagaatcacaaatatgtctgcatgaaagactcctgagagataatgagcagggggagatttctattaggaataaggaagaactgaattagtgaactgaatctatatttctgttgctaagtttcaaagctgcctggttctttatgtttaaataagaagtaactcaaataggcaacagattttactgagcgtaaactattccagacaaggtgatacatgaaatatattgcaatacacagaggagagtaacacatactctaattttaaggatttagatcagattagaaatatgtacataaaagtattatgaaaaacagaaggaagtgtgaaatacccacgtgaacattaagtgcttgaaggaactcagagagcctttgtttcagcttagtctagagaggcttcatggaggaggtgggatccaatttgcatttgaaaggatactttgatggacatattgttgcctaaccaccatccattcagccttctttgcatatttttcagaaatcctctcctatgcaggacacatatcttagggaaagcaaactctatcctagctccaagggagac

SEQ ID NO: 36487 - DNA, 1396 bp, Bovine  19866880711994
ctttgacttatttactatttgttgctgcaagtagcagaatttcattttttttggaggagtaacatttcactacatatatgtaccatatcttctttatccattcacctgttgatgaacactgaagttgtttccatatcttggctattgtaaatactgctcttatgaacgctgggctgcatgtatacttttttggtgtttttgctttttgggggacatatacccaggagtggaaatgctgggtcatagggtagttctactttcagttttttgaggaatctccatcgtgtttccacagtggctgcagcagtttacatttccaccaacagagtgcaaggattttttgaagtgatttttttaatttctgatgccagcctttctaaatacctgaggatcctgtgggatgcttgcttagtggactgtgacccaggggtgctggtggtatttatgactggtttcttttaattagtctgtgcccggccagtgctgcatactttcaaaagattattttgttccatctttacaacaagccaatagagaaggtgttatattatgaatgaagaaacagactttagtgcttctgaccttaaacactggaccacaccacctttaataggaaattagagatgacagacagtaaggataatacacttcctcaaatcttctacttcctaaaatatatctagcttttatgatagattctattttagataaacctaggaaacaatacttttaattggaacttgaaagttttcctgctaagcaaaataaaatttgacttacctggatatattaagacccaggtcctaagttgctattatgataacttatctaaatttgtacaaggaagggtctcccttggtcactcaaatgaaagaacaagaatcaaaaatgattttaaaggaaccagtcaaagaccttaggtcttaggctcccttttgggccatagaggtccagtgacctctccccaggcaccccattcaggaaccccaaagggcagtaagcttttggagagctttgtcaatgggaagagagtagcaaaagagacagttcctttattaatattcaagtcctatcctttctaggagaatttgctggagaatcccctttacagatcagaaataaaaagggccattctccttgcgacccctccacatctccacagtttagtgccacagaaggaaaggtaaatagactggctgggtctcaaggctaattttaggaggattagagtatttgcaaattaggtccctcaatccattttttccctgtatatgaaaagcaacatatttctgcactattcaaaagaaaagaaaattagtgcgagctgccaacagctgtctgacaaccttgagcactggggtatgttggcactggtccagatttcacatacggagtt

SEQ ID NO: 36488 - DNA, 1115 bp, Bovine  19866880742960
taaaccttgtcctttaaacctattaatactttgccccgagaaacctgcccctcagtataggaggggcctcagggccaggattttctctgcttgagcttagaagggcctctgcagccaatcgtcagaaaatgtcattgctgctaaacagggacaataaatccccaagctacccagtaatgcaatctccctcaacgcggaaaaaggtcaggcttgaactgtaaataaattcctgtcacacagcagcgtgtcttttcaggtggggtagtaaatcttcctggagatgagccaccacacacaccataattctcttcctgtggccctggtcttcattagttaatttttctacaactgctttttcataaagtttgggcgttaacattcccttggtgtgtaaagacctcccagaatgcacagcctggatgaaagtagggtaggggtggtgggctccagagggatctatactctaaattataaacagaattcacagagtataggctgtaaaactccttgatggacagaaaatttggatttacagcctgtcggtatttaaaggaagagagaaaatacttgatgcttcctttgatctacaaaattccttataaatttttgtatcaaatcttttaggatgctgtaaataaataaataaacccaacatgttacaccctattactcatcagctttctttaacaggccagaagttagtacttggaatcatatacctaaagtttcaattctgattcttttgccagttgatcagtatttatgaagccaccaaagtataaagatacaaagatggatgaagttggctgctttaaggaattcatagcctggctggggggagaaagacacacaaacaaataattaaaatataatatcatcatggtgctatggcaaaggtttcccccaatggcaataagaacgcagtgcagggagctactaatgtctgtggaatccggaaaggctttgccaaggaagtggtatctgatcagacttttggagaataagtagttttactctaggtagaaaaataaagtttttgcaaaataaagtcttatcctagatagccagatgagctgtagtactccatagaagtctttgggctttgatctctgatt

SEQ ID NO: 36489 - DNA, 1486 bp, Bovine  19866880743394
ttttatgggatgatttaattgccactggggataaaataaatggcctttgaaattctttccttgccttgattctgttctccctgacttgatttcaatgttggccaccacattgcttagcaatctgtatatacagagaggattgggctaggaaacaatagaacatggtgagtttaatgtagatattcaaatttaagttctccctcttactgggtcataaaatctcagcaaggaaggatcttagaactcatcaggtacaagctaagtccagtgtttaactcaatccccacccccctctcttttagcaaatattcatttggtctcatgtgttagcaagtggagaaagctcatggtttgtctgtgttcactgctctatcgtgaagatttttccctactgctgttctcttcggcattttgtagttgcttattcagtagacttggacagacatcaggttataaatgaaagagaaaagggcaagccatctcaaagctgtcctctctctcacataattcattacagaccccctggtgcacagttgacatcttaggtggtatttgagcacatgaaagtcgaccttagtgctttgcccttagtctgtggtcttattaactggctttcaatacattcccccccatgtaccttaaagatagtgaaagatggagaaatgcttctggactcttctaagcaaataagaaaacgatgggcctgaagagtaagggttggcaagaacatgtcattagtagcttgatttgaaggtggctcctaagagctcagtaatttcagtgagtgtctgagaaaagatttggaaggggagaaacaatccatgatggatgaaataactgacagaagggagtggagaagccaagaagaatcgggtgaaaatggtgcttaccctaaacatatccaggactgacagagaataggggcaaagtccccatgcaagaacggcactccatgcctaatgacccctgccatcttgttacttggacttcacttagctgttttattttgtcttgtgtgtgataagttaaatacttgtctaagtccggccacaagagtgaaattaagagcagtgaaccacagcttagtcagtcacctttgaaggctccaggaccttgctccttgcctcttatgcagagagtcagtgttccaaataggcttagtgacagcactttttcatttggtaaaggacctgtacttagaaatggtttttaataataattgagtttaggaggaaaagaggcaaaaattgtcctgttcctcagtacactcagcaggaagaaaatagagcaaaatacggcatatgggagaattgtcttctttcccggaagtcacaaactgacgttaagaagcaacagaatgtaaaaacaaggggccattttccttgtttcattatcaaatggatcctgatttaggggttcttggagtaacctgtttctctaggcctaaccagcctgaggttaaaaagagagtcataaagacagaaca

SEQ ID NO: 36490 - DNA, 1495 bp, Bovine  19866880765644
tgtcccagtgactctcatcaaaaaaaaaaaaaaaaaatttggaagctcactggaatggcagcagcacagatttcctgcagaacttcaaatcaaaccagagagtcaaaagcacaaaggcagactacgcctgaccagagaaaccagtcaagttgtaacgatagctctggactcataattaatctcaaaaggctagctgggcaattaagcctgggtttggaattagatattaaaatatttttaatgcagtaataaagtagagtgggcttttgttgtttataaggaattcaaaactagtcctagtcttcaaaagctcttccatttccaattttaataggatgtgacataggcagccttgaaacagaagttatgatacgggtagatgtttaagctgctagagagtgcagcttaaatgaaagctcttctcgatctcttgtcctaatgattgttcctttcaacttagaagtcagagcctataggtaaggctctaagggctttcttttcacctctgttttaaccatcaagtcttcatcctttgtttatttgcatcaccctgcccataggtttaagacttgtaaagccaaacataagcaaaggaaagaatgaatgtgcccattcttaaacaagcttaaacaaagtatcttcagctaattatcactgctggacatacattaatgggtaaatagcataaattcaactcacatcttgggagatgcttctagattcctcaaatccccacatccgtgattgccatcatgctgtgtgtgtgtactcagctgtgtctgactctttgtgaccccatggactgtagcccgccaggattctctgtcagtgggatttttcaggcaagaatacaggagtggtttgccatgcccttctccagtggatctttcagatccaaggatagaacccaagtctcgtgcactggcaggcatattctttaccactcagccaccagggaagccaccatttgtaagaggaggaatacctaaatgcccttcccagacactcttaagagaggaggaggggtaaaatctgatgagtcagaatccaatagtactcaaagggacaagtttattaacaggttttaaatatccacttgcactgaactttaatccttagcccctgttcactctctataggagcaacagtctgagtcagggctgtccctgaggcccagtagcctccctgcttcccatcacatgccccaacctgttggtcactaataaaatttcctccaccgggggccaagcagaagtgataaaagattccaaacttgggatgtatgtttgagggcagctgggagactccttttaggccaaaactaagccaagagctccctctgttcattgctagccccctgcaccccaatcatgatgcgattctttgttttaccatctgctattggtccctatatctccctcaggctttcctgggtccctccctccaaatactactaaaactctgcctttgacttcactaaccatataatttcacc

SEQ ID NO: 36491 - DNA, 1034 bp, Bovine  19866880768031
cccagggactccatgcctgacagaaggctttcattagtgctttttagctggttataaattgttggtactactatttgcaccttttaagatactatccacgaagggaaaaagcagaggtgtttctatagcaggggtgtctttttgagtggatgaacactaaattcggtcaccagaatgtgtgctggaaaatgaatgcatctctaatctcgaataaggaagtggttaaaaagggatgaattccctgagtcattaaacaggatataaaccaaagacaggttgtgccacctagagaaaaactgaaaagcgtacattcgttcttcagtagtaggcattatttccaaagcttgaaacttttggcatgaccaataaccaaaccaccctccatgcccactcatcactcagctggcttcagctccactgaccactctgccttctccactcaccagatcgcaactcccacctgctctccccgcccacgcacccaagcagcttcatttaacctcagcactgacggctgcacagcccttgcggacccggcatcctgaaacccttccaatcctaaagcattttcctcgaagcactgcaggccagggtgagaggagccgaggaataaagcctgtggaccatgccagccatcctcccgctggacgctaacacagccgcggcgcacacctctctagccgccgggggctagaggaaattctggtgcactcagtacatcatatccaggttaccgagctgaactccccagccgacctccgcacaatccaaacactgtgaaatgacctcaacagaaccgagccttaaaggtggtcaaaggccttcaactttcctccgccgcaagccacttaaaagcaacgtgcccagtacactggtcaggctgaagcacaaaaggtctccaggccacctggcacggagagccgctttttacgaagaaaatagacagcaattatgaaaagcccgcagtcctgcggtatgaacttgacagcggggattgcgctgaggcataactctcatttccgaggcatcactcc

SEQ ID NO: 36492 - DNA, 704 bp, Bovine  19866880769032
ataggccgtggttttaagtgtttccatgctctttggtactaagtatagattggtttgattttcaagcacacgggcaaacaatgtttcctgtgccagatatgtatttttgcacaaaatagtttgaaagctctcagcatgaacactccaattgcgactgacctctgtcaggggtggcaatggcaccaagacatggagcttgagaaatggaaatagaagagagaaattcggagcaacagggaacggcagtgaggaaatttcaggaaatacaaaacttaaagtagaggttagaaaaccaaatgccttctggagaaaggcaggtagtgtcaatgggtaaagccagcctcctgcgctcatgcgcacacatacacaataacaggaagtggtggggactgaggtgatccatcagctgggcacaggtttcctctgaaagggagcttgccggggtgcgggggttggggggaaggctctttgttgtcatataagactgggggcacagagcggtcagatcttacctgattttaagaaaagccagacatctagatatttatgtgaaatctcctgatttgtaaatattgtcttttagttcacatttccaaagggcactatgcaaaccaaacaaaacagtatctgcaagctgctttcagtctttagaccccacctcacaacttctaacactgctatttacatacaaatagttttaacta

SEQ ID NO: 36493 - DNA, 1065 bp, Bovine  19866880778350
ctgagaggcagggctgcatcacggttagtgcacaagcgcatgctggcttgcctgaatccaaatactcattcgtttgccagctgcgagaccctcctagtctacaatgagtctgctactcataagtctctgtgtccattttttccctataccatgtgaatgataataaacagtactaaattcatggcgttgttgggaggatgtcatgaactaacacatgtaaagcgtttagattggaagcaggtacccagaaggtactcaatatgtgtttgttcccttaataataataaggaaagagctccttgaaagctctggaaactccagccctgaaagctaagaatcatgtccctccatttagcaagaaaagttaggatcaaagcctaagactcttggaaccatcaataaaagtgaaggtcaaagcacaacaacttgtagcatttctgcctcttcttgattagctctggcaatgcagaaaactgacactggattaacacctgcacatgcttacataccacgtagggaagaaaaatgcattccgttcaagttgattaagaccgtgatacagccaaggtgggcaagcagctgcttcagaacacttgcctcaaagcctagcatacgcacaagtgggagatggcatttgagatcaaacagtgcagtgtcgcctccatacggatgttttcacaaagaggtgacaaagtgacaataagcctagtaatgtgaacagatccagttataacaacacaggggatattaatactctgcctcgggacagtgttagaccagtgatttctttttgtgacttatagtatctcattttcctgactttgatcctgaaatacttttttatattgttctgttggtagcattggtatgaatccaaacacatgcacacacatcagtcagggctttgtaaatcccagtaataataatcacctgccacaaaatgctaggattcatttttctataaaagccaaatcctttgcaaagcaaaggaaaaccatcaatactgacaagaatatactgccgagcccttgtgctgtaaaatctcaaacaaacaatagtttggaa

SEQ ID NO: 36494 - DNA, 1523 bp, Bovine  19866880780398
aaactgatcctccagtgtgcctgcatgtatgagcagaaaaaatgcagttaccaaatgttagctccccaacacattccaacaaattgagtcaggttagagcatgtatcggagaaggcaatggcaccccactccagcattcttgcctggaaagtcccatggatgaaggagcctggtgggctgcagtccatggggtcgctaagagtcggacaagactcagcgacttcaccttcacttttcactttcatgcattggagaaggaaatggcaacccactccagtgttcttgcctggagaatcccagggacgggggagcctggttggctgccatctatgggttcgcacagagtcggacacgactgaagcgacttagcagcaacagcagcagcagagcatgtatgagtgccttttgtgcaacatcacaatagtgcttttaagagcagagaaatggggaaagcagggcaaaagtctgcatgcttgacctgcgtattttgttaataatttaagtgaaaccacttagcacttttgctttctacaaagagcagggacctgtactcccactggtgtattagaactctcatcagccacaagggaacagagagctgtttgaaaaactgcatctctccagcctctgataattaaataaagcatatcattgaggatctataattggtagagacggctaagactagaaaatgagactattaccctctggaatcatcttatgataaatgatacatttattttagagaaataagaatcaaaacacataggaataggaaggaaagttaatgcagttctaagtattactattcagcagagttgacatcaattggaaatgaataatcatgaaatgtagaagttataagaaacaaaagctttaagagacaaaaattgtaaatggattataagaaaagaagtctcaggttttatgaagataaaacttagtcttgaatacaagggctgtacaatgaatatctgatgtacaaattcttggactgaaaagcagggcataaagaaactaaatgcaaaatagaaaataaaagaatattactttttcaggtaacagaataatattttgaaatataatcctaaatatgcatcatccctggcaattcttattacttcaaagtcctttactcagcggaggcattcactgcttcaagaagagagcaggcccaggcagtaagaagaagccattgccatcttagattttaggtagccttattttaaaacaggtcatgaaaacactgatttttgcctttgttacctaaaggaggtacttttcctggactccaaagatgtgctttaaatatcaaagctagcttgaaggacttggaataaaaatccacaatgagtctggtagattttgcccactgagatcaacaccccaggagaatggacaggaactctaaaaagactcagcatccaaaagcagaggatggtccctggtcaactgaaactcccagtagttccagggccaaatcaagaaggctgcaacggagcagaaatgccagattcaggcag

SEQ ID NO: 36495 - DNA, 1202 bp, Bovine  19866880792863
accaccctgtggagagagaagaggaagcttttagtatttcaccctttagtgagttaatagggacattagttgtttaaccatgggcttattactcgtacaatggccatagtcctttgcctcctggagacattgtgaaatgctgaatggcccagtccttgggctagccaggtctcctgcctgctgggaagagccagcagccatgagagccacactctgcagtctctgctcactattgggtctgttttcaacagccagcaggaacacctgcacgcccggcccttctgaggtgggcgcagctgctgtgacagtgacacatggcctgtggggcaggcctggcacatacttgtcagtccctctgtggtcctcttttctacagcctttcccaccctcctgagactgttctttcttctggatttatttcagtgacccttgggggttgaggcagtttattttgccccgcttcctggatctagcatttattgtctgcaaatactgttatttgcaaagaggactagatcctggtttttagattctcagtaactggcgaatctgctgtgaccagtgctcaagctagcgtccatgctgctttctatgaaagggttaacctcaaggcagcgtgttgtgtcagccccgctggtcttccgccagcttccctctgatgggctgcgggctaccatattaggaatgtgtgaagattcagctccccggtgtacacagcaggagctctcctgtcagtctgaaaggcaggcgctatatttagcatcaggccccagggaatagcagctccacgtgggagggggctgcgggaatgcagttgtgcattgaatctcaactccaatccccacggaggaggctgaagccctgggaaaaagctgggctcttcctccctccacctcctccagtgtctgcatggcatcttttccaggtcagggaagaagtccctttcatctctgctgtttcttttaacatggaggaaaggaaccatgattgttggatgaaccatcactcaaaatgttgtaaacagcaatttgtctccctccagccctcttctcccatatcgagttaactaaccactaatatgatgcgtggaataattttattgccttatgatctctctctactgaggaaataagagaaattgcctccctttggtttttgcagaaaatgtatactttggtactaaaaaggttttatttcacatg

SEQ ID NO: 36496 - DNA, 725 bp, Bovine  19866880804274
aataccctgtagttggtattggagccatataccagttttacaaaattctaaaaagagaggtccccaaattccatggtacttagtggaattaagggagaaattattggatgcagtgttcaaaaagccacggaacttccccttatagattttttacctagttttctcagatttctaatttctggaattgtgttctttcccctcatcccacttatgaccctttattttaaaaaagagtgtactcgtggctcctcttatgttttctaaacctgagatagtcttccccaatgcaaaaagggcaatcacaccaactatttttacttagagatttaaatagtgctcacagattttaacatctctcctacaacattgaaatagacacccactccctatttctctcctgtatttcactgtcaatctttctcagcaagcatgccctggttttcctttcttcatcgttttattcattgcttaattacctgccagagtgatcctcttcattatccctctgaagagtccacggacatgaggacctcccagtcacgcagtattcattctttttccctgatgcaatcgctgacgctgatggtcacgtcttcacagtatttcagctttccttctgcctcaggtcatctctgtgacattacaaggctgtcatttagctcttggactgctgcttctctctccctctcttcctccagtccttaatttttgcaaatggtaaggtt

SEQ ID NO: 36497 - DNA, 1708 bp, Bovine  19866880826840
ggggctgtctagtggctttttgctttcttcttaattctcagttttccggaagttgaggccaaataactgagcagtagatagatagatggaataattaagaatttggtcagtaaattactgagaagttattagaatatataaggcttccccaatggcctggtggtaaagaatctgcctgcaaagtcggagatgccggagatgtgggttccatccctgggtcaggaagatttcctggaggaggaagtgtcaatccattccagttttcttgccagggaaattgcatggacagaagagcctggccatctacaatctatagaattgcaaagagttggacacaactgagcatccatgcatgctttttggactacatcccctaatcgtattgtttttgatgttttattacacacataatatattttcatctttaaaaatatagaaaagataagctatttgaagataataaaaagcatttgtaatcccattgctctgactcaaaaccaagaataattttttgacatccttctgcaacaaaaatgcctgtttttatatatgcttttgtgtttggaaatgtgaagtctactctgtctttgaaaaccagaaaaagcaatatttattctgtgccgcacctgatattttctttgcccagcaaatgttaccccaaattacatgatgtggtaatttataatgttacctgactaatgctttagctacctggtttaccttctatgaaatgtagattgaaaaataataggttttctcacaaaggtgaaaatgtttctcttagacataaattagtttctatttacaaagctgctatatttattcagcatatctcaaaggaaaattgttttccaaaatgattgttatgagacacacatttcttcatcattccgtcagagtcctgtaatggatttgatgcagatttcttttagagaggcttatcttttggtcctaatatatagggacatgctgggaattgcatgtctgcaaatatcggggtcttggggaagggacatgagaagagactagtatagccagaccaggcagtgcagttgtgataagaatactctcacagctccttctggctcctggttctccttcttcccctttgcctgaccatctctgagtctcagcttcctctctgcaaaatgaggataatgccgttcatacataaatggttgttcaggatttagatagatcgtgtcatattaagttcttgtcccaaagtaggacatagtttcagttcaggttttggttcagataaggaggtgaaagcaaggaaatgaaaatgactgttctgcaaaaaggctgaggatatggggggttaggtagtttctgaagtcccgaggccacagttgagggcacaggaggatgggggttgtgtggtcattggcagggagagagtgcctgttggagtcgctggggagatgatagccgtggtggtctgcatcattagtggctccagtgaaccctgcctccccgtgtcctgcccttacatatcctccttctcttgaatttctttttaaagagttttgttgttgttactgtttagccatgccatgtggcacatgggatcttagttccctgaacagggatcaaacccgtgcctcctgcattggaagctttgactcttaactactggaccaccagggaagcaccctcttcccttgattttgatctgagtctgtgacttgctttaaccagtaaa

SEQ ID NO: 36498 - DNA, 1526 bp, Bovine  19866880842375
atctatgatctttacaaccgaaaaggagattttcctcaactccttcaaaacatcatccatccccacttcaaaggttaatatctacggcctcacttgaagaattcaactgaaaaccattgcaaaaataataacaacaatcagggactgcttccagttaagagggtaagggatactataaagaagacatagtctcaaaatacataaatgacttcgtaaaggacttgaatgaacaaaagtaccaagtttataaatggtaaaaggacaggcatatagttgactgataattcggccaagagataatatgcttaaatgagtcttggcaagaatcacttaaagtgctttggctggtaggtactgagtgttctttattagaaatgactatagattaaagagatatgagacaagtgagtaatacaaagcagaagaaatccttaaatcaaaattgacattttaataactatgctttaagtaaatctcccctctgaagtcttctaatgtttaacagctgcaagtaaatatgacaccaggtgaagctaatcaaaaagtttaataacgcaggaaacaaaagagcagaaaggaaactgaaacaacccattttcagtacctctaggatttcaacttctctccctcttctgtcctctcacccacccagcagcctcctcgccaagaattactgagcaagcccgagtgcattcaaaccttagctgtcatattgcatctctctgtgcttggtgagtaatttaaccttctaagcctcagtgttcatgtctgtaaaatgggattaaatcacctgatagggttgttccaagaattaattgagtaaatatatctaaaggcagagtaaacacttaataaaatttcagttattgctattattactattttgctaaagaagaagaagaaactagaggaaaggcaatagagaagaaaatgcaggtggacagagaaaagaatagaaaggaagggtgcctggaggcaactcaatttgccatccaaataggaccaatattcaggcagtgtgctcaggcaggttgactaactggccttgggtttagatcaatcagtaccaatgccccaactagtctaaaaattttgaataccatccctgccttggcttgtgcattattcaaccacaaagaatctttaaaatggcaaatctttaaaattctttaagaaatcaatactgcaacacatattatagactgggaaattgttaatactttatcccactcctgggaatttattcaaatacaaaagaataagctttagacccactgatatttatggagtttttattaatgaagacaaaacatcacaagcaatgtcaaaatccatcaatgaataaatacattgtcattctttatttcaatggaaattatgcactattaaaattataattatgaataacagaagcccatagaaatgtgaagtgcttatggtataaaacgcagccaaaaaaggtagcatagaaaactgtgaatacattctgatataatctgcaaattatataaggatagaaacaacag

SEQ ID NO: 36499 - DNA, 1467 bp, Bovine  19866880853311
aacgtgagacagatcaaagagttcagaacacagcttggcaggaggcagccagagactgatacacagggtgtggtgggcagacaaaaagccagggatgatcagaagcaaggctaaccaaagaagaaggaaaagtccaggaaaatctcagtcactgaaatcagagagggagaggacttcaagggggcacacctgcccatagagattttcgagggaggcagggcactgaaaggattcatgtcaactggtccttagcaggttagctgtcatgggtgacctgtgttagaacggtttcagcgtagtcatagacaggcacaagacactgtattaaaacaagttgaggaggaatttgatctgaagaaacagtgctctgttttgaaaactctctcccagagagttttcctaagaggcaaaggcatgagataagagggcactgaataaacagtggaagaggcattttttctggaggacactcttcctggaccaaagggaaggagtgagccaagaaaaggtctgattgaaagaggtctgcacttctgcaggggtcctcggatgaatggtgaagacagtaactttcagccacgaagatacctttattgcatgtctaagagaggtcgacaaggactctcctggtggtccagtggctaagactccatgctcccaatgcagggggctggggtcaatccctggtcagagaaatagatcccatgtgttgcactgcacaaccaaaaaagagaagaaaaaaaaaaaaagaaagagagaagtagatgcaagatatctgcctggacactagcccctccaaaatctgctctgaaaacaaaccccagatttaagaggacgcaagggaagtctgtagcacctgcacgactgcctctgcccctcaatggagctgataactttaaacgtcattcatcacaggtgctaacttagagcccagcaccaaacatccttcttcctttttagcacattccttgatatttttggtatttccctttcttttaattgtctgctaatactgtccatgggtttctattaaaaaatactttttgctaacttaatgtttttagtccgctttccttcatttcctctcttagtccatgttcgtcttcctttctctattttattactttgcctgtcggtacatgctgatgccttagcttctgcttcttccctcacctccacctcaactgacctctctcaaaccagccaccgcacctcacaccagctgccacacccttccggtgtcctccatgaagctggagaggaggtgacctgctgggggacagagagatgacggggtgcacgtagcttgctgtgaatgctaaatccaggttggttcaacaaatcgggcattcacctgctcagtactgataaggattttgaaaactgttccatatgcaaaactggtctcaacctaaaatgtgtttacagaacagctcaacaggggatgtttcaccatcagctcacatg

SEQ ID NO: 36500 - DNA, 1333 bp, Bovine  19866880887043
ttttacagatgaggcttatagaggctgagattccagggttttacatagtgatacgtgacagaatcagcagtgagaatcaaggctcaccacacttcattggctccatggcattagaatataaatgaccagttacaagtagcattgaatctaagacctgtttgtcctttttcctttttatctcagcattctgctggtgtggtggcctctggtactttatgctccagataatattcctgcttagatccgctgtggctgtggtttcctccacagtggttactcaggaatcaaccttttctctcaggtcaaactcagtatttgaaaactttaatttccttcaagttgacattttaccgtttcatagtctcaagcctcctgcagtttataaaggagcgatttaagacatctactccccacagctcagagaacaattcatttcaatcttgggacattgcccagaattcaagaaaactagatgatcctttcagactggcttttcatttcccttattgtcaaaatctctgtgtacagacacgaactactaggtaagcggtggggaaaaacagtgttctagataagagcctttacttggtgttttgtgttgggaaaacaaaaagtccagataactgatgagtttatttattcatctggatattggggatcatgtatacattggaaaatatattctataaggatttattaccatttaaagaatggtagtatgaacccacccaatttaatcttaatacaatctgttcaatggatctaaaatcaaaccagtgagtctaggaaaaagaaaagttctaattgtttgttccaaggaatgacttaaaaaaataaatgttagggaaggttctataatggtcttttggtaaccaaaaaacattcatagagcagagagaacaaatacagtagaaatgtcaccagtgacttagcttgaaaagaacaaaattatagcattctcctggggactcattcttgataggatggttattgatcaaaaacagtcttgaaaaagtgataaagagactctgaggttgaacatttattttccctgttccttaaagtctgcatatttactattggtcactttttaaaaattcagccaaaatttagagttctcagcagctaacctcgtaagacatttaaaattaaattcaataacaaaattctattactatattaaacatcattcaggtgattcttttaaaaaataagtataaaaacccattgccccaagtcaataacaactctatagattgttctaatgaaaagtaaggctatttataagtgtcagagttaaacattatttgcaaattaatattttttaacatgt

SEQ ID NO: 36501 - DNA, 1231 bp, Bovine  19866880923950
ctttcattcatctgtgctgctgacttgtattctttaaagcagggaataccacagtcaagattcctcagtgaaaaaagttttcactaagatgaccattgaaattctctcaaggccttcattattttggtccttgtctgtcttactaggggtaccctaaaatgccagctgcatgtgattttagtgtgtatttgtactcagctgagcacccaggatacaacagtttctttacaaagtcagccacatgctataattctaaagcactgagctgtatttcgctatctgcaattattggacattaagggcaacctggccttccagttggtatcacgccagcctcaagagcctccaacagccttctcaagccgatgttggcagaatgccactaatacagtgcctgagagaacacccagcgctctcattctcacctagaagagaacagctcctaaagagcaaacttattttttaaaagctttgttgaagaaaactggagaagtgaaagaagcagcactggaggagacagtacaactttgcaatcggacaatcagccactgccctgttctcagcaaagtttcttaatcctctgagtctccagggtcctcttacttcatctggagctggaaagaatgcttatttaacagagtgctgcgggcattaagtgtgagagtggatataaagcacccagtcgggcacataattattgttctgtaaatatttgctattacgatcactgtattcctacttcaagattcgaggtcatcaacaatttatgaaatgatctaaaactagtcatatgtcatagataggatgatttttcagtgaaaatgaatttgattctcactctcctcccccaaaccaccatgacttttaaaatctgttcaccacagatttcaagaaatagtgcaacacagaaaaataaagcacaggctttggtgttagatcaagattagaactgcaaaaccataaatgttgccccctttcctgtttctaggggtacccaggtttttatttaggtatcaatctctcctctccacagcccatagtctggagggcaggctgactcagacaatggacttaaagcgcctatggaagatcccatccccctttctagagtacttggttcaagaaatcagccctcagccaataggctcatttagctggtaaagaatccgctgcaatgcaggaaaacccggttggattcctgggtcaggaggatccgctggtgaagttgtag

SEQ ID NO: 36502 - DNA, 961 bp, Bovine  19866880961251
aagggtgccctgttacaatgggtggccagcaaaggcttctctgttaagaggatatttgatactggagcagatactagaggcaagttagggagccaagcacctatttaagaagagagtaatgaggatgagaatttcaaatgcaaaagtatgaggctgctgggcatgcttgaggaacacccaggagagcagtgtgactggagtgagcatggtgtcagagtggtgggtggtgggaaatgaggttagggttatgggaggggccatcacacacctaccacactcacagaaagcacctcaagtggcagtgtctacaggatagctctgggctgacttccaagaagaagccattctagactctcgagctctcagtagagatccacacactctgactacagactcgaatcacccagccctgctattctcaaccagaaagacatgtcaggcccttggaaatcgggaagccagaagacatttatgattaacttacacatctgctagataatctcttccattattgtttttatcaagcagcatagactaaacagttgaaatgatcaacttgcttaattgcaacttgaagccatgttccctacggtgaaatgaattatctctgtcctgagttatgtgtttgagatttacatgcgatactgctatcatgattttggcttaaaattactctgattcccctctttctgggttcctgttaaaagttcaacttgctagcactcagtaatcagcacacactggggaaaatagctttgtggattctgcaaataaaatcttttcttaattctattcaactattgtcagatgtcctatgaaagcttgtgatgagaactcaagtctagtcaaaatcaatagtcataatatgctttttccccccaaagagtaagggattaggaggggaacctttaaaaagagatttttgttttaccagacttaagttgtgttttactaagaagca

SEQ ID NO: 36503 - DNA, 2132 bp, Bovine  19866881081115
taatgtggggaaggcatgtgagtcagacatgtagggccaaattaagccactcaggaatcaggcagggaacatatccataggggaatccttcacacccatgggcaaatgtctcagaatgtatcgatgaagtattaatcaagcttgatgctgcaagggaaggatacatttgagttctactctgattgacctgcagatttttattgcaggtttaggagtatccttcgtagtaaagaatctgcctgcaatgcaggaggccctgattcaattcttgggtcggaaagatccattggagaagggataggctacccactccaatattcttgggctttccttgtggatcagttggtaaagaatctacctgtaatgcaggagacctgggtttgatccgtgggttgggaagatcccctggagaaggaaaaggctacccactccagtattctggcctggagaattccatggactgaatagtcagtccatggggttgtgaagagtcagacacaactgagtgactttctcttcttcctttcactcacccatgatcctctcattaaaatattaatataattctttttttttttagcccatggtggctctagtggtaacgaaccttctggccaatgcaggagacataagagacacagcttccatccttggattgggaagatcccctagagaaggacatgacaacctactccggtattcttgcctggaaaatctcatggacagaggagtctggcgggctacagtctacagagtctcaaagaatcagacacaacagaagcaatttggcactcatgatcatttttaaaagtactttgaaccaaggcaaaacaagggacctaggatcaagcagctaaggaaggctttccgtcttctgcttccccagcctgatggatgagcttttgcctttctgccatccctggtcctttactttgttttgcttttgacagctatggacctcgggagaagccaaacaggtttagaaaccagtttggtcccagcagacctgcccagtgggaactcacctgtatacacacaaatctggggcagtgcctgcctgggcactaggaagtcagcccaggttcccagggagccctgagacatccagtctaaacagatacatcaatctgctcactgagaagagaaagctggctctcccaatataataacaggctggctgatttattattctgaactttggttcatggcagggggtagtgttatttgtgccagtttatggtttggggccaaaagatgaaataccaagctcgtctgattggtttcaagaatccatttgcaccaacagagcttctgcatgtgccaatgtgtgttcggggattatgacacgtggcttagtctctttggcaaagcccttccgagaaggaaattacaagtcttcatatattcagaaccatttaatagctggcaagctactgccaaccacctatgctattgccaaatttcctgaaatatcttcaagggttcatccttgtcaggttagttttagagctaaataaacacaccacagacaacacatgctacattctctccaaaagaaaaaatgattatttatctctagccttggtccttggcagtataaaccccagatgggaaaagaacactctatataaaacattgtggacatccatgtgtaaccatggtctggggaacagtccgggaaatgacagagaccaaggttagaagtataactccaccgtatgacagcttcatgtccttcagaaagtttcataaccctggcaaacctcaatgacttcatctgtggaacgggagttaaatgttgttagagcgagtggttctagataagtcacctcacacaagtgagggaggcactcaggaaacacctacttctcaaaatggcagggtctgatgaggaggcctcttgatgtagaattcgctatgaaacatttttacatttgtgtttacctttcaatcataacttgaaactaatacagccatgttctaggttagctgaaagacccatctggattcgattgtaggcctcaacttggaatctgcatttatagatatccatacattggcaacaagtggtattacttgaattgccatgagctagggaggagagaggaaataagatcgatacaaggaaacat

SEQ ID NO: 36504 - DNA, 1654 bp, Bovine  19866881094277
ttcttggagatagcaataataaataaactaattttggaacaagaaatgttattataagcaatttaagaaataatgacatgaggacactttataaaaataaatggaatgctgcaaaagctatttgcaaagaattattagtaactaattgaatttaatactggaaaatgcatatgaccaaataagctttttccaagcatgatttaatgttaggaaatttactaatataaagcatccataccaaaaggttaaagaagaaaaataatctccaaagatgttgcacagaaatctttcactttaattttaaaaaaaggaaagaaaaacccttagccaatgaggataaggaaagtgattctttaaaattataatgaaaaattgatctcaaaacaactattaattccagtatcatgcttaatgactaaacactgagattccttatttagaagtaataaagagacaaagacttcctttatcagcactcctatttatcatttccccacaaattttggccaatgtaagacaataaaaagcatgaaaatttaactgtcattatttgaagaatcggttacctagaaaactcaagagaatccactgaaaagattttagaagcagtaaaaaagtttagcaatgcaactataaataaacaaaaattagatttttgtataccagcaaagaggagagtgaaaaagttggcttaaaactcaacattcagaaaactaagattatggcatccggtcccatcacttcatggcaaataaatagggaaaaaaatggaaacagtgacagactttattttcttgtgctccaaaatcactgcagatggtgactacagccatgaaattaaaatatgcttgttccttggaagaaaagctatgaccaaccttagatagcatattaaaaagcagagacattactttggcaacaaaggtccatctagtcaaagctatggttttgccagcagtcatgtatggatgtgagagttggactgtaaagaaagttgagtgtcaaagaattgatacctttgaactgtggtgttggagaagacttttgagagtcccttggactgcaaggagatccaagcagtcaatcctaaaggaaatcagtcctgaatattcattggaaggactgatgctgaagctgaagctccaatactttggccacctgatgagaagaactgactcattggaaaagaccctgatgctgggaaagattgaaggcgggtggagaaggggacaacagaaagtgagatggctgtatggcatcaccgacttgatgggcatgagtttgagtaagctctcagagttggtgatggacagggaagcctggcgtgctgcggtccatggggtctcaaagagtcagacacgcctgagcaactgaactgaactgataccagggaaccccaatttggggcagatgaaggcaaattgccagagggcacacaaggagacttctgtaacatttattgaggaaacattatagagactgaagcagtagcatggtctgtgaatttaatattgcccttcacattccaaaaaagcacatggaggtctaataggaccaagtgtcagataccaggagagggctcctggctcagggatagatacatgacttataaatgcttaacggagaaacaccagtctctcatcaagcagatcaa

SEQ ID NO: 36505 - DNA, 1053 bp, Bovine  19866881140884
ttagcagctagattttgagtcttttacatgtaaggaaatgataaatatttaactatttttgcttgaaatgtggctcattttctttatgtctgcttttgctttatatgaagaacaccataattcctctttgtcacaatgctataaagttccatttattcggaatccaagagcttaaataatcacattttctttctactgcaggtgtatagggagaatcagtgttcaaaataatgcccttcaggcactgcaagaattagctcctaaatctccaaaggaagattacattatgttgtttatagcatcagtgttagaatattttattctcattcatagaacattggtacagtactcaattttgtgctcatagcacccaaaccatcccagtttacatacttgctataaatgctgtgggattttcatgcctctggaaataggtataacgtttatttagtgtgtttatgtctttggattcatatttttgtgaaatttagaaggagaataggggcaggaggtggtcaggagacaacttggaaaccttgtggagagtagttaaagcttcgggacttgaagtgctatgtagaaagggtcttagaagcattggattggaacgttagtaatttggagttacaagaagggaggattttagaggccagtgatttatgaaaagtggcttcccaggtggtgctgccttccaatgcaggttagatgtaaggttaagagacgaaggtttgattcctgggtcgagaagatcccctggagaagggaatggcaattcattccagtatccttgcctggagaatcccatgacgaagaagcctggcaggctactgtccatagcattacacagagttgaacatgactgaagcgacttagcatggcacagatttatgaaagaactttaattacgatgccacatatgagagtgctgtgaaggtacaaaagtgcaaccatctttagcctctgttattatgattgttggagagggcgatggcaccccactccagtactcttgcctggaaaatcccatgggcggaggagcctggtaggcctgca

SEQ ID NO: 36506 - DNA, 920 bp, Bovine  19866881217680
tgtgggaccaatgatttattaatagcgaagttgaaatacagccgttagatattcaacggtgatataaatgctgtgccagaacaatttcttctacctaaaatgatacttaatgataataagtatactttaatcaatattaactacatcagcgaaaacactggaatttgtcaaactgattttttttttaactctctagggtatattcagccagagcccatgtcaatctggattccagtttaacagcactaatgggagatcttggcctcaatttcagcagtttcatgaaagagaaaatactttcacagaacagtacacattcagatcccatccaaataggctttaaatagacagaaatttcatggtagtagtgagatgcttttagccatattcaaattcccaagaatattgtgggtatgttttcttaatagtgttgacagcactcagctgaatcttgaatcccatccacactaagggttgtggtctgctaatgcagatatccaggaccaatgacagagatgtaaggcaggattcatgttcagcaaaacctgaacatgaatttagaaggtaaatcccttctaaaactgaatttggtcagtgtgctgcacaattcttagagaagcaataattctattgatttcaagataattcagtaacagaaactgaataagcaagatgcttttggaaactgcatccctcactgaaagtttaaaacctgactgctagaatactaattttaagggatttttttaaagaaaaattccttgttttggtttgactttttaatgcaatttcaatttcagtgtgtttggatatatgtcaattcagggagaaagttgagatcaaacaggcagttggctctttcagagacattaccaacacggcccaattaaacagcttggtaagtctattcaatgaatgtt

SEQ ID NO: 36507 - DNA, 1634 bp, Bovine  19866881237970
atcaaaaggcattaatcttcacccttctcttttctccagcaaaccagaaactgtatctccttttgatgcaatgtagcaaataagacactaaaatagcaacagctacttttcatgcacaaagaaacaccactattatttctaccttaataattctgcatcttaaaaagccctccaatccatcctctttgaaaatctccattcctgccctaggctctcaacttacatctcctgagaacactttgcattggttttctttcctctactctgacccctctcagcacattctgctaaagacagccggggacagtccatctgctcagggcattttcctccttaaaatcccatggttgcttgcacataggataaaaaccaaaatctttgacagcacctacaaggcttggcatggcctagggcccagttagctccccagcttcatgtcacaccaggttctctcattcttgtggttcttgcaagtttcagctgcaaggaccttcctttaatcgctcacacatgccttgcccttagctcagtgcttctgtccatgccctccttcctctgttcactagtgaagccattcttgatccatacaacgcaacctccccactttatcctcactacacaacaccactgtactttttctttacagcttttcttacacttacgactatgtatttattcatgtatttgcttgtctaatagcttatttcccagtctaaacacctaaagataggaactgtctgttttgttcaccaacatatatcattagtgcctaatacctgacatgtagtaggcattcaataaatatttgacagatgaatgccatctacaatagatattaataagatggatatctgggggtggtggtttttgtgttcttttttaaaatgtaaggctactcaagccaaaaattcaaataaattgaactctagataaaaggtaaattaggttaggtatccctcttcagaaaaaaggataaaagtatcagcccaaacttacccatgcaccttttcctgaaaatctttataaactgcttgtacgctaatcgtatttccccctaaacaacagaaaactattcaataagctcttaaatgacgcaagcctgttcatgggtttttgttttgtaaataacacacttcgtttctataagggaagaaatagtttagatacttaaaactcctcaaacttaggaggggaaataatttggaggaaaaagcaaggaaagacacaatatttctgtttgtaaaattggtttatttacaatttggtatttttaaattatatttggaattttaatttttatatatttctttggcaggcattctgtttcttaaatagggaggcaaaggagaggaggaaacctgagtaagtttgaattttagagatttacctgctgctagtcagtcaaatttaacttttaatccctgagatttagtgaagaatcaaaaatatcttcatacattcatatgtaaaagcatatgttaagaacaataaagaataaagccattataattaatctccccccatatggcaatatgagaagtctctctttcttaaattaactaaagggtgcgctgacagtgcatttagctattagatataccaagagactaagctaccctaggcctcagtttcat

SEQ ID NO: 36508 - DNA, 1842 bp, Bovine  19866881300013
catattgtgattcataacttttacctttgctatagcaataatcttttgatattctaagaaaggtttatagtaagactctggataagatttttttttttgtatattattgttactggaaatacataaatgaagacatgtaaccaactcacatttgaagaacataaacactttaaaaagacaaaaggtatgggaaaatataaaaatagaaacatggttgctagaaattgcctgccccataaatagtcaagttttagtcaccatgactgacagacgtcctgcttttgtgggacttttattttgaaaatagatggaaaagttaaaacagtgttacgtggttgccagaattttggctttgtagtaaaaatagatcaactttacttctgaattgtcggaggttcattatttgaccttggttacgttttatgtaaatctatttaatatttaaggccaagatttcatgtttataaaatgagaataccaatgaatctcattataaacttcccagagattgtctatcttaggtgctgcgataaataacaatcacaaaaactgggaaagttctatagccagtgttccccacaaatggtgttcactaattacttaaaaagttgacttgtaaagtattagttatataaaatgtaaaaagtgcattgactaggaatgtagcaaatagtaagggtgcttctgatctttgcttttgggaaattattatacttcttaaattattgacattaaaaacatgatatggagaaaaagggagaggaagtcacagcatttaaacttttgagttaaagatattagagaggtagaaactattgaatgatgagatctcttagaaactactcataaatgcctgtctaccaagctagctatattctgcgtaagagcagataacaggggtctgggtgatgtttcctttccagcagtctttttacaacactttctacttatttgaatattgaaaattgctgacataattacgagtgtccatttgatccaaaatatgctggtgaaaagactactaaaaatatctatttaaaagtgcttctgtttagagacggttctttaattgaaatgttcagtttttagaaggcaatgtttgaaatctctgggtttggtgattggtgtaagcagagactccagttctcccccaaattcctagcagaatgactagaagggtataaaataggaaaatctgcattcacaagaggaagcagaaacgaggaaggatatagtccctgtggcagaaagtgagggaatttgtgttagcatttccttgatgggtctggattgaagggtaccccagagcgtttttctctcactggatccagaaaataggcaagtgactgagggaggcagcatttggcggtgagggcagggtgaaggctggctggcgagcatgtgaacgcagcatcttgagactgaagttgcctctgtgtggcttcccgcattacccttcttccgattgcttctactcactggactccagggtcctttgaagagggaggtgtgtcaggtgatcgctttgcttagttgcctccagggatttgcttgtattttaggatcaaggcagacatccagagcagggacctctcctgcctcgggtccactgtgccttccatgctgcagccactctgacctcatgggcacctctggctctggctctttgcactggcttggaactagttcaaccacctggacatcgtcttgcccctctttcctaggtaattcttaatcatccttcaggccgtggctccatccttatttccttaggggtgtccgagatctgtgctgtcatagcgtcctgtgattagaattgtacagtcattttcagattattta

SEQ ID NO: 36509 - DNA, 1346 bp, Bovine  19866881337132
cccgtctgtaacaggatgaagccttcctgtaagggccatcatgaaggccatcatgaaggccgtgtcctgatgttttaattccctgaggtaaaaaaggagtcccctgcccagtgtgggggtctggggagaccaaactccacactgagaggagacagctgcagaagccagtctgagactccacagaattcccaggccataaggaattagcctcacgttacaactcacagttgtacttccattaagtaaaagacagagaggaagatggccatgctggctgtgggccagtccagaccactctgtttggaggcagcactcgcacatgacacttcacaccagctgagagctttgcccaggatcaccaacaccagacagatgctggcatggcaccagggccaaggagagggatgcctggacaccctggtcgagcctgaagagtggactccttagaaagggagcatgagcctgaaacacacacaacttccccaattcggggatatacattttgatgtctcaagcacaccccaccggtgaggctgtctttactcagctctctgggaaggagaacattctgcagagaagtgatggaggcagaggggcagcggccacctgatcatctgatgaatctggaaagaacctgagctctcttcacagaactctgcttcctgaattcagcttccgagtcaaagccaacaagtcctcatctcctgccctgctggaaggggcaggaacatgtgcaggatggtgctgagagcagtggctatatagacagaggacctccatccttggcgctcccctccatgatggaatctcatgtgaaagagcaaatatccaagtctcaggggttctggtctacccaaaactcttggcactgcttcagctctctatctctagcatgccgcagtccatggggtagcaaagagctggacatgacttagtgaccaaataacgacagcaacctggctttttgctctacaactaactctaacacaactgaatttcaggctagttttaataattccgagccctgagttttaaattttatggagcatttacataggtcataataaattctgatacaaccaaaatatagaatgtcctgacctttctcaacattgtaagctgttattgataatattgattcataattttaagttaaatttaaaatatctttatttttaattcaaacccagttttcaaacacaaaatataaaaacaatgcctaaacttaagggactctaaaacatttcaaaacacaaatgaattacatgaaataaatctatgtgtaagtatggaacataattaaagtttacttagaatcacagtagtgggatccttcactataggaa

SEQ ID NO: 36510 - DNA, 1285 bp, Bovine  19866881386184
caacttcactttcacttttcactttcatgcattggagaaggaaacggcaacccactccagtgttcttgcctggagaatccgagggacaagggagcctggtaggctgccatctctggggtcacacagagtcggacacgactgacggcgacttagcagcagcagtgttagctggaatctcaggagaactttgggaaagagaacagtattgaattaaaacttccttgtgtccttttagtccattgaatgtagcagcagaaaagaaggaagtattagtcactatggatagagaaaaggcagcctgggctgtatatcactgagatactgggatcctccaggtgtgggctcccatggggccgagatacaacccatgggtcacaggagccctccaagttcagaggtcaggccaaccagcgttagcaaggcaagtcagtgaggcacagacaatagggaacatttagttgcatttgctgttgggtaggcttccctggtggctcagatgttaaaggatctgccctcaatgtgagagacccacattggtctaccattgggtagctggtgcgaagagagtttttatggaggttttaaaggaactgattaaaggaggaaaaaaaaataaaaaagatgatcacaacttttcacacacttgctctctaaggagataccatcaaagagacaaggagcctcgtctgcaataattagaggcatggtgttgtctacacataaatattttacattttggtgtgtgtaacaagtttgtcataaataccaagattgaaggaatcctgacaccaaggcgatctcaaaagacagcgtaaatggttctgacaagaagactgattccaaagccttttgaaaaccacatgaaatgaagaagaaagaagcccatccaaagcatcgttttacaaactgtcacatgtgattagagaaattgcactttatatggcaaaataaggtaagtgagaaacatggacataaaatccaacctaggtacgagttatacattgtttcactagagggaaaatgtctaagaaagcttctatttccccatggctttctctctggaaaggaaaatctaagaattatgacaaacactaactttttcagttattcctgatacacaactgaacttgattcaagataccgaatcttatcttcaaagctttgaataaattagatctgggctgtctctccagcaaagaatgataatgggatcatgaaagttttagtgattatcagcttctgtgttacagttttacaagccccgaaaattgtaattttgagtcag

SEQ ID NO: 36511 - DNA, 1450 bp, Bovine  19866881538965
tccaggcttgtgtttcatccagcccagcatttcacatgatgtactctgcaaataagttaaataagcagagtgaccatatacagccttgacatactcctttcccaattttgaaccagtccattgttccatgtctgattctgactgttgcttcttgacttgcatacaggtttcagaagaggcaggtaaggtggtctggtattcccatctctttaagagttttccacagtttattgcgatccacacagtcaaaggctttagtgtagtcaatgaagcatatacttcaatttttaaaaaagaaagaaagacaaggaaaaggagaagtactcggtaacatgacactacttccctccttcatgatcttgctttctgccagcacacactcttctccacctgaaggcagagctgccttattcttggaagctgaattagccatgtgggctaacagaccagaaccaggagcaagccagggtcaggtttctgctctccactctacattaacttgctccaaattattaagccaaaagccattatcacaacatcataaactgtatttctaattaagatgatatatgcctctttcagaattacacattccaattagcagggaatagttattcctattgtgtactgatgcactgaagttatcatggaaaaaataaaaaatgacttcagttacataaaagtattagtcttttgccaggcttgttctgaaatatgggttctttggactccacttaatggaactatagcttcattaagtatatttgcttgtaaaaacatatttttcaatattttaacaaaatgtctctcagtgtttttaaatagtagcatgtatatatatcagctatgagttctgcaatctctcatacctcgtgtccatgttatttgcatctaaacaattcacttgaccttattacagaagataattttactctagggagatgctagataattttactcatgtgagccctggcatcatatttcctcatcatgtaattattcaatgtttttttaaaaccccatacgttctctagtccaatgatccctgaaaaaagtaatttgtaattatgtgttatgatgttagctagttttattgtgatgatcatttcataatatatacatgtattgaagcatcatgttgtacacctgaaacaaatgagaaatgtcgatcatatcaattaaaaagaaaatactgacaataacatatatatgcaaggacatggagcaactggaattctcgtacactgctggtgggagtgaaaattggaataagcactatggaaaaacatttgatagaatatttaataaaaatagacatatatgtgtgctatgacaaaaaaaaaagatgattttattatgccacaatatttcagttcagtcgctcagtcgtgtccgactctcttctaccccatggattgcagcaggccaggcctccctggccatcaccaat

SEQ ID NO: 36512 - DNA, 752 bp, Bovine  19866881548792
tggagaaaggagttgacagttgggtctggaatacagtggaaaagtctaaactagttacatttgcaaatttaataaacactttcaaatgcttgctaattaccagtcactgcctacatgctttataaatattgttttctcttcctagcaaccctctgagggaagtacaactgttaaatccattttacctgtgagacaactgagacccagaattattagagtctcccagctaggtcctgagccagaattcaaacccaatctggctccagagtccacactcttaaccactaggctaccagatggagcccagcaacaaagtaggtgtgggtgagactgcagagtaataagaagggagaacagagccctgcggaattctaactattaaagatggggaggggaaggatgaattggcacagaccgatcacttccacagatccgtgaggcccgtttgtcccggcaggtttgtccagtgggacctcactctctgaggttaacagagcccaccagggactcagatgattctcacctccatgaatctggacaggctccccaccatctaccaagtctgacgtttatcctgctcgagaaaccaggactcagcaaccataccgctttctaaactctgcacaattggtgttcctccaaggctgactcttttgccaacaacttgacttgtattatttttagtgaagtaccatgtagcaagctgttccttaaaatatttccagtctggaatgctgtcaagacagaaatca

SEQ ID NO: 36513 - DNA, 1581 bp, Bovine  19866881577030
ccctgctgttgctttgactccattttgaaagttttactgtgggtagaatgctataaaacagtgtagatgctacagagaaataactatttgtgaaaggaagaatccatcgatgtaagtgtcactgctgtcttaggttaagaaattgccactgccacccaaccttcagcaaccactcgccctgatcagtcagcaaccatcagcatggaggcaagacaccggcaaaaagattacccttggtcgaaggctcagatgacagttagcattttttaacaataaagtatttttaaactatgtgcattttcattaggcataatactatttctcacttaatagactacatatagcgtaaacataacttttatatgcactgaaacactgaaaactgtgtgacccgctttattgtagtatttgctttattgctgtggtctggaaccaaacccaccatatctcggagggatgcctgtagtattcttcagaaaaagataacgtgtttggaaaacactggtacaaaagccagaacctattacatgcataggtgggaagtgtgcatcatgattcaacaggcacaactcagtttgaaactataccccattttatgccattcaatggaataaaaaaattaatctactcagtaatgaatgcatagtcccttatagttattgtattctttttggaaaaaaagtaacgtgacagctttattcactccatgtggcaaaccaaattgcttcaagtaaagtgaaataagacaaacactaaaatggagtttttccctcctcatgtacccagaggcatatgctatggctgtaatgcataaactaaaatggcaataataataaaaacagtggaaaaccaaatgaaaatattaaactcaattagacaacttattccaaggggcagcaattttcatgctccatctgcttggagaaaatttcttgttaatcaggtctattaatcagggtgtggggtgttggattctattttctgttaaagccataatagtttctgaacagtgatgtgtcacttatctatcgaatctaatttgctatctttcaaatttcccaactcccccaaccccccgccccagaagtttgcaaactgaatactcaagggaaatgggtgaaatgaattcatgttactgggtattatagcaaacatcaatgaataaataagtcagcatcgaatattcatattagaaaatttgactttttaattgaagtgtcaactggggactgtctcatatctttatgctggagaggtccagtgaatacattcattgaaaatttaaataaaaccagcaaacccaatttcaataatttgtcttaagtgtccacttcccagagatttctgtacatgttcagataattgaaacttctctcaggacttctctttcccttggtcttgtaaacaattctactaagaccagttctattttattctcaaggcttaatggaacatgtgacttggactaatatgcagtttttttgaaaacaaaaagaatatagaaactaaatttctcattatgctctactggtattactattatattacttgaaagcagtgatggaaagcatgggcttggat

SEQ ID NO: 36514 - DNA, 774 bp, Bovine  19866881713666
gctaagaaattctcagcgagtctctgccaactccacaaagttatagtcttgtataaatcccacaaggagtggaaagggattatcttatcatccctctacatagagtagatgtaaagtaagcaaatgctgctagagcagaggagaaaattgatcaaaataacattcacagcttccctggcaactcagtggtaaagagtctacctgtcagtgcaggagacatgggttcgatccctgatctgggaagatcccacatgccgcaaagcagctaagcccctgtgccacaaccattgagcctgtgccctagagcccggaagccacaactactggacccgtgccgcagccacagaagcccctgagcctacagcctgtgctctgcagcaagaaaagcctctgcaaggagaagcccaggcactgcaactagagagcagcctcaacttgctgcaactacagaagaacctgagcagcaagaaagacccagcacagccaaaaaattaaaaacaaaaaccaaaaattaaaaaattaacatttgtgtcttagagatcttttttcctccatcaaaagctcagaggactatattcaaaatgaaaatatataggtcagcagataacacctgtctatctatctctacctgctgtgactggtcacatgtcaatgttttaactagacattggatgtcaactgagcctcgagtctattctgtataaaacatcagctttccagagtaaactagagagaaagagaaactctatgatcatgagacatgtcaaaattata

SEQ ID NO: 36515 - DNA, 1130 bp, Bovine  19866881738707
atattgctattccgctgggcttcctcttattacttcaagaaaatcgaatgtctaccgaatgtaagccttcaggagagtggaaaatggaaagaaaacaaccagcactttccccttgactcttctggtttccacgtgggagttacatgtgcttccctgaatctttgggaaaggagaggctggcccaggggcttgctttcagagaatggtggaggaagtaccctggtggtccagtggttaagactccacattcccagtgcagggggtccaggtttgattcctggtcagggaactaaatctcaattgtggagctcatgtgccacagctaaagatctggcatgccacagtgaagactgaagattccacacgctgtagctaagacctggcttagtcaaataaataaataagtcaataaatattcgaaaatagagagagaatagtgtactgagtaacaaggtggaagcaatgattaagaaagacttgtgtttgtcctggaatcaagagaggagagaggaaaaaaagaggaaagagggaagaaggagttgtctaactaccattaaagacttcttgaaattactggcatggtatggttttttttgttgttgttatttgttttgtttcatttgtatcattttgagaaaggtaggatcattccactccattattgagacccctttggagtcatccgaatctctaaatttgcttctttcagagaaaattttttatttcttgggaaaagtccttaaattcctttacttctggaacaaatcatatgtttccttctccaccaatatgaaatattcactgtctctatgactagaagagtaaaaatgccccttgtctctccctggagagaaattgagagaaacgtcatcaaaagcagtgacctccatccttaggataggtctttgtggacccaagaggtgattgatgggtatgctctcctctgcccagcaggctgggggcaaaaggagtaagagaaaagaatgggcagtgtcccttatgattatctttgctgaggaccagtttatgtcaagcccacacaagcaacgggcttccctagtggctcagctggtaaagaatccacctgcgatgtgggaggcctgggttgatcccgggtgggaagatccccg

SEQ ID NO: 36516 - DNA, 1133 bp, Bovine  19866881786630
ctgggtcgggaagatcccctggataagggaatggcacccccctccagtattgttgcctgaaaaatatcatggacagaggagcctggcaggctacagtccatggggtcactgatttggacacaaatgagcttgcacacacatgtgtttgattggctttttctaaaatgcctttttaaagactttattgggggggacagttttacagtaagatcgaaaggaaggtatagagatctcccacatcccctctgtcgacacatccacagcctccctggtatcaacattccccaacagaaaagtgagctttcttttttttctttcacattttccctggcttgtccccaagtagctgcttcctcccaactcaccctgtgtattattccctccctacttcccttcatttgtttttcttctggttctcctacactttgttttgtttgtctttggagccatcatatcctctattagctgaggttatctctgaggctggtttccatcgagacaacattcattttattctgaccctactttagaagggaatttgaattaattattcaagcatttttttcctcccaaaggggtgatccctgagatttgctaaggtccctgccagccctacactattactgaggttcttcagctggaggccagctgtcagggagcacacaagcccacccttccctctatttaaggatcacctcactcccagcaagcactagccagcctgcctccagcctcatccatctcttggctctatttttcaaaacttcttccttgatctctaggtattgtcagttgaaaatttaagaatgagagagaaaaaagtcccctgaactccattccattccaggacacaaaatattgtcaagataggctcaatcctaatcctatggtaatagtggaactgaaggctttttaaaaataactgtatttgttttatttttgggctgcgctgggtctttgtcgcactggcctttctctggttgcagggagtaggggctgctctctagccgtggtgcgcgggcttctcattgtgggggcttctgttgttgcagagcataggctccagggcatgcggcctgcagtagtttggcgcctgggctctagggcacaaacacaatagttgtagtgcctgg

SEQ ID NO: 36517 - DNA, 625 bp, Bovine  19866882079236
tatgtaaaaagcctgattaaattattcctagcccccccccccccaccccccgcccactgccacctcccaggtgcctgccaacgcagaagatgagggttcaattcctggattgcgaagatcccctggagtggcaacccactccagtattcttgcctgggaaatcccacagacagaggagcctggtggaccacagtctatggagttgcaaagagctggacatgacttaatgactaaaccagcaccaccagcctttcttcagaaattttagatattaactttctgggttctgtaaaatggttgggcactttattaacatcttgtaccaataatctgttgtcttttggtctaatgtaaatttattcacagtctttctctggataaaaggaaaaaggatcactttttttcttccatgcagttccacaagctctggtttcaagcaggctcttttatctctggacatctctttgaattagatactttctgcctaagcttcccctcagcagggtgttcaccgtgcagtttggaattcaggccctcgagttagggaacaaagtctgaagctgcctgtccttcagggcacaatagcacagccagctgtttgcttagacatttgtctgagtcgtat

SEQ ID NO: 36518 - DNA, 1490 bp, Bovine  19866880397725
tgaacattggggtacacgtatctctttcccttctggtttcctcagtgtgtaagcccagcagtgggattgctggatcataaggcagttctatttccagttttttaaggaatctccacactgttctccatagtggctatattagtttgcattcccaccaacagtgtaagagagttcccttttctccacaccctctccagcatttattgcttgtagacttttggatcgcagccattctgactggcgtgaaatggtacctcatagtggttttgatttgcatttctctgataatgagtgatgttgagcatcttttcatgtgtttgttagccatctgtatgttttaacaatgaaaatcactttgagaaggatagtatttttctttcagtgtgatcttctcttcacataaacctaactaaagaatttattcaagggggcagagttatttaaaagcaaaaacaaaaaacacctgccacaactcagggcacagtttgggagctgaatctagaggaagggcagaggaagggaagggtgatgaaagaaatgtcagtctcgagaccactgctcaagaggcatcaggacaaagtggcccaggatgatgcctgtgatagggcttgatcagacaccaggagaaggaattctggcttatgaaaggaaggaggacaggaaagacacaggtctgtggaaggattctgccaaaaaagacacatctctgaaccccaaacataaaccaatcccctgcaacatcagtacctgtgtcaacagggctggtaatagaggatggaaattgccttcaaatctataaaccagcaaaagtccttctacaaaagatttgggatccagccatctgtctttggacccaagacaatggataataacatggctagccgctaacagttacatgccatttacagggttcctccatatcacaaactgaattgagtttagaagagataactaaaacatggtgttaaaaatctaaatattcaacagatgattcacatcatctcagagccaaatccaggatctctgctgcttttgcaaaagacaagatttgatgctgcttggtttgagcacgaggagtacagaaacaaaacttggactgacacttgcagaaacaccttccgagcatgtagatacaaataaaagacgcagcagaacaaattgtagctgttcactccagctacagttttacaatctccaggctacatggtacctctacaatgcatttttaaactagcaaaatttgaagcttaaagcgagctgtaggaagagatatgtgtggtttcataccaggatagttcagggaagacataaaagctacatgaaattttaaatgcaattatttcagattagaatatttggattgaaagatctgggagggtactgtttttgataagacagtcccgcttgacaagaagctgtcaccactctggggctctctgttgtcaactgaagatgaaaggccatcagaaagaattagcttcaacttttaa

SEQ ID NO: 36519 - DNA, 2233 bp, Bovine  19866880416267
aatggattgcctgcccttctccgaagttcttcccaacccaggggactgaacccacatctcttatgtctcctgcattggcaagggtgctctgtaccactagtgccacctgggaaggtcaaatattcagtaggtttttaaatcgaaaccaaagaccactaggaggagtgacaggttatacaagtgaatgtctgaagcccctcctcagacgtgagtgtatggaaaagcaggagcgggctctgaaatgcctaggctgctggacaaagtttggcatcacattgtcagaatcagaaggtgagtaggtgacttatccccaagaagagggctagctcgcatgcttaacacaccagatgctctcagatgtctcagcttgcttcaaggtctttcctaggctaagactaactgtaaagattcaagtaagttcttaactctgctcttctccacccagaggaacagagacatttgagtttcccttcagttcagttcagttcagttgctcagtcgtgtctgactctttgcaaccccatgaattgcagcacaccaggcctctctgtccatcaccaactcccagagttcactcaaactcacgtccattgagtcagtgatgccatccagccatctcatcctccgtcgtccccttctcctcctgcccccaatccttcccagcgtcagggtcttttccaatgagtcaactcttcgcatgaggtggccaaagtactggagtttcagctttagcatcattccttaggtgctcttttatcaaggtagattgctagtgaaatgtttttcctatagttccctctaacctagtccccaagggtatcaaaacctgtagggtttcccgggatctcttttaaccaccatcacccaagtcagttagacctgcagtaaagaggagacctgaggactgatgagatttagaaagacagagacagtcacacggtgggggtctatcttgcccacatgtaacaaacgtagggtatgaatagcccgccttggcccatctctttacctcgggccggggcttgtagcttgcccactggtcagaatcagccccagagagtcgcaccagtggtacattgccactttgtacatacagctccaaaagcagctccagtcacacatcctaagagcaatcaagattcctacacggcacagttaattgttgactatgataacatatcttgttatcagtttttctttaatgaattccttaatagatatcattagacattaagtgctacatgacttcctctaagaagaaacatttaaagaaacgacacacattttatgtcctgaatcagtgctgaatgccatctctagtgatcacgaaccacaccatggagtcatgttctccctcgtgatgtgctcacacttgcttctttggctgctgagaatatgtgtctttgaggatagtatttgaagctgcgattacatgtatgtccaaaaaaggagacaaaagactttgacttccaaggaaatcactggatcccgtaagaaacacatagccataatgagaaatagataagtaatcttagtttgtcagcaccctggtagggaattaaactcacaacttccacgttagtgacactttcgcatttaatttcctgtgagccacgctgaaaatgcatctgttgaaagttgaatttcactccatagagctgtcttactaagtgaatgtgtgcgaggttgtacctgtcaaaacaagactctggaagctcatttagaactataatttgggttaggaggagcaaaggggattgtaccctgtaggactatcactgttttctggatgccattattgctatgagtaattggttattcattagtactaagtattaattattaatgttaataagaactgttttgagaaccaggaacctgctgtctgctgtgtccaggctgggccattctagatcattggcttagtgggtgatatgctaaccattagggcttccctggtggctcagatagtaaagaatctgcctgcaatgcaggagacccaggttcaatccctggtcaggaagatcccctggagaaggaaatggcaacccactccagtattcttgcctggaaaatcctatggatggagaagtctggcaactaacacacgtgcatactaaacctaaaggcagatgtggacccggaggccaggagcagatctgaagtcctattggaggccccttgttacagggatcagggctcctgtggcctccagacagccttgcataagtag

SEQ ID NO: 36520 - DNA, 3275 bp, Bovine  19866880424054
atccagcagcccaggcctgttcccaccacgttgacttgtgaggcacctgattaaaacgaccttcaaaaacagccaaagatggacagtctcacgctgaggtttcaaggactgtgctaaaaataagcctaaataagaggcagagggaggctcacggataatcaaatgtgtaatcaatttacatgtcagggaaggataattaccataaccaaaaagaaaagttctccaagccaaaaggttaagaaagaaaattaaaccagcaagccacctctacccacatggaaacaaaaacgtacgttttcggaaaggacaagcctcctgtgttcccggcagcttccagagccttgaaacttcccttcaggaccatgattcttggtcctgggtgtgattcttgggtgtgattcatgattctcgggtgtgagacacaagactagtgaaacccaaacaacttgtcagacttgtgcacagccagcaatacacgcagttggctagctgtgcaagggttagtcgcttgtggtgtccgactgtgcgatccccctgtagcccgccaggctcctctgtctgtgggattctccaggcacgaagactggagttggtagccattcccttctccaggggatcttcctgatccagggatcaaaccgggaactctttcccatctatgaaaaaatatatatacatacaaactaggagcaagtcttgcatcacatacaccaaattgtctataggaactgacagtcctgctaaaacaataacccatttacagtttagggcagcccggccaggaacaggcccagagcctcaccagcccccagaacacagggcattgtttccattcaaacctcgcaccgaaaggcaagcctgtcagctggcagtgacctcgtgagacaactttggggagagcaaagggctgagaagagaaaggcctcattctcaaggcaaacaggaaaaggaaagagaaaaagaaagctctgtctccgcacaaggtttgctgtgctggctatgaactgttccagtacgttccatcaaatagacgccttcatagaatcaagccaagcgcgaacagcgggtctgggactccccatccccggacacacacactcccgcgctctcgcaccccgggagagtgcttatatgggcttcatgaagctaagtaataaacactttgtcttcgccctgctatttatgggttgcttggggcatcctgttctctccactgcccttaccttactccttctaacgccacgtttaatagggcaacagtgaatgtgaagggttccatgtgcccctccccacccactctggttttcctggccaagaaaggtgggtccgcatccatccacctgtcctccaggctcccttcttccaggttaaacctgatctccctttcctgccttccaggcatctccctaagacatctcgctaagatacctgtttctattttaccactgccagcaattctttcattcttcatgatggatcaaccatcttggaaaatgagagtgactcagaagattgtcaaccaccacgggacaccgccccgccgggggactgtgggtctccggacggccacgcatgtgcagaattaaggaacagatgggtcctacctgttgctgacttccaggttcactcagaagccttgagctccccctgcacacatggtgttggggtcacaaaggggtgggatgcccacgtgaaaacaagaagtgcatccaggccaaggggctgtgcagaggcgggcatggacgatgccagaactgtccacagggtgcaggaccaaggatgcaactgactttggtcagttttggggcctcctgcacttggctcctttgggggtttcagggttctcagggctgatgggtcccgcatgaagagagtcatgactgcattctgtccacctgtgggttttcacacaggcccggcgcccagctgcctcttggcccagtcttcatcttgggctacccgcggtaccctgaaaacacacaagacagggaagatgcgttaactcggcttctccccacagaacacggctcgccattgcagccgtgattaaatacaggacattatctcaccataatgccctcctggccgtgttcccaggaaaattctaactaatcataaaaatagaaagaaaaacgcaacctaaattccattcctcttcttaaatgagtgatgtgttcacttttatttatttttctggaagcgaggcgggaaaagaaaatgaattttagggcttagaaaaacaagctactaatagtactaagtagagcagggtggtggtgcagacagcgggatgtagcggacaggccaggggcaggtccggccctacccctgcctgtgagcctggagctttaaatgggagcacctcgtggagcaaagacagcaggaggagaggaggttgggtggctgtggggccaggtgtaggcatacatgcacacagacgcacgcaccccacaagcgaggtgctcagcagcatcttcacggcctggcaggcaagcacaaagtcaatgctcctttcacccaaagcctgcatctttctctagcaccatcctttctggaggctctggcgtgatttggctagtccctgcctgaaagagtttctcctggagattcacctagctcatttctactcaccctttagagatcagagtgaatggtacttcctacgggaagccttctccgaaaacccctaccctgactccagtccaggtgccggcggcattctaaacccgcccctcctagcagtcacgaggctgtaattaaggcactaattgcatagttggttgtttaagggctctcccctgtcttagatctgagaacctgttggtctcattaactgctttgcacgtgcctggtaggcagtagtttttcaataagtgcccatgttggatgaatgctgatggctttgcccagcctgtgaaccatcccctgtatccacagcactaagtaccgtgcccctcccaggtcatttctgccctttttgctgggaagacttcctggggaaaccatgggaaagctcaaaatcccgaaaaccagctttgagatgcttctaataattgtgccctgagttaaaagaaaggacatgcccacacccctcccgcatctacctgccccggctcctgccattagaatcccaaatgctgccatcccccatcaaggcaagtgctgcagtaatgggcactgctacttgatggcaaagttctagctgggctaattaagcatactgagctaataaccttccattttgggactggtattattcataatttaatgtattg

SEQ ID NO: 36521 - DNA, 870 bp, Bovine  19866880459217
tttcaccctttatactttgtctcgaaactcttaattcttctgaacttggagattgcagaattagggatcatttttttttcctcttcccttttctaggtccagatgttttatcatcttggatccaagtcttgcttaataaaaccaatctctaaattttatcaaagaaagtatggaaatttacttggctatgtactgagtatatctgggatggtttcattccatttattgagagatggctttgctttttaaattaatttttaaagaggcaatatacccataataaaattttcagaaggtacaggagagcgttcctctcccctctcctcctgtgctgcctgtccctcagtcactcagttcctccagaaacccctgccatgaaatcccttgggtaaggcatatacttggatacagccatcacagcattatagaaatagtttttcttttttttttttttttttaaaaaactaagcattaagtagtgttttctgcttaaaagatttcctccccttatcagagtttctccatcttatttcagagatgtatttatcctctgtagaatacttaatattaaaaatattaatgaaatccagttacttgaaaataaaaaagtagctctcctaaatcacttgggtcaaagaggaagtgaaatgactgttttattcaaatgaataaatgacaaagttttattcagggatgcattcatggctttaaatcctttcattattaaatacgagaaaatgaagataattaagtattcaacttaaagttgaaaagaataaagcaagcctaataagatgcaagtgatactaatgaattagaaaacagaaacgttaaagcgatcaacctaagaactgtgtgtttgggggaaaa

SEQ ID NO: 36522 - DNA, 714 bp, Bovine  19866880475426
aattggttttctttaaggtgttctcaacttatgtggctaaaataaatgatagtgttttgaaaataccacctgttcttggacctgaagtcaggcggtctggaaacagctctgcagtggccatactttggtttagaaaatcaccctctgcttgtcccttttccatctccagtccccctgcccccctcactctctcatgtgtgacagaatttggcttgtgctgtcctttgtccctaatcggacatgattccctagaggcagtcttttctccctggactttagctgggaaaaaaaaaaattttttttttttttgaggctctttttttgaactaaaatgtagagaggggctgtccttccccaacaggttaaggtagttatattaatttgagcccaaattatattgtgcagaaatgacttctagttttcattgcccctttccctcctgcatcagtgtgtgcttaacgctaatacgattccatacatacagctcctccgccttgtgagcttattatatttctaacacttgcacggttcattattgtgcagtcagaaaggactctcagggctgtggggccagccggggtgggtggctttcagaaaaggcgaaagcaggtgcctttctgtgctgagaatccggagtgaattcagactgagcctgggactccagcagggaggacaggggacttccggtgagatttctgtggtgctgccttttgc

SEQ ID NO: 36523 - DNA, 1547 bp, Bovine  19866880492262
caacaaattaacatcttcctttggggaagcacaaatatttattatataattgcactttaaaaacaaaaaaaagaaaaagactaaacaccccaaagtgtcaagagtcaagcttaacaaatttaaaagcaatgaaatgaaacccagttaagcacaaaaggtcttttttgaatttagtgaaaagctgttgcaagaactaaagaagacgagatctgtgcctccagtattcggtttattaggtccgatgctcgtcttcaaaggaatatcacagccgtgtggcatttaaggatttagaggaattctgagaatttgagtgctttttgccaaaatggattccgtgtgcactttagccatgaaaactgatttaggaccttttattcactcttagtcctccagctatatttgttcagttagataactacaaaattatccgtcggtaaaggtagaaaaatcgagagatgggcctaaacaaaaattacacatcttagcaaaagaaaaaacagactcctctgtttactgcgaggagccaggcaggtgtggttacagaattggccaccaaaataagaggctgcaagttttcagatgctaaagtagcatttgggtctgtgtttatttgctcaaagcgtattatgattttaaggtaacattggacattatctgtgttcagaaattccaaagtaatcaggaaaatcagattttattgcactttagaaatagtagtagctacaagaatatggctgtggcatgatcgtaaatgtgtgatggaagcacagagcttggagccaggacatgccaccaggacagacttggttagtatccatccacgaccaatccatttcttgattcaggtttaaatagggcattttagacctagccttcagattaaaagagcacaaattcagccttgtaatatgaaaatcaaaccctattctctattaggatcgtcagcaagagctatttcatccatttctcacccaccctctgctccctccttctgtccctggataaaactgggttctagggttaggaaggaaagtgacaggaatcttaagagatctcattttggaatgaggacttcttgtccctggaagtaaaggaataaagccaaagaaaggaatatttcaggagagtggctgataggaggaaagtctgaagtttgaataaaagttttgaagtaggatttaatttaagccagggtattgctttctttttattagcattgattgtgcataagacattgcacagttttttgtgtgttttttttttttttttctttttttcctttctttcagtctttctacttttaatttaaagccaatttagtacatgggacttgttctgtaaataataaaaatagaagagtaaaatcgtccatgtgcaggaggggaggaaatgggggcatgtacctcactacaaagatcactgaatttttaacacaaagaacaaatctgtctatctgacattgtcattaggacagaaagatttttttttcttttttccccttttttttttaatcatttcaatataagaaaaggacccctctcaagata

SEQ ID NO: 36524 - DNA, 906 bp, Bovine  19866880499815
taggaaagtgacataaaagctttctattctgaaaggaattctatattctttccagcccattttcttttttcttatgtaagtcagcttggggtacaacattggaggtagagggtgggagaggacagatatgcaccaggtccctggcctgactatctacttacccttccacattagctaacaaacttgagtcattagaggggcattaattgaagcagcctgtgacccatatgaattggatgaactgcctgggctggagaagtttggctgtgaagtggagcggcctgaggcaggtaacatccagtaatctgctcatctggcaggctttcaccagcagctcacccatggctgtcggagcagtggggcagggagagtaggctagaactgagacaataatttaccatgtaatttgttcttagattcctttgatagacttcactaccaaagacatttgcaagagaaggggaccttacaccctgacgccagccccatctggtgacaagagagagctacattgtctgggccccgtgacgaccttattagataggactcacctgtccttacctgcatatttcttccattttcggtttctttgctttttcctttcctgtccaacccaggaatgaagagagagagagagtagaaaatcgagttacatgcaagttgatgaaaaccgagtgtagcaatccaaagacgcaggcaattttaagttcgagcctgtttggcaaatgaggtgtcccatttggggaaatactgttcctgtttaagcccagcaggtgtgctaatgcaaggcaggcttcctctggttgccttatttagggggatgttacaaatggaaagactatttaaatgttcacaaagacattaacaaacaaacataccccactctcaaaaaccctttcctgaaaa

SEQ ID NO: 36525 - DNA, 1169 bp, Bovine  19866880579495
catcttttcctctcctccctcttgccttcctaattttgcttttggattagttcctgccttctgaatatttgcggtgctggcgtcatttagaagtttgagttccgccgccgaaaaatacacgctcttcattgcaggagaagtcactggccagttggaaacagtgtgaccagtgcgcttattggagagtaattaaagggagaatcagagctttggagcgggaggcacctttggagactgactagctcaccctctactttcagttggttggccctctggaaaaaccagagcagccttcatttctgtagggagggggtggttgagagagagagagaaagagagagagaaaacttagatgtttgtcctgttgaaaaagaggaggaaggcccaagttaggtcagtaaaaggaaaaaaaaaaaaaagtaattatggtgagctggaagggaaagaactttctggaaaatggtgctttctgctttggacatacctgtgttataatgatgagaacatgcccggagggcaaagattacagttctttgcctggtgtagtcttaagagtgctttgcctggcacagtggtgcatggtatataaactggtttaaatgaaaagagctagcagaagaatccaagagggtcttctctcccgccttctgtttgtgtcatttaactggccttgaggactctgaaagccactgacagataatctcagagagagcacatggccccacttgggcacggagagaaggcctctccctcaggccagggcctgccatggtggaatgcatgaaggcaaaccaaggaaaacaaccttgagccttgaaggtagatagtgagaaagttacgcgtcatcttacttcatcccatgctttgcgatccttggggaaaggtcactaaataagagtataatttcgagctcgtgctagccgggggaacttcatttctctgccatcaaacagcaggtgtgagttctcagagttggcccctggagtcccctcattcctaaattcaggaggtgtcaaaccctcatgttcttttaatgcctgtggtttctggataggtttcaaggggaaaccctaaaaatcatgagctccagtagaccaggctggagagggaaccgtgagtgagaggacagaggctgcatctgagaggaaaacatacaccttgcagggcaa

SEQ ID NO: 36526 - DNA, 1557 bp, Bovine  19866880595690
acactggtgtggtgggtacccctggtgtacggctttcgggcccgccctcgtgctgccgcataagggatggtcagtgttccctttctctttgtggcattgccccaccgcaaaggtcagctccctccccactcctcaggaaaggaaaggctcaaggagattttatctctgtctgcatttatgtattatacatacacatagagaaatacggtagcttttctgctgggaatccctctcagggcagccgtcaagctgtatagatggtccaacatgcacagccctctgctctgctgaaggggatgagcgaggacccaggccaccctagattcgacccaacaagcaagacagcgagtccagggtcttatctgcccagagggaggggtaccgggggggtggctttgttctgattttcacacgagtacctcatgtgttcgcagtgcctctggtcttgttcacagctgtatccagtgcccagaacaggtgctctgtggatgttggtgggtcggtgggtgggcagatggcacaagtgtagctccttcagggaagcccagttagtctcagctctgtgacctttgccaggtcttccacctcgctgagcctcagtttccttatctgggaaatgggggtagtaaccgtatctgctttggttgagcgatgactgtcccactgccattatgattattgttagataataacgacaagcacatgggagctttcagaggtggctgttgttggtttccacgctcaggctctttgcagtgaagggttttgtccaggcagcagaataggaaagcagctggcatgctgtgctgatcattcccatttggctagtcccttcctcctcctcctccttccagtcagggcccttgtgatcatgtcacagaagatgtcatcctggccaggggctcctggggcagggatgggggtgacctgacgtggagcccgggagcccacggggtggggtgggtggagggtcaggggagacgggagggcccacgtcaactagactcaggaccaggtgtggctgcagccccacagcctggtggcaggtgccgggccgtccctgtgcatgtgattccttcattacggagtctttcattgactcggccacactgtgctgatgaactgagtctggggacaagagcgcataattgacagaaataaattcccatcacaggcctggctgcagccagaagtgagtgtccacctgtgtgtgtgtgtgcgtgcgtgtatgggggtgagtgggcaggtgttcactttcttccctggatgcacccccctgccctccttcctttccagaaccttcctggcactgcctgtgggcccagtgagtggccctgcctctgtgtcccctgcctggagcctcttgcgtcctgtgccgcagtcactgcatcaccctcaggggcgcaagccttccctgggggctggggggcgcctgttcacacacccgcgagcctgccggggggctgggggtccacctgttcccacacctgtcctttctctcgttcaatccatctcccttcatccgtttgtttgttcaccttcagcgctgtctgcgct

SEQ ID NO: 36527 - DNA, 2966 bp, Bovine  19866880616931
accttttcaggaccaaatgggcatcccagaagaagatgaaaggaagattgtatggaataatacaaggaaacacactaaaagagtaggctaggctctagtctgtggccataaattaatgaggcctaaagcctatgattgttaaaatgaaagtcaaaagtaccaatgcagtagggaaagggcaaaagatatggttctggcaaaatggaccctgggctcccatttcaggcacctggttcccattaatctctcatccctatagacttacagagccttctgcctgtccctaactttgcctgagctggtatgtaaattaaaccaacagctttaatctttataacattatagcagaaaaaatgaagatagtaaaaatcgaggatggagccagaatccataggattcaaatatgtagtagcaaaatgccccaacaagggaactgggacaaaagaacgaaccaccataaaaccagatcttatttcttctttgaacccctatcttccctttacccctttgcaaaatatgcatacataggtcgtgttaagaaaaccttttccagttggcctttttccaagacaagggtacagctgggctgaagggccacatgttgaagttattaatatgcctatgcccttctcccccaccgagttcactgatcaaaggccctgccagagtagcaatggatagcctcgcataatgggaactgaaattctacttaagaaaccagctttgccaaaacacactaccttttaaagtgaaacattccatgcacatattaacctgattacagaaaggaagggggctcttttttccttctgtaccctgctaataattttctgtcaagtctgatttggctttagctgtactccaagttcttgtgatgtgccctgatcaccagtaaactgaaaacagaaggtgctgcactaactctgagacaggatgctctggccatgaattcagacgctgcagaattcagttctttgccaacaaggaaggccagtgacttttttcagtctctgacaaccagcaggcctgcctctgattcacacagcgaaggaatcacatggaaaaaatggtggaaataattaagggttcttagagttaacagaagcatcagctcattacatggggcccctgcctccaaaaggagtgaaccattgttgctgcttaggaaaacaacgactaacaaagcattttgaagtctcaatcagttccagccccatgttgaagaattggttaggtaacagaaatgggaaacaaaccatattttaaggaagcagtgtcatttttttctgtccaataagcaaaaagaaatacttcatggtttatttcactgtattacaggataacctggtacctgcacagctgagaaaattttgtccctagacggagtatcaaagattgcaatattgtgcagctgtccaaatagagggccagtccacagagggtctgcacacgatggccacctttctttccaacacatcagaggacagttcttggtggaagataggcagatgaactacatggctgctttgggagcctcaagcactagaatgtggcagattacagactctgtcaagttttacagtctctcaaatcccaagctcctttgcctacaattatgaacataaagaagcacagacttctctgggaagaaatatgttttataagaaagatttcttgtagggctctgtccttatgtttgcacaaactctaaggtgtggagcagttgctatatcctcaagagagtccagcaacaccctagacaaacaagaagtaaagaaagggcagaagtggtctaagctagtcattttctgtttgtgttcagcaactagaaaattatttgctaataaggaccaaggtccttttcagtgatgtcctgtaacttcaggcaaatgtcctgtcaaaacatattaaaaacttgaggttttatctgaatggaccactggataagcgtaaatagacatgctattccattgtccctggtatgtctgctggcttccttttctttttttgatatgttctcctattgtgaaagctagaggactaatccagagtggatgttctggataccttgcctgggttcagtgctcctcttgacagccctccagctgtcttctagagtcctgaaagatctgttgcttatagatcagaatatcttattagcatgggatttattttctctttttcttgggcaatcagaggaggccatcttctagattaacattgttcataatttcttatagttatggtagagaagacaagaacaaggtagttacttaaaaaaaatacacttggcctttcaatctcgcttttctctaaacaaggaatgaccactgatgaaattctcaaccacatgagccaagaatctgcagtgattcacttcttggcactcagtaaagaagaacatggttttaaagtgctgagtccaaacctaaaaccgaataaacggggatgctttgatcttgagtgcttatctttataaattgtagctgcagtggttgtaattaggtaccaaaatgtaggaaatcatttgtaaattcttgttagagattcacatgcaagagtatgttattataggcagtctttatatctaatgaacctttaaattaaaaaaaactacaatataaattattctttagaaagaaagtgaggtttcagaaaatatttcatttccttttgtagatttctttcatttgtctttatcacactatgatatggtatgttttaccaagagaacatttactaaaagggttgagcagcatgactaccttacttgaatttttaaaatatagaaaaagaaatgagtatccctcagtgtattgtaaggaaagccattataaccagtcactataaatgggatcccaatgcacatacatggaaggaaaggaaggagggagggaaagagaagagggtgagaaggagtgggtagagagggaggggagaggaaaagaaagaaagtaaaaagaaag

SEQ ID NO: 36528 - DNA, 888 bp, Bovine  19866880628248
gaaaatctgctctgtcaaccgcaggccgctttcctagtcggaaagcagaaaaagtaaacagtagcaatctctcatgtaacagaagatttaggtataatttgtttaaatagtagcaataatgattattaattcaccctttgaatgttaacaaagacctggtttttgttagtttgtgctttcgattcatttccaagctgaagtttgttttaggctaatgctgccattgatgagaaatgcaattatctttaacttcctactcccccaccccgccaaatatattcgacgttcagcaatacaaaataaaataattcccttccagagcactgctttgcaaatgtcgtgagcacactggagtgaatttttgttgaattcttctttacttccctgggaaacaataaggaattctttttgttctttgccacagaaggtataacaaatggatttcgaaatacctgcactctatcagtggtgcttagaagaaaaagaaaaatcaaagcaagaaataaaaatcacaaaatggtagagtctgaccaccactttatccacaatttgtgcctgacctcattgttgaaaaatttggtgaaggatcacggtggctaatttttctccttttgatactataacattagaactaattttaggtgtattttatccagtttggtgtaaaagagtcagagtccctaagggaccttaccacagggacccgttgcttctccacgaggcagtcctgtcctgggcctgctgtcagcggaggcgggctccagagccagggtccagcttgtcccgtcaagtttattgtccactccatcaaagggcctaatggtcagcagagggggctaaatgtgtcccccgtgacctgacattaacggagtggactgttttaagtgt

SEQ ID NO: 36529 - DNA, 1160 bp, Bovine  19866880649232
ctgagttatctcttagcataaaacggtttccaaatcccttacttcctctccattgctgttcctgtatgtttattttgttcctctggcctcttgtccaactggtttctctctggagagcttaggcatgaggaggtgagcaggatagaaggtattggtgatgctgagacaaatgggtattgtagcatcagggcagggaagagaaattgggcatttgttgagtgcctgctctgacccaggcactggactgtattaagtgctttacaaaggttatttcatctcattctctcaccagccctggaaggactgaaatatatgagtcttttgcaaccgcttgtgtaaatagcagtattaaggcagagttgtttggctaaacaagtgacccttccctcttgtagtcactggccacaccatggatctgaacttcttaagctttatgacatacttggtttttctaactcttgagtcaatcatggctgtttttttccattggtcagtaaatggcctaatcatcatgtggccttttgcttcatatttgtcactgtcaagttggctttgtattttggaaagcttccagcactcattaccataatgataaaaggagagatgcagtgggcgcttgggctgatttccattgagagaagttcatattctcagcacaaggacttggaaaactgtttagaggggccattcttgctttcagaatttatcgcttcaaaaccaaaagaacctgcaaacctgtatattaaaaaacgttcatggttatttgagtctgcagaattggagctgtcaacttgtccagaattagcctgcaagacagacaaggttgatggcagaactctaacactaatttacttataatttgcttttgtttcttctcatcttgggagccgttccttggtgtttcataatcagtcacaagccaggcaaactcataggttgtttcctttaataggtgtaagacaagcaaaggaattctaagaaaatctcctaaatggaaggcaggcattttgttttgtttattgtagttgggatcctctgaagagaagaaccttttgtcctgacttgcagagctgtcctttatgtgactctaagagcccaagtttgtgcttattagacagaggccagtgtggcctttacaaggaggaaagagctgactttca

SEQ ID NO: 36530 - DNA, 1699 bp, Bovine  19866880696427
caagccattgagtaggcattgttgttattcctaacaacaatggggctagtgtgtctggaacatgaaggaccagagaaagatggctcagtatcaagctggagaagtaggcagggcccagcagggttgtagcaggaaaacagaatctgatttgggttttctgatgctacctctggctgctcattggtgaatagaccaaaacagggtgaaagaggaagtggaggggccatttggaaggcttctggattctaggcgagcatagatgtggttgggcaggaaggtggtagaggggatggcaggaagtggtgatttgaggcaagttttggctgtgttgagatttgagaggcagcccaacagtaaggacacagaaagaaaacacatggactcaaacctcataccagctgccctccaccatgacagcgagggaagggagagaggggtgagaaacagacgcttggaaactggaagacgttcaggaacctaaccaggatcctacctcaccgtcaatctaagacttaaaatatccattgcctgcatgttgtggtttggctgccctagttcctctctttttttttttttttgtcaaatggacacacacatacacacacactccggcacgcacccttcctgatccactaagcacggagcaacagtcaacaataaggcttgtctccatgcaggggagagagatagctacccagaaaaaggggggagggggagtgaagactgaattgtgaagacagctcacctggggaaacaggtccggctaacctccagccaatcattaaccctgcccgaggccttcaggacactcacacactcgggaattttaggagcccggaaactcagagcaaagtctattttcagaacatggcctgaagaaggaagcaaaggataaacagggaccaaatgttttaattatttgaaatggtttccaccccaacaccattccccaagtgttagaaaggctggccaggagaatttatgggagggcctttacccccagcttgctgccatccaggcttgcacagccccacaaaccctttggcatgacagcccctcagcaggatgggctgggtgtgcccctggctgccttgtgcctgtagccaacaccgggcctcagagcccagtgagcttcccgggcagccatctggaaccatcctggccttcagaacagtagccacagttggttctccagggactgcctctgagtttcctgcgatacagttcttcatctgggttttatagagaacagggtcttgaccctgggatggaagagagcacagccttgttagcaaactgtccggggaaaactttaaggaaaacgaatgtggaggaggcaagggaagtcgggaagggctgaaggaggacaggcccgtcacccggcactgggccccaacagactccccgggcgtggccttgagaccagcgaatcaagtccagatacctcgcagagagccagaggacaggacagacgtgtcagggaaaaaataactgctaatatgataaaatgccaagtggctacgacaggccgcagcccatcagagatcgcagcaaacacagctcggaaaaagtacaaaagtccttcagtgtgaggtaatgaggcgcgtctaattatatttaagaaagaaccagcaagaaatgctttcaaagccttcccctctttcttcccttcacgaaccaagtccaaatcccaaacgga

SEQ ID NO: 36531 - DNA, 1202 bp, Bovine  19866880711601
agatgcaccatttatgtaattgttacaaatttctgttgtacaaccaattcccacgaaatgccactgcaattgttcaaatacttgtggaagagtatcttaaaacccctacattttgcacctttaggttaacaaaaataccatcaaccaagattctaacagttttatcaagaattcccctgctgttcagaatggagggataatatcagttgcttcatctagtgagatataaagttcaagaaacatcacatgaactatagtactttcacagacatattttccaaagaaaggaagatcttcatatttttatagcacagagttgtgaaattttgcccaacttctgttgtaaaactttgtaagttttttaaaacccacagataatttccttattgcttacattagggaacattttattgtgatttaagtaatgtggaaattagtttcaaaacgcatgatacatctgaaatcaagactgaattggaacgctgaataattccacctttcagtaacacaaactccatttaacacagtcatgttgtgtcaaaaaataaatgaataaataaaaaacaactccattgaaactgggaaactacagaggtgacagctaactgatgtttctttgactgaatatataataccatgtcagatttctcagtgttactaacattgatcttactattctattaggcacagtttttatacatgattgtcacatacgtggttcctgtaaagtggacatacatttcacaaaaccttagtaaaattttcttgctccccctactttctatgccagtaagagttctattaatcagggtaaagcgaagctctgctgtggtaacaaagaaacctccaagcattagtctaagccttgacacatcatatccatacaaagtcagatatggttcaggcagccctcttccatctagaaaataagtcatctagaatatggcttctgatgccattgtgtcagggcaagagaaatggaaaaagacacctggcttttatctatttcagcccagaagtgatacatgtcaattcctctctcccaaatcactgaataaaccagttgcctgactctaactcaactgtctgagaaatatgagagcacgtgggtagttggtgagcatcagctgcctttgacacaggcactaaaactgtataattaagtgatttgaacacacctcaaaaggtttaaactataggca

SEQ ID NO: 36532 - DNA, 1411 bp, Bovine  19866880714089
tttacacaatcttaatagacggaagggttgcgcttaaagttttcagttactctgtgttgtattgtatagggaaatcgtatattgtagtaatgacagagatgggcgtttgtgaagctgtctttgtaaatttctagaccaaagaattattcagaggcatggcctgaggcattgaaggagaatgtcatcatgcactgcttcattttgttctttgaacacagatagtcttgtgcacccgtccttagcagaacccatactttttgctttagttttgtcatcagctctggactggtagtggcttgattttctagctagtaagaactgcccagagaggtaaaaaggacagaaccccatgttgtttccacatcctggtcccctaagactcttgggtctccccttgggggaatctctcttggacagaacagtattaacaagaccatgccaagcagggacctctatggtcactggttgaggggagggcaagtggagtgtgttggactctgtttatctaattcatctcacccaaaattcctgcccagagagctatgcttcatgaaagacaaaatagcttaagccaaggggccacggaataaatagccccccaactggtgagaaattgaagctgagaagcaatctgacaatttccatctcttaaattaaagaaaatagatccagagactttggaaatctttcagctccacaaatgcgagtccctaggcccaagtgtctctaattcttcacaccagaaaagttagaagcctcaggacaggcggcaactacaggtctgtctctggatgctcaagtcattaaactctgtgaaagcaatttgacagcgtttgggatgtgttttgtcattaggggtgggattggtattgttgttcattttagccgggaagaggtgtgtgtgaaggtgtctgcatgtgagggtgtgtatttcagatgcaggtgtcactgagtgtgtgcgtgttagggatgcgtgtgagtttttcgagagtttcattactgtttttgttttgtgttgttcctgctgaagaaacactcctgagtttgattcctctggaaattttgtgctactctcccatatgactaggatcgcccaaagcaccattcttcctctgaatcattttgaccagatcactctgagcagcccgaattttacattcacttttcctcctacctaaaggaacaagttgtcattctaattaaataacaactttatttcataatgccaaggaataaaaatctctgaattactttcactaacttcccgtttaaataaaatcttgcaaataattatttgaacataaattatttacccattaattctttatttgaatttggaggaattcaaatatgttttctggcaaacacttcatgataagtgacttggttaattagcagtaagtgtgttatt

SEQ ID NO: 36533 - DNA, 774 bp, Bovine  19866880722075
tgcctctttgaaatctacatcctcttcgacatgctggaaatccagaacttttgacaagctttcaatacattgtaaaagttctaattttaaacttctaaatgttataggccaagaacttgctgttttgagttgtcaattaggcagatggctctgttggtcaattaaatgatttttgtggttttaaaacccgcataaagtggtgttgagagtctcaatgtcattcttatcatctccatgaatatttgtggagcccttcctgaattaaagtacaaaagagtaagatggagcacaggttcccagctgtggatttgagatgcctgtggcaggtttctatactaccccattgaagcccacagtggtagagagaagtgacaagcgtgatgggaattatgcaaaatatatatatatatatatatagaaaagggttctcgatctttcaacatggcacctttcaactttgaagggatctgggaaaggatttcccatccttgagcctagctcaggctcacctcctcgtgtgaatcctgccccctggcccagtgttaaagctgacctcatccagtttctcagatcccctctctgggtagacttcctggattagtttatccaggtgccaaaatagcatccttgagatccatttgtttcactgctcaggacctgcggtgatgtgcaaatgcacctgggtttatgaatagatctgcattctttgttatgggtcgccccaccctgcaagggtagcatatggagcttgcattgaacacatctccataaatg

SEQ ID NO: 36534 - DNA, 735 bp, Bovine  19866880747385
actgcaggcagattcttcaccagctgagcccaagggaagtctgacccttctcttttcttctccactcagtgttggaattgtctctaccacccctacttcaccaactccaagatccattttcacgaaggtgtaaatgggttgattagtttattcagggctattgacaggctgcaggcactggagcattcagcctatctccctgcaggctccctggtggctgcaggggcttccctggtggctcagaggttaaagcgtctgcctggaaggcaggagacctaggttcgatccccaggtcaggaagatcccctggagaaggaaatggcaacccactccagtactcttgcctggagaatcccatggacagaggagcctggtaggctatagtccatggggtcgcaaagagtcgggcacgactgggcaacttcacttcacttcacttccctgcaggctcaagcaggccatggttacttccatggcctccagcagcaattgagtgctggtttgcactggggtttggagactgagagatgtgtcattccagcatccctctgactatgattttctgaagacgtatagttgcctggatttaacagggccactgaaagtgcataggaggacggggaaagacagcagagagcctgcccatgggaggctgtgctaggggagaacagaacagagtccttgcattatctgctgtgcatacctgggacacagacatgcatgcaaaacccatgg

SEQ ID NO: 36535 - DNA, 1792 bp, Bovine  19866880755034
aattggagtatagttagtttactgcactgagcttttaaaccccattttctatcaaataacctgaaaaacagctgtccagacctttcagccattgaaactcagttctcagtctggtgagaaagtgaatattgttttaacatcattatgactttcatattcccacgttgtgggtaccactaaaacctgggccacttccgagccctgcagagaagccattctgcagagagatgccgcctccagccccctacccctggaaatctgagtattaaaagtgtgactgtgcggacctcagatcaaccttgtccgattgtgtgtgggggcatggttgacattggaggctggataatttttgttgtcaggggtgtccctcatttctccaggtcagataccaggagtccctgctccccaaccccgactccccatcaaaaatgtctccgggaatcacccaatgtctccttggcaggcatggagaaccactgggctagagactgtgtttgttttctcttggataaaaagatggtagattcctgccgcctctgagttatatatatttgttgagcgttctcttaagtttgtgatttgacctagctgatatcagttgttgccatttgcttaatttcatggtcactttagcattgaaacattaagactctttcctttaagggcacggccatgggctggtgtttgagactgtgacattttcgtccccaggagggctgtcctgtagaaatagaactcaggccccatctgtaattgtagacttgctaggagtcacattaatagaaaagtaaaaaagaaacaggtggagtgaagtttaaatgtctttttccacacagtatcggcatgactttctcaccgcagcagttgggacttgccttgtggccagtgctcggcagtggcagatgagcggtggccaccatattggacagctcagccccatctgggatggttttgtggtggccaccgtgttggacagctcaacaatatccagaatgactgtggccctttccagctgtggaatcacaccacgggagcaagttttttttcttcttttcttaaaaaaaaagaaaaagacaaaaaaaaaagggctttgtgtttattctctgcaaagtggggccttggctgcacagatgcagctgtgtggagctgtggcccagggagcggggcctctaatctctagggaagctcccccggcctctgtgggggagcaccctgggccagcctgggaggagggtaaataattccaagggctcagtgtactctctcacaccgcacagactaatggttcgggttaattttgtgtacaaggtcccttttgttggagaagggggtgaaagtccgcagctgtgaccggaaacaggggacgggcctactgggatgaccttgttttggaaagtctaaatggagcactaatggcagagatctaagacgggtgatgtatgtgtgtgtttgagtgggcctgaagataaggtgaagagtattttaaaagttactttagtgcaacctcccagataaccataggccgagggccagttacaatttatggcaagctggtagtcaggcctggatgttggcctcattttatctttgagtccaggctctgtagcttaactggtggtgctctctttgtttatgttagtttttggagggggagggcatggggggcggctggtcaggttctgcagtgaagcctagtgtcattttatgatgcagagccactggtcttcctgctcctgggcgcgctgtgtgtgtctccttgccatccctaattgtaacgccgccgggcgttgca

SEQ ID NO: 36536 - DNA, 1373 bp, Bovine  19866880765653
actaaatcgttttactggcctatcacacttttctaccgacagagagcaaaagtaaatacaaatcagtcgtgtgttgcaccataggaaatttatgatgaccccaggcaagtagctttctgcaagactaatttatgtatagtcacatctgtcactgtggcacttggacacatcttaggcttttttattagttattcctggtaacaaccctgtgagatcacaaggtgggtcagatattcccttcctcaagaggcctctgaaatttcattcgatgctactacatttcaggactcagtcctcaagtcaggagtttggtccagaccactgatcaggatcatctcaagtcctaggactcagaagctctatcaggcccaaattcattactccatttattaatttttccccacaataaattcggagagggaatcactttcctggggtcataaaatgatttagttgtagtagggattaaacttccttgtaagttaatgattaacaaagactcagatctggattcttattctgactcagccatttattaatggtgtgactttgggcaagttgcctcccttctcttgcaacactgtcatcttttgagagcgagggaaacattgcttatcctttgggcattattgtgagtgttgtagtaacaggtcactatctgagtgttttctgggctaggttatttatgctccttcctgtgtttaatccacaacacagccttgaaagaggtggagggtgcctctgtatagaactcctggtacagaatcaacactcaatattattaggatgctatgtggtaactcattcttagagttagtagagaacatcaccatggttgtctttctttcctgctgtttatttactggaaacatcttggaattcagagaggaatctcttcaagttgcaaaattacaggttaacagaatttgaagtaattttggcttaaaaaactcaagtgtgggcagagaccaactgatgaggctctctgctgactctcagaacaaatgcatataatctcagctttcatatacaagcctgaaactcaccagatccacctgtctcctgagttacagaggcacggttgtacctccagccagagtcatgctcaggtaccacagagcattattgcttgatggctgtatacacataggcccttagaatagcacatgtcctacagtaagtgctgagtaagcattagctagtattgttaccataagcattaccctactctcatcacacccactagttatgtctgctagatcagctttcttaatatacaaagctagaaagattctcctgtccagaatgagatttgtttgaatggctttcatattcttatgaccaagtgatactacctaactttccatgaatat

SEQ ID NO: 36537 - DNA, 1659 bp, Bovine  19866880783356
atgtgtcttggtatgtctgatatgactgatatcagacctatctgggctcaggtgaccagccccacccacagcctcaggctctccctggtgacccataggcacccagactcttcttatttgtactccacacagacacacacagccgcacgatggaaggtatcgagaaccaggcagtccctcttagatgcttcagagagactttgaagaagctgatggtcacaaaagacaatctcttttaaatcattgccctgttccctccagaatttaaatattgtgaatttttattttagcctcctagaagtgtcctgttagagtgaagcctgccatatctgtaattcacaaatgccaaagcgttctagatttgagcaggaaattaaagcttcagatgctgcaatgtcccatcatcctggagtagggaaggctggaactcctgtagaggctctgaatcccattactgcagatccaagacatcctagcatctccctcaaaaaacgtctgtacccaaaggttagtaccctgccctgatttcacttctctctgctgttgattataaaattctttctccttctagatttacaaatggtagtgggcaatgtttacatttcttttatttcccatctgttagataagaaacatgttcgaatttaagcatgagtcttaaacagcatctcaggacctctcttgcatcagtgcttagcaactgcagttctgggcatgccctctgctcctcagaggggaggttcatgggccactatcaagacctcttttgcaaatgtacacaagacctcaaacaaagctaaaaacagggagcttgacaaatgactggcaccagaagttcttcctagagtatgtgggatgctcagagtcagctctgagccagttaaccttggcagggtcagagagagctctcatccggaaggatgaaaagccctttacaaaagcagggcaagcggtcttgaaatggccatcatggctcctcctgatggattctggttccaggacacaaacagttaaaggcacctgcctgttccttcagggtcagcacacctgctcaccaggtgctcgttgctcttagggaaagctgtccattccaaagaaagggcgaggggagaggagcagaggccatccacagtgcaggcttcctaatcaggtgcgagcagatgctctgctgaacaactccatgttgagatgtcactaatgtaaaaattagtgtttttctctttctgccagaatgcaggatttacatgatccctcacacatatccctggaggactggggtataatctcataaccagcaaggagccaataaaccttcattcaggagaaaatgcaactcccagaaaactcagaaagcttgctttcactggcagctgcccaaacttctctgccccatgtcagggagcccatccccatgttgaggtgcatgtctctctcactcccacctgcggtcccttagctgcccttttatggtggtcctgagccatgcttgtgctgggcagcctgtgaaatcagtggggaatgggagggggagatcccagggcaggtggacatatacaaccagggtgtggggactgaacgcagggagcacagagcttggccacccccggaagaacgaggatgggacagtcctggtttaataagccacattggtttaataaa

SEQ ID NO: 36538 - DNA, 1958 bp, Bovine  19866880791727
aattgttagagaactggcaaatggactttgacaaatcgcaatttgaggctttaaaaatgaacttttatcacagagcaagaaaacaaccagatactcagctgtgcttatgtaaattccttgagcgacatataatagagacgcaactgatgaacgctcaacgacatttaaagactagcatcaaccccttcttgtgggtgggaaatagatgactcaaagattgctctggtcgaataaaatattggattaatagggaattatcatctataccacacatggattaccaattttaaaagaattagacctcaacaaaatacatttaatttaatctttctttgatgagtcagagggcacttcaagatcttgctctgccctcaggccatcattatgaaccactattgatactggtgaggcctgggagatagctaataaagagatctggtcaacagaacacaggaaaacagggagtctgctgtttttagacatttatgtcagggtgtttccctttcaattttgatctctttatatccccaaggaagcttacagctcactattccctttcctgtctaggccatagcatggttacatcataagaaggatttctcaagatttttcattcaaagattcttactggcatctggagtcttctccttcactatcatgtattcagtatttttctattaaacacattcacaataatttttctccccattctccttttttttcttcttcttacatgtggtcgcagtctcaatatacaactaaacagaatccttagaaaggatctatttgtgcagaattataaaaagagaactaaacacgacctgtgtcttctaagaggtactatctcagatgtgctgatacacgtacacagagaaaggctgtccagaaattctagagactgtctaaagacttcaagccagaggaaagtgccagcaaggagctagatgatatgcactagtctcccaattaaataagaactgtttcaagtttactcttctgttactgcttgtttttttgaagttaagtttttcactttcctcttaaattatagggccccaaattagactaaagtggggtattaaccagtgcagggtctaatgagaaggttacttgtggtttcaacattttatgtttctggccagagatactttgaacagtggcatttgattggcatcagctcatttgttttgcaaataggtaataatgaaaccaaaaaaatgtgttccatatcctgcagaccagtaagctttgctcattttctaactacagactacaatactttggccacctgatgtgaagaactgactcatttgaaaagactttgatgctgggaaagattgaaggtgggagaagaaggggatgacagaggatgagatggttggatggcatcactgactcaatggacatgaatttgagtaaacttcgggagttggtgatggatagggagggcttgcgagctgcagtccatggggttgcaaagagctggacacaactgagcgactgaactgcgggatattaaggcttgaaaataaaagtgactcaccggagaggcacagttgttggccagcaacgaatatttgggaaaacaatacctgccagtcattaaaagatcaaaatcatgcaaatcaaaataagataatattttttctgttaagttcatttggaaaacagaggagagcagagggtaagcaatgtgaaggaagggagaggggaggatgagtaagagataaagagagaaagcccagttgtggtgcagagaagtaaagcagcctctacaacatggcagatgggaatgtaaattagcacaactttctggaaaacagtttggtaataaagagtcaaatgtaggttcaagcttcttggccagtagttctactgcgaggaatctatcctacgggattagggaagctgcccttttcctagaccttctcactactaccctctgtatacactgccag

SEQ ID NO: 36539 - DNA, 2453 bp, Bovine  19866880821011
tttctcctgtgcctttgctttgattgcttttacttacatctctgaactttcatcttttctgttgactattacagggcctcacttgctctccagttcctagagcccctaagtggtcttcttacccaagtctcctgcccgccacacacactacggccagaattatccttttgaaactggacaatgttctcagagcttccccaaccaggaaactgggcatattataggagcttaaaagtattttaaaataaagaattagatgaatctcactgaataaatatcaaattctttgtcttaacactcaaaatcccttaaatttggtttcccctagaggattcttgaaagtcaaagtgttagtcgctcagctgtgtctgactctttgtgatcccatggacgatagcctgccaggctcctctgtccttgggattttccaggcaaagatactggagtaggttgccatgcctttctccaggggatcttcccgacccagtgattgaacctgggtctcccacatcacaggcagattcttcaccatctggtaaaggtaaacccctcctaaataagtctattagttctagatctacaactgtctacagtagcccaaaatctgatatattagattcaagcatatgcacttgtcaatacgtaactgtttgacctacaaaacagccattttgtatggcccaattcaacatatatttcttcccctgtgattctgcttaagccattctaaatgccagtttatcttcctacgccatccaacttattcttcagaatccagttctaagtctctcatcttccacagagactccacaatggatggtttctcttctgcacttccatagaactttgcaacctttttttttttttttttgcatgttctcagttgccttgtaatgatgtctttttgcctgcatatctctcctcccattatctccccaagttgtcagtaaactcttggaggacaggatcttgtcttgttttcttcagacccttcacaggttctactgcaatgcttttcatagagcagttgttcaccagatatttactgaatgaactcaaataatgtttaattttcccaagcatataaccttgtattctaccttaaaacaataggaaaaatagatgtacaaagtctgcaactgtttccttttaaaaaaacaatcattccttaaacatacacttatcaattagacattatccttcgacactaagagtaggagataaaatgcattgggggtggaggcaggagtacccttgtgagatatattaactcctcaagtacaaagagcctgtgttgtgtgatgatctttttcctggcctgtctagcatcttgaagacgtgaactgacctacaagggcttatgcctttggataatccacagataaatcttctgttctgagcatcagcagctacttcatttgctctaaacaataggtgaaggaagggaagcggccaacgcttccgctgatgacgaaaacgatgacggcatttacatgattccgcagtgcttgacaaactcagcaaattacttgtaaagttggcagtcagggctgtcaatgaggaagagtcacctcggggccagaaagcagcagccacgtttgcataaaaggagagagctcacagcacctgacaactcagagagaggtatgctctgtgtgcataggaattcacagagcaaatgggcttgagttacagtcaggaagactgaagcatgggtatgagaaaggacttcagaagagccagggcctccacaaaagaacaggtgttcagaggaggttatcaaacttgcttagaagaagttaaacagcgtgctgttggcacctgagtaaacagacagaccactagaataaagcagaaagtctgggacgagacccaggcccacgtgaagatttagtatatcctaaatataaaggtgacatcaaacatcacttgggtgcaggtgatcttttcagtaagtggtgttaggacacctgcggagccagtcagtcagtaaagttgggcctatacctccaaacacacaagaatatagtctgaaatgggtcacagagagctgtatgaaaaaaaaaagaaccctacaagtcctgaaagaaaacatgggtgaatttctgggtatggaaaaaggatttctaacttgaatcaatatccacagataataaaagaagtgattgataaattcgattacataaaaatatttgtaaaagtctgcatggaaaatgcaataagcaacattaaaagacaatgagaaatgggagaaaatgtttgcaatatatattacaggtaaaaggctaattttttccaatatacaaagttatcttaaaatttgagagaaaaaaagatataaagcccaagaggaaaacaggcaaaggacatgaacagtcagtttgaaacaaataaatacaaatagcatttaaatataagaaaaatgttcaacttcacacataagtaaatgcaaa

SEQ ID NO: 36540 - DNA, 1665 bp, Bovine  19866880916993
tcttccttctggtgaaggcctaggaggctgcccgagtgtcatccttgtgaaagaccaaaggcagctactacccccacttctcaaccatcagactctgagctaaagcaccactgacagcccctccatctaaacttccatctcccaaaccagcaacataatggaggagccaattaaatgattattaattcatgctactttccgtaagccagaggttctcatcgccttgtgttccgtaaaccagcttgccacctgccccagaaatttacagcaatcttttctatctatctccattgactaaggagaaaaaaacacattcgtacaagtccagacttgaagcttgagtttgagataatgaccccagcatgctagtcacagaagcttcactagacctgaaaatggtcattcagctcataacaaaaatgcaatgcaaggggcagtgagctctctccacaggccaaccccccacccccacccagcttttcagaggccccacactcccctctagaaagcagaaatgcatggtttccagaggatgctctgtgctctatggtcctcactgtcgttggctgtggggctgctcttgccatctgcttgcaattccctcccaagagcagaggctagggttttgtgctggatctcctgcggagctactacgcttggtaagtggccagagatctggctaaactctctcgcttcactacgatagcgaacgacggttcctctaaagggtctgctctgctgccaacatggtggttgaacattcatggttctcattctgcctccagccaagcacttaaagtcattgcagaggaatcaggagactgtgtgaggcgaaggtgagcactggcacagccaggggggtctccgtgccctggccagtgcccttccccaagaactctgtcctagagtccagcctggtgaggtgagaagccttccattcagaacagtcccagtctgcgtaactgcaggctacactgcttctgcacatctctagatagagaagttcagacacccgctcaaaaagtgagccgagcacccctaggtaggtggagtaagacacaggcctcatggactcatcacgtatagcttcccgtttccatggagcatttcaaagaaaacttgagctctactacagatgggtgtgactgctgctggggaatggctcattagttttctccaccaactcgaaggtgaaccagatagctcggcactttgaaaacccagaaactctttgctgttgttatcttgatttttatttggaaatacagattcatagttaatttcaagaatagtacagggaggtctgtttccccttcaccaagtgttactttttaaccaaccagggttgagataaagagtgctaggtctctgatcactcctcaacatgaccacgtctccccgctcccattactacgatctagattcccttggccagaccaggacttgtgtctcctctgcacacttctgtcttataggaaagcttagtccctccctcatatgccagggacttcagaagtctgccatccagctaaaggagaaataggtctcaaacttcatacctgtcacagagaccagagccccaacattctcaacttcaaatgagtcccagaaatcccccagaaaacttgctaaaaggcagcccccaccccctggaacaggtctgat

SEQ ID NO: 36541 - DNA, 1187 bp, Bovine  19866880919552
ctgatgaatgccccacagtttatagagttcttcatttccttttcaaatccatttcccttatttcttatcccagcctcagctgcaaaatgcaggatattcccacctcctgcctctcctgtcccttgccagaaatgtgctatgccattttctgctgaccaaatccaactcccacccacaaaactcactggtgaccacatctctgtctctctgagcatcaacaatagtctctatttcacatctcagtttttaaaccagtgctgctctatcaacttcggtagtttctctgactacgtgtaggatcctgggtatatttcttcctccaaaatacctagcacactagtaggctttgataagtacttaatacttatccacctgattaatttaacccacagactgcatttgaaatattagggctacaactgcattcaatgggtaggggacacccaggatagtggcaggggcagaagaagaatattctgttttggttgcatcctaagaacaaaagcctaagtgtaacagcatacacctgtttctcaggtcgaggtttgtaagtggaagcattgatttcaaatgtcaaagaaacataaatattgctcttagggcaataaatgcaaaacaaaactgaaaggctttgatgacatttccactgggtggctgtcactcatcaattccaaccttttaacaaaatttttgtttggtttaaagcaatcatgaagcttcacgagccatcagaggtggagctgtaggagatgttagcaacgacatctcaacagttaggacaggtgaacaatttctaaacattttctctgaataaagagtttctggtttgaaagaagatgaacacacaacactttacgactagggttgatgcagttcggggtggaacacataggtttgcccagctttctgcatgatcacctttccttcccaacttcatcactggtccctttcccctcagtgaaggcaatgcgttagggaccaaagttagggactttcatctttaattgttctttattcaaatttggacaatgtagtcaaagactactattcaagagatactaaaattggccaaagaattaagagtaaacatttcaaaacagctcagcattcagaattagttagatggctagaaggtagttaacagagaagaaattaacggactggagtgaggaacaagtcagtaggaa

SEQ ID NO: 36542 - DNA, 1320 bp, Bovine  19866880966750
gatttctggacacaaaatgtgtattatcgcccaggttcagccaagaagagggctctctgaggccgcatgcatattaaagtgtgtaatcttgctgttactatggggaaatgatttacaggatcatacaacccgctgcctcctgtcatctgctgggaccctgtggttgccgtggctgcacatggagactcagctactgagttaatgtcacctactgtgtaaaattgcacctcagcagaaggagaaggctgattggtttcagtcggggcttcatgtggtgaaggcttaactaggagaaaagccatccgaacccctgtggcttccagtgagggggtggcagagccagacctgatactgagacctgctttggtgtcaaagctcaggtcattctggctgaagacgcctggacattctgttagcgggtctgtggtaaacttcagggcatttcctcaagactttacacaaacctaaggatgtgagtcagagaaggcagtggcaacccactccagtgtgcttgcctggagaatcccagggacggtggagcctggtgagctgccatctatggggtcgcacagagtcagacacgactgaagcgacttagcagcagcaacgagaatgtgaatattcgacagaaggaaatctggagaccaagtctacgtgtccacaatatgatattttacagagaacagagttaggaaggtgttgggtgtgtagagaaaagtgagacagcaaaagtcagagagaagttgtctggtagatgtcttaggcatccctaaatatctgggacaggtccaggcaaagtggcagcatgagaaatttggaactaggcatttttcacagaaggacaaatgaacttgctattgaacatcttggtatctcagatcagatcagatcccaggcttggaagagtatcctcaagatccagtttgtagcaactcagctgttattggtaccaatccttgatccactggggcttctagtatcttcatctgcaaaatgatgaagctttaacaaggtgaaattcaaagcccctgcctcccgggcgcccatcctgccataacacaagcccctcagtttccatgtccaccatacactgtcctgctgtccagctgaatgcctgacacatagtaggaactcagaaaacattgcatggaatgcctcccgcagcagagtgccagtcagtccttatgagtccagaagggaagattcttctccagtgagcgcattagtgttaatgcggccatgccccttgtttctgctctgcagttcctcaagttttccaacaggggaacagtaacagtacatttaaaggcagtcaggaga

SEQ ID NO: 36543 - DNA, 1240 bp, Bovine  19866881005717
ctgttctcctatttatgctttctagtttttattgtctatcttagcaggctgcaatgagggttgtactacctggtaatcctccatgatccatatgtagtttataaaaatcattttttatctctaaactttgttctctgcctcctgtacttgtctctctagaattcatactattctggaaaactttggaactctaagtctcagtaactccctttcatcaaatacttaatggcactactaatttggttatatggcactactagataaatctaatgtcttcctcctgcatagataggataggctgaaaatttgaggctgaaatgttgatgcttgcaacactaaatctctttagaacatgcatttgttgtcttctttcacattcaccaaaatgccttggaagagaaggacctcctacatctattgtcaattcattatgcattggtttcctctcaagaaccagtcagccccattcaaccagcagtaggtggttggtgctttcccagaagtcagtgacagcatcactttcatggctcttgattctgaaaaatcccatgtccctaagccaccgcagcccaccttcacaactgaatggtaacataacttcttgtgaaacagaagagaactccatcacatgtagaaaactcagccatcaataagcagctctgtaagcccttcagttggggaccaaccacagaacaggctgtccttcaacaatcaaacagtctttagctgtgatcagctgcttccatcacctctgagactggcagatttccaataaagccaatagcaccccctcccccagggtaaggtcatcagcaggaggcaggcattgtcgttcagcgcagcaatttgacaacagtgttagcttacactctattagccagcagctacaccctgacccctgaccctgacattggcctcagatggccctctcctgaggtagactctgatcatttgaggtggcccgccttgctggttagtatgagaggaggcccatcaggaccaagcagggctccttgctcagccctgctccccacaggaggctgaaggcttgcagtacagaaacaagccagagttgaacccaggatggcaaaggtgaaagttcagaaacatatccatcagcagcctgtcaccaaaggatgctgtgagaactacgggagctttcagcgtagggctagcccgttgtctccagacagtcccgctccttaatggaaaagacatatcaaaatatggcttacaaaat

SEQ ID NO: 36544 - DNA, 1436 bp, Bovine  19866881049064
aaggcagagagaaatggggctttgggaaaataaaaatctgttagtactgtactgtctgatagacagtttgtaggctggacaaaataaaacaaataacaaaccttacccactgtacaaaaccccccaaaatcacagcattcaggatggccaggtggaaaccaaaaccactgtggaggctctcagtggaaatacaacatgtcagtctgtaccaaagcaatcgtaactaagaaaaccaaatttaaccacccaaagtgtttctcatcaggcttctctcctttaggaagcagatagatacagccatggagaacatccatctgagaagatgtcccagaacaaggccaaagggacccggggggagaaaagcttccaacaggccatggtgaaataatagggtgaaaatttctaaatgccttaacattttatgggagaggtctaatgtttctacccaggtacattatatgatttccactacctctgatctttactttccattttacagcccactgaataacaggtttcttcaagagggaaagaaagaaaacagaccccctataattgaggacaactttgcctcataaatggtttgtgcgttcagagagcaaaggcacctggaattttctacaggaaagtactttcaaatactaccaccacgtgctggtaaggcaatcctttcccttgtcaaacagtactaaagcttgagctttttaccacgatgcctggagtaactgccagggcctcttatttctcgttgccaaaacagatggggacaagttgatcaaacacagaaagctgcagtggtctcagtaacagcatcaggatgtcaatggcgggcttaactggagagaccactgtgaatggggtgagactacagccactgagggtgggctttccattcacagcctccctcccaatacacacagaggactcctttatttccattttcctcttctcctttctctgcccccttctctccctgcaacccatttctgaaagtaagtcaaggcctccagtggcaggtcactgatgatagatgctgactctaactgctggaaatagccctgtgacactgggccatgatggaattaccctcactcagatcttctcttgggtctgtgcatccttccaagatcaacttacgagacagtgggccagaggcatgaaggacaagaaatgcagacacgcacgcttgtctcaggtccagatgctgcatctgacctaagtagctgtgtctgaggggcatccgcctgccctttcatgcctccttgctggtcagtgcaaatgcaccatgaatgaagcaaacacagaaggataaagaaaccatggcagaacttcttggaacataaaggccttttggcagattctggctctccctctcctccaccatcccctccatgggaagggatgcagggacagtgagaaaactatttgaagaagca

SEQ ID NO: 36545 - DNA, 1705 bp, Bovine  19866881141914
aggaggaggttttcagagcccagggacctgggacatccgaagaagcgagaatcacaagagggctggctggcaggaaaagcagcagcttccattgggaccacccagagcagaagcaagaggagaaggaaagtgggagaaatacctggcttctcccttactcccaccctctgggctcctgaccatccttccctttttggctgactccatccaaccaggagccatttggagagggagctcttgggaaatagagtttgcacagggctgccctctggaatatggggcaggaaaggagggtttgcctctgagagcaaagaggccaatgaccagcggcccccctttcccatccgtcctcaactgatgaatagaaacccttcctaccacctctgtgtagaaccaattttgtaggatgcattcctaagaaagcagaaggctgaacctttagtgcctttgttttcagggcctggggactgccagctggaggctgtgctgaggggctctgcttcttgctttttttgagcttacagatgccgcaccttactttaggatttacaggcgattgcagtttcataaatcagcgatgtgcgctccgtgtgggagagtctgcaaattctaaactaatatgtcgctctttttctgtctagcatcatatttatgttaaggctgtataaatcgtgctctccgcttctacagcacaatcacagtgaaaagcgatgtagctaacaataagaaagaatggaaattaaaatgcaagaaaacaaaatgaagtcaaaatccatgtgacccgagagttaaagccacttatttcagaaatgtgcattgattaagggaaggaaatcaagtattcagtctgcatttagccacttagctgctaagccgttcagcctgttctcttgctgtgtcaaatgtgtctctggtcaaggccctgaggattgtctccacatctgaggtggtggtggtggtggtaagcttctgagccttagtgtcttttcgggggcaaactttccagagggatcttaggggccattgtactgaggaggaattgtaagagcaaaactgggaccaaatttcccaccaacaggtgaagacagaaatggaactcaagaaagcacttctcagccttgagccatgaaatccactgtttcctgcctagcttagcagaccacagtaaggtggattttagcagaagtatttctgccatacagatctcagtgtattttatgggcacagatttcttcttttagtatcagactcctagaaggcatgaacgtaccagagctaaagaacaaggctgctgctaagtgagttgttcctttggcttgcagagggcagtgatttcaaagggaacccacccagagacatagcatcttcctttcctttaggggtatttgcttttcaggtttgtttattacatttgaaaaaccaaccgaaacatcagcttatgcagtagaccaaggaataaaaggtaatattttaacatgctaaaggaattctgccagccagtcataagtatcaatccatcacaattattagaaacaatgtactctgcagtagtaaagagatacagccaatatgcagacatacacgaaataaattccctcttaggctggctgttctgcccgccccccaccctcgccaaggcaaatgcagagactgtacaaaagagcaacatggagacaggggggaaaacaacatcacacattctttt

SEQ ID NO: 36546 - DNA, 1417 bp, Bovine  19866881158402
cccatggaccgcagcctaccaggctcctccgtccaagggactttacaggcaagagtaccggagtggtttgccattgccttttccataggcaagtacatatagacagaaagtaggttaggagttgcctatggccagaggagcagggagataaggtgtttaggggtgatggagaaggaaatggcaacccacttcagtgttcttgcctggaaaatcccagggacggcagaccctggtgggctgccgtctatggggtcgcacagagttggacatgattgaagtgacttagcagcagcagcagcagcagcagaggagcggggagataaggtgtttaggggtgattgttaaaggatagctaagtttcttttggggatgataaaaattggtcattgcataactctgtgagtagatttaatccactaaattgtacatttaaaatagatgagttatatgatacatgaattatagctcaataaagctataacaaaaaaaattaagagatgtatctgtacatttgcattttaaatgctaataagcaaagagaaatatctgactacttttgaaaaagagaactatgatttgtttaaagatattttgtctggagtgaaatttctagattaacatgctagttaatatgttatacatattgacattctacccaagacttgcatttctattataatagaaatagtaatttattttgttggtgaacttgtgcaaatactttatattagttctttttaacattttgctataaatcatgttgaaatttaggaagaatgagagaagtgtaatcagaacttgagttaatctttatttttaaaaatgtgtatgatactatctaaacctttcacatttgaatttgaatacagttagaatattttactttatattttgttttgaaaactagataatgacagcagtattttttgttttcacttttgtttagtgtaaattttagcatacattcggcaaacaattttaaggatatgcatatttggtttactagatacctgtgtatttaccactcagattaagaaacaggtcactgtcagctctctggaagccccttttattggcctctccaatctcaatccttccaacctcttcaaatatggttcttgagatgatcatttccttaagttgctttaaaattttaccatatatgtaggtatccctaagcaatataatttacatttgccaggttcttagctttatataagtggaatgatttggtatatattctttgttaattttttattttggtcagcattgtgcttgcaagattcacttaagacagggtaggcttcttatgctgctgctgctgctaagtcacttcagtcgtgtccgactctgtgcgatcccatagacggcagcccatcaggctcccccgtccctggggattctccaggcaaggacg

SEQ ID NO: 36547 - DNA, 1038 bp, Bovine  19866881180392
aatcaaatcattgtcacctaaagtgctaattatgtctgataaatgtatggcatgcacttaatgcaaagagagcttaggaaatgatacaccttccgtaattacagtgaccaacctagctccatcaatctaaattttttttcaatccatgttcatttgggtggctttattcttattaaatggctttcttaagcttcaacagacccacttgctgctaataaggaagctcacataagtattttggaactgcctacaataagacggcgtgttatgtgatacacatccagatgagtgtacacagataaacaggaaccacagaggaatatggttacagtcttctcccactgggccttggaattgcaaactgatggtaaaatttgccattctttgcttgcctaatgaatttgtgtatccagttaactaaggtactgtatttctttatcagaggagcctgaaatcctttcatagctgacaacagacccgttagtctcttcccctggagacataaatgacctcgtgggtaggcatgctgccctcagaacctctgacgataacatttaaaaattactcctctccccctgtttttctccatggaagaaagccaccattcttctcagagccaaattgtatgtggcctctaatcgaacctgacacccttacacaaatggaataagagtaggttttaattagactgaaggatgctgattttctctgaagccacttcagagcccctatcctctccgagtcctccagcagacgcactggcttgtttcacgcatccatccatatttggctgcagaaaccttgctccaaagggtgtgtgaattcaggcctatcatcgggactgatcagctgaatagtattttcagatttttgttttgctctatcacaattctgtctttttgtgtgtcttaattgcagatacaggcaaggtgctctgtgggaaccgtgtatatctgggcaggcttttctttgcctcactgaagtccaacaaaactattctcttgtttgtgcctcttctttctctctgggtctttttct

SEQ ID NO: 36548 - DNA, 993 bp, Bovine  19866881243239
tgtctggctctaggtgagtgatcacaccatcatgattatctgggtcatgaagatcttttttgtacagttcttctgtgtattctttccacctcttcttaatatcttctgcttctgttaggtccataccatttctgtcctttatcgagcccatctttgcatgaaatgttcccttggtatctctgattttcttgaagagatctctagtctttcccattctgttgtttccttctatttctttgcattgtttgcaaagagatccaaccaatccattctaaaggagatcagccctggtgttctttggaaggaatgatgctaaagctgaaactccagtactttggctaccccatgcgaagagttgactcattggaaaagaccctgatgctgggagggattgggggcaggaggagaagaggacgacagaggatgagatggctggatggcatcattgacttgatggacgtgagtttgagtgaactccgggagttggtgatggacagggaggcctggcgtgctgcgattcatggggtcgcagagttggacacgactgagcgactgaactgaactgaagtgaaggtttatttcctgttgtccccctttttgtgttgggggtctcagagcccagcacattcctgtgactgtagttgattcagcataattgatgcagtctcatttcccacagtgatgaggattatatcagcttggtttaacagtctcattttctgctcccagtgcacacttgttttaatgtgtttcagttaatgaggtagaagagagaacgaggtgttactgtttatacgcagacagtgagtttgtacggggagccccgccacagcccatatggccccaggcgtcctcagtggcaggtcccacagagcgaagcctcctttttggaacatgtctttttttgtggctaatgctgataatgatcattagctataagatttcctgatactctttataatggcgcctcttggtgtgtctctcatgtgtcat

SEQ ID NO: 36549 - DNA, 697 bp, Bovine  19866881260335
cccaattgtgctgtatattgaggttaaaccctgtagggcagctcatagccccaggcatatgggtggggtcagagtagcaggtgggctgcgtggctccacatcgcccactctggagcacattcgcactctacccatgtgctgtggcacagcagacgggaggtcctctctctatagctctcaggatgttcatagcagagttgtttacaacatcagaccaaaggctatagccagactaggtgcataatagaagtggataaagtccgtatgctaacatctaaggaacctttacaaagtttgatataaaagcatttgttggcaaggagagatgttcatgatataaaacacagaaagaaaaaaaaaggacatggtaaaacaggatacagcatttgatcttattttcattttttaaaaaaggaggtggatagatagatccatctagagagagacggagagagagggaaacaggcttttagaacagtcaccaaatgtttacagctgtgatctcaggataatgggcttacaggtgtttttttgttgttgttcctttgttttctctgtcctttttctataatgaacatggatgactggaaagttttttataaaaagtcacctgttgaattcctatagaattattaatgttcaggttccctttcagtctaaacatagtttccccagaccaacgactttcaacctttca

SEQ ID NO: 36550 - DNA, 1323 bp, Bovine  19866881270812
gatgtgattctctgccttcctaacaccaattcccaagccctcttccctgtaaccagctgccaagtttaagatctaaaacctcacttccattgtgtgtctgtgtgtgtgtgtgtgtgtgtgtgcgtgcttgtgcgtagagctgctggtgtgtgatgggagtttgcagggatcttctctccttgcttcatgttttcacaactcccacaggacaggaattaaaaggaaggaagagctgaactcttcccttaggcaagtcgatctgtgcaaaaacaaagagtcagaagctaggtctccaacaggtcagtctggtttccttctctgagaagcatcaagggctactttttcatctcaaccatgttcccgtcttgcataatctataataatgtgattctgaatgcattttagaaaatgcaagatggaatgggactctctcagctcctaccaaacacgtggtctgagagacctacaaggagctgcactggagggttcactaaaagaaaaaaggacagccacaccatcctctgccgggggaatgtgcttccaaattgacggctcatggtcattttttgttgctgttcctgaaaaagagatggcaatcgtggagttggaggttcaccttttgctcttgtgtttaattgctgcaaaagccatttattaccttgtgttcttccccagagggaacattatcctccacagcagccaggcctggctatgtctggctcatctgactgcccagaagtgaacccatcacctccacatgattctggcgcagctctgtctccacgtctgtcagcctccagctcaggaaggccttgtaaaagaaagaacggtagaaactgggatttctttccttttttgaattttgcataaaaatctccccaacccacattaatgagaaaacatcaatcatccgtctttccccgggaatgtcgggagccatcccgagctggtccacagtcctgctcatctgtacacatgcagggctgctgaaattgctttcccttagaaaaatatgttcatttctaacttcctcggatggctgtgtcaaatgaaagtgctttgtcatttttaatgcccagtgttgcctttctccccactgcctcccgtcacaatccagccagtaaaacccacaggtattttggtttaaaaaaaaaaaaaaaaacagccagaaagcacaggggatggttggaacccaccagggtcccctcacaggctcttggtgcattacactgaggcaaacatgactgtaggaaaagttctttctgttcctctggtgtttcctgggaccttgggcagcatctggatagacacacagagacagtg

SEQ ID NO: 36551 - DNA, 1081 bp, Bovine  19866881460817
cttatcatgagtcttatataaaagctaaggaaaggtgtaactagctgtgtatttcagcaagattcaatctactgataaaatagattatcagtaggagaggagagcatcatagactccttagcatctttttcaagccagaaagtttgaggcacagaggcacagacaagtcaccttactgatcagcttgtcgagaaaaacctgacttctcatttgtatgacttaaagcgccttcgttttttgtttttatgtgtgtgtttttttaattttgttttgttttgtttggccacgctgcatgacctgtgggctctcagttcccagaccaggaactgaacctggacaactgcagtgaaagtgtcgagtcctaaccactggaccactagagaattcccaaagctcatttgaatgaagaatcttgcataaacttcagatgtgtgtttttcaaccatttgttcctaataatgatcatgcctgggaaagagttgacatactttaagaaaaacagctgttagtgggaggatgttgaaaggtggtagaagaagcaggataagctaaggggctggtgtgaggtgtctcctgaattatggatttcttgaggtgacaaattttatcttgttgcttgcagtatccagcatctagtacattatctagaaatgagtaatatccctttaaattattctacttaaaaactatccacaatgtgtatctccaacccattacttctttaatcatatttctgggaataaggaaagtaatttgtaaattttcttcattaacaaatatatcactgtgttataatcttttaaaaaaatcaatgttactccagtttctccccccaattatattttcaaaattcttctctcaaacaaccatttaaaaattagatgacttctggggctcaaatttattatggatctattcttttagagaaaaagcaaccattcgtgaagtatcctaatttttcaggcttagcaaaacagtctgctgaaaagggctctagcccaaatgagcttctatttgatcctaaacaagattctttcaccagaaaacaaggagtcctgggagagggaggagagttatacca

SEQ ID NO: 36552 - DNA, 743 bp, Bovine  19866881506961
tgtactgctatgattttcataaaatattaaaagtcaaattctctcaaatctagtattgtattaatttaagtacacttaaatacatgactgaaatcatatgaaatgcatataaaggaaattggtgttctgtgccagtgataagcatctggatatgactcaccaaagaaattactatatatctgaaggaaatattaaaataaacagcccagcactagtgattgcatagaactgtatatattcgctctgtgcactggacaggaattttccatttcatacatcatttacaacttgctgcagtgattctgcaaaatcagaccataccattagcacacacaaagagaaacacccagtgttctcattgctggaaaattcaagtgtttggggcttcagtgtgcaagaatgtcagtattccatctaagcagatgttgctgtgataaccaggataaggacaccaggtgaccaagtagggatcaaatatccacagtcaagcacactgactttttaaaatctatagtccaagcttggtttatactcacagatatacttaatttttaaaactacttgatataaatgaaaacaaaatggtgaaagtcataagcaaattcctccagaggggtatagtattgtttttaagtgggaaccagttcttatttctaaagtattttatcaaggcattcatttgaataccaaccatctggtttcctgaacacttcatcaaatgaatatctgatgcagtcacccca

SEQ ID NO: 36553 - DNA, 1270 bp, Bovine  19866881615953
acccccatgaatcgcagcatgccaggcctccctgtccatcaccaactcctggagttcactcagactcacgtccatcgagtcagtgatgccatccagccatctcatcctctgtcgtccccttctcctcttgcccccaatccaagctgaaactccagtactttggccacaattaagaatcatgttaattcactcttctatagattaaaatgtttatataaaagttgtgaattgtttttataagggagaaaggagatatgcaagctgctgatatatacgacatataagggaagttaggtcctcttaaaatctgtagcccacaaaaaaatactatgaaaacttatgcttttccatttaaatcttcttggacagccattttcttctcttttttcatcaaaaacaaattgtgacggtcgggttagttgattcctttgactgcataaattagtcagcaatgtggtcactgctaatgcttattaaaataaatatttctaaaataaatttaatgttattaagtagcttgatgtgaacattcccacttaccctgcactttctgagttgttgcttaatcctaatgtttgttctactaagatgcagatatacagagagatgcctatctgttagagaatgactttcgtatcagcctgtttccgtgatttcaagatctcacagtatcatggaagtaaagtgtgcgtgagagacactccaactacacgtcacccccttccctagggatccttattttatgttttgttaaacttacatggacctctcactgacctgaataagactaattttaaaggaacatttctggggtttatgtgagttcttatttaagaagtgtgtgactagtaaacctgaaacacaatgaaatccattgaaaaattggtatgtacaaaaaaattatggcataaacatattttgcttatattataaaaataatagaaaaggtaactgtagagcttttcaggattaacttattataatttagaaatatgtaaacatgataggcgttcaacagttgcaggcatcatagtgttctaagtataggtatgaataaaggatggttaaggcattagtaatagtttcaaaacacagttttctgagctaatttttaacgtgagccccgtggaagttaaggccacacaaagaagtattattctttatgtattctccctgatagtgatatattgttttgctttctcaacataagagagatttagtttagaaactcaaatcgatttctgcaggcttgcacctgagcttagggttt

SEQ ID NO: 36554 - DNA, 1131 bp, Bovine  19866881641727
tgtatctggcactgtgttttgtgatagaaatgcaaaaattagtgctccctactcccagagacacacaggttactgagaagcatttagcagacaaacaagcatttagcagacaaaacacaacacagaaggtactatcatagaggtatagtaatttatttaacagatgtctattaaaggcatatcatgtttaaggtatactagatactaatatcggcagagaaggcaatggcaccccagtccagtactctttgcctggaaaatcccatggacggaggagcctggtaggctgcagtccatggggtcgctaagagtcggacacgactgagcgacttcactttcacttttcactttcatgcattggagaaggaaatggcaaccactccagtgttcttgcctggagaatcccagggacaggggagcctggtgggctgccgtctatggggtcacacagagtcggacacaactgaagcgacttagcagtagcagcagatactaatatgcaaaatggaacccttgaaagaactcacatccatgtgaagtcatttgaaggacctaggggacagagtacaaatgaaaccctcattctatatatctagatattgaaaagtcacaagtaaaaatcagcctagtaaataggatatttgtaatttttaatgcctaactgatctgattccattcctgcctctcttttataatttaaataaccattattcacattttctacttaccattcttccttcttgataatccattttatgcaaaacaatttggattaacagttcttgataatccaaaattggaacttctaataaataaatatcaggttaaatcaattacctgcctagaatcaaatccaatcaccttattaatttccaatttgagacaaatcaaactgtcattgagcatcctaatacatatatctttacttcacattcatgattatttccatagaataaaattctccaagagtgtgatcattttatgacttgtgaaagctacggctacactgccctaaggctatagtgtataagtttacactcacactaatagtgtatgagaaggttgttttgcctgtactatacctggtggtggaaattctaagttctttatttttttgaggatttttattta

SEQ ID NO: 36555 - DNA, 1517 bp, Bovine  19866881666210
tggatggatctagcaggcaacctcagtggttgcctcttgaatcctgttggggcaaaaaaacaaggaaggggagggtaatatttagactctactgggaaaaggttcactgatcaagttttccccattctaggcagttggctatgatttaggaaggcgtaggctgtccagagactaacactgcatgacggggcatataaaaccttgcaaaagttgtctgacagcttagacgttatttttgtttttatctgcatcaccccatccactactgaagttgatgtcaagttatatttacagttgttaggggccaagatagaatggtgactgaaggtacctattctagagccaaatgccagtgtaaacacctactgactgatggccttggacaactgactttacagtcagtttcctgattgtaaaacggagatgataatagcttctatctcatatggttgctgtgatgattaaatacaattaaacattcagcatatttaaatacagtatccagatcacagcaaactcttcttattgtcattattttcaatagttatttggtccttcatattttctcaaggttctgacaaactcaattggactgtctagaaatactttgccatttgaatatcatcaatacctcctctgacacctaaaatagattcattagggaagatgccctctagaccacagcatttgaaactggcaaggagataaggaggttccctactttcctcaaggttgagattctaatgtattcctgatgaaaatctatatacacattcaactgtatttgatctttatttctatcccatctggctagcaagttctcattaagatatgatttaagaaccaaaagttcattaaaaagatcattctatgacaaagtgagatgagcaacacagaaatgattccatatcttctccagatcatcccatttagggcttttttccaactgaatccagcataattcataaaagcactgagatttgccttttaaagccctggaatgactcaacaattaacattatacattcctgatatctgatggatgcactggctccaaatttgaacaaataccaccattagtaactgtcttctacagctttcttactttaagcacattatcttaggaatctttccttctatgttcagttctacaggaaaatattcacaaatagcctctgacttcaatataatttcaccttactttcttaagaataagaatgtggggaatgaaaaggactgaagttttcattcagaatgcttaaaacatctttttttccagtttttttttttttttcaaatgaataaaacaaaaactcatagtaattgcaatgttactaacattcttttaaaagcagggatcagtcacagaaatcttgtgttctacaatgtcaaaatttgtctgaacgacactttaataaaatcacaaaataacagcatgtctattcatgctatataaatatgaaaaacaccatcaaatgtaaaacatgagatgcaccatttatgtaattgttacaaat

SEQ ID NO: 36556 - DNA, 1155 bp, Bovine  19866881776448
aggatgaaatttcctcttatatataggaattactagtgctattgctgttttgaagactgttcttatttcaaattctactctaacagagtttaaaagccctttgctaggaaaggtaaatgtagtcagtcattcatttaattcaactcactttttgtatccttgcgttgtaaacagtggatccaattcccatttcagagaagttaatcttacctctttcctcgctgtcagcaaaacttccttgcttgttgttgtcccaggtacctaaaatttgcatataaacatgtgaattaaaagtatcaatgctattagaactctctggggccaaatatcatccaagctggcaggcttacccttctcaaggaaataagctagtcagtcagctccatcaccaacacttcctgcaacttcataagtgccaggagagacaaggacacctagaaatatcaaagagctgtgtcccctggagtaagtgtccttgctcacacaacctcaggatcagccatccacctctctctcacacacacaaaatctggtgacagagacaagaacttttgctcatattttttttaatgtatcacaatgagcaggaaacatacttgatgaaatattttcaaaggagtatattcaattaccatctacaatcaacttaactatgacaacaaagtttttgtgacaaatttttttcagtttgaaagttccatgtggttctgttagtctccatgtattttggtacagttcgagatcagcattgttacagtaacaaaaaagctaacaagactacattatagaaaaacaccaagaacatcatttttggtttcacttgctctatttttttttttttttttttgatttttgtttttttgtacattgcaaaggctgctcatatacctcttcacctcagggtcacgttcatgtatgctttctttcctacccaaacttgcccccctcccccccgaaggaagtaaataaacaaaaaaactagtcaaagctttgtttcacagtgggcagtatctcagcgccaacaaccaaccaactcaatttatgcttctatttaaaatgttttaatttaatttattatttaaaaaaaatatatgtccatgaacatcaagtgcacggcttgggtcactgcctctctctcctgcaacttcctgccag

SEQ ID NO: 36557 - DNA, 758 bp, Bovine  19866882100243
gcgaactgggccggtgcgcagccggtgcccacccaagggcgggtgagccagcaagtgccaagattcaggaggagactgtttcactgaagagctggcatcaacctcctctgttccccactgtcaacctcagatgcctcggaaccactcaactcacgggaccccacctgttgcccccggaggagccggtggacaagactgtgcctcccccgccccatccgacaaggggccgtgggcagccggggagaaccagcaggcccttcccctgccctggggcacccagaatttgcctaattgaacattaacaagttgctacaataaagttcctctgttgtgagctaggaaccttttcggcaacaacagaagtcttgttacaaaccgctctctaaagccaggcctcagcctcgacaggtgtgaacaagatttaaacacctcctacaatacaatgcaatccaaacaaaggggaaagtcaatcccaacctcctggggtgaaccttgtctaacatcttcttcactcatgcagcccaagggagccaagtgaacgcgtggagagactgtctccaggctgggcaaggagacctaaccaaccctgaagcaggtctctctgccactccagactggccaccagcctggtcaccctctagcagaagacgaggctatgaatgcctcacatgcaatcctgggcccccacacgcacgttccatccacccctaactcggccagctggtagaccattctggcgagcttcctacactcctggc

SEQ ID NO: 36558 - DNA, 926 bp, Bovine  19866882209101
taaaaccaagaaagggcttttgttttagggaaatttcagcctgctgtgggcagagagttagatgaagagataaaatagagagatgagacttgggactccaagcattctgttaacaaagttatgaagcattcccacaactttaacctggacccatgttcatggaaacactgggattactgggaaggagcacatttcatattgagttttgaaacagtcttcagcagggagaaaaatgtaacttcaccttaatggaatgtgaatttaaagcacagtcctgtatgtaattgagtaaaatgaatggcgttaaaaaaatttttgtgtttatcatcacagccagagcaacaggtaaaatcattttgtgcatcagagtctggttcatttgttaaatcagtggtcatctttagttactggtgataaaatctctccacatgaatttttccagaattgagtacattacctttaagaatatctccagaaaaggattcatttgtatttgtaatcttgaaggacttgtctcatttacagttttattttaactaatagccatttccaaaaaaaaaaaaaaaaaaatccatgacaaactaaatctcctgatgatttcctcactcattaatgaagacttttagtaagtactactgtgcaaatgtctttgaactgttttgcttaaaataatgtttttagttctttcgaaaaggtgctggccgagcctttaggtatcaaaatctctatgcttagcgctccttttacatggaccctaaaagttaaactgctacacctgggggatttttctttaaatttaatttaactgaaaatctcttcaaatttgtattggttggctttggtgcagggcatgaaataattttccatcgcaccccacccattcctcgaaggtcagactttggaattgggctgttactgtcttgctg

SEQ ID NO: 36559 - DNA, 2953 bp, Bovine  19866880371870
actgcagcccatcaggctcctctgtccatgggatttttcaggcaagaatgctacagtgggttgccatttcctcctccaggaaatcttcctgacccagggatcaaacccacgtcctgtactgcaggtggattctttactactgagccactggggaagcctaagagggttatatatctaggttattgcaatgtattttcttttgttctttggaaatgttcatggaagccatacaatttatgttagagaatgacaacatggaaaatcctgacatcatgtagttaaactgtgaatggaggaataccttacagagtataaacatgtagtgactgaatccatatatacaacttgctcttggtagagatataaaatattacataaaatacattaattgcaatgaatcatttgtctcctgtcttttggttgtcagatccatcaaatacaggagaaagaaatcttcaagtatcttagtttatgagattcttggagaattacatgaatatctcagttgctgtaaatgaccaacagattgagatgcttgcaataaatgatataaattttagacttctaagtccagagttgtatgcttttaaggtggtcatagctaataactcagcttctcatcagtttcattagagatatgccaatctgctatcttgcagcaaggaggaagagagagtttttaggggtctattctgggatgtggtcaggaagaaaatgggcaagttgtgtgtaactgttccgattaagaattcctgaagtctctgaattccttccctctatattaagctaaaaaatatctggccatttaaagtagatttcttttggcaccatttggtttatgagttaaatttggcaacttaaccaacactggaaattgaacccagactctggtgaaggcatccttatcaagaacctggatcatatcgaaaatgggattccacactcctagaaagtgcatttctaaagcccatttgaacaaattttattctatgataattatattgattgagattaattcctaaaaatcttgttgaatatatttccccttccaaattctgattatacatttcatcccatagtctctgtttagtttaaattcattaatttatgctttcctgtgtacaaattgtttattaagtgctcagcacagttactggtgccaggggtgcagcaaagaacaaaatgagctgcccacccccacccggaccaaactcctgttttcatggaattcacactcttgctggaaacatgttttggttacatcccactgcatacaaaaccacctagttcatctcctgcctctcctggtgggctgactggactcatctggactcaagtgcttttgttccgtgtgatgttagtttgaagggcttggatgtccagtgtccaacgcagcgtcctcttgtgcctgacctcttagtggaaacagctggagaactggagtcaagtgggccactggagggctgggcctctcagtttctccatgtagtccacgggctcactctttccgcagggtgttgtctgtctctacagagtctacccaggggagttaccagccttttcacggggtagcacagagccctcccaagcacaaagtcggaagtcagcatgccctctgaaggcttaagcctggaactggctcagcatcctttctgacagattctcaaggttcaaatgagttgcagagctgcccagattctccaggagggggactacccgagggagtgagtcccaggaggcggggttcactggggactatgtctgggaacaaaggacacaaaaaagtaaaatatatagtggatggtagttaagtgcaacagagaaaataaaacaacaaagggcaacacaatattgggcaagtgttgcaatttcaaatataacatccagaggaaatctccaggaggaggtgacattcaagcccccaaaagttggaaggaggtgagggaacaagtcaggcaggtgtgggaacttccctggtggtccagtcgttaggaatccgccctgcagtgcgggggacgcaggtttgatccccggtcggggaactgggttcccacacactgtggagcaactgggctcacgcgctgcagcaactgggtccacgtgccatcctcgctggcaggagagtgtggcaggagagacggcagcaagggcggagagtgcagaggcctgcaatgggagctcccagcacctgagcaagaacagggagcctggggtgaagcaagcaaaggggagaggggttagagatcaggagggtcaggggacatgaggtcagtaccaaggcgctttggcgccacaggatccattcaatttctcctgtgggggactctgcttcctcagtcaaggagggggagggcagaccaggaatgttggcaagagcgccggtggctcaggtttcttcaggcttaaatgtttactaatatatctgctgcacagctcatatcccattatttccctcgagatctatgcaagatacatggcagtattctcaattgccttgatgtaacaagctgcacggtccatctccagtttggttttcatctgtctcagccccgtgacaacatagtaaaaagagatgcatggggcatggggacaggaagactctggattttagtccgtgcctcccagtgaaaatggtaatatttgaggtcacagttccctcagtttcatttatccagaaaccagataaacaatcacaaaagccaacagttcctagaagtttcacccacagtgttccaggcagccccatccatgaccttatttcccagctctcctttatatgactttaaatttcccgtatcagaattttaatgtcggtgccattgctttttatgatattttagcttgagaattgattccacatacaccagtcatctcggggtgggggaaggtctgtgccctattctgtacctaacagcctcccttgctttggctcatttctgcatccttcagtgtt

SEQ ID NO: 36560 - DNA, 1168 bp, Bovine  19866880473194
aattgcatggcactgtatagtccgtggtgtcgcagtcgaacccaactgagcaacttgaactttcactttcatagcaataaaataaattctaactctttaagactatgggcaacgttatccataaatctgacccatgttcatctgttcatatcaatcccctgtacaatccctttctaagtatgctgtgtaatgaaaaaaatgacaaatctagaatgagtggtcagttgtattgttttagtttttatgactttttcacaggtacacagagatagaaagcgatatatatgtatctgcatattggcttccttcaacccaaacttttattttcttgtctagatttccactgaaatctccattagtgtcaatcaaaaatgtcaatccactaaatatataccagttagtcagcaggataatgagtgctaggaatttaacttcttacagcaattaccatcaatttgcagtttgaaagaatgaaaaatctgagaattgtatagtggaatacattatgataagagactgaaatgacaacaggttgtgattaagtgaggtcctcacaattctgttaattttcagtatactagggcttactttgcatactagatatattttatacccgatttaattatcagaaaataagtttgtctcccaccattctaaataaaaatgagcaagtttcaaattgcgcatgctctgtgttcaagagaagaagacctcaaggcacatagacttgtgcctagaggcaaccactcagaaagcaactgattagggcactcaattcccactaaattattcagaatctctaatggaaatcagatccaacgcttcctggtgtggagcagcccgtcttggttacccaatattcagctagctactcaagagcttttgagaacaataaagtaaaaggtaaaatatattttaatggtgttcacagtctcttgggtgatttcttggcatgaagttcctcacttcctgacagctgctgccgttgagaagagacagagaaagtgaaagaaagaaatcaatatttaaatctgaaaccgccagaaatttccatgaagggtgccagtactaactggtttgcatatgtgtttggcctttcaaaagcccccagtcttaagaagagagaagacattctaagtaaacaactcattaggaatcacaccgcaag

SEQ ID NO: 36561 - DNA, 3299 bp, Bovine  19866880486200
tctccaggcaagaatactggagtcggttgccatgccttcctttcagggtgtcttcccaacccagggattgaagctacatctcttaacatgtcctgcattgacaggcagtttctttagcactggcaccacctgcaaagccccttcttccttttgtagttattaggaaaataaattgggggagaaaacaaggtgattaaatggttgaccaccagtgcttgcaggtggcaaagactttggacttaaatgagatttcacatccatttgtagaacttgaggatatagcgcattcataatcactatggtaagtggagctcatcctctccatattgtaaatccatactgaccacatctgtgaagctctccatagcatttcagaacttcagcttagaacatttctggggtacacactgctctccagaacctgctgccctcaaatggactagatcacactcccatcataccctaaaccctgagcatgcacaaattgtagttgcatattaatcatttggggaaaaaaaattacagtccccttaaatccaccacactgtagatcactgtcattgcttctgaaagcccaagctggaaagctggaatacccccttcctgacccagctttgcttgtgccttcaaactcatggcacttgctgcttcctcttcccacacacaaacatcttgtctgcccacttctgccaaaactttccaccatctcctccacactgctcttttttgccatgaacaaatttccttccacacagctccttccctgaaaacctcctgatcttaactaacatcttaactccaaccctggggcatcctgtctcctttaaggatgctttcacacctggctcacagtctttacctccacctcatcttcctgacatactgggtgacttttcatgtccatccagaacagtctatccatccctgctcctcatcgtctctaatgaactttgccttcacccatacagttacccagaagactgtcatcatctgaaactggcccatgacttctttaaattctgaattcaagcattcaactcattttctacaacttctcatccctagagctcttattccagttaccagcactcctcaatattgtaaagaccgtcaacaatgttgcccatctaacttaaccgtattgtcagctcccttctctcttcaggtggtttaaattccacaacccatcccttcaatactttattattacttcaaataactttccccactgcctcctcgtcacccattcagaaaattcctttttctagtaaaagcaagtctgccttctccaatgctatattccgcccttccacgttctgttttggaaatatcccctccatgaagtttggggccactagaacccatggtctccagcctccaccaggcccttggagatcctcaagggtcttgtttccagaccagtgctacttgttctatactcttctaaacctcttctgcttgggcaacaactttgatgtctgctttctttcctgcagcatgtctcatcagaaagatatcctggtttctacctcacaaacaattgtctcaagtatgtctgcatgtggcaaggccactaccttagttcagtgccacatcgtatttcctctagattattatagacatattaaaaaaaaacacaaaaactaagctacctctctggtcttgctcttcttcacatactaactagtgtgactacttgacaatgcaaatctgtccactgatttaaagatattcttcttatacctcttagcaaaacgtcaaaactcctttgtgtaacactcagcatcctgtgggatcttctccatgatgatttattccagtttaggtctttccaccctctctccatctgctgacactctccatctacagttccttcacattcctgcccttgatgaactctacagccatcatgatctggcctttctctgtatcctgcctacttcctgttattccctctgacaggtttggataagagcaattcatctttcaattgttggttttggcgtcattcctctgggatgcaaagttgcactccctccctcttcggcaattagagttttactgtcaccccattctcattaccaaagacagaccctttatgttgaattgctgtttcttctttgcttgtgttttatgttgtggtatatagcttgacagaaggccatttggggattgtttgtttgtttgacattttagaaaaaatacactttacaaaaggatgagaaacagtaactctcaaacacttgccaaatcctctgagcctcaacttatatatttgttgaatggagattataatatgatatgcatagaatgagtaatgtatgattaagtgattaaatgaaatgtcatatattaaatgtctgaaaaatattaacctttaaataaattataatcacaatagcattttgtaaatttattagagcagagggttttaaggtcattgttgcaaagatgatgccagattttatgtaagatgtttcctttcagagatctacccacatatatggccactgcagggaaagtaactaatgcttctaacaaaaacagaggtcataaatgattaaaagaacacttaagaaggttaccattttctttctactacgatcagtaaaggtgtgaaatttcaaagacatagtttgagttattgtgatcactgtggttgtgacatagactgtaagcccttcaacctgtctcaagcatgtgttccttgctgtgtctgcaccaaatgattgcatgagtcaggggtgaaaataccttgtcggtcaagcaactgatgagttgtttcaatctaatctgttgtttagcctttttcagccaaacttaggctctgagagattagtaacttcttagaaagccactcttgaatacagactcaacacaaagagacttgcattgcattaaagaaccccaaagctacatggtatgacctatgtgccaatatctcaatgagcatgtacatataccatgtatcctagtgatattttcactagtgttgcaagcaactctctaattttttttaattaaaaaaggctttcatcatttaagaaacaaaataaaaggaattgcatttttttttttttttgtattctcatctcctacaaataggtaggttacaaataatttcccatctgttaacctgaatacagtgatcctaagggaaaactgtgttggtgtacggtgtgtacacatatatttctaagatcttttggaattgtgccccggtggtactctagcaagaggctctaggttggcaattacttttacatgttgggatcagttatcataccatcatagactga

SEQ ID NO: 36562 - DNA, 1131 bp, Bovine  19866880492677
caggctccagaggagaacctggggacttaatctggaaaagtatgggtttttgttttcctttttgatctcaaacaaagcaggtccagcctgtttcatttatacctacttgaaaatttaaatttcatttcaattaaacatttcaatggtaaaaataaataaataataaaactatacgttctagtgacaatggggaaaaaatgagaaagataaaaccattgattctaaagcttagaatggagccagctcaggccactgtcaaaggcctggtcactgagtgagagagggcagagaggaagctgttacagtttgggggctgtgtgcagattctcatgcattagggctgaggtccagcaggaaacctgaaattgggttcagatttggacctttctttgtggagatggcataacttaacagcaactcggttttagggaatgactgaagagaggattgagaaaggagcagagaggaatcttgtgtgcctttccttagaagtcagcaaatctcttccttactggttcattatagatattcaatggcataatgcagggaaagtacagataacaatgctgaaaatagacctagctacgataagtaggagacggcagaaatatttgttgaatcgactttatcattttctcaaattgtctatcctgctttctttcctttgtcttcactgcaggaaattgagttttgggctgcaccatgactttgtaggagatggctgcattttaacctctttagaagcatttcccatagagcttcgtgcaatcaggacataaaggtaaaacgatctgtatcattgctttgaaaagctcaggaccattctaattgcttagcaggagagaaagactgtgcagaggtctgaagcactaagatgagctgttatgaaaagggttacatgtatcttagctctgttggttctttgaaaatcaaaacgtctgacaatacaccctggggaagcagctgtgcctgttcttttcaggcagatgagcttaatacttgctatagcagtgatttcagacatactgcctttctggaaatgagattgtatttaaaagaacaggctcttggcatctatctcttttcttccaatgactagtaagaaaagatgatgtttctgaaaggagattt

SEQ ID NO: 36563 - DNA, 1146 bp, Bovine  19866880553763
ttagtaattgtatatggaaataatgaatgttaaacaaagggaatctaagaactttttgtcattttaagtactttctacatgatcagatattacttaagtataaactgctgtgtaatatcaaagcttttttttgggatgaggggtaatgctacatgttaaatttattgtcacttaagtaatattgtaacacttaagtaatatatgatcatgtaaaaagatgatgtaaaaatcatgtaaagatgacaaaaattcttaaattctctttggtaacattcattatttccatacacaattacttggtttatatcaaatgatcctactacaaattgagagtcatcctaagagaagttttcatgtgattgggctttagttttacctgggaaaatgttttcattctaataatacaataataatcagatggaattctcaaaatataaccattcaacctaagtctacaataaaataaaaagatgttccataaaacagccattgaaaaatctggtagctcatcagaatcacttgggaaacttaaaaattcttcctgggcttcataattgatgactctgatatacgacttgttttgtaaactattgtcatagcacagggaaagtaaaggaataagtcttgcaatcaaactcttcaagtctgaagcacttagtagaattcagggccatatacaacaaaatttcattataacaacaaccaaaaaatacaaagagagtgttatgaaacaaagctatttccatgtctcatgcagctggcccatagaaacagtgccttattgatatgattacaataaatactatacaatgaataaacacgaacatcaagtgctttctctttgaggccatataagtaatagctattgttttatgaagaaactaaattgtatacagtttacattgaaagcagggagagcagagcagaactgatacactttttgagatatttatgcaactgtgtcctaccattaaatagcacatgctatatattccaaccacctaccaagaaaataaaatgaataattcaatggaaatggaaatggcttaaaattataaaagcaccaagttaagtgtatgttggagtcctctgttgcattcttcctaacaaaatttcatatcaatgacagtgcacaatattgaatac

SEQ ID NO: 36564 - DNA, 798 bp, Bovine  19866880593303
ataatggatgatgtgcctgtctcagtggaataatttagtgactcgctccggtgaaaggtgaaatgctgagtgaggattgaaatactccatatgtcttaaaattccacaaacctaggcgtgtgggagacattccacacagaaactcaacatgactaatccttagaaaacagtctgaaatcgatctttcttccccgctgcctggacataccgcagaaggcatccccctggggctctcatggagccatctggaatttttcaggtttaatattagtactttgcttctacagaaaggcagcaaaaacccttcctcccgggtcttccacctgagacatctagtggtccatccatcggcatggattttcctttattcctataactctgtgagaaattaattgtgaaccatccaagacaggcttttgcttacttctcatcagaaaacaccatgaatgaagatgtttccttgttactagctcttttttatgtcctgggtagcttaaaaaattctccagtttcttttttcctttttaatttttattttgtgcaggagtggtgttgattaatgatgttgtgttagtttcaggagtgcagcaaaagtgattgatgtacatacacatatggtcagttctttttcaaattcctttcccatttaggttggaacagagtattgagcagagtcccctgtgctatacagtaggcccttgttggttatgttttaaatatagcagtgtgtacatgtcagtcctgctgctcctttgttcaggcccctctggtcctttattggatggtgggcatgtctgg

SEQ ID NO: 36565 - DNA, 952 bp, Bovine  19866880606247
gctgctgtgccctcctactatctctctggcagaccacctttccttgtccttcattccagtccctcctctgtgctcagtaattcggtgttttggaaccacctccgtcaattctaaggacaaacaatgatgaatttttctgacagctcaaatgcccatgatttctccttccctattcactggtttttttgagtggattccagtttttctccccatgggcggtgctgcctttcctatttaactctacactcaatgaatagagacgttgccccattctgtgctgtgccctggcacagagttgattctctctgtacaagtctcactgttacatttgctgcaatatgtgatgttggcaaacaaacccttcagtacacatctttgagttccattgtagcctcattaacattgttccctcttgtagaagataggttagtgctggtccttttccaaagaaattcattactactgtgctgaaaagatggcctttaatggtggtctcactgggtgctccccaggctctgtgaaaggaagggatcagaaatggcagcacgcttttccttggcttgtcttctttcacatttcctaggaaaacagacaatcactgctgattaaaagcaaaaacaaatcagaaccaacaaacaaaacaaaacaaacccttaccctgggctttctgaaatcaggttatattactttacttcttccctgaccctactgttctctctcactcccccttattaaatctgactattgactgtaactctataatcctttgagccttctgggttctttggaagactttgctggtgatcattatctaattatctcttgaagactaattatagatgtctgtgtgtgttgagtggggagcattctttactaagatttatgtacagcttcagtttagattgccttggcctcagagaagatttaagttaaaggattaaaaacatgcaaa

SEQ ID NO: 36566 - DNA, 1186 bp, Bovine  19866880749643
atacatcaattacaagagaaccctgtcaatgttgatgatacatggagtttgttgcaaagcaaccactagcacagaactcccagtctggggaaagatgggggtcattgtagataagatttgaaaccttgtataagatatatgataggcattagaggaatgacaattggagcagaaaagaataaaatgtgacttgctagagagtctggctggctgatcagagttaggttttatcactgcagcttccttcttctttgtttcgtggtatttataatgcacttgataatttgtcgttcatccctctttgattgcatatgagaaaagagggagtaggagattggcatgtgagaagaccgggggaagtgattttctgtcatttcctaataatttcctcaaataataatgtgagaaaggaagaatactgcacaagggcaatattacagtgaattcactcattcattgatccattcattccctctctccttcccaccactgttattcatcattttaagcactgaatcattttccttgaactagagttcaactagaggaaaatcgtatgtttctactgagaggtatcctgtggtcttatgcattctttctctttacctactgtcagttttctagattcggtcaccctgtcttgctttcttcctcttttctctctccttattcttcagtggctgtcagattgaggagaaaataatgtttatgaagcaactcagatgggtcccccatcagatgcacaggatctagctttctaacccttcaatattgcattgaaaccacagatcttcagggttggtaggagcagaatgtggtccattagtcagtcccactgtgttctgtaaggtgaatgccgtggcgagtgggctgcttgtcataagagcataagtcgatggatgagtttatggggatgtgagaagagaaaagtcctttgaagacatccagtgtctctttccaatatttggtacaggacaaatagttcttttttctaataggatggtataaaatataatattggtaattacactatgttctatcattacagaatgcaaaacattcctttcaaagcaatattttaaattaatttctctcttacctcatttgttttctttctaccttctttctactgttattaccatattcactctatgatttatagaattaattaagctattattaagat

SEQ ID NO: 36567 - DNA, 1379 bp, Bovine  19866880765940
acagatgagcacacgcacagtgagtcagtgtggccttgattcctgggtaggcgctttatcaccaaaggagtgcgagcaagaacatcccaggaaagggaagcagttcctctgccttcaaaatggacattctgtaccccagacagtgtactatttgcttcagtggttaaagcagatggatcatgtatgtgtgataagccctaaaccaatctgttctagttagcgtaaagtttaagttacattacgtataagccagtatgacttccttaaacttcaatatatgaaaatttcctccatcaggattaccatttattttgaagaaacagaaaccctcacaagctagcttatggagaaatttttttataaagaatcatgtatcacagaaacatgcaagaagaagacaagcttatgcagacagtggtgagaaacgtagtgtttacaaagaagctctaagtgcaagatcaacgctgccattccctgggatgtagagttttcctccaaagcgtttaccacatgaactgctccacagaaatggcagctagaacttagcttctgagtcaaggtattgtcctagctcccgtcttccttctttctttctttactggccagaagtgtgggtgctcagtgtgccataccgaggacatttaggggacatcatctggatgcgtctcattgcccagaaatactcaactacattttgagtatttttgagtattagaagatagtactgtcatctgttttactacttcatgactctcaaggctgttgtcccattaattaatttgatcacttcagctagttagaacccaccatttttggtgatgttgctgagtttgacaactggagaaatacacaattcatgtcagaatcttctctaccactttggtgaagaatatagcatattagcagtgcatgcatgctccgtcgtgtctgactcagtgcgaccccgtggacactagacctccaggcttctctgtccatgggatttcccaggcaagaatactggagtgggttgccatttcctgctccaggggatcttcccagccaagtctcttgtgcctcttgcattgtgggaagcccatacaacatgtaactttacccaaataacctcaaaccctcagtcttcagtagtaattcagaagcaaaatctcctgaaaagataattccgtaattaaatgtaaaaacttcgattatatttggatttaattataaataagcctccacacttttgagcagatttgctcctcaaagcccctatgtctttaatataaagaagtttacttcaaacagaaaagtagcaagtactgttgaatgcttccttcaaatttttactatgaaatgtggaaataatacaaaatatctaattcattcattgccgagga

SEQ ID NO: 36568 - DNA, 797 bp, Bovine  19866880816104
attaaaaatttttcctgtatctcttgagatgagcatattttttctattatctattaatgcagtgaattaaatgtatacattttctattaaaagtatcattgtgttcttagaatatagtggtggtggtttagtcactaagttatgcccgactctttgtgaccccgtggactgtagcctgccaggctcctccgtccatgggatttcccaggcaaaaattctgtagtgggctgccatttccccctccaggggttcttcccaatccagggatcaaattctggtctcctgcattgcaggtggattctttatggactgagccaccagggagcatatggtttttttccctataatctattaatgcagtgatttttttattaaaacattattgcatgtttatgatgtatttttgagagtactgggtttcatttgctaatattttatctaggactcacaatcatgaggaaaataggatataatatttattttaattgatctagtttggggtggtatcaataagaatactgtaccacagcaaaaaaacttccaaaattttagtagcaaaacattatagttttatttattggtcatgctacatgctcatctcacatcagtcacacagagatgcaggatgacagagctttcaccatctggaaccttgccagtcaccagggagagaaggacataacaaagcatgcactgacttttaaagacttctttttggaagtcacacaaatcatagcgactcatatttccttaggcaaaaccaggtcaaattgtcctgattctcatcaaaggattag

SEQ ID NO: 36569 - DNA, 2478 bp, Bovine  19866880843670
ttacactttgagaagcatataagtgtctgtgaagcttcttctaaaagaagggacttttttgtaaagtgccagacactaagtattagagacatgggaagtcacatttggtttctgttgctcatgtttctgcttttttaaacaactctttaacaattcaaaaatcattcttggctagaggccatacagaaacagatagaggctgtacttggcaccaaacctaggctctaaaacaatgcaatgacgagctttgggaactctaaagcaacacacaaataaaagggatcatttgctcaaatccacactattttttttctgacctcccaatgcgtacttcacttattttgatacttttttttattctgttgtgatagtcattgcttgataagctagagtatagttattctcttcataccttacatacacatatttagaatcattttatataaatgtatatattcaaaatactttatatacaatcactgctcaattacaatgtttgttgttgaagccatctagtctatgacatatatttgttccaggagtccgagctgacaaagacatgccccatcaatccagaaaaaacctcttactttttaaacgccctgttaacccagactttagttgagttagtcccacccttctcctctattgttgcaggagtcttaacacctctatcatagcacctatatatcatgtgttcttcaccacatctccaaggaaaatttgtcagggctaggattatggttattcatctttgcatcctagatggccaacagagtacctggttgtacctaattttacagtaatgttgaagaacaaatgaataagcaagtattaccactgtatcaggggcttcccaggtggcgcagtggtaaaagaatctgcctgccaatataggggatgcaagagacatgagttcgatcactgcgttgggaagatcccctggaggaggaaatggcaacccactccagtattcttgagaggagcctggtgagctacagtccactggttgccaaacattggacatgactaagtacacagtgctcaccactgtgtcagtatctgtcccttacacagcacttacacgcactttccatataataactgataatatgggaggaagatagaaaagtaagctctaaatacagaatgaaagtgatactgacatgagtaacagattttttcctcagtttgaaatatgaataatgttccctttatatgaatacatatatatgtacatatacatacacacacacacacacatgggcttccctggtggctcagaccataaagaatccacctgcagtgtggaagacctgggttcaatccctggtttgggaaggtcctctggtggagggcatgacaacccactgcagtattcttgcctggagaatccccatggacagaggaacctggtgggctacaattcctggggtcacaaagagtcggacacaactgagtgactaagcatatatatctccttggatttgggattttttttcctgagaaggatggagtcaaagggaattcctagtcatgttcatctgtttcagcaagctgtattccagccctctctgaaatccacaggggttccacagacaaaggtagaaagcagtggagtccaatctgattctccctttcctccattattaaagaggtgcaatctgccaaagaaggattgccatccctatctaaatctttttctttgaatctatacgaagacgaatgaaacattttctaaaattggaggcaaattagctttcggtctcctcaaatacaatttctctgagaacaaagtctcatccgtcttctgatgtgattaatcttactagtaccaactacttgggagttcacactggagaaacatattgataaaacacaaaacgacttcctgaggtttttgttaagatgttccatttaatttaaggtcatcatttatgtggaattctctgctagtgaggcaagataaacagctttatttcttggcaaaaacactcttttgatttttgccactcagtaacccataaagagaacacagtatttacaaacaaggctctgacatgttctcctgtaactttcttgtgctttcacagtttcaaacgcctcttaaaatagctctgcaagtgccctcccaacattccccaggagcacatcacgttccggtgtaagtgacagtggtctgagagagcattctgtcacctcattgtgaatttctctggaccatgaaatacccagtgtcccagacaacaccaattttcaacttatcgccaactgcttctcctctccattttactctgatataaaacgaagcaaaaagacaaccaaaaaaatgggcatttcattttgaaaatatttgtggccaagttgattacatttatggttatcaagacttcaggatgaagtaatctgctattggaagaaaagtacaggacagaattaggagagatgacatcaaactacagctttccaattgtctct

SEQ ID NO: 36570 - DNA, 3029 bp, Bovine  19866880851268
agtgtagatggttgtatccattaggcattagtacagcaaagtattccatgatagaggtaggattcccagcagaggtgcataaaatctcttatggcctaacatctcaggaatggcatcgcattgcttctaccacattaattggccaaagtaaatcacagggcttgcccagattccaaggacagagaagtagactccatctcttgattggaagacttcaaaagatatggatataaggaaaggaagcactgtgaccagggataataactcagagtaagaggctaattttaaaaaatgagtctatttaattacatttaagtaaaattatttagtgaataatattaaaagtggtgtgtggatgtggcagaagtataaggttgtaatatgaattgttaaagtttgaaaacacttttctactcttacattattttcacttttatagcatccctttgtcattgtcctcataaactatctttgattgttccaatggccacttctacttgaagcagggcattttttttgaaaatgtgtggcctactctgttcttcatggtagtgtggtattctgattgagccctgcattagttaagttagatgtaccatgcccagcttcttaactgtatcccaccacatctagatatcagttcagttcagtcactcagttgtgtctttgtgacctttatggactgcagcacaccaggctttcctgtccatctagatatgctgtgcattatctctgatcagcagctagtctatgataagccaaggacaggtggaaagtagtgtgcattttcacacttggctaaaatatgaagaatgatttggaattaaaattaatcaattaactcatctgaatctcttcaaaggccccttgatagttttataagggagtcttgaattctatagtcaatataaaagccattgaagagtaaagaaaaattagttgtgattatttaaaaatattcagtctgggtttattccagccagttgatgtagaagtaaaaggatcaggttgttggttctcttccaagccatgtgtacatgaaggaaacaattaagggcaaaacttgaactactgagctgcatcccagttcacacaaaaagagcttatttctaatgttttgaaaatggataaaagcagtagttttatcttttactctgagtggcgatcttaaagaggccaatattcatttatctttaagactgaatctataaacaaaacagtttaatcattcactttttccttcaatttctttttgagttacaaacagataactatactttctgtgaaaatgaataataaagacatagaatcataggatatttgaccagaatttaatgttgtaatcatataaaacttagaacaaactgctgtcagtcattagtaatatggtagcttaattgctacacaatgtgatttttatatcataattaggaattgggaaaatatatgtaaatttttgaagttactattattctttcatagtaaagccaagtttaaaaactctctcctttattattacttatagtatctttaaactatatcaactatacaattgtattatatatattcaataatatatgtattcagaggcactgttctagttctgaattttgaaccacctcatgttacccactacagcctattactaggattctctcctattctttatctttgcctctaatttgaattatctgggagccttttcaactattctctgtcttgaagtcctgttactatatgctataggtgataggactgtggctataataactctaagtcattcagctttgggtggccagttaacaacataggaatatagccatgtgcttgtgtgtggttacaaagtggatgagaagagccagagatacaggaaagtcacataggtgtggaggcaaaccagtgttcagcaaggacggctccaagttaaagccagtaagtcccgccatatgctccttcatctctcctcaccagctcagggtctttcaaattgttctgccttaggagatagaaggaagtttggaaagaagttcagaaaaatacagctaagccttcagggattctagaccaactgatcaggttttcctctgtgatcagctttagaggaagatttcacggtaatattaggtaagactttaagagcagtgggcaggatcctgttaggatttcctctggttatatgccagtatacccccttgacaaggtagttacaattgtttcaatattttttgcccaaaactaagcttggacttttttagtcctttgtgataacatagtctgatattcttctggatcatgtgagaatgtgtttgaggatcaggtttaccaagagtatcgctagtcttttgggttagttctcagattcgtttccaatgttttgcttgcatttccaaagctgattacccaggcacttcccctggatttttaattgttgtctgcactaagtctcagtgtcatcatctaactttaaacatttttttttctttcaaatcaaactacaaccactcataccttaaagaggttgtcaattatcaataaacgatgcctgcatccttaccagtacccagtatgcccttgaaagcaaagtgtgaagaaagggcaatgagagaagtcaaagaaacccaggttgcctgaaagggaatttaaaagggcttgatagtcagtttaaaaaagactttaaaaaggttaagtaaaacttggatgacttcactgttttgtttaaagctagctctttttactttgcatcgtgaagacaagctggcaccctgcacaggagtgttttaagtcatgcacggctgtacacagtagcctgtgagaggatccattcccagtcaagcactatatcataaaatgttaggcctgtaagtgactttagaaatcatctattccaacttcctcattttacagatgaggaaactgggaccaaaagaggttaagcgacttgcccagtgtcagtcataatgactctgtgcatagaagcaatcagccatatcattgactccgtgcctggaggactagctgctccctagcta

SEQ ID NO: 36571 - DNA, 976 bp, Bovine  19866880978614
aatatggcatacagatagaaacctattttatacctctgtgcctctttaaggtataaaagatgattctcaatatcttggaagagtgattacacctgccagagtttatagctcacttcctgggagcggcttaacactgtacacaacctgtctaatcatatttcacacaggagttacctagcagcattgaatatataacagaagaagacatttaagagattgcacaatgcagttacagaaaaaaagaaaagaaatgacccatccaatctcatatatccatctggtcgtagaacatagacaaagactcaagttggttttaggtgaaatgtgttaagtgtttcaacagatatgaagatcctatgagctcatctcttagatctggacatctgtagccaaaggaatcaattctcatttagttttctgccttattcccttttccacatctattatcttactccagactcctcattaatatggatgtttaggatctaattatacttgttacagtgttaaactagataaatttgtttcaaatattctttgctggttttgaattttaaagattataaatctaaatctcgttacagtgcaataatatgtttatttatatgtactagagtaccacactaatcttgaatacattaattggtaacatcatttgagacgagctagagttcatttgtgttctacttgtgaaaaatgcattttggagcaattggatggcatatgcaaactttaagaactgtagttaagccattataaaagatgaaattatttttaattaacataaagaatctatttttgatagtttgcatgctaattatgaatcttatctttccaataaaggaagtcatggatattcagtaaggcaaagctttgttaaactggttcagtctgtgtggcagatgaatttttttaattaaaagtgtcaaaaattaaggcgttacaaattccaaaactgctccaatttttcacttaa

SEQ ID NO: 36572 - DNA, 1713 bp, Bovine  19866881042338
tcgtaagatttcactctcacaggttcccaattactgtgaacagaagctggagactaagtcctaatttgtaacaataaaaacatataatgtatcctaggcacaatggttttcttagaaaactggctaatctctgtccccaggccatttcctgcctcttctgactctcacatgaattagggattggaaaccagacaattttgacttcctgagcttgctttgctcttggcaacgatggaagaataatttttaaggcaagaaaatgaaaatgatccatttacctccactctgccctcactctgaaggaggatcttggagctggagaaagaaaataccagagagggaggggagccttccttccccgcagagcgttgaccataagacacgttctccttttgagggctcagcacttgggtttctccacatattttaatcaatattcactgagccataacaatctggcatccacagtcactctggtgttgtgtttcatgaataactactttttccactgggtggagaagaaatgactctgtacacggctggcagatcatcattccttcgagcaaagcaaaatcagcagtttcaagggaaatgtgggcatctcagtgtggtgatcagtgcacatctaaaacataaactcaaattatagaagccaactcacaggccaactgatctcttttggaagatgtggcttcagaccattccacgtgcatgtggaatacctagacctgattacagagttctcctgaaagccaatgcatcccaggaaaccttacgagacacagcaaaggaataacatgtattccccagcaaataaaactgttaacatgaccttgcctcattctggcagaagcatgttgcaaagtctcctggggaggaaggtaccgtactgagcctgggaatttgagttcagcggggagcctggtctccactgcccaagtgctgcaagcctgaggctccttctcatgaaatggcctccgagatggtgaagatggccatgaaggtcagacccctgagaagcctagatccagctcatgccccattctgaggataatccatctttccacaattccttcaagtccaagacactccacctcctctcctatatcagctctttctgtaggtttcttccatcagtgggactggaattctttcaaattgatcagcatctcatttttactcccccttcacacccatcgtaacatctagacttccatcctaatatcagatagcttctgttttccttcatagtgtctccagaaagaattcctcctaagtacccactaatgtgaaggcatcagaaatccattcgtttattcattcttacagacatttgacatcatgcaaagcattgggctaagacctctatagttaagtaggggagaaacagctatttaaaataactgccatataaaaatgaagtcaggattcacactattgtccctaccaggaactcccacattttcagtctttaaacacaagtccggagacacttcctcctggaagcctgccatgaatccactcccaaatgaatcaggtatctctcttatgggctttcaagagtgcttatctagatcactgcactaaccctgcacccattagccattgatggacctgctctccaactagactgtaagctttaaagacactgtcatattcatctctgtactgctgctgctgctgctgctgctaagtcgcttcagtcgtgtccga

SEQ ID NO: 36573 - DNA, 4482 bp, Bovine  19866881057889
gcataaaatattccttgattcaatagttggcctggagctttatttaccaggccacaacctcaaataaagcaaaccggagaccttcctcttcttcctcttttacaaagcttgtccactcccctacctgcctttgagcttctatcaaaggcaaataatgttctgactctctggctatagcaagatctgaataaatggcctctgttctcatttgggtgattttagtttaattccacaagtcagaccatctcaattgaattatgtgggatgctagaatctgcattttaatcaagggcatcagatgattcttttgcacaattagaatgtcagacctaaaatgggagaaaaatgaaagatttactatctcaacatttggtaaacagtttagtagagaagaaatgtatatgagatctttttcaggcttaatattctcctgtgtcacttatctatcatgtagcttaactgagcttctcagatccttaattttctgactcgtaaaagaaaatatcagtactttctcaactaacataaggttactggaaagataaagcaaaattatgactgatgctgaaactgaagctccaatacttcggctgcctaatgcgaagagccaactgattggagaagaccctgatgctgggcaagattgagggcaggaggaaaaggggaagaccaaggatgagatggttggatagcatcaccgattcaatgaacatgagtttgagcaaactatgggaaatggtgaaggacagggaagtctggcgcactgcagtctacggggtgcaaagcatcagacatgacttagcaactaatcaaatgaccatgaaaatacttaggatgtggtatataaatattaactattataatgaaaaagtgtgagtgtatatgttagttgctcagtcgtgtccaactctttgcaactccatgaactgtagcccgccagactcctttgaccgtagaattctccagccaagaatactggagtgggttgccattcccttctccagaggatcttcccaatccagtgatcgaacatgggtctcctgcatggcaggcagattctttaccatctgagccaccagagaagcccataatgaaaggatatttgcactcctctatcacaacctcaatttgaaaattagtatctgattaacatttcttccaaaattacaaactttgtagttaattgtaattaaagtttgtccttcataatgaggagtgatgtcactgttggtgttgtcattcgaggacacaattgtgactgattgaagatggaagtgtggctgtttgtggcatgatgctctttgttatacagtaagtacaggctctatctaactcaaaggagggcttctagaatcataatagcttgtaaacatgtaacaaatgattctcgaataacagaattcactactatattgtcatttgtgtagttatttcagattgctgcagagcccagctaatacttttgctttcactgcctgacattcgttggttttgaattactgcttaaaagtatatatcagctacatgtctactataactaaaagaaaagagcccaaaaaagtgcatatcagcatagagtagactgcttcaacctgccagaagaagagcagcctgccaacagaacggtatgagcaagagcagttcctctttactacacgctttatcagaaatccactgcaaattctaatagatgcgatgcactcagaaatatataattagcattcataaatcaaataaattaatgacactgttcaagaaaacaacgatgccatctgtgaatccaagtcttagggaaataaagagccaccataagatgagacatgaaagactcgtggcagatactgagattggcatggacttggaatcctttggacatcacactgtacttttcaaaagacagtttataaaaataacaactttgttgtttttaaccttattagtacatctttccactaaatgttgctacattgttaaatgtttggtatgctaattgtgatagcattatcaatacatataaatgtgccagtatatacagaaaattttgtgtacttcatttaagctactcattaagatgagttgatgttaagtaaaaaaaaaataggtataatttataaagccactgaatacagctgtataagttgtgcacttcacaattccagctcattccactcagattgctatgtggacagtctcaggaattgtatggtataaaatcagcacaggtacatggggctcccctggagttgctacatcttggcaaagccttctgggtatgcttcctggaaaataaacattctgatgactgggcaacaagtgctttcacaagtcagaaggtttccagttccttgttttcaacaaaagtcaaagagcatttttgacaaataacttggaaagaatccatgaaatgaatagcactgctataataaaattcctctcattcctatcttgttgtctgtgtgaacacattttctcaggaactgtatctatagaaatgaaaaacaggaatatcactgatcctaaagtctgtctcatgccagcaggaagcaatagttagccaagatacatggtctaaatgaaaggaaaatagcccaattcatcagactgaaataatttttgataaatttttacttttgatttaatttaagcgtctttatgttgtttggttaattataataatcagttcagttcagtcgctcagtcgtgtctgacttttaatcagcctagaaatttttttactacttgagaatcaagaacataaaatagttaaaattctaatttatgtacatatttgttcagagaagtttaaaaggtagtaagattttcaagtataaaaacatatagatgatactttctttgaatgtttccaatatgcatgaatttcagttaccaccattttgttaaataacaccaatccatcaaacagggttcaagttttaattactcttgtgtatttttaataactttaattgcataaaatagaaattttgtcctctagctcttcagtccacaaatcactgcataagtaacaggtgagcatcatggttagcgaccaatcacgtctcttctttcaaagtccattgtgattggtcagcgtgcatctgttattcagttcacagacagacaacaaagcttctagttgtcttgcctcctgtctgtgataaatctgcacagtattttacaaaaatagatgattgaaagagggcactggaccaacgaaaatggaaaacgtagcaaagaagtaagagtgatattgccaaaagcagagcttgaatttagcataatgaagttccaggagagagggctgagcgtgggaatgttgaccgtgccaccagtgaaaagaccagattgcagccagctgaaactcggtgcaggtgaaacttgtctgacttaaagaggaaagtggttgttgttgaaaaaaaaggtaacagtgtcctagaagaaagtaacgctggtaaaaattttcactttcaaaagaactcttggagatatgtcacaacattgcaagtgcaaaggataaaatgttggaagctgatccaactttagaaataagacaattcactaaggcatagaaacatgatcactctctattgtaagttacaggacaaaaagaaggcggtgaaaactctttattcttaataaatgttttacaaaaaaacttatacttttatttccaatgtttctaattgcagtgtgtgtgtgtgtcagttgctcagtcgtgtccgattctttctaccccatggactgtagcccaccaggcttctctgtccatggaattctccaggcaagaatactggagttgatagccattcccttcttcaggggctcttcctgacccaaggatcaaccccaggtctccctcatcccaggcagattctttaccagggaagccacttggagtcttttctttttttcttcaaatttagtttcccaagtagcagggctgagattttctgttgtccaaaaagacttacaaggccacgtgcgctcttgagagcagggaatatgtctgctttttatttttttattccccagagtccatgacggtatgaggcacattcctttcaaagcaagtttggtgcctggaagccaaagagtgagttcagttaaccactaactgaaagtgtgggtgcatgggagaccgttaagcaactgggcctgctcagacacaacacattcccaggaaattccaatttcacaagggcagatttcttaagaaatctatttacttggaacagaatgctttcttgcgtttttccaatgtcgagatagcaccaattcatgaaacctggtccagtctgctctacaggcagggtctgatatcgacagacagctgcactgggccaaggaggccaagttcgtcctccggcactatcaaacttggctctaggggagcccctgtaagcggaaagactgatgaccgcctgtctctgctctgtttctcctaccccctcgcttccctccctagttactcgatccaagcgt

SEQ ID NO: 36574 - DNA, 4174 bp, Bovine  19866881088088
aatatagatgtatttatgtctacaaagagtcggacacgactgagcgactgaactgaactgatgtcattagacaacagtcactttctgctcctaacacagaagcaatttaactttaatctcagctaattagagggtgaaatagttggtttcattggaaagaggatctgtgcagatttatgtactgtattcattattttggaaaaccttcagttctatgcagaataaacttggaggcaagagattagccaacaagatatttcaataatcctcattcaaaggtgagaaggctgtggaataatatgagctttaataaatatataagcatgatttttaatatcaattatctgtatgtggaaagtggccagatgcaaaacaatagctttgccatatgcatatatcctatctatattatatagaaatggccaagtacaaaataattgcattaacatatccctcatagtctatatgaattatatcacagttagaaatatggtgacaagattatattcattgtgcaactaagaataagttcattcttaataagatatatataaatatgacttgtgtcaaatacatatgaataaaactgcaagacattgtagaaggacaaaagcaaaacttaaatgaataggaaaacattactggatggaaagacttactactagacagtcattaatttttttccgagttaatttataatagcacactaacaattccataaggaaaatttcacaaaatactctgaggtttatatttaaaagcatgaaaatatagtaaataatttaaaacagttcactaataaatgaatttacttataattagagtgtctaaatataaaattaaaataggaaaattaacattattgatacaaagataaactggataaaataatgggatagaatggaaagcccagaaatctgaattttggaaatatttagtagattgcagaactaacttttcaaatttgcagagaaagtgtaagttatttaataaatgttcctagagtgatttgtttaactctttggggaaaatatcaagattacatatcttcatatcttattctcaagtatagggccatgtatatattccatatagtccatagctaaaacttcaaactgataggatattttattacctggtttgcaaagttattttaatgataattcttatttttataaacagctgtaggaaagtaacataatcatcaattgctggtgggatcttactatcaaaaacagcaagtgtagatcattttgaccaatgatccaagttttaagagtttatcctaagaaagcaattagcaatctataaaagaaaaaaaatgtacatgaaacctcatttcaccattgtatactagagtgtaaaattgaaaaggacctaaatgtcacaaataaaagattattcaattaaatcatgatatcatcacaaaactaaatattatgtacccactagaatgatgcattaaaagttgcctaaagtccattattatctttatttgaaaattttatcagcgagtcaatgtcaaaggttataaagtaggagcctagaggtcaaatctgtccacacaacagacttgttttgcttgcttctcagtattttataacactgagccaagatttgtaaattaggagaacacacataggaatccagatttccagtgtatctttacagttctgaacacctaacaatattgtgaccacacttcaacctcaactgggactggacagtggaagttctcctctctttcccccaaggcccaccagccaggaacatacttttctcactcttccagttccctaccttgccccactgagatactgaactgatctctaccatgtgatctggaacttttaaaattaaatgtgtgcataggtgaatatattcattgcatgctcatgtgtgtgcatataggaagatatacaacacaatttcaatagaaataaaacttcacaggcaccattgtgtaaggtctttggtaacaagaaacaagtcaacactattcactattttatctctcgaatttaggtaaaagaaaattattgttgaatggtcaagtaaggaagataatagctcttatttgtcatgtatgaataattcagaatctttttttcttttgcattacatttctactgtggtaattttaaaataagaaagaaaatgcacaataacttttacttttttaatatccaagggcagaaggaagtctgtaagcaaaggaaaatatatattaaataaatctcatgtatttataacgtaaaaaagaaaacggcaccattagttgagatgatgcagaaatccttggcactgaattctgctgtatataatacaaaacacaatacaagagccaattgattcttgtctgattttgtacttttgttttgatttctccaatatacccttgcttactctctgcaaagtgctacatatctcaaacacaccctttccaagagccttcctctcacttccctcctttgttgctgggatatttagacaataattataatgatactatcaaaccagcatgtaagtcactgaatgatcatttctagtctgtccactaagtaagtccaggatgaaatcaccagcacagaggtgtcagttaattgaggaatcagacagctagagagaccagactgtgagaaaatacccttatcccaaggacaaacctttgctctgacattggagagaatacacaaataaacttgccaagtaaattactttccttccctaattcatgatctcttgctctagtgctaaagccactatttttttttaatgagttggtaggtaaatatggagctagattgagagaattagttcatgcttgtactttttcaatattgtgagtgaaatgaagatacagatagcaatttgaatctaatttgcaggcttgcatggatgaaaagtcacagagggaagctgagatgcaccaggatgttgagggtggaaggcatggcgacagtgacaaaaccagctgacacagagcagaggcctcttcagtaagcacagcaaaaccaaaatatgatcaactcaagacagagcagttttctccctgtagttacatgcagtacaatagtaaggaaaatatagatctaaggccaaagccactgatgatcctttctgacctcccagtcatcaccatatggatcctaagaaaattaacataaagttagagtcctacaatgcatttaagctgaaagagacattggagttgaacattctcactgcacagaggacaaaaatcaaatccagggaggcaagtactatctcctgaaggagcctgcagataatttaacatcccagacccctgctcttgtcatgagtgtagaccaacactgctgtttaaaaacaaagagatcaatatgtgaaatggcatgagtggagtggttatgtgtctacagttgattggcttgaattcctgaaatagatgtcatcatccgtaactgaaaatttttattttgagatgaagcagattcaaaatagaaacccctcccagatagtatcccccaagttcctaaattaaaataagaaaacacacacaccgtgactcaggagaatacaataggaccagcagagagccagctaaaaggaagtaaaacgggggttttggggtgaaagtaagggctgcaagggagtttcctgagtcattcagctgcctatatcagacagtatcaaatcttaaaattagaggaacccttattcagataaattgataattttgagccaaggcttatgccacatgttaggtttgtttaattcggtcattaaactgtacaattcacactattttgtacttatatccttcttttctttgtcatgtatatatttttcatcatatagcataaaatggaaaacatttgagtcattattaataaagtcatttactgtttattattcttcaaaaatacattaatagtaaattgtgggcttacaggtggctccgaggtaaagactccacctgcaatgcaggagacacaggatacatgggaacccactccagtattcttgcccagagaatcccatggacagaggagcctggtgggctacagtccatagggttgcaaagaatcagacacgactgaagcaagtgagcacacacacagtcatacataacacatggcacatttttgctctgatattcatatctgatgccattgctctacacaacaggata

SEQ ID NO: 36575 - DNA, 1112 bp, Bovine  19866881094231
taatgtaaaatatcacataacttcaaaaaacttacctcagttttctatcacttaacatgtactataagtcaacattctaaataggattacagtcctctattataagtccctagtggtactatggtatattgatacatttaaaaaaaatgctactacaaaatttttcttttcattttgtttctgcctattgtgtacttaagctatagataatttttgaataaaaagcctacggtagatataaatgcaatagttaactgatcctgtttgctgatgtccttttcatggtccacggaaggtggtggcttttagtccagcatcttctcctgtttcttgccttcctttttcttcttcttagattctgctgtgattaaaataaaagaaagagaggaaaaagtatcacattagtaagctatgagagagggagccacttttataaatggccaggaatgaaatgattaaatgcatagacaaagtacgtgtgcgtgtgtgtgtgtgtgtgtgtgcacgtgcttttgccagagtgcgcctatgatcataggcaggagtaatacagcttcctgtgtgaacacctgtaaatgcctggtttcatagtggttgcccccatttgataaacaacatactgtctgggggtctcacttagaaaattgaaacacagccggcctctctgagagaatacactgctcaatggagagctaccaacgctctcccagaccctcacttcccacattgcctttccatgggacaggtgataagcttttttttcctgttatcattttcaaagtgcttctgctcctgaggtatcctctcctgatgtgtcttctgtttatacatttggccacctagtcacagatgaaggaccacctctgaatctaccaaacatggagctttgactctacagagactcctagccttggtgaagcaagtaagatggaccaacctgggctaaaccaggtaagtaaaactattaggatttaaaccaaaagacttcatccttttccattcagtcatctgtcatttcccttttcctaagcctaggagaaaacagtatggaataggacatgtcagctttggttccaaagatgagaatggtcagcatcaccaggctagcgagt

SEQ ID NO: 36576 - DNA, 1142 bp, Bovine  19866881166430
atgtgtggaaaattagtgtcatagaccaaatggtgcaagtgtacaccaatcccagttattttcatatgactctgaagccttgaaaactgaagtgattgtgcaagattgcgtgttcccaagtggcaaagccagaacaaaaggtgtagatccctgttcctttaacgatgtgatttttctttccttatttagctctgctgcttgagcaatggctttttatcatgggttcctaacacaaatctgatctttctaaaacaaaagtcagcttttattttgaagatgaatttagacatctgaacatcttgggagttgtcatatttagcgatgcaaagtaaagtcaagtagatcctagcaaggaggtaaataaattcagagaacatttccaaagctgctagaagatgaaaactcagctatttttgttatccttggtccagatttttctgtttctataaaaaaaattgtgagttaagctgtataaccattggttttggcattttttcaaaggttttctttcattttgcagaagacctcatttattccaagttctcccagctcccaggaggttggaaacccagccagggcatctgatttatataattagcctttcgtgagtatggatggcctctcactccagcatgaagtgaggtgaatttgaggaaaaacactcttcctttatcctcctgctcaccctccctcccactctagttctcatttgtaacccgatttaccagggaaagcaatgattctacaatccagtgtgatctcagcctgtcagagctttcagccagaaagacttagaggccatcaatttcataataatgggtgtataatgacggtccctttggtattgctctcacccaaatccccatttagagacggcgactggaaggacaaaggctagtgtttcaggaagggcagatttagggtagatcagccatggaaatcagcattggctcacatgtccaggacctaatgagaatctggcagaggcccaaaaaggagctgaatcctctctgcctctgcattctagtccccatttcagggcttttcatgagaatctgtaggattgtaaagggaggaaggtgagggagccacgcaggcaggcagtcatgacaggatcattagctgcagggttattctgtgtc

SEQ ID NO: 36577 - DNA, 1286 bp, Bovine  19866881243925
ttcagcacgattatatgtttacaaagcatagaggatttattctaatattttcccacctggaaaaactgggcttaagcgtcttcggcaatcagaaagcaacaccgagttcttcccaatatgtcatgtcacttttatagcaatcatacttgcaggaatgggactgggcaatggtggtaactgtgaacgttctgatgtagaaattgcagatggagagcttggctctggggatggacgcggaaaggagcagaaaggagcctggagaaaaggctgtcatatttgctcagaagaaccgccaaatcagagagcagagaagatttcattggaggagcgccttcaacagcaactaatcccgtcatattgaaagaaaattgtaaatgttttctccagaaattgtctgcccatcgcagctaatcgaacacacactgacgaatacacacacactctctttttataccaaaggtgcccggacgcagagacccgctccagcgagtgcgcgtgacacacacggacacgcatacacacacgaacgcacacacgccagcctgcgggttggccagagccttgaaactgcagattccactcggagatcgccagaggcaccgaactaattagtaattagttgcccctacactaataactacttccccaatcactttggtgaagaaatgaatcccgcccagctcgtcagtccagccaggtctccgttctgtcttgctctccagactcctcttcttcgtgaaagccaggtttgaaagtcctttttgcttcttcacctttggtgttttggtgtggcgggcgggggcagtgtcactttaactccagtctacaccgccaagggcctccagactcgtaaagtgcctgggacgcgtgtggggtgcgcgactctgctagcgcgcgcccgagccccgcggctcttgcccgagcctttgggtccgctctctccccgcctccccccgccccacccctcagagtgtcgcggcaccaactaatcttctccttttcgtttgcaagatcaagggagagagcaagccggcgcccggccttggactctgagccgcgcgcggctagctccgcggcgggtcagccccgaacctgtgaagggctccacgctcctgccagccagcccacgccagggatactgcagcccggggaggcaactggagctaatccggcggcaggtaaggacagccagctgctcagccctccgctggccagcgccagggaccctggcacctcccgattctccggaacgggcgcggaggggactggggtgaggaaattggcaa

SEQ ID NO: 36578 - DNA, 1665 bp, Bovine  19866881264470
attagtcatacaagaaatggcttgagccttacaaatcagagaaacatttgtcatctgaaatttttcctatcaactcctttaatacctgacatatttttaataaagagccagttattaagttctctgtttagagcaactgatgtccagtaataatcccacaaatagtcaaatagtaaatactcttaatatatgtataatgaggtataaacaatgtgttcttagagccagaaggaattgtgtcccacttactcctttctcaacccctagaaaagaactttagatactacgagaaattaaatccacatagaagagtcccattctcaataagctggctccgtgacaagcagacttacaaatccagaccaagagagatttaacattccctctcttcacatccctgcctctcccaattccctgggtacagcttttagttttaaacagcaatatttctagtactttttttcttgcttgtgcaatggatgccttgttatctttccagaatgatttcattgtctctctttttaaaattttaactatgatgttccatctgctgttactgaactggactgtctcaaaatgtaaatgtagactcaatcccactgggaattgcctaaaagaatcatttgcctgataaacagcaaattgcaaaatggattttaacttgcttcaattaacaagggcaacaacatcaacaaccaaaacatcgaggaagaagaaggaagaaaaggaggacacaatggcttgcttagattgcattgcaggcatgtctgaatccccttattctctatccattgagtggaagggagcccttgaagcagccacaatacttaacaccgatagtggagttgcttgaaattttgctgggctggggggttgggcagaaagaaacataagggagctgacacatttctgcttcctataatgaagaatctcagagtacctgaaagctcccccatttaaattttttctttttacagtatttataactagatggtttgcctgccaacttgcttgatagaaaggaaggtactccctcccttttttgtgggaaagtagtaaaacaactttgaatacttcaggtatagaaagactaaatcatttattcaactatttattgaatgcctaccatgtgccagagcctctgctaagcactggatgagttatctatgtctttgagtctgtttctgttttgtaaatatattaatgtgtttcttaatttttaagattctacatatatttctctttttctgtctggcttacttcacctaatatgataatctctaggtgcatcaaggttgctgcagaaggcactattcattcttttctgtgactgagtaatattccagtgtgtgtgtgtgtgtgtgtgtgtgtgtgtaggggtatgggtgtgtgtgtgtgtgtgcctatatatgtacgtgtataccacatcttctttatccattcatctatcagtgaacatccaggttgctttcatgtcttagctattgtaaataatgctgctatgaacagttgggtgcaaatatcttttgaaattagagttttctccagattttttcacaggagtaggattccaggatcatatggtaattctattcttagctttttaaggaacctccatactgttctccatagaggctatactaatttacattcctaccaacagtg

SEQ ID NO: 36579 - DNA, 1694 bp, Bovine  19866881266644
aaaagaaaaacaacttgttttcaagatttaaatccatgtttggatagggttggatagggtgaagattttccatcatctgtctagcccatgaaacaagtgactgcttaatacatcagcatatgtaaagcatccctttccaaggccatgtactcccctaatatcaagtaagtagtttattattgctgatgatatgaatggtgtctttgcctatgacatattttagattaagatatgtacgtacggaaatggagataactagagaaaagggaatattttaaatgtcacttagcttctaaatttcccataattaggaacaaaggtggaaactacaaatgtcacaatgcattgtaattttattgattataataagtgattaatatgtacttactaatcattttgttgaatgttaatatacaaattgcctttaaatgaataacataatttaaaattcataaatcagtcaacacagagacaaatcaatcatagctaaatgctttaagaacctcatgtatgtgtatatatgtgtgtctgaattttgtgtacacataaaaatgaagaatgaagtaatacaggccttaagtacaattatcattttgatttgcttctctgcattttctaattttttgataatcattttgtattaccttgcagtcagagaccaaatcagttataattgtcaaatatctgtaacatttttatagtggttctaatagtacatttggcattttcttccgtattatctctttatgtctctacttgctttctaagctgaaaaggctctaaatcgaggtatctagatatagctggagactttgtgttatgctctcctataatctgctctatttcaaacagatcaaggtcatacatgccttcaagttccaagatcaaaccatttctatcaagccagtcaacatgaatagagtttcttacaagccagtgatttaaactagtacattgcacttcattacattctgaatactaatatacttatgcttttcttattgtctcttggcccaaagatagaggttttgactagaatgaaaataggtagacttttgtaatttctttctgatttattcagtgatttatacagagaatacttacagttttaaatggctacataaatgaagtttccatcctcattgactcaaatatataagctcaagacaggataataactttagtgttagggagaattctggctttttaaaaaatttctttcctcactttaattctatttatgagcaagaagccaaattgaatgtaagaattaatttcagaaggtactgcagctatatcctttttcagttttttttttggatattaatgattttgttatggtctattcaataaagtagattcactttattacagtacattcaccacttggtcactcttcttttatttaacaagataaaaataagagatgaggcaatgattgtgattgcgttgaattccagctccctgggtagagtctaagcagtttgaattgacatttgtggtcactgtcaaaaaccaactgcttgccacatccatttggtgttaaacacaacatctgggttcagtataattaggttttcaagtaagctgatgagaaaatgagccatatgcacttatccaaatagagaagcttgaaaatttttcttttgattgacataaatacatgacatgaggttgaaaagacagcatttcag

SEQ ID NO: 36580 - DNA, 1910 bp, Bovine  19866881489071
tgacaatcagtttaggctcagagaagttaaaaagtaagttaatagtttcctctgaagaacaaactggaatttgttaagataaatgggattagaaaggattaggaggtacaggaagaagtgaaatttcttctgactataaataaaatgcaaatttagataagacacgtataaaaggtaagtggagaaaaggacacttggttgtatttaggaatctagtatttattttaagcatatctctgcttaaggttgcactgcttatggaaagaaaaaaaaaagttaatgcatgcattgctcttttcataaaaatgcacatatgaaaagtaaaggtaagtggattatattttacagacaaaattttcttggctataacctccgaagacaaaagcacccacagtgtaagcttaactgacaccatcattcctctggtactaaaacctagaacagatagagtccaagagaacaaaggactccaaaaagttgactcttgagttttctaacttttcaatgacagaaatgacacaggcctcatatactgatgattcacaccagattcaataaagctgtaaaaataaagtagtaacgaagtatacagagtaatgggcagcaactatttttattgtttccaatcgaaatataaaatgattgtttcctcagagtctgattgcagcctatttctagaacggatcaaaatgaccacagtattatcccactaaaatgtgaaaaatgagagcatgaagcagattaaagtctttactaaatgatctaatgccaattgagatgaggaaacataaaaagctacatcaactcggcaaggattttttgtatccaaagcactaatttagagttaaaataaagcaaattggccagagagaatgaagaactttatgtggtaaatcaggacagtcaattctcctacctgattaaaatgaaaccactttgttcgtgataactacaggctaaatcatgacataatttactatatgcgatacatgtgtcacataggtcatcacatgcggtcttaactctctattcccccaatcccaccccctttcttctcccaacaccataagttcaagcccaactatatatttaaattccctaactcccaattcttcaagataggcttcaacactatgtgaactgagaacttttaaatgttcaagctggatttagaaaaggcagaggaaccagaaatcaaattgccaacatctgttggatcatagaaaaagcaagataatttcagaaaaacatctacctccacttcattgattacgctaaagcctttgactttgtggatcacaacaaaccgtggaaaattcttaaagagatgggaataccagaccaccttaactgccttctgagaaacctgaatgcaggtcaagaggtaacagttagaaccggacatggaacaaccaactggttccaaactgggaaaggagtatgccaagactgtatattgtcaccctgcttatttagcttctatgcagagtacatcatgtaaaattccaggctggatgaagcataagctagaataaagattcccagggaaaatatcaataacctcagatatgcagatgacaccacccttatggcagaaagcaaagagcctgttgatgaaagtgaatgaagagagtgaaaagttggcttaaaactcaacattcaaaaaatgaagatcacagcatctggttccaacccttcatggcaaatagatgggttaacaatggaaaaagtgagagactttattttcttgggctcaaaatcactgtagatggtgacctcagccttgaaattaagatacttgctccttggaagaaaagctatgacaaacctagacagcatattaaaaagcacagacattactttgccgacaaatgtccatatagtcaaagctatggtttttgcagtagtca

SEQ ID NO: 36581 - DNA, 936 bp, Bovine  19866881720761
tcattagaaggactaatgctgaaactccaatacttctgggcacctgatgcaaacagccaactcacaggaaaagactctgatgctgggaaagattaagggcaggaggaaatgagggagacagaagatgagatggttggatggcatcactgactgaatggacatgaatttgaacaaattcctggtgacagtgatgtgcagggaagcctggtgtgctgcagtccatggggctgcaaagagttggacacgactgagcgactgtacaataacaaccacacaaaggtgtgctctcattaatcatcgaatgtgagagaagactgcgcctcctctttctcttctccagtcaggcaaacactcatagatcttgagtcttaaattcctcgtattctgcctactggtgtctcctccactgctgaaatagagcgtgtggggtacagagcacacatctcacatattccattatcacgtcttcttcgttgggatgaacccatcggtggttaatgtaaaggccattcaatgctacagtggtctaagactcagataccacctgtgccaaattccttttagcttgtaaaccatagatggagacataaataggttttgtgtctctctaatgacagagttaatcctcaaattcaattagcccctgctaactgaatgcatgaatgtatatgggttctttccatctgctgcagcaatctttctgaagctgctattagcatggaagacatctcctgtttgcagaaaaaacaaacagcctccccgccccaccccccaactcatccagcattcccttctggcagagaatgtgcaccttgctgccagagcaccaggatgtgctctgttcacagtcacttccatttctcttacagatcacggaattagccataaacctgaaggaaccagatgtctctcccaaacatctcatttgtttatctc

SEQ ID NO: 36582 - DNA, 945 bp, Bovine  19866881875324
ccctcctgttcaggagttgacttatttgtgccggaactgaactcgccgggaaacccaattaaatcctaccactgcagaaaagcacaaaataattcatcattttgggttgttttgaaatagaatgaaaattagtttggaggtggaatgaagggagaaggaaacatcaataaaagcaagaggaaccagaatcacaggaaccattaacattgatttcattccaggacagtgggtcagccagaaagcttggcatgctaattgcagaaggcacatttggtgcattggaagataacagcagacaaaggggagctggaaagaatcaaagaaaaccatgccaaagggcagcccagactatgttcagaaaacatgatagtttctccaattcgattttcatttcaagctccaggacatgtttctcagttagaatcaagtttgaacactagaaaacagaaaggcccactattattagttcctcttttctgtagtctaatttctactagaatgtaaaatgcatctgtatctaacttcttgcttttagaggggactatgtgagggctagtgggtatttctgagatgggattgtaggtgggaggggtttttctacaaatgattatgctcaccttagtgctagttttacctgattggagttgaaatttgatttgactatctggatacaattttgaaatatattacttcaccaaaagtgaaatcccttacataaaatcaatattcactttgtaataaagtatgtccaaaaaaaatacattataaaaatgttactttttccattaaatcaaattaaattggatgtaaagccccatctggaaacttggtggtgctagtggtttagtcattaagtcatgtctgactcttgcacccccagggactattagtttaagttattgaaagggttgattctctattcaccaatcatacaaaggtcttgct

SEQ ID NO: 36583 - DNA, 1504 bp, Bovine  19866880388827
ctttcgttgctggaggttatattcactgatacttactgtatttgaaattgaaactgagagttttaaaatatctattaattaattttaaaataacaagataaagccaataaaagttaacattagagtgattacatcatcccatgtttaatagcctctggaaaaacccatgctataagcatgcatgaatgagaataaaaaaggcaaatactgtctcagaagtattatggggatcattttgaccttgaagatcccctgaaagtagcctagggactccaaggtgctctaaagtacactcaaggaaccctgacatagagcaactgcataaataacattcaaaatgacaacaaaccctaacaagaattaaatcttagaaaggcactgaataaaagtcacattcataagcattctaagtagtttggagaatcccatgaacttcttctctgtctttgtacaaaataaaatacattagttaaaaaggaagctacttgtatatattaataaatgtatttctatgcacaaaacccttgatttaagtccttgtatgctttattccccatttagaagtcctttaagtctattctgtggtaataatattcaaactcctataatttctaccagagtcctacaatcccgcttccatctgccaaagtccttactcatgacaccttagtcttttgatgttgagggctgatagtgacttagtcctctcaaatcctatttacttcttcatatctattgccttatctatactttttagcaaaatgtcttatttacttcataattgtaaggtccctgagacctgggatttatttttatccctcatggtttgttacacaaaatatgtactcagtcagtacttgttgaatgatagataaataaaagagtaacaatctcttgttgacatgggttgatttacatctaatgtaagctttttctttgcaggtcttggccacctgtaatgttgaacagtcctttttcaatgactggttcactgggcacttgaacttccaaattgagcaccagtaagagaaatagtttatgataaagggaaggggctgtcactaataactgtcctccatatagtccagagcactagacttgcaatcttaagggaaaaaaatgaaccaggattctctaaaggatgctatttttcaattaacaacaacgataaagaaagaagaaagaaagaaaggaagtgtcacaattgcgagttcagttcagttcagtcactcagtcttgtcttactctttgcgaccccatgaatcgcagcacacccggcctccctgtgcatcaccaactcccggagttcactcaaactcacatccatcgagtcggtgatgccatccagccatctcatcctctgtcgtccccttctcctccagcccccaatccctcccagcatccaagtcttttccaatgagtcaactcttcgcatggggaggcctaagtactggagtttcagctttagcaccattccttcctaagaacatccaagaccaatctc

SEQ ID NO: 36584 - DNA, 1550 bp, Bovine  19866880675514
gttcgtctagtcaaggctatggtttttcctgtggtcatgtatggatgtgagagttggactgtgaagaaggctgagcgctgaagaattgatgcttttgaactgtggtgttggagaagactcttgaaattcccttggactgcaaggagatccaaccagtccattctgaaggagatcagccctgggatttctttggaaggaatgatgctaaagctgaaactccagtactttggccacctcatgtgaagagctgactcattggaaaagactctgatgctgggaggaattgggggcaggaggagaaggggacgacagaggatgagatggctggatggcatcaccgactcgatggacatgggtttgagtgaactccgggagtttgtgatggacaaggaggcctggcgtgctacgattcatggggtcacaaagagtcagatacgactgagtgactgaactaaactgaactgaattttatatatatatatatatatatatatatatatatatatatatataatatgtatagtcagtacattgttagtatatttacatctacttgtggggtgtgtagtaatattttttgctgataagtatgtagaaaccactgcttaggaaatgactttcagaatcccatcatactcctggaacattctgtaccttgagatgaccaatcacaaaattttgcatcaggcggttccacttggacttcttaaatacggaaaggtgtcccaagtcatgttgcagaaatgaatcctgagcctagaagagacagggttactgtcagagaagttggcaaggtaagaagaaagtagtaagtgaggccactggtaggtttgggaacccatgagaacagtgggagatcttgtctgacctcaagccaagtgtgtatctgtcacacttgctgagttctttcccatctctgtgcctttgcacaggtggttctctcagcctagaatgctcttctctccactgtcagaatcttccagtgtggaatggaaagaggatgcctttcaagtcaggctaacttgggctctaaactgtccttcaccactttacaaattatacaactcttggcaagctagttggtagctctgaactcagttctttgtctgagaagcagagattataataaaccttgctcattcagctgtcgtgcagccaaaatacatgtaaaattcctgataatgctaagcagtcaaacaaatatttgtttcctttcttgactctaaaagttgcttttcaaagaataaagcaagttgacttttcgagaaaaaaattagcatataaaattttgtaattaacactgatgttaattctccatgaaatcatccccaattgcctcaattagaattagatgcctctttctgctcccagagcacatgcttgtttcttttccttctgccttgtatcctgtctagatatttcaatgaccagctcctcccctggatgactgtttcccaagggcagggtcaggtgcatttccctttgtgtccacaatacagtgctgggtcatagaaggccatcttcagagatctgcacttcattcaaaggat

SEQ ID NO: 36585 - DNA, 787 bp, Bovine  19866880683790
tgctgacctgcccctcttaatgttgacatgttctgacacttacataaagcaaactgccttgtttgtgtctgaagggattaacctcacaggttccctactcattatcctcatctcctacgttttcattttcatcaccattatgaggatctgttctagcaaagggcagcacaaagccttctccacctgtggctcccacctgacagctgtcactatgttctacgggtccctgacttgcatgtatctgagaccagcaaacaaccaatctgtggaacaagggaaaattgtgtcagtgatttgcatttttgtgaatcccatgctaaatccatttatctgtagcctcaggaacaatgatgtgaaacaggctttaagaagaatatttatgagaaacgttggtgcaatgaagaagagttctcttttgacagtttcccagttaaaaaaaaaaaaaaaagagagaaagaaagaaaaagtgtctcgaaagcagccccaaaatataccatcgtgcctgaagaatccaatccacttcagtattctttcctggagaatccatggacagaggagcctgtcaggcatcagactcctgtccatggaatggcaaagaatcggacctgacccagcacacatgcacattgacacacgtttgcagagctggggatcgagtctaatggaaacaaagaatggaagtgttgtttggaagaaaacacaacagaagtcagtttcttatgattaagcaggtttaagcttttagcctcactcaagggactcatttccacttgcttggcatatattt

SEQ ID NO: 36586 - DNA, 1269 bp, Bovine  19866880743192
ttaaattatatatatttatattcttttccattatgatttaatcactggatagtgaacagagttctgtgtgctatccagtaggaccatgttgtccatccattctatatatattaataatttgcatctcccaaactccccaacccacacctctctacaattccttccccttggcaatcatatctgttctccatatctgtgagtctgtttctattgcatagatatgttcattcctgttgtatttagattccacatgcaagtgatatcatatggtataaaaagtaattactccaggcagtaacaagttgagtaggttgtaaaaatgactgcaaattctttccttcaatgcagtctcatcatttcaaggtgatgtgtcagatcctttcactaaatggtggagtcaattcctctgactccttaaatctgagttggccatgtgacttgctatggccaatgtcatatcagaaactgcagcagaatactcacgacttggatatgcttggcactcagtgtaattagtttatgcccaagcaagaaggacttattccttattgattgtagagcttcttttgcttcctcatttcataggcagtagataaggaggtttaacatggggtcataatgccacaagataaggatatttttccctattcttcagagttgatagatttaggctgtaaatacatgagagagggagctgcaaagaatgatgagagcggtcaggagcaagatgcctgtggcagaggactttttctttccccatagcaaaggacaagctcaggatggtgaaagatatgtgtatatgagaaaacaagtaccaacacagctcaaaatgaagttaatatatagaatagattaacatttcactaagtgtatttttaatgagtcattgaaatgattatagatttacttgcagctgtaaggagtaatacagtgagatcctttgtttagttttcccagattcctcttgggacaggcagagtaacagttcccaaagatcttcatatcctaatacttggaatccataaatctgttaggctacatggcaaacaggaagtaaggtagcagacaggctgacctagagctggagatattattttgaattttccaagagtctttaaaattggaagagggaggcagaacattgacagtcagacagagatttgaagatgctgtgtgatgtttgtgttgaagatgaagtaaatggttatactcaaggaatacaggtggtttctagaaattgaaatgatcaagaaagtagatttttctaga

SEQ ID NO: 36587 - DNA, 616 bp, Bovine  19866880753130
tcccaccggctgccgcagctggctctccgcggagctcgccgcccccgctgcctcccgcagcaggcgtgtgaagggctgtgggtgtcactttccacagccccgcccggtgacacccttaatcacagccaggaagagcggggctcaggaggtggggacgaggtgtccttgggtgtgagaaaatgattcacaccggagggctggccaagtggaccagcagaagtcatttcctgaggtcccggtgggagaaggcggggccccctcggctttagtggagactcagctcttgccttctgcttttgtcctgggagccaggcggaggtcccaggcgagggcacggggtcacaggcttcatttggccttggaatttaaagccacggtggacaatggcggggccccaatggtgggaggtccctccgccgtggctgagagctgctttgctgcgtgggaggtgtgtggggggttccctgcaggtcagctgggggcaggctttgtgaccgtgggcaagtcactccacctgtctgggtctccgttcctggagcctgtcagcagtcacagagggctgctaggacatgcaccggtgcccggggttagttacaggggttaatacaggtacctc

SEQ ID NO: 36588 - DNA, 1742 bp, Bovine  19866880766012
cgggagaggatctctgtgatatgtggttgcaaattaaaaaaataagctacaaaaatactaaacatgaaagaaaatattgattccctaaaccacattaaaattgagaccataggcttgcctttaagagcataaacatgtaagacacaccaaggaaagatgtatttacagtgaatatagctggtatacctgaaatacatgaataattaccatatatttttaaaacaagtcaggcaatctagtgaaaaaatgtgggcaaacgcttgaataactattggttatataaatgtcctgaaaatattgcaaagttgctcaatctcactagaaattggcaaaatggctggtaaagttccaaagcagcattagatttgcctttttcagtgaaacatctcccaatttctcatggaaaaatctgtatatacagtagaaattcttcacacattttgattttcagtgatttttttttgtccgtattggaaaaagacactaattaaaatgatcacaatgtcaaataaggtatcctgtggaaaattctctattataatgaactttagataaacagttccagaaattttgtcatcattactctgaagtttactctgtaaatagctaaagaaggaggtaagaaaaggattcaaacacagaaaacaaatattttgatcccagaggattttaaaaagcatttagaggcagcaataacattttaacttactttcctcttaataaaattcccaaggtatggcatactttagggaaacaaattctctcagaacaaaaaatgatgtaactacttctgaaaatcttaattcatgtggagattttttttttttttttttcagagtggaatcttcctatttccttgggggaaaatctaagaatacgaccaagtgactgctagacagtcggacttcctctctgtgcaaaggcacaggtctgggtgggaagatgaaaggcatgctgaaaaaagagcacagtttgtacttcaatgttaattttctaaagaagaaaggaactcactgccatgtaagtttaactcactttttaaacctatttctgattctctatatcttcaaaagttcaagatgagttaaatggatttatggggaaataagattgactaacattcaaaatattttataggttttctaatgtcgaacaaactcctagttaaaccctaattttctctctaaaacgtttaaggcatattactctttagaactgtatttgatttgctggcgtttcattctagcttttgtatgccaacgttcccaaactgaaaacctgcaatttcttttcttatggataatgttatgcttctaagtaatttaaagctttgtgcacaataaatttcttgtttttttccctcactctagtgactgagctaaccaatggctggtgaaaactatacaaggatcacagagtttattttcacaggctaaaagtaccatccgcatgtgcaaggcttcctcttctcgctcttccttcttttttaccttgtcaccatgacaggaaacctgggcatgattatcctcatccggatagattcccgcctgcacacaccgatgtatttttttctcagtcacctgtcctttgcggatgtctgcttttcatccgtggttggccccaagatgctcagagacttcttcgctgaaaggaaagccatttctttcctgggctgcgccttgcagcagtgggtcttttgggttcctttgtggccatcgagtgccttctcctggcgtccatgg

SEQ ID NO: 36589 - DNA, 2448 bp, Bovine  19866880867922
tcatatatggatgtgagagttggacatgaaagaaggctgagcatcaaagaactgttgcttttgaactgtggtgttggaaaaaactcttgagtgtcccttggacagcatggagatcaaacctgtcagcactataggaaatcaaccctgaatttgcattgaaatgactgatggttaagctgaagctccaatacattggccacctgataggaagaaccaactcattggaaaagaccctggtgcctggaaaggttgagggcgggaagagcagagggtgaccagaggatgagatggttggatggcatcatggactcagtggacatgagttcgagcaaattctgggagatagtgtaggaacatggaagcctggcatgctgcagttcacagggttacaaagagtcagacatgactcactgaccaaacaacggcatctcggctcctacaccttgtcataggaaccgggctatgtgtccaggctgtctgcctgatggcccactcgtctcagtatagtgcgttgcttcctgacacacagccttgagggatgcacctgggcctcaggagtcagcctaagtattcgtcttgggcctgcatgtaaccagtcctctctcctcagatccctcctatccccttgtgagtttgtttcttcattttttttaagtggaaatgtaattcttattctttctgcctcacagtgatatctggatcaccactttgtactaagtatttcaaaataatggtacaattgtaagctgttttaaaacatgaagtgcaaaaaaaaaaaaaaaaaatgaagtgcttaatattgcctaaaatccctctaagctttatgtgcaaccattctagtgaagtctagtcttatggaggccctgccctctgaagccagtttttcagtcaaccaaagtcttggtgaaataaaagtggtgcttttcgtggggaatacccaaaagtttggagccaggaagaggtgaacctggagttcttcttctttgcttttcagaaggtagtttattctcctggaactgtaatttctccaattgtaaaaagaactatagttagggtatagtcacatcattgactcaacagctatttatggaattcctaatacaggtccaatcctgtgcctttaggtactgaggactcagggatgagcaaaattgacatagtctctgctctcatggaaactggtttaacagggaacatcaaacaattataagcagtcacggaaaaagaaaagttatgtgtaagttgtgtggcaagaagtaggtggttagaaacatggaattactgtttggcacagggccacgcatcccattcctttgtttctcagaggtttaagaattctgaggatctcaggaggatgacactgctttgaaatacttggaatcctctcatttatgccattgcaggtcctcccaggcaggatggctggtttcccacagaaaatgataaattggccctgtaatatacctcatccccatccctccacatactcttgagtcccgagacctcactcacgtttttgtttctctcctgattgggctcttctggagcaagctctccaatgagcagtggtttaaggtacaaccgcacaatgtcagggtctggatgcatggctctgaagacgtcctgtgaatcagagagaactgttagaggcttaaaaatgacacgcttacacacagattatctcccctttcttacctcattctgtaccgatcttacgaatcagcaaagattatgttatagagcatttacttctaactctaggttgacacttccagttcgttgatcagaattacccttgaaattcctctatgaaagcctcacactggagatccacccactgagtacatggcttactaggcaagtcctgggtagaaagttgatctccaagcattggaagagatagttgtttattttattgagcccagaagcagtagttggctttgagattatgggccatggtgaatctttagagtcaaacctcaggcttggtgtgggagttgcccacattgtttggagcatgcagcaaccaagactgcctatgcaaatcacatctctcagagtttcccttttggttcttggtcaaggaccaggggacagaggtccttgaattaagttatttccaaggaaagacaagttaaagttgatgataacaaacatctaagagagcatgggagcaaagccctcgaatccttagttgtctaaagtggcactttcttgggttaagtttatcactgaaggagccttagcactctttctaaaaaaaaaacagaaacaaaacaaacaaacaaacaaaaaacaccatggcattctctgtaggggctggagacaggcacaaaatagagctgaccaactatattttttccaactccattcccatgttaagtagtaacttccaagtggctatgaaaagcagtgttggttctcatgtcctgcttaagtttggaaata

SEQ ID NO: 36590 - DNA, 881 bp, Bovine  19866881462049
caccaacttattgatccaggtgtctgcacacgcaagggaaagcagtggtgaaatatcacagaaaaagtgattgataacattttggaccacagaagggtaagcaaaaggtgagacttgtatgagtcttggtgcttataagagccacagcataagggcctataaccagctgcacacagaccctctgggacataatgagtgtgtacaacaagggcttacagatggctgtatatagatcataggccatggaagccagcaggaaacattcagtggccacaaaaagaccaaagaaaaacatctgtgcagcacaacccatgaaagggatgcttcttttctttacaaagatatcacacagcatcttgggggcaatggaagaagaggaacacaagtctacaaaggacaagtggctaagaaaaaagtacataggagtgtggagtctgggatcaatccatatgagagtgatcatccccaagttaccacccagagtggcaagatagaaaaaaagaagaatgaaaaagagaacaatctgctgatagagatgatctatgaggcccaagaaaagaaattcagtcacagttgtctgattctgatcttccattggtcatctgcaatctgttataagaaagatgttttttgatgaaaaacaatcattgagttacaaataacatattaagccaataaagggttctgttagataggtctacaatagacaattactgaaacactttggaactaaaaaataatattcccagattctaggttgagcttctcagttggtgcagtggtaaggaatccacctgccagtgcaagagacactagagacatgggttcaattcctgggtcatgaagatcccctggatgtatggaatggcaacatgctccag

SEQ ID NO: 36591 - DNA, 2950 bp, Bovine  19866880392909
ccctgacaccatcaacgctttctttatccaccctcctttttcttgtgggaggaaaaagcagatatatatttccttaaaaatttatacatcaccccacccccaagaccccaaagcatgaggcactcaattttcattatgaagtgactagtgaatatttagaagcctgcgtttaaaattgcatgtattaaatgcacataaaatgaatatattgtttgtgaaatattaaacacaagtccttttttttcctagttgttaagcacaaatatgggcctgccatgcatgtgtgttatcttgagaaaatgtggggctttattatgcttctttaaatcatactaagtattccttttagctataaaggatcttttcctttggtaagtgttttgttgttttttttttctccttttgactgaggataacttcacaaaagcatatgtaagttaaccagaaatgcaaagaaaaaaataacactttttcagaagtgatgtatctttttaataatcacttgggggcaatagaaaaggcaatttttaaaatgaaagtaatctttaggaaaaatattatgaaaaggctttattagtattctgttgtgttgtgttagcatccatttcatgggaaaagacgtttctttttaacaagatactccatggcaagaaaattatttttttttcttgtttggcacaattccaatccttttttcctttgccctcccagtggatgaaatgatcttagtggaaaacacattttttttggaagaacagatttacaggtgaatgtgaccaatgaaaatatttgaagtgaaaaaatgaaaatcaaatgattgttgtagatccttatagtgagcagttgggagttctgctgacttcgtatcaggaatgaccatctatcccaactgatgagggagcacattttaatccactaaggttgtgtattgattttggcagatttgcagtgtgatatgtgcaataggtatttttgcagctggtaccaagtgtatccagtactaatatttattttatttttaattatattcttatactttccagtttttaggtgtaaaagttgatatttacccttgatatattgggttggcaaaaaaattcatttggatttttctgtgagatgttacggaaaaacctgaatgaaaaatttggtttctgtactacttggaagcctgggagaactgtttctgtttgaaagttgtgtgtactattttcctattgctgttgtaataaagtaccacattacaaacaatatacatttagaatattacccttctaggtctcactgagctaaaatgaaggttctggcagggctgtactccttcctggaggctggtcatttgtatccttgtcttttccagcttctaagggccactggattccttggttcatggcctcttcttccatcatcagaggcagccaggttgcacccatctgactattcctccatagtcacatcttcctctgcctgtcacgttagcaggaaagggctttgttaaggacttatgtgaccaggttgggctcattcaggtaattcaagctcaaccaccatatcaaagtccttaacatctgcaaagttcctttttcagattaggtaacatattcacaggttctgaggatttggatgtagacattttggggaggcccttattctgcccatgtgcacagaaagatgcagagagccccacagcaatggcgatgactgccatcagtgttctttggtgcctcctttgtgccttttggggcttccctggtggctcagaggttaaagcatctgcctccaatgcaggaggcccgggttcgatccctgggtcgggaagatcccctggggaaggaaatggtaacccactccagtattcttgcttggagaatcccatggatggagaagcctggtaggctacagtccacagggttgcaaagagtcagacacgactgagtgacttcactttgtgccttttacaaaaatgaccacctatgatgtatagtcggcactcagtgagtatttgttgagaaaatgaatggatttattgattcttatctgtattcatcagatggcattatttggagcatttagcgtaagtgggaaggcacttcagcactggttactagcagagaaataggtcttacaggaatttattgatatttataaactaatccatgggttggtataacattcgccagagccatgaagctacagtaacttaaaactaatcatcaggtgttggaaaaaagtcactgctcatgctcagaagtcagaattgaaacctgtacagctgttccctgaagaaagcagacagcagaaggtccataactcttgagtgtttcaacccttcaactcttgagttaaatataccgggagaggatggaaccaaattcagctcacatgggctacttagagtaatctggtgttctggaagattcttcttgggtgtggtcagtggagttacgaagcttctgttaattgagttttggttggcatcaacctcatgtgactctttgagagtgaacagaacacacaactacctttgttcctattgcagattggagatcccaaagtgcaaaaaggcttcagaaaaagacctgccttcaaatcctgcataactgggtaacagagtatctctaaaacagaggtaatgtctaccttgttgattgatggaagcattagcaagatttttaccaggcctagcataggaacaacaaatatagtaggtactcaataagttttattattatttacagaatttctcagccagcttctaacattgccggtgatgttttgttatacaaaagtgtcattcatctcaggtaattaagaggtgcattttggttaagagtgtagattctagatttattcatccatttattcattctttttttttttttccaccattccaaaattccctattgctgttatgaagacaagaaggacagagtagtcgtgatctgttgtg

SEQ ID NO: 36592 - DNA, 1878 bp, Bovine  19866880411285
ataatgagttttgaacgtgtctgtattgcaaggggctgcctgggactcctattttggagcctaggctggtcctacccctgattaattatgcaagcctgcttcctgaaagcccaaaccatccttgcttcaagaaggaaccgccccaaattgttttatcactatatcttacacatccagctttaatttaatctttggtaaatttatgaagctcttcaacctgtttcacttaaatgtccttttaacacacagtcttatatcatttttatgttagttcattatttccagcagaagcacgtagttgtctggaaagctaaattttccttaaaatacacatccacatatttttggagcttgttagagactcctttttgtgtttccatcacaagggaacagaattgtgccaccagactgtggaagttgtttatttttgtccctcttatgtacattttcagaaaccatctccttcttaatctccactggggaccagtagttttttttctctaattataaagtggtctcatttctgacctggggtagttttaaattttaattcccgacttgtgtttataaactgttagactacattatcctgttgggaacattgagagaaaggcttcagtcttttgtgttagttttaacaattagatattcattcagtgtcttaaaatgtattttgggtgaacgaaaaatgcatttttgatgttgatttttttcctttggtatttcacttatctatatttcacattagcagtgaagcttttcaaactctggatgagtgatggtgatttgctgtaatattattaaaaatctaagaggagtgaacataattgataggattactgttttgtttttaactcttcacttttggtttcaaaatgtttatgtggaaaaaggtatagacatcttggcataggggatatatttttacatattttggcagattctgggtcaaagctgctcaaacatcaaggagcctatgggttggttgttttttttttaagagttattttctgcctttatggtaatactaaggatcattgaaaatgactaatccttgcccaactcattaatgccaggaatgttgagtttctttattctgttgtctgtgactcattagtctgtgttctgaacagcaaattggcaaaatggcctcttgtcactggaaagtattccttttgcacttggagaatataatgtacctgaggggctgcaaaaatatttttcttgcagatctggatgccccaggctgctaaaacccgaggcagtatagaattatgcttagtgtcccaaagacctaattatagtactgtctacccttgtggtactactttcaatgtattttaaaatatttggagccaaataaagatgcttttttttgatgcagattcaaatacctttagcagatcaaactgaaaccaatccctgaataaacaattttgtagcactggggaccagtattaaagggagtaaagacgctcattagtgtctgatcataatttacaaaattctacaagattaagaagttttcatacaattctgtaacatacacatccatgcacgaataaaacaaacactgaagttcttttaagagatgttccatttagtatttacatatatttatgtatgtatagaataatgcatatagttgttttatagtccttaattgtacatataaaacgaataatttcaaatattttataaaattttaaatgttttgaatgtattataaatatattttaaatattacttgaatgacacaagtatattttatataattttaagcataacatttaaatatattatataaatgttatgcttaaaattatggggacaggattggtaacttctaccccagacatttttgccagcaaagaatca

SEQ ID NO: 36593 - DNA, 1899 bp, Bovine  19866880456685
aatgctttattatgttctttctatggagttcagttaacagtgccttgggtccatgagtaggggaaacttaaaggtttttcttaaacaaaagagaggagagcttgctcctgaagcaggtttcccaaggtcacggccacttctaattacaattctaatgaaacataaggagatcttcccaggagatcattacttggtaatttttcaacaatagctataccatcttcttccctatttggaaaatacagaaaaatggcccatcagcgtccctaccatagatttcattttcacactcggtatttctgaatccctgattagttctctgacaagcagcacatttatatacagtatgaaatatgagcgttatctatgcctcagtcttaatttaaaatttgcattatacagtatttatgtagaccttttctgcaacctttcaagtactcaaacaaatgattctccattaaaagagttgatcttgaaatatctgtctgaacattgtaaatagcatgttatggatcacgcgtttatttagacaagtgaaatacaacatcaaaagctatcgctgaaaaactaggccaatgtgggcattaaaaatataacaccacatatcttgggcaagaaagttctccagatcccacgtgtgatgatggggaatatttagactctccagcaaagattacatgtttcttgattcatctcacagcgcaagtctacttcatttgcaaagtgataacctattaccataactaaaccgcctattgcatggaggctcagaaataaaataaaaagattagccagttatcttatttacatatattgaattgcagtaatacagcccgatctctgcctctcatttgattctaattaaagcgtagcagagaaactgcaatccacacaagagcttattttaatagtcagagctggcaaagtcccaatatcacaatgtagcaattaacagcacggctgtatttgctattcatggtttgatgtaaaaacttgtttattaagatgggctggaggcgctggtgtgcaatagacctgcatgtaattagattccaattatttgtctgtttctgatattgtaaactggcacttagcacatcagttaaattgacacacggcgctgcatggtttactcggtaattaaaacatgttctgttaattagatgatgaccactttatttcagggctcttgtgtttgggttttctagtgtgctctgtttgtatcatgagccaccagacgctcttctaatgagtccttgttttgtttcaattaccacctgctgttcaaaagcaaagcttgttttaactaaacaaaattaatgcttgtctcttcctttgtaagaacttaaatgttagacaaattaatatgcttattatcgaagtgctaagctctggttttaaagactgctaaggcaattagaagaaagttataaaatgttgtagagtgtggcataaatattgtttagcgtattaagaggcattacaaacaatgaaatatttgctggggttgaaagggagcagagagacttagcctccccacccccaaattaaattagctcttgcaatttgcacagggatatccagaaactaaagatactagtgacttcctaagagaaggaactgaatgaagtcagacatgaaagtatgtggcacggctataaataaacccatgaatgatgttggattgccctgaatggttttcaaaactacatgcctgctgcatattctttttcatatgttgttttcatgctaaacaatcaatggagctgtttcttaaaacttatatagcaaaccctatcagaaaagccagttcacattttccagggtgttagggcctgttctattacctatgcctctgattccaaagccacctccacaccagcacttctcccggggaac

SEQ ID NO: 36594 - DNA, 865 bp, Bovine  19866880600945
tattttcaatctaatttgtggaaggagaatttttccttttatcatctataccttattcctttcctatattcaaccattacttttaaaatctctgtccactaaaattttctcatctcttcgccaagaaattcatttttccccttataatttgtacaacattaacaattgtattcttagctcactgtggcttacctatgtagatcctgtgtggttttaactttattaagatcataatttagggatatactgatattcttttccaattagtctctacagctcttcaaagaattattttatctcagaaacatcaaataaaacagcttacaattttttatttgctttatagttctttaaaggatacaaagacatcatttgtgaatagttgatcaaatgttagaatttctctttgaatccaaaaagtcctattaaactgaaattgtatttgaagttcaatttatttaaatgtcctgctttaagactgacccatgagaggtggtctggagaaaagactgatcaagataacatatttttttttccctttctctccaaggagcaaaaagaaaaaaaaaaaaaaaaagcattcttcactgatgtaggtagaaaaccaggtattgtatgaaagaaatcacacttgtccatcctacttggctacgtagatctcagaactaaaaaagccagacaaagtcaagaagatgacaaagaacttgacaatgagcagactcaaataggagcaaatgactgcatatagtcaaaaaatgcctctcatccaaaagagaaagatatttccagatattaacattttacagtagattttattgtactgattgaagacaactttgttttagcattgccatacctccatcaa

SEQ ID NO: 36595 - DNA, 1537 bp, Bovine  19866880620585
gaaaattgagaaataaacttcttaattctcctttcaagtctgatttgttcctcaaagaactagctcgtcatttaaaatggttccttaaaattccctctgtaaggctgccatgacatttagcatgcttctcacaggtgaatccttccaaaaacagagaaggagatcaaacactgaaaacctcttagaaaataaattgtattttactaattacaataccaaggcagcatagtaatcatgttccatattcattctataaaataacaataataatcataaagggtggtgccattccattcagcttcctcttagcaccttttatttaaatgcaatcacaagagggtatttttgaagatgaaaagcaactttcataaaaatgaaaatgactctgattccctcaccactagtcaaaaacctttcagactaagataaatgactcgaagccattagaaaaaaattattgccaacttatgtgtgcctgagcaccccccctactttgcattttgattcatatttaaaatattgattccatcaaatggaggaacagttagtgtcagcaagaagatgatggagaaaatgaagtcaaaggcgaacaatgtaaacagtggatttatttatttacccttaggtggaggtgccatatttcacttctattgaacacttgctcaatttattttattaatttaatctttctaaagtactacttcacactctgatgcaatttcagatcaaacagatcactgtgtacttgttgaattcatggtgagtgatacatgaatttataatccagaatgattcataattgagtgagctaccttattttactcccctattaccggagagctttgcaatgaaagataataatgttcgaggaagaaatgtgaaagatattctcaaaaattgaaccatatgataataatgtcaagcgaaaatgaaatatttaatgtccatatttaggttctccatcatgtattatgtggtcatgtaaggggtgtcaaaagctgatgagaacttcaatttgacctggcaaaaatgaagtaagcaacatacagtatttcatccattatgtccattttcacagtgaaggatgggttttataatactttattccatccaatgtcaaggtcttaaaaacaaattttgaaagcacttaagaggttcttttaacagctgtatttagtaacaaatgacagatatctattaatataagtacatcttatataaaatattttaatatggattttaggtgatagtatattcttattaacatcatgtgtaaaatggcacatcatagcagctcttttacatgaaagatccatttagtcccatcttcaaattatggattaatacaatattctacaccataatggttccaaaagcattgttagcattatgtattattcatgttttcaggtaccattgtttcagctcataatagagtatctcacaattatgagtgaagcttataatgaactgaagaaaactacctaactgtactattttaataggtcacctagttggttctgatgacacctgagca

SEQ ID NO: 36596 - DNA, 961 bp, Bovine  19866880634184
atattttccccaagcattactaatacctcacagttagagtattttggaagacttctgaacacattcttatctaatctttctttgtttaaaactctgaatgtttataagcctggaacccaggaatcctcatttggtcatattcatcacacttattttttgctgtttgatttctgctttagaggatgctgtccatgcaggcacagcctcgaccaccagcatccagcatggtatcggccatgcgtggtgatgaaaaacatctctcccaggaaacagacacccttcaccactattcatgttaagttccctttttaccttttgatagttattttaatttctggggaagggccaacccatttggccaacccatttgggccaacccatatttggctaatttgtccaactgcaaattagcaaaagcagatactgtttcaccaaattttgaagatgattcctttacaagtgccagaaacaatgtcatcatgtacactggaaagctgtttaccaattttgacttcaccaaataggcccatattattacttggcttaggatattttagaaagaaaccacttccatatgctatgctgaatctcatgatagatcattaaaactcttaagggagacattatttttctctagagttaagatatactcaaaatcatgggcttctaagtgggggaaaactacagttaaccaaagccacaacaacagtgtttagcaaacgagcgtgatgtttacaacaggactgaatgtgacagctttcaaagcattatgtatatttccatgcatctacatggctagctctgacagcatgtcagttatcatttttgtaataacatggatataatttattagaattcaaatataggataaactgagaacatgcttcggcctgaagtactaatttgtctgttgctgacagttttgtatgtgttttaagtagaaataaagacattgtaattg

SEQ ID NO: 36597 - DNA, 1092 bp, Bovine  19866880651762
tatgaggcatatcaggatagcagaccagaaggtggcactttttcttttttcttctactcttttggccacaccacatggtatgtgggatttagttccccggtcacaggtcaaactcacaccccctgcattggaagcatggagtcttaacccgtggaccaccaggaaagcccaagaaggtggcacttttatctagtactgatgcagctcctgtccttatctccattcctcatcccttcccacatcccgggctccttcatggtgacgtaacgagctgtctagacctatgtagaaaataccgataatgcacttttggtccagtgttgattataatcactcgaacattatgctctactcaccctacctttctgaacaattcacatgagcctctacatggctcctcttcaggttttaactcagctatcttttttgaagaacacccaagaaaatattaaaccaagtacttaaattttataattttatcacaggtcatcagtttgtgtaacctgggcgaacttaatatgtaatgggcaaaattcttagagtccaagtgccttcattaagtgtatgtactgttcttgtgttcagttctgtaaagggagaaatttagaggcattggataatgaattctgccctgcagacatttccacctacacatttatccttgaaaaaatgctgatatgccttcatgtggtatttcctatttgtgaaggttccctgactgaatatgttgtctcacttctttgggaaaaattttgctttattaactttgattgtccagcattgataattaattttgtaggcctatcagcttatgtagtgggaaaatttcattagcaagttaaatgtaacttcgtttcttcatggcttcccatattttgtaggcttttagggaagcaatggttttataaaaatccattgagcagggcaaagacaatgtacttatctggttatattgtgtagaaaaaaaaaccctctttctggaatccctataaaggttgtatgttctcagagctctcttatctagtgtgcttccttaaatcagaatgttcttttccctaagaagcccaccttaaagaacaacattatctttat

SEQ ID NO: 36598 - DNA, 1194 bp, Bovine  19866880660823
cctaatccctacatagcactggatctcttaggtggatggtttcaacatcgtaggtaggaaaggaccaatattaaatttataaagatgctatgagacaagctgaactaaggtaaaacattcttagagaaaaaaattttaataaagagaaaataatttagttgtaatctgcagattggacctgaactgacgtttattaaagataaacaaataattattatttccctaatactgttcccattttaaatctccctaatattgtttccattttaaatcaagaactcagattttgtgcccagctaaaatcctgaatttcccaggctcccacctggttctaatagaccaggaaaaaaagttctgtgcaatgaacttttagggaaaacgaggttatctttaaaaggaataggaactgcctttgccctgagcatcatgtttaagccacacttttttgaattttcttacctgcagccataagtcatccctaacccaaacaggggtctgacatcttacaagcaatttattgttatgaaataggatgtcgtttcaaattacatgaataaaccagcacatataagctaactagcataataaacttttaaagctgacagtagcagtatcttaatggagcagaatttccaaggactacaaaatgaagctttgttttctctttctcatgaatgcaggtgtgacaataaactctctctagcctgactcagagaacttccctggtcaaactgagatagttacttaaaaataaataaataaataaactattcatgaagccaagtaacaacttgggtggggtgggggggaggaatctaggtttcaatataaccaaccagcttgtaaggaatataaaaatattttacctggcctgtggttacttattgaataaaaggcaaaatgtgctttaaaagggcttcccaggtggtgctagtggtaaagaacctgcctgccaacacaggaaacataagagatgtgggtttgatgcctgggtcaggaagatcccctggaaggggatttggcaatcctttccagcattcttgcttggagaatcccatggacagagttagcctggtgggctacagtccatggggtcacagagagtcaaacacaactgaaacgacttagacatatttttaaaatgaaaattaattgaacaaagcttaatagaaagttttcttgatagaaaacttt

SEQ ID NO: 36599 - DNA, 1102 bp, Bovine  19866880696370
ctagcagccctatgtgtataaataaagctttattggaacactgcacatgcatttgtttatatatcgtctattgctgctttcaggccatcaaagcagattgaaagagtacaacagagactattaacctgcagagactaaagtatttgcaagctgatcctctccaaaagaagtttgctgacctatcatttagaagataatcatagccaatattttgagagcttacgtggccttagaccacttggggtacgtgaattgtctcatgtcctcccagagtcttgaagagtaggttttatcattttttttttttttccagttagggaaagtgtggtacaaagatgttctataatgtagtcagggttacccagacagtgaagagcagagctaggctgtatcctctggctctgtagctcatgctcttagctccctttctctctctatctcaggactgtatcggattcctgccgtggctagaagaaaagccccaggctaccagtgaagggcatcacttagctaaatgatttattcatctgaaaaaagggaaggattgggctggattttaacctagccattaatgagcttgttaaccctgacctttcagatcaatcttctaggcctacctttaccttttagaaaggattccattttctaacaataaagcacattttcctcttcttacaatctaatgatcacttgctgtaatgctgcacatcgtagcagcccatcaaaccattagttacacataaaacctattaatgtacagtattcacagttgcattttctttcaagtcaatagaaaggaaacaatttattacaagggcctgatacacacctcagtacattaagacagtctttcccaaagagctgtgtgctaatgctggccatatttagggaccaaagtggtgagagaggcatggaattttctccctggccaccgtgagttgtgtgaactcgctggggactaaagcttcctgagtattagtttcctcacctataaaatggagatgatgccacctaccttgaagagttcttatggcataaactttaaaacttacataaattatttgagtgttgggtatagaataagtgtttcataaattttaag

SEQ ID NO: 36600 - DNA, 1412 bp, Bovine  19866880710194
tatgacatatatgaatggacctgttcacccgcattccaatcattcacttcacttctaacccaggactttaatgactgccaagcttctacattcactggcatgcactcatctccgtcatgttcttctgacagcttattcaaacaaaaggaatatgactaaactccccaagcaggacagagggagttctagtgctgaaaagcaagccaaatttacaatttaaaaataaattccagtcctgttcaataaattacctattgcatactgtaagaattacattattattgccataataatatatggccgttattagaatgacagcaataacatatgcaattgctaatggacttataatgtagcatgccattgggaaataaaaacgaactatattttttcccattaccaaacaaatgctgctagaatctatacagtaattggaaactgagtagttaaaactagaagtttatacccatatttgccttgcatatatgggcctctgtcacataattttccactaaagttaaataagaagaaaatattacacacagactgtttctatatgcccaaactgttttgattattttgatggactcgactggctaagtcaagttatccagttaaaaaaaggtgaactcaatcaaaaaaaaaaaaaaaaaaattcagagaggtcaaaagaataatcgtgccagtcaaaaactgatttataagttctttttttttttttttcctgaagagattgatttgactggtcaagtcagttaaaatagtcaaaccagtttgtgtatatagacataaccacagtattgagtcatatctagttcactgcaaaaaatagtagcaatacttcttaactaagttgatattcaatatgagttctctgaggtgggtgggacaaagctttccatttctatttttaagctgaagagttttagagaaaactggctagagtgtatcatctataacgaaattacagaccacctccaaatcatagacttaaaataatgactaattatttctcatagctctgtgagttgaatggattgagctggagagtgcattggctccatatgggatagtctgaagtcattcatgaagttgcatttagttggagcctgactgggattggaatatctaatgtgaactcccatccataaaggtttctatccatattgctactcattagttaatagtttaacctgagtttctaaggaggcagttgactccaagaggaaatatttcaggagggcaactccagtgtgcaagcataaactcagcctctgcttgtatcacacgtgctaacgtcctgctgtcaaagcaagcccagacacaaggtaggagtagctctggaagggcatgagcatcagatgtgatgtcttgggagtcacgcacataacattctaccacaatacaactgg

SEQ ID NO: 36601 - DNA, 1337 bp, Bovine  19866880766055
gcccctctgtccatggaattctccaggcaatattagagtgggttgccattcccctttctcccagggaatcctgccaatccagggattgaacctggtttctcccacgttgcaggcagattctttaccatctgagccaccaggaaaaccctaatgtgaccataaataaggagcattctgtgtgcagtattttcaaacctttgaccacaaagcattttttctttctttttaggtgactagcagctcatagtacatatctccagaaacattgctctatagtaaggagcttgtagtgactttattcatatttagcctcattttgaggctattttctttctctttggatttctgccaggttttttttttttttttttggtatgttggacaaaagaagacatgtgttaaatattttggttttgttctttccaagtatcaatatcagtataaacttcccaagttcaaaatcttcatagtcatgttgcttaagtcgaagtaaaaaaatgcctttatttttatggttttctaagtctattttaccaaatgtacacttactggattaaagatattaataatatttgtcaaaataataatttatacctaagccgtgagctggggctttaaacacattgcttttaccaggcttcccacaaattaagacaggatttatgaatttagacttaatataaatttgaattacttcaaaaaaaaatacatccctattatttttcactgttggttttaatacagagccagttcctggtcacaagatagtacaataaatattttaaaattcggacatctcacactgaagtgaatgtggtcttcagatctgattttaaacttgtcactgatgaacatcttaatgtgctagtaaaattacatactatgatcataattttatttggcattcctaaagctacatctgtcttaattcttcttcccctttaattttactgatcttcaattagtaaaaaccaagtaaaacaattttgagaaatagggtcagatttttttcacctcttatcttacagcttttaatacagttttcagtttcagtgtctcagtggtttttactctaattgtttaattttattttctgtgtatgcacataattacattattcattaatccacaagttcatacttttattttcccttatttattttgcaaatgtgagtgaggctttccaattttttaaaatcgactctgtgagggatgtgtttgaaaggaatttcattagagtaacttgtttagctttctatttgtttgatttaccagactcccctctccagtaaaagagcagccgaacttatgtgggctttttatgaggtctagtgtca

SEQ ID NO: 36602 - DNA, 2173 bp, Bovine  19866880838106
tctatctagacttctactgactaagtagacgtttggaaattggatcaacataacagaggttcgatggagtttgcagctgggcgaactgggaagagaattttgacattttaaagaagggaacaggaagctaggaaagatgacgctcatttctcatggatttattcccttggttctcacttttatctgtcccttgtcctaaagaaatgttttttctccccttgactaatacgggtcaccccctcttctattccccatggcctcaagtcagccttcagatcgccaacactggccaagagtataacaggggtatcactccataactgctgaaggccagggggccccatgcaccatcttcaaaggtaaaagctaagaagattacactcattcttttagcagagaaaaggcaacgtgggcctgaagttcattgaacacaatcatattctacactctcaggaggactaatcattttaagaccaatttggcggttctcactcatgagaaaagaattcttccaaaaaaagtgaaggatttgggagacagaaaaaacactagaattacagaggatggagcgaggaaggggccaggccactcattctgtttcacaggctgttgaggctactccaaggcctctggttctcatgccgtgtttcagagttggggggaaactgaggttcatggggagaacttaacctgaggccgtggagctaggaaggaacaacagtaagactagaacccaggtgacatgatgcttggtctgacgttcccaaatgggtggtccctggcatcacctggcacaccaactgagaacccagatctttgcctccctcccgtctcctaccctgacctacgcaggcagaacctggggtgtgtgtatgcgtgcgcgcacacgggtgcacaatgttagccacacacaggttacaaagaagcaagcctcgattagttgactgaggtccccagtttcagggactgggatctgacctaatcttgtccagttctccaggggagggatgcaggagtaaacgcttctaataaagacaccaagggtccacgtttaatgaggtgcgttggggaaacaccactctcttctatgaactgtgtgtgccttagcaggagcgtgctccataccctcagccactggtacacactgacagtcccaacaaaactgatggaggcagaatggatcttgctacctggtctcttaagagcatattatcaaaaagaggaaaataagtttaaaaaaaaaggggggggggagggcagcaactggaaggaggagaaattaaatttttctaccaaactgagtatttaccaaatagctatcttccagccactctatcgagcggtggtcattcacagaccttcacaactcggccttgaaggccaactcgggctctcagcgggtaggcaacctacggctcatttcaccccaattgaagaatttcccaacttttattgtattctgtcaccatcttaacattcctcacgtgttattattaaagactctcttgacatttcaagcagacgcactcggatactctgtcatagtctaggaattctaatgctccccgagtaaagcaggattttaaattatgaaaaagaatcgtcttggttttccaaggggagacgaggaagggagacacgcagagaccctccctccttttcctcggcccctgtcagagcagtggtgccacgaagctctgatgctgttagcatctctctgttcccaccacccttcgagcttgttcagagagtcaggatgctggggagtcccagttgtgaggcgctgtcctgagtaccgcttcaaagggggttagaaaggcccaaagggcatcagagacaggtaacatacgggccaacgtcccggaagttggtgtgatcaccaacagccctgctgacggcggagggatcacatgagtccccacggtggcgcgtctgtgtgaggctgattgtctccctccgctgttgcagcctgtgcactcccttccctgctgacattttcttggagcgcacagttcctggggtggatggatttggacaccttccacgtgggcccagcatcaccgagctccagcccaggctccgcctaccacgaacttctcggggagaaagctccttgaggcagaggagagcgcggccccactggccgtgtttccaaacccttgatctgcaaaag

SEQ ID NO: 36603 - DNA, 1364 bp, Bovine  19866880848177
tgaatgaaaactagtattccaatgaatactagtctaggaagaaaaataaaaatgaatttcagttcagttcactcagtcatgtctgactctttgtgacctcatgaaccacagcacgccaggctttcctgtccatcaccaactcctggagttcacccaaacccatgtccattgagttggtgataccatccaaccgtctcatcctctgttgtccccttcttctcctgcccccaatctttcccagcatcaaggtcttttccaatgagtcagctcttcgcatcaggtgcccaaagtattgttgagtttcagcttcaacattactcaggactgattttctttaggagatgaatttcaaggttaaatatatctgtgaaattcttcatgaaccctccttggagactctcagatgttaactctgaaaagtcctatggtgataaaaccagtttaattttttttaactttttgtatttttgaaaagtagcttggtggttctctgtactgtttcacagtggctgaagggggtcagatgtacagtgatggatggtaacatacctttggtggttatcactttgtagtgtaattcgacacagatgttgaattataatgctgtaacttgaaacttatataacattatatactaattttacctcattttttttaaagggaaaagcgtagcttggtaattgaaacaaggattgaaataaggatatcatgtgacaagatttttctgtgtccctctacttttagtattcacttctcgaattttagaaatcctcatttgaaaaggaaaggttgcccttttctattctttaaattgtctaactctttaagaaaggaaaccagtccttggctgtgctctggggtgacatgaggttgagagggccagacaaggaattcttttcaatcaggagcagataagaggcatttggggcatgaaattaacattgtagtttattactaatgatgtctattaataaccctcagtatctcataaccattcttgcctgatatatctggtaatgcagaaaagtaaaaagtattaaaagtgtggagaatatatagcaatgtagaaggtaatatttcatatggtaggggagaagtagcaatttttaattctaaaaactgtcttacaggtttatgtaagcatcaaatgtgtgtaaatctttaataccactcctgatatcaataaatatttactattaaaaatagcaaagaataatttctattcacatttatttgagactaaatttgtacacattctcagttaacattttgataaaagtcacctctttcacaacatttgcttcccaaactagtatggtgactttatactcgattaaattaaaggcatatgcattgagtactta

SEQ ID NO: 36604 - DNA, 774 bp, Bovine  19866880865749
cattagaactgattcaaatgtattctttttaaaaataatccatctagaggatgatttgatgttaactaactagattgatgataaatagctaaagggtgacttgaccagtgttaaggtgatcccattaatcctcccaggataacacaacttaagaaaaggagcaggcagaaagtaataacacattttgctgctcagtacacagcatgcagtatctctgggccagactgtgtatcatcttcctgggcaaaccttaaggttggtagaaaatgtcaatacaataatgaaagagaaaagctatccttaaggtaataaagcccagagggcaaatttattaccaatccacccatacagctgcagaacaaggagaaaaaaatccagtttaaaatgaaaccaggaacttacagagagtttttcattcatgtgacatgattttgtgataaattactttaatgctttccaaaccctgataaatggattgatatgataacagattttgttttgtggcttatttactccctaaaattgcattatgaagtgggaagggtgtgtactcttttataccactggaaaaccatttagggcactggactggggaaagtaataagaataatgacttgaaggaggatttctaagcctctttacacacctgaagaccttaccagaatacaaaaatcacaaagacaagggattagaaaacaaacacccaaataaagagcagttaacacttgcatgtatgagattatgctaaaattccctgtgtcactggagcatgca

SEQ ID NO: 36605 - DNA, 1623 bp, Bovine  19866880890090
ggtgatccggttgaaggctcattgctcactaatctttaagcttcttctgggtgatccagttagtgaggcagattaaattttcttcttcatagttccacactcatccttcctgcatttaagttctcaaagatgccaagagtccaaaatagacttgtgctcttcagggcatacaaataaccccctatattataaaaactttagtcatgagagtggcatggaggtgattctgctatttaaaaaaaaaaaaactattgtgggggggagaggaatttagactatatcttttgtcacacttattagaggaagagagagaaggagtggaggagaaggaagggaagaagggaggtggagaaaacaaaatctttgcctttccatgttaaatgtttaacagcttcagaatcctcaacccaggataatgggtagaggattatgaaatatttcacaggggcgacttccttgatcaaggtaggtcatctcctcgaaatgctgtagtgtttgtagctcctttttgaatctctgcttctgttagcacagtggtcaaacgaaatatactattgcttctcacagaagatctgctctgttgagttttaggaatttgggggaaggaacctcatccaagctgtcacatttggtctcttcactgccaggcaaatggtcaggatcaaaggactctgcctggagaaacagtctgttggatgacagaagacaacaggcttgccaagtttcttaatatttgtcatgtttttccatgttcagtaaaaggacccagtgctactgaattacggagtgattcatcaaggtttaagtaaacagttagtaaataaactatctcagatgctacactttgaaaacgtactttttcccaatcaatattgcttctgttaaattttcagtagaaactataaattaaggtcaatgtaagttcttgacaatatcactgagtttaaagagccatggaggcagataacccaaaactagcttcaaaaatattactctctgttgaacttgactgcaagagaattattagaaatattttcttttaaataacatacaactaaattttaaaggttaatcatcctgagtccttacacagggctcaaataagaattattattagtttacaataattgctaaattagtatttctagatattttcaccaattaacacagaaaacagtgctgactaggccattagtccactggttaacagtgtacacaagaaaaatttgatagtgtgacagggaacttcttggttcagtttctttgattctcccaataaagaaaggtagtgctaaaagagtaaggttggagatgattaagtccaacattcttgtttcaaaaatgaagaagctgagaaccaaggaaattaaatgatgtgaccatgttctcattgctgattctaaacagggcagtgattagaacactcttctcttgacacatgatttagtgcttatggggtcaatctgcttcctacaaatgttcctttttcctctcctcccatttctctatttccccccaacaccatcctttttcttcctcagttcagttcagtcactcagtcaatgtcccactctttgtgactccatgaatcgcagcacgccaggcctccctgtccatcaacaa

SEQ ID NO: 36606 - DNA, 3087 bp, Bovine  19866880903867
aaaaataaatttattaaattttttttttaaaaaaaggaaaactgatcttttttccaacatatgacacatttggaatttgcgcaaaaatcatatatttcttagaaaagacacaaccaaatcacaagtttttaactattatggaaacttcaaacatatacaaacttaaatatgcatgtatccaaccattatccagggtcaaagtcacttcatttatacctctgtttcactgattcccatatccccactctaacctctggatcattttgaaacaaagctccaacactgtgtcatacatctgcaaagagttcagtgagtatttctaaaatataagaagagtttaaaaaacgtaactgtcatgctaatagcacgtccaaaaatctaacactaattccaccacatcgtcaaatatccaggcaaatttcaaaattctctgatattctctgaaaattcactgatagctacacaatagtattttttaaaattagaaattaattgtcacatttgaaaatagtatgtagtgtataataacctataagggaaaagaatccaaaaagtatatatttatatgggcttctctggtggctcagacaataaagaatccacctgcaagaggagacctgggttcaatccctgggtccagaagttcccctggagaagggaatggctatccactccaatatccttgcctggagaaatccacggacagaggatcctggcgggctacagtccatggggtcacaaaaggtcagacacaactgagtgactaacactttcatatgcatacacacacacacacacacacacacacacacacacataattgaatcactgtgctttacacctaaaactaacacgatactgctataaatgaactaactacaaattttaaaaaggggaggggaaaggaaagaaaatagaaatattttaatcaagtctagatttctgacttctctcttaacaaaaatatctggcaacactgagtgcacactgcagagcattgagcagaaatgatggagccacttccccctttaagcaggtcttgagtgctccagtcaccacactcctcaacacccctactgtcttgcccactgcacactccacacacctacatcactgatctggcttttggacacaactgagtctacaattctaaatctaagctaatggaaattttggatgattggaacctctcctagagcttttgggtaaatgatgtcttaagtggtggccacagctatgattaagctttacagacttgagtaagtcacagacagaacagaaaggaacaaccctgaagacaaatgctcacatttgagggtcaaaccagggacagaacagggaagatgcaaaatcaacagacaaggaagccaagagagggaatggaggagttatgaggtacagattgatttgattagttcaagaattatttggagaaccaaattatgtgctgggctttcctctttgcaaggtattccaagacccagagatgggtaatgttgcttttaaaggagttacgccaagtccaacactacataaagccttcccaccttccctattcgtcagttttgaaatgtgagaatgcaagcccggtaggttaaattaaaagtgtagtcaccggggcgacatattaatgctcttaaaattgaaacgaaaattaaaatctaaaataagatctcttgcattcacctatatctactaatatatgttgactccttcttagagaggctggaatgcttgagactcgttgtaagaaaataaaatggtgtgtgtttcacaaccagatactattcaaaattaaaagagcttaattttaagaatggtgcaagaaaagacatataatttgcttgctatgcacacagtagattaaaaactaaaaaaagccaatgagtgtgaaatattaaatatttacttctcagggtatttttgtgcactctgatattaatgggtaataataattactgtaccttatccaaaacacacgtagactgagaaattaaattcccagcatatggagagagatattggtcgatgcacatgcttaattcccattatgttaacagaaccagaggaaatgcacctatggaaaaaaaagagatcccttcagaaacttaatataatgggaaatctggaagtatcttttcccctggaagtagatgaattaattccattaaaatttcttaaaataaatatgcatacagacagaaaagttgagtatgtaaatgatttcatagaaaataactcacaaaattgatacttgtcagtctccttgaagattaaaaatgtgaagatggcttgggaccctaggaggaagctcagtcaaggaaatcagtcatccatctgagacccccaccatcactcacatctttaataggagatgtgttgcccttctgttcccttttctatttgctaattctaattccccatcaaagagtttatctgaccacaggaataggaagcccagtggatatcagagccatatctccatatcacacatggaaaaggtgatcagcactggaggagtgggtaaggaaattcacaatcaagaggctggagtgctggtgcaagttctacactttagccacttagatgaccttgatcttgacctgagtatttaaatccataaagaaggatgttaataatcccttatccatttactttacaaaattgaaagtctccaaaagaatatgtatatgtgaaggtaactgcaaataagagagcactctacaactgcaagtgccttaagtaatttagtgctataggttctgtttttcagagctctgcttcatttattattatttgttttgtcttctggccttttttcaaatatcagagtcatacacatcagtataaacaaattagaacaagataagcagactaaagaggggatgttaatcatgctgtcaccatcccaaaataatgcccatgaatattatacttacagatcgacctcagccagggttatctccccactccaggggacatctggcaatttctggagacatttttggttattcacaattgaggaagaggtagattataaatgctgctaatatttagtgagcactggccctggaggctgctaagaat

SEQ ID NO: 36607 - DNA, 772 bp, Bovine  19866880985756
ccctttaacccttcagatcggagtgagctctctgctgtgcctcaccattccttgttaatttccctacacttacccacatctttgtaaatcaattttttcctcaagtcctttccgcattcctttgatatggtgttttttgctgtcttgccccaggacatcgccttatatatatatatatatatatatttttttttttttttcatgaaaactagtttttttagtgttcttactcagagtttttataagtagtggaccatcattaagcctcttgctaagcaatttgggagacaactttggattcctatccaggtacacttagatattcttgctgctggagtaattgtatgctcttaagtatgtgcatttaaatacagctttcctgagtagaagaaatcatcaaaaaatatttagaaagggcagtgaccttttgtaaaggcatcacattaaaatgttttacatttttaccttgcccatcatttttctcattaaacaatatgcattatttattaataaggccactcacagggacaggcagcgaattggcaaattggcctttacattaagcttttaatgttaaatttataatgaatacgccaaactgcaatatatgaaataatagtctgtctgctttctgtccgtaactgaaaaaactatagtaggcttcaggactgttgtgtatatacaggatctgtttccttctgaaagattttctgacctaaatgtaataaatcacatcctttctaatcctactgtcttgaattcctgagtctgt

SEQ ID NO: 36608 - DNA, 1053 bp, Bovine  19866881010786
tagcctgccaggctcctctgttcatgggattctccaggcaagaatacagaatgggttctcatgccctccgccaggggatctttctgaccccgggatgaaactcacatctcctgtgtctcctgcactgcagacagactctttacccactgagccacctgggaagccttacataagaagcttatcttacataagaaatagaatctcaagtcatttatatagtatgtgttgttaaaatataaataataaaatgataaccctcattgtagggagatgatgatcctataaaaagcacccaagaactgaaagcctcaaatggaaccacagattcatatttctcatctaatactcatgttagggtagacgcatacagagcagacagtaagtaaaatcctgactttttgttttgtgtttcattctttgcttcattttgttgacctttctctatttatgaaacaaaatcttttaaatttaaatggataaagtgtttacaagagactacactagattagtatactaacatgattccattgtaagaaaataaattgggtttaaaaaaaaaaagaagaatccatggtagcaatggcaggagagaaaggtcttcatgtatctaccagaattccccttcatgggagggcaattaagacaaccaggaaggaaataaaagtttttcattgttggctgcaaggtctacaattgcttcttagtcaaaagaacatgtttaattaatttttttaattaagaatttttagcagtaggaaaaatttgcacacatacaggaaatggataattattttaacatttggtggccttttattaaatattctgaaaaatataaactctggagatgccaaattttgcaacatgatcttcttcagtctgttactatacagaagtaagcagctgagtggaaagaaaagcaaagtttctctgctcagaagaaagatggcttttatttatctgtcctcccatgcttttccactcactgctattttagaaagattacacttgtaaaagttttacttatggtataatattagaccagatttattaata

SEQ ID NO: 36609 - DNA, 815 bp, Bovine  19866881058928
ctctttttagcataagaattaaactcttaaaagatttaagcagttattgtcacagtgtagaaggttgatgtaagacaatgtagaatcaggcccgccacaagacatatatggaacacctttggaaataatctatcagataaaggagaatgcacaaattattttgttctttgcatacttttttaaaaaaagaacttttctgagatagtttttgtgaaggcaactctgtcctgtagaatgttgtaaataatgctgtttgtaatagtaaggagtgctaaatttattgtggcatatttttgaattggggcttagttgtgcttattccagatgttcatttgttcactcagacagtttggcactggttggtgtgagggtggatgtatattctcacctgcacaattaacttgacgttatttttggaatcattttcattttcagctatcaggatgataccatacttggggaaaatgctgttgagtttaagttaagagatgctgaatagctaagggcaaaatgtaaccactggggcacaggaagtatttcaaaacagcattgatactgttttattgaggataaagattttgtgtgctgctgctgctaagtcacttcagttatgtccaactctgtacgaccccatagacggcagcccatcaggctcccctgtccctgggattctccaggtccttcatgttttatggctgtgtttgtataaattgcatcctagccatcctacaggggctctattcaaccattctggctacctctgatatcatcaagatacaggagttgcttgaaatgcctacagaaattttattgta

SEQ ID NO: 36610 - DNA, 1377 bp, Bovine  19866881073521
tttcgattattgtaggtatgactagtttcctgagaaaccagtcaaaatgtgtaaactcattcagaagttagatgaattccactcactcattcaatttgtattttagtgccaggttgtaagacagcactgtgagggcgacaaggagacaccaagagtattgtcagctcttgtgttctttggctgtgtagttcaggagagtctgtgattatgtgaattgtgagtggtgaaaattttgactaatgatgtgacttatgcagtgatccatgtcaaaaacagagctacttgattagtgacagtagttcagtatatctcctttttattcactcttgtcctttattgattttatgcccctaaaaagacagctatgctgtactcacttgatttacatagtgggagaattcacattcctttttcagaaaattcctctggatgatggtaaagattaacaagtgtcaaatgatgcttgaagagcactatggataatcccttttcagctgtgcttttgaactagcagtatgatgccatgagtttgaactgtgatgcccaggacaaatgtggtaaacttttgaacaaatatccaaacttagggtcacaaatctgcaaaagttagaatatgcattcactgtagggaatcacactggctgcttgccttcgtgcatgcttagtgagtaggaccgtacaataccattggcaagacaattttgaagcagactggcaaatgtgagtgaaaaatcccagccttatgctggcaggtcaacaatttaaattcacatcagacatacagtgacaggagctctcctgatggccaaggtccctagcacagcctcttctcccagctcaaagtcagcggctctgcctgactctgacttcaagagggaagttggattagtggccactgttcctcccaagttgcttttcttggggccacttaaagtcagaaaacatgtgctgtagagattatattccattcacgaagggatgtagttttatggaatgagaaaactaaatccacttgaacattaatgcttggaagatttggtaagtaaagaacaaaccagtgaaatcaagatcgtgtgttgccctcccatatcaactgtctaaactataggtgatgcaggaactggactatgattcatctcatgtgaagtttttggaagatggagaatgaggaggtattcattaagcttaatgtattgagttggccaatacattagttcaggataacctgaactaacattttgtccaacacaaaattttaaaaaagtaattttgaaattcagtgtagctatcaattgattcgaatgttaaattctcaaaatcctggtgtagatccatgagaaaagtttcatatactggatcttttttttctaccttgta

SEQ ID NO: 36611 - DNA, 1059 bp, Bovine  19866881100899
gcagattacatatggagaaaataattgcagtatatttatttgaaaagaacttcatttgagaacacgcatatgcacagatgctcataaactctggttgcagtcataactgtagatcagtctctagactcttcagtcttaagagcagttgagtctcacttttaagttagtatgctctgaatgtctgccatttgcacatggggagttctgattggcacaatcttttaaaatattcatatgctctaacatagctctcacactactggaaattcataaaacctgaaaagaaaccacacagtcaaagctttatgtatgagtgtgcgttgaagcgtgttttaaataatgaaaactttaaaattatataaatagctgtcaataggggtatagaaccagacaataaaatgttatttatccaataaaatataaaactggaaggaagcatgcaaaaatgctgacagtgggtgaggggtgtggctgattttttttcttaaaaattttttgaacatatgctaacagtgaacctgttattaaaatttaagtgtaaagtttagaaataactaaaaaggtaaaggaaggtaccagagatataaaagagaaaaatcttgatgttagtgttaattaactaaatcaaaataatatacttatcaggtcaggccctactttatccagtgtctcccagtagttcttattttatattccagatgtctcaggatagaagacaaggttctttatcatttaccctttgtccttctgctctatggccctggttctagccatttcccagaatactctctattcatagtcaatgctagagagagtaagggttagcatttcacataatctgtcaagaaaactggtcttattcagtctagagaaagtaatcagccaggtcttggacttgagcataaattgtgttgaacaagcctggaagcacttgaagagcagggacacaattgctccattcatgggcatctcagaagtaagcactgagcagggctttctagattactcttctgttgtagatgtgtaagtatctatactcctccagattcgctttcaact

SEQ ID NO: 36612 - DNA, 3480 bp, Bovine  19866881104242
ctctgcattcagatgcttgtatctttccttttctcctttgcttttcacttctcttcttttcacagctatttgtaaggcctccccagacagccattttgttttttgcatttcttttccatggggatgatcttgatccctgtctcctgtacaatgtcacgaacctcagtccatagtttatcgagcactctatctatcagatctagtcccttaaatctatttctcacttccattgtataatcataagggatttgatttaggtcatacctgaatggtctagtggttttccctactttattcaatttaagtctgaatattcttgcctggagaatcccatggacaagagaagcctggtaggtacagtccacaggattgcaaagagttggacacgactgagagacttctttccgatatagaagactttaatttctttttttaaactgaattgttaagaaattccgtggtagctcagctggtaaagaatccacctgcaatacaggagaccctggttggattcctgggtcaggaagatccactggagaagggataggctttccactctagtattcttcagcttctctggtggctcagatggtagagaatccacctgcaatgtgggagacctggattccatccccaggttgagaagagcccccagagaagggattggctgcccactccaatgttctgtcctggagaattccatggacaggggagcctggcaggctacatgtccatggggtcgcaaagagtcagacacgactgtgggactttcactttcacagaacttctagtacaacactgaaaagaagtgatgagaaacaattacaccttgtttccaatcttaggacagttccttcattcgttcacaattaggcatgatattcattgtatgtttttcatagatgccttttatcatgttaaggaagttcccttttattccaaacttgtcaaaattggctgtggcaatttaaaaagtggcaattttcttttctaatctttaacattaagtttttacctagagcaaattagtacattctagatcattaaggttcaaagtttgtacaataaatgtcttaacagaccttttcttccttttcctccagagaaagagaatactggaaataagtaaagctagaaattgttgtattttatggatatattttgctttaggtgatctctgaactagacttatcttctacataatccctgtccaacagaaatacagggtaagccttaaatgtgaactatatatgtaactaaaattttctagtagttccatgagaaatgtaaaaaaaatacaggtaaaattagttttaataatatattttatttaacccatcatacccaaaatattatcaaatctacatgtcatccacatgaacattctctcttattttttgtatttagtctttgaaacctgggatgtattttatacttacaacaatggaatagtcacatttcaagtgctctgtagttacaggtggctattggctacagtgttggagattacagttctatatccttacatataaaactgtagttacctagtaaatattaaataggcatattggtggaaacatgcttaatatttgatacacagtaataggtatagaatatatagttgttaatttttgtatttaaataacatttgagcagaatgctagcatcttctaatattgacaaataatcttgtgatatgttatacctgaaaataaaggtcatgccttaatgcaagattttcaaaatgcatttgaatctatattttcacagcctttggacatggagagttatatactgtcttttgaacaatataaatatagtaaaatgcctgtaagaacatggtgactaaaagattgagctgggaaaaatatggccagtgttctcccttcaatttcctctaaaggaaactggattttctcctacttggagatctatatctcttggatatttggtcaacaaaatgggatcagctttcttgccagcataaagagcattaaaggaacaaatgggcatcacagatccagatgaacatcagcactgactgcattatgacactctggctgctaaatctttcatggtaatgggctgtgctggagatggctgcagtgataggcttcatgctggaagaagcctgtggtcattgtaggtggtgctaatgtcatcttatcgctgatttccaaggatcacttgcacaacttgtaatgagagtggctaaagtattgattttgagctccttctgaatgtgaaaaagatgatggtttcaaatcttggagagatatactcccagtgaacaccaccacccttactgaagcagttttaagtagtggaaaataaagcatttttgtgtttaaagctgcgtgctcagtcactcagttgtgtccaactctttgcaaccctatagactgtagctcaccagactcctctgtccatggaattttccaggcaataatgctagagtgggttgccatttcctcctccaggggatcttcctgacctaggaatcagacccaggtctcctggagtcacccgggaacactccttgtaagactcatgtattgtgaattgaggggaaaaagtattctcatgcttccctgttctgtctttggatatcttggttagagtattagtcagaaggcttgaaaagttcaagggcacagattcagtcatcatacaggctagtgattttcaatatttcccagccacagatcattctccttcctccagctgctgtgttgactgtgtacctagtcctaagggaactaagtagtagtagataaggaccattcatcactcctggtgttgaaacaactcagaacctgtggagtgtgggtcagaagtggcatgtggcatcttttaaagaaaagcagcacatagagattataccatcaggaggagtcagatgcttataaactggactgtgtaagttttcgctgaaaacttggcactaaagctgagaatagatgcaaagccagtaaacaaaagcaacagaagagattagctctttgatatatggggccatccgtagatcctgaaagaacacaagctggtaagatcaatgagcgcagataagaataccgtttagacttggtgttggtagccaacatcagcattaatgtttccatatcaatacttatttatggcctctctttcctaacatttggcttacttaaaagagtattctcaataaatagtatcatttctgcttgtccattagtttattagcacttttcttgttatatttaaagtgaattttaatttcatacactattctaaagggagttgttgattatgttttatcaagaaacaatgggtaacatgtggaattcataccagtgtctttgctgacatttgattcaagttttctagctgttttctgagtttgctggtctccatccagtttagtagctgtgcgtatctaactgaggagaaagtgaaagtgaggagaaagagtcattaaatacctaaaaatataaaaggaaa

SEQ ID NO: 36613 - DNA, 778 bp, Bovine  19866881136638
taaacataatttgagtgtagcttaaactgtgtccaaatgggataaaacaggtcacctgggaaattagattttgtagaatacaatcattcaatcttacattgtacttaatggagacagttttttaaaaacaaaaattttcaggaagcaattgactggtctatcaattttgtcattatttctctatgatacatctatagcatggagcagctgaagcaaaacaagataaacttccctataagtagcagtaaagaactcctctgtcttggtgggtttggtcttcccaacaaaaacacagaggaatctttagcctgagttcactttttgttttttacttctgtttttttttttttttaagtttgtatttaaaagattgtttaattaaaaaaaaaaaaaaggatttcttagctctgtggcttttggaaggaaatgattctgaaaatacttcatgtctgtacacacttttatcctgaaatgaagtcttcactagagatgagtgccagctattaaatttgattatggggccctggggcagaaggataatctttttaaaaaaagtgaacagttgaaaaatgacagtggtagtaaagagcaattaagaataagagtggatgggagatgtatatgtgagagtgaaggtgttgatttaaacactttaggaaagtttttgagcacaaatcatgtcctgacaagtgacttaaacatcttttctttgaaacacagggaaggtggtagttaaatttatatgctgcggagtcacacggtcgggatcaaatcccag

SEQ ID NO: 36614 - DNA, 1804 bp, Bovine  19866881146798
gcccgttcttcaactatgccttaggtactctctgaccattgagaactggggagaaagcacgcaccagttgacagaagcctctgtcactgtgggaaatgctttagctccttggttatgtgcaaattagggatcctgaacattttgtggggggaaaaaacagtcttacttacatggagaattgatcattttaaatatgtgagttaaaatcagaaccttctctcccccttctctcctcataaaatttaaccgaacacaggtaataataccacctggaaatcttttacagtacaaataaaaatgaaagttcagagttctaggtgatgaggtgagacccaacaagataaaagaattttatctagtagtttctctatgtttcctaaaaactgtttgaaatgggtccttgtaattaagatggaaatgttaaaacaattacatataagctgtttgctgctggtaaaaataaagctgctttctggaaatcaagataacatgtatctctgtcacaagttctctgagtcacacagaaatgtgctcattacttgagagacatggtttggccttcttatcaaccttccctatgatgatccagtgtataaaccaatctctaaagtttccttaaaatagaatgctgaccgtaaactgtaactgttaaaagcttgtaatcccagttctaatttagggtggtatgctagcgctttgcaggtctcaggaccccattgcttaattaactcttcttagtgctggaatcctattgactaatgaaattaatataacattggaaaatctatgccactttctgttccatcagtaaaataaataatgcattattcagtagaatctaaagttatgagatatgtctctccttttccagagtaaggggaagcaatggaaagggtcaactgattattattggtcctctagtttattctaagagattttcccctactaatcattacttccaagttgagagcttctaaacatgttttaacacactaatactacaattcaaagtagatagaggctattttccctatgttcataggcaactagagacttagatgaacttctctagataaatacttggcatttagcagatgctttcagtcccttgggaaatggattaaaatttgtccccactgtgaagcccaaggaaaagccagactttgtgactaagcaaattagaggagcacacagccagtgatgggaagaatatctggtcagtattataaaattcagagatatgatggtgaaaatcaatgttagagcgtacagtgtttatggacgggtcagccagcacaacttttctaggaggtaatttgataatataggtgtgattattgtataggacttggttaattacactttttgtcttcctaatgcccctaccttttccctcaacccccactcagtattggaaaggactttccttggcaaaatcttccttatctcttaaaacctgttgcatttggtcactcagggcagttaagagtaaacttcttggggaacttcttgaaaagagtcaacagggaaaaatctcctttgggaccatgagctttaaggaattaggtttaggaactggaaaaggaatttgaagaaaatcccacttacaatagcatcaaaaaccatggaatgctggagtagtaaatttaaggatgtatgcatacagcctgtatactgaaatctacaagccaatagatttttgacaaaggagactgggtaattcaataggggaagtagtcttttcaactaattgttagtagaactactgggtattcatagagacaaatcccaactttcacctcac

SEQ ID NO: 36615 - DNA, 1232 bp, Bovine  19866881159724
taaggaatttcctaaaaagcctgaactcggcaacacaatgacaatgctgagagagctttgtgtcttagaggatacgtggagaaactgtatcacacatccctggagaaaatactgtaataattgtctatagtttcttagactgagtaacagaggaggtaagggtcaccttttaaactgctttgcttctgatcagctaattatctcctcaccctgtgatgccttttatctcccctctaagcaacttgactcacataagtaaaattctaattcttcacagattttcaccttaactacgtttctaccctaacctccctgctcttctgtttcatccactggttttctttggctccattgggaacatggtgcccatttatttctttaatccacttcaccacctcatagtacattctactctgaggatgaattttaacaagatgctttttactgcatagtacactccagtaaagaactaatgtttacggcgatgtgtatctctattccaactgaaaagcggaggtgccgtggacctctaccgtgttaattttctcctgtttgactttttctcagtgcctctttgagtgatttagatctgttatatataatggcagtcttatgggcctgtccacagggtatctatatgctgctgaaatagcagtgaagatagcccacaaatgaatgaagtcatcaaatgtatttgatgataaaatcaaggttattttttaattttttgatgatgtgaaagctgtggagggatgctaacaaatctgtttgatcaatatatggaatataaaaagaagaggagacaagattgactgatgaataaaatgaaactgacacaaacaggctgacagccagctgtaagtctctttagggcaaatgcaattaacttagaataatagactcaaatttgatggttagaaatgcatttttattaacaatcacaggccgaatcattatgctcttatgaataaaatggtacttatatttcgtgcatgtgtgtgcatgcatatataaatatatatatatatgtctctctgtgtatatttccatgcctcccacattcctatgtgctctgcttacaatcgggatggaaaagttgatttttagaataatgtactttaaaaaggaaattcattcataaattgtctccaggactataaattctgaatattctcccaaattacatatataaaaatcatactacttatctggtgctattagacataaagcca

SEQ ID NO: 36616 - DNA, 1633 bp, Bovine  19866881164120
atatggattacttgatggaagtactgctgatcccaattctctctttttttttttcttaaacaacggaagcacaggtcaggttgaccacaaatccgtgagcgaagatcaggccttagcacttttaatcttgtgaaacaagcaattacaaatagttgcatcgatttgttaaaaagctttaggtgacataaattgtttcctgtttagcttattgctctgatacataaatgtcacccagtccagcatttgtgaggccacaaaagaagacagggtgacacagagatgtgtttgtcagtccttctgtgagctttctggagagccgctctccctggctcgtgtctcattaatatgaaggagaactattttgctatgtgaatctttaataccagtttaattttcgattctcaactgggattttgtgcttgctttcttgccactcaacataaagcagcacatttgaaaaacatcttctaaatagaataatatttacaaggcacttcagcctctgaaaagctaatactcctcccttctcaatacaagggactatattttggattgatatttctacacttaaaatacaattttaaatggcttgtgcatgttattgacttaacataaatcaaatgtatcacatactttctttaggttggcatgccacttagaaaaatacattagtttctggggtggggaaaagtctggagaaaatttattaaacagaagtttttactgtaatagaatattaatgtaagccaatgctcatttgccattaagctgatctttttttttttttttcctttaacatacacatgctttttattattttgcactcaagcaaaaattccacattcaaagactttccatctagtcgggaatgtctctggcaagaaatacgttaagaaatcctgacctcgaaagacagcagaccttccacattgagcttcagccccaccaggcaacacatgcaaacttaaggtaatgctagtcaacagtggggaatccagagaaacaattactctttaaatcctgcctcaccgctactccaccagcgcgcagatgaaaatgtttgatttgcaacataaaagattcattaattaccacttgaatatttaaagctattttgcagtctaacagagatagataaagcagtgaattaaaacctctaataaaattgtaaaaatatttcggtaagtttacccatgttatgatttagggagagattcaagcattctcacggaatagattcttagcagttttcaagtgtgtatttgaaggaaggagccaagtgttgtgggaataatttgtttctcactttcaaatgtttactaataatttatttgcaaatcaagtttgctactttagaattccaccagtgtgaggagtggggggtgcagtgggaatttgccaggcaggttggaacatggtgtgtctgatccagaaattaaaatactttacaaaagtattcaattaggctggaagacttagaagccctcacatgaaaggggtgagttcctgcccacaaaatgcaacaaatctagaaacagccaacccccaaaacagccctaccacttctgcccagcattagctgcattgtactttattatcctttatagcatgtcggtgttaggaacctgggatg

SEQ ID NO: 36617 - DNA, 1299 bp, Bovine  19866881166090
tatccacttatcccccacaatttccagctattttggactcctttctgaattaacctttcatatcaaaaggagcaattctgcacacaagagactcctggtacaatttcatgcataatttattcactcagttcaacattaaacgcacagtccttgactttgtcaaggtggattctgttggcagacttcacaagcagcaaaacaggagaaatgagatctacaactcaacctcttcacctattctgtctggtgagagattggggctgggggcagaggaaagagaaaaagaaggcaagattgtaatacatgcgttgtcatccacagaatcacttgcaagaaccctgtatttgcacatcagtcacctctcaaaggtatttcttaagtccagaaaaactgaaacaagtttgaattctctttcacccacagaagtctagggccatttgttatcttcctgatgattccaccattcacgggaaacaatatttttatcctgagttacctagtaggtgctgttggaagaaatgactcaaagctgttgttcaaacagatccacacatgggcttgagggcatattagaacagctcgttttagaaatttaaagaacacgactttctgatgagatcccaaatccccgatttgcactcccaaattggtcttcaagaacgcagacattcattttctctcttaaactacccatctgaaccctcaaatgagggatgtgtgcaaccagttgtaaaaaccaaatcttgtccggattaaaacccactgactgctctatttcccactctcacggatgacaagctgttttgttcatgctgtaacagagggtttcactctgtcaatgattacagtatcaggacttaatacataccagcaacttcactgtcattatagaatttattccaaggaacatcaccacagagatggtgttattaatatccacgagtcgcagatacagaaactgaggctcagagatttcttaacaactaggcaaaccacctcccttgcaggcctcactcagacttgaaaggcaactctaaaactaaaggaataattaaatttaacactgatttccccaaatacactaagcaaagtgaactgctccctaactttagcacttgccctttaaaacctgacctcccagtaaccatggcccactttccaagcttgtggaaaatacgaggcctaggagtatacatggagacgcctttggaaatgccagaaaatgctggaaattttcatgcaggacccttggcaaaagtcttaaattcaactttcttagccagctgcccccacaggcta

SEQ ID NO: 36618 - DNA, 1374 bp, Bovine  19866881246711
cccccatacctggtcatactttcttaagaagaaataacccataaaaccaagcagcagttttgcagtatgacacagcagtattgcttgcattaggccaattttccacttatgacagcagtaatagcactaaaagccaataaaagcagtctgttcattcagagatcagcttttatggcttactctaaatattatcaagtgaatcaagagccgtcattatagtgtctaaaaagccttcgtaccttgtaagcaaacagtgtgactctgacaaataatcattagcgtgcctgtgtgaggccagaactgagggaaaaaaatcaaataactgatatttccatttacataagtcattagggtaattttggttagtttcagaataaacaaaatggattgcatatgtaaaatgatatactattgctttcaacaatcccagttattttttaaaatcttatttgcaggcagctgaagacacaggcttcttagattgttgaagccttctcaggccttataagtagagaactaaagcttgaaaaaactactgagggctcagtcaattacacagacttcgccaatatttcttatgtctcagttaaagtatatctcaatatctctgattgcattcaatttcagatttagtaattactcatgcttgcttgtttataaagacaaggacaaaatttttcttattttcttaaaaaaaaaaaatccagtatcctcttctgaaactcactttacttacctggctttcatatatcatacatatacatacacaatatatgtatatatacatacataatatatgtatgtatatacacacacacatatgtatgatgggcttccctggtagttcagctggtaaagaatccaactgcaatgcaggtgaccctggttgattcctgggttgggaagatccactggagaagggataggttacccactgcagtattcttgggcttctctggtggctcagctggtaaagaatccgcctgcaaggtgggagatctgtgttcgattcctgggttgggaagatccccaggagaagggaatgaccacccactccagtattctggcctggagaattccatgtgtatcagatcagatcagatcagatcagacactcagtcgtgtccgactctttgcaatcccatgaatcgcagcacaccaggcctccctgtctatcaccaactcccggagttcactcagactcacgtccatcgagtcagtgatgccatccagccatctcatcctctgtcgtccccttctcctcctgcccccaatccctcccagcatcagagttttttccaatgagtcaactcttcgcatgaggaggccaaagtactgcagtttcagctttagcatcattccttccaaagaaca

SEQ ID NO: 36619 - DNA, 853 bp, Bovine  19866881256644
tgacctttagcaagtcacgcaaaaccttgaattcaggcatatgggaggatcacagtaacatccactgtgaagaattgttatacactacctggttttccaatcactttctcctcattgaaaatcggtgggctaattttgttatttctcttttgtagatgttaaaatggaggctcagagaggttaagaaacccatgtccacacaacgaagaagttaatccaggtttttaatcaagctgactcacgatgctccactgtgtcctacagctattataaaatacagtaatacagccaccaaacactgactccatgtgagaatcgcagatcatacacattggtttaagactaatcaacccaaggttcccacacagtgcagtctcagataatcaaattttaaggggaaagtttcagctgccaaaaagaattcttaaaaatatcattaaagagggctcaaatattttaacaacacttatcaaagttctctcccctttcctgctgctttcctcatactcggcaacacctcactgacttctcagcacctcctggagaaaacctatccagccctcgcccacaacttatttttcctcttctcccatcttctctttctcagccctttattatgtagaggcacctggcacctctcgtagaagaaagagtccatattattcagaagaaaggaggaggaaatttggactggcgatttgaaaattatctttggcaggctggggagctgctcaagttcacgtacgagtccatgttagtaattcttgttcttttacactgggtcctcattaaatgttaatttccttcttccttcccttgactatccaatttttcttcctagcagggagattct

SEQ ID NO: 36620 - DNA, 674 bp, Bovine  19866881300825
ttatatattaagatgtatatgttgctgctgccataattttcaaacctggttcctaccacagatcaacagagacattgctaaagtcacatattcttttttaacgatccaaataaacatagcacaatcttgttaccagtttccttctcaacagcacatgtccttgtgatccttacacaaatgatttaagtagatagatgtttatgaagcactttttcacattaaaagaatacattacaaaatagcacttatatgacctaaaatttttcttcgtaatttttggcatcctaaaaagatcctgtaaatttgataaccatctcttcaaatttgacttttcgtttcatgaacaacacagggagtgtgtggtaaaaaatgtaaatgctagggctctgctgagacacacataaatatagatttgttggaattactacagctatctgtcagccttgtggctttttgagccaaaatttcctaattccaaaattatgagcatctgacaaaatctgatttatattgctttgtgaaactagggcctccgtatacacaaggtaatagactgaaaaaatggacttggacaaatgagaagtgcatcttaatctgttgtttagagatcatttgaaaacgtgtcttagactcattctgttttagagtgagaaaaatctgaaagacattggatg

SEQ ID NO: 36621 - DNA, 1747 bp, Bovine  19866881302277
acatttataggaaataaattgagagatgaatgtaaacctatggcatctggaggtttatttgcaaagtccctgcatcaaagctttctccagatcacaccatattagctatgtttttccagtccagcagaatcaggaaggtaaccacagacttccttgatggaaaacacatgaaaaacagagcaaattttaatatgtagctgaagttgctggtcaaggagcatcccttaaaataattttattaccagtgttttcagcacattgtttagaattgcattaaaaacatgaagcaagttgatcttgcctatgatttccttcaaaattacagggcacatttctatttatttataccaataaaagtatatctctttaatagcattttcttgaaacctcaggactactttttggcttggatatgtaaaaatacgttccaatcaaagagaacctcagtatttaaatatggcatgcacacaactgttcattagaatttttacaaatagaaatagtatgtacaaacacactcatatatacaaaggccactttactaagctttgtagaatcacattattataagtaatagttaaaaaacactgattggacagaatgagaaatggtcctcaaacttaatttatatatatatatatatacatacacacacacagacacacacatacacatatataaattcctcaaccttgaatgctctctgcagtaggttacagctagcattacctctgatttcaaattaattctcatgcagcctgttatataaatcattatgaaatgtcaaaagcttgtacacatctattttttaagttttcacttactttccaaatagtttccatttttcagtgtcacagacttttcagccactcagtccattttaacgattttttttttgtcactctaaaaatttcccctcatttacagcacatttgtgtaagcctacgcacatacacgcacacattttgtaccctggggtatgggtgatatacatcatggtaatctgaaaaattctggattcttttctttggctcacactgaatggccaaataatggacacagacaaaaggataaaatgttttgctatttaaataggcaacagctacagattgccatgtataaataaatagcaaagattaaaacaatagtacactggcccccctgccccttgctgtccatcacttcccatttagaacagttactaaggaaaatggtgcctcacactttgtggtcattactcaattatccatctcagtgaaggactcctccctttacaggttacgctttgaaatttatggcagtaagttaatgccactcacaacttaaaaaaaaaaaagtatgtgagcagcatcacttaaaaaatatgtggctaactgctggaagctattaaaaaccaaataaacaaaagagattacacttcaaagaaatgtcaacagtttttcctctctcagaacagacgagttttctttacttatatccacagccacatctggaaaatgcttatggctttatacatcttttatggtaaaatgaatttattgagttttaaaattttcgtgatggattaatgcaatcttcataaaaggtaaacccacaccctagtaaaaacctgtcttaacactgaaaaatgatttcaataataaataatagtccaatgttaattttaaggagcaagatgattttgagaaagcatttggttaactagatttcatatatttttttctattagtacatggaaataaaaatg

SEQ ID NO: 36622 - DNA, 734 bp, Bovine  19866881382067
gtaggtgccccagcaaacctttcagtacagaaaatgttctttccaagtgagaagaaagcatctaataacagagagaatggacagctcagtcagaactactccaggaggttttccacccactacgggtaccattaactttcttgctaagtgctatggcatacctgttaggtacctgagctggagactgtcttccatgacctcatgtgtcaggacagtgaagggtaccttggagctcacgctttatacaagagaaggggccggaaggctataggactgggtgaccttgcactgttcactgacttattgctgccagaacagtgcccaaaggacaagggactgccaaaagcacctgtggaataatacgtcatcctagaaaatgcctaccattccagagaaacaggcaggtatgcatgcatcagagaaacagagaggagaagaaaggaaaagagagaagagagatgtttgacagaagaaattctaaaagtacttcagtgtaggagatcaaagctgaggtcttcgtgctgtccacatgcctgtgaaagctgcaggcaatttggccagggcaagattgtgagatcgagtccagcattctcccaacgcaggcatagcactttagcgtgtgtgtctgtgtgggcatctgcatctccatgtgtgtctgtctgtctgtgtgtctgcaatatcaaaacaaattatgtaagatgtgtatttgtactgcaaaatgcaaggaagtcagt

SEQ ID NO: 36623 - DNA, 777 bp, Bovine  19866881397049
ctttcctttatagtaacactttacatacccacagtatgtatcaaaagtgagaaactgacgtgcaaaatagtcaactgggctatagttccttatgtgattctgtcagtttttcaatatgaacaactattttgtataattctatgaaattttatcacatgtgtagatttgtgtaattgcccaaaggtgatgctttataatgctggcataaaggaaaagaaaatgttttgaaccctcagttttttttttttatgttttgggattactctgtccctaaaagagtagaatattcttttaattttaattcactattaccatgatgcaagaatgattaatcatagtatagaaaggttacactttatagaaaatgattcctttcagagggtataaaatgactccattaaaaaaataaaattcccgtacatgtacggtttaaaccttacctattagatttaatttctaaatatttacagatggaaatgactcttaacttttctgtatatctcctgcactgagttgtatattgaaggacatagccttgtgttaatacgggctacacagtccattgtgtgcttttgtttgtagctctttttaactcagaaggatatgcaggcaaaacccccaagttttcagtgtgttccccaaagccccagatatcagagcttcaagagcttaaaaaagggttaaattttaatgaaaatataccctctcgtcattgtgctttaaattataattttaaaagccaatcacttgcttttttgactgacatgtggcattttg

SEQ ID NO: 36624 - DNA, 1229 bp, Bovine  19866881409573
caaagatagatatgcccagggttttaataaaagaaagaaaaggcacatcatcctgctctcttctagttttctgaaatgtaaaattgatcccctgtcgggaaatccaaaacatcatggactttatttcttagatctgattaatttcttatgtttgatcttaagacttgatccccttaggtcaactgatttctacctcctctaatgtttgacacaaaagaaaatccaaaggtttactcatcctctaaaagtcaattcaaatattatatccccaagtgaagattctttaacatcttcagtcaagtcatatttaaagaatctttccctttctgctactgtacttcacgggtttttaacagagaattggaaatgatggtttacatatctatattcccttagacaacggccaaggtgtaaacattcatctcaggaaatcctggcataatagatacattaagatgattgcatgaatctaattacagagcaaaagattcactcctctgctctagataattctatagtaacttcagagcatattaggaaagtgttacccatttaaaatgtgtcttctatctttggatttattttcttgctttttgatcttcatttgtggtgaaaatgttagaagaatgatgttgcctgctgccgagttcaagttgaagaaggcactatatcgaggtgcagtctgaaacgtgacagcgtatgtaaatgtgttggtgagctaaaaatacatggataaatgatgcatgacatccacagagtatgcacaactttgtatttatatagtacctacatgtagacattaggattctatttatgcatttgccaagaaagggaaaagtgtctacatatgtctcgtaaatatggatccgggctcatgcccaatgcagatgctgcagagagacgggagtggggaaaggggcgtgcagctctgggagcagcctgtctgtcagatcatttccccagaataggtttctggaaacatgaacaaagatgatggcctgtagacaacgcacatttatccaaaaaggacgaaaattgtctcccacagtgcttcagtattgtgtataatttttttttataattctttgaaaattagtaatctagaaatgtcacatgtggtagcctttatttaagaggacccaagcgttcacatttcccaggtatagaaacagaggagctctgcctattccttatcttataatcaggatagtgattcataaggagacaaa

SEQ ID NO: 36625 - DNA, 864 bp, Bovine  19866881444715
aaccaaaaataatattcagattttccactttccacagggcacatcctgaaaaagtatttttatttatagcattatacataaaacctataaatgctctgaacagtatgggtttgatatgtctgaaggttgtttttttttttttttttaacttatattcacaagatcttccaggagaaatatacgacaatgaagttaaacttcagctaaccttctagacataactctcaaggtactcccagatttactagtgatcaattctccacacttgtgaaaaacgtagaatagtctctgacactttgatatacaaattccacttttaaaattacgatgttcacagagttgctggaaagaatagacttcttcatttgtgagaagtagagaatagagaaaaggtaacaagggaattttttaacatgtgttttctggacagcaggcaagcaaccagttatttctggaactctttcattgcattaaaatatcacagagccaaattctgccctcaaatgatttttcttaaacttatttgagtccatatgtttctagaagctgaatttgcttcagtgcatctcaaggtctaatcttgctgttattacacagacagaatctccatgaaattgaatttttgtttatgtaagaacagtgtatttgaatatttcctgaagcaaaatgtgggcaaagactgtgaagaattagggttagtggaaaataaattgcagatcatcaaaacatctctgaactcactaatttttcttacaagatttctcctttacttggagaatgtttttttcttcttttacaggaggacatctgagaacacagaaaggagtatctagaggatttttatttaaaggtatctcttaaaaa

SEQ ID NO: 36626 - DNA, 2007 bp, Bovine  19866881703402
tccaagacagaaatttcactccctggccatcaaatgctacctttcagcttgcgtgggaatgaagtcctggtttgagactccgaaagtaaaaagacctgaaaaatgtaagctgtgatgaaaaagaaaccccagtgtaagttggacagtgcccattgtctgacagattccagcccaggagcatcaggtatgtctttatgcccacacgtgctgcggtgtatgtcttagtaaaagatgctttatttgtatcatgacaaaatgccatggggcacagactatgcctcaaaattttttaagttttaatgaatattccaattctccccttcaccaaagtccatgacatgactgttttcccactgtgatttgaaggtaagcacagagaaggcaatggtaccccactccagtactcttgcctggaaaatcccatggacggaggagcctggtaggctgcagtccatgggatcgctgagtcagacacgactgagcgacgtcagtttcacttttcactttcatgcattggagaaggaaatggcaacccactccagtgttcttgcctggagaatcccagggacgggggagcctggtgggctgccgtctatggggttgcacagagtcggacacgactgaagcgacttagcagcagcagcagcatggcagataaacatgaaaacgatgcgtgtcgtttctagcgggaggctttaaaagcctatgcctgatgcattgtatttgtattttccgcaataggccatcatataatcgaggggcaagatgtatcaacctcatgctcagggtgactagaagtggccaagagcctgtggcttctgttggttatgtagcatgatggacatttaaagtcatgccctgtgaagccaccgatctccagaggagttttcggttattacaacataaactagcatattctgccagatcctgagccaaatttgaaacacactgaaaataaagaatataaaggaaagaaggagaaacccatggctacaaaggaatcctttggattaagtaaattggaaaggacagcagaaggagctaagttacttggtggagggtatttgggggtaaaggataatgggactggcctattgctgtgtcccttccacttttcaggtggtggactttaggcaaagtacttaacaagtactaagtctcaaatgtcctcttttgtcaagtgagagaagttgtcatatgttacagcatcaaatgtgcttccctagtggctcagcggtaaggaatttgcatgccaattcaggagatatcggtttgatccctgggtgggaaagatcccctggagaaggagatggcaacccatgccagtattcttgcttgagaattcccacgaacagaggagcctggcaggctactgtccacggggtcgcaagaatcagacacaacttagcaacacaaccactaccaagagcagcgtcaaattcaaggctctaagggtctgttgtaactgaataggaactcagcctctgctcctggcccaggctgtgttctacttccatcctaagcagttcagcctggttataagatcataaagcccaatagtgatcttaagcttcaaaaggcagttaaactgcaatcgaagatgagaaaaagtaaaaggaaatacactgaaacaaaatcacgaggaccaggttaatgtatcataaataattacatcctccatatactggaaggtagcattctagcatagaaggcaaataagcagctaaatcaagtgtcaaatcatggtataagtttgagaccatgatgttcatgctgacagtctgtggggaagagcatctccttgaaatggtctttaccgtgatgcacactgtagggcacttgagaatcatccaagagcatccaagtaggcgaggcctagtacattcaccaccccacctcagatctgatctgtgccctgggagtgtataccaagataggataggataggataagctgtgctgtagtaaaacaaaataataccaaccacgctgcagtccggcttgcatc

SEQ ID NO: 36627 - DNA, 1221 bp, Bovine  19866881824921
ttctgagtgcttctcttaacatagccctgcaaccagtggttatgaaacacactttgagaaatggtggaatccattctgataagctcagtcatttaacatttgactttcaacatttctaagtgctaatgtaacttaaagtcccatttagacagtcaagattaaatgcatacatagagtgtgatcataggaaagcaatgaagaacaatgcttgctgatttgcagtgtaactccttccagcccttttcaggagatcttgaaccactagagaaaggctggtggcagaagatgcatgctagcataggaaaagcacagtgcatggcaccatgacaaagaaaagaggttgtggagggactgtttctcctcctctctccattctattttcctttcggtgctgagttagaagatgaatatgtgaatgcaaaagaggctataagataatgaacagaaggcataaagatgttgaaagctgaaaccaggttagcctgaatgaaatggaggaaagtcaggctcagagctaatcatacacttcacttatatcttaactcaactgtttacatgcagaggaaatgtttctgtgggacacaagttgctgcaaggtcagcaaggcaacactgtaaaatagaaaaggttaatttttgatggcacttgtttctcttggtgaagcaagcagtggctctcaaaaggagttctttgggtggccataatgactggggaacatcactggcatatcaaggacaggcgttaggatattgaacatcctgttgtggaaggaggatcccacacaataaaaaaatgacctccccaaaatgagtttcctctgtgttaagatacacagaaaaaactctgtctgggtctatttccttttctattccagtgttttcagtatgtgtgtatctcaactaggtgtggatctgataaaagttattgcaggaagattgaatagggctgaactttcaagtgttcatttacatttcaaaagaggaaataatcaactccaaagggtctctaactaattgaggctgttagagggaaaaatatattaaaatattttattagagtagtattgcagtcttattctatggagataaattttgagatacttctttccttttgcagtttgctcatttcacattctactctctctccttctatgcacaatacttcccttccaagaaatcatatgtgagtggctaacattgcacctgcatgatgtcaaccttg

SEQ ID NO: 36628 - DNA, 935 bp, Bovine  19866881989282
acccatttttgactctgtagtcattctgcaggattggtgcaccaggttactaatttaaacagacattgcacatgcagctccccttactgttggcctgttgtcattccttttaagctaaatactcctcctgtacccaccaggaaagctccgagagagtaattcttttttcatactacaacataaaaggttgtataaatctgtcagccagatttttaggtgacctttggactgaattttccatcgttttctttgcctgtcatgggagtcagttgataagggaatgctagactatatttgctaatattaaatgtttgtattcccatattttaacaaagaagggatgctgtgaaaattgatgggggtgttaagctcatggaatgatggcataagcaagctgtttgaaggaccagtgagtattgtaaatgcaagacagctactgtagagagaggagctgatttcactaggtgtaatttgtagccatttttgcataaaaataaaaagtgaatttggtgagatttttttctttcagttgtcaaaagtttgtattagaactgttatcaatgataaaaatccaaagcccttcccaagactatatatgacatgctagtttgcgctaacaaacacaaacacaaatgtgttttgcctctttctgtaaccttgcctgtcttctatagggaagcagagttagggtagtagacttgaggttgaggcaaaataaggaacctgggtaattctcaaaatgaaagataaatctaagtgatattcttatgaagaaaaaagattccctccagcagcaaagcaccagggttgtggaggtgtctgggtgcacagattctccgtgtatgtttgccatgtggtggtaccacttttgaccaataaaaggtcagcctggtagacatttggacggaacatagaggtaatggtttcttttgatg

SEQ ID NO: 36629 - DNA, 723 bp, Bovine  19866880353654
ctattaaaaaattagtaagtatattttaggttctctaaccacacacacacaaaaatcacttacctcattgtctagacgcagtaaaatacaactttcttccttattaaaatgtatcttatggggagggctttcacttctttcaacgtcgaataagaagtttattagaagcatcctcaggccaaaaggggacacactaaaacacatattacacatattttttttttttaaaaatgatttcaccatgaagacctttatcattttaataaacccattagagtatacttaaaatagtttaaaataaacctctgtcaacactactctggttactgtattgcttagctataaactgttgattttgagatggggcgccacttgtgggcactttgaacacaaacagtaatgggtagtaagttgaagagctaaaataattagagtgctgtgaagagatattaatgtggtccagagctagagtcagactgaaaagtaagtaagtaaactgagcccaaagtgatcagtttaaaataggggaatgttctattacgaaaaaatcacaattgggttgtgggtaccagtaatttaagcagtagtcaaagtacacacaaatgttgagtcaggacaaatactaaatccagagtcttagaagtcaaataaggataaaacaaaaacacatgtgtacctgggcagattcatttgatattggcaaaactaatacaattatgtaaa

SEQ ID NO: 36630 - DNA, 922 bp, Bovine  19866880432437
ctcaattgcaaactcaggctgagacccagctgttttgtttaaaaatccctccaggtcatcctaattgcatgataaaatttgagcaccactgttcagtccatttagttctctagaaaaaatgaaaaccatcttataaatataagcatttgatagcaatttatttccctcagtgacttttcattgcttttaaagtctataattttgtcaaaatagtttataatccctgtgtaatctgaccctaggtaggacacctgattttacctcttttctatgttttgaatatgttcttgggccgtattgggctacttcagttctttgaacataccatacattcagatatcttcctaccatgaatcatattccctactaaatttagaattgataacttccattaatgtgtcacttagtaggttatgtatcactttcaccatcacatacctgaaattgaggctcctactgtggagtctttagttacggactttattctcccagagtactgcgtatttaacctccataatggcacttaaccagtttgtagtttgctttctagtttgtttttcaccaggcaatgggattcttgaatacagaatattcagttaatattctttgactaaatgttatgttttcaaggacattttaatggtagattggtctagggcaggatagattctgtttatcactctgccatttcacatgcaagtgacagtttttactgcttctttttttccttttcagacaactgatcaatactggattccatgtttacatgatgaaactgagaaattatttcgtaagggaaaataaacaatgtttatttttgacaaaacaaaaaatactatgttttgtcagtcaatgggcttgacaaaagatacttttaagacaagtgataatacatagataaggatttttatgaattgtattg

SEQ ID NO: 36631 - DNA, 1228 bp, Bovine  19866880590187
agtaattttaatgctatacttttatgaagccttgctgtatttaacaggcgtatttaacattctctttgccccctcgatcccccatccctgctcattttgtagatactgaagtcattatggcattattgtgtgattagtgcagggcagaagagacagagctctttgtaccgggtcatgggctctgggaacaatcctagtcctctaacagcctctactgacctataaaaagtgttgtgaatcttcttactgtctgccttccaagagatatgggaggagaaatgacgtaatgtctacttagaccttcgagcttctcggaagaacagtctacagtaatatgatttcttaatgcatttatttgtgtggtaatggagtataattgcatttatcccaatttctttctatacctctaaatctgacagtctcgcacggggaagcagtctggctttgggagtaagaactgggtctagactagaatcctccaaaagtacaagtgtactggctagaaagttatgaggttgagggaaggagggtgggagaggaaggagtgggagctacaggtggtgatgcgggggaggcagtggttataattatcttcagagtgtttataacattttaaaatcctattattttactaaagatcaacatgtcaatatattttaaaatatacgtatttgttttaatttacaatattgcatactggacaacttatatgcaatattgatcctgccatcattctctgtgctcataggctctttgattgagcctcctccaagatttaccttattatgttcctcgggtcacagtttggttgttgaataactaatttctgagtctgatatggtagttctctacaaacaccaacacgtttatagattcagttgtaagaggcctagtaagttactaaataatcctttttctttgttctgtagaaaaaggaataacaagtgttttttttaattgaaataatcaattaaacaaaatcaaataaccaattgaacagtggattttttgagtagctttttgagcagtattacaattgagttggctttctagtaagtcataaaaggagaaattaaaacaaaggatgaaaagctgaggaagtatacataagcatcatccctgacattccataaatatgtcagtttaggttacccttatcgttattggacagttttgttggggaattttctgattgtgattggttctttagcatttctaatccagtgtt

SEQ ID NO: 36632 - DNA, 2747 bp, Bovine  19866880598590
atttaaattctagttcccatctcttccttgttcctgcttctactttgcataagtaaccatccccttcctaagtgacatttcttatatgtaaacagggcgtttactctggaggattaaataaaggatataaataaagcatttcttgtacccagaacaggaagacatgcattaaatgggagtcttttccttccagtttctgtgccttttttaagtgagggaactctttttttggaagcctgaattgggaggtccattctgctctccatcttatggaggaagatagggtatccttgactgttttctttgagttgatggttaccttcctcccacttttaatcacacagaaagccagtaaattagacatagtgaaagaaaaacatgatcgacagtaaacgatagttctttgcaacaattaaccagttaggagggttcattttccagcatcacatttttaagccccagctccaagcagttgactttttactatttttgcagtataatcctacaattttaagtatccatgctttctacctacaggctttatttaccaggtcccgagtaaggaagtcattcctgactgcaccacccaccactctgctttatctttcacctggaggcaaccatgaagaaatcagagaaaggggtaacttttctctcttttccttgggtcaagcagataaattactttatataaggcaatgaagaaatccaggctgtgtacaaaatctaccttttgtgtggcatgcaagacagaagtaacaaatacactgattagtgttaaatttatgctttccccaaaatggtagtaaattcaagggtgaaagtgagcaaatctcaataacaccatagaagatcatgtgaaagtagatctacaagaacagaacagtcatctctaggttataagaaaagaaatatatttattggagaatatttattatttgttttaaatgtaaaacaaaagataagcatttccccatattccaggagtgagttattttctcatctccttctccagacatgcagtatttcttaccaaatcttcaaaaccatcaggacttacttgatgatgctctctggaatatggatgcaatccattgggatcagtccactgagttctgctaaactactgacgtatttaattttactgctgaatttggaacttgaaaaaaagaaaagaagaaagatttcagtcactcctctcatccctcagacttctgcctcttcttgaaaatccttatcaccttgcccccagcactctgacttagaagaatagctatattatttgagtagttactatgtgccagactctgttctaattggttaatatatattaactctggggattttcctggtggttcagatggtaaagaatctgcctgcaatacaggaaacccaggttcattcactgaattgggaagatcccctggagaagggaatggctacccactccagtattcttgcctggagaattacatggacagaggagcctggcaggctacagtccatggagtcacaaagagtcatacacaactgagcaactaacacagacacatattaactcattttctgtgatagcctaatgaggtaggtactattatcattctctttttaaagataaggaaatttagacatagagagttaagtatttgcccagatttcaccttcagtcagtggcagaaggtgccacttacctataatgattggctgttttataagaaggtgacatttttgtattactagtgtaatagcaaactaattctaaaaatatatcattccatttgaaagggaacttgatcaggcatcaaactcccttgaatggtctctaatgaaaaggcctccccagtctactgagaagatgctctcaaggtcacttctgcatacatccagctttcacattttacttgcagttttgactatgggctactggctgtggcttgcgaacagtcacttcaagtcctgataagccttgggtgaacacacactactaacgataagccacattaggccacttccttcctctggaatttctgagctaaattcagattttgatttaaaaaatggagggggtagaataagaaggcagaagaagtcatgccaggaggacacctccacactggaatgtacagttttctaaacagcaaagtgattcagtttctcatattcagatatgtatttgtaactgaatgtgaaaaagaatattttttcttcttggtgtattggtacctgctatttcctctacctggctttagctagccaatcctattcttcaaaactcaccttgaggatgcattcttctggaaagcctctctcgatgcagactctctgtcttcacgcttcacctgttaccttagaactcaccctcactctgagttatcaccctccagcttcctttgttccctctattgcagctgctttcttgtctacctgtgtcagctgccaggctgtgacctctttgaggaaatcaattgagctatttaatttctcaacctgcagcacctaacccagtgcttgacacagacagacagttcatttaaaaaaaatgaacttgaggagggagggataaattagaaggatgggattagcagataccaactactatattaaaataaacaggtaaacaacaaggtcctactctacagcacgggaactatagtcagtatcctgcaataaaccataatggaaaagaatatggaaaagaatatgaaaaggaatatgtaactaaaaaaatactctttttcgtagttaca

SEQ ID NO: 36633 - DNA, 1458 bp, Bovine  19866880628660
ttattttccattataggttattgcaaaatattgactataattccctgtgctatacagtaaacctttgttgcttgtttcatatctatttttttaagttagaaattgagcgttctgtgccttccagaatctcctttttttgtctgtgttcacttatatttatttagcattcccatccactacattccaacaactagggtagcaggattcaactagttttcctctggcaggagagctctttaaattactttaaagcataatacaagcctttaagatatattttaaaaaagctactaattttaagattagcagaaaatgctttgacaggcactaggaataaatgtacaatgaagagcttatacaaacttttaatgagtaaaaaagcaaacattagaactgatattgattcactgatgtttgtttaataattcagtttctattttaaaataaatatatttctccttggtaaatatttattatgtcaagagtatgagaaagaattctaattcaacatttattgaagggagtttcaagataataataattcccttctctaggggatcttcccaacccagggatcaaacccaggtctcccacattgcaggtgaattctttaccagctgagccacaagggaagccccaataattaaaacaaaaataattaaattatggcaagtagtgttgtggtaaattacatgtaataatggtttacatttattgagtacttacatgcattattttatttaatgcctaatgatggtctgaaggaggcactgtttaccatttctgtattgtagcaaaaaaaccctaaggttaaatgaggtcaaataaattgttcaaaccaggagccagcaaaccattctgtagagagtcagatattaaatattttaaatgttatgggccatacagtttcagtcaccactacttagctctgccatggtaggacaaaagccatagataatgtgtaaataaataagtgtccctgtgttccaataaaacttgatttatgaacactgaagttgaattttctgaaatgttttacatgtcacgaaatagttttattttaatcatttttcaaccattaaaaaaaaatgcaaaaccagtcttagcgcaaagatataaaaaaccagtaataagttggctttggctcacaggccatagtttaccaaccccaggtctgtggtaacatagccaagaaatgataaactcaggctctgaacccagtgtctacctaattctaaagaacacatatttcaagtacttaaacattatgttctacagtttcagcatataaaaccctctttaaagatccctgtgaatcaatctatgttagtgtaacagattttttgacctgaaaaaagaggtcactaaaatgtattataggtcttttcactgctaaagggtaacacctatgacagaggtatatagcaaattcttttttttaattcatgtatttttaaa

SEQ ID NO: 36634 - DNA, 2103 bp, Bovine  19866880631571
atctggtaacatttcttcatccagcctaaccctggcgtcttccgtcttggggttgcaccattcaagtacacaatcatatagtcttcagctaccatcaactctaaagtacttattacatatctgatcacaggaaggaagagaagtgttttaagttcccacatgatagagttcatcttatttcaccataattatataatatttaaattacagggtgcataacatttaagaatgggtgcacatattacctcttcttcttgagaagaatgcagttacctaagatcacttctctgagagtattactcatttatttgcacagttatcttttttttttttttttaatgcaggtacacttgaaaagtctgtgggtcagaaacccaactttcaaaaatatcagcaatgctattgtacactaaaggacaagtcagattaaataaaggcagatataaatgaagtcaggttattatcagttgactaagaacatgttatcaggaaaccaaaataacacttcacccaaaaaaaatgttataaaatttaaaaatatgggccaaactgtgttcattttgttttcagtgcattctcctgacaaaacagctcctctgaagctttcagtctcttgagcaattttccttgatacagatttcattgacttttaatcaaaggcttggaaaattctacatcaaattctgcatcatctgtttccttttattaaagatgttctatctgccattgcatccccacagacattaactcaaaacattttattgtaagcatcactcacaggaaaagattttccatgacatagtggtagtccgcccgactgctgtctggcagaaaacaggcggcaaacacaatgatggcatttaggccatccccatagtatcctgggggacaaacaaaagacatttgtaaccaactgaaactcttaacaagatactatttaacctaaaggataaatctggaagccttggcaagtgtatgtatgtggatgtattagatatatctttaagtgactattataaagacgatacttctgtaagtatatacacacataattatcttgcagtggttaagatacaatacatagtgtgaatatatttgcatatatagggcacccaagtattatggatgattatatgtattgtacatagtcgtgtaagtgggttataaatattcaacttaaaaacaaaggatggtgaggcaacacattttgacttaagggcttctaatttatataataaaaaagctaatctgtataacactctttcctttaattgctaagagagaggttctgtttgattctgtttagtatttcctagttgtagtaaactctgttccttgaaaactcatctttgaaacacgtggcagatgttggtcaagtctctacaaatttgtatatagaatctcatgtgtcttccagacttaaaaaatggaagcaatgcactgtactttcattttttaacatccatttaaaaatatttgtgattgtatcatataacatagttctaggctttagaaacattagagatttcctcaaagctttgagtaggaggacagaatacaccctcaagcctgatcagaatttggcgtgtttcactttttcagaactctaaatacccctctggtgattacaaggcagtaaaatactggctagatatagatttggatgggcttaactctcgaaaagcagtttaatgagatgttttctacaaggatagagagtatgactctgccacaaaagaggtgggggaagaaagtgataccaactaaaaatacatcaaattatgggtttgtgtatattactaatttgaggctgctgcagataatgctacatatcttagaagatgctacctatgtaagtgtatacctgatgcaacgtgtttgcaaaacaggaccgcagtagcttccctctggattttttgctttagtcccatcttttccaatatgtaggtattttgccaactttttaaagaaggtggtatgaaggaaaatggcataaggagatatattttcatacaagaagtggttgttccacaaataatttcatttaggaagattcataactgaatagaaatccacaaggataggggggcttaatgacattaa

SEQ ID NO: 36635 - DNA, 1602 bp, Bovine  19866880766082
tctccccatatctcattaagcttcaaacagactagctgcctgacattcctgaagcacagcagaagggctttctggcctcaaggcactgaataaatactacagtaagtgacggatcagatgaacagacaaatggatgaagtaaactaagttcataataggtgctcctttccaccattactactgattccaagtcaggtaccgtggtcctgactttgtctggcagccatgctttacaaacccacggtccacttaaggataaacggtggggaatgtccatctatggccacacttaccatagaagcccagttagtcaagacacggcttctccctcaaatattgcagaaactcgtcagatgacatgtttggggggaaacaaggctgtgaccctcactccagagacattcctcccctgggcccctaattccaccaataaaaactgctgtgcaggcatgttctagacgattctcctccagttagcaattgtttgcaagaaatgagccctaagttctgttgactgaagaaattcctggggttgcaacttttcagcgaacacagttttagaaatggaggctttaagtgattcggagccagcctgccctctgcttacatatcggctttcaggagccgctctgaggagggttcgcgttgaagtaggccttttccttgtaacccgagagctcggctaatgaccctcgagtgtttctctgagagagaacagcaacctagaggagcctttaaaggatagcttgcacattaaaaattgatgcaacacttcaaagtttaatatctaaacaaaatgcttagtgtttactgcttctgcacattttcatatgtattgaatgtgggggagaaagtctggtgggcctggggagcattactaagaaaattgtctaacgtccatggtatatatttctaaaaagtcaatccagggtttttagtttatggctattctggaataatggtttttcttcagcctacagacaatatttaggttggaaggaaggttgactgtcatttcctccaatggtcacaagtactgaaaaatttccaaaacttggcttctacactagccattctcaacctttatttctgcaagacattgagggttgccactagctgtaaatgatcatacaaaaaaccagttattaagaaaatgcattttgtgttaaacagagtttctctgaaggaaagaataaaaggtgcctggcaaaaacaagcatgggctaaaatgtcaaagagtagggggtggttcactttatgtaacaagccaggaagaggaaaaacaaaaccaaaaagcacacagaatgatgaaagcttcctataattaaatagtccagctatattcaggtggtacttgtaaagggaaaatactaagtgtaggctatagagtaatgaggctgtttccataagccacagatgaggaaggaccagtttcagtatgttctcctggcaccttacaggtgcagcagtgaacgacctccaacgtcccccacttacactcatcactccaacatctttgctcaagagtgaggatcccaggaaagggcctgatatgtcaagtgttactcatccattgccaatcacccaggtcaactgcctgtc

SEQ ID NO: 36636 - DNA, 2293 bp, Bovine  19866880886652
ccattacacaagagcaggatctcatccaatcccaaggccaatattcagctgggatagaatgcatcaaagggcttaaaggaaagaaaattgagcccaatctgaaatcaggtttataatcactgattacagtcagttcttgttatttgtggcagtgatgttcttacagatctgaataacatactgaaccattgttttcagggggaacacggggctaagtttctgtgagtgcttggtcacagcattctcctttgccaattaacacacaaccttgttttatgtccatttctgtttaaagataccttacttgatctgtattgttgattcactaactttgaactcagggccaacaacactataacctgtgcctgaacaaagcttatctaacacacacatacctccctaaggcccatcacagccatcctgtactcaggaatactagatgatacataagcataatgtttggggaacattcttaaagagatcaccagcaaaaaaaagcacaaaaataataaaaataaacatgccatgacacagactgtaaaaggccatttgtttgcagcgtgagagctgagacaagaaggcagagccccactgggctccacctcagctgggaacccacacagcaggtgactgaaatttctgggcactctgttaaagtccacaagtgaccatgaaagtgccaaagtattgcttaggaggttgcaactatggtttagcaagtaggtgagtttgtgaacactccatctgcaaatcatgaggatcggctgtatataactataaattcaaaataattgattgtattgaatataaataggtttcctccccaaaggcaatttgactatcatttgggttcgtctctcacgttttgactgtcctgtcattttttccatctgtccactcattttcctcattgcgttcgtttttttatcctgtaaggtacgatgaagaaagatcttataagagaagtgtgaggtaaacgtctcctgttcttcagttcacgctggatcctttgtgtgtgtgtacaccagtgtcttacttgtgggtgacctcaacaggctaccagaggaagaggtcctggtatcagtcccttgtagtatatcatttccagtctttgtcgtgtgtctaaagctgttgaggtcaacctaatttgcaactgaaacctactaaaccagatacatcccagacttggcccaggctgcaagctaattttaactagccctgacaactgctgtggctgttttcagctttatttcagccagcatgcttccagtctccttgcaagttttgtatctccctttatgaaggactttgcaaaggaaacgtacataaacacagacttgggagttcctaaaacaccatatgtaattgaaggcatgtgtcttaggctccaaaggttggtttttaaaagcacatacgctccactttcatttggctctgctttgacttcttttttgtgactctctcacgctctgcttgcttcttgtttcttttctacactgataatttttgctcatgcagactggatgaagatctgagggaagcatctgaagcagctaagtaagacttggtttccattcagcagctggcagtgatgttggcttgcatttcaggaatgaattgggagaacctgcatgcctggtgttttattcttgcatcctgataatagtgctgccctttaaaagtttcctttgttccatgatagatgtaatttctcttatttgtactacaatctgtttgtccccctaatgatcgtggttatcttgttaaacatttttttaaaatatatatgcaattttaggcaccacagcaaaagaaacacatcacaggcagtgccatgaatagtgtaacagccagatgatcacttgcatcatctgactgaggcaataaaacctcactaactcatactaatggagaaaaatggtagcaacgtgaaatacttctatagaaccaaattcctgaatttccaatattttttaaaaaactactattcagtgactgggaaatatagcttaactaacagcttctgacttatttgcatgagtacaaaaaatattgctcactattattatagttttcaaaatagcaaaatcataactttaatgcaaatataaaatgaatacatgccaataattttattcaactaattacttaaggaaccagtaagctgttaaaaaccagttcaaagagtatttgaaaagctagatatctataagcaatttataaaggaatattaggataaaaatgttggtttagatacaaaattgattaatgttcaacagggcaataaactgta

SEQ ID NO: 36637 - DNA, 1714 bp, Bovine  19866880915444
atgaaatgatgggaccagatgccatgatcttagtttcctgactgttgagttttaagccaactttttccactctcctctttcactttcatcaagaggctttttagttcctcttccactttcttccataagagtagtatcatctgcatatctgaggttattgatatttctcccaggaatcttgattccagcttgtgcttcatccaggcccagcatttcacatgatgctctctgtatataagttaaaaaagcagggtgacaatatacagccttgacgtactcctttcccaatgtggaaccagtccattattccatgtccagttctaactgttgcttcctgacctgcatacagatttctcaggaggcaggtaaggtggtttggtattcccatctctttcagaattttccagtttgttgtgatccacacagtcaaaggctttggcagagtcaataaagcagaaatagatgtttttctggaactctcttgcttttactatgatccaaaagatgttggaaattttatctctggtccctctgccttttctaaatccagctgaacatctggaagttctcagttcacatactgttgaagcctggcttgaattttgagcattactttgatagcatgtgagatgagggcaattgtgcggtggtttgaacattctttggcatttcctttctttgggattggaatgaaaacttccaatcctgtggccatgtcgagttttgcaaatttgctggcatattgagtgcagcactttcacaacatcatcttttaggatttgaaatagctcaactggaattccatcacctccactaactttgttcatggtgatgcttcctaaggcccacttgactttgcattccagggtgtctggctctcggtgagtgatcacaccgttgtgattatctgggtcattaagatcttttttgtatagttcttctgtgtactcttgccacctcttcttaacatcttctgcttctgttaggcaaactcttcagttggtaaactgtttctggttcagtttcctagaaaaatggcaccatctgctggctgggcaaaggcaaaattaatagatctgagcttgtctctttcataggtctaggacctaagttccacactacaaaactttcagtgttcttctttgtgactgggaagaggtcaaagtacatgctatgaatatctatcccttggacaaaggggagagataacttcttccttaaaattccacatgagttgcccagaagggttcttctcatttttagcaaagactgtcaatgttgaccaaccattatgggtaatatgaccagagtagacctctcttttaccaccctacctcatgatatcccactccccatcatttattgaataagattcttatataccacttttctcaaatttgcttttccttgcagaaaccatccaataatttggtgataagttgaacctaatgatatattagttatgtctccaaggaagagataaccaagatttcaaatcctcaagcagccttgtatagttacagttttaagaggattatgtgcccagaatagatactctagacaaatgcagatttgggcttaaattattcaaatccctctctgatgtcttaacctggtgagccgtaataaatccaggaaattcaagcagcattttttttccctttccttgactcgatgagcacagacctagtccagaaagaaaaaaaaatttgaa

SEQ ID NO: 36638 - DNA, 754 bp, Bovine  19866881003685
tttagatctttggggagagggtctatggaggtagataagtaaacaaatgaagaatttgagagaaaaaagaaagctacacaactaagccaaaagtgataaacattctcttatggtagctaagcaggaagagtagaaatatagagggaaggtatctattgaaggaggcaagattttagggtaataatgagagcacatgactatgactccatagtgggtttggctggaaaattactgatgttccctccctatatttttgtcttgaaaacagcttcttaatttaataaatctgttatcctaaaaaaaaaaaaagaatttgaaagggaaactaattgctcgctatctctttggggaatctcatgacagtgcaatttgagcacagataaatgctaacagggtacactgtaccactatataggcacatttaacagtaatctacactaatgctaagctttctacgcaaaaacctttccttgaatttttaaccccaaagatccatgctttaggtaaataattctacagattacctgctacaaaaatgtagggaaaactattttaatggattgttttcatgacgaactggcatttatatctatataggaaaagcttcactaacttagatcttacttattcagaatttgtagttgtttagacattgtccaggctttctgcttttgcaatatctattaaaatagggaacaagttataaaaattaacagtgtaagcaacttttgcaatggagaagcttgatgcagca

SEQ ID NO: 36639 - DNA, 973 bp, Bovine  19866881020023
tgcttaccagtgtcacgacagcgatttcttgggaactcctacagagctcacttttgccatttttaatttaaaaaatcctaattcctctttctttacttttttaaagaaagctaaaataaactttaagtctctaaagaatctgtttataatcaatgactgttaagaaggtgagagaaatagaaagactaatttttaggaaggagagttaaagggcaaatttcaaataaatgaaggtgttgtcatctgttttaaatttcataaagatataattgcaacttgatgtaactgcaaaaagaatcacaggcttgtgatgtcactgtgagccatctttatctgaccatttaggtaatcagaaagtaaaattctataatcttaaggtttccagtgggctagaacgtttcagattttaacatcgtacagtttatttttaaaccaaattttttaattttttttatttttaaccaaatgactttttatttttaaccaaattttaccaaccttttctagaatgaagactgaacagatcctagacctgcttacaatggtccaatcctgctctctttatctcagttttacctatattttctgcacaaaacacctgctgagttacaccaggtcctagtttcttgcatttttctattcggagttcctgcagattattataagataatgaaacatttgcagaaagttttgcatattttttcctttaacagcattgtagtttgcattcagaaagattttcagccaagaaattctaatgtaaatctaaccgcttgtccattaatgatcattagtgtcacatctaagagacagttctggttggtgttatttattaaaagcaatcaaaacgagccattatggtcctaattacaatatttactcagatggccttatttatccacaagaaaaaataatgccagacagctgctagaacttctacactaggaatttaagaaacagaaatctccataca

SEQ ID NO: 36640 - DNA, 1240 bp, Bovine  19866881116165
ccttcccacggggagtcggagaaattccataaaggcaaatcaagcctccgtgcacaaatccaagtagtgatggagcgaacacctgtgcccccggcgcctgctgggctagggccccggctggatgggtcggaaacgtccgggtcgggcggccacgctagagactaaggcttcccaggaccacgcgagcggaggaaggacgatgccgctgccccatagggtcccgggctgctctgatgctggggtccctgcgcgggtgtgcccaggccttctacacacccacgtcgcggattgggagcacaacctcaaaactcagctcctgagagcgcggggcctttgaaagctccgttgtgactcctgcttatttccgggagtgggggcgaataaagtccggagcgaggaaactacgccaccagggtcaaccagcaggtggtgccagggttaggactggaaatcacgtgagcgagatcccgagccggccttctcccacccgcctcaagcccttgttagggctaggggttgggaaatgaatgggcgttggagtccgctgggggccgggcgagaggctggatggggtgacagtgaacgtgcctgggagaatcccaaatgtcgctaactcaggcaaccatccgcacgtcaaaggtcagtgggtaaacaaagaacctatgaaaatcgagatgagcgcatgaacttttacctttttcctagtcctgcacatcgatctagccccatgggtcacctacactcctcctcacgctgggcacagctgtccacggaagcttcgggatcgtctggcctagacccaggctgagggggtgcgtgggaccttccgcggagctgggggagggggcataaaggagaaagaatgaataaatagccgcttctaaagttccacatcgttttctggcaaatttttactcccctctatagagccaattaaacgcaataaaaacttgcaaggaagccctctttctagccgagcgtcgccaacaattgcctaaggggtaaaccaaatacgcctgagataattacactaagcccggggcgatgatttgcctgccagcatcctcagcgccagccaatatttgtatagcgtagtggttgttttaaaaaataaaaaattacacgcggaaacttgaaaccgactggttggtgccagggtggttacttgatctgtttttcttgaacgggggtctgtctgcaggcagctggagcgcgcgcgtaccggcccccgccggtgctg

SEQ ID NO: 36641 - DNA, 1065 bp, Bovine  19866881144679
cctcccctcttgcatatccagaagactttttggtttttcagttcttcgctttttacttgttagtatggagtggcaacttaaaactcctttcatagggaaccagaaaccccaaacccttcaaaacttcttaatctagaaattaaaatgtgaatagaattctttgtgaattaatctatgtcagtttagatcaaatacctgtgtattttctttgttgtgcatgaaacagagtagcaagaaatgcagagtgaaatttttttattttactatttttaatttgaaaaatactttaagattacattgattgctaatttttttcctgtctttttttcatgcagatttgaaaccaaaatagattcatttcatgttactggcttaccagataactcaacaaaaccccgcctcctgtcttcattagatgatgctgcatcactcttgaaaattatgtttgagataaatcctttagatgaaactgttgctcagaggtgtatcatagaagctgaacctttagaaatgttatatgatgcagtaagcattttttgcaattcctaagttttaatatatttctatttgccttgagtttgtcctcatgttatttatacttattttaacagagaacagtgaatagtatagtagaattcttcagacctccaaaagaggtaaatctagcacagctgacttcagtaactttgacaaaacttgaagaatttcgtgataagacagcaacaggtaaatgccagtattattgttggtttatcatttatacagtttgagtcatgttatactgattttagtattctttgagtttatatttgtagactagatacagttttaattgaaacttagtgtggtgcttttatatatttaaattcaaatataatgataattatgtcttacacttagcaaggtctgacctttgaaccacattcatgttaattgcaaaattttgttaggatttttgaaattctgtttatgacagaaactggcctgtattttcctttcttgtaatgacttccagattttagtctattggtgtcagaacctagaagttccacccttttttattat

SEQ ID NO: 36642 - DNA, 1107 bp, Bovine  19866881144896
ttaaatgttttaatataagttgaaaccattattttagttaaaattcattgggatagattcatctgtttttacagaaagctctggtggcttattttggtttacatatggttttattgaagacaatttagtaattgaaaatttttcattgtctcaagtaatataaaggttgagttcattgtttggtatagcagatgtagctgtgttaatttcaaaaattggggagaattatagagattctaatatcacagatatgaataactatttcatggaacttaatttttttagatgtgtatcttccaagttttacccaattgagttcatggatcaaaaattctttttgattgttacagttttatacttggctaatatttaatgaggagcatacacattgactttatattgaaaatatcttgctgaaggttatttaaaaattaatactaacttcacattattttaaaattgtgttattaattcatgtgtttagtgattctctgtttcttgattaatttgtgaacattattcattgtaaagatttaaattttctgcaggtctggtatatattattgaaacacagaaagttcttgatctcaaaattaacttgaatgcttcatatatcattatcccacaagatggtatctttagccctacatcaaatctccttcttttggatcttggacatctaaaggtatatactactattaagtattttatatgtcatttatgatattactttgtttaagatgtcttttggtttatagatgtttgatttgataaattaatttttagcttagtagcagaaactaagatttgagaaagcctccctttgtaacgaataaagtggtttcatttagttaggtagttttctacatttcttacatgaaaatgaccgattgaacactgaaggtcagaggcaaacctaagaattatatttgtaaagtttgagagtagtgcttgaggagtttatttccttttcaatttaaatttattgcttgatcaattaaaatgtatagagtaggaggaagttctagaagtcatcaaatgtattttcacccttctgaaattttttgtgtatatactataaatattgacattttagtatttctatta

SEQ ID NO: 36643 - DNA, 1005 bp, Bovine  19866881146690
tgtgtgtgtaccctagggaattgctgccctctgtcagtgaagaatatctagcattcttgcaatgaacagctgtttgtatccatccagactgcttagcagagtgtacgagaagaggcaatttatgaggcaaaggcgagttcaacttcttttgcattatgtgtatgttaacggttcagatttaggtgggctcatgtgtggagccaaagagcttggcaaattgatatagcagggaccttctgttgaacattaatcatttcttttcttaaactttatacttgtctcctagtacagctcagtaaataacaatgcatttctatgccgtttgcattttgcagcagagacccaatatcagtccacattcccaccaactatcctttggttatacgttagcaacttccaaattctgactttagacatggccttcaattcatttgtagagagggaaacatctctcaagagatatcatatagctctcttggttttcatacaagtacctcaaactcacaaggcaaatgtgaacttgtttcctagtttctaatcccaatgctactaccttcattcaaggcttcatcgtgtttcacccagaatatagcgaccaagacagcaatgagcccatgggcgcctttgtgcaaattagggcaagatccttttcttctattgacagtgccccagtccccaaaaatggctttgtgagtggatcatggcctggatagtggaggttatttcagccccactctcccctcttattggatacttgagctcagagcacagcctacaagtggcagccctgccagtgagactcttacaggccccatctcttttaatggctttcctatcttgaatacaaatcatagtgcagtctgcccttcacaatgaaatgtaaatctaaccatatcctgctcccttcttacaatgttcatggctctccagacattctgactcaagtggaactgccctgcatgggagataaagactttgagcttctgatccttgtaccaacctgca

SEQ ID NO: 36644 - DNA, 948 bp, Bovine  19866881203411
aaaacacctgcacgcaattcagacaccagacttctgactttcgtcacgattggggaaatatatcaactttctccctaatgttgagcactttttattaaaattatcgactgtaggtttaaaacaaaaatataaagcttttttttttatcctcgaaggtgtttcaaagacaaatcccctggaaaattacttccactgtacacttcgccctatactatgttgacccagccaacagattttttatcaatggcttttgctttgttttattatttgattaagtctcatgtaactcttcttactggcagtcaggggaatcatccatcttggatggagcatttaaatttgctactttttaactcaaggattagctttgcacttgggaatgtttgggcagcatcaaacccaccctacagaattctgtgatttaatttcatttatggatttaaagggcttacagctgtcttcatagttaaatgagaatttactgaaatgttgccctccccagtggcagagagagccccacaatcggcaggacttcagtactcccagaagtagaccatttgaccaaggaggatgaaattagcacacacatacacacaaaacataccatctgagacttttagaaaatgtagatccaggtggaaatcttagagcataaattacttggagctttcattgttgctagatcttagttggaaagatttgtgttctttcacatgcacagctgtggaatctctgggggaatttcttgctatttttcatttttgcatatcagccaaaaaccaagatctcagcattaactgtagtatcataagcctcctgtataggatggtggattttccaaaggatgctagacaggaactgattaaaatccaagatggcattctgacagctaagtgacaccatgggtagcacaatgaggggaaagacggcgaacaggtagatccaggg

SEQ ID NO: 36645 - DNA, 2277 bp, Bovine  19866881296432
cccaccagcctcctccatccatggaattttccaggtgagaatactggagcgggttgccatttccttctccaggggatcttcccgacccagggactgaacccccatctcttctgtctcctgcactggtgagcgggttctttaccactgtgccacctagaaggctgatacatttctatatgtgtacctgaaaagaaccaataaagataaaatatgctgtcagaattgattgttttaatacatcttaagcaatctgaatattttcttcctcaaaaatttcattcaacaccatggaatctgagaaagtagcacctggtcggtataaagcaactctatttaactaagtttatgttccagtcttactagagcccaaacattgtaaagggttaaaatatatgtataccatctgtatatgcatagtttaatatgtgaaattttacaatttttctcttcagtactatttaagaaactgggtacttaatcactatgaactcaactatagtttcctcctcgatctttaaatttctattttcccagatgacctactctaaaggtttcttttcagtattacagaaaccaccaaacaaatctatgcaagcaattaaagcgcattgtgtgagatctgaggaaatcattgatatatgcacttgccttcattttaaatcaatgaactaatatggatctgtatacaatatctatttggtgggcaagctcaccttgtttaaaaaacaagctacttctgttagctcttatctcaaaactagtgaaagttaatggtgatttttatcccgaaaccagattcattagggcagcaggatggcagagcagctgagagcattccaaggaaagccagaggggtgccatgccaggcaccactgatgggaggttagggacgtgtcagtgattaggaaggtctgatggcaagtgcaggaggcaatacgagggcacttgccttgaggaaagacctgtttcttagtccctggttgcttcgtatcattggtatctgtgtgccctgaatacctgcccctcccaataccgtacaaagaatgatctttgtactatagccattattctcttggcctcaaaggacagaacacgttgagtttattaccctgcttggctgtgcacagcctctaatcctagtcatggtggaaacctgcccaatcttttatccaagagcacacaacgaagggccagaaatatttttagttctgactcattgagacatgaaaataaatataataggaataatatgtaaaacttaaaacacatgaatcatagcctgatatggatatagcttggaaaaggaaatggcaacccactgcattattcttgctgggaaaatcccatggacagagaagccaggagggctacagtcagtggggccacaaagaatgggacacgactgagcacaacgcagcagcagcttgcacataactaggagatgtagggcaaatgtccccaggggggggggctacggacccgtacttcctgtcacatcagcagcagctttaattagaaataaagtgcgcgagaaactcaatgtgcttgaatcgtgctgaaaccatcctccctaaccctggtccgtggaaaaattatctttcacgaaatcggtcccagggatcaaacagttggggactgctgtataataagggcacagtcctgcttcctttcagaaccaagattcactccctcaacttctgagagctgcagatgatttacagctgagtccctctctgagcatggcgctgggcaggagagaactccctcctgaaagtttgtgcttcctcttcaggagctgccagcatccagtgactggttgataaaagggagcaatgactcacctcctggtcctgatacaggataacctctggaaaaccagctcagcttcagaaactctggtaaaatcagctgagctctctcccacagctgctttgcatctcagcttctctctctgcccaatcctagttcctttgcttccttgtgggggatcgttctcaagagccttcctataaaaattctgagtgcaaatctccatctcaaacattgttttctaagaactgacctaaaacagtacctgttccaaagcgaagaaaagtgttcactgaagagaattttattgaactaattctcatactcccagttttattaaaagtatggtatgtttagtagaaatggcttgaacaaggtaaagtttgatttttctctcataaaagaagtctacaggagacagtctagagctgagataatagcaccatgaaatctctcatcagaaattta

SEQ ID NO: 36646 - DNA, 2231 bp, Bovine  19866881314325
ctgttttgttcctcttcactttctgcctaagggtggtgccatctgcatatttgatatttttcccggcaatcttgattccagcttgtgcttcatccagcctggcattttgtatgatgtactcttcatagaagttaaataagcagggtgacaatgtacagccttgacatactcctttcttgatttggaagtagtctgttgttccatttctggttctcctgttgcttcttgacctgcacacagatatctcaggaaacaggtaaggtggtctggtattctcatctcttgaagaagtttccacaatttgtttagagtcctacttggatacaaacatcacagcttcccctgcctctactcattagtcacctcccatgctggggaccaaggctcttgtcccaaaagccttgtcttccccctctggtctcttctattcagctaaagacattcagtaatgtatcctggtttgtcaccagtttcctcccaggttttaccatcatgggctgagctagtgagatctcataacattctttgaactacatttttcacaaatctttttttcccagtcacttcctgtctttcctattatttataggtttcatagtttttccttttccatacgacccctgctccttttcagaaaccctgatccattcttcactgccacttctcctacctacatattaccacactttcttccagtaacttcttaattatttgtaattaaaaagccaataaaaaaatctttctatatatcatcaaaatgtctaaggctcttcatttaatgtgatatttctggtactcctgtcaccttatttgggaatctctcttgtaagttcatgatcactttgggaaatgggcatattacaagaaggcattttgaataaattaatgtatcactgcaacttatgataaataaaaattatacattcttagaccttcaaaagtaataagcaggcaattctgttttactgaaatccttcagtaggagcagtaagctgaaccttgccttgtgaaggaaatggagcatccatgcccaccttcctgagaaatgagctccatgatatgctagaattcggcacctctcttcttaagaccatttaataaatgttggtgtttggagagctaataggtgtgctttggttctagtccttgtaacttcccataaaatgacaaagaatccagaacatagcctgttaaattaattcattctcaacttcagcactgctgagggaattaagaaatagcatttcacaaaatatattggtgacaatttgaactttgtatagaataatatctaattctcttttgcatgtttctttacaagaagggaaaccctcaggacatagcaatatgctaggatgactgctccttcactctgtaaatacatttttaaagtgtactgtaatgtcattttgatggtttagtttctggaaggatttggctaattacatttctaggaatgtactcagaccagttttagctgcccagcattacttttaatagcagctgttacttaccttttctctcacttattttcctccctcacctgcttttgaagttattttgctgatttggagccctgaccttggtttaaattagtttgtctgtaacactcctgtgaatcatctgcaatattttaatggttaattactgccttgtatcaacttgtcagagaaaagcaggcaggaaaattgttcctttttttgtgtgacaaaagaaacttgttcaaaagagaagcagtgaagtgggctggtggatgcccctttcccatccgtgtaggtaaatgctgaattgattctttaagttataagacttggtacatactgagctgaaataataaatttacaccaaatagccagtggcaatttaaataaataagaagactcaaacaaaagaataatataggattctttccagaatagacaccttgttccttaatcaagagtgattgcaaagattggttgtgtggaatttgtggggaaagagtgggttatggtaggttgggtgggtgtcacctagtggcagaaaaggtaaaacagaataaggtgctagaactaggatttggtaattgtcttcttttagtctttaatggcaccccactccagtactcttgcctggaaaatcccatggatggaggagcctagtaggctacagtccatggggtcgctaagagttggacacgactgagtgacttcactttcacttttcactttcatgcattggagaaggaaatg

SEQ ID NO: 36647 - DNA, 1254 bp, Bovine  19866881318546
attctcctctcctgccccattagcatcctccttgtggcaggaaacgtgggtggtagcggctccagggtagacctttcaaatttttaggactcactctctcttgatcttgagtttgaaaaccctggaagaatcctggttgttcccacttgggctggatacctagcaattgaggtggattagaaaaaccacataatacaggtatggtacctgtcagagcaagagtgataagataaaattcttttccttggcaggggggtgtggggtgtggggggctgttgggtggtgagcagataaacctttaggtgggcaccctagatatcaggcacaaagagctacccaatctctcgctgtcacacacacacatctgtacaaacctacagatacacattattccccaaatccctgttttatttccagccaaccaagcacaagttataggaagacacatgatgctgggagagataaccttagttaactttcatttcatgcaagtttatatctcagttaagagaggtattataaagagtgatcaaaaaaatctatgtaactgttacatataaaatgtaacatattacatgtaactgttacttataaaatgaaaattatgcttaatcaatcaaaaatacataatactacgtatgcaatccaggataaagaggccaagcctcctcaatctctattctttcaggtcatggtgagggatactctttttgctcagtctcccctttaactgtcaaacttccattgctatttgcactatatgtgcagggcatcaaaatgctttaaatacaagtcagaaattatcttcaggccctacccaagaggcagagagtatttgggctaaatctggtgggacaagagttgtatttctatgttatcattttatattatataagagctatttatagaaaggctcaaagcaggccaaataccccaagggcaggggtgggagatctaaattcgtaacaggtagaaagtagtaactttagagcagggtttctcgcttgacctcactgactttgcggatcattctttgctgtgggggttgttctgtgaattgttggatgtttagccacatcactggcctccactcactagatgccagtagctaaactctgtcttctggatgtgacaatcaaatacgtttccagacattgtcaaatgtcacctgcaggaccaaaacaccctacctaagaaaaacagagaataatagaagaatcttgcaaacttaaataattcaaatccccttgaact

SEQ ID NO: 36648 - DNA, 1275 bp, Bovine  19866881328528
ccatgagacgttatcataaagtaccatcgataatgctgctatttttcacaaagcactccattattcttgtcatctggaaatgaaagctacatttttgtctgacacacagaacaaattgcagcagacaaataaaggcacctgggcaactatgccttcagctgggttcctgccacttctcatgactttgtattcatgtcctgttcttgttcttttttctaatttaaattttttgcaccttaagggaattaactagatgttaaaaggcaacgaggatcatttgagatgctaagtggccttggtcatggtgaagtttttaagtgatacaagtttgtgttgtttttcccatggagtatagtttacaacacagagagcaaagccactagttttaatgcaatataaataatccaaattcaccaactgctttaaaaagcagcagtatgctttcaaaaaagtatctaaaaccattaaagttttgaaaatacctgttgacttgaacggaagaaacacctgaagccttgaggcagagtagctttctgaagaaaaaacacataaatatttcatgtgggaggaatttttcatggtacatatcagttcttgaaaccagtgagatagctcacattcactgccagcaataggcagtctgagttctgtctgggggaaaggtatcaggaagggtataaattgtaaatattacatacttccttggtcagcacaaactcagtattctgaaagacagtgagatctccatgtctgtaagataaaagaaataataataatagctgtcaatgtgtcttaaatggttattgtgtaatgagctctatgttaaacactttatctggattatacatttttttttttttggccatgccttgaaccttgagggatcttagttctgaccagggattgaacctttgccctcggcagtgaacctgcagagtcctaaccactagacagccagggaattaccgcgaattatttttgtttaacatccatcccttgagatggatgcttttgctttatatttctgatgaagaaatggaggctgagagaagttgttaatgttgtacagctatttgttggtaaagatctgaacacgacttttcagatgaatagacatttttggtttgttccctgccaccctgctgtggcagggtggactactgtgggtatgcataggtagtggagttggctcctgcccaggtgactgcaaggccagccttgcgcatggttgcagccccttatgagtgaggctggatgccaggacagctggctgca

SEQ ID NO: 36649 - DNA, 1351 bp, Bovine  19866881349430
acctttctgacatctagacacctgaatttaaaaaccaagcttgagtgttgcctgaccagaactggaaaaggcatacagagaggtggcacccctaccctagggttaggagtgaggaagcagcacagaggcagtgagggagcaagatctggatccacagagagagtggggagcattccgtggactcctgaaggccttgggcttctcaacagtgccactcctcccctccccccacccccaaccaaggctggagcaactaagaaacagctccttggagttggatttttgctgtatatgtatgctatgaagtatttccttatacactttccggcttgcacaatggttgcattctcttttggatcactacctcaggacatttagtagcatgagtgacagggacattttaaattcatgggaaatacaaaaccccctttgtgggcattggtttcagctgccacctcaggtaacaaaggttgagctaagatttccttcgttttctttccttatacactgattccctagccaagatgctatcaagtagcctgctgacccacagaccaggggagaggaggagatggaaagcaagttaattcaccagatggagagctagatatctggatcaggagacaactgcacttccaaagccagatcaaagtcaagtttaaatagttaagtcctgcttcaaaagctgtaggcagagaaatatgagtggatctgagctggactcagaagtgaggaactctcattttccgtcctccatttttccaggatctggagctagcaggttctaggatggaagtccccaccatctgcagtgcaggccctccagtgagtcagaccttggttcaaatcttgtaattgctcttgggcaagttaacttctctgaacttcatccataagatagggacaatacgatcatatatctccttgactttctgggaggaaccaatgaaaaaatagatgcagctgctgaacagactacatagagcttagtaacaaacaaacaactagaggtagttgttgtttttaaagggaagctactgcccagaatcacagcctcccctgtttacaaagaacacagtgaaaggctcatcaggagctggtgaggccctgagttactcattttccacgtaactaacccaaggtctggcggcaagctacaggcccaggtcataagcaggtggatccacaccactgacttcatgagcaacagcttctcttcctttttgcatgatttcctgctccctcttctacccatgtctatctcttttttcttccccaaaggctccatcagtcccctctttcctgacagagtagttgatggtgctgagcccacctgctttctcagaaacaa

SEQ ID NO: 36650 - DNA, 722 bp, Bovine  19866881361436
ctcggccactgcctcgttatcctgatgactcacagagccagagtactttccctctcctctgctgtccttttaaattaaattcattgttctacaagatgtctgcggttcccagaaatgacgcaagctgtatgtgccctattcgaagtccggacatttgactctcaggacgttctcccaagagacctggatcctgccactcaccactccagctgctgacatttccagtaactgctcttcttccttcacagaagcttagagaggattatgaatagatggatttctttttaaaaagtcttgcaaagcctacctttaaatttttggatatctttgctaaaatagaaagaaaaaggtcaattcctttgatattagttgcccaaatgggtaatatttgacagcctagagagtgcaaagcaggcattttacagtagtttaaaagctaaaggagaggtaataattaacacattaattaaccagttaatgcacattggttcttgttcagcctctcgtccttgaaacaggctcaaaaagcttttaagtcttgtaaaaatgggaggcacactttcttgagcatcttttgtaacatggaataatttaaaaacagcaagcataacacatccgctctgagaccacacttatcggaagtgtggttggtcagtagggaagctgtcctggaaatgtgcccaaatagtgagtcagcagctgccattccaaccacatcccat

SEQ ID NO: 36651 - DNA, 825 bp, Bovine  19866881373039
atttcttggatgagatatccttgggatgtttgtgtaaagtttggaagtcttaaagggatttgaaattttcttttctcagttagttgcaggcaaaataaactgactagctaattgaaacaaaaaggtaatttactgaaacaatatggtgtagctcagaaaatccaagagaaactgggaaagtagatttaaaactgatgagtcagctaaaaggagccttgaagtgtgaaaaagtgaaagtgttagtcactcagtcatgtctgactctttgtaaccccatggactttagcccaccaggcttccgctgtccatggaattctccaggcaagaatactggagtaagttgccatttcctcctccaggggatcttctatacccagggatcaagcctgggtttccttcattgctggatgattctttaccatctgagccaccagggaagcccctggtgggagacttagaagcaggaatttcacatcagcaggaattttaaatcagacgtgcctaattgctagaaaactttgtttcttttatattgaaatatttagcttaacatttcaaagttctgtagaaagtttgaattggatgaccttggttctgtctgctctttcacgatacaagagaggaaagaggaaggatatggggccaagatccttcagcggcccattgacttcctcaattgaagagtcaccaaccagttgagtaaactagattatgactacaaaaagctcttatgaagagaaggttctcagactcaaaagaaggcatcaagattgttgggctgaaaggcccgccccttgtttaactgctgtggatttttcaacttta

SEQ ID NO: 36652 - DNA, 1592 bp, Bovine  19866881469880
ctgggaaacaatgctaactcattctgtgatgctaaggtgacccttgtgctaaaatttaacaagatttgtgcacacagaagagaaaccacaggcaaaatcactaataaagttgacatgcaggactcctatataaaagctaacaatcaaaatcatacctacattaaaatgatagtatattgtgatcaagtagacctaacctgacagtagaaacacaaggaagtttcaatgttaaactactaatctaaatcactagttaaaagttcagagaaaaaaatcgtattatgtcaatagatgttgaaaatatatttgacaaaattcaacaccaattcaagtttccctggtggctcagtggcaaagaatccacttcccaatgtggaaaacacaggttcgatccctggtcattgaagatcccacatgccgaggagcaactaagcctgtgtgccacaattactgagcctgtactctagagcccaggaactgcagctgctgagcccgagcactctacagcctgtgctctgcaacaagagaagccactgcagtgagaagcctgtgcaccactagagaatgtcccccactctctgcaactagagaaaagcttgcaaagcaatgaagacccagcatagccaaaaataatacataaacaaacattaaaaagaaattcaacaccagttcaagttaaaaacaaggaatgaaaggaaaccttcttataaggagtttctcttagaaacctacagcaaaagtcatatataatgatgaagcattggaagcattcttttcatctatggataaagcacaaggatactaatcactagtgcttgtattggaggttttgacccatgcaataacacacaaaaataaataggcaaatgtttgaaaggaagaaaacatttatttcatttgctgataacattgttatcgttgacccaaggcaataaaatggcatgctgatagaactgtacactgctacagaccaactaccatagcaacaatagaaaaaagtgtcgaagaattaatcctactcaaagcatttgttttcaccactgctccatctacaccaagagctcagatttatggtctttattgctccacctggcacaaggagagaattccttggcttctattttgtattaccaactcctgacctgggtgcattctgagtgacagagcccaggtcacatgcttgtgccctcgctgcaagagaagctggcaaagtcagtatctagcattttcaccttctttacaaaagataagttctgccttccatgattcataaggtggatagttccctcaacctagaaaaggatttagatgctctgcactggaaacaatgacacgtgtccactagaagcatccctactctcactaataatgattcttcagttattctggaattaccagtaagcaaaatgaaaaaagaagaaaaaaacaggcaaaaatagacatagaaataaagttggagattaaattattgctattatatatggagctggtttgattattctcctagaaaatacatgagaaacaactaaaatgttttcacaaacaatagaattcatccagttgtctggcacaaaattaataaatagatatat

SEQ ID NO: 36653 - DNA, 801 bp, Bovine  19866881553792
ccgcacattgatttttagaaaattcgcaagaaccagaaaatgggaaaaccaaacctaaatgtcattctggctgaagagtagatcagagaatctgctaatgcattctgcttttattttcaagcatttcccaaggaagaagtcaccataatctttgtactgcccatgaagaccacagaccagtcaagtgtgttttgcagacagtatgctgagtgaggcaggaaaaaccactccagcttactccatcaaatgacaacataaatgctcctttgtgataaggccaacatgaacagcatgccactcagtgggttcattaagatgcttccacattactgatgccagatacaaagcaacattgcagcaaactggccacacaagtcagagaacagcatacttgttcccatacaaagctgcctttcaattcacaaatccctgaactcaatgccaggcttttagactatggagtcaactgcaaaaggtctccaaagacaaaggaaaacaagaaaacctctgctccctaggctgctaaaggaaaaaagatttctgtgtttgttgcttggtttttgtttttaacctattctagtttcaaaatctgcatatctgaggttattgatatttctcccagcaatcttattccagcttgtgcttcttccagcccagcctttctcatgctgtactctgatagaagttaaataagcagcgtgacaatatacagccttgacatactccttttcctatttggaaccagtctgttgttccatgtccagttctaactggtgcttcctgacctgcatataggtttct

SEQ ID NO: 36654 - DNA, 802 bp, Bovine  19866881556045
ttgactagctatgtataattctttatccagaggatgaaagaaaaagaaagaaaaaagaggaaggaagagaggagggagagagtggaggagggaggaaggaggcaaatctttaaaaagaggtgaaattttataatgaggtaagagaaaactgaattggaatgagggaggtgtccgaaaatcggtcctgctgatttttaatgccttttctagcagtgtcaccttaggagagtcagctcacttttctgaaaaaatggtttactccactgaaaacaggaatgataatacccgttttacaggaaatgaactgagatttacaggaaatgaactgagatttagctttgggaatcacaaaccacataggtcaattcagtgttaattcaacttctatttctgttacactcccccaggtgagacacgagaagcttagttttctcaccttagttgaattctatttatgatatgatgcttcttaagtcctaaagaattggtgctttaggcactattcggatcttctatagatcagcatttctcaggctcctgtgtccagacagattaacagagacttcaaaaaggcaggtctggggcagggcttgagatggctcttctcaccagctcccaagtaaggctggtcagtgtgtgctcaccctacttggttttgataacattaggggctgcgccaacactttcacacactgagcacacattatttattggatcagagcacagagttttaagtgctgctgctgatgcattttgggttttttccatggtgataaagtacgtcctctgggaatgactgcag

SEQ ID NO: 36655 - DNA, 1035 bp, Bovine  19866881565697
ttgggttctcaatagaaggaaagcaatgaaaaccaggatgatgctgagtacttactgaaatacatgcccctcaagagccatagttttgaggctaaagttatgtcttagaaacctgccatcttcagagtgccagtgagcttgcagacccgcagtggttaaatcaatagttaatgatgttcgtcatgtaatttgagcctctagtttgtttatgctagaccaactttatccatactccaaacaaattatctcttataattaccagcccgaagataaatctctaaatgtttttctgatgatagtgctgtggttggcaggtgttaaaagtgcctcccagggacaaagattgaagatgagcttgtttccgcaaatccttcaggcgaggatgttgcgctttctagcctgccatgtgcaaaggcgccttgtatggtgccctgttaatgaaatctaataggcaaaggtcgtatatctttacaaagaaaaatgcaaagctgggatgtgataaatgggctccgtggggctcagtggatgaggtttggtgagaaaacccatgtttgaacagtcggcatggtttctctgtaatgtttatgccttaaatatcaccctgtagtgattcttctcacctggtagaatgattaaaataaatacaaaaataagaaatctctgtgtctttagtgctttgaaccacagagactggtcatccaatgttaacattaaacattatccaccagaacagtttgccttagagaaaagctggagatctttaaagaaatccttttgtaaacctacctattagtaatgtatcaatgtttcttaaatgcagaagtcttataatctatatatgttgatgagcattatcaaaatagtaagtaatgcatgcagatgcgcagggctatatccaacaatttacgctgtttggaagtagattgaaaatcaacatgcttgattttcatcatgctacaatgcaagaataagttgaatttggaattataaagagttaaataaatcagatatcattgaattgaatcactgctggtt

SEQ ID NO: 36656 - DNA, 955 bp, Bovine  19866881568719
ggcataaataggtacactttttttccaaaagtttgggaatcaacatcgtaatttattataaacttaatttaaatgtttaaatgagatttccaaaatagttcatatgtagcattatttcttatataatctggaaaaatactatatatgcttacttctagctcaagctgacagtggagatttattaaggaactccagtttttgccttcccctgagaaacgtgattttgccagtagcataggtactgttctatgaccaattccagcctcaagaaccagaaaaatagaatcaatgttcatttttattatctctcctttgggtaccaattcaggcatgggagctctttttacagcttcatttggttcttcaagaaaccacatatttaaatcttttgtatccttcttttcccataaatgtgctgtagaagaagcagtttcttttgggatggtttccttagcagtataaagtgctgaagttatggtaatcacagtatttatgataactggtgaaacctaaggagaaaaattcaaagcaataaaaaaaaaatacaaaaatcactttccaaactacatacttcaaagaacatgaaatatatttgctgacagatcaagagaaattaatactgaagtaatattactaccaagaaacagatacaatttgctgcctacaaaatctttttttattatgatagctaatttcaaaagttaaaatatttacatgttgatattaaactgaccaatttcaactacatatactataaggaagctacctacagaagcagtcaactgccaataataaaatacatgaaaacattcatcataaaatgtaaattaagtatcattttacaattatgtgtcaagaatatttttaaacagcttccttttgcttaatgattaatattattgttataattgtttatttctaagttttattgttttttccaaaagggcactaaaga

SEQ ID NO: 36657 - DNA, 1692 bp, Bovine  19866881587142
gacaccaaaagactgccggcaaaccaccagaagctagatcagattctctcagctttcaggaggaacttattctgccaatagcagatcttggacttctagcctccagaccgtgacataataaggttatattgtttaagtcacacagtttgtggtgctctgttatggcagtagactgatacagtatatttatgggataattcataatgtgatcagtcatagcaaaagtgatcaagtcagtgcctggttattgttcttcctgaagaaacatggtaatgactcacagccttttgggagatgcttaatggagatgtaataatacttggtgttggcaagggaactattcatgtggtattgccatgagcaatctcatttgctgcagtggcactggactggactggaaaattttgttcccttcccttaacatctagatatactgctttactaggagtaaagtaggtccaagatttataatcactccattctgctgacaacagcataaaggccaagtttctcccagttaagcacactctttaatatccataaattcccttcttttttcccctaaggtttattatttaaagttttcaacatagatttttgtttttgataaccttcatttctctctactggttcctccattaaaatgaaggattggaacaaaatcaaaaccatccatgtctcttttctgataatctagttgacaaacaatgaaaaggtcacaaaagatcaggcacaaccataatgaatgaaatagattccaatatgtggagtatacaccccacaagatgtgtgttgtattcagactcataatgaactggaaaccatgtgaaatgggacaacagtatcttttccactgtcctagcttccaacactctttgcaagaaccagcactctggccatgcttctgatgagaccattttatctactgcttttcaaagtcatactcattctgacctcatatattgaacaaagcactgaaagagtattattgtaattatttactttgaagggtagatttttctgtaacctgtgctgtgctgtgcttagtcattcagtcgcatctgatgctttgtgatcccatggattgtgacacaccaggctcctccgtccatggggattcaccaggcaagaatactggagtgggttgccatgccctccttcaggggatcttcccaacccaggggttgaacccaggtctctcgcattgcaggcagattctttaccgtctgagtcaccaggaaagcccaagaacactgaagtgggtagcctatcccttctctagtggatcttcccaacccaggaaccaaactggggtcttctgcatttcaggcagattctttaccagctaagctaccagggaagccccttcagtaacctatataaccttaattagaacaactatcatttgtgagatgtactacaatacaaatgagaggcaaaaggtttagcagctttctctttatgtggtagaattaacccatctgttaaaggcagtggtttctaaagcccaaaccagtgctgcctccaacgaacatgctatgtgtgtcgcaaggagacaaattcttctcattttctcaatatttccacccaaaaaaattaactgggtcaccaggcagataaaggtcatgacacatacaactgtggagctgcagcattgcaaagggccattaaaatgtaaggaatcctcttttt

SEQ ID NO: 36658 - DNA, 1775 bp, Bovine  19866881705076
taaagtgggatataaaatataatttaaaagaaaataaagccccaggatggtaatttatcacttactaagaagaatgaagaagtgtttgctgcttaggctggtcattgcattgaaatgatcattgtctttagttcgcatataatccatacttaaactctcctcatttttcaatacatatgattttgccataggtacgttgagtacactaaaagattcacttggtgaaacagaaatactaagtccaagagaatttaaaatcataaaaggtgccagatcccttatgaaggtagctgaagatccagtggcagcttctgtaaatgcctaacaaggaagagtcatcataaatacaagaaaatgtagaaaactaaatgacaagcagagtactaacagacatatgacaaataactaaattaacaaaaacttctttgttaaccaaaaggttaactcagactggtaccccaaaattaaagtttcaagtaactttccttacctcagctaaattatttaacattataaggccacatttagataatgtaatgtttagctggtctttcgaatagaaagtgatgacagttttgtattctggtactctgtaattttcttcttcagtacctgactcaacaatggcctttttggctttctttttcatctaaaataatataaattacagaaatgtgagaccaatttgtttctaggagcatggtataactcattttacaaaggaaaaacaaacatcagacaaatttcaaccaaaacattagagaaagcaatacattttatcagttccactgccttactggaataactgggacataaaccaacgaatgccgcctggacagaggcaatactggaagaaaagttcttctcctcctcagttacactaaaatggcagacataatttagaaggggaaaataaaaccctaataagtaaacgcatgtagcatctgaatgaaaatcagaagcacatacatcatagcatgtggaaattcagggcaagaaaagttagcctactgatgttataaatgctatatataaagaacagaaacctagggacttaataagtccaacaatagttgcagaacagtgccactaggacctaggctcctgtgaatcaaactacctacctctttttaagattcgcaagtctactacctgtaagtatcctgacctaacaaccaccaaagaaattcctttatccaaatcctctatctaaaatgagcacaatcaaatgtactggtctaatataaaaagctggaaataccatgctagtcaccttcactgttcctttaactggctttaagccactgaaaatttgtccattatttcacagaatcattattagggaggagatacgctaataatcctacaatctcttgcttcagaagcacaatttcatccatctaaaggttctgatttatatgattacataaattcacattatatttgaagtaaataataatgtattttcttttatatacacacccttcagataccaaggaaaacctgggatagacaacaacctaaaaaaatgctagaaatattttaagatgatagtttataagtggggactttgcagccagtattgcattccacctcttccaatttaaaggtattattactttatgaaagtcctttaacttcaacagttttagttctatcatatattaaaatgaagtttaaaactgaatcttcttcagaagtttgttttaaggtttaaagcaaaagtagattatttaagacagtatctagtacataataaatgttacacagtattt

SEQ ID NO: 36659 - DNA, 1542 bp, Bovine  19866881726566
gtatgcactgtgagtacttttgtgctttttcccttagtatattttattttacattaagacaaagcagatgaagagagtatcctctgatttacaaaagaaaaagaaaaaaggcaattagacaaattgtttcaaaatgccttcaatcctaaataataaaaatcttattataaatatgttagtatttgcttcaaaactctatggaaagaattaggccctcaagcttttacagctctatgaagaccttctaaatataggaaagtaaaactgaaatttatgtcagtttattaatggcatcacttaaaactataacagttaattaactaattaacaacttaattaactcagcacttaatttacttacttgagttcacttaaattccctagatgtgatttaatgaactttcagtgtaattcctgactaaccatggaaactgtgtgatgtatatttatgagtttaaaagatatttcttgaaattaaattatttaagacaaaacactaagcctagaagtgtttttttcttcaatagggaatatctctgaacatctgatatatagcaatttaaccactctgcctttttctctcagaaagaaactcatacttgtgtttgtttgtttaaacataccaatataacattcagaagtaagccagtgtgagcaaatttcatcatagtttattaacaattaattatcctatattctcaaagaataaacctgagacaataattgaaaattacaggagaaaatttgctataaaacattctctgttccatggatttacttatacaatagacctgtttacagaccagttctatacagtcatgcttctcagtgtgtggtctgtggacccgtgccagtctgagttggaaaaattaagtttttctcctatgtttttcctttactttcgtatatctaccacactcacaacacttctgacaccgtgggtactttcccctacccaagaattctctgcaacactagcgggcgtcctacaatttaaaccaggtctgactctgtctacctggagacggcatgggattccccaggttaagtgcccagtcctataaaactgggaacatttcaagcttctaaccaaggcttggtctttccagtgaccagcccccatccaggaactattcaggagttcacccagagtcacttcattagaataaaagacgctcctaactcccaggaaattataagggtttttggagccttgtatcaggaaccagggtcaaagaccaaatattagaataggagatgctcctagcgcttgttacttaggaaatcacaagggctttaggagctctgtgccagggaagaaacgaatatacttttttctattatctgacagagttgatgaattcttactagtagcagatgagacaagtacagaaactgagtgtttagatacatttatagcacttcgagaagataattatatgtctattgattctaataataacatatttaggcttgcattttgtaagtctgttttttattttcttttctctaagtaattcatttttattagttacttaaaaa

SEQ ID NO: 36660 - DNA, 1102 bp, Bovine  19866881901896
ttcagtgttaaagagaattacattttccattctcttctctcccttttttcttcttttaaagattttctggaaggttattactatttctctgacttttgatcatgaggaaatctcaagcaaaagtaaaaagagaagtatagtaaatcctcatacactctaggaaaatttaaaaatagcaaaagtagggaaataaatggaatgaaatagcaaacatgggagaaaacaggattttcacttttgaattctcaataataaagacatctcaattacacactgagatataaattaataagacttttcatcttttgggagagtgccacttcggctcagcccctgaaatatgattttgtggtttctttcttgcctcagggattcatgaatgtacacaggtcttagatgaaggcagatgaaacctgggatttcagcagagcctcatacataagttttcagaagagctagcagaccatcaggttgataacatcctgggggagctgcaggttggcccaaaggggagaagacagaaggatggggcagaccagagaaaacatttccacttaccatgaggtcagcatgcagccagagagacagagtcttctagactagatttgcacacacccacagaccacctgaggatcttactgaagtgcaggtggagtcagtaagtttgggggaagcctgagaacctgcatttctagcaagctcccagccaaagccagcatcaagggctgaaacctgtgtagtttcacaaggccctgtgctcagaagggagctgagcttggtttcatggtctgctgtcaccctcttgaaattgttaataatcttcaatttgaacttgtgttttgaaggtaaagctggatggtccagtgtggcctgtgtgagaatggagcagatgcgtgcagtgcagtatgaatatgcttgtccagcttcttgctatgacaccatcattgggtactgcaatggggaaatgacccatgagtatgaattctggtgggagttccgcaggtctcaaagcaagtagaggggaatgtgttatgtaaagacaggaaggttaggagcactgacaggcttggaaccagagtatgctgtaaccaattagaaggaa

SEQ ID NO: 36661 - DNA, 900 bp, Bovine  19866880410962
acagatctctctctctctctctctctttttcttttttggtgaaattaaaatagtggtgtccatttatattcaaaccagaaccttaccagcttgctgaatattcagatctcttagagaaaataatgaaaatatgctgtaaaagtctacctgaattccccatccggtgttcctactcagctttctgccttcagtttctcctttttagctggaaaagtgtaccagccaaaagacagccaggttctttgtgaagcaaagcatatcaaaccatctgtagataaaaaagtaacattttggcttaaaagccaccttctgatgtaagacagaatgaaaattataatgattgatagagtatacagtattgttattaagaatttgaaaataagattttcctataaataactcaagatattccacgtaagtcaagacttatgtgatacaatatgtgcattttctcaaaaatcaagagaaattaaactagtacccaagaagttgggttatgaagtaagaatgtcagtgaagatcctgaaagtaatttaaacattggcattgtacatatttcacttatatctgtcacagaagattaattttaccctgcacttttgccatgtgacatcaaccccattaatttatttctgtcatttctggctggcaaaattaaaataattcagtcctatgaagaagccttttttgccattgttaaaattcagtggcacaaatgaaagctacgtctaaagttattgccaggatttagggaaaaaaccaaacaaacaacattttggctcaaacagaaggtctttcgggcaaacagtcatggatgaaagttgcaagaaaaaaattaaaaaactccgtaagttcagcatgcaccaaacattttcagacaaccatttagtgtctaaaaat

SEQ ID NO: 36662 - DNA, 1615 bp, Bovine  19866880438862
tgtactgagtataaggctaacacacaaagatagattaaaaattttccaaagatcacctaccaataagtgttagagccaagactgaaacccagcactacccccagaaatatggaaaggcattccaggcacaaggaatggtgagagcaaacgtagagcagtgaaactcaatacgtgcagagatccactaagaaggtcgaattttctgctgcaggagatcagaaatcactgaattgttcaatcaaataaatgacatggttagatttatgttttagctgaggcgttccagttgctgggtggaggttagttgtaaaccttgggctaagattgaaggggtgttgaagggtaaagaatagttcaccacgtgaaagatgtgagaaaacagaagggtttggggcattgggcccaccgtgtggagaggctgcatggtcaaagagtacggcacttgctgggaacctaaagcaccgtcctctggttgcagtgtaaatcgcaagggtaataagagatgagggcggtgaaagtggaggttaaaaatgggaaatggggacaatactgagcttgaacttgtttctttaaaaataaaatccaagaccactgaagagttttgctgaaatgtatatttcagaaagatccctctgttaggtagaatatggactggaaactgcaaaactgagagcaagagataaaggcaacaaaaacggggtcagtggagtctgagagatctttaggagatggaactgacaagacttgatgattgattgatgggtcatcaagtggtgagagaaataagcaggagagtcaccacggatcctggttgcgtcagagtagttacttactagtgcctcctttcactctcaagagcacagcacttcaagtgatcaatgttacagttactcctgttagaagtgaaagatgtcttgtggggtcttggtttgagccacagaatggatgccattcaccgaaacagagaatgaaggagaaagagcaggggtaaggatgaagacatactggacattccggacacattgagtttaggactgaggttagaggacaatgggaatcttgaagatgtcgtgacgtgtcggggccagagacgtagctttaaggatcatttgcataaaagaaatggtatcagatccaatcaataccttagagctgctgtcacatacgaggcaaggctctgagacattttgtcttcaggaccagatggttgggaaattttggagaaaagcaatgaatcgaatattttctgtgtaccttcagttgagtggatggatgtttccagtacagggctggttcatgggattttctgagtagggccatcaagtaatcattataactgggactgctacaggtgccctgcagtgcagggtcatgttcctgatagaagaacatgagagttggttcttgtcctgaaggaccttatggtcaagttaggtagataacagttgactatacaaccaactattgtctacttagtgacacacaagaaacaattaaaatgatgaatttatttttaaaatgaagcatttatatattctaaattggcagtacaaactaagagcgttttagaatttctgagcagagaagacaccttgagctggaatagtgacagcca

SEQ ID NO: 36663 - DNA, 614 bp, Bovine  19866880506139
aaaaatctaaaaaaatatcactgatgtagttctcatttaatctaaagagataatcataatccttgataccgcttggcctctagaggcatgagtcttccgtttcttgctaactcaagcaagtacattattccaaagaatgtctgtatatcgcatatttctaaatctcctaatgataatggttcttttaacaatcaatgaacaatcaatgactcaatatttgacccttggtgaaatgaagcactaatgagttttgagggggtcctgagttagcgggggaaggggtctaaatgattttcatgttcccttccatctctaagggcttcccttgtggctcagctggtaaagaatccgcctgcactgagggagacctgggttcgatccccgggattgagaagatcccctggataagggaaaggctacccactccagtatcctggcctggagaattccatagactgcatagcccatggggtcgcaaagagtcggacacaactgaatgactttcactttcaaatttcactttccacctctacatactctaacaccaaaggctatagtaggtaatagtctagaatttagaaaacatatttaaatgcttcatctcatttgataaa

SEQ ID NO: 36664 - DNA, 2570 bp, Bovine  19866880660439
ttgcaaattcagaaacctggatctcatcagagtataacagtgggctagattcaggaaaaccaaaatactatttattaattcacagtaaaaaaaaaaaagtccacctgaatagagcaaaaatttctgttgtaaaccataaaaccaatactaaccagctgaagcaaaatcattagcaacattatgaaactttacagaatttctagaaactcagagactgaattaagttcagagtctctgcagctaagtgcgtgacgagttgcttcagtcgtgtccgatgcacgactatggactgtagtccacgatatggtagcccaccatagtgcacgactatgaaccctatggactgtagcccaccaggctcctctgtccatgggattctccaggcaagaatactggggtgagttgccatgccctcctccaggggatctttccaacccagggattgaacccacgtatcttagtgtcctgaattagcaggcaggttaccactaacaccacctgggaagctcctacagccatgaagaaaacccaagtgccaacactggaccactcataggtcagtcccattggcagtggaagcagcaccacagctcccctggtggacacagagaatgagacacagtgtggtatgtcaaccacaagattttactcttaggaggtttgccactatttcgtgtttgtagttaagttactaagtcatttctgattcttgtgaccccatggactatagcctgctgggctcctctctccatgggatttcccaggcaagaatactggagtgggttgccatttccttctccaggggatcttcctgacccagggatcgaacccacatttcctgcattggcaggtgggttctttacctctgagccacctgggaagccccaaattagctattcgtatacaaatatccccacttttggatttccttcccatttaggtctccacagagctttgagcatggctccctgtgctgttcagtaagttctcattagttacctattcgacatagtatcaatagtgtatatatgtctatattttttgttctgctttttaattccagaaagctttgtgttcatgtatttttttcccctataagtttcaccttatataaagcttttttttcctttaagatagttaacaatttaaattgtaattgtgcagtaaagagatttcatttactatacaaagacatttaattttatttttagtaagatacttgaagttattctttattttgaaaagtttatttcctttttagtctgttgctgcccctgcattgatgatctcagtggtttttcattcatctggggagtcaggaagaagagtattcaacatttaatatgccagaagccctagtaagcacaaaaacacttaagtacccatgtgatttacggtcagtgggtctgtttcccctttctactgtgtcaggaattagttggaaggaccagaattcataggagaaagtaaaataggactgtggggattaataatcaaaggagggctttttagtccgtggtacccagagctgcacattgatgcaggaggtggtgctgttggtttagtcgctcagtcacgtctgactctttgtgaccccatgaactgcagcacgccagacttccctgtccttcactgtctcctggagtttgctcaaactcatcattgagtcagtgatgccatccaaccatttcatcctctgtcaccgcttgtcctcctgccctctgtttttcccagactcagggtctttttgaaggagatcaaaccagtcaatcctaaaggaaatcaaccttgactgttcattggaaggtcaagctgaagctgaagctgaagctccaaaactttggccacctgatgtgaagagccaacgcattggaaaagaccctgactctttggaaaaggagtttgtgaggtcttagtaaaccaaatgtggacaggtctccttagcccacatctccctggccaatctcttgcagttatggcctcatttaagttgcactgttgtgaaaaggacagagggctgagatgctacagtctcaggtggaattctggagtgtgtaaatgtaagcctccagctctgagtttagagaaaacatttaaaagaaagccagaggaaaaatcttacagattaaactccgtatccatgactcactttctctttgctctctcgttccagctgttactcattttaccgcgaaccccacaggaaggcttcttgtgatgttttccctttgactgctttgccaaaaatataaatatacaccttgggagaaaaagggtgagagagaaaacagacacaggtcacagtttttttttaaatcttggttctgccgataacaaactctatgaccagatactctgtacaggaagagaggatgttataaaatttgttctcggtggccaggcagccatctctctgtagaagggcttgtctcagatgtccacccgtgtctggattgctgaggtcccttttggatcagctctcctgggcttttggaagtagccccgcaggtgtgactacagcctggagattccttagcaatgaggacgaattatcagagaacaggcaggaa

SEQ ID NO: 36665 - DNA, 1152 bp, Bovine  19866880766533
tctgttttgttcctgaagtctagcctctaccctggacttgacttaagttctaattcattctggcttctgccctgatctgtgttctgctggacttcactgattccagtagcaacctcttgcaagcaccaagcttagtctggaactgataaccaattgtacccaatgctactttcactgtggttttaataagggatagcctgttccctggatggtttccaacaacagtggacacacttgtgcatgtgcgcgcgcacacacacacacacacacacacacacatcatattagactgtgcagccataaggtttgtatttttagatggatatttgcataagcacgtttgaacttatgttcaaaatgtcagatcttgctttatgatgatctaaccaaaaaaaaaaaaaatcagatctacagatttctctaatttagacacatgcaagtatatacagaagcttatagcaatcagtacaaaagaatacatcatcagaaaagacttgaagaaatagagaacgaactcaggagatgctgtctaatgcctagtctggccatgggggaatatacaaagagaaaatgatggtagcttctaggacaggctgatgatttgagcttaggaatcttattccctgcgtgttaattttgttggaaatgagcaattgaacgtcaagagagggggtgtcagattgaaaaggctttcactggataggtctgggaaaatctgaatgtgaaaaaaaattaagtatagtaatgaaatgtaaaccattgaaaaaaccagaaatcctgcatccatacttataacaaataaataaataattcagggagaagagaaagctcttgcttacagttgagtgccagagaccaagtagtaaaatttggaaaaccatcattttgaaagcatcatggtaaagatagaatcagacaagaaaagttactgaatgataaatctcataggaaaatttgaggaacagaatattttcatggtctcaaagtttgcatgtggtggggcaggggggagagatgggggtcttctgaaataagaactcttccctgaaatttcagctggcagcaatggaaaggaggttggtcaaaggaaaattgggttggccccagactacttctccactaccttaaaatatagtagatatggaaaaaaca

SEQ ID NO: 36666 - DNA, 1832 bp, Bovine  19866880821943
acggggagaaggcaatggcaacccactccagtactcttgcctggaaaatcccatggatggaggagcctggtaggctgcagtccatggggtcactaagtcagacacgactgaagcgacttagcagcagcagcaggaaagaggacagggaagatgtctctctctttttttttccctcctgtgccaacgctggaacattctttgccttttccctaatagaatgtgaaataaaagaatttttaagtggttgcaaaactgaattcatctgaagctaaatgtagaagaagataacaagctgaatatttccctctagcagtttggagggataacatatctgctctgaacaactgaaagcacaatttactacattgtgtggtgtcctttgaaagtaagattctccctgctaggtgaacatcactgctaatatcactgcgaatatctatcactgtcaccctttcgccacttagctggtaaatagcaatctaattaatagtcagttgggattcactctggaggaggaataagaataaactcagcaggaaagttgtaggcttgcccactgtggacagttcttcaattacttcttttaattcttcagaggatgtactgaaagagactgatggagccattagtgataaaccctgtcaggagagaacgtgctccctcttccagtgcttctggggtacaccactgtctaggtatcatcttggggtccccatcactactaacaccacctgtttgaaaagtaaaaacacatttggagaaaaatggaggattggtgtcatgaaatatactatgatcctctgctgagggccagaaaaactgctaagggaagaagagtttcgtgtaggattcatgcaagctacatagacttaggataattgggtataattgtacatggccccataggttgacaaataagcccctttctgatcctcagacaccttatgtggcacgtataataatacatgacctctccaagatcaagaacgagatgataccacttctcctggggtcccattccagtcctttaaaccatgatgctgatacgagctgcctcactgacctggactctatattctcccaattcccaggcagccacactggactccacgctctcccttgcacggtctaagcatgctctgaagcagggcatccttgctcactgttctctcttctgagaagctgccacctccctccagccacaagggtcatttcctctccacctcccttgacccccccaatctaaaattatgcaccctccagttactctctatcctcttctgagctttattttcctgcacagcactttttaccacctcccagagtatccatctattctatcgtttatcccattgctgattgactttaagctcccagaaggcagggactttgttttggtctctcctgcacccacagcacccggactgtgcctagcgaacagaaggagctcaataaacatttgttgagtgaataaataagcaagcatgtagaacaatggaaagctacatgtgcgtgtcttgtgtgtgtgtgtgtgtatagatgataagaaaactggcttgcctaggtgaaagtaacaaatgatgcctggccataaattaaattttaatacaccaggaaaactggagatgtagagatatgaggagcctacaggtatggggtcagctggggtgcctgaggaataatccaagaaggtgatgaaggattcatgagaaaaatgagcagattaggtctgagacacttccccaagaaagaattagtaagaagagagtctgaaaggagaggggctgcaattcatcccatagctgactgacataccctccattaagaatgga

SEQ ID NO: 36667 - DNA, 1698 bp, Bovine  19866880843352
tgtggaccttttaaaagtacaatattgtgtctgtcttatgctttggtgttttgcaaggcatgtggtatcttagctccctgactaggaattgaactcgtacccactgcactggaagatgaattaaccactggaccctaaggaagtcctgacctattccaggttctaatacctgattgtagattttttcctccttgagaatgactgtatttggctgctgtgaaggtgccaaggctcacctagatcaggactcggcaaaggctcccgaggtatctggaaccctggacggctaccaggtttcctgtccgccgagagccccagtatgacacgcctgagacagaggcgtgttttctgagtcccaggacgagccggggcgggtgtcggcgaggggagaagacgaaggcgcggcacatcccttgctgtgatggtttctttcccctgacggaggcaagagtgctctccgctatttgaagagagcaatttagatttatattaaggaatgaataaataggattcagtgatgaaatctcatctggagtgaatgcaaatcagatatgctaatgatcgtgggggccgtttctcacattggagcagaaaaagggagcccagcggaagcctgggtgcttctcctgtctcccccgttaaccaactagatgttccagaacaactgaggctgtgggaaagggttatcttttacttgacagtgggcttccctgatggcccagtggtaaagaatctgcttgcagtgcaggagacaaaggttcgatccctgggtcgggaagatcccctggaaaaggaaatggcaactcactccagtattcttgcctggagaatcccatggacagaggagcctggtgggctacagtccatgggtcacaaacagtcagctacaacttagcaactaggcaacaacaaagcacttgacaagtcctcaagtatttctgggcagagtattttaaacatttcccagaaggtctcaagagatgatttatgcagacccctacgtgaactggggcttcccaagtggtgctagtggtaaagaacccacctgccaatgcaggagatgcctgagacaagaagatccccctagaggagggcatggcaaaccactccagtattcttgcctggagaatcctatggacagaggagactggcaggctacagtccatagggttgcaaagagtaagacatgactgaaataacttcgtacacatactcaatgtaattacaagttagactaaactgcttagaaaatgtcttgtagcccacagtgataaggaaagtaaaattcaatcattataatggaaagaaaagacatatatgtctaccatcttacatatttcaatttttccattatgaatatccctttcaaatgtttttaaagagtatattgttcaagaaattattttgcatggatatttaaatattactgattaaggtttatgatagtgagtcattctggttcctgaatttattgcttttacttaggtcctactaaatgcaaacttacagaagttcccagttttgaatatcctgtgagaatgccatatatatatatatatatatatatatatatatatatatatatatataagagatgattaatgttcacttcagacttttaaaaaaatcagatagtgctttttaaattgtgaggacaacactaaaagaatagaaacaaaataatattttcaaatcaga

SEQ ID NO: 36668 - DNA, 1098 bp, Bovine  19866880846855
acgtgtggatctgcagctcagcagatctataaaggagagctttgtcagcctagagacggggtagtaccaaaggacactcctctccaggaagagggttgtcatggactggagaccacgattcagtccattcgcatgaagatcaccaaactgataatcaccagtttcaatctctcaaccctggcatttatgtcaatgtcttccctggtctctcagatggtaaagaatctgcctgtaattcgggagacctgggttcaatccctgggttgggaagatcccctggagaagggaatggctacccactccagtattcttgcctggagaatttcatgggcagaggagcctggcgggctacagtccatggggtcgcaaagagtcggacacaactgagcagataacactgagggagggaagcaagccatcaagagaacctggctcagttatccttggctgtcacaaaggccattgtgtggttaatttttatttcattgctatctttattttttttttgaattgtttcattctaagctcgacaagcctgattggcagattcactgtctgattttttctagttttaaatgatatgctttttcttccaggcatcttcatctattaacctacattcatttttaattttaatgctccaatcaataattatttcacttgacagtttttgacagtctgctgctccatttagctgtttagcgtgaatttcaaaggtgatttctcagtctgtacaagggaagtaaacttgctctttcatcctctactttgcgggggcataggaaaatagacatgttttgctctttcctaaggagtttttaatatagaagaacttcatagttttccatgtaggaagatagaggactatagaacagtcacattttctgtgatgtagcattttgttcctgtcatttttcacttgaaaggctggatttctgttaattggaattgatattgtgaggtcagcccgtcgccaaatatttattgaatactcattgtgtgcaaggcactatgttaaatgtggtaagaaattaatacacgagttggacatgacgacggaacacatgtgtgtgctcgcgcgcgcgcgcgcgcacacac

SEQ ID NO: 36669 - DNA, 1156 bp, Bovine  19866880920253
gatgtccccagcctagggatcgagcccaggtctcccgcattgcaggtggattctttaccgtctgaggcaccagggaagccctcattaaagtgaaccttttgttcctcattacagtgatattgttccagaacttggatccatttttcagtccatcttgtttaatgcttctctcttgttggattctttccctacacttagaagctaccagtttattgaaattttatgccgtgctctttttagaatgcttattttcaggcatgtatcatatttgtggatcagaccttgacaattacaaggcatttaaatgattagattctgattgtcaaaattcaagcccttgaaatagaatgcctaagctaatgcattccacacgccagcatctcatttgctgatcaatgtgttcatcagaatcaatgatgagcacgtactatatacttgtcaaagtaaacttattaaaaatacattagttctaaataaaatcttgtattgatttgtcatttgttttattgatagcaaactttacacctgccctcaaatattcacatcaaaaaatatctgttttttcagatagattgaagttcaatgatgaatacaattcctcattgagaggatactggctcatcagcatgcaccaatggcatgcctcacgttcagaaaaacaaagatgagggcagctatggaaagcaattgatattcctgcccaggttggagttgatgtgcaaatggataaacacagtgtttccattccgaagaagctatatggaatcacaccagcaggggtttgatcctgaatttccttctgtttttagctctgttgtcatttcagaagctgagaaaccaagaatctcctagagatgtattaagggattccaacccccaagagagaacgatgcaacaattagcaatcacataaaaagtaaacaataaagcatgtaacaatacaagggggggtattacaaaatggatttataaatgtggggtggtattagtttagtatgactttgttactcactattattaacatagtgcttactgacctttttagatagtatataaaatgaactggtctagagctaaatagctaatagtttctgtttttaattaagctctgtcttaatatctccccaggggtctaataccctggaatccatttttg

SEQ ID NO: 36670 - DNA, 950 bp, Bovine  19866881074882
ccttggtgaaacgcttccccatatactgtatttgtcctaccatgtaatgaatgatctgtgtccctctctagactctgagatgcttagagtcactgatcagggctcgaatttttcataacagcctgcacagtcctctgcacataaaaattctcagaaaagactggttcaatgtgtcaatgaacacacacatccggatactcttaagactatggtgaaaatgtccttaaattgtgatctgaagttagaggttaaagtaaaaagaaaaaaaattcacttttagtgaaatgaaactcttaagcattttcacttccagatgcatcagcatcacataaaagatgttggaactattttagaaaatagacattctgcacattttcccgtctgagaatcggtctgaaaaataccaagctacacagggggcctctgggtgttctcaggacaaacgttcagctgggtattgattccacacactcgcttaatggaaatccagaggaagactcaacatctaccacgcctgcccgtcacgcactattcccctatgcagccgctggagagtaaggcgggggcgggggcggggagagagaggttccccggagacgtctgtcctcccctcccaagaccagccagtacttcagcgatgatgcatccgagcaggagagaacttaggcgctcagagaagcaccacacccggcctgatggacattttccactttcatggtcattcttctcccgcatggatcaatttcttacatatccccttataatttttcaagactgagcctttgcaaatatctgcctggctgcattacctaagccatcatcgtacatatgccaaagccccacctcactcaaggctagttctgctctgaaaagcacagtgggcagcaaaagaacaagttcctcctaacaaggatccgggctgatcgtccacattcggaaccattcgtcac

SEQ ID NO: 36671 - DNA, 1171 bp, Bovine  19866881189502
tgcattattaagtctggggaatttgtaagcttacttaagtctttcaattgagttagactgtggataagtgtatcagatgagaaacacataaatggtgtttatttactctgaggtagtaaatggagaagttgaacgaaataaaatgcatctattatgaccactggcgtccagcaaggccactgcccccgtgcccctgttctgcctgcactttcttcgtatgtgggtcattaacattgtgtttaggtcagatgagagtctgttccatctgctgtgatagctgaagtaaaatgctgatggagatcatttgagatcgtctctgtgctgctgattgcatgcttgtggctcataatcagaatgatgcgaagtaattgttcaagcgacttgccacggctacgttttgtgtcgttgcaactgtcagcagtttggtcctgctcctctgcctgaagcgtgtttgcccagcgcctgttggatggcgcgagttgcccttcactgttgtgggtgacatcggttctagcatcctcacttgctgccccccatctattttataacctgaaaaagaaatgtctgcttatttagtgggagcaagtgctggcttttgtgttcaacagaatgctacgtaccagggcttccatacagaaatccacatgcttgttgccacagtgctcctctctttttctctttggccagaaaagccaggcagacctggcttagaattcttgctttgtcacctactggttatgtaaccttgggtaggccacgtgtcttgaaccttgttttccttatctgcacattgggtctaagagaacctgttttacagagattttgtgagaattaaagatagtggataaaacttgttggcataagtgttgttgttcagtcatgaaatcgtgtcccactcttttgcaacctcatggactatagcttgccaggcttctctgtccatgggatttcccgggcaagaacactgggagtggttcccttttccttcttcaggggatcttcctgacccagggattgaacctgtatctcctgcattgaaggcatattctttactgctgagccaccagggaagcccttgttggcataattagccacccagtaaatggggaatagttaataataaggaatccagtgcttactcaggatgacattatacaatggcaacacagaa

SEQ ID NO: 36672 - DNA, 927 bp, Bovine  19866881349721
tcaatccacttgcacgttcccatagtctttttatagcctttacgcttgcattcatgtccacactgacatctcctctgtgtctttagaatctgtaaacacatactagctatctaactcaacataaccgaaatcacaaaagtgattacaattttatggttaccactgcaaataatgcctctgaaataattacaagaaagataactgatctataaaatagtgaatattttagttttaataaccagttcccaccactttagttataactcctaccttattctatcagagatttttaaaagttatttattcaaagatctcttaaaaatgaataatgtcaagggaatgttagctgtcatacattggctattccacagaagccaaatcgcagaaagatgcattaatagtatatttaacatgccttacacacagggaagaagcttccaggtggtgttagtagtaaagaacctgcctgccaatgcaagagatataagagaagcgtttcgatccctgggtccagaagattcccttcgaggaaggcacagtaacccactccagtattcttgcttggagaatcccatggccagaggagcctggagggttacagtccatggggtcacaactagttgggcatgactgaagtgacttagcacacatgcatgcatacacaggaaatgcccagtaatacccaaggaagatgagatttcagtgtttctatcattgtaacagaaaaggaaagtggaacactgtcaagacaaaaaagaatacgaatgattctgaaaaataattatgactttagtgtttcaattgtaatttatagaatccactggctgtttgacctgtcttccctggagttatgaagtactgagttgataatatttggaactttaggatctcaaatatgatatcaattcatcatttagagttatagag

SEQ ID NO: 36673 - DNA, 1743 bp, Bovine  19866881377427
aaaatatccagaacacacactctccctagaataatataatcaggcatttggctctaaatatctattcgctgatgactcccaggtttacttccccaggcctggccattttcctggaccccaaacttgtgtacataaatgccgatttgacatctccatttggatatctgatgttcacattaaacggaacatgtgcaaaaccaaaccttcttctcctagcccgggttgcctcttgcactgtcttctgctgcttctcttgtaaatgccaacatccacgcatccgagcatgtcaaaagcaactagaaataaagactaatttctccctttccctcaacttccactgtcagactatcagccattctgtgttttaactcaaaaatctatctaaaatccatccacttcaccccatctctgctgctcactgactcaatggacatgagtttgagcaaactccgggagatactgaaggacagagacacctggcgggctgcagttcatggggtcacagagtcagacacaactgagcgactgaaaaacaactgctgctgctgctgtccccttggtttaagccaccaccgcctctcatttccttactgggctcaatgctttctctcttactgccatactttaaaacaaaaattagatcatgtctctattctgtttaggtatgttctgtagcttctcatcagaataaaatcaacacccttttatcgagggaacaaagctttacatgatgtagccactgcccagctctccaaactcactctgtcccattctcacttcctgctccagccccaggtctttcttgtgctccctgatttcccaagccttttacgatgtctttgcacttgcttatcttatcatactgtatacaaaggtctgtacagtcaaagcaatggttttttccagtagttgtgtacagatgtgagagcagcacaataaaaaaggctgagcactgatgccttctagctgtagtgctggagaagactcttggagagtcccttggaccaaacaaggagatcaaacccagtcaatcccaaaggaaatcaaccctgaatattcactggaagggctaatgctgaagctgaaattccaatactttggccccctgatgcaaaagaactgactcattggaaaagatcctgatgctgggaaagactgaaggcaggaggagaagaggatgacagaggatgaaatagttggatggcgtcaccaactcaatggacatgagtttgggtaaactctgggagttggtaatggactgggaggcctggcgtgctgcagtccatgggagtcgcaaagaattggacatgactgagcggctgaactgaactgactgaactgaagacatacaattttcactatggaacagaaactgctctaagtgctttacatactttatacactgtaacttactgatgagatcactcaggcacagagagagtaagtaacttgccctaggctacacagctagtaagaaataaaagggtcagttatggaagatgaacaaaactaggcctggtccttaaaggctattcagtaaaggaagcagacaattaaacaactcactacagtatggtttagtgctctgagaggggcaagcatgggggcctttggggaagtaaaagtgtgccaccaaaggctgtgtctggagcatggagtggagggtgcaggtgggggggggggacagggcgggggctagtgaggccagagctgcaggagaggctggtcagagagtttcggaag

SEQ ID NO: 36674 - DNA, 739 bp, Bovine  19866881563561
ttgggtcatcgaaagagtaagctggaattttgccctttgttcctcaaggctttgcaactgatttgtatgcgatcgggtttataccaggagggcataagaataaattattatttagcttattattctctggttctaatagatctataaaccaagattcttaagaatcttcttcacatttctttaaaacacacacacacacacacacagtaatgtctatttggggcccctttctgaggatctcaggggaagtttgctggtgataaatgctggaaccctggaacagaacaaattggtctcacaagcagtcggtgacagcctttctgaatacagctgctttcttcattagaaaactaaaaatagccccgatcattgcaggctgatttcactttaagccttctgccgcatccatttgtctgtttcattcagggtttctgagtgtctatgacacggtgatactatttcagatgaaaagtgcattgaagaaatgtttgcttccctcccccacgttcactccagatgtccccaactgtccattgctgtttcctattaggagaactcacgggaatcttccggcatccttgccatccccatctgcttcactcatttttgggaaaagtaaacaccatccacattgcaaacaagagtctacaattattaagggatttttttttcaagggaaatgtttattacatgtgtgatttttctatggatagctcatgaaatattgagtacaactacc

SEQ ID NO: 36675 - DNA, 853 bp, Bovine  19866881852406
acaagtcaaagtaggatttacgttcctttatgcattttcttttcagggtcccactctgatgctgcgggactgagaccccaggcagctcagtagtgacttataagggcgggggtaccttgacagggcacggaggtgggcccagaggaagaggcagttgctaggtgaggaagaggagacccaattggtcctgaaatcaaaaagatatgagggtcagatacccacagtaccgaagtccccaccatgggtggtctcaaggcaaacaggaagagctgccctttaaccttttcatatttatatctcaagaagcaatactctgtgggttttttttcctcttcaagattgcttttgacattcattccagttataaatgtcacagttgttgccaaagagtgattaagtaaccccttactcagaagttctcaggatagcactggagactaaaacctcctaagggcagtcttgctatatattctctttctgctattttccaccatctcatttgctagtaatttctttggctgtgtgtgggggaggcggggctggggggcgggaagataaacccatttcaactaaaagaaagcttcctttttaagtttttacaatgttaaaataaattctgaatttgagagtcgtatctttaagaatgttctgggctattcttcaaaggtagttcttctgatttattgaaaataatgtggtcaagttaaaagaaaagtactaaagttttacttttaaaataagcattggggtattgatccactgcttagtttccctataaaattgtggaacagctaactccaaaaatattctgtgcctttaaatttttctctgcctaaaattgttttttttgtaa

SEQ ID NO: 36676 - DNA, 1790 bp, Bovine  19866880507210
tataaaatgctcccaattctagtaatatatgtgtatcaattataaaggaaaaaggaaaaatacatggtttctttatattattctgtatgtgcaaggtgggtttttggagctatattactatcatatctttctagtgacaaactgaatgagtaaggtatcttatcagatattacttgagaaaatagaattagttgtgccaaaagactaatgcttaagagattcatttctttagcttacttcttaaaccaaatctacttttctaacatagatactgttacatgtaagtggccaagtttttgaacaaataattaaaaaaaactcaatacatacatttctaaaatagtcatttagctacaattatttcatttttctatatacaataaaccatttttttctatgcacaatagatttgagggctatgatacaccttgccacttactatgttcatttttttcaaacctctgttctatctttctcaaggtgagtttctaccttaaaaagtcatggtaaggtctgtatgagattacatatgctatattcttagaagcatagtaaaacacacatggtaaaaatatcagtaatgtggattttgtgctgttcattttttaaattaactaaagttttaatttacagaaaatagagtagtgtttcatttctttgaaacaatgaacctgttagcgtctgtttagtaaaatgactctgatttgtatttcaaagtttttcagttatccatatcaaacttgatcaatttaaacgaatcttttatgactatccttttcaaattatgcagaataaagttatctattagattaaaaatattcacatgagcttgtcatgattctttaggctgatcttatttgctatcagttattttaatcaatgaattctgcatgaaaaaatctgttgaaaataagtatacatatatattttatttaaattaaaatttgacttactaataaatgtgaaaatgaaaggcctagattgattttgttcaaagaaagttttgaaagcaagtccttttgtaaaaaaaaaaaaaaataagaggacatagagttatatttttgtttaattattttcttccttcttttcattctgttaccaaagataaagctgatggcaaaaatctgaggaccctttggaatgcttctctccatctatcccagtgcccccactttttcctgccacattcccagaaaattctctacatatttataggttaagaggggaaaataactctccaagagctactttcaatgttactttggtgggcagtaactttataagtgctaatcagaagtatatgtcaaaaatttcaccttctgccttgtaaaagctgacttagcagaaacaaagatgaaattcagggcaagtcaaaattcttgtttcattgtcccatttttaaataagagatgaaatttaggacacctcaaaattctcttctgccctattttattgtatctatgtttattcatattcagcagaaggagtaccaattttagcctttggtttcttcattaaaaaaaaaatttttcctaaattaattactgtaatcttaaaattactatatctgtttaaagaaaataggaagattatataaactagtacagatatttaaaatggctcagagctccattggcaaaggaataaattctgtttttcaaaaactcttaaaatgttcctttgtgatatgctttatgttcatttaatttgttgtgatcataatacatgtttgcctttttatcatttaattttataccacaaacattttgatatttattataaccttcttg

SEQ ID NO: 36677 - DNA, 1879 bp, Bovine  19866880538158
gatgagatggttggatggcatactgactcatggacatgagtttgagtaagctccaggagttggtgatggacagggaggcctggtgtgctgcagtccatggggttgcaaagagttggagataactgagcaacgaactgaactgagatactcttagctaggaaaaaaaggtcatttagaaatcttaagaatgtttatctgagatgcttaaatgcttgtggcatgttttgaaatctttagtgatcatcatttcggcaacttgagttgaacgggatgcatagaagtctcacaaaattttaagagttttatacgggagaaagagaacacagtttggattacaaggggccaagatgactgaagtatcctgaggtcctctgagatttcaaatttgtgtggaaaagtataaacctgttcagttgtcactgcaagtatttcttcagaaggatccaaggagggtaaggaaagtggtgagatgtagcgccaagaaaaaaaatgagcagagccaggagccatggggaatagtatgaggagattaagtcttagggagaagaccccagagaatattctccactctgagcatgtgtgtttgggggtgtgcctaatgatcgacaatattttaccaataagtgttcaaaagtggtatggattagtgatgtgtgtagagattcttcctctcactttaagaagtggactgtgctttgtgtgacccttctacaaaacatataaccagacattttagtaatattaattcttaggtctctgaatcaaaatgagccacctccaggaaactacatccagatcagctgtatgtatcataagatcttgtacttgtagcctggtattgtaattacaagacacattggggtgtttatggaggggtaaacatattttgtgtgtcaaagagatacaaataatttggaccttgatcagatcacagtaaattgattgcagtaatgggctataaataaatgacagtatgcctatttcagcatccttttccctgaaactttctgggttttgctcactctgcctctcgctggccttacatatgtaacactgtggagactaagcccacagaagtttgcatactctgcttgttctcagtcaatgggttgactggcttttggcgtcttgcctccacgataggaacaaggccaagtcactcttggaggatgagtgaccacatggaggcagctgggggtttccagaccccagccagtcagccattgggcagttttgcctaattaaccaagagctgaacaccaatctatgaggcaacttagtcaagattgggaaaccatatttctggacacataaattgtttatgcatggaatttgaccttaatggattgttatgattttaatactctatgttgtagggtggtttatttcacagcagtagtaactaactcaactctgcaactgtggatttcttattcaaaactcacatgacttcagtcttttaatctgtaatttgtgtatgttaaatcaactttagatggtaatcatgttactaaattaactcaaactatatagaacatagtaggagttcagtaaacattttaattgaacaaataaatggttattatttaataaacattttacaaaaattgcactgcaaatgctatgtagttagggtcattgagatatattgtttcctccattcccctacattgagggtaagaaaatgcctttgggttctctcaaaatagatgattctgcctctgtaatgggtacctgtaggactcattaaagaatgatgccatattaggagtcaccgtggtttgggaaaatccaggaaacattttctattgtgataaagataaaagagccttttctggcaaaaggtagcagctaagtgcttgtaaaaataacaaagcag

SEQ ID NO: 36678 - DNA, 996 bp, Bovine  19866880581352
taaaaaatctgttcaatttaaattgcaatacatggcatcttgcttactaactcaatttcttgtaaacccatgtgaaaaataaatttgacagactgttttgtattgagtcagatttccttagcgttaagccagtctcctgggaatgtataaaaatgcaaaataaatggactgtggcaccacagatcttgccaatatgattgccacagctatcagaatatcagcatgcagtgtggctcaggaactccacaggacgatctggacatcagttgttcagcaccctccccccacccacaagcagagcagacaagccctgttggatggtgattttttataatgacttcatttatcctaacccccttttcccactttctacagtgttgtcagaatgatcttccaaaacatggacaagtacaatgtatctgtttaaagctattctattaatacaaccttccaagagtttgggaaaaaaacacagttccttacttcttcataatttggtccctgcctacctttcatcggcttcccaggtggctcagtgggtaaagaatccacctgcaatgcaggagacacaagagatgcgggttcaattcctgggtcaggaagatcccctggaagaggacacagcaacccacgccagttcttacctggagaatcccatggacaagaggagcctgacgagctacagtcacagagtcgcaaagagtcagatgctactgaggcgactggacacgcacacactacttttcatctcatttcttggtatgcgtcctggaattatccatgagttgtgctcttaccctaaggaacactttttaatttctaaagtttactctttctcttgcacctctctttccttgtacaaatctctcagctgcaaaaatccttctgtattgtaaatttagtcaaatgtcagatttttttttttgatgcctcaacctccccacaaacaatctgtgagcatcatggccaggagaccaggtgcaccagtttgataag

SEQ ID NO: 36679 - DNA, 2251 bp, Bovine  19866880665289
gttaatttgaggaatttttaactcctccatccctatgaccttgactatggccttgaatgccttctttaaaacagctatggaatatgtctgattttcttttaagtaggttaataaccttgagcattcccagactcagtagcagagagaagatcattctaaattttaaattcttatgctaaataatttttaaggataaaaacttatagttccttaaaattgtgaactattttcataatagcaatagacaaagtcatgaatattagttgatatagttgaaataaagacaacttcagagatatccaagaaagttataggcaactctttacttaaatttcacaaaattaacctttgcccatattgactaaatgattagcctgacttttgtaaactatagagatcccaattctcagatacttatatcagaagaacaagatttattttttttgtttttaatttgtattttgattgaggatcatacagtggattttacagttaattcaataactctgattccagtttcaatcagtaccactgccatgaatatctcatattcaagttttattctaagcattcctagtattggcaacttctagaattatagctggtggttaagttttaaaacttcacctgacagtcccaagaatcagttattattactacaatacagagcaggtgatatcaagtgtgtggtttcttcacaacccatacaccgtcatatcaaaatctagggataccatcagagaacagcaaataatgataggtgcattacagcaactgaagattgataaggtctaaaaagtaaagctagagatagagactttctataggtcagaactgagggaagaaccagaaaacaggaactctagaaatagcttaagtcaagttgaggacaaagcacagtaagtagtagaagttattagattagaaatcaatgtagtttgtcaaaagtgaagtgaaccataaaaagataaacagaaaaacattgaaaacaataggaccttaaaacagtcaagttccaggactttcttgatagtccagtggttaagacttcagctttcaatgcagaggatccatggctgggaagctaagatctcatatactttgtggccaagaaccaaaaaaaaaaaaaaaaaaaatcaaacagaagaaatattgacttaaaaaaattggtccacatcaaaaacaaacaaacaaacaaacaaaaaccagtcaagttctgcctttgccagacttttatatggattctagttgatgaaagccagtgtcagagcttgtacataaggatagttaaactctactggaaaggtggtaagttcattgataagattagatagggaagtatgagcctagagctaaagttaagttctgatgaaaagactgacaaatttttctttgatgagtctttttttgaaaactactagtaagtaccagcagtattttgggcatagaagcattaaaattagttttaaaataggtcctaaaacataagagttaatagtctacttgaggagaagtcatggcagtaatttgcttttagagagagacttttgtgatcctatttttattttggaatactcaagacctatgataggggatgagtttgtcatgcatctgggtaaagaatgaagtaataatagtgttggctagaactaataaggggagaaggcaagggcaccccattccagtactcttgcctggaaaatcccatggatggaggagcctggaaggctgcagtgcaaggggtcacgaagagtcggacacaactgagagacttcactttcacttttcactttcatgcactggagaaggaaatggcaacccactccagtgttcttgcctggagaatcccagggactgcagagcctggtgggctgccatctatggggttgcacagagtcagaaacaactgaagtgagttagcagcagcagcagaactaataagcctttaaatgaaggcatgtcagatttgtgtgtgtgtgtgtgtgtgtgcatatgtgtatgtgtgtgtgagagtgatttgagaattattacggggttaaattcataaaatagagaggaaaaaaagaattacatcatgtttaaactatctaaaaacagctgagagtatacctaaaataaggggcaaaagaagaaggtgactaactttcttttatgtcagagggggaagaggaagagttccaagcagctgaagttttaatgactaaattacctgtcatcttttttaagtgtcagaaagaggacaagccaatca

SEQ ID NO: 36680 - DNA, 1904 bp, Bovine  19866880740932
gaaaagttatgaccaacctagatagcatattgaaaagcagagatattactttgccaacaaaggtccatctagtcaaggctatggtttttccaatagtcatgtatggatgtgagagttggactataaagaaagctgagcaccaaagacttgatgccttttgaactgtggtgttggagaagactcttgagagtcccttggactgcaagaagatccaactagtccatcctaaaggagatcagtcccgagtgttcattggaaggactaatgttgaagctgaaactccaatactttggccacctgataagaagagctgactcattcaaaagaccctgatgctgggaaagattgaaggtgggagaaggggacaacagaggatgagatggttggatggcatcactgactcaatggacatgggcttgggtggattccaggagttggtgatggacagggaggccttgcatgctgcagtccatggggtcacaaagagtcggacacgactgagtgactgaactgaactgaatggttaaaaattcccaaacttgggaaagatataaatcttttatagattgaagaagctgggaaaatatcccaactaggacaaatctaaagaaatacacatcaagacacctaatagttacatttcttaaagctaaagacaaagaatatgtcttcaaagcagtgagagaaaaacaatgccttacttaacaagggaaaagcaatttgaatgactgcagatttctcatcagaaatcatgggaggatgtttctgtcacacaatcagttagctcattcactgttaacacaaagcattgtgtttgaacccacccggggatacccccttgacagaaaccatggaggccagaagaaagtggcacagtttttcaagtactgaaagaaaaggactctcaacccagaattctatatgcagtgaaaatattcattaggaataaagtggaaatcagaacagtttcagatgaaggaaaactaagagaatttgttgctggtatcacctgaaaagaatggctccagaaagttctcaaaacggaaatgaaactttaaaaggagacattttagaacatcaggaaaggcaggaagaacaacagaaagaatgaaaatatggttaaatacaattttccttctcctcttaggtcttctaaagtctgttcgacagttaaaggaattaaggtaggaatactgtctaatgtgattctaaacatatacacatgaaaatattaagacaattataaataagggagggtaaacagacataaaaggagataaagtttctatacttcacttaaactggtaaaacatgataagttctacctatataatgtaataactagagcaaccattaagaaagctatacagagacatacagtggaaaatattatagataaattaaaatggaattcttgaaaaattataggaaagcagaaaaaaataaaacagaaaaataaaaagcagaagacaaaaaacagaaaagcagactcaagccctaatacagttgacccttgaacaatatgggtttgaactgcatagttccacttgtatgtggatcttttccaagagtaaatactagagtactgcatcacctgtactggtttaatccatgtatatagaacctcataaacacagaactacaaatgcgaagggccaactgcaaggtacatgtggattttcagctgcatggagcgtcagtgctccgaccctcatgttgtccaaagggtcaacctatatcagtgattagatttaatgtaaatggcctaaatatattaaaagattggtagagactgttatagtagatcaagggaagatcactacactgtatacctataatacacaaataaatttaaaaaaatgatgacccacctatatatgctattagaaactcacttctacatg

SEQ ID NO: 36681 - DNA, 3395 bp, Bovine  19866880743909
ttctgaatcccgggatccagtccatgcattgaaacttaacaactgtaggctttttaaccataagaatattagtttcttgtttatccagtgaactcatacccatgttttgattgttatcttattctcccatccccatttttcctagttcttttctatttatgtgaagaaacaaaagaaatagtaacagaaaatcactaggggaaagtagaatgtttttgaatagaccaaggaggagccctggtttaaggataatctagtccttttcagttcatgtcatactgacagttctcttgttcagtgtcttgcagggacacagataatatcacagcatgccatggagacaaagaactgaagggccaaaacagccctcggaaagaggttgagttattgattttttttttttaagtcacatttctgtgaaaatggagaagttgggcttctaagaggaaagatgctttccgttttatccctccttgatttccaaacactaagaaagaactcagccatgtgatatgtatttcaaacaaattttatgcagacatgcaacctagtggtagcaataagactagaacccacttcttcttacttgaagtctgatgttctttatgattttgcttatttgttcttaagagtgcattaaataggattccaataagttgtgggaaaaatggtttccgtgggaaaatgttattcttcaatgtcacaccttcatttggggcaatctccgagagctgctgtggaatagagtggtacttgacaagacattagaaggggaagtaggaagcagaagaggacaattttccaagctagaacaccttcctttcctgccaaccagaagggaagtgattatagctgcttcaacaggaagtgccctgaataatcagaaagggttgggctgggatccctgctcactccagatgtccttctcctctccatagcactctcagaatgaacaacctttaaaaagattggaacaatgctcttatccaatcactacttgaagacaagctaaacactgcatgtttttcattcatgcctatatatggtaaccagtttcaatcaggtaactatatgatcgacagaaaacacacgcacataaacacacacacacacatttcctaagctcttatctaaagataatcatgactgtatttttatatttcctctaggatttatgactaaattatgaagtaggtaggaaatggatacccactccagtattcttgcctggagaatccaatggacagaggagcctggtaggatacaatctattgggatgcaaagagtcagaccggactgagtgactcagcatgtacaattatactttatacatatacacatacaaacacacacacacatgcacaaacatatagatgtgtgtatacataaagctaagattatttcatacagttaattaggacaggaccagaattccaactcaaatttttctgcctcccattctgtttttgtcttctctacaccatgatgttttctcttcagaaacagattgtatattgctatttcaaaattgcagtatacctgtattctgtgctatattagagtaaaatggaaaaaggatcatgatttaaatataggcttgaacactggctatgccagaaagttataatgtaaacatattaatgagaactgaaatcacccaatacatatcaggaatatatatcaggaatccctcatctagtttttcattttccatatttctacttctacacccctagagtcacttcaccttgttagtttttcactggtctgtacaattgtacaatttcttatatgcagataatcatatcatgcatgaggtatgagatatcatgcaagtcctcttcttatccttcctccttcatgtttgacttgatagagttaattgtattttatttgcaattctgttgtgatttctgttttattttaaaagtaagcatgctaacttgaatttattagactaaatgaagaaaatattggctccactttagtcattgctatcacaagattgtgaatgacagatcttagacaccagaatcaataatttcctgctcttatgtaattttccttccattagctccctcagtgggtatcagaggcctgataataattgttaaatcaaatccttcacataggacagaacaagagaagaaacattgaaaacagatgaggaagaaagatgtctccccattagaagtgcacttatattttattgacagagaaggaacctgctaattggatgtaaagatgggtcttgttccaggtaattttatttttaagaagtattgtggagtcataagagaagatggtgtgtttgagaaatagtgctcagtgacattggaacatatgtcaggaggaaagaggtggagcttgtggcagcatttggggtagatacaaaacagatattaagaaactcagatagtctggaaaccatagctcactaatgttggttcatctttggaatgtgtgcatgctcagtcattcagtcatgtccgactctttgcgatcccatggactgtagccctccaggcttctctgtccatgggatttccctccaggggatcttcctaacccaggggtggaacctgcatctgctacatctcctacattggcagactgattttttacccactgagccacctgggaagccccatcattggaataatctgcaacatcttgaaaaaaaatagatttctagcatttgctctttgaatttatgtttttgcagatgcgactgaggccaaacatacacacacacacacacacacacgtaaacacatacatgtaagtatatttgtgtggatatgtacagcacatgtaacacatgggcttcccaggtggagccagtggtaaagaacctgcctgccaatgcaagagatgtaagagatgcaggttcaatccctgggttgaaaagatcccctagaggagagcatggaaacccactccagtattcttgcttggaaaatcccatggatagatgagcctggcaggctacagtccaataaggcttcagatttggacacgactggagcgacttagcacatataacacatatatatcaaataatatatacaaatatatacacacacttttcttcgaatgtgttagtcgctcagtcgtgcctgactctttgtgaccccatggactgtagccaaccaggctcctctgtccatggaattctccaggcaagaactgcagtgggttgccatccccttctccaggggatcttcccaacccagagatcaaacccgggtctcctgcattgcaggcatattctttaccgactgagccaccagggaagtttcttcaagtacccagggatcactgttaccagccaggtttctatactgctaatgtacatatttagagaacctcaaagaatcctgtgtcagagggag

SEQ ID NO: 36682 - DNA, 720 bp, Bovine  19866880760741
gttctctatgattgcaatctacttcctgattttgatttgctagccagactcatcttattcacaaatatttggaggtatgaatgtgtcacctcagcttccctggtgtgtcagacagtaaaaaatccacccagaacgggggacctggatttgatccttgggttgggaagatcccctagaggaaagtatggcaacccactccagtattcttgcctggaaactccccatggacagaggagcccggcaggctacagttcattgggtagcaaagagtcggacatgactaagcaactaagcatagcatagtgcatctagaagaagaaattctccttgataagatatttctattccttttatgtattctttccacaaacagttcaaaacaaattaaacattgaagtaaagtgcaggcatttaatcaatcttaacacccatttatcgctgcttaagctacaaagcaatagagattatccctttaatatttaatacattcataaatctgctacagaaaatctgtccctttctgtgtctgtacttcttcccctatggtttattgcttttcagaagtttcttgtagtaaagttccacaagactaaatcatttttgagcaaaagaacagccatgttataattgcaagtaagccagattacaacatattattgaactttggtcaacatgaaccactattattagcacatatctattgcatatctatatttcttg

SEQ ID NO: 36683 - DNA, 1082 bp, Bovine  19866880766774
caaagaaatctacaactggcaaagaattcttttctcctgggataagggactcccttccatgttggctctaatatctgccctaaggatcagaattgctcttctgagggaagtggaaattagttgttgcttttcaagactgagatttataaaatacattctggctggtcaccagaaaatgaaaattttgcaaatcttggaaagtttgaagctgctaaaggaggcataagcaatctgttccttcagcaggattttattcagatcagttccacaggaaacctacaggatataataagaaaaaggacagagaggagcagattcacgggaatacaaactcacaaagcacccaacatggaagtcttacatgatagatgtgctttttaagtcaaagggccatggccccatctaatctattcaactaattgctgatctatttttgcttcctctggcattgtgaaatataagctagtagtctttcctgcctcatctccactcaccccttccatatgtctactctctgatcaaaacaggtgacattttcccaaaggcccctctgatttacccttctgtttcctcactccagtatctctgtttagattcccggttatatgcttgttggttaagtacaacccagaacttactgcttagatgccatttcttttgtagctaccctcgactatctgtcaatcagtcttctcaaaagaactgcctgtacacgctgtctccgtttgcttatgtccttgtcacttcaatccacttggatatggctttgccatactgtaccactaaatgtgtccttacaaagtcagtaaagtgtccatgctgcccaatgaatggctttctctgtcctcatcatactagacttttcagtagttttcaaaagagtgaaccatagcttcattttaaaaaaataaaaaattatttatgtatttatttgactgcaccagttcttagttgtggcatgcaggatcttccgtctttagttgcagtgcatgggatctagttccctgaccaggacagaacctgggccccctgcattaggagcacagagtcttagctactgggcccccagagaagtccttaaa

SEQ ID NO: 36684 - DNA, 1996 bp, Bovine  19866880767643
catggactttacagtccatgaaattctccaggccagaatactggagtgggtagcctttcccttctccaaaggatcttcccaacccagggatagaacccaggtctcctgcattgcaggcagattctttaccaactgagtgacaagggaagccccattttgttgttattaacaacaacaataaattctgaaatggtttctatctgctccttcaatttctgactctgaattccaaactcttgatttgagccaaatcaagggccagaataagcaagcatgcctcaggaattttcaaacaccaactatttgaaatataattttatttgccataaggaaaggataccacactgtaaagcagtagtggtattccagatgagcaaagacactagtgatgagagatttaatcttgtgtttcaggaaaagatatttatgttttcacagacagcttttaaataatttaataaacaactaatgccttaaaacacagagtctgggatctgccaaatgaagtttggctctattctcagacttgccttttgttacctacgtgatcacagaaaaattacttaatctctaggctccagttgcatcatttaagcaataggtatgatcatagcatctacttgaatatggctgtaagaattaaagaagcaaaagcatacaaaagatttagtatagtgtgttaacaaaatgaccccttatagatattactatttatattatcatcatcattgttgctgttaaggcattcagatttggctaaagttggatttatatgggattgtatcacctgattgtattccatttgtatgaattacacttttttgtccatggcattgttgagggtcactttttgactttttattatagaaggaactttttacagatgtcttgattattttgattgattcaagatcatgacacaaaggagagttcctgtagttgtcagtcattgaacaatgccagtcagtcatccttctagtatcttaaatcttaaaagaaaaaaaaatgaacttttctctttcagggttctgtgaaattcacttgacatctcaaaagctgagaaaatttgtcttttcttccctctccatttcaaacataaaattaatgactttgcagccaaactgataagagcactatcatttaatgtctcagatgaaataagggatgagggggtgggagtggggacaggggcacttgtggattctcaggctcctaaatcgcaaagctcttaatacatggctttaccttgtcaagaatttcagtgcctcaagctggaatactgacacacctcaaggtagatctcacttgttctcacataatcaaaagcatttggtgccataatgtgtaaatgagattggcacccaggagttgcccctgtgaaaatgtcctccagacagactgttccagcagcctggtgatcccgtccctgctaatgatgtggttgtccccagcctgccgctgaaggcagtcctctccaaggtcactcagcagtgtattttgtttcttgtgtgtttactatttactgtagcttttaagcacagaccaattatagttactggaatgcccatgtctttctaaggttacctaacagaagctgctaaatatccttttgcaaagccaagggaaggtgggtgaatcttaccacaagtaaggaatctattggagaccagattcagggttgtctttgtttttctgcctcaaggtactgtaaaagcgggaaaattgtggattgtcctccttattcttctctcctctttctttctccccttcccttatctctcctcttttcttctttgttgaaattatcaatggcattaagtgagattctgtatgcgataacacctagcatgcaaaatatactgaatgaataattaataaactgtcctaaagaaaagctcaactcacatatcactatgtactctgatcaattagttctcaccatagaaattcttctctgttttacacatacatattttttccttctttattttctttt

SEQ ID NO: 36685 - DNA, 1023 bp, Bovine  19866880767644
ttggtaaagaatctgcctgcaatgcaggagacctgggttctatccctgggttgggaagatcctttggagaagggaaaggctacccactccagtattctggcctggagaatttcatggactgtaaaagtccatggggttgcaaagagttaatatactagttacatttttaaaagtgagtacagttacctcagttacagatgacagaccaaatatttctgattccagtatttctactgtacccattctgtgcttaaaaaacagaagtgggagctagagattgcatgtcggttttcaataactgattccaatagaaatttagcagctgataaaagggaggaaaggggtttttaccacagattttaaatcccaaactactactttatatctttcaggtaatttgggaatgagtctgtggatatattgaatgttcagcatcttacaaatgattcatatacagtaaaccactagggaaactcaataattgctgaatagaatgagaactatgtttccaatttaggagaacaggaaaactacagtagaaaaggcatgtaaaataataaaagaaaatcttcatagggttatattcctgcattaaaaaacaaaaggcaaacaaaccaaaaaacaaaccccaaaaaataggctcagctccctctaggccatccatgtgtgtattgcttcggtcggcagactttgctaggaattcccagttctgacggggatgcaatgagtgattgcctctgtccacaaacacttttagactgccatccagggtccagatgtcaaaaagggcttgatcaggggagaaatccactgttttagtgtaacttctgcctcctgttactgaaaatgaaaacattctctttttgtgcatgagataggggattttaaaaagtaaatgaggttgtaacataaatattactattttctttcttaaaaacaagagcaattctcagtgaggaaaactcagccagacatatcctaaagctaattaaaattatgtcaggaaataaactaattaggaca

SEQ ID NO: 36686 - DNA, 1189 bp, Bovine  19866880835257
tacttactggatacgtagaaaagtttcccaaactactctgtcttagtcttatcagctcagacgcattgggcaccagagaggatgaattgtcagcctctgtgctgtgtgctttatgtgctaggtttccaaatataatagttggtagtttcaatatgtatgtcttatagcactgggataaactagagaaaggttagaatccttgtcccactctacctacctcagcctggataggatcataggatacaccaatctgtgaatacaactgagttgatattatttactccaatttatgggaaacttacttttatataaatcttttcttttaaaagaggggcttaatcctttgggttcttcttagatggcacatcttaaatgcatttcctttctgcatttcctaaacgcattgaatcaggtttgcgtcctggtacttctcatgcaagtgaacatttccggtgactcaaacaagacatctcagtgtcagttaggaccaattatggtctaacagcagttaagtgtaggtttcttaatgaagtggaactgtttctcctgtgcattaagtgccaagtgaaatggctgttggctaacctcaagttaatgaagtagttccacagtatcacctatgtgctaataatgtaggcatgtcagggaaaaacagagaggtcttaaatgaacatagaatgccatcaataagttaggttgaatggatgccttcctgagaatttagtttcacataaagcaggaggtcataagctcacgtggtcctatagtctggaaagatgtttgtgatgggagcttgcattagaaggtgctttcagaagcttattttctgcaaaccacaagtttgacaggacttttacatcatctattaagggtcattgggaagaaaaaagaagacatcaaagagtagttaaatcaactaaatttctgcaattgcccttgaataaaaacatagactattgtgccaactcttctaaaaatggttatgttcagtatttatcaatgacctctgggtatgtctatgagctaatagagctttccttcagaatacacttgacacttgcaaagtctaaatgatgtcaaagaagcaatacaaatatatcataaaaggctatcatcctatcgggtgaaataacctctacaggaaagaaaaactactcaaatgcaaccattcatcacgagctctctcctc

SEQ ID NO: 36687 - DNA, 1570 bp, Bovine  19866880839294
tcttttgaagtttgagtcaatctttgtctttacttgagaaaagcataaggccaactaaatgggaaacatattttggatagatagattacttacttttggtttattatgtatcaatttaaaataatataacattattatgagtcaaaaggaaaccaatgcaaaattattcaaaccttgtacatttctagctagccaagtgttacatggacaacattttatcaactcagcttatgttaaaatctcttcccctttcttttttgattcctcttacattgtttctctcagaggtgggagtctagagacatttcatctggttttctgtattaatcttactctggcagaacctccacacaggtattgcaacgtacctacagtatgctttcacaaaggtgtacctattgcaaaaaaaaaaactaccaaggaagacttcatgtaaaacactgcctgtagagcatgaccagtggttccttttccttggatggttgtctatcctctcataattgtttatgtgcagacagttttatgtcaatcctctgattggattatgtcaattcaccatacaggtcagagagcacaagaaacctcctgccacaatctttatataatagagtctgtacctcttcacagactgctgaaataggataaaaggatttgcttttcatcataggaaaaattaaattttaattgcctgttaaaacacaaatgtcaaaagcaaatcataaaggcaaggttgcagtcctctcatacatcatgcttgagacctatttgcatgcaaatgaattcctttcttaattttaagtgtgccttttcacagacaatattaaccatttattttaaaacattatacagtgataaacctgactctgtgtatgtgtgtgtgcagcaaagacaatcaacattttttaaaatataaaacttctttcatatatgtatttcatatatgtattgagcaacagcagataattacttcagatgaatgtgactcttttcagctgaagagtaaaatcatacactatgggtaaatcagatctcaaagttatttcagccttaagttattgccctgcccaaacattattatgtttctgatataccttatctcccttgctattcctattagagtatcgtttttttggaaatgacaaggtgattttgtaggcagaagttgtggtctgctaggttctgtttggaaacacatgagagtgaagaataagagatgtattcttaagaccttagcaatgctgatgtgaacataattatttagtttcatttaattatcattcaaatatggcatgtaattgtgaaacttatggaactatgaaagtggaaatttataatgatgcaggcttaatttcattaatttaatgcataaagcacatattacacagagacagacgtcaaattaaaaactctcagactctaattagctttagaaatctcttatgtctaattgattggctgtcataattaatttaaatagtgatttcaacctggctatgatgcagacaagtcattcattaataatctttaagggaaaaatataagatacagacatatctatatatatatatgt

SEQ ID NO: 36688 - DNA, 935 bp, Bovine  19866880846209
agttctacacagatgataatctttgagcacttaaagcacaaactagcagctgactcatgttgaatgaattcaagctaattcaagtaagtaaatttttaaataaaattaaatatttattgacattttataaatttattgacattttataaatctgcttaactatttaaaaaaatttttttttgtaagaagacatgcatgtccagttagcactttagaaacgataacagatgccttacgtcagaatcaattttagcaatttgatttgggaaagagtatctttctttgtctatagatagatagatacagatatccatgatacactgataagttcatgtatatgtacacacacacacacacacatatgttttcaaagttttaaaagaaaaaaatgtggagcactatgttggaaaaaagttgttaatgttctaagactttattttcaggctacaaagttcaaagaaaacttgtaatgaaccctggtcagggctcctctatgaacaccttgtgtcattttgggtttattcctgctttaggtatttgatagagagatacatcactcagaagttgactcaagaatcatacccattccttcgattagtttatgagttattcaggaccttggaacagaattattaattatttcattaaatattaaaacttgatttttacttatgagttttatcagccttcaagttaatgtttacgttgaagccatgaagatttttaaaaatctcatggtttcctgacttactgaagaggaactcaggcaggaatcatttgaagattcgcagagattgtctctggaaaaactgctttcctgctactaacattttcaagctttgttttttccatgccttctctgactttggcttaaaaatcttttttttttttttttcctccctttggagattcttcttggttacctctgctttttt

SEQ ID NO: 36689 - DNA, 1138 bp, Bovine  19866880906331
cttccggatctgcctccagcttccccacaagtaaacatatgcatataccaaagtgctaatgagatagtgagcttggccctccggagagtacttcaggttttaacccacttgacatggtaatgggatcaagcttactgtcttaattgaatgtactttcactttgcaataattagcccttcacatattccagtaaacttaaaaagcttcagtaaagatatctcaaatactcatataagtagagtgttcttttcattggatttcatcaagactcttgtgtttatagatgcatttggcaaagcatagattttatttttggacttgttttccaatgctctttctcctaatatttactgtgtgatcttgagtaaggcagcactgttctaattacaagatggtaataatcttatctataatgagtttctctataggagattcactggcatagagttgacactcaatccatcgtggcttttttggttttgttttgttctttctatattctcctgagttctaacatatcacgcttcagtaagatataaaatatatgcatagctggtagaaagacactttcaagatacagtttcattgatacatatcatttccacatgtacaagaaaatagttttaaccaagcagttgcaaagggcatgtgggtggtgcttatcagtggcggttcatctagtgggaatatggtttttatagcatgtctagtagtgattgctgtagcccaccaacataatctgcttcactggtgtttacctgagacagcagaattttttatgtctctcagtatcctgaatattgcaaaagaaatcttccatattttgcatttttgttttactaccatgattcagaaattccatgtttagggtttcattggaaagagctcagtgtatttcacctggttaaggttcttgaaatcgcctcaaactgatgaaccctatggattccctgtgttcaacagaaacaccatttggccagtcacacacaaaaatatcttcatattttttccaaagacaaaaataataatgaataggtgaataatttatttctagtttacttcattaccccttgcaaacctgtccttaacatttcatcactatgattaccaagggggtgctctgggcctcttttcttat

SEQ ID NO: 36690 - DNA, 2116 bp, Bovine  19866880917915
tggagaatgactctaactgagtggtatttcagtgtaatttatagctctctattgtaaacacaaatatgggttatatcttagcactggaaagaatgctaatggccagtcttgggtcactattattttggatgaaattagtaccagaacacttaaggaatttagatgggtacactgaatggagatgaaaggaagaacaaaaaaacaagcaaacacacacccagaaggaaaaaccggaagattaagttccagttttctttgggcattaattagttttgtattcataaacttcacagggagctagaaggaatgtataaagtaagctataattcaaacttattagcaaagttgtagaaaacagcggccagaattgtgatacttttaaaaatacaataaaccctaaaatatccctgattcctttgaacgacccaaaactactaaatatttcaattattgcacttccctagtgaaccagtggttaagaatctgcctgtagcggatgctggatccatccctggaatgggaagattccacgtgcctcagggaactaagcccgtgggtgctacaactgctgaccccacggcagcaacaatagaagccacagcaatgagaagcccacacagggcaacgagagaaagcccactggcatcagtggaagacccacccagtgcagccaaaaaaataaataaatgaactaaaataacattaaaaaaattccaattcgccccaaattcagctataatttgaacagccaaacaagaacagccaaaacaatcatgaaaaacaaattcaagggcttctagtacctgattttaagacctttcctaacagcatggtaattcagaaagcatgggcggcagaggtagacccctgctccactccagcatgcttatctttctgtggtttctcttcgctcctggagtagcttggctcccgacactgggacccgtatctctgccgctagccttgggtccacttgccctacccctccccacagtgcttagtacgcagatggggcaccctgcccatctctgcaaaataagcatggtacctgtttaggaatacaccatcaggatcacttgatttgcaacaaagtcaccaacttagtacgaagtggaaagcaaagtcttaccaataaatgataccaaactgctgttgagtataaaactaagtgcaacatttctggctcataaaatatgattaactcaacatactatcaatttaaccaactgttaataccaggagtatccgtaatgcctcccccatcattgccaacatttggtattgtcagcctcagtcctctggccttttgggtagggggcaggtgtatcacgctgtgatttccataaacttttcctaatgaggctgatcacctttcccgggctcattagccctttggatctccacttgtgtgaagtgctgtcaagtattatacccatttttctattgggtcgttcatcatttccttagggattcatcagaattattttatgtattctgaatgtgaaatatttaatgtgaccattgtccctcactctatcgaaatgtttggtcattctgacaatggaaatacagaaaagaggccagggttagcatgagaaacacgacaatgactgataatagtctgcagagcaatggcgggggggaatagattgagaaaaacaaacggctatctggttttctcgctttgcagaaatacctgcctacagttttgttgtcagagctgcttcaggtctttgctcacagccctccaaaccccacctttagctagagttaacacaaatctttaaagggtaaagaggtaagaaaggaagcaacaaacaacaaaaaccagctggcatcaagatggcaatggagctgacctccaacagaccctgagtctcattgtaagttctttctaccatattagcatattggatgtcacctaccagctgctgttactagatactaaggaccaaaacacagaaagtgggtggcaccctactccctggaaaaagccctgtcccttccccaaagaccagtgcgtaagcctacccattattgctcggtcactcagttgtgtccagctctttgagacccccatggactgaagccaaccagactcctttgtccatggaat

SEQ ID NO: 36691 - DNA, 1452 bp, Bovine  19866881096338
aaaaaatcaaggtcttggagagatgacgttccctaagttattttaaaggcaagaagttgaactacaatccagacagtgagtaaaatcttgttgacagaatttctgctgacccgttcttgccctggcacctggcgggtgagagagcacttgaaaatagcaatcagcgacccatttcctcacttctcagtggactcgagatactaattgcctgctagtcccacccaccctgcctagatcctctctccaaaggctcttttcattatacgtgttgtttatgaccaagccaaggtgtcatatttagaaatagaaaaagaagaatcaccccactcccagcactgcctgaagctttgttgagtggttaaacaatgaacaagagaaattgttgctgttaaaaattaaaaaaaaaaaacaaacagtggcttggaatttcaagacagcatttccatttgaatccatgaataatgtagttatggtaatatagctgctattcataattatgaacacttcattcctccacatgttctcatgtcacacagagcaggctggtgagatctggtctgcttctgattgtttttgctgtgttttgcattataaattatactctgctccaccctgactaccccaactatatggcggccgttggtgacattatagtcaacagcagcatgtctcctaacctcccctgtaggactgaatatgtcttgtaagttggaggttagaatttaatttcaatcaagaattagatctagtgtgccatcaaccatttgaaagataaaaagaaattttactgtgaaattatacatcatggttatttccttatatggatttttccaaagccctgagagaaattctagctatttagtagtcacatagtttgtataattttgtaacataataggaaagatcatggagcttgatatcagtcacattttgctataaatcttctacttagtagaacttgatacaatactgttgattttttttgtgagaattaaatgtcacgactcttaaatgttcttagcacataacaagcactaagtaatcaatgagtaatagtgtttgtaaccaacttaaaaatttatgattagaaataataactatcttacagcaactttgtgagtttgagtttaatgttttcttaaatctaaaactcaagaatttgcattttaatttttctacaattactctttgttttaaagtcagttcacacatttgacatcattgttcctttctgcccctgaaaactgggtaaattgatgatatgtattttctttaaatgctgtatttgaatttccagactcttcttttttttttttttttttttaattttattttatttttaaactttacataattgtattagttttgccaaacatcaaaatgaatccaccacaggtatacattgtgttccccatcctgaacccttctccctcctccctccccataccatcc

SEQ ID NO: 36692 - DNA, 847 bp, Bovine  19866881218073
aatgtttctgtacttccttcattgctctgttattttccataatgagacagagtttcagagtgtagcctctatgccctgcagatgacattcacttaccccaggtctcaagcttaacattttataaattaccacttcaaaagcaagagtcaccatctatatgcaatgggacagaggtgagtgtcatgtgacatcaaaccctatcattttcttattgtcccatttcagattttattaacaagtctgattttctttgcagggtcaagggctttattcaatcagaaaagcaaagtcatccaaaaataatgttttactatttcttttatctgctcaagaattttctttgactgtctagaacctagtacgttaattctgaatgcaacttcattgcatccaatactcataccagcttgtcacccactgcatttcaaccttgcgcactattttaatcatatcttcacacatttctgtacaaaagatcatcctgtccccatgcttccctgttgcactctccatctcctatcctcaagtgtctttcaatcaatgtcattcattcattcattcatccatttattcattcattaaaaccttataatttcattcatactttttcccaagctatacatgaatcatggaaataaataaaatattaatcatggaataaataaatatagaaagaagaataaataaagtaaagtaaaatcatgggaataaattatgactcattctcaagttcactgggaggcaggcctctacttcaataaaaaaacatcaacactggtttttagagttgaacaggaatatgcctaataagtaactgagagtgtaaatttagtagagagagggacaa

SEQ ID NO: 36693 - DNA, 1563 bp, Bovine  19866881219196
atttccaaatgattctttgatctctagagttacgtcttagaccccagtttctgtttagtgtatctgcttctgaattgatatgtaggcaacaagcccctcagacacaaaaggcagctgcaattctcagctggatgccctgcttcttactcaggctgcaggtggtgaaggttctcacctggagcacactcaggtgaacatctgccatggcatgtcagaactaagggggacacatctcctgctgttctcatctcaacatgatagcatgagatgaagcagcctattttacacctaaatgaggtggatacttacaatcttgagccaccagagtattactttgttttttcctttttccattttacctgatgagattttataaatatagttagtcttcattagtgggttggtggtggtatcttatattaaccatacagcatggtgtacttttagtgaggctttcactcagagaaaaataccatgggttcaagttctagtaggttgttgttgttgtttagttgtgactgactcttttgtgaccccatgggctgcagcccattaggctcctctgtccatgggattttccaagtaagaacactggagtgggttgcaattctcttctccaggggatcttccagacccagagatcgaaccagcgtctactgcactggcaggcagattctttaccactgagccaccaaagaattgcatgctggaaacagaggcaacttgttaaaattgatttccttactaacagaagaagactcaagttcctaccagtctcaaagagttattttgtgcaactgatgagatctcctcattcattcacttaatagttacttgctgagaatgtctgtcaggaaattcactaggttgaggtaaaaatactgggttggccaaaaatgttgttcaggttttttatacgatgttctggaaaaacctcaatgaactttttgaccaacctaaatttattttcttgggctccaaaatcactgcagccatgaaattaaaaggcatttgttccttggaagaaaagctatgaccaacctagacagcatattaaaaaacagagacattatttgctgaaaaaggtccatctactcaaagctatgatttccagtagtcatatacggatgtgagagttggactatcaagaaagctgagtgccaaagaactgtggtgttggagaagattcttgagagtcccttggattgcaaggaggtccaaccagtcagtcctaaaggaaatcagtcctgaatattcattggaaggactgatgctgaagctgaagctctaatactttggctacctgatccaaagaactgactcactggcaaacaccctgattctgggaaagactgaagtcaaaaggagaagaggatgacagaggatgagatggttggatggcatcaccgacttgatggacatgagtttgagcaagctctgggagttggtgatggacagggaagcctctcatgcttcagtccatggcgttgcagagtcaaatatgactgagcgactgaactgaactgagctgaataataactaatacctctgtagtactgggta

SEQ ID NO: 36694 - DNA, 844 bp, Bovine  19866881287362
tttaaaaaaaaaaaaaacacagtttactgtatcttttcttaggacctccacattagagtttaattatatgtaaactaggattttccaaacttattttggtccttttaatatcccctcaaactggggttccaaagagcataatcttttaagtgcttgactgcaaagtgcattatttggtttttgcatctcataaaagtatgtaaagtagaaaaatgagaggaaataactaaattttcccatgcctcatttcccccatctcctaaattaaattaatataatctgtcatatttctttctgtctgtgaccttggagagtttccagtagaaaagacctgtgaaaagttttttatattttatatattcagttactctttcagataggcaaatgaggtaaagaaatgctataccttatctgtaaagcttccatttaggtcttcttaaatcatgaatgattgttcagacagctttctatcagcatgattttgtcagggaaactgaggcagagttatttgtatgcttctagtcactagagaatgaattgatacaagaaatatcatctccagagactattggtgaactccaagtatcactgtaatttgaagtgtgtccaaaaaaatgaaaacaaatgtgataccaaactgatttgtcaaagaaatctttaaaaaatcctgttgcttatctggttttatgtcctttaagtagcagaattatgaccaacaaattactttatcaagatgataccctaccttgttgaaactgaatcttgaaatcactctccttttacttcaagactgaaacctcacattacaggtctctgtcttgtttgaggggggaaaaaaaatcta

SEQ ID NO: 36695 - DNA, 1075 bp, Bovine  19866881608431
gcttttttttttttttttgagaaacagagcatgctgctgctaagtaacttcagttgtgtccaactctgtgcaaccccagagacggcagcccaccaggctcccccatccctgggattctccaggcaagaacactggagtgggttgccatttccttctccaatgcatgaaagtgaagttgctcagtcgtgtctgactcttagcgaccccatggactgcagtgaaccaggctcctccatccatgggattttccaggcaagagtactgaagtgggttgccattaccttctccaaatacagcatagaatacggaaataaagacataggagaaagttcactattaattattcattcattaaattagtttaagagtgtttttgaaatgttgttttgatccccgggtaacccttgaagtctgcatcactaacctagaatatggtatgtgcatcaaggaatctgctagtgagcttagaagtatgtttgaattctcaaggcaaggaatttgagaaaggaaaactaaggccaggggctagggtgtttagtagggttagtgaatttatttagtactaagcactttatgattattttccctcatttaattctcacagtaaagtacagagataagcatcattagcaccccttttacatttaagtaaaccaaagctcaaagaggttaagaaacttgctctgagtgacatagatagtaaccaggtagcaagttaagattcaaggctcttttttttccactgaaaatttagaaaaagtttaatttttcatataagactgatatactctttatattctctagtcttagcttactacattgtgtctcaaactctttaaacattaattcacctggaaagccaagcatagcgtcttgtactcagttgacaatcaataatcatgactgatagtaatgtttctgaatgtggttgagtagaattttcctttgtcattcatccttttcgttagagagatccagtgcttctgttttaatggtttacatgcatgaagacaaaaaactctgcttagggcaggaggaggaagggaaatggaaggaagaaagcagaggagaaaga

SEQ ID NO: 36696 - DNA, 963 bp, Bovine  19866881620955
actgagttctaattgacatcctttctagttggatggttggaactattccctcagaaaataaggctcgggttaatctaagtcactcgaatgttcttttctccaataatctagatggcttttttctgtattcctctggtaaaatggagatttttctaactggctatggagggacagcaatattaagataaactcattttgagttttataggttttatgtgataattttgttcctatctattagcatttctaaccaaccagatctgtctctccgtagttataaactcagttaaccacagtaccacattctatcacattaatctggcaaacctatccttttgcccattgtttagtcaagtgagctttgaaagaggctttaactgatggtattgtatcatttatccacactgagatccattcagagctgcacaaaagtcaagactttattaaagaatcatcagaaaacttaaagtttttatatgcagctttaattttgaatgaattctgtataaaactaaaaacaaaaagggatgccttcctttccaagatcaaaataaattagtttagaagaataggtgatttaatgattaaagcatggatttttttaactggtaatctcagaaaactaaactccaaattaattataaaatgtttcagttcaattcagttcagtcattcaatcagtctgactctttgcgaccccatggactgcagtatgccaggcctccctgtccatcagcaactcccagagtttactcaaactcacgtccattgagtcggtgatgccatccaagcatctcatcctctgttgtccccttttcctccctccttcaatctttcccagcatcagggtcttttcaaatgagtaataagaatcagagagtttactaaaatactttcttttcagtctcttctgtagacttgatgcatatagggatagatgttaagaaaaaaatcacacagaga

SEQ ID NO: 36697 - DNA, 671 bp, Bovine  19866881947190
taaatcaaatttcttcctggagtgcaaactaataataatcatcactataaaggagtctgttgtgtttgggacctaaagtgctatctggttgttatggcaacccagatttgaaaagggatgcctggttgtgaggggcaggcaccaacatccccaaaccaattcttcatccaagcttctcccaacagaataatttctagtcattcccaaaatgtatgcagagtgacggattgtcagctctataaactagtctcactcggtaaagggaccaccttttcatcatagaaggtgatgttttcacttgactaatgttgacaaacagaaagaggctaagtgtatggtactcattaaggccatatatatcagcagtgcaaattgatattaaagagactatggatgaatctggttgggttcctcttcaaatatgttctgatctctctccatccttcaaacagaaatcatgactctcttatctggacagtattggtccatcataaataattgtatcaaagctggtatgacattatttcagttatccttatcaagatatttctttttttttctttttttttttaatttaaaaaaccaaatatcaaaatgaatccaccacaggtatacatggtgttccccatcctgaaccctcctccctcctccctccccataccatccctctg

SEQ ID NO: 36698 - DNA, 1589 bp, Bovine  19866882034958
cattggagaaggaaatggcaacccactccatgttcttgcctggagaatcccagggacgggggagcctggtgggctgccgtctgtggggtcacacagagtcggacacgactgaagtgacttagcagcagcagcagcagcacatgtgaagggttctaaaaatatacgttctttccctgccttctacagtctcagcagagcatacataccttgcagtctcccatcctatggagactcagtagtgatcttcatgtcctcctggaatccaagttctctgccttcttccctagaatgtgaccttaacagcaacagtaactattgtttactggatgaactctatgtgcacaaatgtgtgtatatgtgtgtcatggtactaaaccttttttgtgttactttatttaaaattttcaatatccctcacagtaggtactgttaacatttccaggtgtggaaactgtgggttcaggggttacacaatgcagctcaagtcatgcagtagtgaggggagtagccaaaacttggatcatgcaatataatcccagtacccatctctcaacccctacattgctctttacactgggtggatgtagttcatttttgacaaccaaagttacaaagaggcatgataaaaatggaggtcacggggtggtcccaggaaacaaataatgctacatgagtattcctgctaacttactttgagagtgattctgctagagttggcacagaaaaaaaattttttttgcatgtgcagaactctgaatgaaactaacctaagattacctgattgatggtggagagagttttatgtgcagcaagaaagaatatggaagcttgtggcatctcatcagctctctaatttcctacattaagcagcacaaagtgattagactgaaaaggcactttaccattcaatggagagaaagctgcttgattttatttccagagaaattagccccttcttactccctttttgtctttagaaaatagaaggtgaagtaagcactatgttgataggctttgcaaaaagtctgtggcacagagacaacaagaactaaatttaaatcctatataatatgacagatcttgtatctgttttaacaaaaacaacaactatcattcaacaatgttacatgtgctgtgacaagcttcatatcaacacttaccagcaccatctcagttatgtgtcactacttcctactgagatgtgtgtgattatctttattttcataggaggggatggaggcactataattaaacaaatacctgaagtcaagtttgagttttgaagatgagatttgtacccagacaacttaatcctagtgtctaggccattaacccctacatcccaccaacagaagtgtgaccagcagatgggagagagggtggaagcagagattgggagaggagcattgtcattctcagagcagtggtaacattggagattggggttggaacaaaagatcattatctgatggtttatagaccttccatgtggattacgggcctttgactgatttttgttctatataaggaagcctttcataacatatggtggtatttcaatcattaagtcatgtctgacacttctgcta

SEQ ID NO: 36699 - DNA, 687 bp, Bovine  19866882039190
atttggcagcttctcttatatagaataatgatagaagagctccatctcttctctgtcatttatgttaaaaaatggtaatccaagcgaatctatattcctaatgtttgttgtaaccccattagttctcagacaaattcttagcaaaattcttgcctaattattaccactttacctgattttaatctcatattttaaataataaagaagtctcaatctgttatattttaagatgacctagtaatgccgtttttttcctcctttaagcatttcttaagcacataacttgtcacttctgtgctaatttgctgtaacactcgttgataagtggacattaattaatgctaaattacaatggaatttttatggaattacaggtgacatccgcatcagcaccaaatgagttcatcatgattaaacttattaccatttctaattaaccttgagagcccctggatgttaactgcacacaaggcaagtgtatatgcagcctgcagctcccattgaaaacaaactttacacattatataacctttaaaataacctaagaatagcataggacacatttgtactcattgcaaaggatcataaaataaaataccaggaataatctgaagactttgagcaactaagtttttgcccttaaaacagaagtcagaaaagtgtcttccacaaattgaatttgtttga

SEQ ID NO: 36700 - DNA, 1281 bp, Bovine  19866880357907
tgagtcattggtaagagcttggaaatcattgtcatattaatttttggtttaattgggtttgaaatgtggtacaaaatgtcaagaatttatttttaatagagagtataatctcttctgtagagatcaatgatggtggctacacattaacattttatttcctactgtcctttctttcagaactaaaaatgagtttatcatctaaggataaagaaagaactttgaaggtattgaaagtctctctgaaatagaattttcaaaaggacagcattttattcttgtttactgaatcatgaaatatgttcctttgtttataagattagagacaatttgggaaggagacagggcaagcatagtgattgcagatgtgtgcttagttgtataaaaataaatctccaattagtgtttttaatcccattccttcatagagaatattggttatgtgagttattagggaaagtgaaagtgttagtctctcagtcatatatgactgtttgcaaccccatgaactgtagcccaccaggctcctctgtccatggaattcttcaggtaagaatactggaaaaggtagccattcccttctccagggactcttttcaacaccggaattgaacccaggtctcctgcacttaggcagattctttaccatttgagccaacaaggaaacacaggagttactaaaaaaccctcatttaactaaaaaccagttctgattttattatcaatacaaagaaccctatgaaatgtctacatttatttatgctttagagaaactagtagtttacaacattaagtagtagtgttaattctgaggtcccataacagcagtttctacatgtttgaaagagttaactgcaaataagctgttagcatttgaagggcctttattcagtgaaagtagatgacaattgtcctgagtgtaggttgaagtcatatggagatgtttgtatgtgttatttatagccatgatggtaacaaaatccatgaagaactcaaaagaaaatcccactataacattgaagtgttttattttatttatgttactgatgcctgagggctcatgaaaacaaagtgagaactaactgaagttacttgaaaatttctttacctttggaatgcagtctttttaagtcaagaatgttcagttcaactctggaagcattctgttaataacacacacttgttaagcatgtgatatatcctagacagcgctcttctcattgggcaaacaagtggtatacaccactgcggttgcatgggactcagcttatggggagaaaaaca

SEQ ID NO: 36701 - DNA, 1587 bp, Bovine  19866880390675
gtgacaatatacagccttgataagtgctattgtgcattagtgtgaacattctttggcattgccttactttggagttggaatgaaaactgacattttccagtcctgtggccactgctgagttttccaaatttgctgtcatattgagtgcagcactttcatggcatcattttttaggatttgaaatagctcaactggaattccatcacctccactagcattgtttgtagtgaggcttcctaaggccctattgactccactttccaggatgtctggctctaggtgagtgatcacacgatcatggttatctgggtcatgaagatcttttttgtacagttcttctggttattcttgctaccttttcttagtatcttctgcttctttaggtccatacaatttctgtcctttattgtgcccatctttgcatgaaatgttcccttggtatctcaaattttcttgaagagatgaagcaaagttagaaaaaaaatgtgcaccatttgagacacactagcaaattgaactccagaatgtactcacagagattaattaacacaccagattgtcttcattatagccaacattgctttttttttgttttttaagtttgctgatttagtagttaaagtaaaaactgacctcacaatgacgagcattctctcttacacctgctgctttttgatatgatgttctgtacttttcccaaattattttgtcaaaaagtaagtggaagcctcctattgtttgtgtacatttctcatttgaaacaagaattattgttcaattatatcatcatccattgagaatagtcctctgagcaatttataaccagggagtcctcattatctgtaaaagccgtttgtaatcaatttagttaaatgcttcagtgaagctgaaagaattgcctcctaaatatttatcatgattacacgccaagagtataatgtatacatagctaaagcatgagtttcagaataacaactctgagcagacctgtctctctaaatcttagcatcaatcagtcagtgatgaccacaaatttaattagtatcagttgatattgactaaataatataaacagtaaattacaatgattcaattttgagtaatgagtagcggaagttttctctccttccaaatcataaagtgcaaagttaagcccatgtgatttacagctgaaaccactttcctattagttcaacatttaaatagtttttcatgactgctcctgtttatctctgtatgcctatgatacaagtatatgttgggagacaggcaaagtgtgtctcagaatttttctaccctatgcctatagaaaatctgaataatcttgatctctcttttgaattctatattcaattacctagtggctgttcttaagagaattaaattccaaatattcaaagttgaattttcatctttccactcacaactttgcttatgcctagtattccctatctcactgagtggcttcaccatcttcctaactgcttaattcagaacccagaagaatgatacaaaaaagatcttcatgacccagataaccatgatgggggagatccctcacctagagccagacatcctgggagtttg

SEQ ID NO: 36702 - DNA, 1866 bp, Bovine  19866880400474
aataaggaaacacttgttgagaacctgctgtaaacttctaaaacttatacacgctcattataaaaagtgaaagtgccaaattcccttcctcattagcacttcagtgtgtatgcatacataagcacgttatgtttctcgtgtttaagaaggaatcatattgtacatagtattctgtgacttgtttcttcctccctttgtcttactaatatagtatagacatttctccttgttcatcttcccatttttgttggaggccatatatacacatggggcttcccttgtggctcagctggtaaaaaatccacctgcaatgtgggagacctgggttcgatccctgggttgggaagatcccctggagaagggaaaggctacccactccagtattctggcctggagaattccatggactgtatagtccatgggatcacaaagagtcgaactcaactgagtgactttcacatcacacatatatacatacacatgtgtatacatacacatgcgtatataatgtgtatgtgtacatgtgtgagcatgtgtatatatagtagctcatttcttattaaagactgttaattctgtgttctaaataagtcctctattaaaagacatattttctagtttttcgctgccaaaaacatggttaataattagcatatcttgttttcagtttcactaatatgaatttcaggtaccagagtgaatagatgatgtttacatacatgtctattaaattttgttatgaaaagtagaaatgcacattggatatacattatggttatattgaataatattttaaataaataaaattgaacatttaaattattgatatttgaggtactttgcttaagatgtatgttatatgctcacttataattgtctacactaattttttatgcctttgtagcttaatatcttgtcttattacttcaggatactttatccttatgaactttttagtgtgtaaaaataacgggtaaacatctggttttcccctaaaaagataatagaaggagatagttcataagaaattatgttaaggctacagatagcttttgctatctttctatatggtattttcttcttaatgacttttttaagagtagtcagtgaattttaaataatatttctctctttatgcttcatctgaaaagttatagaatgctttaatggagtgttttcatgtaacagtttaagaacagtgtcataaagttttacccattcttgaaatccaataagtaaacccttgcatttacaaaattgactgaagtgctaaaatatttcccataaggtttatttaattgaactttctttgtgttgttgagcctcattatttgtacattctggtgagtgaatgtgtgctgtctcaaatttacttgtaaattcaaaatcacttcttacaacagttgcatagccatttagagacatgcacggagctgcaaaaaactggagtttgctgatgcgagcattcaacctgtggttgattaggtggttcttgtcttcttgttttctgctctcataaacaaatgtcctcttggcactctacttaatgccacattttttgcatttcggtgctttttgttggtgataatattgtttaaaatggcccccaaacatagtgctgaagttttgtctataatgttctgaaatgcaaaaaagctgtgatgtgcattatggagaaaatatacatagtatttttgctcaggcatgaattacagtgcttttggcagtgaacttagtgttaatgaattatcaatatatatcaaataatgtgtctttaaatagaaacacacagaaaacaaggttagatattgatcagttgttgaaaatgttgtgatcagaggcttataggaacttaaccctttgttt

SEQ ID NO: 36703 - DNA, 1422 bp, Bovine  19866880744203
ggggttcccgtgttctccgtgggtttcattctaggaccagcaggtatccaaggcatatgcttcttagagagctaataagggcattagaaagcaagcagaagtgcacaatatttgttaagacctggtaagacctggagaagggaatggccatgcactccagtattcttgcctggagaattccatggacagaagagcctggttggctatagatcatggggttgcaaagagtcggatacgactggagtgaagtagcatgcatggcaagacaaaccatactgcacttgctgaaacaagtcaaaactaacatgcatgggagagggcactgtatttcacagactcaaggtccctgcaaggtcatatgcagaggagagaactaaagaatagcaaacagtattcccatgtactcacagcaggacaaatcccatagattgaccaaatctgtggacacacgtggagtggcatatatagtacgtaatgagttaaagatagatgatcttgaatcatctagaaaacattgcataatgttcaataattttagttctttagcaaatcaaaatgtttttaaaacattttaacaccaaaaacgattgtctctaatttcaccaaacaattattttttttgttatgatgccatataattgatactattgtatttaattaaaaactccttctagtatcctatttaagactataattcctatactccataatcatattgttcagagttttctctatattcacactaaaactgtagtagagctgaactttaaaaaaagagatactttcttaattttaattttatctaaggaaattctagaaatatattctaaaataaggaaagcataagcattcaaaactgcccatacttctactccaccatactgaaacaacatttaatatgcttttaacatgtttcttttcctttgaacttgtaactattggagaaaatcatcaagaagacctgactgccttctgatgcttgactgtgacctggggaattgagtctcctcacctgctccttgtccttggattgtaagttctgtccgcattcctgtcttggagttgcttttgggacatagccatgaaagagcaatatgttgttgaagccatctggatggtttatgtgaccgaatccagtatttagacctctgtataaacttttatatacagattctgattggcaagtgccaagatatactcgtcttgcaccggcccaaaacaaacctcttctgttcgtcagttcccttgcttattaaacctgacacctacaagtctaaaatgatctgcctgtttcttctgtctctacttgcctcccgtgtgtaggggccagttcccacctggggaactcccaaggttgtcaaccaggagtaacagaacaacattttcaaagattgtagccataactttcactctaataataat

SEQ ID NO: 36704 - DNA, 752 bp, Bovine  19866880767100
ggtgcccattgccttctccagcaagctatacatagatatgataaaattatttttctgtgtattctttagcaggtattgggaactgatatccaggttattaattattcactcctcatcaaaaaactataaatttttacatgtatcttattcctggtttggaaaaataaaatgaaagtaaatttacatattctccctcttagcaatttcatttctcaataaatggttataatctggatcttgacatagaagccattaataaatactttgaaaagaataggaaataaaatagcaaaattgagattatcagattagctctatcatggattttctttgtgacagaagtcaaggaatttaatctttctgattctcagattttccaccttaaaatggagataatttttctatcatatattaggaattattattaatataaaactaaaaagacatataaaaacattttgaatataactattgtttatacattatgtttcaagatttggagtaggtaaaattttcatttgcttctctttatgaaaatgtctcaggagtctagataaagaagaaaaacaaagaacaagaggctcatcactcccataagaagtcaccccttcatcagaagagggggaaatacctcctgaaacacaacgtgatgaaagactctttctaaagctctgtttagaataccatctggtcccaacatgcttcataaaacacagagaggatgatggggtttggcacatctataactctct

SEQ ID NO: 36705 - DNA, 970 bp, Bovine  19866880829927
tagcactggcagaaagcattcagagactgagtaggccatctggtgttctctagcattgtcccaaagtagagaaaataaaagatttacaacagtttctctttcccattttaatttcttttttttttcttctaaaagtaatctcatttttatttttcaattggccactacattgttttttattttattttatttttaaactttacaatattgtattagttttgcaacacaggtgacatttaaaccactcttctagtatacacatcttttggaagacattcaattcatcacgactataaatcacttactcatcacaccacctcccagtgtttctctccccccacctctcttttttggtgtcagtgctattaacctatatcttatctgtaccacattttatgaactgttagaaatttttaaaaattatcaatgtctcaaaatcattctaaggaatttttttaaatgatgagtgagtgagtgaaagtcaccaagtcgtgtccaactctttgtgaccccatggactatacagtccatgaaattctccaggccagaatactggaataggcagccattcccctctccaggggaatcttcctaatccagggatcaaacccaggtctcccacattacagggagattctttatcagctgagccacaagagaagcccttaaaatgatgaatgttcattaaataaaactctttttatctataagcacaatatgatatattcactcacttaatctggaaaataacaggcaatttgaagatgatagttgaaaactacaaaaagaagaaaacacatactggaatttaattccatttctcctataagctgaatttgttattaagttgataaaattcaaagatgtattttgtatggtagggaaatcagtgccaacagtcaaaaaatgttttaacagtaaagggtaggaaatgacattgtgaagtacctctctgtgctagagaaacaaa

SEQ ID NO: 36706 - DNA, 2275 bp, Bovine  19866881063654
tgtccgattctgtgtgacccatagatggcaggcagcccaccaggctcccccgtccctggaatcctccaggcaagaacactggagtgcgttgccatttccttctccaatgcatttaaggaggttctcaaacatgagaatctcagtgttggtggaaataaacctctgaatgcttagtgaaaatcaccgagaagacaactgccctctccctgggaatccaaacaggctgacacatgatactttgcttctccattcattcgaagtggtcttatcacagctatgagaggaaagcaaagtggctttctatccctggggctgtgcagacatcaggaaaattttgatacttaacatcaattcaatgtgtgcatctttttagtttcaagatgtgaattctcaaaagcagaagggtggagaacactttctaggaaattttctcaaggcagcatagacttatcacctaccagcctagagaatgaattaacatcagtaacagtattcacaggacattcacactcttggtccctgaggatatttccctgcccaaatggccatgatgacaaattttatgatctcagaaacttctaacaatataggtataatagtttttattttaagaattaggcagtctttgaaataaattttctcctgtagacaacatgaaagaagtccattaatatgatattctctcttatatataggaaaatattgttctgttgttatactagcgttcatcacatatattggcatccactgcacagaacattttattgctatatgctgtcagaaaggcaaaaagattaaatcattctctcccattatttcaattttgagcagagctctcataaggaatgttctttgagatactgacccttctttgagagtcagtcaggtatgttgagatagttctttcacatgtttggatcacatgagcactaattagtttactaaaagcaattctatgaatggaattactctgatttggatgattaattgaagctcccacaagtaattgactcctggtgaacagctcacatgcttggaagaactggatcctctacttagggtaaggattataaaacaatccagagacatatagcactattacaccatcaaaaagttgagaccaatgcaaaagtacaatttaaccctttattttctttgataaaccatattcactattgataaagtaaaaagcacaggtaaaggatgaactttaccaaaaaaaacccaaatatatatatatatatatatatatatatatatatatatctttgtaatattcataattggttgaatagcttttatatgaaagcttctttagttatccccaaactgaaagatattcaaccagtcatgaagattgcagttggaatattcttccataagtacaatattgtgaattaagtgaagcaggtatcaagagagaaataaaaaaaaagattatttcaccaccatacctggacatcttcctaggattttcagattaccttcctagtcaagtgtaggatttttataagccttcttgaagtttgtatataaaaataccataagactcaataaatttatgttgctgctgctgctgctaagtcgcttcagtcgtgtccgactctgtgcgaccccatagtctgaactaatttatcctcttaaataatttgataaaaccaaaaagtcaagtggtaacaacttaaataaagatgaaatatgagttatattttctttttgctataaagtggaaaatggcacgcaaaatccatgttaaatagaaatagttcattatttgtatgcaaactaaaatagctgtattaacattaagtgtgaatttctatattcattttttatatagctgaagtattatgtatgatgaatagttgtcacatgcacacatttcattcttctacaattctagaatttatgaccaataaaaattaataaagaattagatttatttttggaaataattaaatatgtgattgcataggttctaggcttcagtggtcattcacctatttgaaaaataagaatctcaataacaatttattataaaaataagaatagctgtgtaggagaagtttcaatgtattctaaagtaactaacattgctagaatattctagtacatgattcttactgaatcatgtcaagtatacatgattcttctccctaggcttcatattgtatttgtttatattttggctattgtcatcatatgtcagtttgtactgagttagcaggattcccctcagaaagtcaaacctgaatattatttttcttatcagaga

SEQ ID NO: 36707 - DNA, 1556 bp, Bovine  19866881079697
ttgtaattccttttctgtgagcgatctgttcatagcctttgctcactttctagggtgaagtgtttttaatgtaaataatcataataattaccccttgatttaaatgcatgaaatatatttttaatggattgaactgatagtacaaacttctgcatttgtggactgagccattggtaacttttaatgatatcaattgatgggcatcatatgtaatcattttatgcatacaggtatatagccttgggccctgaattaatatgtagttactgtttgtcataaacacagcagtaggcatctttatgacattcattttcaatttactttttatatgactgtgaatgtttcaaattctacattgatgacatttgtcaacttatattctgagaatgtttgagacaatctatgaaaactttttgcctggagatagaagcattaccaaatgatataataaatgcttggtgatatacataaaatgttgtgtgaccaaagtctcataataagcatgcttttagggaaagtaaacacagttcttagttttatttgttaacttcaacatgttgaatttttcactcttacagctgagataaaaatatttgtgatatatcaccatatagtttacatattatattttaatatctatagattttgagcatatttcaacagatgcctaataataatgattagagagaatttttaaatgtcttctaaagtgtgtattaaggattccccggtagaacagctggtaaagaatccacctgcaatgcaggacaccccagttcaattcctgggtcaggaagatcagttggagaagggataggctacccattccagtattcttcggcttcccagtggctcagctgttaaagaatctgcctgctatgagggagatctggattcagtccctgggttgggaagatcccctggagatgggaacagctacccactccagtattctggcctggagaattccatgtactgtatagtccatggggttgcaaagaatagtctgactacacttatattaggttataaaaatgattcatgtataattactacagtatatagcacagtggcaaaaaaataaatctggatacattaaaaagaatcatttcactactttatacctatgctacattgtctagaaacttttcttatatatttttgcaaagtgtgtttaacacatttatccagtttggctaaatatgaatggcagatgttcctatctgaattcttttggcttctaaaatattaacttattaactagaaggaattttttaaaatactagacaattctacactgcataaccttactgttattctaaattgctaacaaatttatcgttaaaagcaatatttaatagttgacaaaaatactacacaaatttatacaatagtggacccaaatcagtgtttcttgcaaaactgaagctcatggcctttgttattctttcacaggatacacccagacaaatgttggggaagctctggcagctgtgcatggctctgaattcagtcaaacaactatctgccgattgaaaacctgcagctcagcttca

SEQ ID NO: 36708 - DNA, 808 bp, Bovine  19866881112552
aaacactcaccacatgaagacatagagagtctctctctcttactctctccctctaccctcttaaaaggagagactagggaattatttgacaagatcacacaatggaaaaagcatcagcatacagtcatacttgttccttgcctcagagtgttggccattcacttgtggactataaagattgaaatagtggacatcacacccctcctggatgtgttgaggttgactctttgtgcaggttgggctccttagctcaggagtgttgctattccctctgaagttccatgatgagacaaaaaagtaacgagcagccctttaaaatccctgctggtttgttaaatgaggatagcagagcaaaggcaacactctgggatacaagacaaatcctgaagcctgcgtctatggtaaaatccctactaaatcccaaatgatgagagaaactatgcttaaaaatatcagaggaaaggttaagaaaccagacaatgagtgcatttgttgttgccacagatatctcctcaaatattccatacttgtatgttattatttcatcattttatgctattccaggagaatctgccagggtggtagcacctaggtgtctttgttttactactgcacacagcaaactctcatttccttttaaaatagagctaagtcccagctgtggcacaacagctcccttgaaaaatagtcctataaaaggacttttacaaatcatgggaagaaatatatttattttctgtaaataaactagcaaaacaacatagccacacactggagaaatgcaggtaagaagaataaaagatttcag

SEQ ID NO: 36709 - DNA, 1238 bp, Bovine  19866881148533
acaccttaattcaatgatacttgtagctatttataaatgaagttaagttatatgctggactcaccctttataaacctctaggtactcagtgatcaatgaatttattttttgaccagcttcatcattagaattgttcaattaattgtgtgcatgcagaaaatctacaagctcatggtttcaataccagcctaaatacattgcacattgtcacagagtttttgtaagcctctgaatttaatggagttttatgatcatacccaataaaaggctagtggctctgccacttcctctttgatggaagaaatttgttaggtgaatgagcagaagtaaaagtaaagacccatgaagagttgatttctgtattcattgctccagcaaaagacaattttatagtaccatgttatacgagaattttaagagactattctctggtcagttctttgcaaagtctacattgggtgaaacctgcaagaaaactgcagcttccagttgtgtgcgtgtgctcagtcactcagtcatgtctgacacttggcaacctcatggactgtagcccaccaaggttaaaactggtcagtcacaccaacccagaacactggatataattaatgaaggctctagtccactgtgatgattcatgaacttgggaaaaatgtcaacccctagttttagcatactcatcagagaactgcccccaaatgagaacaaattattagcatataactttaagaatagcataaatgtgtacatttgaaatgaaacgaatgtgtcttgaatcctcatacattttcttaccagtcccgtctattttgtctttgatccaaactcctaaatgtttgtgcacatgttttgtggtgacaatgctgggaaacacagcaacaggacttcattattctgttccttcctgtcattatggaaaccagtcatcgacctatggcgtgatggcaggtaagaaaaattgtctttacatgtaagattgagtttggggacgcttggatgcattttctgggtcgaagggaatcttgaccagagtgtatcatgaaattcagatctcctaaccttagaaattgctgctaaatccaccacttactataatggtccctgatctgtaacgccttcagagatcataatagttatacctgatcactgctgttctccacatgcctgaaatgaactgctatgcttcttaacgcctgtgtttgctttgtatatttttattctaattctctgttgccaaactg

SEQ ID NO: 36710 - DNA, 955 bp, Bovine  19866881297319
aacataattcgaaatttatttttcttaatcaatgtgctttttaaaaagattcttagagtatattcttatatactcttatgtatatcaaagtttaaaaaaggatattctatacagttggcaaacagtaaatggtagagctgaaaattcctaatttgtattcacataatccactagaaggagaggcaggagagcagatattaatgatgctacacacataacaaaggtaaccacgaaggttacacgaaatagtctggtttatagttctcccaggttagttattcctggaccctcatacactcttgcaattgtcacgggatggaaaacaaaccatatggtcaaactccagattgtgaactatgatcattcatgaacaatcagaattagccctcattcttagtgagtttgggaaattcaaaaagagtggactccatccagtttactcagggtacttcagtcaagtaggtggctacaagacacttaagtcagaaagacaaacagggatatatttggatgacttgacccaaccatatacaaatacaatctctaagaataacgggatcctacagctagatcctcaaggcagggattctctctgctgacatcagtttagaaataagcattatttattacactatataaatgatactaataatgttgctgatgatatcttccaattaaaggttgcactcactgctgtgtaagcctactcctgctgagaaatggcccacaggttaagtcaagtacaaatactacagtgtgccaaccaagaagaatgaaagcacaacttcaaaataattatggcaaaaagccatttcctattgtcactcagtgttttaaaggtttttataatacaataaaaacataccctagtgatttgttgtttcacaatatatatcctctttcacaactgaaaaacttattagatatacagtctatcatcttaatggtaagaaag

SEQ ID NO: 36711 - DNA, 1458 bp, Bovine  19866881317939
aacccaagttgtaataggtagaggagtaatgttgagatgatagatagaaaatgactagcatagaaagaaaatgactaacgaaaaaccaaagcatgaaatgtgggcatctttctctaaaaacaaaccgaaaatacaaggaaaagaaccataatcaagtactgaaaagacaaatcaccagttgccttccagaaagattttctggcataaaatatgcttttcccactattccaagaggacatttagtactcatcattcctatctgtctcattgaattttaaagatacaggttgtgcagtatcctgccagagtcaaaataacactgaccttgatcattttcatcacagtgaactcactgtcttctgtggacagccctttcaatggtctgatatttctacaccggtcccagtttcactctctggaggtattatcacaaaggtagagtcagtgtagagcaggagaaaacaaatttggtttagaagaatcttagatttaacctgatatatttaaaatggatattttagtgcaagaagctattactattgtttagttctgtttggcaattttttaaaaatattcaactgaattctcaagcttaaggggaaatggctttctttaaatagtaaaaacaaatattacaaggaatatgtgcatttaaaatatttaaatatcctttatatggattaaacttgaaaaaaagagaccttcaaaatgttggtaaacgctagcatcagctatggtagcaattaaatattacttatattttgcaaactttaaatactgttattttacaaagagcacagttttgcatagaaataatataaaattaaaacaatagctcattgttaaacttccattctaaggataccacacataattgagttacattaactctcaggaaataggacccagtggtgacatcctgattaccattctcaattaacactgctacattttgtaatgcctatgtttaatgtcaaagcattaagaggcttccaggataagaaatctattagtgtttcaaaaatatgttccaaaccagagagactagaaacagaatgaaaccatatgtcatttgcactaaggtgataatttcagcaatatgaattaatcaagtttctcaagggaagactataatttaaaaagtagtaaagaaattcagtgttgaatactaggctgaatcagcttatttaagatgcaaaacaacaaatctgagaagatttgagaagtattacacatgggagagagaacatttccatatttctaactgccacacatgtctattcaaatcaaacaatgacctttcccggcgttcttgtttattaatcatgaccctcacagggccaggcaaaaagtgtgctctcaataaatggtttttgaaaagaacagcttaaagaaaaaaaaagtgggggggggggaccttcaaaatttaggcttataatggaaagaagactgaagcaa

SEQ ID NO: 36712 - DNA, 863 bp, Bovine  19866881457249
cagaaatttaaaccagagttaccagatatcccgtatatatatatatacaccacatgtatatatatataaagtcctggctcaggaatcttccttaactccttctacaaatgtcctcatattatgaacattgtaagactcaataaggtgcctgggtgggaaagaacatttttgtttagattcatttgcatcagtcacttaaagattattttaaagtctttgggtaaattataataagtagtgctttcctaagactaaatccaagactattataacaacttttctgagaaacattagagaaatatgagagagactaaatgggtgatgtatactgaagcttaaaaattgacggtaatttttaaagcctatttatttttaaagggccataagaaaaattcatcaatggaaaataaaataaaaagcaactgagttgtgcagtaaactctgaaagaaaaggatgaagaggtagctaattagttttctagttgactcatataaactagagtttactcatggctttataatacaagaagcatctccagtaatattcttctttagcccctgaattaggaaatcacaagacccatggttcataaatccagtcagatcatcatggttactgtgtgtcttgtgtccttctgtggcattgtaaacttcttatcctgtatgataatgatggaaccatgcatatttcatggtcacagtgctacttactgagcatgagtcacccggagctcactgccaaaagtaacttgaaactatgacagcaatataatttttcatttaatcttgatttgtaggatattataaaatggcaaaaaaaaataaagaatagaaatcgttctagaactgtcacttctcaaggg

SEQ ID NO: 36713 - DNA, 1473 bp, Bovine  19866881525562
ctatggtttttcctgtggtcatgtatgaatgtgaaagttggactatgaagaaagctgagcactgaagaattgatgcttttgaactgtggtgttggagaagactcttgagagtcccttggactgcaaggagatccaacagtccattctgaagattagccctgggtgctctttggaaggaatgatgctaaagctgaaactccagtactttggccacctcgtgtgaagagttgactcattggaaaagactctgatgctgagagggattaggggcaggaggagaaggggacgacagaggatgagatggctggagggcatcaccgactcgatggacaagagtttgggtgaactccgggacttagtgatggacagggaggcctggcatgctgcaattcatggggtcacaaagagtcggacacgactgagcaactgaactgaactgaactgaatgtttaatgtttgtttggaaacatcatctctgctctgaaggttaattaagaagatagataaattaaatgtatacctataataaattcagttgtgttaaaagcctttgcttaggaaaatgaataaatgtgctgcctgcttaataaggttttgaatgaaaaacattctgatcatcaattaccttttgaagtagatgaactgacttttgtgttactcattaaaatggcactttacctgccctaaaatcttattccttatactttctatactctcttcttcctgtctattttaataatcatttttgatgtgacttcttattctaacaagaaaaaataaccttagaaacaaatggaagatttttcacttgttagttgagaatcagaaattccttttctaattcttactcctttcttcttttattcttggaataggtcaatgaattgtatctgctctttcctgtgagaaagagttatagatttgtaatgctttgtaggtacactttaattttctatttttaagtatttccttttgataaagtgacaaaatgagagcagaaatggtataaaattaatatttcttaagatacagtttagaccataaccacatgattcttcttggttttggtttgaagttaattacttttatggtaatttctctttgcagtgtggagaaatgttgccctgtaatttttttgtaatttgttttgatcataagaaaaactgatctccacactgtaagtcaagggctgatgtcagcatctccagtaataattgaataattctttagttttaaaaattggtaatgcctgagtgagatctgaacctagctagagtaaattagaagcttcattgttaaaaaaacattattttcagtatgtgtatgatttctggttgaaggtatatatatcttgagagaaaattaaagaaaatgccaaatatgatgcaaattcccctcacagccagtatgaatgcaagatgtattaaattaagataaaaaatattggcatgaaatgcagacatgagcttagaa

SEQ ID NO: 36714 - DNA, 1072 bp, Bovine  19866881613093
agctcagactctgctgaggaaaatgaaggcccaactccccctttgtcatcaaccactgactgttgttgggagagagaagcctctaagcacgtaaaagtgcatgcctggtcctggtccctctggctctgggatacagcagagcctgcaaaggcagtagaataatctggggggtatccactctcactctgctgaatcctgtctggagactgggaatctggaacctatccttgttgactttctgaatcacttattagttctcccaggctgtgaaacatcagaaaatctagtcgtaaaagatggggattcagccacacttgtctcaaacacatgcaaatgacccctgaatacagcccctgaaatctcctctcccttggaaagaactgagtaatgaattcatatgctatattttgtagtaaaacagttttgaaataatgttggattggaagtcagaagatcccttcccttatagtagataacagaaaacattcaaactccttcctttctactgccctcatatcaggtctcttttgaatttgtggttgaccacaccctcatttgtaccttattacctagtcaaactaacttatttgtggctcaatgaaaacacagtgctatcatattaatatttcatgcctctcttctgattctcttctgtccacctaaaggtttttttctctcttgtttttatgaatctttacttttaatctaagatgttactctgaagtccctctcttgtgaaaattatttcaataacttatccttatttcttttaatttcaagatcctacctaactcaaaactggcacaaagaagctgttcaatacatacatatctttgttgctgttgttgtccagttgttaagtcatgtctgactctttgtgacccatgatctgcagtacgccaggcttccctgtccttcacaacctccaagggtttgctcaaactcatgtccattgaatcagtgatgccatacaacaatctcatgctctgtcatccccttctcctcctgtcctcagtctttcccagcatcagggtcttttccaagagtcagttcttcacatcaggggccaaag

SEQ ID NO: 36715 - DNA, 823 bp, Bovine  19866881888992
ttaccatatgggtgttatttagccatttcaattgcccaagaccaaactgaatggcacccacacagacacaaatgtccacacatttttgtaatttgaaatattgaataatagttaatactattccggatgaaagacaaatgctttaccttttcatttaatattctaatagtatttgccaaatacttctaaagactttttcttaaactattcaaaatctttggcttttcatcttaccagatttttttttagttttcaagaaacaaattttcatccattctgaaatttttcctcataatgaatggcttcacattttaagttaatattgctccttgctttgttatttgtgttattgcaaaacactgctataaatgactagcagaatgatctaaagtcaatttcctaaggaataagatttgttgttttaatgatatatgatcatgccactggctgcaaccccctctataatagagaaactgtcctacctatatagcccatcaattcatgtttagtaaacaataaatttattaaataaatattaatttactgtaaacaacagtaaacaataatttatactctaaattgtcaacaaggtaataatagtataaagtaaaaaagtaataggaataagataatgaaagaaaatatggttatttcaaatgaattagttttgactggagaggagtcagagggtttcaactcatcagccaacattttatcaaattttaaagtagaacatctttaaaactccatggactgttagactaggataggaccatataatgcttatatttaatatctctcccaatgcccaaaattatctttt

SEQ ID NO: 36716 - DNA, 710 bp, Bovine  19866882043152
gagccttgcaggctacagttcatgggcccacaaagaatgggacatgactgagcagttaagcaaatagcccatgtaagtcttagcagagtgccaccaatatatgtttgtcaaacacatttggaaataagcatgatggaacaagaaggaagagaatgaaaaacaggatgaagattttagtttaaattgcattaacctttcatcagcatggaccaatgaatggataaatagaaactgacccaccactctaattttagctaatgccatatttctttaagaataacttccagatgctggcttgggtgtccattttgttatttctggcaaagaaaattcttttggatattgccagcttaagagagcagaatctattaatcagtgccagccataatttgttcttccagcataaaagcacagaccttttctttggaatgcttttagttataaccatctttttctccatttctgcctgcaaggatgcacattcatattcctaccgtgaactgtggcagggtttagtgttcatctgttaatttaatgaattaattatcatgaattaataaatggcatactccttagggaacataatagtccttgtacggcaatggttctcaaactttggtatctattagaattacctggagcattaaaatgaagcatacagaggttaggcttattgaagtaacataggatgctgggtctttgcactttta

SEQ ID NO: 36717 - DNA, 1765 bp, Bovine  19866880257495
tggcaccccactccagtactcttgcctggaaattcccatggacggaggagcctggtaggctgcagtccatggggtcgctcagagtcggacacgactgagtgacttcactttcacttttcactttcatgcattggagaaggaaatggcaacccactccagtgttcttgcctggataatcccagggacgggggaccctggtaggctaccatctatggggtcacacagagtcggacacgactgaagtgacttagcatagctagcataaggcaccatttctcttaggtaaatgaatacctaagagtgagattgctgggttcccatggtaagtgtatgttcgtaaaaaacctgcaaatgaaccactgaagagaagctgcggtcagaggctctgcaaaagtcagggaggctggggttacctcccccagccactgtcagcttctagacccatctgctgaagctctgtgcctcctctctgagggaggcttggagcccacctttctcaccagcaaatgtgcaacctcccaaacaccaccctccggggtcaggctttgttgccagataatgtgactttgtaaagaagcccttctcctccccccaaaaaggaggctaagaaaggctctcagatcaatcctcagcagatacgcggagtcacaaagctccagcaaatcctttattctccctttggagcagctgctgcagcaccccgccctgcagagccggcccccagtggaaacctgaaaactattcatatcatttaatcctgttgaaaatcctctctgctctttcactgaggtgcggtcggccgaggtaaacctgggcttaattcatatgttggaagggagatgaaaggtgtcatcacatgatctgacatcctatccaggaggctgactcttccctaatgtggaagagtcataacccctgactgagaggagctaaagtcaagtcttcaaggaacagtcccatttggactttgttttactgtgcactcactttagaagacagcaaaactgcagaagcaaagtaggcggtgtgaggggatttgagaagcccttcactatggctcattcatgttaagaatctaccagattttttacacttcataccagacatggggaaagaagactcttaagaccatttttaccctattgccagtcatagccatgaggcttgggtttctcctctggcaccaaaaagtgtgagatcttagaaccaagttctttaattttaagaaactgatcctaagatactgatatatccagaatgatcatcaaacctactcttttttcttctagaactcattgatacttaacagtaccaacaggcccccagaccttctctgttctttccaggctgggaaaagacttcttatgagttccatgggtcatacagttagagagaaagcaaaagaacataagaaactggatgcataatttcacagaatacattctttctggcttgctttgagacccaagtaggatttggagaataagtggtcccaggtgggctagtttagggtgacttccttatgaggaaaactattataaggcccccatgaaaatgccagtctcctggcagatgacatttaaatgccttccactgggtgagggatggcccaggaagcacgctggagaaacacagatggaaggaccatcctggagagtttgtcatcctacggtccttgaaatgtgaggacagcagcaggcagatgaaacctgtgatcagtgttccccatctctggtacctgttggggtcacctggggaactttga

SEQ ID NO: 36718 - DNA, 1844 bp, Bovine  19866880385445
gggtggtcttataagtctctattcctagaatacttttcctccagatctgggcagttcttgttccctcgctccatttgggcctctgcatgagtcactcattcaaagtgatttcctgacttccctttccctcccctatctgaaatagcatctactcccactcttctacttatgttgatttattttctctccagttcttgtcaatttttggaattatagtagatcatgttatgaaggcactatgttatataattaacatttaatttaatataatttaatgtaaattatattagcatagagagtagcaaataatagaagctcgaatggtttctgtggaatgaatgagtaattctactctaattcccatattagccatctgtttagcttcgaggcatatatgacaataactcacactggctatagtattttgttctaaatatcttttgttctaatgtatggacagtttttctgtccaatttttaagcagtttggagattctgtgaacagatatcttttccttttgaactctcacagaatctcattagctaacagaattgtaataatattttcataagggatcatattttatttttaaaaaatagtcttttctcacatttttaaaagattcaattgggatgtggcagaattaacttctaagataatctataatgggtaatagatataatttagattgccaaatggaaacataaaacaatgttcagaagtcagggttacagacccaggatttctgagcaccaaagaattgatgcttttgaactgcggtgttggagaagactcttgagagtctcttggactgcaagaagatccaaccagttcatcctaaaggaaatcagtcctgaatattcattagaaggactgatgctgaagctgaaactccaatactttggccacctgatgtgaagaactgactcactggaaaagacactgatgctgggaaagatcaaaggaaggaggagaagggaacgacaaaggatgagatggttggatggcatcaccaactcaatggacacgagtttgagcaaactctgggagatagtgaaggacagggaagcctggcgtgctgcagtgcatggggtcacaaagaatcagacacgactgagcaactgaactgactgactgaggtactttaccaatgaggtctttccaccatgctatcaaattcatccagctcgacaactagattatagtgatatggttcacctaaaagaccagtcagttggacgatgtgctcccaacttacacagaaagcagttcatggaaatcatttcagaatcttcatcaatatttggtccaaattaggagatcaagaacaagaatctgggtcatcgtgataaaccttaggagatgaaacactgagaatcttcttgatatctatgtgtactaaaagataagaagaatgcacaagagggacttccctggtggcccagtggttaagaatctgccttccaatgtaggagacacaagttcaatccctggtcggggaagagcccacattccatggggcaactaaacctgagcactgcaactatgaagcccatgtgccacaactgaagagaagcctgcacatcgcaatgaagggcctgtgcactgcgataaaaggtgtcagtgccaccactgagacccgacgcagccaattaaataaatcactgttaaaaatgcacaagtatttttgtcacaccactgtttgtaaaacggtccattactgtccattaacagtagcctgggtaaataaatcacagtgtattcatgcaatagatgactataacaaaaaagaagaataatttaacaatcacatgcaataatattaatacatcctacacacgtaa

SEQ ID NO: 36719 - DNA, 1442 bp, Bovine  19866880397758
aatcttgattccagcttgtgcttcatccagcccagcattttctcgtgatgtactctgcatataagttaaataagcagggtgacaatatatagccttgacgtactccttatccgatttggaaccagtgtgttgttccacgtccagtcctaactgttacttctatggtgctttagtcccttttgaaaaaataaaaagaagtgaaggcattttaagcaaaaatttggaatattttgttgaatttgaagcttattttattacagtaacatttcgttttgccagatgtgatggtcacaagtatggtgcatggttgtaggctatgttgatgaagagaccatggcttcccactgaaggactgacctcctggattggaaacttagaaatgccctttcctctgaaaaactctccaccaagaaatcagcaaagctcccagaagtgtctgcttagaagggttgaataaaagtccttgtatggttttgctcattatttatgtcaaaatgaaaaatacgttctttacccatgattagaagtatctttttcatggctatagcactagcacttgagatgatgtcctccatttggcagtgagataagtggagaagggaatatcatgccaactttggacaacatatgattgtgtatttttagttatgatccaaagtcacaatttggcctgtgaagctggttctacctctttgccaagttgggcaaggaatcttggctgaaagatgctttttaaagacctggagtattggactagatgtcaagacatttgtatttggacttctttggtgccactgtttgaaaaagcaaaggtgtcctggctttgctgtttctttccattttaatgtaccaggaatgatcccggagccctcttacagaacattgtatggctatatcagaacttcatttagaaatatttagaatcgcctaagttggagtgtctagaataattattgtttaataatgctactattataatatataatagtgtctactattattattgctgctttgttattacagttttggtcatggttatagtaccaatgtctctgtttattataaagtgagatgatgactggtattctttccagacagccccaaactgtcccagagaaattaaaagtgaaaataatttatgtcacagtgctgaggaaatgaaatacccagtggtcaagaaataaatatgtcaaagcttctagcaaaatatgaagtgggaatgtagctccagactgtgtggacctactcactgcctttcactgtggaaccagctttaatatttttgacctcaccatatggcatgtgggatcctacttccctgaccagagattgaacaagtgcccactgtgctggaaacactgagtctaaaccactggaccaccaggcaagtccccagaaccagctttagatctcaatattctgctttgtattaactttcttta

SEQ ID NO: 36720 - DNA, 715 bp, Bovine  19866880427711
atctggcatttacacaaggtttggcctcgcattcatttgcatctgaaagaaagaggatgaacagtgagaaatggggttctacccccaccccaaccctcccacacccacaaaagaaaccaccaatagtttgtctgaagtgagacatttcagtaagctcgctaaataagagatactatctggaacatctgaatcctcctagccatgatccaataaggcacgctgactgatcacttcccagctgctgtgaacagccagcccccaaccagagggcagaaagcaccaggcacttctgtgcagaacccagcgcagcctagttgctgggatttaaaactggcagaaagaatgcagacagctcattcttcatgagatcatccccgtttggaacccagctgaacacttctcggacagacgattgacatggttcgaggaatcccacgactttcccacagggcctccaaaagccaagccatttgcatatgagggatttctcccaggctcgctgggcgcgaccctcgataataaatgacttctcgggagggacggcacgtgaactggcacagccggtcacatgcgtcttccccaacagctcggaggactcacgctaaccctggtgcgggggctctcttacctaactggcacgttttgccagtccactggggcgggcccccgcactgaaatccgttaaccaagtccggcaggtgcccccggggcacag

SEQ ID NO: 36721 - DNA, 1394 bp, Bovine  19866880473752
caagaatactggaatggttagccattcccttctccaggtgatcttcccaacccagggattgaacccaggtctccggcattgcaggcagattccttaccatttgagccaccagggaagccttaggttcttggcctcggctactgttagaaccatctgaggagctttacaaaatattctcagactgtccctatcccaggttaattaaatcagatcctaaggagagaaatggacaagtggactgtttgaaagcaccccagagtaataaagtacagcaaggtgaggaccatttctgggtgttgtgtagacgcaatgtaaatttgctattcacttggtgttagaatgtatagggaagtagagattcttcagtacccatgagtaagggctgtagaccacaagatatcaaatgctaaaaggggaatgacaggaagagcttccagtgtctgaaccctcaacggaagtacaaattttgtaaattcctcaaggcttgaatgataatttctcttccaaaccctactcataagaagtgaaatactattgaggacaggagctaaaatggaggcaaagtatgatactcgtctcctagaaggaaagattttctttgacagatgcatttacagatccaggaggcaccatcaatgtaggatactatgttaggagagccccctgcagttgtgcacgcatcagccatgtctataattcatcttcatgaaaaatgcacaccattgaggcaagttggattgaaagtacttcctcttcttgaaggttatttggcttcacattgttaacattttccaaatgattgaaagtcacatttttttatcttcaataaattatcctgagaactccaagggctataacaatttcataaggaactcagctctggtaccaaaaaggcaatatttttaatctctggcttttgaggtaggcagctagaaatacaggcaaaggatttcaggttcacaaaagtgaaaccaaggagcatctgctaatccctgttcactctctaatatctaggtgacatagaattgacagacttagaatttgccataaaaatattgttcacatcatgcttgattctttaataatagcatcttagctctttcacttactagctatgtgacttggcaagctgcttgacttccttctgcttccttgtgtaaaataggggcatgcacttactatcctagtgattattgttatcttctttgtgcttgttctctgacctgtcctactctttgcagccctttgaactgtagagcgcctggctcctctgcctatcagatgctttcaggcaagaatactgcaatgggttgccatttccttctccagggaatcttccccacccagggactggaccctgtcatctcctgtgtcttctgcactgcaggcagatt

SEQ ID NO: 36722 - DNA, 756 bp, Bovine  19866880479733
caatgaaattaaatcccagaatcccagctcatcagcaaacatacaaggtaataagttcaaattgtaaagggaagttagtgagcagccagagatagcctttaaggaaacagtcactttcttatattaaatagtataattaaaaagtgagatgacaaaatgaccagaatatttctcagttaacaaagtaaatgaaaggtaataagataatccaagaagtacataaagttgaatagtatagccatggtactcaaatgaagcaaattaaactgaagcatgattccaaataagtcatgggatataaaaaaccagaccccgtggactgtagtctaccaggcccttctgtccatggaattctccaggcaagaatactggagtgggtagcctttcccttctccaggggatcctcccaccacagggattgaacccaggtctcctgcagcacaggcagattctttatcatttgagctatctgggaatccctatttgtctttaatatttggaaagtcctgctttaagtagcattgattcagagtgtagaatttcatttccaaaaggttcaaccacagtccttgattttataatgaatattttcaaactcaatacttcacttctttccatctctctcagtatgcttcctaacttttttcagcttttaaattgtcaaaaaactcagactatacaaagggcagaggtattgattttcacatcttgcatatggaactcaaaggatactgtccaatagttgtgtaagaaata

SEQ ID NO: 36723 - DNA, 1927 bp, Bovine  19866880507609
tttcacttattcagtcaattgagaataacagttcgtgcatttggcagtcaaatgggaaatggccttgcatgttacaacatgaacctgattacatgaagtgatttattttcttgtttagacacagtgtaccaagaaccttcttcaagtggaaagctgttaaaaacgtgagaaccagcagtgctcactaacttacaggaatgataaatgcaaacagcccagaatccagaaactgtcttgagaataacagtttatactgtcttttctttgagcatctaaaccctagactctggagtaagtatgcaactttagtccatcagatgtaggtcatttttctttctgtgaggtctatttcacttatatcttgtctggacagggtggagcccctgcttaaattctatttctagcttgcagaaagactgaattatcgtagaccaaagccagtgctacttggaaaatgggaaaggcgaaggagacaggacatgtcttcctgtctggcccaactgtgaacttggctgggaccctgtctctggtgggcgctcctgggaggttgcacaggcctgggtcaagcttctgggccgggcctgttaatgcctctcatctcgtgtgaaggccggtccttggggactctttcctggctctttctgccgcttgactctgtggtcagcatatttgtatgtgaccttcactagaaatctttagcccagagacctggtatgctgctcctgtcctctttctcaaccgttttctatctattacatatatatatatatataattctgtactgtatatatgcacatataattcagttatatcaaattataatttttcttcaaaaacatactgcagtaagatttcctgaagccctcctgcccctccctgctgcctttaacccgtccctctgtcccttagcccccacatgtcacatctcagttcccgctctggctggggagctgcatccaatgggcccgttgtatgcagctcctctctgtgttcatggctatgatactgaaatatgattcaggaccacacacagatagcaaagtctctggccacttaagcatgtaaacagtctagctttttataaagtggaaaaatatttcttgtgcactattttaacatgatcagcatgttgaaacttggtgagcaactgtgtcaacatttctttggctggaaagagccaacctggagagcctggtggtaacatataaaaagcgaagctgctttgtttactactgggatttgggcagcaattacagcctgcagttgacttgcagacttgagacataagtgaataagtgaaatcattattttttgcatcatgattaggctagttgaaataatgattccttgtcagatagctaagattccttcagagaatcagaggaaaatggatagctgagttcccatgaagtccttttatagaaaaactcacatcgtacctggtctgccagtgtcttcttttgtttcaaatatttactgaacacctcaaacatgtcagattcttttttacacgctgggcgtgcggattaagtgggatagacgggctattggctcatggtgcttgctgctgctgtctcaggggaaacagtaaataagaaatcaggtacacaaaaaagacaatatttgtgattgctctgagatgggtttgctcaacgtcagatatttatggagggcacttttgagtctattagggtagctcagagtctccaaactaatgcatttcttctcttacaggtctcccatgctagcacaggaggcagacagtaagcagtaaacaaaataagtacatacattagggctttcctggtggctcagtggtaaagaatccacctgccggtgcaggagacccgggttcaatccctgatccggaaagatcccacatgcagccaagcaactaagcctgtgtgccacagctattgagcctgtg

SEQ ID NO: 36724 - DNA, 1139 bp, Bovine  19866880514824
ttctctacttggaaattgttacaaaaacgtttttcaaaatattccttacaaaggaaatagcttaggatgtaatacagacatgtttttcaagccaaatggaaacatttttatcttgggggaagagcagtgtagggattaatataaaagcagaaataaggcagaaagaataagcttttactaaatgagttaccccaagttttatctccctggagatgaatttttgccattctttctactttacaaggtctcctccatcttccttggatatctgaaccacatttctctctctctatccctcagcctctgtctgtctaggtttccaaaatgtttgctcggctttgtcctgctaacaccactcaataaaatgcgctcactaccttgggagtatatgtggtcatgtaatcccataatcatattcctagatgatatgtcaaaattcatttaagttggacttagctctcagcatgatctcacaaagatgtccacgagaggggtcaatgatgacttcatcgtctaaggatgaatgcactagcagagcggaggcccatttcaatgacaaacagaacctcaaggtcaaaataaaaatctaagaaatcaagtacctctaaaatccgaaaataactcatttcatggatgagcacagaacgagagacttggaaatgcttctttggctgacactgtcatggaaaaacaagaactggagcatcactttcctgaagttatggtgaaatccttagggcaatgcaccaaagtgaaagcgttgagtacagagttgtgtgtgggtgactgagaaaatttccaagttctgaattttattaaatatgatcagatctattaaacatactaatctctctgtgtatatgtttccaattctgtggtcacttttatctctacttcaaccatgcccaactgctctccttttatgtcatttctaagaaagtttcattaatttgttcttggatactaccatttcattgtctactagtacactgtttttatttttagatttatgacaacatttggaggataattgcattttgctaagctgcagttttcactgcaaagtttttctgtctgtaatttgtcttgcaaaaactttcaaaatcattcttgggccacagtcataaaatcatagcagt

SEQ ID NO: 36725 - DNA, 957 bp, Bovine  19866880533036
cttcagtttcagccccagtccttccaatgaatattaagggttgacttcctttaggattgactggtttgatctccttgcagtccaagggactctcaagagtcttctccagcaccacagttctatgggtgacaatctggaactttgctcaaaactctacagtaagtcccctatttttgttctgagagcatgttcctaagtccaatttgttcttaagtccaacagagttagcctaaggaacccagctaacacaattgactatatagtactgtactgtactgtgataggtttataattcttttcacacaaataatatgtagaaaataaacagatacaaaaaataaagaaaacatttttaatctcatagtaccttgaaaagtacagcagtacagtacaacagctggcatacagaggttggcatgcatgttcacatctttgaaagtttgcaaaacttgaagaccttactgtatttgcctagcaaacatgctgtttttattttgattttaagtttattggggcagcacatagaaataatggggtatgacggcccacaacttccaagcttgtccttgataccaccccctgagcccttttcagttacagactcattagaagtcctacacccttatctgtactttcacaccaaggacaagtggcttgcattcagaaaaaatacagtaaatacattgtttaattatctagcgtccctacggacctggatacttcctttcggtgagcacctgcctaaaaggttttaaggaacccactttcccccagacacccgactcagatcagaccttttcagcttctggggcctcttttggaaataggagctttcctgaatcattgacgccctctagtggctatctcaggctgaattcttgcctaaactcagcagtccttccatcccctactaaaattaaaacaagccctaaattaaaaacaaaaaaagaaaaagca

SEQ ID NO: 36726 - DNA, 1272 bp, Bovine  19866880546897
gtaatatttttaaaaattttaaatagcaatattagccaattaagtttaaatatttttactaattttgtgttaattacatgccttaaggaaatcagtcttgaatattcattggaaggactgatgttgaagctgaaactccaatactttggtcacctgattaaaagaactgactcatttgaaaagaccctgatgctggaaaagattgaaggcgggaggagaagggtgttgacagagaatgagatggttggaaggcatcaccgactcaatggacatgagtttgagtaacctccgggagttgtttgatggccagggggaggcctggcacgatgcagtccatggggtcacaagagttggacacgactgagcgactgaactgaactgaactgaattaaacggacattcaaagttattaactctttgttagagagggaactgcatgctgctgaatgttatggtagtgagttatttttttccagtttatgagaaatagaaacttaaagttcagcagctctataatagagcagaaaaagtactttcattttcctgtcttctaagcaggcatagaaattttgaagtcactaacattataaataagactaacatgcctgcataactaatggtgtagtaactgattcactttgatatttttttttaccttataacaaagctcacattctttccccatccccctaaaataaagagataatggaaaatgtaccacatgcaatttttgccctcatcaactgtctctgaagagacagttttcaaatcttgtttccaaatctctcacccccagcagattattctgatacttcatttttcacattgtgtatttctaaaaactagagatctgcccagattgagacaagcttcttcaactttaacatgctgactcttttcttattgggacaaacatccctcaatatatgctgctgctgctaagtcacctcagtcgtgtctgactctgtacaaccccatagacagcagcccaccaggctcccccgtccctgggattctccaggcaagaacactggagtgggttgccatttccttctccaatgcatgaaagtgaaaagtgaaagtgaagttgctcagtcgtatccgactcttagcgacccatggactgcagcctaccaggctcctctgtccatgggattctccaggcaagagtactggagtggagtgccattgcctttctccgtccctcaatatatagtctaccatttatgtcctcctgggataaagtcagagaaagcaaattgagatgtacag

SEQ ID NO: 36727 - DNA, 810 bp, Bovine  19866880563717
tcacttcagtcgtgtccgactctgtgtgaccccatagatggcagcccaccaggctcccccgtccctgggattctccaggcaagaacactggagtgggttggcatttccttctccaatgcatgaaagtgaaaagtgaaagtgaagtcgctcagtcgtgtccaactcttggcgaccccatggactacagcctatcaggctcctccatccatgggattttccaggcaagagtactggagtggggtgccattgccttctccactgggagtggtatgaacccaagcatctatcccctgggggaggctagtcttgaatcaatgatcttccagatatagccacagataagaagagggcaagagaagggagatattaagaagtggtgtaaacaaggtttggcaacagattttgtgagggagtgagtggtacctggcttcagtcccaaggagaaaactttgtaagggggagtggtaagcatttcattgtgggtcatgatgaatttgaaatgtctgtgggtgagctgggaggaggtgtttagtaggcaggcagatatgatttggggcttcagaagagaagccccagttttaaacatctgcctggaggctgtagctgaagcttttacagggaatgttggctttatgttgagtgagaagtgaaccaaatttagtaccttagggaaacatcaactcctaaaagatgggcagaggaagagaacattcagagactgagaaaagagaaaggaaactgagaagtttcagaagaaagtggtttcttaaaacatgaagattgagttttgaagtcagaggtcaaaagtat

SEQ ID NO: 36728 - DNA, 2029 bp, Bovine  19866880572289
atggggaaacagtggaaacagtgtcagactttatttttggggggctccaaaatcactgcagatggtgactgcagccatgaaattaaaagatgcttgctccttggaaggaaagttatgaccaccctaaatagcatattgaaaagcagagacattactttgccaacaaagttccgtctaatcaaggctatggtttttccagtggtcatgtatggatgtgaaagttggactgtgaagaaagctgagcaccaaagaatgatgcttttgaactgtggtgttggagaagactcttgagagtcccttggactgcaaggagatccacccagtccattctaaaggagatcagtcctgggtgttctttggaaggaatgatgctaaaggtgaaactccagtactttggccacctcatgcgaagagttgactcattggaaaagactctgatgctgggagggattgggggcaggaggagagggggacaacagaggatgagaaggctggatggcatcaccgactcaatggacgtgagtttgagtgaactccgggagttggtgatggacagcgaggccttcgtgctacatggggtcacagaatcagacactactgagcgactgaactgaactgaataggaatatgcatcagatgtaatgctagaccagataaatacctcctttatcctctttaaagaaaagagttttataaaaaggatttaagaggaagagggtgggagaaatcaattgatgcataaatatcttcagtttgaaatgcctttgattcttcagatgaaagagtattcagtaagaagctaggaatatgtttctgaagatcatgagagaaggtgggacttggaatataaagtgaaagtgttagttgtgtctgactctttgtgaccccatgaacggtagctcaccaggttcctctggccatggaattctccaggcaagaatactggaattggttgccatctcctcttccaggggatcttcccaacccaggaatcaaaacagtgtcctgcattgcaggtggatcctttatcacctgagcaatcagggaagcccatactttagagaattgtggaaataaaaagagatcacatgtgtgacagtgctttacaatttgtacaaatgtgaacagttcaatattcttctctttggcttagagtattaaagttttcatgatggagagtcaggacatgttccatggggatatggagctcctagagggcttgtccagggctcagggaaatgtccagcttaacgtgcagggcaccacaattttactacttcaaaccaaacgctgtggagaatgagcagtcaacagagaaggtagagacaggagagagtgcatggtagagcactttaagaaatggaatgagttgcacaaaccgtcaagtgaagtcagaggttaaaaagaagggcagtccactggatatgagcaagaggtcactgatgctatctgctgagatattagagtgccttgcccagcctggtacctgttagctagcagaactgcactgctgttcatggccaacactaacagaatgaccccagatagccttgctccatcccagccatatcctgaattattcaaaccaatccatccccacctgattttcactgccagagtccctggctcttggaatcaattcttattgaagatctcacatcatcccctcaaaaacagtagctgacattgatattgatattctgttctgacttctggctgactctctcgaatatattttgagtgtttcttctgacctaatttttatttatgctccttattaggtattgatctctgaattccctccttgattgaacttggcattcttttatttggactgtatttcttctgcttatcgaaagtaatcatcttgccagcctagatattgtcttgaaattcagcccaaccaaacttagggtcagtgatccatagactcatcccattagcagcatgcttgcatgctaagtcgcttcagtcatgtccaactactttgtgacactaggactgtagtcctctaggctcctatgtccgt

SEQ ID NO: 36729 - DNA, 3820 bp, Bovine  19866880596739
tgattgcttagggagtcagagtaggaggatctgtagaggcctcttccagaggaagaggtgcacatgcctgagtaactcctaggaggcctggccacggcacctggaacggcctccaatcactgaaacggctcagttactctatctggaaaatggcctaactgaggaggtcggaccaaacaggcctaacaatcaggccctcaggtaagatgcttaattcaggctgagcggttgtaccactggccactttctgatgctcacgcttatcagctcacataacgaagagtttaaagtatttgaagaggagtgtgttttgcctataagttattctaattcaaataaagtctttatataggatgtgatgaaacgaaatatgacataagtccccctccctccccccaaaaaagaggcagaaaaaactctccaaccaccagaatggccaaactggaaaaggccatgaacaccaactgttggcaagaatgtgggctaacaggaattctcatgcactgacagctgctttcagaatctaaagctgaactcaagcataaacacagggtgcatgaatagcacttttcacagaagtcccaaaccggaactgatgcaaatatccatcaaaagtagaatttttcattgaaaacaaagtggggtgtgggggaggtaacagtcacacagtgcaaatcctactctgcccctaaaagtaaatgaacttcagctagaggccatatcaggactaaatctcacaagcataaagttaagctaaagaaacctggtctgaaggagtgcactccaccatctgtaacgatggagacatcaccattcctcttaccatcatcaaattctgcagcaacaaaacttccgtagtcacggcaagtaccaacatagttccctcctctctccatccctcccttctttcctcccttccagctctgctccaagtataaagcactctgtcaacgagcctccagaaatgatcaagtaaaaatgtctagtaaacacagttgggtacccggtggaagaatcagaagtgaaaggcccaccgaagaagggtgagggttcccaggtcctcaaacaacttcagcaaatcgcttatcctcagagtcagggttttagtcataaaactggaaggtccaggacttaaaagaggtggtctccaggtccactggactctccaaagaccaatacgatccttgttttgaaataatttatatataaaaaatacaattaaagaagtttccagttctacactcaagtatccttctgttatcctcagaaagatatccagcagaaagatccagaacatcagtgaccacagaccctgatgttctgtctacacaattgctttagccgtggggatttcgcaacaacagtgacatctatgacaggataatctccaggtttacagagatgaaatatgttttttcctaacacacttgaagtggattgcattttggtcatgtggctttcttctgcttaaaatgtcaaatgaaatatgcacaccactggcattattctgagtgctttaaaacaaatacttcggaccttaggtcaccgcgagagtggaagtgacatccacatctgtttatttgtcttgcaggtgggggaggggatggtagtcagggacatagaaacacacaaagagaagtgattttcaaagtaatggtttattatgtgaattttgcaaaggattgaacaacaacaagaatatgttatcaaagtcactctgcctttgctgcggatcacactttaacgcttatagttccacgtgattaggggtcagagaacatgctccaattctccaaactcttttcgctgtacaaaatctccagaaataaagtgttattggtaggaaggggctaaatctgaagttgactaggaaagttccagtatgagttcaggaagcctggtatctggagataccacttgagtgataactaaatcctgcttggtcagctgtctcaatacaccgcctccccctctaggaaaataaagcagcataagtcaaactctgactgttttactactgacattattaggagagtggagtttactgaaatctttcctcctctgtcccactcccctcaaggcccccaggacaggattatcttgaagggaatccttcctaaccctgtatcttcttatggttttagtggaaaaccctgctgaacacacctataagagaaatggtaagtttaccatgtaaaagagatttgcacttgcttagtccaaattatactggctgtgggaaaccttactgtttaaagagaaagcagaagagagagaaaacacaaaaagtgtttgtgtctgttcttacagcaacctaactctgatacgtaagaaactcacagctgttgaaatacactgaattgacatacttagggagctgtatttcatttgtccacagataacaggcagtgataaagactgcattatctttgctctttaatgacattgatttcactgagttgagcaggcctctgagactgtgtactaatccggggctcaagcaaagctccactatgcttgaaagctaaatggcagcttggcaaagaatccaggggaccctctgcttcccccttcttgggcaccagctacaggcttgcaatattgatgctctaaaagcccagaactggggtcagggctgggaggaagaagcaaaatggaaatcataaagtgatttcatctttaccttttcataaatcatacaccttttcatctgaaaattacatggcaatggtattccaaaatctagaggcacttgtaaatcacaattaaggatgcctattttcttgagagctactgtggtcctccttagcctgaaaaatctatctttagccacaaatagagactaggattagagagagaactgctttatcatggaagcatcttaccaccagtagtcttcaggtaggtctatttcaaaaaataattgggttcccatggtagctcagacagtaaagaatctgcctgcaattcaggagacccaggttcaatccctgggctgggaagataccctggagaagggaacggcaatccaatttagcattcttgtctggagaactccaaggacagagaagcctggcgggcctcagtctacggggtcacaaagagccagacacgactgacagactgacagacacacactgcactgcttgatgtacgaggcgtccagtcccagccagaggccagcgtctccccagcagcccccaaagtctatccctgcgcctcccaagcaccatgctttataaggagctaccatactgcccaccacctcccaacagacaacctcccaatgccccagtgacgttctagatgccgacctgttgccacatgcacttccttctactcttctccaaagaacatcaagaacccgagaaaaaaaggagatggggtcattttgtgagataaagaaagggtggtctctgctttaaggacagagttctgctactatttcatttcgcattctgtctaaaataaactgctccaactggctttattagaaatttagagactttatgaaatagaaaggaaaaacaaaaaaacaaaaaaaatcaaatgtgagttgaacaagttccaccctgacttagggaggcagcagattagtcttaagtagtactgtgctccaatgagtaatagtacttttgaaggaagtggtcgtttatttgggtcgttatattgatatttcacaatcccaagatgctaagagcaaatctacaacatggagtttttactgtaaagccatccagcttcgcttgttttccagggattcctggccaatgtgacctgagcttccgcaagactgccaaggggaagctgcggtccagct

SEQ ID NO: 36730 - DNA, 1459 bp, Bovine  19866880645040
ggaacaggggcacagcaggaaagtgaatcaattttggacagaggttaatctaaactcagcagaggagctcaggtttagggggacttggttccagaagcattaaatggaattctacattgtcaactaatttattttccatttcaaagctatttgacatgttttcatttcccttttggaaagaaacaactaaatacctgttatcgatccatcatttacttgtataacacaaaaattttaaatctgcagtgtaaaatagtaaataacctcccccacaacacagaggtaccctgagaggtttagtatttttagaggggaaaaatattaacacacagatgtgataaaagatgaaagttgtaaatatttgtgaaaatataagaataacaacaaactctactttgttttcatcttatgaaaagatccacaatgattcaataagttttatttccaattaaatgttctatcaccctctgacatgccatacagattactaattcatatttcaatatttttcacatttaatttaattgatataattgcatctatggaacaactactctatggtctgctttaataaagatgtgtgagatacatccatcgagtcagtgatgccatccagccatctcatcctctgtcgtccccttctcctcctgcccccaatccctcccagcatcagagtcttttccaatcagtcaactcttcgcatgaggtggccaaagtactggagtttcagctctagcatcattccttccaaagaaatcccagggctgatctccttcagaatggagtgattggatctccttgcagtccaagggactctcaagcatcttctccaacaccacagctcaaaagcatcaattcttcagtgctcagccttcttcacagtccaactctcacatccatacatgaccacaggaaaaaccatagccttgactagacgaacctttgtgtacgagacagcaaaagagacactgatgtataaaacagtcttttggactctgtgggaaagagagagggtgggatgatttgggagaatggcattgaaatacgtataatatcatatatggaacaagtcgccagtccaggttcgatgcacgatactggatgcttggggctggtgcactgggacgacccagagggatggtatggggagggaggaggaaggagggttcaggatggggaacacatgtatacctgtggtggattcattttgatatttggcaaaaccaatacaatattgtaaagtttaaaaaaaaataaaattaaaaaaaaaagatgtgtgagataattcagtagaatcacttttatttatcaagcattttgcagaaagcctgggactatgtaagaagtactaaattacatagttgtaatttaatgacaaagttttatttaatatcagataaagagtgaagcacgagttagattatggacagagaatttagccaatgtacccatctgtctc

SEQ ID NO: 36731 - DNA, 1161 bp, Bovine  19866880657834
ttcctctcccttacacacctgtggattttaaaatatcattctagggtctcaccacggagcatatttgcagcgaactgcgaaatttgaatattttgaagaatgtttctgccgaatattcgatttacatagcttgcgagccttccccttctgcaaacaatgaaatacacgtggccattgtgagtatgagacccattcacaccgagtcgtttcactggaagtagcccagaaagctcacttagctggtatccagatgaacagatacatggaaggagagcttgacgtacatgtgtgttaggagctcagtcgtatgcaactctttgcaaccccatggaccatagcgcaccaggctcctctgtccataggatttcctaggcagtaatagtggagtgggttgccattcccttctctaggagatcttcgcagcccagaaattcccagctgggtcctccagcactgtagacagattctttaccgtctgagccgccagggaatagcatacatgtatggtcaaataattttgagtaaaagtgactggtgagtgtccctgaccccctgggtctgatgcttccttttccagtctgctgaagacatccgggatgatggaaaccctatcaaggagatcaccgacaaaatcataaatcttgtcagtaaacgtgacgggaacagctcgctgattgctgccgttgcggaagtaagagttcagaggcgtcctctgaagagcagaacaggtaggtggtggggtcggggtccctttctgtggggaccgtcctgtccagctcatcaataagaccagcacaacctacatccaggaaaacccccaggcgggaagttacctgccggttccctgttcaaggacccccatttttaactagcaagaagacagaggctggctgacatgactggatcccatgactgtgggcagaggtggcctgacttgtcccctgcctgcgggctgtctctggctgtcaggcaccgccctggcagagtgttgccgtaccctgagtatgtgtcttcgtggagcctgcttgtgctctggggttgggaaacagtccatcctaagcacagctttgatgaatggctcagtggccctgcagggcagccggagtcccccggggatccctggagcatcactgtgctatagcggcaagggacccccggggg

SEQ ID NO: 36732 - DNA, 4712 bp, Bovine  19866880674040
aaaatgagaaagcacatactacaaaaaccgtgaaaatgcttctgatagtatttaaatgaaatataaagcattctttaaatgaagtgagcaaaatccacatgtttccactggaagctttcattggggtcagtggcttttgaattctattccatggtgaatcactgacattttcatggaaaccagtacttttccccaatgtgctgtttcttagctgataggatttgttttccctctcttttcttgtgctcaattttgagctccgtcaatcttatttctgtttcagcagagctctttatgcagacaggtagattctgaaaattcactcctaatgttatagcttacagccttgtcttttaagcttagcacatacatttgagagtctccgtggggtgtgtgtgtgtgtcttgctgcagtcacagcccaatctgtctgagcttacctctgtaccaatttttgtttttcatatttttggacttgtgacttgaaactttaacaaaaaggaaaaagcgtctagcagaccttgaacctggacatgatatatgtcatgattattatgcttctaaaataatttgtggggatattagattaccccttatgtttgttatcttttaatccatttgaaatttggccctcatggtccaaaaccagcttcttatctcatcttaaataaatacataagaaaagtgttttagagactagaaggctgaacagagacccaagaagagtcttctgaggattcatatttaaatttagataccttttccagaacaggtgagcccttcagaaaatgcaatgaggcacttattccatctagcagctaaactcttaagtatacacattaagtgcaataaatgaagcacatctagtgacaagtgttaaaagtttatttcagaagcatttctagaatgttgaattatcttagtaaattaacaaatactaaagtaataatgctgctggcaaacaactgtaatgtaatatagcttaactgattctcagaccaatgaaaacagtgatttgtggttcgagaagacaattgtaccacaaagtattactgttttcagatagaatacagaaaaaattagatcttgtatgacatgtaatattaatacttaatattttaaattattaaggatgagttacaacatctccatacaaatgaaatatcatcctccttaggggcactggtatttgtacagatgtaagctttctatagctgctgtcatataaatcttataatctggaggacttcctaaatgtgaagaattttcattatgaaaagttgactggtctgagcgttttgcacaagccagttccgttttcttatcttcgaaatgttctgatatccagggataacactggtagctcaccaagtcagcttatgagaaaagtgccatttccatcttgaggctctttcactgttttgcatgcttccctttagctgtggtcagccttcagcttcccttgtccccacctctgaccatccttcacatgcacacttccctcggtcagctaatgctgggcactgacggggcagcttcaatccctggcacctccgagcccctctctgtgtgtccagcccacctgtgcagcccctcctcgtggtcctgtcccccatttcctttcagcgcctgctccaggaataatagcacacccaagtcaagcagggggccctgtcacccacaaatgccccatccagccaagaccctagtccttccgtcccaggtgcctccgagtcagtcctccctgacgcttggcctctgcagagccctccccgtcccggctacgtgaagatcaaagaacacctttccctgccaggatggcctcctgctggtagacgcccgtggggtctggccctcctctgactagcccttgaacttcctttgtcccttaaagctttggatcattttatccgttcacagggacactcgccccagggccagatccatctcgtttctctcagtagttactttccaggaactaggggaggcctgggagtgggcttcctgactggcgtattggagccgttttggggaagaacatcaatcatttgtccggtaactgttgacttcgctccctcttccccagctgcagaagtggcgggggagagtgggcaccgggcagagcctggccgccttacttgtgctgtggccccaagtagaggttgcttcctcctacccctttcctcttttcctatcgaatcttcagtgttgaagtgatgactggctggaaaacctgggagcgtctgttcagagctgctccgcctggatgcagggcagcccaagagagcagccgtgccagacgaaaggagcgcccagggagcacccccacccttgggggccgagtgagtgcagccacgccgctgcccagcactgggaaggtctgtctcccgccctgcacgagggccccatgcggggaggcgctccgtgttgcaatagctctgtccctcatgccctcatgccagggatgtgggaatcgtgctgtgtactttgggaagaaagggcatgattacgggatgagtcactgtatttttcttactacagtttctcataagaaatctcgaagcccttatagtctcagttttggaactattgctagaagtgggtccttttgcagtttttacctttagtttcaaagttttgcttttcccccaccttctttttcttaaaaatatgaacagcaggaagctcagcaatgttgtcttgcatatttacaaacccaagtccctgtgtcaagactgctttctctgatgtaaagcctgggaacctttgggaaagtcaaaattatttctcatttttattattcctttattaagggaaataaccaataataactgaagccataactttactttccaaagtaataagtttattgtgtaaataatcacagacccatctggatctgggacatttcagagtcagcacaaagctgctgtctcacagagcgttggttacagccactcctagtctctggtggcccttcccatctgttcttaccatcacattctaacataatttgctgagtgctgactctgtgccaggaactctggcaggcactgcggaaacaaagaaaaagaaagaaatcattcttgccctcaaggagcttacagtcttgcagatcaagggctgtgaaggtgacctggcgacccaaaaattttaatttaggtagagcctcccttttttttaaggcgtatccattctgtaccttaatggttcatttggcccctctctacaattcagaaggaaagttcaaaagtcttattttcttttaaacctaagctgtaaaaacctgtgattctttgggaaatttaaaaatggtgtttattaatactagtgctgcagaaaagtagatgtgggcgctaagatgtttaggctgtcttcctcaccttcctttgacatgtgaccaagctgtgaaagcatctgccaggagtcttcagaaagcactacccctcgccagagcatcctctcagtggaagggttgctggcatgcccgacaagggacaatagttaagcactaaactatcgttcaatcttaaagaacactccatctagtttatgagtataaaattgaagtgaaaatgagtctaaagaagcaataaactgcccttgcctgggttatttttagcctggctgtcctatttctcagttgtgagtaactgaacctcggtgggccttagtcctcctgtcagtcaagggagagagtatcagagtatatcaaaaatcctttctcacactgtttctaccagaaaaagtggatgaaaatacatctaaataaaaatcacaaaataattttacacaaaagagcacttgtagctttaaaagttgagattggaaaaaaaattcaggggaggattatattttaatcttaggaaagataaatagaaattgaaacattttagtcctgaattttttgttgttgatgttcaatcactaagtcatgtccaactctttgtgaccccgtagactgcagcatgccaggcttccctgtccttcactatctcctggaatttgctcaaactcatgtccatcgagtcagtgatgccatccatgtcgtccccttcttctgccttcaatctttcccagcatcagggtcttttccagtgaatcagctcttcgcatcaggtggccaaagtattggagcttcagcttcagcatcagtccttccaaatgaatattcaggattgatttcctttaggattgattagtttgatctccttatagaagaaataaaagaatttgtgtactaacttcataacccaacaacagaattctttaactttcatgagcaaacttccaatataagtttaaaacagatcattcaagaaaagaactctttcttaataccaaaaaaattaataagtagtggatgatttttctatgtttttcttactgtatcatagactttaaaaatccattattcttattgtatttcctaaacagtgctagtggtaaattatatggaagccattaacaagagattcatgtagcactaggaaattttccttgagtgggaagaggtaatttccatatttcacatttcccacagtgttttgaagttggttttttacttaataacagcttaccaaaattgtacatgttcactgtacaaaaaatttcagaatcaaaacatatacaaagaaagtaaaaattacccataactcccaacccaaagatagcttctgttaagacctagtctgcactcctctatacttcata

SEQ ID NO: 36733 - DNA, 1459 bp, Bovine  19866880692913
tgttcttgcctggagaattccagggacgagggagtctggtgggctgccgtctatggggtcacacagagttggacacgactgaagcgacttagcagcagcacggctaaagggtattcttgtctcagaaatcccatggacagaggagcctggtgggctacagtccaagggagtcacaagagatgggcacaacttagcaactaaaccaccacattggctaaagagggaccttgaacaacacatggaattttctttcagttcagttttcttcactggtaaaattatggggttggcctcaatcaggccccaggggatatgcatcaggggtagtgaccttttaactttaatatttatgaattaatgaaatctatggtagatatttattaaagattctacaagtagccaatttctattccattccaatgataattttgttgttggaatcatttcagttcctctctatattatgcatatagaagcctaaatagtacacagagctttctaatatgctcatgactcaagcagcagagtatataaagaagatggaacaaaatatagactctatacctctgtcataggctgttggctgttgtcaagctgaaaatggtttatttagtattctaattacaaaaaagcagggctaaaccacttatattattcttaagattccttttaaatataattaacacaaattaagacaatatttgcaagggtcctgaaaacaaaacacaatgacaaaacgactagactattgatttaatagatttcttaaatgtaactaagaaaaatttttgctatttaagctgtgttttctcaaagtttcaccaacatgataaaaataccagtgaacctctccctctctgtctcttaaagaaatggagagagtgaggactgaagaatcatggtgatgctgaaaatgtggtttttgaattcatatgttaattgtattagattattattcagcttatctccactccttcctctcaacttccaaggaaattgtgtacttttctgcctaacacatacaaggccttgatcacgtgtccttgatcttagactgttgggaaagcctagagaccttttcaagaaaattggagaaactgagggaacatttcatcatgcaaggatgggcacaaatacaggacagaaatagtaaggacctaacacaagtagaagagattaggaagaggtggcaagaataaatagaagtgtataagaaaggtcttaatgacccagaaaaccacgatggtgtggtcactcacctagacccagacatcctggagcagtcaagtgggccttaggaagcattaccacaaacaaaggtggtggaggtgatggtattcagctgagctattttaaatcctaaaagatgatgctgtgaaagtgctgcacttgatatgccagcaaatttggaaaactcagcagggccacagggcggaaaaggtcagtttccattccaatc

SEQ ID NO: 36734 - DNA, 2084 bp, Bovine  19866880705248
tatttccagttaaacatctagctttgtctgaaagataatactgaagttgtgggcccggacaggaagaatgaagttgggaaaataaaatgtgatactctctgcagcaactccgttaccatttatttccctatctgataagtgaagaaaacgaggaacaggaagattacataacttccgccagatctgaggctggaacacccgccatttaacccttacgttagacggcagccacatgccaggacagtgcctaggatgtggcagatggtcagtaaatgctgtgtggcgctgatcacgtgagccctgataggatgttgcacttgggcctggtgagcagcttctggagaatgaatatttgtgatgggtattgatcgatttgcctcttttatccccacctttctctttatagggacacttttagcatatgcattctttatgggtttcaaagagcccatgaaattctttatggcttaaaaagtggtgatttggtaggaagttcaggagacttgtctggaaagtgagttttcctagcacacgtacttttcactcgggttcagtgagtgctgtggatgccagctggggaactggtggagattctgggcatggtgggtgggaaaagcatccccctagacacacctgccattgtcaaggtggtttacctcttttctctcttctctatggttcagccaaacattaaaatttcctgggtccagttgatcatacaatcttcactaaaaaccttgcaagtatgaactgatttgcctctcaataaatcggtcagtcattttcatctcttttcttccacctcctgtgcccaccccacaaacacggacagatgtgcacagaacacacgtcacatgcccaccacccatgtttttctgttcgtttgttttttgctctcaatcaggaaaattcaagtaagactctatttgtgaaatataactgctcagaatcagttcagaatcaacatgaccctagtgaaagccctagaattctgtgttttcccagcaggcttcagaaagaagtggaatcaacacagtcaaatataagatgaattccaatgagctccactaaataatgccaaacctcgaggatactcattacctgggctgaagggcatgaagctttgaagtctcagatgtaggtaaagacatgtttaaaatttcagtcatgatgtgaattaatatacttctattccttgccaaatttggaagcagaaagatgattttacatggggacaaaaaaggataagagaaaagacagcttataatttacatgtgcttctgaggtttcaaataggctgcagtggtaagtaagcaaatagacttattcatgagtctatttaattataaattcatttaaaaatatgtaccaagcaccaactgagagggaattagtgccatgtgtgtgaatgataaacaggatagtatttctggcaccaagaagtttgtagccgagtccaggtgcaagaacatggatctggagacatactcagggtgaggccctggcagtactcagaaacccaccctatccaggaaataatactttctttagactcacaaatttaagagaaaatccattctcctgaaacacagctaacctaggttttcacaatcagaagcttcctttgtgttaaccaaactcttgacataaatatgaaagacagattgactttcttaagtgtgtaagacagagcacaagtgtgtgttgaatggtccagagtcttttatactgaccaccagtttgagttattgaaagcagtgtcctcccctctcctaacatctccctaacatcaaagacctgctgaattttcccaagtgcatcttcaagaattgagaaagcagtaagaaagagacttcctgtgtaaaggatacttaacatcacatggccttggagagaaccaaatcttatcatacatctctgctctccttcccctatctcactcccaacttactttcctggtataagtttacccaagatttcacaggtacacttcctgatggagtccccttccccgaccaggccatgccccattttaaacagtctcataacactccatacctttgacagtaccatttacaatactg

SEQ ID NO: 36735 - DNA, 1791 bp, Bovine  19866880714683
aaaaataattaactaaaaatataaaatgtatgatactaaattttagtgacagtgaattcctcacatagtcatgtcctaggatgtagagtgtgtagtagtgtgtagcgctagttgtatatgtacagtgtgaaatgatagcatatggtacaagctctgtgttttttcagtttggtcctttaagactcatggaagccttttggatactgctctgcactttcacaatccctgcactagagctcatagcgggaaaatggcctattatcacaagcaaatgcccactgctttcttggtgccctggccaggggacagaacatactttgagttgctagtccttgaaagagcaaacatacctccaggaggaaaaaaaaaagagcacacaatagtctcaccaacattccatttaatatttactcttctctttcttgggtcaaggttgtggaatataaactgggttcctgccaggttcttaccacttccaacagtcatttttcagaaagttctgttttgggggaagaaattttaagaagtagtacctggaaggaaatcagccatgtttatgttgttgagtgattctgctatgtttgaggcgggaactgcactgcccgtagatgttaaatcattcactgtttggagagaacttcctttgggtgcagattttcttattctccaccagcagcagctatttttccagctgcctatatatgtttgtgggtttccctggtggctcagatggtaaagaatctgcctgtaatgtaggagacctaggttcagtctttgggcagggaagatcccctggagaagggaaaggctacccactccagtatcctggcctggagaattgcatggacagaggagactggcaagctacagtccatggtgtcatggagagtaaacacgactgagcaactaacacacacacacacacacacacacacacacacactccatatgtgcttgcaagtttttctcccccatctagactgttaataagtggagattgatgaccacacctaatctatcacccctgcctagaacagcccaggtcagtaaggcaagagaggaagccccgcccccttgccaaggcgggacttccactgcagcgccccccgacagtcttcacctacaggtcggaattcaccaccactggtttggctttcttctcttcctgaacaggtttcccccattccttagggtctcccagaagctcttcctaaataaatcaattaagcatgattctcatctcaaggtcttcttctaggaatctccaaatgactataacccagaggactgagaatcagagccctagaaatatgcaaattagcatattgtcttagttagaggtccttgatttccaaagaggagaaacccactcaaattaacttggatggagagtttatagaagacttgaatcccagaggtacaccattgcaggaattagaaagtcattttaaacctgttgaggccacatggtctctcttctccaattctctcagcacttgtactcaagctttattgctgcaattaatattctacaggatgctacagtctaatgtgttatgtctgtgcatgtctgcaacttacgaagacgacagaactctcgctctggctttacagagaacaaacttatacagtctcttagtaccctaggtccaactgccaggggagaaaactcaaaattctgtaggccacctagggtaggtgtctgctccatgacagtcagatatggcctcagaaacagggtcacctgctccaacatagccacttcttcaacagtactggggacatgggtgg

SEQ ID NO: 36736 - DNA, 1670 bp, Bovine  19866880754838
tccctacttggcaggacattgctggcaaaaatgccccatttggcccaagagaaacattttttatttgtagaatcgtttccattatgattaatctttctttctttttccaaatactcaaagacttgctttattatagtacacatgggatggaactgacgggagggggtggatgttgtgtgcaaccactgccctgattagcattggatgcccatccgatggccatgaatttgccaaaggtgccactgctctgcatcgtggtttttccaatgccgcccatcagctcccgaccccgcattcccatcctgagacaggaaaaggtgccgaagagcgcccctgccgctgtgcccacggtgcaacgcatcacgaagcccatcttcacgcggtcaaagcagcttggctaggactgtccatagggacccacggccaccggcatctcgcttgtgggctttgatggtggcttgcttcccggccctggtctgaccaagaaccattctcacagccccctgcccacccctcccagggcctcttcctgtgtatgagtgtcccatggtgactgcagcagtgtgatatgggcctggttccaactgagcaggggtcttaagctcctgctggcgttaatgacagccttatcatttgggtatcgtggaaatcacgggtgttttcacttagggctaagaaggcttctctgttaagtttttaaatttttttttttttactttgcagacaccaacgactgcagtcctcatccctggtaagcatggtgccctattatgcaggcacttgttggctgtgacaggtgtgggcctcctttataaaatccagcttctgattcaggagagctgggggttgctgcagattccttctttccaacaagctcccaggcagtgcccatcactccagtccgtgggccacacttcagtcagatggtgtccacgtttagagcagtgatgctcagacttggagggtttagtgcctgggacgcaaccggagctcctgcaacgaggaactgtgaattggacgctctgggggtgggacccaggcactggtgcgtgtgggcagggctgagagctgcccatcataaccggtgtggggccacctttggcgggggagtggcagacagggaggtggtaaccaagtggcctttgctctcgtagttacaacagcggcacgtgcgtggatggtgagaactggtaccgctgtgaatgcgcccctggcttcgctgggcccgactgcagaataagtaaggaccacctctgactgctgtctccccaccccttagtctaaaagttctcatctctaaaacagttatggccatggttctgagtagccttgacaattagtctcctgcttccagctgggagtaagatgcccctggctggactctccatggggtgcacagccaccctcactcctggggagagctcggccacagcaactgatggttaatctactctgaggctataagaaaagtgtgcttatcctgtggtagcatgaagcgatgggcaaggatgcatagcttcagacttcagccacaggaagggctgaggctgtggtttccaaggcttgatcaggccccactgaaatgattcagacaaaatgaggtcaggaaatccagttttttaggaagtttacagtttattctgagccttttccctacttttttacatgcc

SEQ ID NO: 36737 - DNA, 1378 bp, Bovine  19866880767105
tggcaggctactatccgtggggtcacaaatagtcgggacaggactaagccactaagacacatggtccactcagttaatcaaggattgacagtaatttttttgttgtctgtgttttgacaagacaaagttcagcaaagctgttattttaggtgatgtagttagaaaagggggaaaagaaaaagaaattattgttctgtttggcataccagtcagttcaataggcctgaagacaccatgcagtccattctaacgtgtacacaaaattgccaaaatgtgaactgttgtattaaaattgaggataaaaagaactactttcagggtcagtaattagatttcaggaatgaggaattcacagatacttaaaatcaacatttgtcacgccagaagaaaaggcattatacaattccaataaatttaatgaaatatcacagccacaagagctgggttaattaactgttcaactttccatttagtgttctcttcatgtttaaattacattcaataatttttaaaaatgttttaaactttttttttttttcaaatttaaacggagccaaatgaagacgtaagaatctgccttacactgtgttcaagaggccagcagatggcgccccgcaagcccaataggcagaatgagagccttccccgcattgcctgcatccgggttattgtaggcctaatggatagggttttaactgtgtgcatacaagagtaatctgatagccagggccaggttgtttacaattaagtgctctttttgcccttcacgttactgatcagttctatgcagtcaaaaagattatgatattttagtggggcagagatgtaaccagtttttctccattctgctcattaatttctcactatttattcagcactaagaactgagctaaaaaaaaaaaaaaaaaaaatagcggctaaaattagctccactcatccattactagatcatgggtgtgtgtttagaggatatgggcttgtttgccctctcattttggaccaagtggcacaagacctgttaacctctaatgtatcccgctgtgagaataaagacatgccaggtgtaatacactggggaacctgacctcagcgacccgcacagctattcagcagtgcccagaatgttcttggcacacatcattatgcactggcaattctgattgactcttgccaaagctgagatactaatactcaacttttgaaaattgccattaagaataccagcctagactttaggactccaaactccaagacgtgtgccatattaactgacaataattttagaatcatttagtgtttcctcatatataaactggtctcataaaattgctatggaaacaaatagaaaaaataggaaactttttgaataatacaaagt

SEQ ID NO: 36738 - DNA, 951 bp, Bovine  19866880806199
atgctgatgcccgtcgccctctgccctgtgacaacgcagctgctcccagcaggcaggcattcttggccaccccccagcgggccctgcacctggccacgcgaccagctatggtcagtgcagcgtccagggacaggagtgagcggagtctccccctgggagtgagctcggcccctcgagagcctgccatgtgccaggaaaaggacacaccctgggtagtgctggtccaaaaagggtggggtggcacacagaacagaactgggtgcccagcgtgaggcatccagcactctgcttgccctgtgtgcccacgagcatcacaactgcctgctgtaggcacagaggatggggagggttgttacagagcataatggtgacaaaagctggctaaaactaagtgactctactttcaaaggaccctcaggtttcccggtcctgagggtctccagcagatgtgccctctgtgttctctccctgagcatgatgtcctcacacaaacagtcaaaaaggtggctgcaatgcctgctcagcccaggggacccacggcagcgggacctggcccacataccttcctggcatttggcaccactgtgccctggggggcagatacagcggtaaccattgatctcatccacgcaggtcgccccgaaagcacaaggtgaagactggcactcgttgatgtctaggagaaatggtcaaatttaggctccaatgggaggcaccaatgcttttctgataaaatacacagacaggatctgcaggcctaagtataggctgagtgcattttcatcatgtgaccagcacccaaatgaagaaatgatcatcatactgccaaagtctccggtcactgccacccaagggttaccactagcctgacttctaacagcttagaatttctcattcggggaaacagcaatttttaattaaatgctccttttctctgatagtgtaatttag

SEQ ID NO: 36739 - DNA, 1876 bp, Bovine  19866880820922
ttagcatttacattatggctaagcttcaggggaaaaaaatcaagatatttcctatcttaagttttaaatttaaaaaatccagggcaacacagtgagaagaggcagaagcagatggatgtaaagacttgccaggaaacatcaacacagaccttctgatggtacctgcctgtttgctcgctggaattttctgctttaccaccttggcattcagaacgtgaaacagtttgcaatcttattaaccgctccatggtaaaatctgccaagaattcactgtcttattttcactttgttaaacatgcatgaccacacatgcacaaacacagtaccaactgcccctgaattagattatataaagacacttctaaagtcttaagtcttgaccatcaaccagaagactgaggtgtctgccagtagcacctcttcttgtagcaggcagccttcagcagatcatgtaggtgtcagtgattaggagaaatgagagataatttgagagagaagttgggaaagaagatatgaaggattaaaaatagatgaatctgctttttatatgatgcactatgaataaactttttctcacgtcatggaactgatttacagctctataaagggaagaaaattggttttttcagcctcagtgctagatacatttctgcaatgtcatcccttgtcagcagagacaaacctgattgaaagatattgatcaatcagtgagcaccagatacataaatgaaccccactgaagatataaaatctcatgcttatatggtttttgacctcaataagtttaacatctagtattcttaatgaaaacaataaacaacaaacatttgtaaataataccagaaagaaaatacaataaaacagtagaaggaaaatcatgagggagtatataattatttgctaagtcaatgtgaccaaaagtaaggaatgaaaattcttagggcaatatttcagtggactagaatggtctgagagaagaaacagaacctaagctggcttttggaggttggagagaggtggggggaagtctgccaagtaaaagttacagcacaggtagaactacaagttaaacaaactcaagttatgctcagcagaccctaaaaatgcccatctatttgggtggagtgggaggcttgtaaaggggaatatgctagaacagtgagttagagctgtctatgaaaggccttgaatgctacactgaggaattagtgctttatcctttgaagatgatttctgagcagaagctgatgtacaaagtagccatgtctttttttagcattttggaattgctgttgaccgaatggaattaaatttgcattctctcataaatagacagtggcaaagtgttatcataaaggatgataaattaaaaaaataataaccagtcctcatttagtcatctgttaagatcaccctgcatggagggaacggagactcagatatagagaatggacttgtaggagaagcagagagtgggacaaatggagagaggagcattggcatatatacactaccatgtgtaaaatggatagcccggaagtggctgtgtcacgcagggagcctgcctggtgctctgggatggcctagagtggtgggatgggaggaggggaggggaaatatgtgtaatgatggccgatttgcactgttgtacagcagaagccaacataatactgtaaagcagttttcctccaataaaaaaaataaaagaagccagatatctcaaaaaataataaattttaagaaagatcatcctgcagtatacacatgggcttctaagtcctacccagaagttaattgtaagtttcaaattttaattattgactggaacaaattattcaagatgagtgtctaccaagaaggtcgagaatcgggtcag

SEQ ID NO: 36740 - DNA, 1348 bp, Bovine  19866880869275
cctgcaaaaaaaaaaaaaaaaaggaaaaagaaaaggatgaattcattatctccaaatagtggaaaatattataaatggcagtaaatgaagtaaatgggagtttccactgtaatgtacaattctttaagccagccacccagaaagaacacagcttggtttgctgggtggggagtctgagttaaaatacaggagactgttcttgggctccaagtgccatttgggagtaaggcttttcccctgctgctgtggatcttctgctttattgctgatctggactgtgtgggtcttgcagcctgctgaattgaacccaaatggagctctcacctcttcaacttagatctgaccttagggtgttgctttcctgcctgactcagtctccagaggaaaagcaaataagacattaacttctttttgtgcatgaggaaatggtctctctttgcttttggatggctctcccgctctggctgcctttgctggcccatggaacaaagccgtggctgtgtctccttgtcaggaggatgcattgctgagcacgtctgctcaggcctgggcgatgatgctcccctgtggaaccccctcctatcctgggagctgaatctgtgggttgacagctttcccacagagaaccaggacacttccgtccctgccaccacaactacctcctctcctgctgccagaatctatgaagggaaccccagccttcacctaaatgaatgagttaacactggacccgagtggagatgaggtccatctgatggtgtctcttctgttctggctaataaagcaagtcatccacagcataacctcttctcaatattttcttaactaattttcatgatttgggggaaattatgaaatatatatatgaaattattagactcttgttacctgatacttgccatggaatgcagaaaatgaagtaactgtgtctctataaactctaaaataaactcatctctagggtcctattttctactttttatcctgactacaaactgtcttgtactaagcaaaaaaaatctctgaagtttggtctatgaaaatttgctggcctgtggaaattgaggggtgctggtgccaaattcaattctgcaagtattgttgagaactcactatttgtgaatccaaaataaatatgagtcatagcttcagaccttaatatgcataaaatctacatgaaaagacagaaaagcatatatggtacacctgatctgtattccatcccatttgttgggtgtggatgcttcagttcatacacacatacccacacaacacacaaatacacacatatgcatgcattcacacagtacttatatacatgtacttacagatacatatatacccacca

SEQ ID NO: 36741 - DNA, 2546 bp, Bovine  19866880923983
aaattatagaagcgaagaccacattcgtggttgtcaggggttaggaatagggaagctgcagaaggaagctctggcaatggaattctacactgtgcttatggtgctggttacaggaatagaaacacatgataaaaacagctacacaaatgcatgtaaactggttccatctcataagctctggaggttgtaccgatgttagctttctggttttaatagctgcactctagtcacaaaagatgtcaccactggaggaagctgggtgatgggtacaggggactccatgtacttttatgccaatttggggcaaatctataattatttcaaaacaaaaaggttaaaaaaattaaaacttcagttggggaggggggtgaggtggaaccacaaactgagagaaggtgtgtgtaagacgtgcagacgcatattcataacagaacagaccaacagaagggaggggcagcagaagcgccagagagcaccagcctccctgctgagtctccccacatctggtgaggtggcggcggtgcccgtaggcatctctgactgaccccttgcgttaatgctgccttgacgaccaccctggggcggtgaggggcaaggccttcactgtccttttatgaaaccccgggaggctgaagtctaaacacaggaaggccatttgccaggggcctggggcagcacacagggcgctctctcctctcagcgcctgttgtccgggacaggacagaggaagccgcagacagccgtctgcctcccccaaggagggaaaaccacaggcgggggtgccaggcggtctcaggccccaaagagctggtcgtcctgaagggcccgggcctctccaagaagctccagtctccatcctggcactctccagcctcgaaaccgtcaggcgaggaactggagcaggtatgagccccaccacccccagctcagggaccgtcacagctccgaggcctccacagccaacttgggcatgtgaccttgaacacacagggccagcacatatgtgtgcatatgcgtgtcacactggaagaaggtcctctcttcctaagatcgagttatcattggaaacccaactgagctgccgcctgctcctcgggagccctctagggatccccagggtgaagggtcccttctctgggccagcccagcccttccaacaccccctccactcacttaactctgctcctcagtccctcccctccctgtgaccagagctttctgagaacaggggccattcttattccctctgataacctggagcagggcaaaggtaagtgtcaagcctgctaattggaatctgctgatgttactgaaatcagtggctacagactgtgttactgttttagacttatacctattaatctaatacatctttactgtctccaaatcccaaattccttattaaaccctctaaacaggaggtcaaggtactctggtcctatttcaatacacaaataacacgtaagttacatatatcatgcagccgaagttgagagagctaagatgcatataaatgtaaagaaaatatggaagtgttttgtattgaacataaggggcaagagatacctggttgaagttttaggtcatcagttcagttcagttcagttcagtcgctcagtagtatctgactctttgcgaccccatgaatcgcagcatgccaggcctccctgtccaccaccaactcccggagttcactcagactcacgtccatcgagtcggtgatgccatccagccatctcatcctcctgtcgtccccttctcctcctgccctcaatccctagcagcatcagagtcttttccattgagtcaactcttcgcatgaggtggccagagtactggagtttcagccttattaggtcataaatgtgaggttttcagtgacttgtttttgtccttaaaatactgacatccttacattcatctgaatgaaaaaggtattattagcctctacatactgatcattaaaagataaatgtgcacacacacagttaaaaagcaaacatgcaccttaaaaaattaccttcctaggctcctagcattactttaaggagggaacagcaagctcagggcctggggttcaaagcataaatgttaaaaaagctttatcagagctgccgattcgagtctacatgcagtagaatttttactttacaccctgtttttaagaagttcagaacaagctccaaaaagatcaattttccaaatatctcaaagcatataatcttcataaacatactgagaagttaaagtatatgtcttacaaacagtatctcatcctctaccctgcattcttgagcccattttctctgacctgtaaacaggcattctttcacaaaaagtcttcaatagcgtctgacctcaccaaaaatatgtgtttttagtggagagggaaagatcctaaaatccttaagaaaattaatttggggagggaatggaagtagatgaaacaatatcatgattgtcctgtcatttaaatacaaagcagagataaactctattaaagtttgtgaccttctagattattctgtgggaaaattcaaggcact

SEQ ID NO: 36742 - DNA, 1587 bp, Bovine  19866880957310
agtgaaggctgtcgcagcacctgcaaagctagaactcgcatgactgtggaaggacagggttctctactggggaacacagccccccatggactcagtacagccccaccatacactgggtacaacccctgtgcactcagtagagccctttccttttggtgtgaaggtaggttttggacagacagagcagtaggtgttgctgtcaaggccagaccaaaacccaggttagctcagagaaaaggcactgcccttgactatgtgtctaacacaaactcatgcaatgcctgatttcaatgaaaagttcagtaatccccctttacatgtaagaaaatagaaagccaaagaggtttacataatttacccacaggcctcagtggcaatttgatagtgaaactgggaatcctatccaattctgtctagttctctacaccgtgtgttagtatcatgaatctgggtggaggcaaggatttccattgtacaaatggttgctactatggttttccaatcagaaagatgaggagcctggggctcaggtgccttgggaagcatggtctaagcagcagagggtgtctggaaagtgagccttctttactgtgaggtgcaatcagctttccttccatgtaggatcccactcactttcagatgtcaaatcttctgtccttggatcacactcccattttaaggagagtgaattcacaccatttagtgtccttatatctcctggttcatggcattctacaatgttttggttacttttctaattataaaatggatgtgtttgtttcatattaaggacctcagccaactgacatcatatagggtcatatggcaaaagagaggggaatcttctttctggggtttaggatttatttttagtcattttcaactatttttaatccaatatccctccccatttcccccaaaagcctcactgggttaggtttcctcagaaaaagctgatagaaattatctcaaactctggaagacttataacatgttgagatgaaaatgcccatgatcataccaactgacatgtcagccattcacactggccatgagaatcatataagagcacagctcagaggctgcagggtgagacagttgtccaggggagaggactactgcgagctgtttgcaggtgacacttgcaacagaagatggtgagtttggcaaaggggaccggggcacagaccccccacagcatcctgattccccttcacagcacaaacaccagcttgattcagtggctctctcagtctctgcttctctctgatggtctttctcatctgctcccacttccaaaatatttgagttcatttttgttatttgaccttttaattttagaaatgaaaggatatccaatatgacttaaaactaggaaagcacctatatgatcatcattcaaaattagtgacagttaatatttccttgtatttgccttcagaaccaaataaaacattacatcagttcagttcagttgctcagtcatgtccgactctttgcgaccccatgaattgcagcacgccaggcctccctgctacatagtccctttcaattaaaaaccccctgggtcccattccctaagctcct

SEQ ID NO: 36743 - DNA, 650 bp, Bovine  19866880975905
catggagaacgtgaacggggagcttcagaacgggaactgctgcggcggctcccggaacccgggggaccgcaagtgctcccgcgacgagtgtgacacgtacttcaaagtgtgcctcaaggagtaccagtcgcgcgtcacggccggggggccgtgcagcttcggctcggggtccacgcctgtcatcgggggcaacaccttcgacctcaaagccagtcgcggcaacgaacgcaaccgcatcgtgctgcctttcagtttcgcctggccggtgagtggcggaccgggccggggtcggaccgggccgagctctgctttctcttgcgagaggagagggatttaaagggccttggctggaaactcggcgcaggcccggggcgtctatgggggtggtggtcagggagccggggctctgtgctagatcttggcaagccccagtccggatgctttttgctccgcgcaaaaaaaaaaaaaaaaaaaaagtggaaagtggggctcgagagggtattgtcaggcaaggctcccgggagggccggttgaaacttgcaacttggaggccccagagtaaccgcccgagccaggaggtcattatggatgatctttgctcaaccaattaaacctgatgcgctgtggaaggcggctgggcacaattctgg

SEQ ID NO: 36744 - DNA, 1779 bp, Bovine  19866881002130
aatctttagtagaaaacactggaaattaaaaaaaaaaaaaacaacaacaacagtacaaggaaatcatcattcaacctcagatggtaaaatatgagatgcaaattcttgaagaaaataatttcaaaggagctcatcttgtcagaaataacaacaataaaatatcaactgagttaagctttgggcattgtttgctgataaagtaggatgaagtctaaccattgtatcgcatttcctcggggaacagaacaggaagccctgatagctacagaaaaaaagggaaaggagcatcatacagaggagaatgaagcccgtgaacatggctcagcatgtctgtgggactcacagaacatgtctcgtgttctgtcattattatttattagtgaagtttactgaaccgtagggattagcatcttattaatctaaagaagttaggattttggcagcacagaaaaaaaagtggagaactaatacaagttaagacattttacatcaaaatattcatttggtctagtaaatatccaatttcttaattcttccacttatactattagagaatttttatatgttaaacatttaaatcaactgttaagagtgaagtattttccacagtatatttaaattattagtagtattattttttattatcataggtattctcagactcagtttgatgatcaaaactacttaggcattcatatgattgaaaagaacttataagcacttttataagacctatcgtattctgtattcttatattgttgaacagctttttggataagtttaaaataaaacaatattgtttataatgacataaattatataggttactatttaagaatatcatgtaaaaaaaaatcactctcaaaatcaatgtgggccctgtcaaaatatctgattagtcaggttattcatttctgataatctttggagaatagtcaaggagactaaacatatgttatagggtcctgtttcagctgtataaataaatctatcttttaatctgaagtaagagggaagtttgaacatctgatagctttataattttttttcaagtagctaagtatttccacttagtaactctgtgcttagttgcccagtcatgtctgacttgtagtctgccaggcttctctgtccatggctattctccaggccagaatactggagtgggttgccatgctctcctgcaggggatcttcccaacccacaaattgaacccaggtctcccgcattgcaggcagattctttaccatctgagccactaaccagacagcaaatctgccagtgctatgatcttagacttcccagcctccaaaatgatgagaaatgtttgttagtcaaaagccaaccagcttatggtatttttgttatagcaatccaaacggaccaagggaatttggcataatcagatttctgctttaaaaaagtcaccctgatgacaatgtggaggacagactagaagggaaagacagtggactttgtgatattacatggaagattcaggagataggctgagtggataggggtacccgctgagaaactgaactaagacaatgcctctgaggatagaaagggggaaatagattcaagactagtcctcagatcttgctctttctctctctgatgtcagtatctctaccaggttagtcaaatgtctcaatcatgtcctttagagcgttttgctttcctccagcccaggaaccagtccaggatcacctattgtatttggttactgtctctttagtctcctttaatccgccaacatttatcacctttccttac

SEQ ID NO: 36745 - DNA, 1397 bp, Bovine  19866881011435
acttagttagctctatggtaggaaaaaaaaatgatctatagactatgagaatctagtaaaaaccatgtagagtgtataatttagtcagaggacaatttcatgctcccataaagttaataacaatgtaagatagtatacaagtgtttctcaagggcctgtcactgagaaatcttcagcaagacaaaagtcaaccctttcgctggttacatggatgcttttgctttgtgaaaaattcattgaaccatactctattacttgtataatcttccctatgtgcattatattgcataaaaagattaagaaaaaaatagtttatccctctgagctattgatactgataatgatttagtttgatttaaaatactgtcttttcacaagaatttccttttattatactagctttcatgcatctgatatattcttacatagttcaggactaaaatttagaaaaagaggcttgacaataaaaaaatactttttccttataagcaatttaatcatgattaatttttaaaccttttttcaatagttttgaaaaaatatattatctttgtcttctacctcagcttaaatgaactcccattatgaaaagcaatctagttctctgcttcagtatgcactatacttttaacatatgagcaaaataaaattcaaacagaggagaaattgctttttgttacaagtttttgctaacagaaggtaagaagtccttttgaaaaagacaattgaaggaaaagaaattggaacagttagaaagaaaagaagaccttgtagaaataaaatagagaccaaatcagataggagcttacttggaaaactggaatagggacaaattggctgggtcaaaaaaggaaaacggcttttagaaaaatggctatagaaataatcatagaatttaaagttggtttggatgatttaagaatgcaggtgaggaggggtgacaagacagctcatgtttcaggagatttgcatcatgttttatgcaaagttgagctagaagttgtttttataatcaaagcaaccaaaactgattattaactgtatattcatgacatgtgagcattggtagtgattgaactcagatagctgtttgagtgatgagatacaaggaccctcaaatctgacgaggaagccaagacccaaagagattaagtaatttggtgaaggccatctgaagagccaagaataaagaggtataggactagtctgagtttgttgttgctgttgtttggtcactaagtcatatgtgactctttgcgactccatgaactgcagcatgccatgcttccctatccttcagtatctccctgagtttgctcaaacccatgtccattggagtcagtgatgccatacaaccgtctcatcctctgttgcccccttctcctcttgccctcact

SEQ ID NO: 36746 - DNA, 1523 bp, Bovine  19866881013304
atgtctgcagggacagcgaggaaagcggaccgtgctcagagccagctctgtgggtgacctatgacccatcatcgtggctgcttatgctctctattctatagcagttatttctcactttgcaaaaaccgagtcaactcagtttatccagtattggggaagggaggtgcgtttccttgataaataagcgcatggctaatcggactctttagaggccagagagtgcctttgatcctcaaacaaaaccagaagcacacaccttcacctgggacagggctcagctactcttccctcaggtttcaagccctctgcaactgtgtcttctcagaaatccagcttcagcaaacaggttggagcagaggggagggggcccccatggcagagtgaagggggagtaagcaagggagagcagtaggcaagcatttccacggcgggcccacgaaagctgtgtcagaaccgtctcccccttcccactcagctgaacttgggaaaacaagcaccccaagacgcaaaggctttctgcttccagagagctgaaggcaagttaaaaatcttcgtcatgggaaaattatagggatccagctaatggctaatcacccatggccgcgagtcaacttagcccctgagaattctgactaaccacttcctaacttctaaaagcaagccatccacgccccagtacaaagaaccaccaggatgtgcggtttaaaaatcagacacaggattccggttgatctgaaatgaaacttcagtctaaatgacaaatgactatttaatggagtaaaagaagaacaaagtcaatgctttggtagcaatttctttaaaagtggaccctcaagttggtgggagttcacggtgatgctcttgatactcttagcctagaaggtagatattaagagggagttgcttttgaaatagcattcttgtcactgtctttcccctattccctcccaaatgagggcttgctacacctcttcaatttgcttaacaaaatgcaagaagagacagctgaggacctgccctcagctcttaattaatgagagctggatccccaagcataaaaaaggaaccacaagaggccacggatgacttcaaaagaaaacaaataaaaatactgaccctaaaacaggcatccacaaagttgtcccagtttaataatatatgattaaggttctcatgagaaattgaagcgactttcctcacaggatgattcacaattaagtttgatattattggcaggcttgcaatgaagcaagaccgtgcatccaggaaaaggaacccaggtcgactggggagcaagagaggcaggcaggttctctcatgtggaggaaacagaacaaaaacacacccttgtcggccaccatccagagggctgcttacaggtcgcgggccatccagctacggagcagcagaccaaccagaacttcctctggccgcaagagggttctgttatcatttttctttcaagggaaggggaaggagccgggggaaggctatgcaaatgccgtggggaaagtcacaccttc

SEQ ID NO: 36747 - DNA, 1091 bp, Bovine  19866881016161
ttgactttaacagtgagattcattcattaactcatgaaacattttcagtggtttttcctctccctggagcccactttgacagaaagaggcatatatgaactcacttgagaagtcaatgaatcttcttttctaatacaaatagataatatcacattgttgcagatttatttagtggactattttttagaacttatctgccagactctattcatgaattgtcttatatttcacatatattagcttatttaatttttattatgaatgtacaaggaaggtcctattattgttcccacaatactttgaagcacaatgaggttaaacaacttcctcaagattaagtagcttggaaaaagtgtggattcccacaagacaaatgcaaaaaggagatgaaacacttggcagatgatatagtatttctcatgaagctgcataaactctgaatgtgtgttagtcgctcagtcatgtctcactctttgtgaccccatgaactgtagcctgccaggctcctctatctatggaattctccaagaaagaatattggagtgggtagccattcccttctccatgggatcttcccgacccagggatcgaaccccagtcttctgtattgcaggcagattctttactgtctgagccaccaatcattttgggggaaccaagtagcctcctcggggcttccctggtggctcagatggtaaatcaagtgaccaagtgacccaaggagaggacaatgaccagaaaccctagaatcctgctgggtcttttgggaagaagcacaccctctctgatagggacatgaagacaggacatggactggcaaccatcttgccactgttggggaaactctgagattgaaagcaaggtactgatatcaagagattgagataaatcaattcctgatgatattatttgaacccctgggttcagccatgcccacgtttctcattacagagcctgcagacgttttagttcctcaagtccatcgaaaaccttcattgtcaaagccagtttgaatcaagtttctgtcattaatgacaaagagccctgtctgaaagtgaacaagttcatttcccaagcctgttgttctgctc

SEQ ID NO: 36748 - DNA, 1946 bp, Bovine  19866881020907
atctgagacccaccaggggcttcctgctctgaagctggagaaaggtcatcaggcctggccaggagcagcagaaaccctcatcccagggtgcggttgcagaccgggcttctaagcaggagccttgtctgtggctgtgagtcagcattccctggtccaaagcagagtcctcgaggggccagaacaccgcaagaaatgcaggaagcgcaaccctgcgggagatgccgaccaccacaagagagtttctcttagaagtgatcgattagccccgagggaaataatagtgggaaaagcaaagttgccagggtcctgccaacttgagagctgtcagatccggggttacttttgaaacaagatttggcagaaactgcatctaatgaagagttgcatgttttggaaaactctctcctccagacatcttacgaaaaataagccagggcaggcacaactcagccacaaacactgaaagcttagctctgactcagggcagcccaaccaagaaaagaaaagggtggaagcagctacttgctcacagaagaggattgcaaccccgtcatggaggatgtcgtgaccagacctgggacaaatgagcagtgtgcctagaagccagacttacaggaattcaaatgatcattttcagtagaagatatgtacctgcattgggcttaactttcaaatcagcagcctccaggagcttgttctgacaacaccgctcctttctggttcacactttaacatcagaaatttactttagtgctaaagagccattagctttgtcggcagtgacagcatccatagaggaagcacatgaagaaaccagtggtgtgcctcgtcacatccttgcatgaagcacagtgaccgtgatgctgtctttgctggccagtcctcctgccctgcagcctgagtcgggcagcagtggtgaacaggcttacgggtcaccccatctgcttgcggccccagcgtcatatctgaaagtatgtgagaaaggcagagcctgggccccacccagacctacagaatgagaaactgggtgattctgaaacctgctcaagtttggcaacccccgggctaattgcagaccccttgggattggtttcctgcagcctgactgtcctggcccccagcgcatcagcagggcccatgtgtggacatgcagccgtcacgacccctcagacttacgaagcacctggctcagggtgtgaagcactgttcccaggtccttaagcatggtggccacagcaccccgggagctgtgactgcgctaagagttgcaggacatttacatatagtttggcctgacatttgggggagacgtcagagaggcttgttctttcttgtagttcaggcatgtccctaccccttgcccctgcccccacctttaagactctggtgaagttcagaacagatccaagcccaagaggaattcagtgggcagagtttgcagttccccacttggaaggctgacttggaaatctaagggccacttagatttcacaccaggagacttccatttgcaggatcacccactgttgtctccaatgggcttgctgaaatgtcatgtagtgaatcatagcaatgacttattttggatggacaactacagtagattttcttaaccaagttttattctgaaataaggaaggaaactatattcaaaggccacccatcaaatgtgtctttttttcctgctcaacattgggtggtcctttgaagtaatacctcctccctggtaacacggaaaatcaagatattccccaaagtgtaggagttagcaaaaaaaaagaaaaaacagaaaaagcccaacaaaatgaaagaatatggaaatggacacagtggtaagttcattcttaagattagtggtttctcccagctcattctgtccatcccccactcgcctttccttagattgtagggcaggactcatgaagaggcagccgaatttcatggca

SEQ ID NO: 36749 - DNA, 814 bp, Bovine  19866881073518
aagtgcagactgcccagggcagaaccctcctgaggaggtgatagaacatggtctgtcctgagccccctctcagagtcacccattttctgggtgtgcttgtcactgaagtgttgttgagtcttaaacagaaacagttgttgcagtagtttaagcagagagggcacaaaataacaacccaggtgataggccaagaaacagtgagctccctggaagagtctggaataaggaagagccatcccaatagctgctgcctgccccagaactagggggagctgtttgaactagaggcaccagagaaagtttttatcaggtttttatttcattagttaatctgggcctggtggttaaagccagtacttgtatgtttaatgattatctttcaagaaaattcttggctttagagtttggtgtatttgtggatataatgatgactgagtttcagacttcccatctcccagtgcagagcacatggttcagtccctggtcggggaactaagatcccacatgatgaggggcaactagagaaggccgtgtgccgcagctagagaaaagcctgtgcaatgcagtgaaaagccagtgcagccgaaatttaaaaacagaaaagttgtttaacagctgtgtcattgcacagctgtagatcagtagggtctttctcacagccttcatgtacatgggttttaagagtattagcaaagggaccaactttctgcttctgcacaggggcatgtgtttgaggaatttcgcctttaagcattttccttccacatgtctgaaacacccctggttctcttgtttcttgagtggttgtttgatt

SEQ ID NO: 36750 - DNA, 2992 bp, Bovine  19866881076207
ccaatctctcaggggctgctcaagtagatctggttgcaaggctcacaacgggagttgtgtttcgcctgattttaaggcctcctcaaagtactgtttccaataggctcggaggatttctgatttggaggggcacctttgagctggaaaatatgattttctggcttgaagaaaaaaatttaaagacttataaaaattcccagaagactctttggacatcagctagctgttactaaagaacattgtgcaaatgaatcagaaacatatggattaagttccccctgaattaaacatgggtttcacacatgaagcgggtgagagcaggggctggtgaagggaagagcatgacaaaaagacttcgcatctttgttaaatcaaaaccatttgaaaaatccatttttagaaagaataaaaacactacttatacttaattcctcttgatttgaaatgttgtttatttcagtttggagagctgttccttgaccttggtcttcaacaatgacctagtagatcagacagaaagcattgttttcctgggcttcttttatacaatgtcattgggtcccattcaacagctttggtggtgagtgttctataactattatgtttctccagaaataaagtacaggaaacattttccataatcatgatccagtggtattttctaactgaggtaccttccccagtggaccctgaaaaaattaagaaaaatgcatactggcaattgggaaatagatctacatgtaagactcatggtctcagcatggagcagaatattgagcaaaaagagatggtctctacttacttcttgattcattttaatagcaattacagtaaaaacaaacaaacaaaaaagtgaccttgataactttccttgcatatagccaaggtcaagactaacttacattcttttctaaaaatgttgctttgtcacactgccaaggacaaaggaatgttgagtccagctatatatcttttaaaattttgggaatgttttaagaaggagagaaaattttctcataattactgtatgagatgtctgaattcaatgcctgctatgctcctggagtttgaaaagagtgaactgtcctttaatcacaactttttccttatttattccatgaatctgcttagcaaactcttctaacaatgttaaggcaaatcaatgtcaaagtcagacaaattgccatttttaccattttaacgcaggcaaaggaactcatttctacaactggaatgcaaagtcaccacattccttacaatggcttcccccaccctctaccctatccattatgcccacttctctacccttttcttataactttcttaattccaccacaggcccagtggcctccttcctgttctgaaaacacgtgagctactcagccataaaagataatgaaataatgccattttgcaacaacaaggatggacctcgaaattatcataataagtaagccaaatgaagacaaatatgatatcacttatatgtggaatctaaaaaaaaaaaacaaacaaacgacacaaatgaacttatgtacaaaacagacatagaaaacaaacttatgattaccacaggggaaagggaagaaagggataaattaggagtttgagattaacaggtacacactacttatagaaaatagataaccaacaaagttctactgtataaaacagaaacctataaaggaaaagaatctgaaaataacaaatataaatacatgtaaaactgaatcactttgctataatctgaaactaatacaatgtacatcattatacttcaattaaaacattaaacacacacacacacacgagctgttttatcttagaccttgaccaaggccatttcctctgcctaaacatcaggccctcacatctttgcatggcttgttcttctcaccattcccatttctgttcaagtgcccaccccttgtcccagtcattccacaatctagttaactgtttatttttgcccttagaaaattctcactctcagaagttatctcatggctacatttatctactagtttatttctgtctcccctacatgctgtgggcttcatgaaagtgaggaccttatctggcttgttcactacttcacccttagctcctaggacaggaacttgtccagaataggcactcaataaatatttgttaaatgaatggatgaatgaacaaatgaatgagccatggaagactgccattagtgtcctatctggacccctttaccagttctgctcatccccagccaccatgtgctcatgcctgcatcttccctggaggactgcccttgggcatctggaacttctcacctatagggagtttacagtccccctgaggcatcccataaacaatgactgactgtgtgtgagggcaaaagcccagctctcatatagaacaaatgctcagtggtgccattcacacttcagagctcctttctggttcagactgaagctagacttaacctaaaatcttgtctttgctttttcccatctcctatcctgcttcttggggcttccccgatattcagcggtaaagaatccacctgcaaagcagaagtcacaggagacatggattccatcttgggttggggaaaataccctggaggcgggtatggaaagccactctagtatttttacctggagaatcccatggacagaggagcctggagggctagacagagtgcatagggtcaaaaagagtcagacacaactgaaacaacttatcagacatatgcacatcctgcttctttcactctctttctccattaaaatggtatcatctgcatatctgaggttgttgatatttctccctgcaatcttgattccagcttgtgagtcacacagcctggcattttgcatgatgttctctgcatataaagcctttgactctggatcacaacaaactgtggaaaattcttaaagagatgggaatattagaccaccttaccttccttttgagaaacctctatgcaggtcaagaagcaacagttaga

SEQ ID NO: 36751 - DNA, 1198 bp, Bovine  19866881088106
ttcatggtggccacttggtgattaaagtttccactggagacccaagcactgttaatggctgacatttagtaaagcaaagaaaaccagagatttgtaagaatcctagaaaaattccctcccacggattcccatgccctggattccatttaagaatgtattgaaatcatattctcacttaaaggcttgactccaatgaccccagttttcagtgatgtattctcatttcttacaactcctctgttatctattttctatttatctcccatatacatgtcatgtcatactgctttacggtattatagtctacaccctttataattttgtgagtgtagttttgtctttttgtcttagcttgggaaaagcagcaaaatcggagacaaggatgcaaccacctcctggaattgtccagctgcaaagtaggaagctggagtatttacccaccagattccatcccccactgtggttattgattccgtagctcttctgcatgactctgaaacagccaaacaagctccagctcccagagtttggcaggaggctcaggggcaaagcagagaaagctgtgtagtgcaccctcaaagtaagatgctgacagctgtcgttgagtcttgagtttcatggaattgtctcccacgtgggctaaaaacagaagtgggccatgagtctgtggtctcagtatcagaggcgctgttgcatatcatggcaacttgggctgtgagtttctcagaacagaggttgtcttccctgacctggtactattctgtgcacttcgtacagcaccagatgtttggaaggaggtgcagtcagtattcctgatgggaacaagttccgaataaaacaatcgtatattatccaatgcttcttttttcttcttctatctttcttattcttaatttcacttgcgattctgctaataaacagttgagccatggtagaaagagcattgcaagttacgtggaaattccctggttccagtctaatcttagactgagtggcattgggcaggtcaaaagtatctccaagttttgattttgaaatctgtgagctgctttcctctcaatattaatatcaaaatgagcatatgtctgtgtgaaaagtagttggaaaccatggaaatatgtaagggaccttcctcctcttcattcccatggacagctgcttcctaaatattcacttttccagtctgaaagtctgagca

SEQ ID NO: 36752 - DNA, 781 bp, Bovine  19866881111581
aaggacaaagaaaaaaaagacaaaacttcagacattcactttgacattaaaaaaaaaaagaaagaaagaaagaaaactggacgccacagattagagctggtacccagtacctacttgttacaaggacatatgaaaaggccacagcatttccctaaatcttttaaatttttctcagcttccttcatgtcttggttgatatggttcatgccttcttcaacacgatcgagttgttctggttaggacaaagggatgacagtgtggaatgaattttttgggggttttcaacagaacatgagaaatgaaatggaatttgaaaaagagggagagctattacaatgcattgtctgaggagatgcattgctagaattggctgtcgatgccctatgcagccagggatggaagaaaatgaaaagtgatgctcatatagtttacagttcagacatgatggggtggggtaggtaagcctgcttgattctgaatgtccaggaaaacagcacagcgtattcacttactcagacaccagtgaaacccaagagaaagaaaacagggtgttagtttatgttttaggcattcaaatgcaatggtactagagaaagtgtctgcttcaactttaaaacacctctttcttttggtttttagcatccccaaccagctaaggatagaaaataatccactttctcctttgggaaaaataacaactatagtgataattagcagtaggtaccatatctttttttccccctaggaatggctgtcagccaaaggcaggccataggcaggt

SEQ ID NO: 36753 - DNA, 1800 bp, Bovine  19866881175777
gtctttaaaaacaggactatggaaatctcctcagagtgcatctgatttctaccacttttgatagaatcattctacagttattttttgcaaaataaattagaatgaaatacttatttaatttcccaaagtaaaatgaagacaattttcaataaaacgaaatttggaataatttttaaaaggtgcattggccatgctaaaggaaaggggagcaatatgtataaagagcaaagaatcttgaaagtattgttttgtacacagagtatggatttttttttctttatcattttagcgtgcactttgtgaaatcagtcttcatggtttgaagagattcaggtgtggaaagaaagtcaccttgggatgaaattttgacaaaaataatcaaccaaattgtggaaattttacaacatttgacatacattttaaggctgatttgtggagacaaattgtttctgactccaatagtctcatacaaaaatttgttcttatcgaatgaatccatgaagcagcctaaattactgctacccctcaaagactcacaatcaaagaaaagtaagttgtgttgtacaaccaagtgagaaataagagataagaaaagtaatacttcatcaagtttgcaaagttctttctaggcatctgataatcttggaaatcttctgagataggcaagatagccaattacgattatgttaatcgagtacctaaggcactttcccgtctttttacctctgttgcttcatttgcaatacttatatgaagtcggtactattattgccctcctgtcccaacagaaagcactgaagtacagaaaagttaattaacttcccaaggacctacagccaggaagtggcttacttgcaatgaaaacccaggtaggttaaaagactcatgcagtcatttttagagattaaaaaaaaagggcattaaaatttatatcataagctattaaaggtagagttaaattcagaccaaaggtcttaatgatttgtgacttgatagttttccctgaatgacattctgttttgatttgtatcatcccagacttggtagaatgacagtccccttgactctaaatgccatgtagacttcatcagtctagttggcctcctacagataattctctttactaggctcatatgctgtttggaattttttacccatgctcatctctccaggctccaccataaactgaggcagtctactcttcagacttaccctcttccctgagaagtcttttgtggatttcttagtgctgttatcagtgatgaaacagaaagagagagacctccagactttaggactccagacctgcccacaacctggtaagaaagagggagattaccagatcccttcaagtatcggcattttgcattcctgaacacagtgtgcctggtgttttccaaaggatacataagggggctaggcttcccaggtggctcaatggtaaagtatccacctgtaaatacagaagctgaaggagatgcaagttcaatacttgagtcaggaagatcccctggaggaggaaatggcaacccattccagtatccttgtctgggaaatcctatggacagaagaacctggtgggctacagtccatggggtcacacagactctgacacagttgagcatgcacacacacaaggaggagtgcagagattttgagaaatgagattatcactctcatcagccaaagaaagtgactttcctgatttttttttagtttattcatgctcagacggtactttcagtttctataaaggatgctgattgtgtcagcaagcataggctaagttatgctacagta

SEQ ID NO: 36754 - DNA, 1424 bp, Bovine  19866881186776
tcagggcaaagaatcctctcggaggcccctattagggggcactctcatcccccactccgtccccacactatagatcagcaatcgagatcatttggcaatgattattagttgccagggagctttaacttttcccaggcccatgcttgacctctgtgcatcccagaaggtacatccagactccagggtccagaccacgcatgctcaccttatgctgtcaaggccaggtaccaggtcccaaatcggcattccactacaatcacatcacatccaagtggccactgccaacctaaccccaagggaggccgaatcccaaggccctcctcacagcgtggcatggggggcaggtgagatgactggcaggtgttccaacttactaataagttcatacaaacacccccacccccaaagaaacacaaaagaaaactgcacacacctggatttttcttggtttcaagctataagaataggattcttatataaagctacctggcattcacctatttttcctttttatccccagaaaaacagccagggggcaaagcaggagggatgggcaggatcaggccttcagtttgggctcacagagtgaatggctctgcccctccccagctccagggaacctggcaacccgggaggtgggtctccattccgtgcagcaggaaggggtaatggtcagctttcagaaggccctttggagaggatgccctgggattctacttcgaggagggtcctggcctcaaagcgcccccgtgcctgcccccgtccctggcacctgggctgcgggaggcctgagttccgcacccatcctgcctgcgggggttaccttggcaccgggcagagtggccagcacttaattgccacattaagaaggggggatgtgagaaacaaggtgattgtgctgagagctgggagcttccttttcctggcaacagtggcagccaaaccaagccctgagaagtggcggcttcccctcctgcaaagctgacagacacagacagcccaccctgcaaacagcacgcgtgcagcgtccagaggccctggtgggtggcgggggcacgccctggagcgcccagcgtgcccggggggccactgtatgcagtcatcgccccggtcaggctggggccctgggctctgctgactcgacggtcgcgtcctgtggctggccctgtatctgcactatttgtgaggcggcggcattattccctgtaatccttgtttcagtcaatccggccacactattgtcctgcctgcgtctgggtggccagagtagaatatattccaggcacaaacatattacataaaggctccagaaatgccatgtgtgggcacacacgtgctcaccccgacaactcacgtgtgtggcagggtttgggcaaagtgaggcacacagcagggacggccaccccaggcggcccagctaaacc

SEQ ID NO: 36755 - DNA, 1087 bp, Bovine  19866881198958
gcttgggaggggccctgaggactactgtgtttctatgagctgggtaccctacagcctgcttgatgctgggttcggctggcttcgtgctcaaactgcttattaaagtctagacgcaacataaaagcacataaattggttccagccatctctagtaaaaacttcagctggagctgggaagtgactggagcatctttcagtgtaattaaaattgactcttaaagtttctttagcttaattggtcacactttctttggaagttggtgaaagcctcttgctgggaaggttaaatgcatttctgtgtataagatcagaattcaaatatagttttatggacacatttacagttatgttctacccgggtggtcttttttttcctgtatcttttctatttaagatttatgctgtcattgaccacagtctaaatgtgttttgataaaaaggaaaaaaatgaaccgttgctgatgcatttcaaacagagttggtaatattttgaagctttcagtaaatgaaacggcagtttggcttagtccaagctccttctttccctcaagcccttcactttggaatcagtgcttgaactttgttctccagaaactgaaagtaactactactgggtccaaaggtaggaagctggcactttctaagatggtcatgtccttgctgtggtcaaatgcactcgaccccattatctgagaccatgtatgtttatacacgtgaatgtgtttatatgcactgagactttctgcccctcagttttgcttcttgagggatctaccagtgtaataggttctgatagtcaagaagctcatgttttaacatttttggagtgtaattagggatgaagctccctgaatgattccctaaatcatccttaattcagacttgggggaagacctgcttggttttatatttgtgagtatttactccacacgatttccagggccatgacttgattcttcccttgacatctatttctacccatcccagtggagcagaggggccagccatcttcaaatcaacataagcgttgtctcttcatgagtatacatggggcagggtttgtaaacaatgctgtgaataccataat

SEQ ID NO: 36756 - DNA, 1139 bp, Bovine  19866881282780
acatgtatcattttcaccttaatgtttaaaaaataagtattcttcactttaattaatgacaaggttatataattttgaattgcttttcttccaccgttctaaaaagtttattctagaaatttcatgagagaaaaagtaacacattaacaaactcatcactgaatgatcgttaaaaatctgtatcttaattactcaaaaacaatgaccattttttccttttgcccaggagactggaaccagatatcatgtctactgcacattccctccccacattttcagtgctatattgtttcctcaaaaatcctattcactgtccttctccaaaagactttttccagtctactcagttccatttgcagactatattattgtctcttcagcatcaatagattggcaatggttttgtttttcataatgtacattctgataacttttcatgaagaagctttatattcatacagattttaagttatttggggaagcaagttatttgggcatgtctgtggaaaacattcacacactcaccaatcccaggcattccagagactctgcactcctgactgatcaaagaaccaactgcaagcacttggaaaacacatacctttttgtagctactttcaaagaaagtaggtcagtgttaatgaaataataagaaatatgatgtgtgacatttatctactattaggatatggagtctcatagattaataaaaacaattctatttaatagaattaacatgtatcataaatgaataccatttaaaattataacagaatctaataattagatgctttaataaatgaaactttttctggaatattcagaaggtactgaagtttttttgtagaatctcaacactttcatcatgaatatcaattattactgtatcttagcagtagagatctctaggacgacaactcccatcaacagaatactcattcagtacaaatgaacttacttagaaaacagaaacagactcactgattttgagaacgagcttacagttgctggtggtagtggtgggaagggatagttagggagcttgagatggacatatacacactgctatgttttaaatggataaccaaccaacaaggacctgctgtgtagcacactgaactctgataaatgttatgtgg

SEQ ID NO: 36757 - DNA, 1126 bp, Bovine  19866881359039
tttgctctcatgaactctcctgaggtttagacctggaccaattgtcactcagggtctagttataacccaagtcagttttaagagttagtgaacagaatagaattggttttattggattatactgcattttggggcttcccttatggctcagctggtaaagaatccaactgcaatgtgggacacttgggtttgatccctcggttagaaagatcccttggagaagggaaaggctacccactccagtattctggcctggagaattccacagactgtatagtccatggggtcacaaagagtcagacttacaactcagagactttcacttacactgcattttaatgctagtcccttttctttcccttaagacttcctgttgttcagtcgctaagtcctgttccattctttgcaaccccaaggactgcagtatgccaggcttccttgtccttcactatctcctggagtttgctcaaactcacatccactgagtcagtgatgccacccaaccttctcatcctctgtggtccccttctcctcctgccttcaatctttcccaggatcaggatcttctcaatgagttcttcgtatcaggtgaccacagcactggagcttcagcttcagcatcagtccttccaatgaatattcaggattgatttcctttaggactgactggttgatatccttgctgtccaaggggctctcaagagtcttctccagcacaattcaaaggcatcaattctttggcactcagccttctttatggtccaaccctcacattcgtacaagaatatcaaaaaaaatcatagttttgactatacggaccttaatgggcagagtgatgtctctgctttttaatacactgtctaggtttgttgacccaaaagtgttagtttaaaagttaaatgacagagagagagagaggaagagagggagagagagagattgagatttatgtgtgaaacgcttctaaacatgccctgtaagtacagtagattttccccttacaaccacaccctgtaaagtgctgtattttcagagctgcacaattaacataaggagcatgagtcaggctttgaacaactctgtgggaaccagaaagccttttgctattaggaatgatgtaaattcc

SEQ ID NO: 36758 - DNA, 772 bp, Bovine  19866881364837
cctttggggaaggcttttgagagccattccttcctccctacataggctgaaacaatattttatcacggttttcttccttgaaatcacctactcacaatgtcacaaaaaaccacatagcatcgaaacctgagcaagtaaaaatcgtcttgaaaaagtagttccctttggagttcttgggagcaaataggattaaggggcagactgttattctcattactcttcccattaatgtttgtcccaagtggagaagtagatgagtggagaaactctctcacttagtacaatagcttttctttccttataaatttgagtcttggagattttgattgacatttcacaaagaaaagtacagtttctaactggttccaccttcattctctaacctggaatcctcccaactaaaatgattttagcctcaaaacatgaaaattgggatagtcataaagggaggaaatgaggtgttggtagaattgagagaagtgatatattaatctgctcaatatgccgtctttaaaagtagaaatttaagtgttcaataatgcatttacaaattattttcctatctacacaagctaaaatgttctcatagagaacagagatttaaaaaggatcggattgatacctggagatcaatagattttccctaagctttgggtcctgggcatttgagtttttcttaccttctaaaacctcttctttgatgcccagggtaacaaatgatgcccgagaaaatgaaatggatgaaaacctggagcaggtgagcggcatcatt

SEQ ID NO: 36759 - DNA, 782 bp, Bovine  19866881381979
cttggctgagagctctgcttttcgatctgagaattttttccttccagcaccctgggctgggttttccagagaactaagggaacctaggaaaagtagcttttttctgtttccaacttggggcaaaaagagggaaggtttgtaacttgaagttagttgtggtgcctttcatatatttttgtttgtaactctggtagagacatttagtcactcaccttccatgtggggagtcgctgaaagaagatgctcaaggaattccacgtcctaatagggtcattgctgaaattggtggggaaaaaagactgtatttttgctggctaatacagcatttctagatgctcattaagctgttaaaaaatgtgaaatgatgactcatcctgagcctctcccaacccccctccctactccaatttgcctgcgggttgaaggaatgtatactgacttgagttaaagaagaaacttgtggtttccattatagtctgtaaacatcggtcgctgaaagcctcaagcaagctatcatctgctgccacacacatgctctatatacagttcatcttggaaagcagactgggagagcgccgtgtttacagctccagagtaacccaaccaatggcaggctggtcttccccgggggtctccagagcggcactgcgcacagctaagtggaggtcccctctgatgttctctaaggcaaagcatcaagagagaaaccaaggccagctctcctgaaagcaagctcttcctgctgcttgcagtgtccctttgccaccttttcagcaacaatt

SEQ ID NO: 36760 - DNA, 1059 bp, Bovine  19866881412220
aaatcaagcaaagtcactcctttgcttagtgggaactttcaattgctttagattgcactaatgataaaattccaacttcttactatgccctcggccccacaaaatctggactctgccgtgttccagtttcaacacatttcttttgctctatagtccagaccacagcagggcttccctcatagctgtcggtaaagaatctgcctgccatgcaggagacctgggttcaattcctcggtcagaaatattccctggagacggaaatggcaacccactccagtattctttttttttttttttttaatttgtgaagaaagtttttattttgttaaccagagttttctattcattgtattgtcgtgggttttaacatttaacaagattatctttcaggaatcaagagttaggatttacagcattgtggctctaaaattaaatactgagctccatgcttatgaagcgaattggcacataaggatcgatataatgacattttagtaattccaaatatttattttacttcattattcaaattcttttgtttgccttcaggctgagactttacagattgttttgcagccctctgtataaaatacgttccaagatggacacctatgaaggaaaccacagctacaagaagccagttctttctgatccaactgctatttttcatctcttctttctagctcaagctctgactcagagctgcttctttctgaaacttgcaagcctgctacttccctgggaggtggttcttcttaggacttgtaagtgccagactgtctggttcagagaggttgtccttactaggaatttggaaaacagggctgcttttgatcctgtgccaccccaaatgtatgaacccaatcagaggtaccataacaaccagaactttgtagtctttccagaagttctgaaagctcatagtacttcagcatcagtgtacctgcctgccggccgccacccgcagcccccaaggccgcacctcgagccgccgcagctcccagagttccactccagtattcttgccggagaatcccaggacataggtccttggggtca

SEQ ID NO: 36761 - DNA, 1487 bp, Bovine  19866881435735
tgggatacacctcagacgtcccgtcaattgtcagccctgactgctagaattcagggagttggcaccagttcacagatgtgcacagaattgtctgtgggcttcacctttacaaagcttctcattcagagcaaattggtgggtaattctagttaaccatataataggcccttaagaacattaacacactctgcttggttcatataatttggtaaattcctttaagataaactcaagttaaaaaatgaatttttgaactgtggctgaagggcagagcaaagaagaatttgctggtctctcaggcaaaaatgctttcttaaataattagagacaggaatttgaaaaggtagcctttctgggatccaaataaaaggactgataaacatattttaaatagttgatgtcctaaaaatcagtaacagttacttaaaagtatctgcccactattttttaatgtctgctcaaaaattttttttctgtaaaagaagcagaattgctttgtaggaatactttgcaaaaaaaagtaccactagatccggctagtggattagcctgccaagcaaggtcggcctggttggctttgtgagtcccgtggggtttctgagacccaggtgtttcgtcggagggttctaggaaggctggaggatggaggaaggaagatgaccaggggaggattaggccttctttttgttttggcgagggtgggagcagggcaggcatccttcagaggcaccccttcccctacccacttgcctgcattttgtccacacatagcgtcgcgtttgaggatctgctcgtgtggccttgaagtttaaagctggattcgttcttggggcacctcccatcttcctctccttatagtgtacttgaaatgagatctcttaaaacagtggattttgtcggatgaggccattcccgtgactgtggccctgcgagagactggcagcactgacgcacccttctttgtttcccttttttatcttttttacagctatttgccgacagggctgtagccccaagcatgggtcttgcaaactcccaggcgattgcaggtaaacaactagacttttttttccccctaataattatccctttaatgcaaaaagaggactgactctactgtgaatatgcctatctttcattggaggacaagaaaacttgaccaaaaaaaaattcaaataagcacatccgaagcttattaaattataccagctgtccactggaatgtacatgcttctctcttggaaaaaaaaaaaacttctgggcatagcgagtgacttcatgtattaacggttctgtaaattgataacacgttgttataatcttccccttcaagtgctaatggactgtccaggactgggttggtgctgggggctctctcctccccccaccgccgcggtgttcggtctcccggccctcccccacttttcccatcagtagggaaagtggagcattctttagaatgggattagcacgagctcctggccccc

SEQ ID NO: 36762 - DNA, 983 bp, Bovine  19866881625048
acatatatagggaatttagaaagatggtaatgataaccctgtaagtgagacagcaaaagagacacagatgtatagaacagtcttttggactctgtgggagagggcaagggtaggatgatttgggagaatggcattgaaacatgtataatatcatatatgaaacgaatcagcagtccaagttcgatgcatgatactgattgcttggggctggtgcactgtgacgacctagagggatggtatggggagggaggagggaggagggttcaggatggggaacacatgtatacatgtggcggattcatgttgatgtattgcaaaaccaatacaatattttaaagtaattaacttccaattaaaataaataaatttatattaaaaaaaaaaaaaacttgcctctgcagtcaagtcaggagccgagctaaaatactcagtggctacagcaggcccagatcttgcccatagtcagcaccctctccctaaggccctgctgtcaaggttccaggaccgcacaggccttttctttgaaacctccctgtacaatgtcaccaagccggcctgataggaggccccgaggtcaaggcagtatcaggggtaaggtttcttaagtgccatgtgtgagacaccatctgacactgtttatacattgacttagcccccttattgaccacaagacagaagttaaaagcattgcttttggaactcaaatgtgttaacttctaaagtgatgtttgaattagggttaagaagggcccaacgttttgatctactgatgggagggaaagaagaggagaaaaaaacaagtaacttaagggaaactttttttttccccagaaaggaaattgaattattttgactaaaaccaaaagacttgtttgtaatgagtctgtcatctttggggctgacatgagatgactacagatgtgtctgaattctgccgctgcccaaatgaggaagctgatctattaaactggactgctggtttt

SEQ ID NO: 36763 - DNA, 2317 bp, Bovine  19866881666456
cttggggcgtgggatatctcctcccggccgccgcccatgacctcggacgtgggttaactcctctcctcgctgcacctggcctccggtgtgggttgctcctccctgctgccgcccctggcctcaggcatggggtgtgtggtagctcctcctggccgctgcccctgacctcggacgcggggtaactcctctcgtcgccacccctgacctccgacgctgggaatcttctctcggctgcacccccgacctcggatgtggggtagctcctctcggcagttcctgcgccgtggcagtctggtattcttggccgctgcccctgatctcggaggtggggtaactccacttggccgctgcccttcgggcatggggtcctcccagcttctgcccctgacctcagacgtggggtggctcctctcggccgcgctacggcgcgccatgtcgcagccgcctgcgctagtgacctgaataaagtaaagggtaagcaatctgggtatttgggagtgtccgttcaagcaaaaagaataattaatagaatggtcctgatctgggagagtgcctagtatgttggaggaacaggaaggagaccactgtggttgcaatgaagtcaacaaaggagtgaaactgggaatgaagtcagagaagacatagaaccaggtcacgtggagcctgtaggttttactaagaattttggcttttactctgactggaatagggtgccattgaagggtttgggaggagaagtgacctgatctaatatttattttctctctacttatttttaacattatctcttcatcctctgagttgagaatagaatatgaagttgggtagaagtgaggaggctactgtaataatttaatcaagaaataatgatggcaggaatcagtggtggcagtgaggtagacagaagtagttgaatttggactatattttaaaagagctgttaggatttgctaatggatcagaggtgggatgtgaaagaaagaaaacaaaagatcacacttgcgcagctagaagcagcccttgactaagaatggaaagattgtttggagtgtatatccagtttggagtacacagatggtattgaaagccaggatactgggtgaaaccagctaaggagagcatgtaagtagaaaagagaaaatatccgaggactgagctctagagatgttgctgtaattatctccatcagagcagaacactctgtcctgccagaaaggagtgttgcccaagtcttcatgatccttaaatcttaagacaggttaggaaatcctctggagtggaaattataaatgctcactgggcatctttggcattaaggagaaaacagaaaagagagaactttggagataaaaattgtgctacaattcacggggtcgcaaagagtcagacacgactgagtgactgatctgatctgatctggtctgatgagcactctgtgatacctgtaagctgtctatagcatgtgaagtggacacaatctatataagagagaataagacaaaaaataagaaatgatttggtaactgaagaagaatcaatgtcacaagtgtgaccatctgacaccaattctgtactaccaactggatgtccaacaaataaattctgatgctaactccccagcattagtgcagaccccacagacaaggcctgagcaagactgaccccacctcagacactagccacaaatcagattccaggacatctgcactgctaaacagttggttacaaattcaggagctgcatgaacctctcactgtttataatttgctagaataatttgtggaatgcaggaaagtactattcttaacaattacagttttctattaagagtatggatctgacagatggagcaaggcacagggcaagcttggaagataaggcagaacttcatgctgtcttctcatggaattcaggtacgtcaatttcccggcacatcgagttattcactcaccaaccaggaacctcccatgagcttctgtgtgatggtaaaccggatgtatcaacttgattgggtcactagctgcctagatatttggttaaccattatttctgggtatgtgtgtgaggtggttctggatgaggttaccatttgaatcagtagactgagtaaaacagatcatccgccaccaacggaggtgggcctcacccaatccattgaagacctgaaaaagcatgagtaagaaaaaattccttctctcagcttggctgtctttgagctaagacattgctcttctccttcccttggactagggtttggatgggaactatattattgactctcctgggtctccagtttgccagctgcagaccttggaat

SEQ ID NO: 36764 - DNA, 4830 bp, Bovine  19866880149270
cccttgtggctagctggtaaagaattcgcctgcaatgagagagacctgggttcgatccctggattgggaagatcccctggagaagggaaaggccacccacttcagtattctggcctggagaatcacattgactctatagtccatagcgtcgtaaagagtcggacacaactgagcaactttcactttcactttcatatatacatattgctgtgtgtgcttcatgcaacacacaaattgcttcagtcatgtccaactctgtgcaaccctatgactgtagcccaccaggctcttccgtccatgggattctccaggcaagaatactggagtgggctgccatgccctcctccaggggatcttccccacccagggatcggatccaggtatctcatgtctcctgctctggcaggcgggttctttaccactagcgccaccgggaaaccgggccaactctgcagagcccccaggccggccatctgatggcgtggcttcggcctgtgtccctgccaaggccccagagggcagttccaacacctgcacggccctgggtccttggtccctccttccctgagaagactcacgtgacgactctggtgtggccagcgccgtgtctcctcagaagggggaggagggagaaggacagggtggtccagcctccggctgcaggcagctccacttacccctgagaccgctgggtagcctgggccccgggtgagggtcattttactgtggaaggctgcggcggagatgatctgggcggacgacatggcagccatgctctgcagggccttgtccttagctgcctgatcctggggagacattggggggaggcctcagcgcgagcaccgtggcaggccaggagaggccccgggaccaggctcccgctcctgcagggctgtgaaccttccctgtgactctgaggaagtcattgggtggctctgatccctttcctcatctgtcaaaggggacacttgtccttcctgtcgcactagcatttaaagagactttgacccactcccgggcatatagcccgagaaaaacatgatccaaaaggatacatgcaccccagtgttcattgcagcactgtttacaatcaccaggacgtgaaagcaacctaaatgtccatcaacagaggaatggataaagaaaatgtacatatatgcaatggaatattacttggccattaaaaagaatgaaatcatgccatttgcagcaacaatggatggacctagagagtgtcatactgagtgaagtaagtcagacagagaaggagaaatgttgtatgacatcccttatgtgtggactctaaaaagaaataatacaaatgaacctacttacataacagaaagagactcgcagaaaacaaacttatagttgccaggggggagagatagttagggagtttgggatggacaagtacacactgctgtattcaaaagggataaccaccaaggacctactgcctaacgtagggaactctgctcaatgttctatgccagcctggatgggagggggctttgaatgagaatggatacatacatatgtaaggctgagtcccctcccggtctacctaaaactactgctgctgctgctgcggctaagttgcttcagttgtgtccgactctgtgcgaccccatagacagcagcccaccaggctcccccgttccctgggattctccaggcaagaacactggagtgggttgccatttccttctccaatgcatgaaagtgaaaagtgaaagtgaagtcgctcagttgtgtccgactcttagcatggactgcagcccaccaggctcctccatccatgggattttccaggcaagagtactggagtggggtgccatcgccttctccgacctaaaactactagaacattgttaatcagttataccccaatgcaaaataaaaagtttaaagttcgaagaaaaataaaaagactttgaaggtcacctgccagaccacagctctcctgttaccaacctaagggacacctgtaaacagagaccacccaggcctcgctcacctccacaccaaggggtgtctggggccccacctggctcatgggagaggaagcaggaatacgctcagcagaggtcatctccggtcacatggacagtgacaagggccagtctcctgtggtccctgtctcagacctggcctatgggtgtcaactgtaccatgggcacccaaggctcctgagccttttatgtgtcagaatgtgactatctgtcctctgtggtccaaagaccctcccaaaaaaatgggctcacctggcacaggctctgaatgaatcagcagttatcatctgcttataataaatccttgttaatacttgtctaagccaatggtcccatcctgagctccccaaccccaaagggcctctcaagcaataagacaacatcctgtattccaaaaagtccatatggattggaaataagaccatacagacagacgggctggtgcagggagcattactggggctaaaacgctgggttatgtcaactcgggagctgtgattagaaatcctgtatctttatgatggattattttaaatgggaaaaatacgtgggccctttatttaatcaccaacttggtgacccaaatctgtcctgaatgataagcaagcggattgctgagggagggcctcacagctcacagctgggtttgctgtgacttcactcgcccggtgggtggcattacagcaaaggtctgagtggtgagcccggcatcctgcgggacacggcgtggggccaggcccttctacccagactctcagggacccgtacagtcacagggcactagacagcccccggaaagtaaagaacactgtctcactttggctctgaacatcataggatccctgtgaggctggcaggacttgtcacacccctattctaagataaactgaggctcagagaatttaggggacctgggtgttgacaggggtcacaggagggtctgccctgcgaagtgggtccaggacaggccatccacgacctctgacctctgcaggcccaggggctgagcagaccgaggagggggcaggtcaggacctgagggcaaccccatcttcagcacagagggtgcaagaggccacgctgagcggtgggcaccccagcccattgtccttttggggccaatcttgaatcctgctctgaggtgatccctattaaccaaagtatcaggctgcctctctgcaaggattctgtgggtctcaggagcatcactcaggcttgctccctccaggacatgggtggggcagcaccccaggaacagggtctgttaacagacccctgttaacaacggcagtgggaggctggatggctccaaccagagatcagagacctgtactcctttctcatagctggcctagtgaacagccggggaccagcaagtggaacaggaatcggggggagttggggggtgacatcaatgacctggtactgaattttgaggttggaggggacctcagacagcaccttgattaaccctgtcatttataggtggggaagctggctggagcttgaggtggatgacccagccaagtgcccatgggcaaagccaggccagtgacccaaagatttccacctgaccttgctgcccacggggtagcttaactgcactgggccccagaccccttggagaatatggtaaaatcctcagaccaaattctcccctaagtgcatatgcaggaaaatgtgtatattacttaaaggacccgtggctccccttgaagcctgtctggcggcccactgaggctgttcctggcccctcatcagagtctattgacagggacaagttcagtccctccagcacacgtgggccatacagccgggcccctcgggaatcaacagctcccctctacagctcttaacagaagcctggacacccgactctccatcaggtcccccgctgggccccagggagtcacagggcagccagagagtggagtggggagcaagtgggcgccagggctgagggtgtctgggtacatgtgccagcctgagagggagggcccagcagctgcggccagccagctgtcctgggggcaaaggagcgagggctgggccgcagctgtggggggcagggacagctgggctgatgcaggaggaatggagctgggtgggcagcgggggcagcctcctgtggcctccgacccacgccttccaggctccagtgtcagggtcatgggccgcagtcccagaggggtcctctgtggtcctctagcccaggggctttgaaactgggttctcgtatgctttcgggttcgagagtcgtggggcctgagagggatgtagaggaggggtccctagcccactcctcaccaacttaactttgaccacagtcagctcctctgacatcatatcggtgataattcagttaggaaaaaaaacagaaaggcttccactgctttagaaaatgtctgtggggagttccctggtgacccagtggttgggactctgcgctttcactgttgaggacccaggttcaattgctggtcggggagctaagaccctacaagtcacacagtacagtcaaaaaaattaaaattaaaaaaaattttttttaatgtccatggatttactggtctggtctaaggcccaaatgctggctcctccacgggaggagtagtcacccaaggggccctggctctggggtccagaaggcctgagtcccatgcagagggggttcccaccagggctggccccctcaaacagtcacctgtccaggcctgcaaggtggggctgatccagggaggggcaggaacgtccagtgccagagagtggggtgggaagaattccaccagcccctcctccagcatggaaccccgct

SEQ ID NO: 36765 - DNA, 719 bp, Bovine  19866880411525
aactccccctgggtgcacggcggaagatgaagccactactgccacgggtcagctcatacctggtgcccatccagttccccgcgaacccatcactggtgctgcagccctcggtcaaggtgcccttgcccctggtggcctcgctctcagagcttgcccgccacagcaagcgagtctgcatcgcccccaaggtgctgctagcggatgagggggtggcctctctgcccacggcaggacaggtgacagaggagaagctactcctcgtggaaggactctctcctctgcttcctgtcccatccatcaaggaggaagacgtccagcctggggaggagacaccacatctagggaggcccatcaaagtcgagagcccacccctggaagcgtggccttcaccctgcccatcggtcaaggaagagtcatcccactcctgggaggactcgccctgctccccaacccccaggcccaagaagtcctccagcactgggtccaggtcccccacccgccgtgtctccgacctgctggtgatcaaacacagggaggggcgggagatgagccagtctcggaggaaacagcacctcgtgccgctccgcctggacgagcccgagctactcctctctgagggcccgggggctccccagccagccctggcagggcccccacagcctacctgccagctcggctccccgccagaagatggaggcccctttaagacacccattaag

SEQ ID NO: 36766 - DNA, 2829 bp, Bovine  19866880493469
cgtcaccctgccgttgtcatgaactgcagacgctcagcctcggggatcccagggtcgctgggaccctcggagtcctggtgtcggggccagcagccaggctctgcggcatctcctgcatcaccaggactttgctccctcaacaacatattctttgagtcatgataccaatgaataataagttcattagatactttcccttcccacttgatccctagctaggagcaaggttgttgagttgtgttttgcttagttttctaaaatggatgagagttgaaagggacaggcgaatcctgagggcctcacaggtgggggggttagaatggccttgtgcagagtggggaggggaacttgggtacccaggtgacagcgcagacgcacagggacaggatgtagtgacggggcacacgccagtcttccccagttctctggaggtcagcctggtttccacacccttgtctcctttctgatcagcatttcaccccaaaaaatcaagttgaagcagacacaagtccaggccaaacagacgtctggtgttatgaacctctggtcctgccctacagctacccagctgggtaggttttgtttactgctctgtcgggggcggggaggggctgcagacagaggtgtccctgagccccagcaggcagggatggaaaccttggtgacggaacagcagctcctcagctggcatcgcctcaaagctccgcagggcccggaatagccgttccaaggctgctctcctttcccttcccttttttttccccctttaattaatttaagcttttttgattaagtgacagctttcatcactcctggcagctgctgagagacaagataatttatagatgcactgacactatatgattaggacaagcaccaccaataacagacgagagatatgctgagcaagctgatggccttagctcatcggtgcctcccccacctgccaggcgagtcccaggtagacgtcccgcgtcagcctggggtaccccccccccgaagactgtaggtaaacacgactccaccccggtgcccgggggctttctcagagctgcctggttctgctggggaaacacgtaactcctaaagtcctctggtcagaacttcctggccagttaccagggcatccctgggggcttggtccaggcaggacctgggacacagcgggtcctgggcctatcacttctggctgaccttgagcacgccctcctcctcccactggacgccacggaaatgccaccattgtctctggggctcacaatggaaaggctgagagtcactcctagtcccccagcaaggacagtaattaaatcacccaggaaatacaggctccgtcctccatccatggcccttcgtaaccgtcctgggtggccacagcccatggggtcacaaagagtcggacacaacttagcgactgagcgctgcacagcatagaaaatcctagttgtaaatacagagcacccactgtcttaaaccctcaagaacacaccgtgttaccccttcctcatgtcaagcagaggtgctcatgggtgagcctcctcctcctcctgggtggagcatgtgtcctctttgcacgccctcagtccggccttctaagtgttccttgtctcagggtgaagggcaccctccctgggtgagaaaggggccacttagcaggtgcttctcatgcaacgggtgctgtgtattcacacctagtattttctgtcctgtgttgtgccacgctcagtagcatccaactctttgcaactgcgtggactgtagccccactaggctcctctgtccgtggaattctccaggcaagaatactggagcaggttgtcatttcctactccaggggatcttcctgacccagggatcgaacctgcacctcctacactggcaggcagttctttaccactgagctacctgggaagcccagtattttctaggcaggattaaatgggagacagtcagccctgtgtagccccgaggattagcagctcaatcggaagccaagattccccttcacctgagggtctggcctgccgtgcgtggcctctacccacgtggctgaagggaaggaggagggtaccctgcgttccagaaggttaagtggacaaaccacactgagacaaacgggcaccttgtcagcttctgggggctggctgcttggggagcggagaagcaaagccacgggggttcctgtgaaagaatgcgtgtttgtggctggttctttggtggctgttcttggcaaagagctgagtgtgaaagattgaggagagcctgggaggagtcgagctccgggactagggggaaggatccgtcatgccatctgcgttcctagcgcctcctgcagctggtgcagagctaagctgaccacaggcatccagcatcacacggtcaactgcccaggggacctgccttgtcggggcacccctgcctccctgtgcccacctgacagccagaccgcctggtccgggttccttggaggaggacttctgctccctgagagatattgggaaaactgggggcaggacatggttctactgagccaagtcactttatgcttttaagatttttttattttaaatatccatagattcacaggagctttcagcggcaggacagagaggtctgctatgacagggatgtttgatttcttgttatggtccaacgggactctgagactctgcatttttaaagactattgtctgtctgttgttcacattgggtcatttctgttctatcttcaaattcactgagtcttttctctgttgtttccattctgctattgagcccattcattgagtttttaaatttcctccattactgttttcaagtctaaatttt

SEQ ID NO: 36767 - DNA, 993 bp, Bovine  19866880507628
aatcgctggcccagagacggccgcatgcgcctggtccctcctgttcctgcccctcctccacacgggctttcgttgccagggccgtctggagggtgattggcagcccgaggtcaccgaagccctcttggcaacccagctatcccagcggatgggacattgattccttggcagctggtgcttcctcaagaaataactgtcttaaaagtctggtgccttattggctttgctctgaccgaagtgttccccgtctgccagtcgccccgccctgccccaagccatttcccctgctctgtccaaacccacattcatcccttttgttctctgcaaacccctgtcctccgactgtcccagcagacctttttcttgatcacgacttgagcctctggatttctctttcaagatcagctccagcctgcctgactgatgagctgaggtcattcctaccctcagttcagttcagtcgcttagttgtgtccgactctttgcaaccccatgaactgcagcatgccaggcctccctgtccaacaccaactcccggagcccacccaaactcatgtccgttgagtcggtgatgccatcctctgtcgtccccttctcctcctgccttcaatcttccccagcatcagggtcttttcaaatgagtcaggtcacctgtaaactaagcaacagggacagtgagtttgaggatcagggtcccagcagacacactagaggcccttggccctgagtcctggggacctgcctctcctggtgagacgccccggcccgtgcatgggctggcagttcagaacttgcaggtaccgtttcgcttctgtttcctgtgcacagccaggcctggcctctctgagcccataggtgcttaatgtccatcccagccaaggcaggaggagcccctctgtcttgtgccctgtctccccccagctcccttgctgcctgtcaaggagatggaggtcagcagggccaaggatacactctgtcccttctctgcaagga

SEQ ID NO: 36768 - DNA, 1877 bp, Bovine  19866880532175
ggaaatcttgccgcctggcgggcctccagcctgtgtctccgactgttcttttgttcccggggctcccgccaaacatctgactctgctcaggatcgattgcacgtaaagtgcagagagggggaacggggatttttccccatggtcgtccaagacgcagatttttagggctttgattctctcccagaatcacgctgaacagccatgccttttgcaagaggtcacttcattttcaactgacgtcaggcctaacttgctttggaaactttgcgtcaggtggtcctaaaagagagaggaccatgcaggtgaccactgggtcccactgaggacagcccaggctcacagggtctggcaagagcaggcaaggagcccggagaccagggtcactggcaggatcagagtgccgggggcagaggaggcgccactcctcctcgtttgttgattgactacccgggctgggccagctgcttttgttctaggagatttcgtggactcattccctgagcttcagacaattgtttctttttaagaaagggaagtttggaggtggctgagaggaaatgcccccggcaggctgggggctgtggacgtgtcagcgggggcccagatctgtactgtcagtgggaggctgggggctcttgggggactgctggggcccgtgcggggccctgcaaggcctcctccaggaggagctgcgtctggagcgagggcttgggcacctagagcaggagcatctggacgggcgttgggctggaggttgctaggcgctggagtaggtttcccagggagacggggctggaaacaccatctgctgaggatgcttgggtcccggaacaggcgggggaagaacgagaggttctctctgtcccagttaaccttggttccattgcctgggccagcattccttccacaagtggaccaggaggcgctgaagccctgggagagccgagtggtccaagtgggacaaggctgtctccttgtggggccaggtgcccgggactccccactttgcacccccatcctgccccagccttgtggggagggggcatcatgggcagaggattaaatactcatacttagtcaaaacattgtcagttacaaggatcctccacatctactcggaggtggaggccaggagagagtatggaccccagaacgggaacaggcttagtgcttgatctatcatctgcccgaagggaatgctcgggccaagcctgcctgaatcctctccgcgtgcgtgctggaggagacgtacccggtcagcttgcagacgccgtctgttttctgtccacagagagtaaagcccatgactgaggttgggggtagagaatcgggggccctgggttctggatacaaggtcacacacagtcctacggacagtggaaaccagctgacttgtgcgaattcggaaagggagaaaggttgcctgtttggatgggtgtggatccaatcactgttagggacatggactcaacctctagcccctgaagcactactttctccgtaaaccttcttcggctttaaggatcattcatcaccgtggcagatggaaccacaccaatgattctgctgaaaaggcttcattgaggggctgtttacacagggaccagcaacagaggggctattaccacctgggtctaaggggaagtcctgttcccggagccccagggccgctgtggactagacactggccatgcaggggtgtgactaccccaggactgggacctcatcaggtgggcctggaaagaagggcccccacctcactttccttcttcattggccaaactaaccagaagcctacagtcggggagactcggtccacaggcctcagtccaggagcagagcagggaggggagggggtcagcagagagcaagagccc

SEQ ID NO: 36769 - DNA, 1703 bp, Bovine  19866880537169
ccttttctccttcccttccttccggtcatcaagcgagagggcaccggcatggagacacccatgattggggaccgagtctttgtccactacacaggctggctgctcgatggcaccaagttcgactccagcctggaccgcaaggacaggttctccttcgacctggggaaaggtgggcatggttagcaggctcttaggactggggtgtgtgcgctgtcacaaacagaaaccgtattctcagaagcttaaacagggaacagcttattacagttctttttttaatttccactgtcctgaaactattgatttttttaatctctcattgccttgatcaccttcaaaaaccttgcttccttttctggggtggactgccttgttttcttgaacctctttatttcagagttgagtgatttttcttttttttgagaggtctgagacctgataccatttatcgcaaccagattttctaccttcctggtcccatttctaaatagtacccagcttccctttgggcatgggacagtaagtctctcaggccactgtttgaacccagagggagatccctgccaaagaggacctgtttcttttctgtacctacaggggaggtcatcaaggcttgggatattgctgtagcgaccatgaaggtgggtgaagtgtgccatatcacctgcaagccagagtacgcctatggcttagcgggcagccccccgaagatccctcccaacgccacgcttgtgtttgaggtgagtgtccagccacagagggccaggcagagagccaaccttatctcagcccagggtctggctgccctccagcccttcctgctgcttggagacaatgtagccaaggctgagggcctgctctcaggggagggaagacagggagtgcgcatcacctactgctactgccagagaattgtcagtgggcaggtttcagttgtggggaggtgaccgcaagcccctctttcagacttcaagcagcggggtgagggcttgaggcctattcatctcgagaggggtgctcagagggaggtggaccaacacgaaggaattgggaggtcacaggctccatgcagtcatgactgacagtggagaacattggtgccctggagataagatgcaggcagagatgcttctcgcatgggtcgaggcaaggggcaagcctttgctgagaagatggaacttcactgtgttaagactcacagatggttgagccctacgcagtggaggcctggagaatgttggaaagactagtgagagatgtggggtcatttctaatgcctgtcggatggagcttgtctagcagctgaattaggaccatctggaacacgtgcttgttctatagggcagtcattaaggagactgatagcaaggtcgagaccagggccgctcctgagaacttagccacttggtccactcctggtgcggctgcctgtgcagtcagacctgctctggcccttactagggactcttgtgggagagaggggagcatggatccttacatcttgtcccacaggtggagctgttcgagttcaagggtgaggacctgacagaagaggaggacggcggaatcatcaggagaatacggacgcgggggggagggctatgccaagcccaacgaaggtgctctcgtggagggtgaggctcacaatctgggattctcactcgggcttccgctgtgcagggcctgggtggctgtgggcaggt

SEQ ID NO: 36770 - DNA, 1891 bp, Bovine  19866880567631
gggcaaataatgacattatggaattactagcagccacgagttaggttttaactacattgtgtgttatggtgactaataataatactttcaacctgtgagatattgacagaaaatccagatttctagctggggcttgaaatcttccttggaaaagtcatccccagcaagtgtattatgatacaggagctctggaatgctgatgctttcccagagagaaaggcaagagcagctaagagaactggtccctgtctcctaacccctgagtcccagcttccacatctttgtaggggtgaccctcagtctcaaccacccaccgtcaaccgcaccaaccatccatcattgaatcacctacatgagagctagtttgtggttgagatcaaaccaggcacaggatgctgtaaactatgaagagaatcacaaacaacagctaatttaattcctttcctggcagcattactagtcctctgaagaaacctgtgtgtgtgtgtgtgtatgtgtgtgtatgatacctcggggtgcagctcccctaagaagaggctgaaacaaatcttatcagcagcctacaaagcatctcccccttctccagcactgagggagtgaagggcattctcctccttgggaccaacctttcagagtgtttaactgctggggagtcagatggacatgcactcactagtcctcaggatgactcacacacagatggactggcggcgggcttctgtacagtggcctcgctccctggggctccatccacgcccacctcggcttggatctttctcacgaaggcccacaatgctctgaccactgtgttcaggacgggatgccagctgcctgctcctcagagcagtccctgacttcttgcagggttggggacttggggtgtgtctgagtagcggtggaaagaagagacagtgatgggaacccaaataacaggattctaagcaacaccccccagagagtcatgccctggggtctccctcctgagcaggtcccagtgggccagatgtttggcaaattcatttacagaaaataaggttcctgtaagacttagttccagataggtgagaaagttccaaccatttattggtattttaaaaatatatatatatatttttaacttggactattcttaaagtctttgttgaattaggtacaatatggcttctgttttatggtgtggtttttcggccttgaggcatgtgggatcttagcccctcaaccagagatctaacccataccccttgcattggaggcaaagttctaaccctggacccccagggaagtcttcgcttatctgcgtttttgacgtgcgctccatcttggcgactggacttcctgtcgcgtcagtccttgttcattacttatggtgttcttccgtgtgtcccataacagaaggtaactgctgagcggtggcttcccttagctgcccagtgtctgcctttctaagaaaatgttagaatataatctctcaggcaggcccgggtctttataattctctttgtgccacactatgtaagtgctgaataaatgctttttaatgacgaagcagctgaaaggactccacacattaccgtattcagaccgaagctatcttggcaaagtgacggcagctcccagatggagacagaaaggcagaggggtgaggggactcacaggtgaacagaaggcaaaccagagacgggggctcgacagccctcccggtcctcagttaggagagacactgcttgtttgctcgttctaaaaagccgcagccttcaacacacatgtcctctgggcctgcacatctcgggtgctggaggaaagatagccctcagctggttcaagtacagtcgtctcctttggccaaacatcaggaagccagcttgtaagcacacactaccttattattccc

SEQ ID NO: 36771 - DNA, 1731 bp, Bovine  19866880602241
ccctccctgctctccctgggtcctgcgtgggagcccatttctctgtgtccacgtctctccaattagacccaaactcctcgagcgcaggcctgggggccctgtaaatgctgactaaatgtgtgttcaattgaattactgagtaataagaacttgcctaatgccagtgaaatgaataaaacaaaacctaataaataaacaaattatagctttgagagatgagaattccccttcttaatatgtttataaaccaggagtttattgtttaggtaacagattctctgtttaaagctgcgtgggtgctgagcagtaatgccctacctagggcagactcagggttcagggctgggcgtaccggggaccctgacaccttctctaccttatccctgttagagccaggtgccgtctctgggtgatgaagactcttctccacttttcaccctgagcggctctctggtagagctcagctccccacctctgctcgctggacacctttaaggcagtgagaagaggtggagatggaacgggagaggatagggtcaaacacccaattccacctgcttggagggaaaaggccttcctcataaaccagggatatttcagcagcgccaaggccagagatcagtggccgtggtgcgtacatgtatgtgtgtgcacgtgcactcgtgtgtgtgtatatacatgtgtgtgcgtatgtgtatgcgtgtgcgagtgcatatctatgggtatatgtgtgcatgtgtgtgcatatatgtgtgcatgtgtatgcacgcacatgcatgcatatgtgtgtatgtgtgtgcatatatgtgtgtccgtgcatgtgtgtgaggaatgtcctcccagcatgtccacacgtgtgagtgtggagctgaccactgacttatgcaaagttaaaaccttacgctttcattcctgctggagccaaactgaggcagaagctcgcaaagacacatctttcctttttgtgatttctcatgagggagtccttttgattttagttttaagctgaatctttaattcttaaaaatcagcggaagaattggtcagggagaaaccaactggggaaaacaggaggtgtcaggaagtggaggggggatgagtgctggtggaggaggtgaggccagggcacaggccagatggctgttctgtgtcacacgggaagcagagtctgggggcccgggcagagggcctcatgggcagaggtcaacagagttcccttcatggacagttgctgaggcactgagagtcctcaagtgcaaggtgcccgaaatcctgctcggagccctgcttggggctcaggggacactcatgcctccctgcagatgccctgtaccccgccctccatggacacagggcatggggacctctgggagctcctgcaggtgctggggctgggccctcagtgtctgtcccctggctggtcctccgcatctgtcccccagctggaccctcggagtctgttacctggctggaccctcagcatctgtcccccggccgacccttggcgtctgtcccccggctgcactgggtgggggagggggcccctccctgcttagagggctccatgttttataggaaagcaaagagggctgtgagagtctgtgggttttgggagaaggagcctgaggagaggaaggaggagcaaccagagagagtagagaagcagagagcgagcaggcaggcgctctgggctaggaggggcctccctcaaaatacccaccaggaggttcc

SEQ ID NO: 36772 - DNA, 1390 bp, Bovine  19866880620665
aggggtggggctccctcccagcactcgccctccggggctggccgcccctctgaggagccgtcccttccacagcagccgctgcgtctcaggagtccatgtgcgttgggactgagatgggacggagtggccatgagggacagagtgggcacgcgcaccttcctggggggagctggagcccgtccccaaggcgcaggctgggtgatggcccagttcattcctggggcgcctgggaaggctctgcactaacaaagcacagcgaaggttcttcaggcaagtgggggagagcctcccttttgatgcttatgctggtgaccaacaggcccgaggaccgcacagcgggaccagaggcctccatggggagcagtgtccccaggggcagaacgcctccctgtcctgcggcttcccctcctttaaagaggaataactaagaaagcaaaagtgtcatcatactcagaattaaagacaaaaacagaaagttatcatcagtgtggtaccaagggaccccctccccaaatctggtccctctgccctttagcatctcaaccatcttaaaatgtatctacagaccacatcaaatagactgtttttactgtaatgaaattagagagaatggttgtatttttgtatgctgttgacttttattaaggataaattattcatcttggtcttgcgtcataaactctgttattctgatggataagtatgcgttgagctgcatcttactagatgacacattgttaagttttgtaggcatggagttaaagtttcattctgatttttcaattttcttttatattttggacccagtctggttttgctttgcttttacatttcaagggtttttgtgggtcagcagaaagctcatggggtatagacattgtgtctcttaggtctgatggataaaacctccttctgtccctcccaccctcacccccagagagaggaagaaataagagatggcttccgtggactgatgttcagcctctagttttcctgtctcctttggctcttgcttttatgacgatgaaatgtaagatgtgttctctgggaaacatggaatctaagcatcccaagcaggtgacatgtcatcaattacctgaaactcttgacaccaagggagggatgtggattctgaacatgaaggtcaagtaccagaagggttagggcaagggcctcgagagggctggctcttctgaagactccgacaggcaccttcacgtgactctgctttcacgtggaccctggacttctccctggctccacaaggagccttgcgctgctgcagtcctgacgtgggtgctccggggctgtgtgtgcgaatactgatcgcccggggtctaaccaagcagagagagaactaggtactgtgcaaggagaggaaggctagagg

SEQ ID NO: 36773 - DNA, 1507 bp, Bovine  19866880662834
tcctttcatcaagcctgggcaagacggccaatttaaataaacagtgtggtatattcaaagcattctgacctgaacagaagaggcactaaaaagatgttatataattgtaacatttagatcccttctgtacttcaaaagttacactttctctgagctctagttttaaattataacttagcagaaataatcaagatttttatacacttataataactctgaactaggatttctggtcaaactgtattatgatcttactaaacttgcattcgttgctttaatattctcttttcttcatttcaaaccaagttgttgaatagcaagcctaaacaagcctggttagcaaatctacacaaaacaaaacgaagttctacagaacagagggagaatcattaactcagagggaaagttaacaccagagaactgttaactcagagggagctatctgttcaaggtcagaaagtggatgagtggacgagctagagttcagcctcagccccacagcacctgcctcagcgtgcagactgcaccttccccacaaatattcaaatggtcagcagagagtctgggatttcattattatggcatttcaacaagtctgccaagaagcttttcagtcagaatgtcagttcatgggtatttttaggcagcagaatttccaagccagtgaatggattttgaagatgcccatgggagcagttgatcacaggttataaatactattggaaaagggtcatcagatttcatcgtgtctgaactgatcatggcgtcaagtacttgggtcaacagctattactaaaagcatttttctctaagtcaactgacaagtagattcaccttgtccaaatcccaaatgtcaatactggaggcgtagtttcacatgcagtgagacccaagagtacatctggctggaacaaaacactgcttctgtgagaaggcacaaagatcaaattagaaaggccagaaaagactccacagaaacctaccctgcctcacgcaggagaactgttaatattccgggctcagcggtttgttacttgagtgactgccacaatctgggactaacttaattgaggcaagggaacgaaaacccatttcctaagaggcccatttagaaaagacaatcagagagaagggagaactgcctggggagagagaggcagtgagaagggaaacttggcagctgatgagaggattcatttggccccagagaacacagtgaagaaaactgcttcagatgaagaagccctctctctcattctgcatgtcacacacgacgaaggctttaaaaagcattctttttagtgagcccaacagaaaagttatttaaaacgaatgactttatgcagaagttaaactatccgtttattcctcacagattttaaaaaggacacaactgagaattcaagttcacttcacctcctgcttgggctgtcctcttctcagggggtttcagtttctctctggtaatgtcatttccttctctctcatgtaaagatcaaagtacatt

SEQ ID NO: 36774 - DNA, 917 bp, Bovine  19866880785228
atctgacttgttaaaagccaactcgagcttgcagcctgagtggtcctgggcgcccgacactgcaggcgcccaatgctctactgaccaggcgaggggcaggacgcccagggtcagtccttccagccacgggcctgggctttgtcagggaatgccaccctgggtcttgcctcatctgctcacttcggggcttggggaatcaacccacactccagtctttctacaaactcacacttgttccacatacgaagtctcactgcagcctcttggagacagctgttccaaggtgatttcaaggtcactcgaagtggctgctctgtcactttagccaaagactcctgcagcaggagtggccccaaccacacggcctgctgcagggacgcgggcgtgtggcccagttctaaggcccctcatagctaaggatcccactgtaacctctcgctggggccttgatcagagctcccaggaggtggtgatcaggagggacacactgcctctccacctccactacattacctctccttcctctctcccaggggccttcgccgtggcgccggcctgtgtcccatgccaaccccacatcagactaaggttggagatgccaacaagcagggtcctcaggatgtttaacaggaactggccctctggtctgattctctcccagtggcttttcagatggtcaaggtcacagtgaactgccacccacaggaaagctcacagacgaaacatcacaccaacagcactgacagctcgcagaccaggcaggcaaggcgcatggcagacacaggtgggtgacatgcatcggggccgggctccgagacgccgggggttgggggaggcagtggggacgttaggggggtcacagaagctgagagcgtggtctggaggctcggtcttaccataaagggagagcattgggt

SEQ ID NO: 36775 - DNA, 1697 bp, Bovine  19866880859337
tggttctttcctgcagtagtcattattgtggtgtctgcctaatgttcatttcctgtttccctcatttccactacactgttaattggaattctcttggaaagagctggcccttctctttccttacttccttcctttatttatttgctaacttattaagtggtcttttgtcattagaatcacagtattttttaaattacacaatatataacaaatgcatggctatatgttgtgtagcaaggatcacggatgtgtattctatcctacagattgctgttgttcagtcgctcagtcggttgaactcagttgaactcgtgttcaactctgtgaccccgtggactgcagcacaccaggcttccctgtccctcacgatctcctagagtttgctcaaacccgtgtccatcaagtcgatgatgccatccaaccatctcatcctctgttgcccccttctcctcctgcccccaatccctcccagcatcagggtcttttccaatgagtcagttcttcgcatcaggtacccaaagtattggagcttcagcctcagtctttccaatgaatattcagggttgatttcctttaggattgactgggtttgatcccttgcagtccaagggaccatggggtggccttctttatatccaggggtgagggcacccccatctcaatgcatctcactgagttgggggctggagattcccactgcttatggggaaactgagtcctgggaaaagggaagcatgccaaatcccgtttgccaatgccatgtgcatagcgaggtcaggaggggcagggaccaggtgtccttggcatcccagccgtcctctcagccaggatcatcctgtcctgctctctcctcgtgttcgtgtccagatggctgtgggggaggcatggctggcaccggccaaggtgatgtatgaccacatggggctcagagcagcgagggctcggacattaggggtgtcaggctgggagatcggaaattaaaggcccggagccggggccagcatcacctccccctggtgcagtgttctgaagtcacccgcggtgggcttcatccacatgcgtgcacgggaggggaggcctcttggcaggctggagagacagatgggctgcgggcagcgggcctggacccccgggcgagctgcaggccctcggggcttggcgtgagcttctgtgatcaagctcttgctggcgtgggcacgaggaactctctccacttagaagctgtgtgcccaggcagaacagttcccttgctggcctcagtctcctcatccataacttgggaacagtggaccagatgacctttgaggtctctgggccctgacatcgcctagatttatgatctgcggtcactgggagagtggtgactgggttgtggctgatggcaaaggggcagatgtggccccgcgtggcatagtctggctctccccacctgaggtctctgagctgagctggccctgcagtcaggaagacttcttggaggaggtggcctctgaaaaggcaggaaagaggactttcctgtatatatactctctggacattctgtttgtcatggtgtccacctctctgtctttcctacaggtatgttttgagaacttgcttcccaggtggcacagtggtaaagtatccgcctgccaaggcaggcagtaaaagagacgcaggttgatcccctgggtcaggaagatccccggaggaggaaa

SEQ ID NO: 36776 - DNA, 1428 bp, Bovine  19866880902225
tgaaggaaaacctacgtatcttaatgcttttggatgaaaaggaaggagggaagtctggtctaaattgatgagaaaattccgaatggctgatttttaaagaaaaatggttttagtccttgttgtactgaacatacaataagctaagatttaaatgaacactaataagtaaaattaagttagtcactgcagaattacaatccataataggcctttattgcataatcatgaattacattacatcactgagtcttaattttttttaatcaatgagaaatacagactcagattgatttgctggggtatagtccgaatttaggtttcacagcactcaggatttaactgggcactttcagtggtccagggagcagctttagtggaattctccaggcaagaatactggaatgggttgcctttccccctccaggggatcctcccgaccgagaggtcaaacccgtctcccacattgcaggtggattcaccatctgagccactgaggaagcccctaagacacagggaggcaggacaggggaccccaaagaaagagcagacacactcctgagtctggaatctcagtttacaagcagccaaaggggtgctgggatctacctgtccacctctgctccgacatctatggcccccaccacagaagaatgggacggggcacctggaggatggtgcagctcaggacccaccgctgggcagggactgacttaggaagggccagactgagtcctgctgggcagctcctgtcagtccatcctgagccagaaggcaagctgccaacaggctcagagctctagccactggggtcttccctgccccctatccacctggctcccatcagctctggatgggctggtccacgtggtatctgaaacacccaggaagaaacgtgtacaggaaccatcagggctgcacctaaacccgggcctctctctgctgcctccccggggctgcgctgcagaccccaagagtctcagagtaacctgacatcctcctcagccttcagtgtgggtgtgtctacatcctggctggagtggctgaaggcctgccttccaaagtggttcacggcgcagggagcccataacagcagttccagattactcacccgcacgcatattattttccagtatgattcatagcaactgtaccgtatttcagctacgctacgggttaaacagggcagcctggaaatctaaatgccatttctgatgtctaagtctgaaacaccaacttgacaatgaataaaagagcagttgaaacgttggatattgtctagaaatcactttttcgtgaaaagttcaaaatatcttagcaatgggacctcatccaggctctctcgacccctggaagacttgccaggaagtcatgactgttctgtatcacagtgaatcacctgagaagcgacccagagcccggattcattaa

SEQ ID NO: 36777 - DNA, 1960 bp, Bovine  19866881135134
ccgtgtgctcatgaggggagaagggaactggcttacgtgtttttctctctcgtgtctacgtgggtgattcattggcatgaatgtcacccctctcccaaggctgcacacacattcaggcaggacctgtgtggaattcatttttatgttcactgtagtctctaagccgatccttaaacacagtaggtgctcataatttcatattttcacaaaaacatgaaatcatttctaaagttgatggatgcatttggtaaccagttctcactgaagctattcatttctaaaaacaatgaagaggagaacatttaaatatgtgaatcataagccagggttatggttgaatcaggctttgatggttttcaaattccttccacgcagccgtctcatcttgcttccctgccagccctgtgaggcgcaggacatgttgttttcccaatttaattatgagaaaactgaggtcagagacgggagatctgcccaaggtcacaaacaacatttgtttggggtggggatggggattattttttatttcacttttaaaatcaaaccagagttgagagccaccatctcctggtttcctgtttcatgagcaatcaggccacagacctgctgggttccgagctgggccgcagggcccggtgacgagcgctaggcttgggcagcaggtgttttggttcctgtctttttggtcaataagaccgtctagcacagcactctgaacaacgcagtccccaccaagcagaccagtccagggcgagacaagagctcctgacggagtgcacaccagctacatctgtacacgcggtctagttggcctgatgggtgtttttttttctttttatagttagttggaaataatcttaggcttacattagagttgaaaagtggtagggagagttcccccagacccttcatgcagcttcctctagtgtcagcttctcacgtaattataatataagggttcaaactgagaaattaccactggtacaatgtctgtgtgcatacacagctccttcagtcttgtccaatgcttcaggacaccatggaccctctgtccatgggacaagaatgtccaggcaagaatactggagtgggtagccatttcctcctccagggattcttccgaacccagagattgaacccacgtctcctgtgtctcctgcactgcaggcagattctttacctactgagccatcagggaagcccatcattggtaagatgtgctgagtcgcccagtcgtgtctgactctttgcaaccacatggactgtagccctccaggctcctctgtccaagggcattctccaggcaagaacactggagtggattgccatgccctcctccaggggatcttcccgacccagtaagtattggtgtaatacttacaattaaattctggctccattgatttcaccagttttcccacttgcatggggattccacgtgtctggtcattgtgtccatcgagtcgatgatgccatccaaccgtctcatcctctgtcgcctctgtcctctgtatcctttctttgttcaactcctaatttgcatcatgatcctgcttatcttgctctacatatctcgttgcccacgttgttccagcttcagccagtccaaggtctttcgggactgactctgaccctccaatggttccccgcctctttccagcattttcttcctttcagaccacaaagtgctgcaggtgcatcttgaatcttccctgcccgagccctggaatcaaatgcctcttcctggttcctctgtctggagaagagtgtttaaaagccaagacctgagcagcaacggtgctcattgctgtctgtgacttgtttacgtcggagcttctgtcttaaaggaagcactgtgtctgtccacgcggtgaatgggaatcagccagcatcctgtcttgctgtgaaccagggacaccagcgaccccgccgcgtggaatcttaagaatctgtcaccgtg

SEQ ID NO: 36778 - DNA, 2072 bp, Bovine  19866881196631
tgtactgggtcaaaaaaggaagcagtcactgagttggtcctcaaacatgtgcactgaattactttgaatgaggtgattaaaagaatgaatagacagtgggtaaaaggaacaattaagaatgaccatttatggggggaggggaggcagtattgctgcattagtgtaggtcagaagcagggttctcttaaaactctgcagccatttatttacagacattctaaacagttatatttaaaatttgttaaacagttaatacactaaaaatatgaagtcaactgtttacgatactaaaaactgtttatgacacaagatattttaaaaagcaaatctgggaattcaattcccttttgactccagcaatcaatttcttgagaccacggatgtctgggaaatcagtcagtctttcacaaggaactggcttctgctcagctttcccctctccctgaggtacgcgaacaggtgtcgtcgcctcctccacgtgacctttatcccgtacttctcctctggggtgtctgtaaccagaacaggcccgggctctgggctcttgggcgtgctcgtgtgaagggaacagctgggaaggctgttttccctcagttcagagggaatgggctctccctgccccggggattctggggtctggatgtccgggggaatgaacacacatgggaagtctggaaatgtgtgtgccgacagctccctgcagctctgggggctgagcatgggcaccaagggccttccggaaatgtccttttctggttgactggggccatccctgcttgccaggatcccaggtgtggctgaactggcagaagactgcggagtctcaaacgttagacatggaaacctggagctggtagattttcggcttgaacgccttgcatggtctcgatgatgatgcttccgcttgcctggaaaccagctttctgctgttgtatcaaactgaggtgatacctaaggattccaaaagaaagaaataaaagtgaagcacgctaactcccagacacaaacctaaggaaactgcatcagaggaccagaatcctaaatgggggcccacaacagcaatggacttaaaacagctgcctgagggacttccctagtggcagggaagaatctgcctgccaacgcaggggacatgggttcgatccctggtacgagaagatcccgcatgctgtagggcaactaaatccatgcaccacaactacagagtccagctctagaacccaggagccacaactgctgaagtttgagcgcctagagcccgtgctccacaacaagagaagccgccgcagtgagaagcctgtgcactacaatggagagcagcccctgcttgctgcaactagagaaagcccaagtgtagtggcaaatacccagcacggccaaaaaaaacaaccgctgtctgtcttactggataaccataggaagggatgcgggctttgggcaagttactcagcctccctggcttcatcacaccctacagctgcaacacacataaccatctccctttcagttctgagggcaggcccagctgtcgtcttcaccactgatgcccagcacctagcagggcgcctgacacctagaggaccccagtgtaggaagaaagggctgaaggcagaccagtgagtgagatcaggcatggagagcagcaagcagggcctggcgcgtgcggagcactctgttcgcatccacgtgctcatgcctcctcccaccaacagcgctctaacatctacgcttcctccccactcctgaagccaggggtccagttctccccagtactcctgcaccacatctgtcaggcgctctggggcagagctcaggcttttgtctggctcttctgctacaccactttctgataccccatagctgtgttctcttcccggggcttataaactgtcaagacagaacacatgccatttctgagagtttttcttcactgtttggtccattaaacagtaaacagagggacttccctggcagtccatcagttggggctctccatttccaacccaggaggtgtgcattccaccccggttggggagttaagatctcacaggccttccagccaaaaaaaacaa

SEQ ID NO: 36779 - DNA, 457 bp, Bovine  19866881305727
agcccccgtaggcattgattctcaaaagacagaggctgccccttcctgttcaaaatgctccaggtgacacagcagaggaggagccgaaggggccccctgcccaacaagagcctgctcaagcacaagcccccaaggaggtggcagagcccaacccctgcaagtttccagccggaatcaagatcctgaaccacccaaccatgcccaacacccaagtggtggtcatccccaacaatgccaacatccagagcatcatcacagcactgaccgccaaagggaaggagagtggcagcagcgggcccaacaagttcatcctcatcagctgttggggggagcccccactccccctccaggaccccagcgtcaagcccaaaccagcaaggaccccaagaggacagaagtgatcaccgagaccctgggaccaaagtctgcaactggggatgagaatcttctaagacca

SEQ ID NO: 36780 - DNA, 1025 bp, Bovine  19866881593378
cgcacgcctggtgcgcagtcccacgcagtgaacggtggctgtcaacagcactgacacctactaccaccagcttatttctagaatcgtcgtcatccacgtagacctggtatcaacacaaaacaggctggtcactagcaaaacctactaccaccagcttatttctagaaccgtaaagtcacccacatagacctggtatcaacacaaaacaggctggtcactagcaaatactaattgcctcaaatttaagggtaaatcagaatttctaggatgaaaaacaagacatttcactgacatgtttttgtttttccaattcctcctattccctaaaatgtactctcttttttccacactgatgttctaccatgtaataaaaataaaagtctaagagcacgctggaaaccccggcaccccaaaagagggatggaggtaaaaacaactacatttgaacattctcctccattttatgactcctggataaaactctcttttttctggggcgggggtggattctgactattagactaggacctctgtgaagacagtgagaacacggcactggacacttggaggtacaccctcgttcctgctgactaggtctaaggctggtgccccccgcccctgttcttaagaccaccaccgccccccaccccgacagcacactaccctccatctcaagacaagagccactcgcctaccttgcgattctcatccttttccaagtgcatgtagtaggtggggaagagcccccggtccatccctttcttgtcccgggttatccggcacttcactgtgacacctcgtggggcaggactgtacgcaaagccttccaagtcctctatttctcctggctgaatgtcagagtgcggggatgcggtcccggaggcccctgtgccctgagagagcagccgcagctgggtcaggaaacctcatgttctctttgagaaacacttaaaggacaaattaacttactgatttacccatatgtcttccgtcttctgacaaaataaagaaaaactctgagaagt

SEQ ID NO: 36781 - DNA, 947 bp, Bovine  19866881744311
tactcccacttcttctgtttcccatctggcttcacagaatctggcattattccagagcttcccacacaggctggttcttagtatttccttgaactttgtgagcccggatgaaccaagaatccccagcatagctcagaaatgggtcctcacaaggaggattctgctggccggatggcacagtcctttcacacaagttgggtgtctggaggcatctttggtctcctttggtttagagagatgaggatgctgaaggttcatgctgagtcctggccgcccttcccgttggtcccctctggtaccaggtgatcacgtgtcttctgtgtcgctggactgatgcaaagtgtacacatgtcggccggctccctgcctgttctcaggaggaggggacccgcgggctgtgggcaggccagttgccatgcattcgggttggaagcctgagggaggcaggctttccgtgtctgcctcggggagtgttgtgggacccaggcatccaagagcatctgccagaggtgcctgagatgggcaactgggcagacgcccctcagccctggagctgtcccccagtcgctctcccagcctcgagcctggcagacgactggggcctgggcatcttagtgcccatgtccatttctgtttggtgcttttcccagaaattttctgtgtgtgtgtgtgtgtgtgtatgtgtgtgaatacaggaaatccagtttagagaacagctttgtgtgctccgtcctgcatgtatgcagtgctctgcccttgagaattttaaatgagctgacctacatagcctatttcaattaaaagtgacggaaagcgtagcctggtgagagatgcggggcagggaggaaaagatccgtcccaggcagaaggcagagcgacagaggggacaggaggttgtgggtggaacgcccggactccccaacaccccggcggggctgaggtcctca

SEQ ID NO: 36782 - DNA, 928 bp, Bovine  19866882118427
agggagggccgtgtacgggaccagcacggggtgtccctgcagggtacccccaccctcaccttctctgccctgccccgggcggcccctgcagacacggccaacaaggcgctgctggccctgttcacggcggagatgctgctcaagatgtacagcctgggcctgcaggcctacttcgtgtcgctcttcaaccgcttcgactgcttcatcgtgtgcgggggcatcctggagaccatcctggtggagaccaagatcatgtcgccgttgggcatctccgtgctgcgttgcgtgcgcctccttcggatatttaagatcacaaggtgcgtgccgccctcccctcccctccttggaagcttttcttccaaggagcaagcatcttttaatttcgaggctgcagtcgccctccgcagtgattttggagcccaagagaatgaagtctgtccccgtttgtacttttcccccatctatttgccatgaagtgatgggaccagatgccatgatcttagtttttccatgtgtaaagattccaatttctctactttctaaactctcttgtccatctccagagacaggacttaaaggatttttgactgactctgcttgctcctcctggggtttgcccaaagctatttttaatgtggcatttcaggtgccttttaaataattctcaaaaccccacctgcctggggctttgtctctgtttgtttgtttttttaattcctatagaaaagaattcttgctcccaggtattgtcatagtatcttaatattcattctatttttatcaacaatttacctatttctaatctgaaactactgccaagaaaccattttaagtctgtctttatcctcgagcttcccaaagccactccacaagaattttcagatccccagaaagtctgtgaacagaacaatttcatcatctaattaga

SEQ ID NO: 36783 - DNA, 1536 bp, Bovine  19866880295595
actgatctccttaggatggactggttggatctccttgcagtccaacggattctcaagagtcttctccaccaccacagttcaaaagcatcaattcttctgtgctcagctttctttatagtccaactctcacatccatacatgacttctggaaaaaccatagccttgactagacagacctctgttggcaaagtaatgtctctgctttttaatatgctatgtaggttggtcgtaactttccttccaaggagcaagcgtcttttaatttcatggatgcagtcaccacttgcagtgattttggagcccagaaaaataaagtctggcatttggacgtatttatttcccatagaaatcagctcagaccacctagcagtgggccatagatttcccagaaaagcttcctcctgtgttctcacatggcttaggggatttctcctcattcctcacacatgtatttcctctcttttgcacattttcctgaagtgtgtggatcacatctagccatctgcctctctggactgtacatcctgttccttcagtacacagagtagtctgttaccttcagctctgtgtccagttacactgttagttctagccctgcctctcaaagtcttaccttgtgccagagctttgggctcctacatgcctgggacagtaattgtatcttactctaaacatggggttcaaattgctctatacttttccatagtaaaacattgatttttgtctgtgaccagaggaaagaattcaagaaagaaaaggctatgcaaaagaggagggatagtttgaattcctgtacaaagtgttattgtagtaccaaaataaactaatctgttctgataaatggtatattaataggcatctccaataaggaggtaggtagaataaaatgtcattgctatgggtgattttagtctcaggagaattgaaaataacccaagtgagtgtacagaccagacctttgactgctaaatttatttagtcagaaagctcttggctgtggatgccaggagcaggattttgatatactcaagtccagattacaaaatggagctcagtgggagaaaagggaagcatctgtgggtgaacaatataattttttaaaatattataagtaaacaggacaaacatagaatctgtctgaaaaagacacactttccatttctctttgccaaaatcatgtactgacctccaacggagccagtgcaggtcagtaaaataatatggccattgagtccttgggatcttaactgcaacaacaaattgaatggaaaagctttccagtgacaggcatttatgtttagatttttctgtcctgttttttgttgtacttggtcagagatcaggttgctggaatttttagtagtatttctgacgttgaaaggcacttgaaatttctgtgagccatcaattttctgattaggaagattaagatttgtcaaactacattcctttccaaagccataggctgctagatatgatacttagtctaaaactaaaacaccaacacaaacacacacacatagttcaaaaggaaag

SEQ ID NO: 36784 - DNA, 1678 bp, Bovine  19866880364399
tgttaattgaattgtattggaaaaaaagcacacatactttgtctcgactgatatttgactagagttctgtggtaaagtaataaccagtagctgcattcatttttccagttcttggactgacatattcacagtactatatggtttttctactattgcatgttgtttagctcttgcatattacaaacagggccaaagaatagattattacaataaaaaaacaagaaaaagtaaagtttatcattttctatgaggcttcacacaaaatgccatgacatacttagtatccacttggttggaaaaatcatgcaagttgacccatgtttttcatcatataaaatgagttggttatgatggatatgttctgtgttttgtgctaagaattctaataaattaagaaatatttattgagcacctattataacagtctaacggtgctgagttggggaaagtgtgcctgtatatgtatgggggtatgtgtgtgtgcagagagtagtggtaaaagtgttaggctaagtcacactgagagttcaccttaatagaaaaaatataaaaatgatttctgacagctaagccctggaaaaactattcaaaatatactatacttagcatattttactaggagatagcatgtatgataagttttagcatttttcacagtatagtcctgttgaagactatatttttgcaatttaagcaacaatagtgaggttatttcatcttactgaatactacattaagttaataaagcaaacttttcccttccaatattaagtttaaatgctgtttgaaaaaatgttaataaaaacttttaaagaaatagttatttttctttgtgtcaagtgactatttaagttactattatcttcttatggctccttaagttttaagataggattttaaaataaatttagtgcttgatgtaagtgagaatctaagttttctactttaacttcagagcaaaaagaatatgaacctaatgcaaagaatgatgttatggattttctgtaattagtttagtagctttcagattctgtggttaataatcaaggcttgagcctcaagtaagattgtatgcttgcttgttatttgaattgtaccttggctagatgtttattagtattttgttgagttccttccaacatgttaatgaagaagtcatcacacttttctaaatcaaaagtagacaaagtgaaagttattttttaaaagttgagaggcttgcttttctcttgagttgttcctcaggggtattatgctaaattaatagtgatatagataaaccatgagtacagaaatcgaatgccatccgtaaatgcagaaatctttccagaagatctgtataatatgctattacatatacaaagaaagcaaaagcatatggttgtaatgaagccactaccctaaggtctgcgtatcagtttgcatgtagatggtctctggatataactgcagtattgcacacatgtcaaattatgactgaatgcttattgatggtgaagaaaaccttgatttatacacaattatattaatacataatagctacataaatatataatatacaattatcttcctttttatttataacttcacataataaaaatgtatttttttgagtatcaggtaccataaggcctatgctagcatctctgcaagaagcagactaatcatacttagaaag

SEQ ID NO: 36785 - DNA, 2720 bp, Bovine  19866880402249
gcaccccactccgtactctttcctggaaaatcccatggatggaggagcctggaaggctgtagtccatggggtcacgaagagtcggacacgactgagcgacttcactttcactttccactttcatgcattggagaaggaaatggcaacccactccagttttcttgcctggaaaatcccagggatgggggagcctggtgggctgccgtctatggggtcacacagagttggacatgactgaagcgacttagcagcagcagtagcagcatgctagataaggcatgaatggaaattccagtataatatcaaatagtaatcctgtaatcctgggctgctagagagttatcagaaataatttttttatacatttatctaagatgtgaagatatctaaataagactatcacaggtcaaacattttagagtagtttgccctcatttcatttttgacatacatttgttcaagtagcttgttaaatgaggtctcaaaatactataatgagtcttgcttccaaaacatccaaaccacttgactgctctttatcctagggttggatggcagggtgagcataaatgtttattccatgagtgctcttaaaaaatgaaaactttgtgtttaagaaacttacaacatgaaaacaaaaatcgttggtacatttcccttaggaattcttaaaatgcactatacagaaaagaagggccaggagtatacgttcaacatgttagcactgttgacctctgaaaagtgcttcagctggtgtttgatgcaactttttttagtcccagtggggtcaataaaacagaaagtgaggggtccctaaacataagctgggggccagtgagctgtgaaaactgaccctgcctccaatcagcactctactgatccttgggagctatttatactccaaattttctcttgaaatctgatgacacaattccccaagggcttatattttgaactagagagtttgtaggaaaagggaataaagaaagaggcagccacggaaggagaggtcatgggattctgactcttagaattatatcagtgaaaacatttctgtccacagtagactcttggaaaatagttacactcatgtacccaaacagttatttccaggcattcagtgcccacgcatatacctattaagtatcaaaattcaagtgccaaatgcaattaggggaaactgatttaaattatttcttataaaaaggacacacttcaacaaaaaactaactcattcacctcttcccttctaaatatttgctgggcccacagtaggagcacatatctctgaatattttaccactaaatatttaaagctatatatcaagagaacaaacagttacatttgttctattcttttgccttttaataagtttcataaaagtctgacaagttgggttggaaacaagaattctcaactccttgtgtgacagggctgcatccgcctgcccgcagctcaggcccttgctgtatgaacaggtagatactgtggtcccagtacaatctccgtcaatccacccaagcttgaaagcagctgcttcttggccattctttaagggtggagaggtgtacacaccagcagtatcctgggccccctcaggagaaaagacctaaggaggaagcccattaagacttcggagacaggctaatagacatttgggtagagaactctggggtctcagggtcaaaatatggtagaggggcacactgcactgggcagggaattccaagatgtgagtatccagcaggggaaaagtcatgagctcagtttcttcttggccttggagacctactaacccatgggaaggagcagaccaaaagatggccatcactgaacatcgtaatgtgggggacagtgtccagggaagcagttccactggcactgagctaagggtggtactggcctcatatttggtgaacaccctccaagtgactccttctgggataactgggagaattagaagttgatctttctacagtatggttattctttggaggtaagtggttccctcataagcaagtctattagaattatttgtttagttaacacatgcatatgctctgaggtgcctgcagcctctccacacacccgttctccaccaaaaaaccccaagactaattgtcaagcttcacacagacttcagaaccatctgaggatggatttaatgacaatgtcagctaactttattgcttacttactatgaaccaggcaaggagccacgctttacttcatttaattctcaaaacaccaccataaggaagatattactatcagcactttactgatgaataaattgaggtatagacaccttaagtgatttgctcaaatcatacaactagaggcatccatgccattttttgagctcaagtctctctgatttcaggatctgagtttttaactgatgagctattctttacctcaaatgtgtgttttgtttactaagtgtccagactccctttaaattcagacaaaaatatcagcaatcattattctctatcccatctctatgttgaaattccagtttaaaaataattgatcttaaaaaaatcttaaaggactttggttcaccagaattatgattagaggaagcttaaatttgttttccatgactggtgtgttgaataattttcttagagagaaatatatctggatggtataatttcagggtactttgaagcgtgataaataaattgaatatcaggaggaaagacgtaataca

SEQ ID NO: 36786 - DNA, 1112 bp, Bovine  19866880430187
cacatccatacatgactactggaaaaaaccatagctttgactatttagacctttgttggcaaagtaatgtctctgctttttaatattactgtctgggttggtcatagcttttcttccaaggaacaagcatcctttaatttcacggctgcagtcaccatctgcagtgaatttggagcccccgcaaaataaagtctctcattctttccattgtttccccatctatttgccatgaattgatgggactggatgccatgatcttagttttctgaatgttgagtttttaagccaactttttcacaacaaagaattatccagcccaaaatactggtagtgttaaggctgagaaaccctttccaggactcttcaggatggtgccgtaggtctagggatttatttgtctctatgcatcactattaactggggattttgccttctgcttttaattagaagtttagctgacattggctgccagaatactgctacaattccctcaagtaaatcttttgtgtaaggtgctacttggagttcataacaagtcagagaactgagacatcactatttttgtgcctgcttgctaatatatgtttggatggaaagaacaaatagtcaatatcatggtcaaggtgtctacttgagagaggctggctgattattaggtgttattatcttgctaagtgtgtaatcataaatcttgtgcggttactctgagagtggatgtgctaatcactgatgtgatgaactcccagcaaccagactcatgaggctgatgaacagaatacacgttaatataccaatatttatgagtgttggtatattatatcagggtattcttgaccttcaggcacatctatttggaatcagaatcagggcactgagattcagacacaaatttctttagtgtgatgtatctatctctctgaaaggaagaacatttttcatgagaatgtactgctctaagtgtaattggctaagacgtttcccctcttgaataaagtttgtgtgggcactccttgtttttactccttgaattttcaattttgataatttcatgagagaacactcctacttttccatgtcctctaccaatttatgatggacccattctttcttta

SEQ ID NO: 36787 - DNA, 1555 bp, Bovine  19866880487481
tccaacaccaactcccggagcttactcaaattcatgtccataaagttggtgatgccatccaaccatctcatcctctgttgtctccttctcctcctgccttcaatctttcccagcatcagggtcttttcaaatgagtcagttcttcgcatcaagaggccaaagtattggattttcagcttcagcatcagtccttccaatgaatatttaggactgatttcctttaggatggactggttggatctccttgcagtccaagggactctcaagagtcttctcttgagtcttgagtcaagactcaagtaagtcttgggcatgacttgagtaagtcatggcttgagtcttaagcatgacttgagtaagtcatgcccaactcaaatcttcttttgagtcttctgtgtacactacagttggagtatacaccacagcacaacaccatagtaccatatatgtatttaaatttaaaaagcattattcttatttttgatttgataacttgtttaaatgtacttatgaatattcatactgtgaatcttgatatgaaaaatctgaggtaagtagattatatgttttaattttcatattatcactgcatagaatgagacaaaagaggagtaataccttaactagtaaaaaagttattggattctagatggaggggttgacttaggtcatatctaaatggcctactggtttccctactttcttcaacagaagtctgaaattttcaataaagagttcatgatccgggccatagtcagctcccagtcttgtttctgctgactgtatagaacttctccatctttggctgcaaagaacataaccaatctgattttggtattgacttggtgatgtccatgtatagagtcatctcatgagttattggaagagggtgtttgctaagaccactgcattctcttggcaaaactctgttcacctttgcactgcttcattttgtactgcaaggccacacttgcccattactccaggtatctcttgacttcctacttagcattcctatcccctgtgatgaaaaggacatcttttattgatattagtcctagaaggtcttgtaggtctgcaaatcccttatgattatacagtgaaagtgttaaatagattcaagagattagatctgatagacagagtcctgaagaactatggatggagggatgtaaaatagtacagaaggcaatgatcaaaaccatccccaagaaaaataaatgccaaaaggcaaaatggttgtctgaaaaagtattacaaattgctgagaaaagaatagaagtgaaaggcaatggagaaaaggaaagatatacccatctgagtgcagtgttccaaagaataccaaggagagataagaatggcttcctcaatgataggtacaaagaaatagaggaaaacaatagaatgggaaagactagagatttcttcaagaaaattagagataccaatggaacatttcaagcaaagataggcacaataaaggacagaaacctaacagaagcagaagctattaagaagaggcggcaagaatacacagaactatacaaaaaaagtt

SEQ ID NO: 36788 - DNA, 1348 bp, Bovine  19866880503706
ttagcttcccctggggagacaaacaacacaaaacaaaaagctattatttttcaggaggaggaagagaagagtaggacagaggctgggagggcaactgcatagataataagctacgattgctcatttttttaggagtcccctgttaactattttagtcaattaagatttgtagtgattaaaaaaaaaggtgggtagatgctccagtagagcacttctgggctaagaacacagcaggcttggcataagctgctgaggcgtgcagaatccttccattggtggctgaggtaagactgtccttagccacatatttcttggaactatccaagaatgggattcactgctatctaatctatatgggaccaaaaagaaataatctgtggtagattagagaaaactagagaaaacgggggcgggagaggggtgacaaggctttatgtagaagttttaatttcacgtatttaactgtgtccaccaagtacaaggcaccatactaggtaacaaacaaaacacacactggctatgaactctgagaataagtctattaataaaagagtagaaaagctaaaaaataattttgtcagaagatgtttttggcataaaaataacaaatcctattattaaacattactaaatactcatatgaagtatatacacacatggaaggatttatagctatataggctataacttaaaatacctctacgaactccaagatctgttcagcagagtgatgtccttcatattcatgaatgttggactggttgaataccactgttgttggataagcctgaatgttatactgttaggaatgaaaatacaaattaaacataagattctacatattttacctatttgcttcaaatttataaccagcttgccttaagtaacagcaacaagattttaaaagactcaatgcctaactgatgactgaaaaattttagcctagccaaattgaacaaaggaaatagatttactgctgtatcctcagcagctgattcttatgtatagttactccatttgccataaaatccataggcaccgaaacactgagaagtgagcacgggcatttatttattttttttttttgataaaaacagtcccacagcatttactgtcatctggtaataacataagggtgagcagaacaatatgaatacatgttttagaactacatctctaacaaaggacacctaaaaaaaccaacggtattgccaaacaatttctcacttcatctgtcacttctagttggagacactttggagcagagtaatgttacctccttttagcatgatccgacccagttgttttcttgactttgttttaaaatgaatctcttctgcgtcatcta

SEQ ID NO: 36789 - DNA, 1148 bp, Bovine  19866880571075
ttaggcctatatttgttcatacttaattaatttaactgataatagagtattaatgcaatgacacataggagaaactctagaagtatttagttagttatgaatatttataggcaaatctgctctgacttaattacctccaaatgttagaaaaggaaatattaattaagttttaaaatcccaaactaactactgtaaatgaagctttatgtgaatagagcaggaaatgactgccttaaggctgtgcctggacattaaaactccttttccaactaataaatctatcaattctaagtccaaagcttcaaaattaaaatcaatttgagggtcatacattgggtatttataaatatttactgaaaatattttaaaacctagtgtaatttatataattataaaatacattgcttttattatataatttttaaattaggtattgtcttttcaaattagtttgtcattttataatatctcaacatataatttcaggaaaacagattaagttaaaaactcaaccttaaatacttcagtatatgttaacatatattctgtgattatttttaactatgatcaatttaacaaaaaatagatacatctttagcctttatttgacagatgtatctatgtatgtgctttaagacaaaattactttataaccctagagaaaatgccaaatttttttaactgctaccaagtaattttatcaagcaaatttggaataaaaaaaatcactaggaatatatgaaaatatttaatatgtataaattaaaattttttgtaaggtcaatgtaagtgctgcatattctatataatatgttagtcattcattctctcaagcagaatcacgttaccatctgcttccagatatttattcttctatacatttttaatgagtaccatgctagtacttcactttcactttgcactttcatgcattggaggaggaaatggcaacccactccagtgttcctgcctggagaatcccagggatggcggaccctggtgggctgccgtctatggggtcgcacagagtcggacacgactgaagcgacttagcagcagcagcatcatgctagttagttgctatatgaaactaatttatgatccaaataataagcctgacataatttggaatcaggaaagaaaaacta

SEQ ID NO: 36790 - DNA, 1089 bp, Bovine  19866880778649
atggactagttttagctatgcctcttccactgtttaattgtatagatgtggacagtttagttaaaactctgagcctcggtgtcctaactttgtaattgagaataattcattaaggttttagtgagaattaaataggttttatgatcttcagatagattttaaatagttttttgaataaacaggactgccaatgctaatttaggactaggagatttattatgaacaagactacttgtagactattcatatattggattaatcatttttaaattacaaaatatttgattaaattcttggtatatgtagggaaatagtgccaattttgaagctcatgtgtgtgtgtaaatacacacacatacacgactaacacaaaacttcagtgttagcgtgtgatatgatatgggtaaaaggggatgtccgtagttggatcccagggtatgctgtgtgcaatggaactgagagttggacttcaatggaagcgatgcttttgtgctgagtttcttgtatggttgagttaaggttgctgcaaatcatgtatcactgtaacagagacacctatgaacctaattagttcaaaggggtgagcttcatccacatagaacgtttttcttagggaaaatgattgataattcaagtcaagcttggagattagaggaaaggtcacaacatgaaaagtatatgcgtattaagtaaacaattaacaatactgtattgtatacttaaaacttgataaaaagatggatcttaaagtgaatctcacccccccatacacaaataactatatacatgtgatggataagttatttagcttaattttgatcttttcacagtgcatattgatatcgaaacaagttgcatactttacatatatacactatttatatgtttaatatatctcagtaatggtgttctttttttaaaaaaaaagaaaaaggatgcagtgacttcccttgacaatgaccattgcctctgagatgagagaatttagctgagcattgataacggaggagacttactatacataacaggaagtgattaaaggagaaagctcaaaagcaagaagataacaaggacaggtgaggtgaagag

SEQ ID NO: 36791 - DNA, 961 bp, Bovine  19866880785400
aaaatgacatatcaaattgtcctaagatctatgcagaacattaacaaagaaggatgtactagaaagtgactgggtgactattttagatgggattgtcagtgaagacttctttgaagaggtgtcatttaagctgaagtcttagtgggaggaagggtgccagccatgtgaagattatagaagagtgttctaggaagaaagaaggattagtatgaacactccaagaaggaatttgtttgtaaagtcaaggaaacaaactaaaatcagtgtgaatatcccctagtgcatgatgaagagatagacatgagacaggttcagaaaggtgaagcaaggaaagattacaaaggactgtgtaagtcaaggtaaggagtctgggttttagtcaatgcactcctggaagacattggaaaatttaaacatgggagtcagatgatcaaatttttgtttaaccaacaaaaattctggctcctgccaggaattgaatggtgggagaaccagttctggaaggacagaggccagcaaggaaagtagggcgatgtatggctggccgtccatcacacccatcacccctctttccttggcacacaactggatagcccttctcagtctcctttaaagtgagatgtgactgatttctgtttggtgtaagacaagtggaagttatgagcaccacttctatctctcaaccctaatgctttctatatgcgacaatctatgcttttttcccactccgttggcttgatacataagagtccagagatcatggaagccagtattgaaaatagtggcacactatgaaggaagggacttaggttctaaatcatttactaactagaaactcatagcttgaattctttatgagaaataaactgtgattgaaataagctactaggctatagttttatcttttataatagtgagaagtttaaaactgggactaatgcaataaaaataagtaaattaa

SEQ ID NO: 36792 - DNA, 949 bp, Bovine  19866880807430
tatggtgcacaaggtaatactgctactcctaaatcacttcagtcgtgtccgactctgtgcgaccccatagacagcagcccaccaggctcctccatccatgggattttccaggcaagagtactggagtggggtgccattgccttctccaacaaggtaatacagtggttttcaaatttgtttttttaggacgagttttttgttacactcattcttacccagaatttcaaatatgtgaaagagtttcagcagaataactttcattaaagaatgtagtgtgtgagggggaaagtgaagtcctgcctgcttgacccttccacagccccaccagtggctcctgtggctccttggaattctggaggcaccgtgtagaaacagcagaaatcttgtcttggctctgctctcttttctttgttcaggcttgtgcaagtctcctcaaccttaaaagcaatgatcttgatcttcagagaccattcctacgaactgcaaagtctcacaatgccagcagtactcaaaacaaatgaaagattcaagcctagtctattttgtattctattagtgttttcagtcaacatttttagatactttattataaaaaaattggttgatatttgataaaagttagtatcaaggattgattaaagatttgaacaattcagggggtatttagattctggtttgtacgtacctttcattatcagtaaatttcaaaaattctactttgaggtagcatttcaaaaaagaaaccaaagtgtgtattcaacattcacaacgtctaacggtctgtattccttcaaggaagcaagcagtgtaacacagtgttcctacatagaaacaatctggtatgaacatcagtcagatacttgctttggcgggtgttttcacttaacagaatgtgtgaagaaatacacaaacctggtgtcaggcaaaggccactgaagagcactatcgt

SEQ ID NO: 36793 - DNA, 1829 bp, Bovine  19866880829430
ccctgtggtggtttaaacacacatatctacaaattcttgggcactccttcactgagagatggagaatatgtctctttctttgaatctggtttgaatttagggatttcctaggaaccaagagaatgcagaggagatgccactccatggctaccaagcctgggtcataaaaggcaatgtgtgcagacactcactattaaagcgctgagctaccagataagactaattaccctggggcctccatgctgtctggaagcctaggccacatggacagggtcaagtggcttctttagttgacaaccccagcttaagtcccagtgaggtcacagctcagagccaacatcaatcactaggcctgtgagtgaagtcatctccagatggttccagaccctagccactgagtaattcccagctgaaacccagatattgtggaacagagataagctattcctgttgtgtcccatctgaattcttgacctacatcatctgagagcataataaagaggttgttttaagtcactgaattttggggtaatttgttatgcagtaatactgattgtgatacacatgttaagcacaaagtgaatggtcaacataacctgtgattcagtttaatggagggagaagtcaccaaaagcttgcgtgaggatgaggctgccctgcttggcttcccacacttgaaaggaagagcaagacatggacaacaagaaagggaaagtatgaaagcaggtttaatgcaaagatctttgttctttttcctttaaaattcttctcctagagtaattggaatttaaaataaatcagcttctaaagcagtgggaaaaaagattaaagattgaatggagaaggaattggttaaactcccatcttcatttgtggactgtgcttctgagtgtttaaagatgaagctattatgactgcgtataggacttaataatctttaggcagactgataactgagaaagagattactgtaactttggtttggtgacccactaggctgactcagtcacttaaatttaacatttctttaaaattctgaaacaagggttcagaagtgttcttaagcgttcttttaaaagaacagaagagtttcatgggagagcaaagcagtccgctggaaagagacttttcttcatgatttaatgcctctgaggaagtttccaaactgcaggatgatgaatgataaaggcaaaaaagattattttgcctttatttgtggaaagatttttttggagagatatcatgtgcagatagtgtggcaaaagatactgaaggttgagtccttttctttgaaaactttataacatcaggagatgtttataatgtgaagaacgttggtacatgtctcaaagctaaaacctagagatcgctatgtacaaagatagtagtatactttgtgttttaggagtggactttgagcaaaatgttgaggtaggtgttgctgaaacagcttccttcctcttactgtattctcactctccatactcctgttccctcacacctctctggaccttcccagaacccctcagttctcacgctgtctgggcctatcaatccctccttttctctattacactttaccagcactcatttctccgagtttcctccaagctatgctttgaggctattggtggctccttcacgtgtgcccatccaaatagatgtgtctttccttggtgagatgtggtgatgacatggcctgggctttccaggataggtagtatacaagtaatcccattatctccttatactgaaattcctcagaaatcccaacattttgatattaaactgtatatctcagaacttgactcagatgaagaggaacccca

SEQ ID NO: 36794 - DNA, 1479 bp, Bovine  19866880903918
aaaataatacaacaaatgactccataaaatacctggtaataaacacatcaagtaatatacaaaactatatctagaaaattttagaatactcctgaagtgcacaaaagaagaattgaaatcatggtaagatataccaagattttgacaggatgattcaaaatcataaagttatcaattcttcataacttttaaattttaaagtgatccaataagagttctaattgtttttaagctagataaattgattataaaatttatatagaaaaaacttaccaacaaaaacattgaaaagaactctgagaaaaagagcaatagtggtaggggccagatttcctggtattaaaacatttcatgtctcaatcattcaacacagaactagtatatgaataaacaaatggccagaaagaaatgacatggaaatctagtatattacaaaggtgctatctcaaaactagacggtaaaaatggattattaaacaaatggtcctgggatgatgggtggctctctggaaagactaaaactggatccacattggacccaattattgactgtgatgaatttcagctgcatcaataatttacatataaaaaagaagccattaaaatactaggtgaaattttatttttcagtaggaagacttttctaactatgaatcaaaaaacaaaatctgtaaaaaaaaatactagtgagtttggaactacagaaaagaaaacatttcttcatgacaaaaatgccacgtggtaagtaaaaagacaaattgcaaacctgcaaaaattttgcaatccgtatcacaggcaaagaatgactcttaccattatacggagaactcctagagctcaaccaaaacccgacagcctcaaatatgagagcaaaaaatacagatagctcacaaataccaaaatacgaataatttaaacatgtaaaaaggtagtcaactccgctgaaaattagaggttttgacaacaaagggtatccaattgatttattgttctagattttaaaattcaaattatgctattgagatcctataagttgcatgatattacttacaataattgcaactgcagtttattttcacacagactgacattttatactctcttttattttgcacctgttttcaatatttctggaacaggttccaatcactgggatgaatgtagcaattacgggcctactaaagatgaatcatccataaatgctgtgtgaattttgatcgctctaatatctgccactgctattataattcattctcatttcatcaagtattctttcagacttatttttcttttagacctgacattagaaagttgtttttctctttgaggatcacaaaatgctaccaatgtgagatgagaattttgcattcaaggcaagggtaacattgtttcctgaataatagtgacacctgcaatccttactatcacagaaaatggtaatttgatcagctttgtgtgacaaaataatgaaaagatagg

SEQ ID NO: 36795 - DNA, 1763 bp, Bovine  19866881052137
taaagaaatgtgaacaaacggtaatctattacctgacgtcacaactgggcaatgacttgtatgacaaatttaatttcaatagattcagtaattgcttccctgacttcagagcttttaattgattcaaaaccctctagacaataaacagaccccttaaccaaaaaaaaaaaagagagagaggtttttgtgaagtttctttctaattcacaggaaacaaattgcatgctgtctgatcaggttcattacatttttcaaacacactgctgggaaatgttttgtcaagatgctcagagcatttgataatagaagtaagaaaatagaatcaagatttcgagaacaacaataaaataaattatttataatccatgtagatgccacttaccataactagtaaattcttgtatatgtaaattaacttcttttttcatgcaaattatccagttcttttaaaaacatgtcttatagtgcagtgggggaaaaaatgactgtcttaaaaatcataaaatcctttcttcaccatttaaaaacatgcatgtattgagaatgaatatactttgcactgaggaaatgtttgccaaaatatgtttagaacaaaggaaatgtttgaaatgtcattattagttatcaggaattttttaaaggtaattacctttgagtgtagcattgttttgacttaaaaataaggcagtctataattagctagaaagcttaaagacagaagaattggtaagttaaagatgaaaaaaaattaaaactaactcattattaatagaaggaaatcaaagactaaaatgagagagttgatatacattagatctaaaatccttgccagcaatgaaattgttgacttagaagaagtcagatatgactacattaaaattatttgaaatagtatccacaaacatggagcaagaggaaccttaagaaataagtatctacttaaatcatcttaaaggttcctaccaaagaccataaccaaaagaaagtatggtgatgaggctgagttctaaagacaatttggttgttggggtagtgagagagcaacagagtttcaagccaccagaatatttaagtcttcgtggtttacctataaatggttaaattgatttatagattattctatactgttaactgaatcattctcaggacatgcagaaatggtttaaaaatattcctgtaaataaattaaagattaattatataataatactgcaagtaacagcaaacagtaagaaatggaggaagttaacacttctcctgttaggaagtgctcttcaatagccacagtaggaatttaaaataatgacagcctaatcatccctttaaagatctaaaactgtgaagactatttaaaagatggatttacattaacttttacttatgacaaatgcattttcctaattttatttcttaaaatattacttaatgatactaggaaatcatgataattagctgacatttaaaaatactgtttatgtcatttttaactcagcctttttcatttcagcctttatttccatttctctgtccattttgtaatacatttaatttactgtgtacttaatatagtaggctttgaacttaaaatcctcagactattagtatatggatatcattaatgaatatataaaaccagtggtgccataaatatgtgtttccacaaagctttgttagaattaatattctctcaaagccaatagggcttcccctgtagctcaactggtaaagaatctgcctccaatgcaggagactccagttcattt

SEQ ID NO: 36796 - DNA, 2405 bp, Bovine  19866881073871
atagctaactgccatgacaaacaactcaataattctcaaggcttaacctaatagaactctacttctgtgtcgggtaaaaagatcagtgagtatgtttgctgagctgccgtcaggaggtgattcaggaacccaggttactcctgtcttgtggctccactccatatagagagcatcagtcatagattgcatcctctgtattcatagagcagatggaggaagagcgagaacgtggagctcaggcctcaaaatggtgctgctgctgctgctactgctaagtcgcttcagtcgtgcctgactctgtgcgaccccatagacggcagcccaccaggctcccccatccctgggattctccaggcaagaacactggagtgggttgccatttccttctccaatgcatgaaagtgaaaagtgaaagggaagtcgctcagtcgtgtccaactctttgcgaccccatggaccatagcctaccaggctcctccgcccatgggattttccaggcaagagtactggagtggggtgccatcgccttctcatatcactttattcacatttccttagccaaaacaaatcacaagggttactggaaatagtctacctgtgtgcccaggaagaaagatttgaaaaataactagccaatacttcctgcaatcagtttaaaaaaaaaaaaaaaaaatctcttgtcttgaggtatttacattctatatgggggaaaacaaaaacagaataaaacaattaaattgtatagccttttataaggtaaaaaataacacagttgcagctgaggatggaggggagagaaggaaagaaaacacaaagtatggtaagagggataagggtctttagacaatggctgttggtgactgaagttgtatggatgatagaacattggagaagagaagatcaaagaagtaggatgccaattatattgatcttcctctttactgataatgtcacagtgttaaggaaagtggattttgagccagaaaccaaaatcacagagaatacaggattgggggtatcctgtgaattagttaataacagcagtaagaagaagcagcaggcaatttggtgtggagttcagaggtttagagaggatggggaaagaatgatgtgaaaacagcagctagggacaaagagaatgtccgtccccttcttcaggtgaacctgtacaagaactgtagaatacaaagctgctgctgctgctaagtcgcttcagtcgtgtccgactctgtgcaaccccacagacgacagcccaccaggctcctccatccctgggattctccaggcaagaacaccggagtgggttgccatttccttctccagtgcattaaagtgaaaagtgaaagggaagtcgctcagtcatgtccgagaatacaaagcagccataacctaagaagcctatagggaagcactgctcttgtggaaaggccaatttccactggagcaagaaggtaaagggacaattcaaggagtcaataacatcaggattttgctgaagacggattgaccaggaaatctgggactctctgtagtgattgacatgaatgaagtaaatagtacattgaaattagtctcaggcagggagaccagtggagaaggaacttcaatatttagatgagatacaagggcctgaaacaaggcatctttcaaaggcattgcaccatttttctttgactaaatttaactcacaatttgaagggaacatttgttttggaaccaaattttctaaactatttcatattcctttttagtgtttcaaattaaaactgattttaaatccatctttgatgaaactctagtcacgattcttcttctgaagtttaaaggtacataaaaatacatttcttagtgatataaacatagaatcacagattctcagggtttgaaagttttaattcacttggttcaaccatccagctgatattggaagcctttctagcatatccttgccaagcaatcttctggtctaggcttgtatctccaagaatgatatatctagataggtggttaagagcgtgggctctggaattaagcagacctacatttaaattcctattccatcacttccactcatgtgaactttggcaaattatttaacttttttctcagagttccaaaatcttaatctataaaatggaaataatattaccgcttacctcatagtgttatactaaagaaataaggcatgtacagcattcagcacagtgcccaacacagagtaattcctcaataaatgattgatgatattatcattatttttgtttatcccattattattaacttccaaggcatcatctttcagtattggatagctgcctcagaaatttcttcttgctaccatcccatagaaaaatttggtttcaggagaaatttgccaaaataaatgttccacccacagccaattt

SEQ ID NO: 36797 - DNA, 2780 bp, Bovine  19866881075755
ctccttattgtaagagaaagtttattgtgatcgcatggactctattgtcctggaattctccaggtcagaatactggagtgggtagccttttccttctccaggggatcttcccaacccaagggctcaaacacaattctcccgcattgcgggtggattctttaccagctgagatacaagggaagcccaagaatactggagtgggtagcctatcctttcaccagcagatcttccagacccaagaatcaaatgggggtctcctgcatttcaggcagattctttaccaactgacctatcagagaagcccctattccagaaatagaaaaactaaaaatgaatcacttaaaatttactgaaattcaagatgtcacttttggctatagagagaaataaattgaaatgaaaaagagcttggcaaatagtggagcatcagtgattagccaaaaaaaaaaaatatatatatatatatgtatgtgtgtatatatatatatatatatgacggaacagtttatgaaaagcatgtcaatgtttgtgtataaaatatcgaaagtacttcagagagcaatcctggagaaagaaaataatacatgatgatggaattggaggtaatggtggtaatgggtatttgttttgcgttggtatttttccaagcacaagtaggaacacagcaataagtcagcttctgtttgttatcaacccattttgcacctggaggacaaaaagaaaataactattacttcagaacatagggggaatattccagagaacttagtaccatgtcatgtaaatctctgtagagggaaaaatctgctatgcatcacttaaaggcaagaaacttagataaattatccaactggtgatttgtgggacgaaatttttcctggaaagatttccttttaaattttaaaagataaaaatttatcaccagtttttagaccattttctaagaagtcaaaagagaaaacgattggctacaatgctaatgctgttaacacgcatgcatgctatacatacatggagtatgtgtgtatttctaacttaaacgattttgttctggtggctgtcagacaagcattcaaagataccccttttctcttctgatcccatcttgccttagcgctgctactttccatctgctcccttctcttctgtcctttgctgcttgtctgcagttcctagaagagccagagggggaaacaaaggtcttagggttggaaggagcctcacacgctcatctggttacccctcccccacatcattctccacatttcactgattaggaaactgggtcccagagaaagtcaagaactttcgcaatgtcacacagttatgacaaagaaaaatgccaccctctgctacatcacctcctatttccttccagaatttatcactgtccgaaatgatctaattcactaattaatttgcatacgtattgacagtcttcaaatactagaatatacatccaagaatttaaggacctgaactattcgtgtgtcctcaacacttaatgtccagtacatcataggcattcattgaataataaactagaatattggtttcttgtttccaatgtataattttataaactataccaaattatcctatgaaaaatggtataggataactaaggatatcagacctgttttagctacaggtctgtcataagcattagcccaatttatgcattttaagcagcaaaaatttctgttgagtattaatgttttcaactctttgacatgtataagtagcttatgcttcttttacatgttccaaggaagaagaaactccatgaattgtgttcatttggtaaacagatgctgctggccactcaatggatactcatactcacttcataccctacaaagagaattttaacttaattggaaagtaacaaggtacctagagtcttttcctttctcttcccactgttctttctgcttgagacagaccagatacttgaaacagcctctctcttagggccacaaagttacaattttgagatgttcagttcagttatttttcagttggctcagtcacatccaacttctttgtagccccatggactgcagcacgccaggcttccctgtccatcaccaactcctggagcttgctcaaactcattccaaagagtcagtgctgccatccaaccatctcatcttctgtcatccccttctcctgccttcattctatcccagcatcagggtgttttcaaagaagtcagttcttcacatcaggtggccaaagtattggagtttcagcttcaggatcagtccttccaatgaatattcaggactgatttcctttacgattgactgattgaatctccttgcagtccaagggactctcaaaagtcttatgcaacaccacagttcaaaagcatcaattctttgagatcttaaggacaatgaaaagtacctagatgcccattggtgtctggagccacaattccagttctgaacattttcctgcatgatataaataaacctctatccattgtttgctggttttctattatttgctgtcaaatgcttgttctaaaaataatgaagaaccatttgctgaacatactctagaattctgttatttttaggattctagcactccagtatcttgcctggaaaatcccatggacggaggagcctggtaggctgcagtccatggggtcgctaagagtcggacacgactgagcaacttcactttcacttttcactttcatgcactggaaaaggaaatggcaacccactccagtgttcttgcctggagaatcccagggactgggggag

SEQ ID NO: 36798 - DNA, 786 bp, Bovine  19866881127751
tgtatattttttataaggtatttcataaatgcagtcatacttttttaatactttgaaaaataaatattggcaaaggactgtcatccaaacatttataaaatccagtggaacatagaggaagtcatattatcttttgagcctctttttggtagtttcgggtgctttcgatgaacttcctgcttttgtgccctttccttgatccctgctctctagagatgatatgtggcttcttctggaggctttagcacacgctgtcagctctggctaccttccctccatcggctcataatccttaggcctcattctgtaaaaaaagaaatctaccaaagtgaatggaacctaaaggtcaaagctgaagtgtgccaaaaatagctctgagttagtaaattggtgcacccacaaggaaacaatagtcaaacaacagacagagctcgcctgcgttcttcctggaggcaaagttcaattgctctctaaagtctctgcgtattttgtgttaagcctttcacactgttttgccagttcagacccttaggaagttctggatcaccagagctgcccagccttaatgcagttattattactggccagtgccgtcaatgttatctatctggggcttatactggagagtggcagggcagtactttcagctcctggtcatttccccctcgcacagctgattttctcagccagcagttctaagcccatcagatctgcaccctcaagacagacagcatttgctccgacttttccacttgacactggctaggtcacctaaaatgagctttt

SEQ ID NO: 36799 - DNA, 1073 bp, Bovine  19866881160402
aaatctccttataaaaattaaaaagaatcaatttatccttgtagaagaggcatattgcgtgatttttttttttttttttgcaaaaccagaaattacaaaagcaagaaaatcaaaacacgatgagaaataaccttgccctttcaagacataaaagcatgaagggtaaaatgagagagggggcgatggagtgaaatattcattctcaaaggcagttctgaatacatttacatatacatgggaaggatgactaagaaaataggataatgagtaattcatgttgagaatgctaagacactgaaataaatttgggcttagcagaatcttcttcgtttataaaaatgaacagaataaagagcccatatcacatagaatgaatcacatgtaactccagaggaaattaggatcactgatgtcctacaaaattttagaagcccggaattatcatgttgttacaaagatgttactttccccttggggtctctgtgacattgaagtatttggcagcagtctccatcctgtgggcttctctggtggctcagatggtaaagaatcagcctgcaatgcaggatatctgggtttgatcccggggttacgaggatcccctggagaagggaatggcaacccacttcagtgttcttgcctggagaatttcatggacagaggagccaggtgggctacagcccatggggttacaaatagacacgactaaccaaaaaacactttcactttatgtcctgtgggtgaagatcttttcattcacatggttgtcacaggggcatcaaggtgagagtgccagagagaatgtgaaaccagcatgctattactgtagcactgaattttcagggggaagagccttcctacctctcatcaatgctttcagtgaaaacttgtttcttgattatatagatttataaatatagtcaatcttttgaaatgtggagggtaccaaaaacggcaaacatcaggactcatttcttcatgtgaaacagcattagaatgtgttaggctaggggatagtttgatgtagtttagtaatttttaactggggtaggagagtgctttgtaggttgaaa

SEQ ID NO: 36800 - DNA, 998 bp, Bovine  19866881182846
taggatgatacttgcctattactcaaaggtatgctgaggcatgaatacagcagtagactgagactgtctttcacggtttataaagcgctgagtgagcatatgggggcttcgcaggtggagcagcagtaaagaatctgcctgccaatgcagaagatgtaagaaatatggattcaatccctggatcaggaagatcccctggagaaggaaatgacaacccactccagtagttcttgaccgaagaatcccaggtacagaggagtctggcaggctacagtccatggggttgcaaagagctggacatgactgagtgactgagtgcacacacacacacatatacacacacaaatgaacgtatcacaagtttttcattaattttaagtttctacagttgcaaaacaattgttatattcaatgactttccctggaaggctcaaattttttcaggaacttttgaacttcactaataattcccttcatactctccaaaggatagttactccctttgcttgtcttattcctctctgaagaaaaaataataacttatgaactataaaggaaatgaaaccacaagatttcttacaatacttctgttctttgcagtcctaatgtgttgaggctaagcatatagtattaccatctgtgctaataaaaataacaataatgtgcacaaataatgttgaaatgtagaatgatgaagcattatttcaaaaaatgaaattaagtcttattttgtttctttctgcagatgtcatttttgcctgtttgtatttttcttttatctttagtatgttcattgtgtcctgcctcaattacccagagaactctgcttctctccttaaggttgtctgccagctgatcacttctaaaccaattttctttgttacattggcattctctctctttctttttaaattaccttctcaataactttgaatccaattttaactattatattgagttacagaacaattttcacaccattcctgagctagtcacat

SEQ ID NO: 36801 - DNA, 1360 bp, Bovine  19866881184351
ttaaatattttcagtagaaatttcttatgaacccggattcttgtatctttccatacttagaaaagcataaccaagatgtctgttcctagtgactagcagcaactttctgtggagacatgtacctgattacacgcacccctcttgccaaaatcacatatatactgtcctccccctttacctcttcagaacagttctcagaactctctgagagactttcctagattataattctcagtttgactcaaataaaattttccatctctttcttatataggctattgattaattttttgttgacaatatccaggcttgctttttcacataacaatagcttcttgcagttaggtacatgttcatccagctaaaaactatatttctcagccatccttgaagctatgcatgtgtaaataaattccaaacaaaaagatgtatgcagaagtgttacacatcctccctttccctttttatgatgaaagctattttctgtctttgaaaaccctaaccctagcattttaccttttgataacaactctaatctgttcatttccttctctcttagcttggcatctaagatccaagacttgaccctctttaaaacatgtataatactacataggattatttaatacgtttatctgagagattaataaattctgcctgaagtcccaagaatgtggtgtggccagttggtaatgtcacatcacaaggtctggcttctgtacagataagatgcatgttaatatgcacagccgctattgccaaaagcatttgcccagacaacgtgaaagaggcacctgtaggaaaaactcctccattagggccatggtccatcggtggtgcagcttccaggatttggctgggtgactgatgtctgctgcatggagaatcagggacatggttttggctttgtcaagcctgtcaaaacaagggcatgctcacattatcagcacaaaataaccaaccacagtcttttccaagtccaagcccacagatctttaatatgaaaacaaaattataacctacccttcaggttgctgcaaactatttcttatatttttaatttgctggaagtgacccgacatgtctgtagacaacaccatttcaatcactaggttccgaagatccctgtggagtcatcaaaagcagaaaagtttggccttttttctttgttctcaagtgaaacatttaatattaagagtcttatggactctgtgggagagggagagggtgggaagatttgggagaatggcattgaaacatgtataatatcatgtatgaaacgagttgccagtccaggtttgatgcacgatactggatgcttggggctggtgcactgggacgacccagagggatggtatgg

SEQ ID NO: 36802 - DNA, 1545 bp, Bovine  19866881206526
cttttttcccgaggagcaagtgtcttaatttcatggctgcagtcaccatctgcagtgattttggagcccaagaaaaagtctgtcactgtttccattgtttcttcatttatttgccatgaagtgatgggactggatcactttttgaatgttgagtttttcaatgttgagttttaaggcagctttttcactctcctctttccccttcatcaagaggctctttagttcctctttgctttctgccatgagggtggtgtcatctgcatatctaaggttattgatatttctcccagcaaccttgattccagcttgtgcttcatccagccccgcattttgcatcatgtactttgcatatgagttaaataagcagggtgacaatatacagtcttgatgtacttctttcccaatttggaaccagtccattggtccatgtctggttctaactgttgcttcctgacctgcatacagggatctcagggggcaggtaaggtggtctggtgtttctatgtcttcaagaattttccacagtttgttatgatccatacggtcaaaggctttagcatactcaatgaagtagatgtttttctggaattttcttgctttttctatgatctccagtgaatgttggcaatttggtctctgattcctctgccttttctaaatccagcttgaacatctggaggttctcagttcatgaactgttgaagcctagcttagtgaattaatgcttttgagcattactttactaacatgtgaaatgagtgcaattgtgtggtagtttgaacattccttggcattgttgttcattgggatcggaatgaaaaaagaccttttccagtcttatgaacactgctgagtttcccgaatttgctggtatattgagtgcaacactttaacagcattatcttttaggattttaatggcctagggacctaaaattttgcatcagtcacttgtctgattcaatgcatcagaatatacatgtattcaggaagtttttttttatttttaaaagtatttttttggcctcctatggttagcatcctcaaatgaaagcacaacctccaagaaatatataaatcagttgacttatacagtgtctgttgcttttgaccctggattcactttaatgaaaagtaaatgttccctattcagggacagagtaagaaaattgttaagtttgtcaaactcatcttcagggatcctgactctctctttacatatctttctctttcccttaggagtctcccttgtcttctagggttcctggttccctcagagtctggctgcagggccccctaccaatcttgtgcttatggcctttattcaccctaaagaataaataacactttgaaatatttataaataaataattaactcaccttagcattcaatgtgcttagcagtggaagtttaatattctgaatcaattgtgcagtacaagaagcaagtataatataaaatctcctacttcatctgtaggaagatcaaccctgcatacgtttgtcaaatgcctaagtgccatataaaattttagcatccagcatt

SEQ ID NO: 36803 - DNA, 864 bp, Bovine  19866881238616
acattttactgaacgagtgcatgagtgagttgactcgggaatgaattaatggatgatgaacaaataaatgaagatctatgtatactttccaaatttcaactctaaaccttacataaaatttctagtaccaagattctatcaaactctggaattgaatttaactgcctgacctactgatttaaatgttttagggttataaaatcatcacataaattagaacctttgcctatataaccttaaaacagactatgcatcaaaagaaaaatattcatcgtgtgaattagtttcacttaggggagaatcaattttcctatcatgtgctttttttttttttctaattttattttatttttaaactttacataattgtattagtttgccaaatatcaaaatgaatccgccacaggtatacatgtgttccccatcccgaaccctcccctcctccctcctccctccccatatcatgtgcttttgttaaatacaaacttctgtttattgtgacacttcaaaacaatgctaaatgaattttatttttaatccagtgaaacatgtttttaaataaagcctgattctcaaagagatttctgtgacaagggatatccacatgccaaaaagtcattagtgctgcctttgttactcacatacttaactgtgtggggaaacacaaacaatttccaggctaagaatgagtgtcagacagtgcaatgctcgtgtgttctattggcgtgacagcaaatgggcaagggaccagcaggctttgcaaccacattgtccttattgggtaaaacatctactctgtgctaacctcagtcataatcattgcagaagctacacagtccaagacaacaaagcactaacaggaat

SEQ ID NO: 36804 - DNA, 1487 bp, Bovine  19866881305483
gaacattaaataatatcttctctataaaaaaaaatgaaagaaaattttatttgtattattggtagacagaattgatactcatatcacatgctggcagaatcataacttactggcaggtagttgtatgaacctattgctttttatgtcgttattgtctcatctgctagtctatcagtaagtattttgtcctatgggacagaaaatttggaattagagatagaggaaccgaacaaaacctgcaagctgattaaatcatgaatttacccagaatgaaagactttcctgatggctgtatcgtacatgggttcagactttttcagattagtcattacagagaaaaggttaagaactgctaatagttcatgtagaactccaaatagtagttaaaaatagattacagtcacaaaatcttagagacagttattcagaaataattaaatgacttcgacaggttcagtgcaaagtggccaatattccatttgaactcaaatactaccctgtgtgtgactagactaagacagggtgatcccagagtttcagttgaagaagccaagggaggaggaaaaggatggatagtccttatcagtttgtgcttatgtaaatatcacattagcctacttggtgtgggtctcttcctattaccagtagtttctattggtttggtttacctaatttatcttttgtgtaactaataattatgaggttatttttaaggtattttgtgttcatttgctccagagagaaattctgttttcttttgactaaagtcactaacaaccttagatcagttttttccagggattgaaatgattggaaagctgagctttggacttatacaagactagtctcttttcacttcacctttatatatagaaccctctctacgtgtgccctgaacttcattcttctgtctcttgtctcatgaatctattgaaagctgcatagtttcttgcctgtcaagaggtggcaaacattaaccccctgatttctacctcctcctgttcctaggggtcccgtaattcttcaactgcattggtaactctgatgctttcaacagaagtcttctgtattttgtccaattctgcaattgtggtgggagagttaatccaaattacctcagttcagttcagttgctcagtcatgtctgactctttgcgaccccatggactgcagcacaccaggcctccctgtccaccaactcctggggtttactcaaactcatgtccattgagttggtaatgccatccaaccatctcatcctctgttgtccccttctcccaccttctatctttcccagcctcagggtcttttcaaaagagtcagttcttcacatcaggtggccaaagtattggagtttcagcttcagtcctttcaatgaatatcaggactgatttcctttaggatggactggtttgatctccttgcagtccaagggactcgcaagagtcttctccaagaccacagttcaaaagcatcaattcttcgaa

SEQ ID NO: 36805 - DNA, 1571 bp, Bovine  19866881339638
actcttaattaaattgcagcccgagactcatttaaatctcaaaactttcccatctaatctgagtcactgcttggctttgtcattctaatacactcctctcacctgcaactcttaaagctatttattgatttatacatttgattcaattaactattcactgagtccttattctaaatccttaaggaacatgtggactaggtaacagagaataatacacctgggtgaaccaggatacaactgtaataacaaattccaactgcccagaccacagtacaattaattctgaccaagacacagaggcatttatcatgctcagttttctaggaaacaactgtagattttttttgatcttttggctttaagcttttaagaactggcattagagtaaaagtctactatttattccaaactagtagatatagctactaaaattagtagtgtatccagtagatattaaatgctcatgggctattaaatttaaatggataaaaaacagattttcaaatccaatggcaacctatcaaacttttggggcacctattctggctaaggcacaatgttaactgctttaggggataaaatagtaagtcaccatcccttacctcatcagaaacctacttgaggcataatctgacacatgtatattggtggtaagatcaacagtatgtggcaaaatttaagatagatttcaattcagtacagaaatgtttaccataggatgtttgggggaattaggttatagtgttgtaaaatacagtacaaatattagatgcttgataaatggcaactattattttggagaggcaagcatgtgctacttaaaagtagagatgctgggatcactcgggcctggatctggctctcagttggctacttactgcctgcattatgccaagaaagtggctcgcccttttaaaacttgtttttttcccaacgctaccaaatttcattaaatataaaatatattcattagaaataaggctaatctacatccactgaataaacagatgttcatttttgtttctacacaatagtacacatgaaggacattgtaatcagccattcctggagcttaaggggacatttggtatcaaattttaaataggaaaagtttctaacagctttctaattgctctatttcatagtcacattcaaggagaacagtaaattatcaaacctctaacaacaactgccgaggtccagccctggctgatccagggagttcgaagtggggacggcgtcggcgaggatcaggatacaatagcttcaattagatattaattagagatgtaaggagtaatagaatgaggatagctcagtaggaaaattcagtggagaaaagaggctgagtagcttggtttacgcgggagaccaataaaacttcaagacaagaagcttgcaccacttacgtaggccgcaggtgtccttccgttctcccgaaggagaggagacactgaggcctccccggtcggatcttagaagcccaggcaaaattagtaaacttggtgggttccgcgctccacatggagactcagccagagtttgagagagagagcgacatggggagacca

SEQ ID NO: 36806 - DNA, 946 bp, Bovine  19866881341057
ctaaaaatttacttttaatgatttcattcctacatgcaaatagactcttatagagtctaactctttatctacagcattaagggtctgagaggaggagaatatgttattagtgaaccatctattactcttcttgagatttcttcaaatggcagagagaactaaaactatgagaaaactactggagaggtctaattataataataaagcatccaattttggttagacaacgtaattaacaggctggggaaaggagctaaaataaaaggactagttatgtttcatttcctgaattgttatttccaaaaacagagacattttgttcacttctcattttgtggagctattacaaaaatgttctgccactatacatcttagagatagtgactcttacttaaaagttgtatgtggaaagtctacggccaaagtagacttgtttcatgtgaaagattcaggaacatatctttcctataagatgatgttaggaaccagccttggtgacaagctaaatctttcaaagataaaaaagtaacttcatcttaactatctctggttagtatgtcaggctaattaaggttaggctagctcggtgatacactgaccataactaaccactgcacatgtctgcatggaaagataacacagataacagtgaccaactacaatgcttatgtttgtacttttctttcactgctgaaaaagtaaataaatttaatttaaaattttccacagaatctaaaaaacttgatttactaaaagtttttaaattgatccattatcatagaaccaaaatagtgtagttttataccttttattggtacaatatacaactcagaagaccaaacacctgcaacttacaactttaaaaaaccttcattttacagtttcttttcctggtgtattctattagatcctctttaaaaaattaaaagtactgtgctacacattg

SEQ ID NO: 36807 - DNA, 1317 bp, Bovine  19866881421261
ttcaaatatgaccacttaggctgagatatcttctaaaatctagacaagggatatgataaaattgtcacacaggtgttcatttttaagaatcttccagtgatatttaaatttatttctgaagagaaaatttgacagaatttaagagcttcaggggaagattaagtttctagtacttaaaaggtcttctaaacattcagaataagagaaagaatttatggaaatttaatacttcaggaatttttttaccgaatagaaaattcagcagacaagaactgctttgaagtgtgctaagggtcaaagataagggcccctgggccacttcttgagatgtaaatacgactcttaatagagctggagggaaaagttaatctttgctctattttccccagagttcttttcccttgtttcatgctataatgaacagatgataaggcagaaatgctttcaaatttatttactttcaaatagacattctacaaagttttcctttgagtaaggacagttaatagcaaagcagtgctaccagttcttcattcttcaaattccaaactgattccatcaaaaacacattctgctaagacacagcaacccctcagccaaaacattctctcaatatgttgagctttcatttgactttcttgtcagtgattcagatattactcaaagtcacatcaagttgttttctctctcgtactaaatgtcttctttagttgtgtggtatattgaataaacatcacctgcatagttaatgtttttaattcacacaaagaactaaattcaatgcttacataatggatgtattagacacttaatttttaaaaagttatgttcttatgattcagaactgcccaattgaattttagacaaaaataacaagatgtaacatcaactcttggagaggggaagtcagtaggctttttccaaacttgcttttgatttgcttccatcttggtttcatctgctgctgctgctgctaagtcatttcagtcgtgtctgactctgtgcgaccccatagacagcagcccaccaggcgcccccgtccctgggattctccaggcaagaacactggagtgggttgccatttccttctctaatgcatgaaagtgaaagtgaaagtgaagttgtttagtcgtgtccgactcttcgcgaccccatggacggcagccccccccgctcctccgtccatgggattttccaggcaagagtactggagtggggtgccaggccttctctgaacactaactaaatatcttaaataaatattttaacaaaataaatatgaacaacattgtccgtatgacacctatagcaattcta

SEQ ID NO: 36808 - DNA, 1303 bp, Bovine  19866881527678
tttactaagggccctcttacaagtcgtgtcatggaagcccttccatgagcactcttctgaaattgcccatttgaacctcccagatacactgccattttattctatttgcttttattaaaattacattgcatgttttttgtttgcttctctatcagccatccttaccatcaaaatataattaattccatgcaggtacagatcatgactgtatggtttatccttgtatccctggtgcctagaatgatgctggagctctctgtgtgcccaatgatgaatagtcattgaatgaacaaatgattaaattttattaacaagtcatctgaattgggcaagttgaataatactagttctactttacaaagtacttcaatatctttacaaatgtcagtatagtcctgatgaacttctgctacaactttatttcttactctcattcttaagatagttctaatcggtgactaagatcaccatagtttgactcacactgtgtaaattagtgtttactttgatacccataagacatatacttaacaaaacaatttgagtttatcaaggagagttttttcttaattccctctttctaaacttaaacattccctctttctagtgaactaagattactcggcaagctgtttctaatttcaaagtgctctaaagtaatttcatgttatttcttattttccatgtcctgtaactatcaatggatcaaccaacttatctaataagagaatgtgatgttatgttaatttattatagatacaaattaaagaactattagaataatggtaaacaaaataatttttagcattttatttaatcatttttttatttagaaaacgaaaaccattttggtaacaaatcaaaaatgttataataccttaggtaaaacagagggaaagtatatataataaggtcatttggggtctaatgccagttatagtttaattctttaaactgtatactactattttggttgtgaatttcattttggaacattctcactcagtaagtatagatttttctttaattcatggtagaagggtttcctctcagaggcatcttttgatacacattttgcaaatatttcccctgaattgaaatatgattcacatgacagcatgaagtcagaggacacaaatattaaatgacagcttgaaaattatgactttagttgaagccttgtcacacaccttggacttgaatgtctggtaaaaataaacctcaagcactgttaaaattgttcagtcaaattgtgacattttaagacttcttttgcaaagtctgtctttgaggaactgtgcaa

SEQ ID NO: 36809 - DNA, 964 bp, Bovine  19866882240432
gactgaaaagaaaatgaagaaaaggactgatcttaaaggcttcacaaatgaattaaatacattttggctttcccatgtgttactatgtccagttatgaggattttcaaaaccttctttgagttccttaatgagtttaacaaataaaacttattctgttatataatgttgcttcatgtcattgttgatgaagaacagatgagccatttttacctgttgctcagaaacaccagaaaattgagccactaaaaggaaagcacgaagactaaaagcttttaccatggagagggtaaatttagcactgtgtggcaaactgaagaccttgtgacctaggaatggtgaaatgagagataaatgacaagtttttaatttgcacaaaattagaaagtatataaatttactcagattatataaataatttgtaaggcaaagttccagtggtattaacacctgtatcttctgatgtatactcgggaaaatgaggcaaatcaaaatagaagattattttgttatgttaatacttatttatgaggacagtgaactagtatagtaacagtttttgctaatgtggaaaaaaccagacaataggtaataggtttaaatcatagaccttaaatattcaattttattactttaaaatatatacaataaacagaaatactttaatggctaatatgactttaaaatataaaaaaaaaaaaacagcctaaggcaaactaaccacctttctgcatagtttaattatatgatttgtaaacaaatctttgaaagtttttgaagaattcactggttcagaaacatttttccattcatcctcttttcagatcagatcagtcactcagtcgtgtccaactctttgcgaccccatgaatcgcagcacaccaggcgtccctgtccatcaccaactcccagagttcactcagactcacatccattgagtcagtgacgccatccagccatctcatc

SEQ ID NO: 36810 - DNA, 3534 bp, Bovine  19866880404939
ttgtaccttattgaaataattgtgttattacacagtttgttttgatgcctcctttcgaactgcaaacattttgaaaactgaggacatgccttatgtacattcataaccccaaaactaaacataatacaaaaaagattatatatttatttttgttgaggatttcaaagcaaccatcatcattttctcacttataaaatctgcttaatggaaaattcacatccatttatgttgtatagacaattaatgctcataaccttaaagagacaaatttcaagcagtaaaaggatcatgtatgggttagtcatacattttttaaaatttaacaaagatgttataagtgtattccctaacttcatagtaaagcaacaaccttcagcttctggcttctgcatttagttcttgggatgaatgccataatcctctagttttgtttgtaggatacatttcacctgttttcccccactgatactataactcctataattctggccaagtctgttctcagtgccttgatagctaaggtagtggagaataattggtgaccactgactatagagggaccatttgcaattggagacattgtttggtgacatttcactgggactctacctctcagaataagcacatgttagggcaggaaaaaaaaaaaaaaaaactacatgtaatagtagtaactaaatagatgtcttaagactttctcaaaatagcatattgagaacatgagaactcccataaaatccttgcgatgtgccaaaaatggtgtaaaataccacatacatcttctctgtttcttgtagagccctgtgatatgggccttattaaacttgctctacaagtaaactgagattgagactcagttcaagtgatattctaagactggacgacagaaagtgccagaactgtgaacactgtttggctttcttgcagactgaggttcagtactttttatttctcatttaggcctaaactcctgaaaaaatcactctcctaaccttacggcagtggcagtgttggtggccacagtccaataacggttgctggtgagcaattataggcaccctgagacataagaggaatgagtgatagagtttatgacgggaaccactctggtgttttcctgcaagctgactctggtgctttcttgggtgacctttgttggctatgccaagggctttcctttttaatgctgctgctaaatgccattagtagcaacagctgtgattttctctctgtcactctcattaacctcaggagagaaggttccaaggagcctcttctagggaaggtcactggctctttctgtcatcacactaccggtctgtgattagaatagtcaggtgggaagtcaatggaatggtaaactgaaaatgtggagaaacaaaggagaattaaattagaattaggcttccagaccaggaaatcaaacaatatgaaccaggagggccagtgatgggggtgggagggggcaactagtggagaagagggaatgttattttgttccccttttccataagagaggcaagttaaattctacagcgttgtaccacatattttttggtattgatgttgaaatctgtgctcgatgtttaaaatgacagaaaagagataggtgtaggggtgaggaatctaagccaggtatatggaagaatgctcttttatcaacaatgatttcagagatctccataaaaatggcacacaatgtggatattaaagctattctgatgatttgggtcttatatgcagtatctcagacgttctcacaagtcacagtggatctcacaaggcattagttcctcacagagcctgtaagattgccagttcactgaaagggaaaaatttatgttcctggaattgatgctatgtgagctctctctactgcccctccttaattctaaaaccacaaagatttgttctggggaaagctgacagattcaaacatgaagttcctatgggattttcctgatgcaattaaagtaaggaaatatgtggaaagaatggcttcaatgaaagggcactttttcatggatgatatgttattgtgatcgtggaaggggatgatgaaagtgggtgatgtagttaagtgttaaggtcttacatggcttaaggacctttgttgttaaaattatgattcattttttaaaaaggtcactgttaaatatatatttgcctttaaaaatcttgccagttcaagctattcttggtattttgatctctttaggggacttctaaagctgagaggaagctttatatatttctaagatttcataaaatcatgagcaaaatttctaaaatgcagctccctgacttaacaactaaaggagagacttacaattctcatgatcatctgttaaaatattgttttttgtgagccctactatgtgacagagcccttaaagctagaatcaaaaaatattactgataagcttctcttcccacctttcctgtctccccagcaagacttatttttcagtcttctttatgtttccattgttcactgttataaccttaaatagtatgtaactaaatttctctcactgactgcagtctcttaaaagtcatttcaggaagagagaccagtgttcatagactttgagccaagaaaatctacatcgggaaggactttgatatgatcaagaagtgttcaatttcccttaaatacccaaagagtgacaatgagaaatgagatgcttctgaagaagtagacagaagatgattcatactgctccaaaagtctgtgtcaatctttaattaaaaagcattgtaaggccttggatagtatggtcattttaataatgttaattcttgaaatccaagaaacagaatatatctttctgtttgtgttgtcttcaattctttcatcagtgtcctataggaaatataatagaacacaaagaatatagccaatacttataataagtatcagatcagatcagtcgctcagtcttgtccgactctttgcgaccccatgaagcgcaacacctataaatggagtataatctttaaaattgtgaacctaagagtctgacatgactgagcaacttcactttcacttttcactttcacttttcactttcatgcattggagaaggaaatggcaacccactccagtgttcttgcctggagaatcccaggagcgggggagcctggtgggctgccgtctatggggtcgcacagagtcagacacaactgaagcgacttagcagcagcagcagcatacacccatagcttatataatattttacatcaactgtacttaaattaaaaaaaaaaaatcaactcaggatgagaagggtaaatatcttccctcctgtgataatctctgacttgttattgctcccaacaataaagatttaatttttaatgaataataataaaaaggaatgtaaggccaaggaaagcttctttttaagactctttcatagttgtcaagagatgaaggcagacaaaaattggtgaaggttctaaataatgtttctagtctgaagacactttcattcagataacttagagatgatatataaaaccaagtaaata

SEQ ID NO: 36811 - DNA, 852 bp, Bovine  19866880530601
cttgaaaagaaatctatcaggagcagagtggcaaagttaaattggaaggaggatcaaggtctaacatcttatataaaatgaatgacttcggaataactatacattgcattgatatttaatatttcacagatgcatgtattctatttgtatgtgctattactcgaacagaagcatttgatgaaattcctccctcaaggtctgtagggttttttaaattttcatgttacaatgaatttctcaggtcaagtcagtggtagcaaggaaaaaaatggctatgactaaaattttcttttctaatcttctgctagagtcaaagttgtctcaatttatcagtcactctgtcctcattaaaatcattctgcctgcagagcattttatgagtttccacacatggaaatggaggacataggggagacaatgagaataagtcatttttttgaatgcactgatgataaaagctgccatattgttaattaacttatataagtttaataagcaatatgaatagagaaatgcataggtaaatgtactaatggttgaatattattattccatttttaaacatatatgtgtgtgtatttgtttttttatattttatatttatttttcaaaagaaatacctaaaaatgttaaggtatatttatgtctataggttatgtgtctatccctttcttaatagttatgtgggaaggcagatgtatggatattgatttttttccttgtgcttattctggttatttctaaggtttttaaaattttattttatttttggctgcactgggtctttgttgcttcttgcaggctttctctaattgtggtgagcaggggccactctacagttgcgatgtgcag

SEQ ID NO: 36812 - DNA, 1375 bp, Bovine  19866880764474
ttctttccactcactactttttcacatgattttcagctttgtgatgtggtatacacatatctgaactctgcaagagtaggatgctctgtgagattgatacactcactccagcaatgaacttgaaggtgttgcaagtatctgtgagatagaagggttccagacaggatgatgttcaagtctttatggcgcatgtgctttctctctttatcaaagttaaaaatgcttgcacttaacagtcatttgcatattatatagacatttcccctgatatttttaatctttgacactttgtatcattattaaaccaatcaccataacagctacttcaaaaatgatacattatatcccttgagtttatcaatcatagaacaatctcagtccatcacatgaattattacaaaactctttgatatgtgtaccaaaaagggaagagtagtctcttgtctttgaactttttaagacaattgcattagagctgaactgtgaagcactctcatgtcaattataaagacataattcagtggctgtgctcaatccatctgacttagagttaaccccacaactttcactattaactttactttccacttcttttaatatttgacacttacatatcctaaaagattggtaggatctttgaaatagaattagaaatcaagcagtacagggtttgccagagtggaggatgtgaaacaggggtataaatcagggtgaattttagtggaacacaagatggttttagatagcatgctggcaaggcaataattaaccttgaatcttacagtgagaaagttattcccatctcagccttctttcattccctctggatacatcaagcagaatgaatcagaatgttgctaatgggtctttaacacaccttcaacacttgccattatcgccaagactggaccttaatctcaaagcctggaagtagagcaggataaaggtgtatatttgttatttgcaaaattttgtaatcttatatttaaggtaagtgaatatggtgattttccattttttaattgattatgataaacagtttccttttaaataaatttataattgaaacagcaatttgattgaagaatatcaacaaatagtaaagataatatgtggaaagtgtccaatccacaacactgactttacagttggaggatagaatcttgatgtttttcggtgttgtttttgtttttcgactgtgctgggtcttagctgcagtgctcaggctcctctagctgtggtgtgcgggcctttgagcacaagggctcagtggttaagacaggcacacttagttgtggtctgtggcatcttagttctctgacgagggttagaaccctggcctcctcattggaaacacttatccatggaccatcaa

SEQ ID NO: 36813 - DNA, 1046 bp, Bovine  19866880785777
cccaaccgaagtatctgtactcaagaccttaactcagtgcctcctttgggaaaagcctaactaaaatgggagttttccctcatcttatttcttcacttcacataatgttgtacctattcagagattttaatttaatattttatcattgattctcttatctgtttcccttacaaaaatttaagctccttaaatatacgagcaagattgtatgtagccttctaattttgatatcattgtactcaattaaaggttgttgaatggatgaataaaaacatggagatataaatccatgagtcgttctctgccttactgattatttctgggaccaagacagcaataattcagttgaggaaagcagatggtgatttctgtttcctctgaggacttaagccctggctcaccatatgccactttggtgccacttttcaagaagctgagaggaaactattaaacaatattgaaacttggtagttgttcatataaacacgaccattccaggtacattcagacaagaatattcagagagagcttgctagactaaggacctcaaggagtatatgggaaagtttgggaatatgagataaataaggtagatttgggtgccaatttttccactgtaggaactaacgctctatttggaatgacttcttccatctgaaatatttaatagctgttcaacaagttggaactgacagtagacaaaatgttttactgccatgtgtcaggtagcttgatgcacttcatgcctggataaatgcaaaatggaattttagctgaaggagatggtatggcaaatggttctttacagagaagggagtaagggatatgtctcccatggagaaactcatggtgacaatgtgtctgattcatattttaattgccagaataaaatcaaatatccataagttcaggcatgctaatgaacaagaaggagaattagatttttctctgcctattaaattttctaatgttgagagaagcaaacagagcactgtggatccaaatattaccctggaggtgttataagcaccaaaacttgaagatta

SEQ ID NO: 36814 - DNA, 1459 bp, Bovine  19866881095313
aataaattatggtatatataatatataccactaagtatgcactaccattgctaattggtactagaggaagttggacttcctactggaaaagaaaggcaacaaaataatcatacagtatcaaactttagtcctgtattcacatttctcaagcactcattgttaatatcagctactatcatggaagctttgcttgaggtattaccactacttcttcttttttttttttttttggccttttgaaactcttttttttttttttttttgatgctatatttttttttaattttattttttaactttacaatattgtgttggttttgccatatatttctttaacacatttgtctcaaaatagaccagtctcccacccaccttctgtttgagttagcttatatctttcaaaaagactagctaactcaggttcctctccaagaaactagaactaaagggaggattaagacatggtgatttgtgggaagtaaattttcatttcaggccccaaagttgtctcttccaccaaaggggatgaggatagcttcaaatttatcctttttcctgttcaggattatctctgtgactaggacaagcaggacctgtgacctctgctaagcagggcataggaccaaagtactgtcatattttataaacacactaaccaccagcgtaaagcatctactaacttttttccttaaaattaagtgatagagaggggaggagagaatcagataagctagtctaagaaaatacttgtcggtttttttttttttttccctccatttggttaactaaatccttttcccttgggctaaaagttgtctcattaagaaggcatcggtgtattgacagttataaacaatattagttgtgcttgtcagtgatccatgctgtcccaattaccattactctaaaaagatttcagtcacaagtcatcctttatacaaagaatagatcaaaacaagcttgcaattagatgtgtaattttagagcgtctttttatattaacgcattactgtgtcttctgataaatgtcccttttggacaagagcaaatagcatgagctttcctcattaataactgattctctttaaaattctttaatgtccagaatgagatgatcatgtctcaaaagaattaaatacctctattcttcattgcagttaagctgaatgtagcatgatggaggaacactattatctgagttgcaattagggtacctgttcaagttgtgacagataaaggtaaatgtaatcaaagaacaattaacaagtaattatactgttactacctaaattcatggctggagtgagcagagatcctgaatttcagtctgtgacaatttaggtgaattatttattttcattgaataactattgaggaaagcaaatgaggcaaggacagatatcatccatttatctgacaaagctaaatataatagtcaatagactatccatctaatagg

SEQ ID NO: 36815 - DNA, 1551 bp, Bovine  19866880152140
caggaaagtgacaaacttccagggaactcaacccaaagaaattctttatattccaaatcactttgcactctgaaagataccagccttcctcatctcctcaaaatctttcatggaatcataatttctgtagaagtctgcatatgccttctttcttttttcacctacagcaaacttatagaaagttgcaaaccccagagagaccatgaatgctccaacaatatgaaatctcagacgtttggccagaaggccacgcatctgaggttttgccaaagcagtggacatggcagtttttcttctcgacggctcaaccgcgatgtcctctcaggctctaattaaaactttttttaaacaatctatcactctgatttgtatttgtttttctttttctgatcatgctgcatggcttgtaggatatctcagttccctgaccagggactgagcctgggccaagacaatgaaagcccaaaatcctaaccaccaggccaccagggaagtcctacatattattattacaatgtaatatctcttgtttcaatgttataatattaagtatcaattttactgtaaagataggaattgtgacatcgcatctcatccacactaataggtacaaacatccaaaattatatttatcatttctctaatataaaagtgcctcagaattctaatccacacattttatgctttctgttcatactagttataactcacaattacattctaaatttagaacttaaatagttaaataaacctacctcccaccttaggtaaagttctaaaaataatattataagaaatgatttaaagcactcaagttagttaccatggtgactgttgctatctaataatttggggataggaaattgttcatcattatctttccttctataaataaaaagagcaacaatcttgatctttttaaataaaagcagaaagaccttctaatattttatttctgtgctagacaagaaggggaaaggccgtttctggagcaaaggacattctacaacaggctactgaaacatttctataagtatatttgctctacatttggtcctaatcagtccacgtctgactgtggactcccgaatattaaagtgattcaatgtgaacgacaaaggaaaagttcgtaagactccagccaccgtgttgactcaggatgcgcctgcctgctggaagtggctggccccatgctctcctctgcactgctgctgctgctgctgctgctaagtcgccttcagtcgtgtccgactctgtgcgaccccatagacggcagcccaccagactcccccgtccctgggattctccaggcaagaacactggagtggcttgccatttccttctccaatacatgaaagtgaaaagtgaaagtgaagtcgctcagtctgtttgaccctcagcaaccccatggactgcagccttccaggctccttggtccatgggatttgccaggcaagagtcctggagtggggtgcctctgcactaccagagggcaagaacagaaggcaagaggtttcgctggactgtaaacctcccacacgtgacgtcccc

SEQ ID NO: 36816 - DNA, 1158 bp, Bovine  19866880567263
ctgaagaggtgggggctcgctctctgaggccctcagctcttgtttctgtgattttaggtgcaaaaagggtttgcagagctcatcaggggcctcagcccatcagaggttctgagggagcccagagttttcactcaaacacaccagatgcattctccttatcaaacccctggcccttcactgaagcatgttcagacttggaataaaaacgtgtttattgacagcctctctgggtccagccctttgagagacactgaggaaacatgaaggggtaagagaacaaccgtcaggcaaccatcttacagagacagaaactaaggctcagagaggctttgaaatctcctcaagggaacacagctaagaattcaactcccagggctctagcactggtaagattagcactgtaatgtgaaaaccaacccggctactcccaaatccttttaggcacaagaaaaagttagttttgtgaaactggaatctactaagatcagaaactcaggagtccaggacacagggctggctggctgagttgtcttgttcagaaatgcccagcttggccctaaaacccatgtcagagcttggccaccttctgacacccttctctgagccatccctccatcccaggtaatgagcagcggcaggcaggcgactgtcatgtgacctccacaaccaatatgtacacacgcatcacagcagctcctggagctcaccaggtcctcccaaggttgtgtgtgttgcggccccttgtacagacaggcactaaaccaggtgaactggactggtttgtagagctacagctggtggtcttccctccagagacagccttctcccagagcaggtcaaggtcctgcctgtctccccgcagcctcaggtgagaggcctctgcagggatgctctgagaaccgctccttcctacaagtgtcagaggctccaagctcttcagtctggtcttccctcctcagcactaacctggctttcagagatgctttccccaggggagctaccagacagcaggaaagccgtttgtctccccgtctccctggcccctggcccgctgccacggtggcctcccctcccccaagaagggcggtgagctgggaggtgggggttggaagaatccgccgagaacgatcttgggaggggtgctggaagccaggcagg

SEQ ID NO: 36817 - DNA, 1361 bp, Bovine  19866880663084
ttatgctttttttgtagcataataggtattttagaggggaattatttgggttcttacacttcactgcctccattggctgggtgcttcatttgaacagtaaaggtagatgtttcctaaatattatggcataaggctattactagtatcccctattgctaagattttgttttggagattaaaattttaatggcaatttagagtgagtgtaacttttggagcttatttcttttgatagcctccgttgtttgatttgcttgtgtgttaatgtgtggtatgtctgagaaattatataacatgtgtttgtttttttaacaatttggtgggttttctgcagtgatcaacttctctaaagaattggtaaatacagtgttacaaaatataattttctaaaaccgtctcttcctacttaataatctttccttgtttttgtagcttggttgcagaattgttggtcctcaagtagtcatattttgtatgcaccaccagcgatgtgtcccaagagctgaacatccagtttataacatggttatgtctgatgtaaccgtgtcctgtacaagcctggaaaaagacagaagggtaggtgttgctgtattaagtggactatcgtcaatatatatttgcacacttaatttttcactgtataggggatgttttggtgcttatgacatgtaacagagtctagatgatattgtatgtcttttttttatttatttaattggaggctcattactttacaatattgtagtggtttttgccatacattgacatgaatcagccatgggtgtacatgtgtttccccatcctgaaccccccctcccacctccctccccaccccatccctcagggtcatcccagtgcactggtcctgagggccctgtctcatgcatcaaacctggactggcgatgtatttcacacatggtaatatccatgtttcaatgctgttctctcaaatcatcccatcctcgccttctcccacagagtccaaaagtctgttgtttatctctgtttctgttttgctgtctcacatatagggtcatcgttaccatctttctaaattccatatatatgcattaatatactgtattggtgtttttatttctgacttacttcactcagcagttttttaaactttgatttaaaaaaaaaagttcacagcctttgacctagtgatcattctctaaaacatgtatcctatagagacagcaaaaactaaagatactgatattctgtactagttaaagcttaaattcttaagggcaacaatatacaaactagtaaatatgacatgtcattaggataatgtatttttcgtccattaaaatatttataaatttaccagtgttcacaaatcaatcactag

SEQ ID NO: 36818 - DNA, 833 bp, Bovine  19866880787040
gatgaagtccagcaacaaggtcaccatcactggctgccccacccatggaaacacagcataggagatggaagcttcctgacccatggtgaccattaccctttgtacagacctgggaggcagcccctggcggtttccctgaagccacacaaggcaggcaaattaggatttgagtgaagtgtttgctgaagaagattggagaaccctgtgagccacagggactttggagggccttgccatggtcttcactctcaggcattcatatttctctccctttctattcgcctgattttgggatttgtttttactttgcttctctctgccagcctccttcctttactatttcttttatcctttgaacaggaacactttggaaaagacaagtcagcagaattccagctcttctactctcctcatgggaaagacctgttatttacagatgctgccattgggtttttaagagtcccacctaagatggatgccaagctgtacttgggatatgaatatttttcggtcattcagcatctggggagaggtgtgtagctcctgggaagacctggagagcttgggcatagggcagggcggggccgtggaggctttcctgggacctgcaagccccacctcacccaacccacactggcctgcagggtccaagggagggccaactgtgctggattcttgtggggatgttctgctgaacttggggaaaggcctgaacctcgggttcacaaaagggtttgaaagaccttcagattacaggctacttaagtaataacgggggcttccctcatagctcagttggtaaagaatctgcctgcaaggcaggagaccccagt

SEQ ID NO: 36819 - DNA, 1216 bp, Bovine  19866880817137
tgtaaattatatattttattgtctagattggacctggcatggagcagccatctagtaagtgttcttgataaatgttgaaaaatggtaggaggcagaatgggaggacacagtagcctctcttatataacatgagggcatcccaggtcacactttagggaaccttgggaacagctctcaaagctattacttattacttttctctagataaactgggaattttacaactgaggcgaagtaatgtttaggtcatattaaaatctcattaagaacttttcaaaaacttgactgtagttgttaactctgagtacatataattgggattttctttttactctgccattgaccaagatgatattaacttcttgttcaatcactaagtcatgtctgactctttgtgaccccatggacccagcacaccaggcctccctgaccttcactgtctgccagagtttgcttaagcttatatccattgagtcaatgatgctacctaaccatctcatcctctgccaccctcttcttttgtcttctgtctttccagtgagtcagctcttcacatcaggtggccaaagtattggagcttcagcttcagcattagtccttccaatgaatatttaggattgatttcctttaggattgactggtttgatcttcaagggactctcaaatgtcttctccagtatcgcattctttggcacttgcttatataattttgggcaaattatgaggtttattgagaatattttaagttataacaagatgaaacaggaaatctaatttcattcattatttcagttgatttgcttgtctaactcaacatatattttaatgtctggtttatttctttgaaagtaagtttatagctttgtggtgtgaagtgtacttcacatgaaaactaataggaagataaaaacatcacttcttgtatgcctctttagagacaagaaaatgacatcagtggctcatatttatttcttttcattttaaatctctagaacaaagtttggaaactgaaacaacaaatgaggtgaatctaaatccagatactccagagcatcctgtaacacatctggaaactcagagaaaaacagccgttacacctttagatatgaaccgctttcagagtaaagctttccgcacggtgatgtcacagcactccggacaggcttcagtgtccccttccccaggacagtcacttcagaaggagcccctcattaca

SEQ ID NO: 36820 - DNA, 879 bp, Bovine  19866880824121
taatagaaagttacctgaaataacaaaatgcagctcctcagctagcttgtcgttaaaccatattgatgtgtgtgatgtgggtttttatttatttgcttgtaagtatccaagtctgtagtttagtggaagtttgagcaaggtgttagattttcccttaaaatgtctgctttaattcgtaacaagaaagttatcaattgggattcattcatattttccctgatttttagcttcttaccattttatctcttcttaacaggagcctgagcacaaggtttaatgaggaactgaggctttaaacttaagtgtgtgtgtatatatgtatatgcatgtttgtacaaatctccatgatgtttgccaagtttgggggccaaaacttggaagataaagacaataaagaataaaagtagtgactcaaagtagttgttcaaatagataattaaaaaaaaaaaaattctggtaaccattctcgttgaagcaaataaaagatttgtaaaacagcttaaaaataaatctagttatgtttctgatgttgtttatgtataattattagggcttccctggtggctcagttggtaaagaatctgcctgcaatgcaggagacctgggttagatccccagattgggaagatcccatggagaagggaacggctacccactccagtattctggcctggagaattccatggactgtatgtatagtcaatggggtcgcaaaagagttggacataactgagcgacttgaacatacacatgtagaaatttgctctggtgggttaaaaaaaggaagaactatagaactgcattagcctctattaatctaaacctaaacaccagatactacatgcatggccacagttctctaaatgtaaggctacctca

SEQ ID NO: 36821 - DNA, 1222 bp, Bovine  19866881041496
taatcatttctgcatttgatgactcagaaaactaagtaaaatgttactgtaaaagaatccatagacttgatagctgttttgatgttaatttttttctaaaataaacttttccattccagattataacaatagaggagactcatgaagacttaaaaaaacagtacatatttcagttgtcatctctgaatcctcaagaacgtattgattattgtcatctgattgaaaaactaggtacaagtatcttacttaagtcgaaaatgtaaccttatttggaagtcaaatgtagctaactattgattaccatttttaagctgtagaaattgagattagaaagatgaataacttgtctcaggccatacagcctctcagcagtagaacttaagtcttaggatttaaagatttaaagtgaatcccatcattcaggtgtaagaatcttgtcctactttgaatgttcattgttgaaactctggacaaaatcaaaggaattatatagttaaaaactacattttcatgaagttgaaggtacactgatatccagacaggagctcctcctgctgtgatgttcttattctactggttgtcaagctcttcctgaccattctggaagcagcatactagaaagctaaacttcctaacaactactttaaaaagtaaaatgaagcaggtgaaattaattttacatatgtattttatttatatgtgtactttatttaatatttactttattagtatatgcaaaatatattcaaaatattttattcaacatgtaattagtataaaatatcagtgagataatttgcctgttttcttactaagtttgaaatctgggatatattttacatgtacagcacatctcaacatctcaatagggagtagctgtgcttcaggtgttcaatagccccatgtgactaggagctactgtattggacaaagcagccttatagaacttaatatgacaacttgacctagagaaacattaagaaataatgattgtttttaatagtggccctgaatcatcaagaaaagattaaaggtcctttagtgctctcctttttaagtttgtgggacaaacttaaaactcctttttaagtttttttttttttgttaagatttctttcagatacagttgtgtacttaagaagctgtatgttttggaaacttcactcatgtggaacatttgtttcccagtcatacaataaattagatggagataagtcagaat

SEQ ID NO: 36822 - DNA, 847 bp, Bovine  19866881087839
gactgatgctgaagttgaaactctactttggcccctcatgcgaagagttgactcattggaaaagactctgatgctaggagggatcaggggcaggaggagaagggaatggcagaggatgagatggttggatggcatcactgactcgatggacatgagtttgagtgaactctgggagttggtgatggacagggaagcctggcatgctgtaattcacggggttgcaaagagtcagacacgacggagggactggactgaactgaactgaaaacatgtttcactctagttctctataaagctggcttaccttagactctgagaggtttggttgttagtaaccaaaaaaccttccttaaaagcagcctatagatactaagtacacttcctgcgtaattatagttattgtttaattacagttattgtttccagtgattaaaaatacaacctgtgaatggtcagcaaaataaccaggtttctaaacatgtttccctaagcctatataattgagaaaagtcccttttctaaatgctgtaatcattttggaattttttaaaatttcctacagtaaacttaccctctgaagttgagattcaatgtgctttattttctaggtaaaacataagtttctggggaaaaaaattttttaataaaaatttccctaagttcaattattgaataagtattttcaagttgcttactgggtgctagatggtggacatttaaaggtgaaccaccaatttgcagtctaacttaacagaagttatgaggacggattttgttatggctatctgttattaaaattgtgacttctgttccttaggcagtctcgtcaaacagtacctgatgtcaa

SEQ ID NO: 36823 - DNA, 751 bp, Bovine  19866881132243
tcaacagctggaaatgggagaaccggattcaaaggtatttgcaaagatgtctatgtgtgtccacctgtattcccatccctccaggtgctgagcatttgctccttctatcaaagcaagcctctccctgggttctcttggctctggccctctcagccatcaaggatctttttctctgtctgcaaactttcattctctactcactctttcctttcatccaagaaacattcttaaaattcttgcatctttaaaaaaaaatcggtccctatcactaagtggctctctagctttctgccaatctctcacctccattccattggtatgcttcttgggaaagggccccaaaccagctatccccacctcttctcctcccacccactgctcagtcaaggtggtctggttcctgcccctctgcccactgaggctgctctggctgtggtcgccatggccattcatctccaaattgtaaggacactctataggccagactctactagtaatagatgaacttgacccagtggaacagtcctcttctttgacattctggcttcctttgctttcatgacatgactcatttctggctctccctgcctctctaacggctgttcctcattggcctcttacaggatcctcttcattaaaacactggcattcccaactgttttgtgttgggtacctcatttacatcccagtctacatcccaggcctcacctctgtcctgagccccagatccaggtagcctatcacatactga

SEQ ID NO: 36824 - DNA, 864 bp, Bovine  19866881289262
ctgctgctttgagagggagatagttaagaagccagcctcaaaggcatccatgccggctttgggatgggaatacagcaaaggcatttccaaacccagcttgaagaaacattagttttctgctttatttctttagccttaaatctaacaagaggagtggaagcaaagcctcatggttaagaacacaccagagtcaaaacaggtggggtggaatcctggctccttcatcacctgccctgtgattcaggcaagcttatctaagctttcagaagctattttcccatctttaagggattgccaggaattaaatgagtaacatttgttacatgttttgcacagtgcctgccccaaggttaaacactttatgagtaattttttaaaattctaaaaaaatgatttgctatttgatactcttgctagactggagctaaggttaaaaaaatatatgaaaggaaaaaaaaatatatgaaaggaagatgggagggtcagagaaggacataggaacataacagaagctgcaacctgcctttaaccccattacactaacatggtgctactgaggtggggagtccctgacatccaagtttaattcaggctctaattaaagccatacatttgaactgtaaaattagagaaacccaggaagacaactgcaatagtttcatcaatttaaaaccaaagacaagcctaagaggcttcctctctgtgtccatatgctattcaaaaggatgcttcagtgcaacccagatgacccctagaaggtgactgaagtcaaccaccagcccaaagtgtggtcagtaaagagcctgaatttccagtgctgagtaggcaaattgatagtgcagttgctaaagcctgtctctggta

SEQ ID NO: 36825 - DNA, 1203 bp, Bovine  19866881766132
aatgcggatcccataaaggaatggtgaacacagggaatggtcactacctggctaaacatgtaaaatgtctttcatatcagttagatatctttaagagacacctgactgtttaaacaaaaataagaaagttattggatcacagacctaagagaacacagaagaaaaatctttgttaccttgtcagaagccatgcaaacaagaagaaaatgaagcgatacatttgaaggactggaagaaaaatactgtcatcacagaattctatacccagcaaagatctttcaaaaaccgaagtgaaataaaaaaagtcaggtaccaagactatttctagctagcagacctacaacacaagaaaggaggttctggggacaggggaagcaggacagcaacacattcacacaccacacaaggttagtacacccactgacagtcctagatcttaaccctggctctgccactgtgtggtcttgagttagtcactatcttctctgaggctcagagtccttatctgtccaatgggggaagaaatgcctacctcacagaagtgccatgaataccatgagacgagtaaaaagttatcattctgggtaaaaggcatatggaaagtcttcataatattcctacaactttctacaagcctaaacttattttggcataattttaaataaaattttatttaaaataaaattttaataaaaagttaaaggaaaaaaattaacaagatgattttttttaaaagtatgcacacatatacatatagtgcataacactatatccaagtctctcagattctgaacacattcaggaaatggcttgttctgattaaacattctggtcaacatgaaaatttcctaaggaactagaatataactgtacttggcatcaacagtcttcacagagaaccaggacctcgctgggtgggaattgctgtgagcccttctaaccacagactggagagggagcaagccttgacaggccagcttggtgggcagaacccggcagaaccacacaggcacatgctcaccaagatgcatgcaatacacacacacacacacacacacacactcaacccagcaggtaccagaagccctggtgtgtgaagaaactctctagtcctcctgatgtcttagctgcgaaactgagaaatcatcaggatttcttaaaaactacttgagatcgaccacacaggatcagcccacccactgt

SEQ ID NO: 36826 - DNA, 1204 bp, Bovine  19866881898100
tcacacacagtgccatttctaccatagtcacaggcccgcaaatttcgccccggagagagtgacagcggtgcactgtaaggagagcgtgtgggctggggcatattttgtgagccatcatggacattacgatctgccacacctttcccaccgcctttctgcgtaagacccttcggaagctcctgccatgcctgggagggaattgtgctctgcagtgtggccacaggcctggccatctagccctggcccactgggcttgcttctggtttgggtttaagtcaacccggtgcccatacagagctcccttgaacagtgtttgttatctattcctcacacacctggttgggccccatttcccctgagaccaaggtcagacgtggacctggagggccccagtgtgtccccagggctcctggccaggctgctgcccctcctccactgtaattagcctgttgcttcccatcccgtcgcctcacacaagtgtcttgtctccctgcctcagcactcacactgttccctctgcttgaaatacctgttcccctccaaacccccgcttcccgctgggctgctccccaccacttgtggccttcctgactaccaagccacaccccagaacccatgccctttgtgacctcctgctctgctgctggccagacctttccataaaccagcgcaacgtcctgcacgcggtgagtcttaggcgtcatacctgggtttccacatcagctccagtgcttcccagccacatgaccgtggagataagaaccaccttattggataccgatgagattaatgaggaaaactaagaatttcttgtgtggtgctgagtagaagatcagtaagaacgtttccattccttctttctggagcttcctagtaagtgctcaggatgaattttctcaccctcatttgggtgaaagagggaaaatgtatctccctgcttaatcctgtgggcctaaaccgccagaagattacgagaatattaccgagctgtgagcagagaggaaaaagctcagtaatgatttgcttgcttatttttaataaaatcctgccagaagagctgaatctttgctcctgaaaagagctctgcattgctgtggtggtatctgagagctgtccttagggcagtggggcagtgtgaccttgagaacagagctgtgtgggcaggacggccctccaataggatgcagaaggatgggggggacct

SEQ ID NO: 36827 - DNA, 3009 bp, Bovine  19866880531806
ggttgtggtaggaagaaggtgcgccatataatgtacttgctcttaagacatctgaccgaaataacacaaacagcttccactcacatttcattggagaaagcaaatcagatgtctgtgtctaactttaaagggaaggcaaagtctaatctaccatgaacctagaaaaaaaattattggagtaattttaaatgatcttaatgagaggcccattgggctatggcccattcatttgtcatccctggccaaggcccaccccagtgccccggtcccctctgtctctctttgttcttggaagaaacttccattttttcacctctattcactcctcccatattggctgtacgacttggctcctgctctctgcattgcccctaagatgaactcccaggtgtaggatccctacttttacctctgattctggtctctgccttttggcttcagcccatatagaaattggaaagaatttctgtacccacatgtcatggctggaacctaccaaagctagattagtccttgtcttcccccctttctgacagtggaggtttagatactcagaggctcagacttgcagctggaggacaaataccaaagctgtgtccaagggaagagtgccaaggctgagcaactcagccaaatctagtcaccatggaaggagccagaggcaagaaacaggatcccaagacaaggtcagggagccggggaacatgagagtgaaaaccagcagggtagacgctgcaaatagaaactccgtaaacaaggtcccatattcacacttagggttttctaattaaatctctttaatcaaagtaatacctgcacacattttacaaaatcagttggttttccaaggctttcaatgaaaattgccagttccattctctaccatggaggcaaactttcaactttttaaccttttcttttgatatatgtatcttcatatgttaataatttggttatatattcttgaattttttgttttagttttaagctatctgtttagtctagctagtgcctttctgctgtgaaataagggaaattagctctcatatgcccatatctactttcccactccctgccttccagtgttaatccatattcagtgttaacacgaggctgactatgtaaatattgccacagaggcaacagcataataagagtaagaactctggaggcagattatctgaatttgaatcctgcctccaccgctagctgtgtgtgttagactaaataatatcttctcaaagatgccaatgccctaatttccagaacctgtggctagtttactctgcatggtaaaagagactttgtagatgtgattaagtcaaggattttgactaattatcctgggttaccaggtggacccagtgtaatcatatgtcttattaagaggaaggcaggagagtcagagagagaagatgtaaggatgggagtagaagtcagagggagagaagatgcctcactgcttactttaaagatggaggaagaggccatgggccagggaacgtaggtggcctccagaagatggaaaaagcaaggaaatgaactctcccttagagcctccaaatagaacgcaggcctgcagacatcttgatttttgctcattgaaacctatttttgacctcaaggctccagaacttcaagataataaatgtatatcgctttaaacaattaagtttgtggtactttgttagagtaacaagaggaaatgaatacactgtgtgaccttcaacaaggtccttttgccaaagatttcttatctgcaaaattacttccctgatggaccagtggttaggaatccacctaccatttcaggtggcagaggttcattcctttgtacaggaagcctccacgtgccactggacaactaagctcatcctccacaagggaagccatcgcagtgagaagcccgcacactgcgactagagagtagctcttgctccccacaactagagaaagcctgcacatagcaatgaagatgcagtgcagtgacaaatgaatcaaataattttttaaagccaagaggtaaatttcaattaaaaaaaaatgagctactaagaggatcgtgcatgcatgctaagtcacttcagtggcatccgactctttgcaaccccatggactgcagccctccaggcttccctgtccatgggactctccaggcaagaatactggagtggtttgccatgccctgctctaggggatcttcccgacccagtgattgaacctgagtctcatgtctcctgcattgcaggtgggttctttaccactgagacacctgcgaagccactgtgaggattaaagttaataaatgtaaaacagttgaaacagtgcctaacacacagtaagtgctgtatgtgtatttgctattattgtttgtagctaagccaccaaaagtagtatgattttgtgccttttctttttcttgcacttattagtctgcatattcatagaagaccctcttagtcttctatgaatttatcactaactcatctgaagctataaaactgcttgttagtacagccatacatatagctgacatatccattcaattattttcttttactgagatacagttgtgtccagtggttaagattttgccttccaatgcaggaggtttggattcaatcactgttgggaagctaagagtccacgtgtcttgtggacaaaaaaccaaaacataatacagaaacaatattgtaacaaattcagtaaagacataaaaaaattttaaataaactaaaaaaaaatgtgtttttgacaagacctatttatttaatcagataaagcttaaaaaaaaaaaaatgcttaaaacaagagtagacaatcctgaaaggacatatatcttataacccaggttggaaatacatgaaggattatgaatagtgattctagttgtgcccataagtgaccctggggatggtacccccttcccactgttcacattattcatgtctctgttcaatgctccttcttcaaacagctcttaaactgttaaacctaaaacagccattc

SEQ ID NO: 36828 - DNA, 627 bp, Bovine  19866880534871
cctgcctcgaaagcacccaggcattgcgtgagccgggattcctgagcactgagtaaggccggcaactagaacgatgaggggggaagagccaccagccactggttggggtgcggtgggcaggccagcctcctctagcaggagaaccagagccccaccaccacctctcaccatgcagactcttccttacaacacaggccaggcacctgagggcttggagcctagctaatgaggatggggagaggtggtgggttgagactagggcagcctggacctggggagggttggaacagatgcctgtatgtgtggtgtcgtaagagagagacagaaagccaaaagaagaggcagtatgaaaagctttgagaaggatagctggccagaatttgcaattcatccgtgaacttcagcaacatttatggacagggtgaaaaatgagatccaaaccctaacaatgatcgcaggctgaaccctagacctggcctcaaactgaactttaaccctggccaagactcaccactaaatctgtcctcagacttacctaatcccaactccttcagcttcactgagcctaatcttggccactggccacttcaaaactgcatgtttgatctcaaaggtagaggaaaagag

SEQ ID NO: 36829 - DNA, 1319 bp, Bovine  19866880603084
cgtgacataaaatatgtgtcactatcaaaaagtttgaagacaatggtctagaggcaatcaaggtagtgagacaggggactggctctggtgacctctgctggccccacccatccctccccacctggcctttccagctgtactggctgcctaagggtttcctgccaccaaccacatagaccttgtcaccacaccctgtggcccagtgcctgggttttggggtgtggtgggggagagctggaacccaaaagagtgacttttaaaataggttcttccccagatttattttcccctggctccttctccctcttccttttccagctccttgccttgtcctccttctccctctcctgttccgagatggaaggcgaagccaaatcccgctcatcagagagtctcctcctgccacacgatacatttctccttcccaaggcccctcaccccatgctgaggagtcaaaataacctgactgaccccgcgcctgcagggccattcccacctctggcagtcggccaccagccccaagtctgcgagaaaatttatctgatctttgaacttagcacttccctggagataaacctgggcaactgctaaaggtatcagagctgctgcagagtctgagagtcaggcattcgaaggtgagcagggcagggagagggcaggaggccctggagcagagatgttgggagtcagagggactatctacgagccctttctccctcccttcatcctcagattctggcccatggccaaaatggaatgtctgaaaatctaccaagtgatcttctctttggaagtccttcaccatcaccacctccatcatcacttttataggcgacatagggtgatcccatgtctccatatgcctggaatattggggtttgcatattaataggcccttgtttgactattaagagtgttccaatatggattttaaattatctcgtcaattgttctggtctatgtaggaaaactaaagaaaactttaccaaaggtcataaagatgatcagcagttcatctggggcttgatgcaaattatatgctcctccccagatgcctcatgctcttcctaggatgcctcacttcctgcttctcactccacctgatgggaaggagagtgtagattgatgtgtgaacttgtgtgttgggatcctaaactccttacaggccttgagagctggttagagtgacctcattcaccctctaacaatcttagctagctgcagggtgcagtagaaccgagagaaatttctgaagcctcaaattcttcttcatggatgggggagttagacggaagctaagtatacccagggggaaggat

SEQ ID NO: 36830 - DNA, 1185 bp, Bovine  19866880614346
ttagtatgagttttaaagaggtgaagcaaaggtgaatgggatgaagagagaagaaatttcagaagttaaaatagatcagacctagcacgagccagttataagaaatgaaaggaaataatcccttccaccatacatgagggattggattccctcagtatggaagtaactctcaaacaatgagatgggagactatggagaaaaaggaagatgctttcttagtgcccgagaaaaaacacatgacccaaagaagaaaactagaaaacaaaacagactataataaatttgattaaaaattttaataatagtctagtaaatacaatggtaaatctattatttacctcgtcttttaaattcatgttttcaggagccatacttattgagagttgatttccatccattgatattgggaagcaggtataaaattttatcatagaatctgcagattttctatttatttctataaatgccttttaaaatagaaatgacaagaacaaaaaaaagtcttattaagttacttctccttaaaaaatttaatacttatgagtcaaatgaatttcataacttaccaaatatttttaaaataaaaaatgcattccttagaaaggtgaggcatatacactaagaacattacaactaaaaccaagaaataatgactgaactcataaagcaatactaaagaggaataacaagggacactgtagtaaatgacactaaggaaatcttatttatcttattcatcactatatccttactacctagagcagtatatagtatgtagcagacaataaacgatcatgaatcaagtaaataaactcaatgattgacaaaatatgagaaatatgaggaaagaaagaaccaaagaaatgtgtaacggttatcaagttctgttctgttattttcttaagtataaaattggagcagtgtacagtttggtttctaaaaccagcttgaacatcaggaagttcggggtttacatattgctgaagcctggcttggagaattttgagcattactttactagcgtgtgagatgagtgcaattgtgcggtagtttgagcattttttggcattgcctttctttgggattggaatgaaaactgaccttttccagtcctgtggccactgctgagttttccaaatttgctggcatattgagtgcagcactttcacagcatcatctttcagg

SEQ ID NO: 36831 - DNA, 1708 bp, Bovine  19866880654333
tggcctggagacctcttgtcctacctctcccttccttaaaggaaactggtgttttgagggtccttgctatttaaggccctcctcagtcaatggcaccccactccagtactcttgcctggagaatcccatggatggaagagcctggtgggctgcagtccatggggtcgcaaagggttggacacgactaagtgacttgactttcaattttcactttcattcattggagaaggaaatggcaacccactccagtgttcttgcctggagaatccatggggttgcacagagtcagacacgactgaagcgacttagcagcagcagcagcagcagcagttactgctgacatgagtgttcccacccacaggcagacacaacccctggaagcttagatctcctgtgggacatgattttgcttgaattcttgagtttgagattttccttgagtttgcgctgggctttgagagctagagccaagagaaaaaacccctcgccagccttcagtctctgtcaatgtccacagggctcttcaaaggtctgcaagaaccagaaacaccaccagggcagctggcttaagaggtgactccagaggctctgagtgtatggggcccggggaccctgcagtctgccttggttccatgtcttccaggagagtcccatgtcgggggctggggttgggtgtgtgagagaagactgcacttggagaacaatgagctgaggcctggacataagacataatgagcctggacataagacagccagatttgggagcactggctgtacaggcccactgtccctcgagagtgttcagagtgtttgacggtccagaggaggatgcctggtgggcagcatgtgggggagcaggaaccttaagtgaaaattagaaagactgtaaagagtcttgaacactagctaaggaccctgattttcttctcttgaagacggggaaccacacagggacaggaacgcaatccgagctatatggggaagggagccagcagagtggacaactgacctgggagggacgccttagtcagggaacgtgtccactaacctcagtccctcaaggggcaaggaccacatcatctcccttcctagctggctgggcctggaagagaagctgctggaagaatttcccacagccggcgagttcccggcacgtggctggactgtgggaggaggcactccagccaccggcatccaggcctggaggacagtcaggtctgggcactgcggggagaggagttttctatttagatagaaaacccagaggttcagttccagttcagactggctcattggtttgttctctttttaagatgccgtctttgtttatagagaggttttggatttgtttccatttgggatccagcagatgagtgtaggaattccaggctccgcttcacggatcagctcttcttggacacacgcacagtcctcctcagacggagctgtctcctgtctgtctgctccccaggatgggggtgccctgaacatgcaggggacaagggctgtcccaacaaaggcaccaagggacagaccaccatagcacctggcttgtggatcatctcacttaaatccttacattaacattgtagattgggtataatattaaccccattttacaaatggaaactgaagctcagagaggtttaagttgctctgttggcacctgcaccgctaggatttaaactcgggaacccaagtggtctga

SEQ ID NO: 36832 - DNA, 1113 bp, Bovine  19866880669459
tgtgggccagaagagcctccctgaaccaggggtaaaggggcagagagctcaggggaagaaagcagaaagaaggcagagaggagcgccagcatcctgagcccttgtggggttctaggcattcagtctgctctgtcccctgcctgagtcagcaagggacgagaaggaccaccctcatttgccagggaaaccctcccagagcacatagtggggcgcccagctctcctcagagcccttccacccttccaagctctctgaggaggaaagaagggcatgcaagtttcctgattccaggagaaccagtgcagggtgaacaagaaactgcccagggccacacacccagtgcatgggtggagctggatgcaaggcctcttggacacccagccctattctttctgccaggttacacctaagtaatcacttcacaggaagtgaggggtagaaaggagaggtgagttgagatgaggaggttcacatcccagctcaaagatgatttccaggaaggaccatgattattcacaattcagggagggagcttactgtgctggcatgcatgtgcatgcactcggacacacatgcacgctcacacacacacacacgcatcggactgcaaggagctgtgaatcacataccacattctgctcaggggaatgcaggctctgaaaaactttccaaaaacacaggagcaccagacagtcagactccaaaccagctctctgcctcccttcatcatgaacactgattctcagagcccaggaaggaagcagtggccagatggcttcctggcagtgcagacccacccccagtatccacctcatgcctggaccactggtgagcagggctgttgctggtccctctgtggatgggatgaggaaaatgaggggccatggagctgttcttcagctgccctgcagccacagagcacgtgaaccacaggcacacccgtgctcacccaccagtgcacgagcctgctgtcgttctgagatttgtggggcttttcactggcctgtgaacccaagtgactcagagctatgaggtttccagatctccctccctgtagctcaaatggcattgctgagtaatcacagagaggttacaaggatcagagccaccagt

SEQ ID NO: 36833 - DNA, 668 bp, Bovine  19866880677536
tggggccctctgggttgtcagtggagactgtggcctaaaggccccattgggcagacatcttttgtgcttggcacctgctccccttgtcctctctttttagtctgcttgcccaggtcctgagcccctgggtttccttctaatgcatgctctggcctgttctctccagttaagttgggatgaaaggttggaataaaacagccacagtccagggagcaattgtcccttggcagatagaggtgaacggaccatccctcaccccaggaggtcaatgctgtgaaccacatttccttcccagcagcatctgcccatgggcccctctctgagcctctttgtctctttcttctcagtggggctgtcaaaagctgagcctcacaggttgtgactaatcactagcagattttttttccatccaagaagaagaaaaagctgaaggagatgaagaaaaaccccaacagtgaataactcggaagagtttccaacatgtgggtgtttttctgggaccaaaaatcaggaagattccaaatgtaaacaatcccaaaatagctcagctctcccaaccccaggcattcccaggacttggatgtccacactccctcccttttccctctgggaacccaaggtcaggggagaggtggcaggatttgggcattgtgaaaaattgtttgagt

SEQ ID NO: 36834 - DNA, 1712 bp, Bovine  19866880737706
aggcctaaagggttcctgatccccttccgagaaggaagcagagaccccacccacccagcccaaacccctgtcctgacctctggcatccagaggtgtcttgccgtgcgtgatatctcaagaactttccagatacttcagatagcctcctagaatggctaggaaaaaaccttgtggacaagatgctcaaagagggggtgggggcagggggagctacctaaaagtccatcagtagaggcctggttaaataaaccctggcttatccaaatgatagactgtaatggagccataaagccgtgcggttgaagcacactcagtgatgcggatggatagtcacagtatggtggttgcaaaccactataaaccagtgaggtcatattttaaaaaatactaacatatattttatactcacatggaaaattctagagatacccaagtgccaacagtggttctttctgggtaatgggattagttagtgcctcctttatactcttccttttgctagctgttttctcagatttctataatgaacgtatattacttttgtaataagacaaaaaccaataaaagctatttttaacaataaaataaatagtcacccttgcccatctggaagtagcatgttgcctgatttggcagcaggggttagagtgggcagtgaggagtgtgaatgctggaagcacttcccgaagctgccaaccccgggaagaggcccgctggggttctgggtcacagtgggcccagagtggccgaggcgccctcgtcagtccacatggagcaacgggggtgaaccctgatgacaatgctgagaccaggatttccggatgaggcgtggcggggaaggcgaccaactcccaggcagagaccagtgtgagccagcccgcagccagctcagccctacctcacggcctttgcacttgggccgccctgggcctcgggtgctctcaccctggttttgcctgctcactctttcaggtcagccagtgtcgcatttccagagggctttgcctcaaacttgtttgaaaaatgaccccctgttatttctatctctccctccgctttatttttcctccagcattcattcattactgcctgaaatgattttttcgttctggctccctgacagagaacttttacaagggtaagaatcctgtgcttagagcagagcttgggcaggacaggtgctcaaaaaaaatgcttgctgagtgaatgaaaaaccagaaaacgtcaccatatctgagccagttccacacacaggtcacccccacctgcctgctgcctcccacagctcccacaccggggcgaggccctgggtctggtcaggacatcaccagttgtgaaaactgggaggtgtctgggcctggcaatggggtgcagagagcaaggactctgaatcgccatggctgggcacaccctccgttaacaaatgtgcggcctcccagagtcacagttttcttgtctcttatatggggctccaaacagctacctctcacaggtgtgggttaaaggcgacactatgtagcagagtgcttcagtagccaagggctcctctccgaccaacctccgacttcatcctcacccctggactgaggctggaaagacctgagtcttcctaggagtgccctgctcccccagtttgatgggaataagaaaggagaggggcatgtgcctctctgacctggtgggatagggtcccaggcatccgaggcagccgg

SEQ ID NO: 36835 - DNA, 3073 bp, Bovine  19866880787153
aggccaagccccagtgtccttccttccttggcaggaaggtgcggggagacccattcgcctggggtcagggaaacacagaagaagtcgtctgggaactcacagtcccctccctgatctgtgaagagagcctcactgagggggaccctggcctcccctaaaccagccctcggctgtttaggcccaggagcacaggcaggagggcagaacggccgggcacgcagccacgccgctggaggattccagggggctggctgcatgtggcgtgacccttgaatcgaccagatgaactccacgtgaagccctcggcggcccagagactggcccagccaggcagcagctctgcccctctggttctcatcctgaacctcacagaagccttattgttatttttaatacagatcgtttttagaaaggtgagagggaaaccggcagttcaccagtgcaagagggagaaaaaataaagctaaacatagttgctccaaaggtctgcgccagcttccgaaattacacgttctcctttgggatccgggcataatttgctgctccggttctgggagcacgttcccaccttcacggcgtcccagagactaaaaccggagcaggcggctcaaaattagcccaagccgggagccagggagcagccagccccagcaccccaccccatgcccgtggagagcaagcctcccgactcctcctgcacactagcctgcatttcccccagagcctcccaggcccatcacacacatatgagtgcatacatacacacacacacacacgcactcagtacaccatcacacacacgcagtcaacacacacactgtcaacatacacacaccgcctgccaccaagcctttgccccactcctctgcccaccaggggagaaggcaatggcaacccactccagtactcttgcctggaaaatcccatggatggaggagcctggtgggctgcagtccatggcgtggctaagagtcggaacgactgagagacttcactttcacttttcactttcatgcattggagaaggaaatggcaacccactccagtgttcttgcctggagaatcccagaggcaggagagcctggtgggctgctgtctatggggtcgcacagagtcggacacaactgaagcgacttagcagcagcagcagctgcccaccagaaaaggcctcctctccccactgctgttctaatccctctcaccagccccctcagagaagctcccctgatgatctagtccacactgaccctgcaggcccagaatcccagatcttggtgtccctgctaagtgagcattcacagctttgccatcactctcatcatctcatatggatccacagtaccaacctcctgtttctgcccaccagaggggagacttcccaagagctctctcttcctctttacccttcctcaggccacacacatccccccacccgagtccctggagactccaagaggatactcctacccatggtggtctctcagagcaacaggaaagggtcaccttgactggcggctcccatgcctggaggtgggtgatgtgggggataggcaaggggtgtcaccctgacgtgggcctcaagaccctctagggaatggcggggagccagctccaggtgtgttcctgcaccacttctcctccccttgtcatcttcagaacacaagaactagtagatgaggaggcgaagaccccaggtttgtttgaaggtaaaagtagagcctgattcagactcagaggcagatgagacaggaagagcagcctggagtaggggaggcagcggggtcagactcagaggcagagtgagacagggagagcagcctggagtgggggatgcggcggggggagaaggacaggacagaggaaatgctgggagcggttcattcacattgtcttcctggttggaggcattgtctgtctgttcattatttttctatattttcccaactgtagacaacagacatatatttataatcagagaaaaatgaatatatcctttattttgaggagcgcactagacagaatgaaacacctctgagcccctctgtgaggacacccctggcctgccctcagaaagtcagacatcaaggccacgacacttacagcagcagcactgagcttgcacacacatctgctcccgccccccacctctcatgcacacttacccacgcacatacactcacaccaccccatccccagcctacggttctgaaatctacacaaaggacagccgcacagaccgagaatacactgaggggttactatgtgagagttcatcttatcccagtcccctagagaagagtccaggaggccacgaccctcctcacccccagagatgggtgcccacttttgaaccctggaaggccaagtggacagctctgtctcatacatccatttcagatcatctccagaactggccactcttgacagaccaaaagatttctagaaacctgagaaacactcggccgtggtgggcaacccagtgacctgagcatcaggtcatcgggactttctagcatgtgcagctcatcccaggaaatgggcaatgatggggagacggttctttggccaagaaggggcgacagagcaaggagacaggagggaccaagacagaagccagatgtgctaagagagcatttggagctggggaggagccttctgctgggtccacagccccagctggtgagcacagcggaggggctgtgtcacagtgggaatggtaagctggcctggagacacaggttagacaaacaggagccagaaaagtcccagttctgctagacttcgtgttcctccagtccccagagaccagggccctccatcccacctgcagtggggaaggggacaggggacaagagcccagccagaactatgtggaaaaccactgggtctggaacccacggtgtcctgagtcagccccggtcctcccaagtcctgcatgggggatgtgcaagatggagtcagtgaaagatttctggaccagccaaatcagatcagtgatctcagagaaaagcgcgacacagaattgctttttcctgaagctgccatcagaccccatcaagacagggctccctag

SEQ ID NO: 36836 - DNA, 1390 bp, Bovine  19866880810306
ctatgcgtggggatgtgttcagcatccccctggaaggggtgaaggtgtgcctcgggcgtgtctgtggctgggtggccttggggcagagtctgagataggagcttggctacctgcagtttgttgaggcagagctctcgggtgccaagagcaagactgtggtcccaggcaagacggttttgacttgaactgtggctcagaaaggggctcaacctggagcaccacagcgctctcctcacctggaggcaagggggctgggtttgtaccaccttagccatcagtcactgactggggttgctggggtgggctagctgcataccctccccaggaagcctgttccctccagcatggccaattccgcggagaaggggcctgctgcggatgagggtgctgctagtcaaagagcctgggtgggctcagtcagcatttaccagagggcatgttcaagtgtgagcacccctgcccacagccatgcccagataccccaggatgcagacaggtgcagagcgagcttgtgtgagcacacacctgcctgcacctgcttccggggtcacccagacgctcgcgttctgcgtgcctgcctccccggaaccctcttggcctgtgtccttcctttccaggcacacgttggaattttggctcgagaactaggcctcccctccagtccaggaatagcctttggcatgacccaagtcccttctctctttggttacagagactctagagaggaaggtcactgggtcccaggagaggccaggcttttgggctgttcctggtgtcacgaaccagacagacgccactgtgcctatgagggcacccaggggacagaggcgaagtcttgccaggcgctgtgcctcgcctgccccctcaccaccggcatcgccccgcagagggacacagccagccttgggactggcgctgagctcatggccctgaggatcatctcaggtcatgagatggtgggaaggggcttctgggactccctccaagatgggaaagggcccccttggaggaagtctggggggtctctccgcactgttgtaggtctcacctcgtggagaaacaacctatgtctgggaaatgagctattcattttgcctccgaattgcagatccatttccttttttataagtcggaatatgaagaagaaaaaggaaattacaaggaaaccttgggttcacgaaatccacctagaatccaaataaacaaacaaaccaaaagccccagtgttttcatcactgctcagtctaccttcctttcttggctccttggatctccccacagcccagggagcctctgatttcctgacctgggactcttgtcattgcagaaaccgctcagaagcccctcctccaggggtccctcccaggttttcctacctgcagggtgatga

SEQ ID NO: 36837 - DNA, 774 bp, Bovine  19866880831504
tgggtgacgaggtttcctatatggggatcctgggtggggtgaggttacgggaagggtccctcaaattatgatcatcaccaacaggtatttgtcatatgtctctgttgccaagtaattgaggatgagacttgcccctccaatctgacgatggagtgaaaaatctgcaagcaagaggtgcagacagaaatcacgaagagcaacaagataggggctagagcccattgagggatggaggcagagaaacggagcaggagcaaggcggcgacagggatagacagaagtagggtcagggaaagaggagaggggcaagcagagacaggaagaggccagggcctgggtggggcagggacccagagagcacaaacaagggcaacggagaggaaggccaagcgaagccgagagaggcagaagggtagccagagcgtgggcccctccctccttggctgcctcagtgccaggctgggctctgcatcctcaaagccactcctgaaactcctgcatgttgaagcacgaaggcagaaggaaggtagccaaactggaaggcagccgaggaccagaatgccagggacgcatgcacccagaggggtggcgttgggtcaaggagaaactgccctgccctgtggcccacaccatcacacctccacttcaccccaacctagctgagggacagtccctcacccagagggcagaactgggctggatgaggagtccttctccaaggtcggccttgagtgtcttctggggacagggaaagggagggacccgacagaccat

SEQ ID NO: 36838 - DNA, 2518 bp, Bovine  19866880875187
gacctggaagtttccgtgacatgagcagttcctgggttggtagggggaccccagtgtccaaagaagaaaacacacacggaactcctcgggggcatcaggctcaaggggcagtgaagtggttgatcaggaacaggtagagcagaaagctgcaggaggccaagaaagaggggtgtcccagggccaaggccagaggggttttcagggggcgacagccagtaaagccaaaccccacagaggtcaagcaggcccctgcaacccggagacacagtgggctgacagcagcccccacctccacaaacccaacagacacagcaccccgcctcgatcaggggaagcccaggccacgttccctgtgggccgaaggccctacgcctctgttcccagctctcagtccctggtccccagctctccccactccccccacctaccggaaaaagagtccttgtccattgcaggcagatcccgggcctggtacatgtagcagcgtagatggtagcggttcccatctgcaccagagaagaaacagatgccgagtgaggggctgggggtgacaggatcaggggctggaggatggagcgcgtctctagaaagcagtggacagaggggctggacgaaagagactacacgtgccacactctcaggatcaggagagcagaccacagcccaaaggcggagccacagaacaatgtgtcctgggcctggtgagcactgggaagggggcagggaagggggaaggggtcaaatgaaccaccgtgccttgagtgctggacttcaggctcagcactgacaacatataccacacacggacacacacacgacactgacccaccaacacagacgcagttctccacagcccccacacatacacctgatcacgcaacccacacacccaggaacgtagggtgacccatccgtgtcacccctgtagatacctccaaacatcacttacagtcaaagatgcaggaaatcgtgggtctgttcacaccaaaactcaaggtggagacggacacggaatcttcactcctgtcgtccaccacgccaccctggagacacagagctggtcacagcagattctgaccccagaggctgggggtggtggggagactggctcagatagtcaggtctccaaggtcctttagacaaggctctaaagcgctaatttcactccagatcccaatgtcaagtccacagggaaaagcctctccctttctagcggagacccgacaagccagaagggggttttgagttgttccagcccaagaggttaaagttcgatagaagaagggactcaaggggctctctggggtagggtggaatccatcaggggtctgcccagggtaggggttatggggagcccacgtctggagggcctcaaacagcatctctgtcctcccctgcctggacacagggctggtgtggggacacacaggcacgcagctgggtccccagctctgcagagaagctgcgctgtgtcttctcatctcttaccagttcccactgtgctgagggtcagaggagcctgaggctggggacaagggcatggggggggggtgggcatctacactcaggctcagaagctctgcatcaacctagatgctcagtccccgcccctgtcctcgttggccactgggccataaatcgccttcccggtgccctgcatccctccaccaccgcctctgccacatggcaccccctcatcgaggatgagccccagcaggagtcaaggcccccggaaaaaacaggaactgtgccaatcacacggcagcccgcccttccagacctggccttctaggacataagttccaccagcctctcatggcaggagcccagcagaagggccagggagagctggacagccttcctctgccatccctctgcatggcccttcccctctcctcacactgtcatctgctccagtccctctttccaaaacccaagcacgcccacccttgaaagaaaacccagcctcccttcccatggcctttttcaccccacccaggcccacccagcgtagccactccccaaggcctttctgctgggctacactgccctctacccagcagcagccagttcccaggaatctccacctctccccaggccctgcagttacacccccaccccccaccccaacccacacctccaaatacaagaggcgcggccactgacatgctcctcctctccaaaccgtgcccaccctcagggcctagctccaggcccctggtccaagaagcctccctggacacctgtccccttcaatcatgtcctaccctttgtgaccccatggactgtagcccaccaggctcctctgtccatggaatcctccgggcaagaatactggagtgagttgccatttccttctccaggggatcttcctgactcgacccagggatcaaacctgggtctcctacaggagacccagaatctacactgcagccagattctttaccatctaagccaccagggaagcgccaagtatctgtgagtgtgggagagttctacagtgtgtctcataggctgc

SEQ ID NO: 36839 - DNA, 1419 bp, Bovine  19866880907623
tctgtagcgggaatctccctgtcccaggctccgggcttaaaattcagattccccattgccatcacctcttccagcaccttctgtaagctcttcttcttataaattctccccaccctccaaagcccaccacttccaggaagcccttccagactgctctcagctctgaggctctccaagttcttctgccagataaagcatctaagtgctctcagtactattctgtggttcatgcaatctctttgattagtagcagtagctaaagcattagcaataacagagaacacatttaaatcaagagccaggtactgttcttcatagatattaaaggtttgatccttaaagtaaccctaacaggtaagtgctattattagccccatttcacaggtgatagacatgaagcagcagacagtcacacctgggcagggggtggctgagatcacaccctcattaggaaaggtgtgtaactgggcgtgaatacccgccctcccctgcatgcttccacgtgtagctctacctgtcagggggtgggtcacgaactggtactgtggatggagtgtttctaaccctaagaaggctggctgatcagccagcaatgtgaacttggagctcccatgacagagacctgactgggagtaggagggtccacctgtgtctatacacatgtacacacacaggtatgtgcactcaggtgtgcccatgttcaccagcacagattctaacaccgtgtacacacacacgcgcgttcatccgtcaaacccgccctacccactttaataggtgccactaaggaagcagcctagtactgcaggaggaccactgggccgggaacctggttcttcctctaaagggctgggtgactttgggcaggttgtcaacccctcttggtctgaacggcctcatctgcaaaaacaggcagaattctggctttctggctttcttttcctatgaatttatgaccatgagccctggtccctgtgcttaagctgctcacagactagcagaaggaaatgagaccacccctaaaacagatgcgagttctacaggaaaagagaacgggggtggggtcagggcctaatggaaaggagcctgactcagccatgaccttggagaaccagagaaacagaagaggggtgggctggggatgggggagccaaagcctccttccccttttacaacctcaccaccagctctgacatcaaacatcgctgaaagcagcaggaggcgaggggccagctgggcctgtaaacacctccggggagtctgagctgctccgggtgggccgtgcaggcctgtgagcatctcagacacgcagggagcacacggcggcaccctaggcatgagcattagacagacccaaagcgtcaggcaagacgagggctacagggcttcctgccaccctctggatgcaccatgtgcagg

SEQ ID NO: 36840 - DNA, 853 bp, Bovine  19866880912755
gatggatgctgtccacattctttggctcatggctgcgacgttgcagtctttattttgattgtcattctaccttcttttatttcatctgttcctttcagtccaagctggtagtgtctctgctggcatcacattctcaagatcctctcttgggtgatccagcctaggctttcctctcctcctgtcaggcctgcagcttgaaccctgctgaccttgactgcctgttttggataatagatctgtaactcagccttctgccctcccctccaggagcctggcctagagacccctcttcttaagagaagatgagctcctccccagggctagtgactgagacatgtagaaacgatgttggccagcacagcccaccttggagatgctggaagtcagggccaagattctagacctgaaccacactgcccacaggcaactccacactttacaggcagaggcaggacccggatgctggccattatgcttacaacagccctatagggtaggcattgccattactggtttatgaatgaggaacttgaggttagagaggaaacagaggcttcactgaggtcacataactagtaaaaaacagtttgcccctccagaaccacccctccctgccagaagtacaaggtgtcctgctgagatgtcactgtctctagccccagtaccatccttacacccgggagagaaagaccctgtccttgaagtgcatttcttaaaacttttagatcctcttctgtggttaggacagacaaggtctggcactgccatctgagtggggcaccctgagttttaacctggacctgtgtgggccccaggcctttctcctccctcaactgccctccaaccctctacc

SEQ ID NO: 36841 - DNA, 777 bp, Bovine  19866881021346
cccaccattacttctgaaaataccaccataccctccaccatcatttcattgccacgagcaccatcaactccactgttaccagttccatgattttcaccaaaattttcattatctcctcaggtactgtattatcacctccagaaatttcatttaaattatacatttagtatattcttccttttgggttacaacagtgatttttgagtacacagaaaaggagtaatatctacatttcaacacacagaattctctgcgtgggtggaggggtagaaaagaacatactggtttctccagctcaagctacatacataggaaggggtggggtggaaagggaacattcattgagccctttctaggtaatagacatcatactaggcacacgagttagaggattttctctggtaagaatcactgccctagttttacaaggaggaaactgagattcccagatgctaaataacatactcaaggccacacaattaataagtgttggagccaagattccaaccctgtgtgacttcaaagtccatattctttccattacactatgctggcaagaaatctcaagagcttggtttaagcacaatgggttatgactctgagtaaagaaagccattgtcatggtccctgatctcagggagatctgatctgatgaggcaggaagacgcccctctctcagaaagaagactgttattaatgaacaagattaaatcccagattcacagagcctatgctttgcctaggctcactcaaacaattcttcacaatgcccaaatc

SEQ ID NO: 36842 - DNA, 1319 bp, Bovine  19866881091311
ttggtaatgaggcgtttcgagtaatgtgattgattatgggcatgcaagcaaatatggctacacagaagatccacttgaagtacgtatttatgatcctgaaattccaaccgatgaggtcgaggatgagtttcggtcacagccaagcatttctgcatctgttcctgctccaaatgtgatgtgtaattctgtgtttcctgttgaagatgtgtttcgacagatggacttccccagtgagtcctccagtaatcagtcctttttcccagttgagagtggaagcaagatgtcaggtttacacatttcaagaggacagtcagtccttgaacctgtaaaatctgtcagccaatccattagccagacagttaatcagacaatgagtcagtctctgattcctcctcctatgaaccagcaacctttttcatcggaattaatttcaactgtaagccaacaagagcggatcccacgtgaacctgtcattaattcgtctaatgtacatggatcgggaggaagtaaaaagaattaccagtcagaggctgacatccccattcggtctccctttgggattgtgaaagcatcctggctaccaaagttttcgcatgctgatgcccagaagatgaagagacttccaactccttctatgatgaatgattattatgcagcatctccaagaatatttccacatttgtgttctctgtgtaacgtagaatgtagtcatttgaaggtgagtgtttttaaagatcactgtatcatgataactcagtgcccaagtttcatctaaattctcatatgtatgctggtgttaactagtcattaaggaaatggcagaaattgtgattgcaatgtcagtgcttagttgtaatcttaagtagcctggcctaagtattgaattgagtgttaggctttctgtattcctgtgactgggcacaccacatggatttttccatttattttgaacttttgagaggttatcccagagaatgcaacataaaaatttatatgacacaaactgtatttataagacaatgtcacatgagttacctttatctgaataagagaatctgttagtaaaaaataaaaatttggaataaaatatttgtactgcacacttttaaagagccagtatattttagctttgcatgtatcttacctgttttgagctaaagatagttaatgttgatttaaatatttttgactctatgattcttacctggatttttagtgcttcatgagaaggagcttcttaagataactaaatccatagcatagcaaaattgagtcagaatgaattattgggaccagctgtgggctcagagcatagagtg

SEQ ID NO: 36843 - DNA, 1867 bp, Bovine  19866881146710
tggaacgatgttggccattagctgctaataacttaatggagtataattaataaaaatactgaatcactgaaactaatataatattgtaaagcagtacttcaactttttaaaaatttgattttgcacaagagttggccttttttttttgtttcatttctgagtgctgtgaacttgttaactataattataaatctcatttaacgccttctccctgcctcttaacagcattcaagatgaactggcatcaaagtttacttctttaacaaaagtactttatgactttaataaagtactagagaatgacaggaaacatgggagtcctttaaaaaaattgatgataaataatttcgatgatgagcagatttggcaacagttggaactgcaaaatgaaccaattttacagcacttccagagtgcagttagtgaaaccattgaagatgaagacatcagtcttctcccagagagtgaagagcaggagtgtgaagaggatatgatggagctggaggctgctggccaggaggacctggaacaagatttagaggaggaggaggtggaggaagcagaggaggtggaagtgtcagacctgagtggtgatgatcctgaagcagatgagagagccaaaaactcaagcaaattggatctgaggaaaagcccagatttcagcgatgaggactctgatcttgattttgatatcagcaaactggaacgtcagagcaaggtgcaaagcagagtgcctaggaaaccaatgagaagtccatagtagatgataaattcttcaagctctctgagatggagacctttttagaaaacatggaaaaagaagaggaacaaagagatgaccaagaggaaggatgatattgatttttttgaagatgtggattccgatgaagatggaggagtactgtttggaggccaggatcttaagtcaggtaaaagttccagaaacctgaaatacaaagatttctttgatccagttgaaagtgatgaagacgtagcaagtgtccacgatgatgggaatgaactggcttcaaatgaagaggaagagattgctgaaggagaagaaagcatttctgagacggatgaagatgatgaccttgaagaaagtggagacagtaaacaacataaagaaacctcgaaaagagtgacctttgctctgcccaatgatgaggacactgaagatacaaatgtcttaaatgtacagaaagactctgatgaagtaaaatcctcttttgaaaaaagacaagaaaagatgaatgaaaaaattgcatctttggaaaaagagttgttggagaagaaaccttggcagcttcaaggagaagtgacagcgcagaagcagcccgagaacagcctcctggaagagaccctgcacttcgaccacgccctgcgcgtggcacctgtggtcacagaggaaaccactctccaactagaggatatcattaagcagaggataaaagatcaggcttgggatgatgtcgtacgcaaagaaaagcctaaagaggatgcatttgagtataaaaagcgtttaacactggaccacgaaaagagtaaattgagccttgctgaaatttacgaacaggagtacatcaaactcaaccagcaaaaaacagcagaggaagaaaatccagagcatgtagaaatccagaagatgatggactccctcttcttaaagttggatgtgctctcaaacttccacttcatccccaagccacctgttccagaaattaaagtggtatcaaatctgcccgctgtcaccatggaggaggttgcccctgtgagtgtcagtgacgcagccctcctggccccagaggaggtcaaggagaaaaataaagctggagacataaaaacagctgctgagaaaacagctaca

SEQ ID NO: 36844 - DNA, 616 bp, Bovine  19866881192262
tactggagtgggttcctatttccttctccaggggaccttcttgacccatgaattgaaccctggtctcctgcattgcaggcagattctttaccagttgagccatcagggaagacccctgttggtttctaaataccattctctgatcaaaggaaccaagaccctttggagaaatggctgattccagggctgaagcagcaaaatatgagatgattctggactatcttgtgctctgtgttctgtgttcctttatgtaatgatcagtcaggtgcggccacaagaggaggcacaagagaagcttgggaaaacaaaatatattatactcacagtcctcgaaacaggatgccatacagtgccatacggaagagacaccagggtggtcaggagccaaaagaggcaagagtgaggagaggggcctaggccaccactggtggaaattcaagggcaaggcaaggcaggcagggtaagcaagctaggattggctagcttgaataatatcagcaggctccaagctatagggtattcccgagctgcctggcacctggccctgggatgatgaagatggaggaataatgtctcctgggccctccagggccctccagggccagataagggacat

SEQ ID NO: 36845 - DNA, 1354 bp, Bovine  19866881232089
taagcagggtcccttttctgcagtctatttagtgccacatttttcacattttctgtacctttcatcagtgattctgcagtttaaaatgccctccgagtggagtgctgaggtactggtgttcctaagctcaagaatgttgtgatggttctcaggaaggaaatacatgtgttagatactctttattaaggcatgagttacactgctggttggtcataagtttagtgttaatggatcaacggcgtatgttaaacaataaaaacacacataaaacaagtttctgtgttgatcagctgatgaaaaagtgatcagaggctcacagaaagccctactctgtatttctccttgaagcaaaggttcattgtttgctaatctactgttcatggcaactttatagaatataactattgcaaataatgagaactgactatgtatcctcagactggcttccatatacagttgagtagaaatggaaatagcgtcccctagagttactcagtgcacagcatgcccaaccatacggagcagcaccgcccttgagatatgatctagttggaatggatattaccgaaaaacaaaatagaaactcctatccttaacataccccaaattttaaaaacttttagaattagtcagtgctcaggatgaaacgactgtctatggggtgtctatgaaatgactgtccttgacatggtctacccatctggaagcctgactgtctcctggaatgcctttcctccattcctcttatgcttacatcggcattctgaatcttacgagaaactgcccaagtgtttctaagtttcttgctcagatcagtttgtaactgtcattaataattgcagatggtgcccccgtgagaaagttcgccacaaatccactgcagaaacacagggcagtaacagtaaataattcatgcatgcacttgcaatactaagaagatatactgggagagttattgaaagaagagagaacacaaaagcagggaaaatgaaaagagaaaaatcaggaagaaagagaatgaaagagaaagactgagtataaaatagtaagagttttagaaataaatggcacttgagaaaggcatcagcaacatagatcaaaatttgtttctatttgtgagcgtgggcgggggcttttggcttttacaatatgctttgttactggagggctaaaatatatagtcagcctaatcacactgctcatggtgtaacaatttcatacaaataaaccctgccagcatgcaactgtcctttgaggatgtcaaaatttggataaaaaagatcatgctccttaaactctgaactcagacatgagggctcaaatcccattcataccacgaagctacaaaggttca

SEQ ID NO: 36846 - DNA, 1390 bp, Bovine  19866881273712
gcttgctattctcaaacatctgtagtctgtgtgaagaaaagttctcaaaaattttattacaaaactgaacccatgacagaatataagcttacacatgtaaatagtatttacattatatgcaaaacatattacagctttaatttatgaaccgatatatcctggtttttcttctttttcttctcggttttctttgcattgctgatttgcattttcacttgatcttgtaatttagaaaagaatgcctgagatgattttaaggctttgtctttaccttcatcctgcaattagaaataacataaggtcatgctgtaaggtattatgcttaaagatgaacaaaaacaaatgactacaacagggcatcacagtgtaaatgtggaaaagaactagacagaattatgagagcctgcgccaattagagcagaagtattatacacattttatacgactacagtggtctcacaacgtcaggtgaccatgagcccctgcacttgaaatccaaggtttgggctgtaacacagccagtgcccacagaggcctcttccctcccctcccatccctttccctctgtgggtgagcttggtcactagatgcccaggtcacctaaagtgtgccactggccctgtattcaagccccctgacacctctcctccccgtcctcaccttgagcagagaggcttttcctgtcttggtcagctgtttcagcttctcagaggctactgctttggtgtatctccctgcctggtctgggttattcttttcaagaagtcttctccgcttttctttctcctttattttcaaatgcttttgatatttctttttcctcctttctcgtttcttgtctgtagctgttttctcagcagctgtttttatatctccagctttatttttctcctattgaaaaaccaccaacaacacactcattaatctaatctaatgacttcggaaactgtaagagaagcaactgcatgaactgtggcccacgtgtgagaagcagcctgacccgacccaggctgaggggctctgaccactcagcgatgtaagacctgggaagcactataagacccgggaagcactgtaagacccgggaagcactgtaagacccgcgacgtgtgctctgcatactccttcacaaaggtggcctggagagcatgagtgtcagccttcccctcttggagaagcaggcagaccccatcctgggttccagggacctgcctacggctgcccagctctgagccgttgagggcaggaaatctagctggtgaaggtccacttcctcccttttctcctctactccagcccagcctagggtaggaggcagaggctctgaagggtgggtgtgggtggagcaaaacaagtaagcacaaaaatggagggctctgctgccaggctg

SEQ ID NO: 36847 - DNA, 767 bp, Bovine  19866881402013
tggaaggtttgtagagtttatagaactttactatgtaagttacagaaatacaattcaaatgtaaaaaatactgtacaaacaaaatctttttttttaacatcacctcactgaagtgctaaagcaatgaatggccaactatggcctgccatctgtttttttgtaaataagtttttttgaacacagccatgcgtattcatttatatatcatctataactgttaagtactacaacagagttgtatagctgagcaaaatagttgaaatcctatgacatgccacacctaaaatattatctggcccttcaaagaaaagtgtactcgtctaaaaaaacagtgtgctgttgtaaaggatataaagcagtatctaggaaccctgttcattcaattccaaacatttacataactcaagtaacagttgtatatggagtaaaagctgaaagatctgacaagtctttataaaacaaaattatgactttttagaacagactaaataactcacttcctttctgtatggaacaatcaggacatcattaacctttccaaatggttgaaatatttttctaatttcttcttcactacagccatcttctggtaattcagatatcagaagaacaggaccataatgtgaagactggtccttccgaagctatttttgagatgaatgaaaattaaaccaaattaagtgacaaagtatagttacaataattcccaatataatttttctaccatttatcctagtacattaagcaatcttttttactaaaatatt

SEQ ID NO: 36848 - DNA, 1144 bp, Bovine  19866881460710
cttttcatgcccctcaaaaccataaagacatatgcccacagccagccaccatgttgattctgccgaactctacactctcatgacaaaaagaatcacttaattatttccacaagtggagcactgggccttcagcctcttgttgacactccctgcagttctgcctccatgtctgtcgagggatcattactctgcttactctgacttcaagctggaccagcagaagtgggagggaaaggaagacctttaaccaaaatgctgaattgcttccaaaaggcccagtgaaaaagtgtgcccgaaatctggcagtcaagcagatggtgaacagaaaagggtcaggacctgacaatttgactattggcctgttccagatggagggcccaagtgaggtgggagacttgtgggaaatgtctttccaaattcagaagcctaaggtatgtatgtgagcccatgacttagtcctccaaggacaacatcaccccataacccatgtagaaagcccaaacaaatggaatctacccagtagggtgaatgaaagacaatcagagtcttcaaacctgtgaagaaaacaatgagacacggctaactcagaatctgtgatgattccaacaaggcctgggcaaaagcttgtcttaccttcattctgcttatgtagacagttttgcttaacaaaagttccaaccagctacttaagagaaaaactatttttgaaggccttcccagggctgcagaagcattcatcaaactacagacactaatcttagctatcttaaattcaattttaaaagtattttgggggagcctactatgtgccaaagtcaacctgctttctagttactgtgtgagttttcatacacaaagtcatatcactttccaaatattctatattttgaacttgctgctaattcaagctggtttcccatgcctccgtgaacgtaagagaggtgctcacgtcactgggcaggttgataagctcctttggggcacttgtactcagcggtgagcactgaaccaacttccaagcgctgtttggacccaggctggggagtaggagggggcaggggatgatgacaggcccatcaggggggaggaaggcattaaattagacctcagagagaacttcctgtcctgtagatttcaaggaaag

SEQ ID NO: 36849 - DNA, 815 bp, Bovine  19866882016118
gacaaatggagataaccctcccttgggaaggtgaggccatgatagagaccctcttgggagggaggaggagatgggtctgaagcacctcgtctaggtgggcttgtcttatcccagtcaggaggattctggaacacttggagggcctgggtacctgtaggggggttggggggaaaccagactggagaatctgggaagcaggtgctgggggcacaatgaagacatggtgggcatcaatgctggagtctatagaggctgctaaggagctggaggtgagagaaaaccgcaataaaaggcagcctgggaccctctcagttcccatcctcataggatggcggaggagaaaggagagggtggggagggccaaaggcaatccctagacgtagagagctttgactcaagggtcaagggaacagctgggaaagccactggcacatctggccaggctgggctggaggagggttagcctgtgcaggcaggaagccagagactggtggagagagatagggccggtgtttattgccctgccggctgaggtgttgcaacaggaagagggctggggggaggaggaggcggctcaggcggaaacaatttatctggagcacgaggaacagctggggagggaggccagctctgctgctctccaaggccaagtgagatgcgaggaacggatgcctggtgccagcgcagccagcagtccctggctcctgccccctgcttccccgctgccctggaatccagcccctcggtcctcagcagggtcatccgtcagccgttgcccagtcctcatcccctgctctgctgcctttcccagtagg

SEQ ID NO: 36850 - DNA, 733 bp, Bovine  19866882124401
ggcttaagctatttagatggggaggatggatattaataaaatgagagaaggtttggggtacatcagagtggaccccaaagaagggaatccccagtcactgttggtagcccaggctctgagcctgagaaatggagggccccgcccctgctctgcattgcccagttggttaggaagcagagagaggaagctggtagccaggaaaacatcttggaccatttttttccactggtgaatcagaggagagtggtaatgggagccaggctgacctgaccccagtcacctccatgagtcatagctgaggtccctgtgctaatcttaacccctcaaagaggacttgttgggacttgccatcgagacttgaccgccaaaatactcttggagctgatgtcaccttgggaaggcctggcccactctggcagggttggaaccagagttgggaggggctggttagagtgttagattctgcctccggctcacctgtgaccttgaccaggtctctgtgaggagttcaactcccacggctcccagctctgacattcccccagagctcagctgagctgggatctgagagggccagcaggaagccttcaggccaagtctggccctgtcctcatcatcagcaattgcccactgaggacctgactcctaaagatgggcagcaagttacggcccatcctgggtggggggcccagccgctctccaaatttgttgtgcaactttggaccaattgctt

SEQ ID NO: 36851 - DNA, 773 bp, Bovine  19866880446479
ctggacgggaggccccgctcccagccgggcccgcccactgcgccggccctggcttcggggccttgggtgccctgagcctcaaagaggaagacaaattcagttactgtgggttttgctgccaggcgccagcacgcagtgggggacttggaactgtgctcaagagccaagggcgaaaggggcggaggagggaggggcaggcaggcaacctggggctcctggacccctgctgctgtcactgatcccaggcctcggggaggggtctggggcagagagcagcccacataggccgggtgagacagacacccagtcctggctgccgcctgaagccagagtggcctcccgtgtttcccgcgttcttggctttggtcttaccacctatagaatggaaacagtttggccatcgaccctgggcagtcctgcccacaaggaagccagagttcaggaaggtgtagaggagtggatggtgggcgtggggtgaccaggctgggtccccagccccacacctggccctctgcaccagtcactcactgtacccctgcctgtcgacccccctagcatccttggcatgcatctctttggctgcaaattcagtctgaaaacagataccggagacacaatccccgaccggaagaactttgattccctactgtgggccatcgtcaccgtgttccaggtacagctgggcaggccgtcccctgctgtgcacgggtgggttcctggagggccatagccctgctcagagctggctgaggcccctccgaggccactggggg

SEQ ID NO: 36852 - DNA, 1243 bp, Bovine  19866880489199
cacgcaccgcggggctggccggcactcactgatccacaggtggatgtgatacaggaagaagcggcccagcacctggtccagcgcccggttcatcttgagcccggcgggcgcacccatcaaccactgcagcagatgctggagctcctcggccacacgctgcaaggatgggggtgtcacccggtgacccacctggggaccctacatgagcctgggggttcaagctcatcaggggcccacgagctgggcaggggtggggtagctgaagggtcccacggagggaagaatgacgaggggtaagggtctggcacggggcctcacaaggagcgagtaagccgactcccatcctggccaccccaggaggaacacggtgcaagcacggcaggcgggccctcaggcctgggcctcggtacccatggggggccacaggcgccctgtccctgccctgtctgccagcccctcctgcctgcacacaggcctctcccagccctgggtgatggcctctgctgcgtctggggcagtgagaagggaacagaatgttctttataaatagagcttatttaatatttaaagggtaagagcttggcagcaggaagaagctttcatttttaaattaaatatttatatttctgagcaatcctgcagaaaagaggcctaggataaaactggccgaaaggcaaagcgaggatgaaacgggtggagtggccgagccccctcccagcccccaggtcccccctcctccctcctgggccagcctcccttagaagctacgggacttggcctgcgggctcctgccctgtggggtcctggccaccagcaggcccagtgcccacctgtgactggagactaatgatagcaggagtggctgagcccacaaggatgctacagtcagatctcagcggcttgaccacacccagggccgagagggccccagaggcctgggaggggtgctgaggggctgccctgggcaaaaagacaagctcccgatacaagtgctgagacggcagagagaactcagagcctgtgtggacggacagcaggcaggcggccatggctgggagaggaagccggggcttctggccctcagtgcgggagccacagaaccggcgggagggtggcagacgggaggctgagtgcaccacagagagcagcctggaggcacggggtctccgtgacgctgacccgctgaccgtgcacaggcctgggctgatggccaggagagcagaaacgactgtgcacagcgggg

SEQ ID NO: 36853 - DNA, 1411 bp, Bovine  19866880747565
ctgtctgagtgaggacggcgtgcaggggatgttgtcagagagcaagtgtgttgtgctgaaaggctgcatctccatcagccctccccacagggtgtccctgagcggaaagcagtaaactgggctccctagctggaggaggaggtttcccttggtggcagcgaggggcacggaggtccaggagccgcgctacagccccatggcctcccatgtggccagttctctcggcagagtcagctgcggcaagttttgtgtggtggttagacagcttcccggcagaatccccggagaattctaaatttcagttgcactctctaaattttcattaagagctttcacccagagaaaatgatggattagattttatcactggaaagaagccagataaaattagctgccttttagtccccacggcacccccctcactccctgcttttctttaaagtccctgcttttctctctcggttcccaggaaacaggtgcctgcggatgtttattcgttgaaaatactgatgttggaggctgcctttgagcctctctgcttttgttccttcagtgattttgcttttactccaatctcctcaagtctgggacagctttgggccttgggctctgcattggagagtgtgtggtttctttcttctcctcagtaaagcttgtttgttgttagaactttatagccgaaagctgtagaatatttttgctgcacgaaagaaattccttgtctgtcttttcttttctctcccaaattctccttcttggcaaagttaacctgtgtctcatccatcaaagtgcagttaggagtttgcctcccaacagccacttttagcaaagctagcttctgagaggtgactgtcttttgttaccatgtgtggatggtgaattgtgaaaacagctgttatttcttcccacatcagtacaaggaagtcagattattctgcacaaaaactcaggcttagatcagtctggaggagctgaaaccatcggggaagccgggggcgaggacattggagttattcatgcgggtgtgggttcctttaaattccacgtgcttttggcttctttagcacaggcactaaaactgaaacaataatgagcatggcccctgcccaaggatggggattcctaggtggctcagtggtaaagaatctgtctgccaatacaagagacgcaggagacagaggtttgatccttgggttgggaagatcactggagaaggaaatggcagccggctccagtattcttgccgggaaaattctgtagactgtggagcctggtgggctacattctgtggggttacaaagagtcagacacaactaagcacatagtgtgtttgtgtgtgtgtcccgtgtgtgcacatgctcaaggataacatgcaaataaacgcatgaagcatctgtatcttttcatgatt

SEQ ID NO: 36854 - DNA, 799 bp, Bovine  19866880771305
agcgagtgcagcttgggcagggggatggcaccgatgtcgccgcagccgctcagcccggggagcgcggaggccaagccccggccctccagctcctcctgcagccgtcgatattgcgcctccacctcctccttcttctgcagcgccagctgccgggcactgtcggccgcaagcgcccgctccttagcctccttggcctcccgctgccatgcgtcgcaggcctgaaacccaggagccgaggtgaccctgcggagccggctccccgccccacgccctgctcagccccgcgccccgccccgtgggccccgccccctgccccgcccgcccgcaccgtggcccgccgcagctcacctgcttcacctgctgccaggactcctcccactgccggatcttcctcttggcctcatccagctgcctccggacccgggccagctcggcgctgctgggactcacgcctgaggaggccgcgggcccggcgttcaggattggggatgggctgggagagaagctgccagagacgaagtcccagatgctgccggggacgccgttcaagcctgagtgtggaggagctggcgtcagcctgctcgagcttgggcctcttgggcatccccccagccagctctggggaccccagccctgccccccgacaaggacgcctgcgccatcactcgccccaagagctgtgtcgtgggggccgcggagctcagagcctggtcccagaaccctgtccacacttaggacctggaggaccccacagggtttctggttacctgagtgacatctattgacgtatgtgacatca

SEQ ID NO: 36855 - DNA, 1861 bp, Bovine  19866880787528
tgaggtgttggtgtgcacacatggcagggcccactcctggcactggtcacagcccacaggctggccactgggggcctggcctctgctaccacaggcccaagcaccctgaatgccagtcccagcccagggcccctccaagactgaagagatgagggtgtggggcctcctgtacccctgggaccagcccttggcaggctgggctgggccatggggggcacacctgctctggggagggtggggggcttccggggctgcagctgttagtccctgggacagacacagcctccccagcaacagctgggccggaggttggacagccaggagagcagagcccaggctgcccccggcccccctgggggttggttacagcggctgcagatgcttggagacgatggggcggggtggaggaggggagcaccctgcccagtccccaggtgcgacaccaggactcccctgggtgggggtcagcatggacgtggctgtccaccccctcccatggcccagggatcttgccacccacttgaaactatccctcggcctcccgtgctccaggtctgaatctctgatcagcagccatctgcagcccaggatgtaggaagacccctttccactaaccctctgggcagcacatgggatcccccaccctctccccaaggctgagtggaggtgggcagggcagggggcaagatggaggctgggggcctcggtggggcaagcctggcggataggggtgagaggggctgccccgcgtcggggccacagggtcattgtgggtgccccagaacatggcaggaccccatcggctctccaggtgtcagcggcccaggcttgtccttcactcctgcagtgcctggtctcacttcccatgcctgagattcgggggtccccaagcaagggacaatgggtctcaccccaggcctgggagcagactagataccaagctccagccgaggagctgccataacgctgggcccttctctctgagccatgtaggtcctgaggtccccatcatgactgtgggctgaagcctccccactggccaccttgtctcggagggacagtacccagatctccgccttctggtccgaggtggccagggtgctcagactcctgcttaagtgtttccaggcctttctgctaacacatgaatctgcaggcccccaagacccagccctgccgtgaggacaggtccactctgcccagaggcccagggtctgcacagcctgcccaccctggatcccctggcctctccgggccctggggctgtctgccggcctgcctggcctcagtccctgccagccagttcagcaaaggacaggccaatcgtcagggccaaggactccctggcctggccaagtggggccggttttcaggactcggggattttgaaccagctgctgtggcaggtgtggccggcccagctgagcagaggcaccggccgcccggagagttgccagccagctgctggagggtgcggggcagccaggctggcccctcgcccgggcagcaaagccaacagagggcggacgggggtggcaggaggcccccacagcccgcagggttcactgctgccccaccggagcagggaccgcaaccggcttctctgggccctgcggacggctggcggtcggctggcctgaaacccccggttttcaatccagggtgggaaatcttcatcgtccatcagaaaagaggcgccgcaagcagagacccgtgccccagccccacgtctcagcctcggtcgcagggccctgaggcgctggggctgcgtcaggagcatttgtgagctgctcacacctcccagtggccactgccagctttgttcgcagggattcacagaggctgaagggtgccgggggga

SEQ ID NO: 36856 - DNA, 1813 bp, Bovine  19866880789250
cgagcaggggccagaggctgaggtcacaggctagtcagcttcactccccgccacacgtgagccccctgaagcacaagcacaggagtcactgcgttgcatgagcccaaaggacagaaagcctggttgtgtgtgagcatggcagggctcccgctaagcagggaactatagggttaaactaacaaaaggctgagagcccacaaagactcagagcccacatccaggacagcctggtgagcacacagccacctctcccacggctgcctccacagggaccctgtcttgcccacaccaagccccccttggctggatgacatgcatccaagacttaaaggatgaacaagggtctcagatctctcaaagctcgagcatctggactggcaccaccccggctggtgctcacaacaaaaagggccgcctgtgtctggacatcacagtaccaaggacgcaccaggcatgtgcggacgcgggcggggctgggtgaccacagcagtgcggggacccggtgcctaggggagctcagagacccacagccaaggcagggaagtgcagcatctgcccgccgtctgctcggtgtagctgatgcttgtaagactcaacaagagcacaggatccctcacccatttggtgctgtgacccccaaagccgatgacccccttgagcctcaggatcggatctgggaggaagctctgaaacaggtagacgcacagtgagatccagggggcaaggtccctgtcgcagcagggctaccccgcccagagccagttccggcctctcaagaaagccatccagtcctgagctccggccagccactctgcggcaggaagccaggactgcagtcacaatgctggatcctccaggtgccccagtcctgcggaccccccacagaccactggggctgggggcagggcaccagctctcttactctttgttgaaaacgcttcttgcccaaagctgcctccggtaagctctgcttcctgccaggagactggatgggaagggaccatcagaggggaccacccgccccttgcctattccccgcaggcagtagcccgacagccctccatccactactcatccacatgcaaccccctcgggggtgcagtccagccccaccttcctcgggaaaggccctcacctcatgcggagctgcatcctctggggccgcgggctccaccgtcggctgaccggccgacacgtgaaggccgtcaccagctgcatgctcgtcagtggcctccgcccaggctgagggctcctgggtacagccaccagggccagccacacgggagacctctgagcgctcacaggacatgctgacctccggaaggggcctgggcatggagggggcccagcgggactgcaggaggacaagtgcccatgagcaccacaccttagaccagcacccacagccccacctccaagggcgccgggcactcacggctgcggggtcatgcttctggaccatgagggccctgctgtcccgcgcaggcttgctgcaggccactggggaagggagcagccgtggcacgtgccccactaagactgcagcggagaagaaccgactgagcagagtgcagacaggcacaaggcactgggcaggggcggcagggggcctggccttgccccctctgcaggagaggggccacgccgacagcagcagcccacctagcaggggccccaacacccatcccagcagcaaagtttgaggccccaagcactcaagtcacagcctcccgctgctccagagcctcaaggccacctccctgcgcccttacaggcaccacactgctggggtccccagatgcagcatcaggac

SEQ ID NO: 36857 - DNA, 1093 bp, Bovine  19866880802543
cccttggaggggtgggggctggagacaccaagatggttcccacaaccgagagccacgtggtgccaggaagctgccacccagtggcacactccaggggtgcccaccatcaacactggcctggaaggctcctggccagcctgacctagggagacccagggtgctggagggaccagccctcccagagaccccatcagggagacagtcacatctatcagctctcgcgggaagcctgaacaacctctggttccccttcacctgcacagcgccccaccccgttcccaggtggactctggcctggcccacctatgagcctgtaccttaggaaacatggcaattttcctcccttgacgagaagtccactgactccctcccgccgccccacatacaccttgcatcttctccaggagccaaaaatgcagctgcagattgatttgcagctgagctaaaaataaccgccaggctccagccagggcccgggaaaatatcccattgctaggagacaacgttactgggaaaccgccattgctaggcaacagggttgcttggtgacagctgggccctgagtcatactcagccctggccactccaccccccgcaccccctcccctgccttggtgagtcgggcctgggtcccaggaggagggaaggcagggagcaaaagctggaggcagcagaggcctgcacccaccgcctgccgcctcccacagctgccagggccgccccacgcttcgagattctcacttccctgggctcccattgggcttcagagtgctgaggaccgccaaacacacctgtggcctccccacgccacgtggtcccccccgcaggccctctcagggggacgcctgcctctgggtggggatcaggggcagtgggggcacagtgtccatcctccctgcgggtccagggcagcctgacctctggggagcatggggctgtcctgacctgcactacatgaggatctccagggcgaccccttgggccccagactcactttccaagaggggacctgcttgtctgaggccccaccccgggagggcggacctgagcccaggtttgtgatccctgagcacacacctcaccccaaggaaag

SEQ ID NO: 36858 - DNA, 1227 bp, Bovine  19866880802824
ctgagagaaaagaactcacggcctaataggtccttgtgttgccagcccacaggggtgtcagaatttaggggaaggatttaatgagctttgttggattgtgttggtagataaagaaactgaggctaatttgggcctttcactggtcactcagcctcagcgtccctgcatgtatctctgggctttaaagagtagagtgacatgaggggcaggcatgaggagaccccccacccaggccaggcctctcttttttcagttcactaaccgctgccttctcaagtggctgaagctgtgggacctagtcgtgtttggccgagagaagcctgtccagaagcctaggcccagtgcagaaccggcccgtggtggcaaggaggccacagcttccagcaagtggaagagccatgaacaagttctcgaggagatgctggaggctgagctggacccaagtgggcggccccggcagaaggtgagtgcacctgactgctctgcacacatgtctaatggcttattctgggtggctggtgcctttgcagccttggggggccatgaggcacatttactgcccccgaggctgtgatgatgtcagtgtcttggtgtggagtgtcagcagtttgagctaggacgcgagtcctttcttctaatgacttagacaaagtcagcactacttgaagggccctgcatcttcccacagtgattacactggaacgtgggtgggtttcaggcgtcagtcatggcagtaacagttgtgtctgtgtccgatctcaatgccactcacctgacatgagcctttattgtttgcgccacgagcaggcgggggcttgtcctcctctggtgataggggcagggcagggcaacatcccctggcactgcactttgtgggatgggattttgtctctggcatttgggccagggactcccaaagtctatgaggcggggcgggttgcagcacattttctcctgtcctggctgcaggtggcactgctgtgtgggcccccagggctgggcaagaccaccctggcccacgtgattgcgcggcacgctgggtactgcgtggtggagatgaatgcgaggtgaggggggaaggctgggcctccctgtgtcctaacgtgtctggccgactgggacacagccctgaacgcctggtttggaggtggggtctggtgtcccaggtgcatgaggcggcatggtccacacacctcagggctcctgggacttggcgtggtgtcaggg

SEQ ID NO: 36859 - DNA, 2080 bp, Bovine  19866880806951
agcttgagaccaggtgtaccaaggcctgaagaactcccccggcctgggccctgcacttgggggacgcgggtctgggcgcggggggaggccctgcggggggccccaggtgggctaacccccagtctcctgtgggaaggagccccctgcagccagccttctgaagaccctgggccccttctctggggacagcctgccggctgtggggggcggggcgggccactccaggctgcgttcccatggaaggagtgagcagtcccctggggtcgctaattcaggccgcgggcagctgtgcagtgtcgcggaggcggttatttctggcctggagaattcctgcccggagcgggccccacgctgggctgtcatcttcccgaggggcccctcttggctctgtgccgcctcatcctccaaggtccagggctgtgaggagccccccaggaaggaccaagatgggcagaagtgtggctggaaggaggcctcacctgggaaggctgggccctcctgggcccaggacagagccagcggggcggactgttccaaggcctccactgctccccgcgggagccaagacagagctgtgacagaaagctctgtcgggaaagctggaaataagggagggaaataaggctggaagggttttggaggggcagcttgggtggctttacttgcaggcaggaacattcctgggcgggggctatgggccaccaagtgactggcgggatctccacaaggcttggtggcctagacgtggtggcttcttgcgggtgtggtgatcggcagtggagaccaggcacttttccctcagttatgccttgaaaaaaatcccaaatcaagctctttattaggagttgaagggaaccattagcacccttcgtaattagcacagtcttctgaattgggtgctggtaccaggagctgtgggcatgtggtatggttctttggtgtcctgcagtcctggggggggtcttcctcccgagaaagaggagtgccaggcccccccaaggccaccacctgcaagatgcacacgtggcaatttgcacgagcttgtgtgtgtgcaagagtgcatgtgcgcgtgatggggtgtgtgtgcatgatggcgtgtgtgtgcatgatggggtgtgtatacatgatggcatgcacgcaagagtgcatgtgtgtgtgatggtgtgtgtgtgcataatgtgtgtgtgtgacggggtgtgcatgatgtgtgcgtgatggtgtgtgtgcgtgacggggtgtgtatgcatgacgtgtgcgtggtggtgtgtttggtgtacagatgtgtgagcatgtgtgtgcacagtcttgcttggatgcacgcctggggtgtggatggctctcaggaacaagcagagcacagactcgcacgtgcctggcacgcgcgtgccaggggcgcaggcccgctcttgcagggatctggctgcccaccccctggccccgcctggctggaggccaggggctgcctctgctcctgtccccctcctccatggcacatgggtgtggactgccagcgtgagaacggcgctctcccgatgagctgagtgagaactctcacaggcggggcgggggcgtcggtgccccaggctgctcagggtctgggcgccagcccacatcatgcggccccagggcgctgggggaggggtgtggagcagactggggtcagagcgggcttccggggagcctctagactcagctccggaagtctttcggggccgccggcacagggaggggctctgaggacacaaagttgggtccagggggagaaagaacgttccggcagcctcagcaagccgcttgtggggcgataagcacccatcactgggctgggtgggtagtgggctcgcaggcgcccgggaatgcgctctacctgggacagtccagcacccccagtaccccccgcgtgacctcaagcctgtctgagaacaaacagctccatgtttggccggctctcgctccccacccagccggccgagcagactgagtgagtcacacgggcccaggctggggcgggggtgggaagaccggccccgtgcgccggggtctgagcaggcggacagtcggggaggtcagtgggcaccat

SEQ ID NO: 36860 - DNA, 2965 bp, Bovine  19866880940306
ccgttcccccgtgcacgagtagactccccgtcagacccccccacagaagaggtctcctgggcgcccgcgctctcccgcggtcctgggctgtggggaggcccccgcacccttgtgtctgcgctggtgccagccagtctgcgggctgccggctctgaccgtctgggagcagccgctccaggtgggaccgccaggctaagcaggtcggcagcagcacccttgctcgcaccttggtggaggcctgcacagccaggagccccgccatggggctatccaccacacgcccagccgcagtagggagcggcgctccggacgctcctgagaggcacctgcaaacgtgtcagctcctgctcaccaagcagaggaggcccagcctgcactgtccagtccaccatcggggggcacgccccacctggtcagagcctgggccccccacaggtcccctgaagccagtcccctcatgaaggcagcgagtgggcagctggtctattcacacaactgctgcttccctccgtgcagcctcaaatctcacactgacggctggcacacaggccaccaggagatgcccaggacaaacagggatgagcagggccccaggagcccccgcactgcacacagcccagcctcggagctcctccctgcaggcccaccaccacaacccgtgtccgccctctggcatctacagcagcccttcccacagggctggccccgagcccacagctgccgcgccctgcacagggtgccacagccctgcagaccccatggaggatggccgtgcaggtcttacctgtgcgccccgcgagtaggacctgaagatggtgcagaaccggccctggcccgaggtgtccctgaaacaaagtggggggatgcgacccatgggagcccacctgcatgaaggaccccgcccctcccgctctgcatgtgccctgcagacctccttggcctggacactccagaagactgccctgtggggctggagaactcaagtgcgggggaagtcacacatcaactgcgagggtctccaaacgccctcaatgtggaatctggtagtgacaaggagggaagggccggggccccctggaaacacgtctttatgggcaaaagggagccaggctctgccaggacaggcagccctgaccttctggtctctgcgtcacatgcggtcccgtgtctacacggctgctatactggtggtttccttaaggacccgactgacttcaccccgctccctggccccggcaacaagggaagcacagcagcccccgcccaggcgtctcggcgcgcagcccgactcaccagagctccagcttgacccgccggccgtccagcaggatggtggttgtcttgtagtctatccctgcgatgaagcagagcgcgggtgagagactcgcctgaccaggacccggtctctgcggcccagaggagacagggctgcagctggggagcccagtggctcctgtcatcccaggggcccaagggggtgccaacgcgccagccaaagggaggggtggttggccctcagcgctggccacgtcacacgcttctcagagctaatgggtttctgagctcctgggctcacccaccacccaggtgctgacaactggagtgtgcctggagcactgttaatgacaaagcggcatctgaaatgcttcttctctggaaagctctcaaagaacctctgctggccacgtctttacttttcattttttgaatactttaaaaattgaagtatagttgaattacaattgcttcagctataccgcaaagcgactcagttttacacggttatctgttctttttcagagtcttctgtcataggttattataacatactgaatttagtttctgatgttatacagcagttccctgtttattactttctcatactttcatgcggaaaaagctaaataagtcccgtccctggcaggggcagggacagtgatggacgcatcgccttacaccaagatcttcaactggtgtccgaaaagctgggtccttcgtcctcctccctggagccttaggcatccaggttctcgactgttcacgacacctgttccagggaggcttggaaatgggcattttccatgcagactctgcacgtgggcagactccaccacagcgctgcacgaagggcccgagggccttccaccccactcactgctggccacatgtcaaagcctggctcccacccatcaagacactcatcagaaggaaaacgtaatccacaaaatgggacatgataaatacttgcaaatcacgtatctgaaaaaggaccagtattcagaaaacataaagaaatcttaaaactcaacaaaaagaatccagttaaaaagtggaccaaagacttaaaaagatgtttctccaaagaagatatgcaaatagctaataatcacatgaactagggaaatgcagatcaaagccgtatgagacaccgcatcacacccatcagatagttattatcaaaaaagcagaaaacaagcagtgttggtgaggatgcagaggaactggaacccgtgagcactgctggtggggctggaagatggcgccgccagcggggacagcacggcgctccctcagaattaaactcagagtcgccaaggaatccagaacatccatccaacatgtacgtgtcgcacacgcatgcttacggcagcattattcacgacagctaaaggacggacacaaccccagtctctaaagatgaaagaatgaatcagcaaaacgcggtccatctgtacaacagagtatcatcccacctcagagaggaaggagagtctgacacatgctgcaacgggaatgaacactcagtaaaacgagccggacacaagacaagcactgcctgaccccttctggcgaggtccctggagcgtgagcctcagacgaagactggacggagagaggccgcctaggaccgggaggcgtgggggaaagaggtgctcaacgggggagtcccagctgggaaagtgga

SEQ ID NO: 36861 - DNA, 1053 bp, Bovine  19866880986001
ggtcacttttttttttaatgtttattattttttaaaaatgtatttggctgtgccgggtttcatttgcaacacgcagaatattgtcttcactgcacacacgggatctttagttgtggcatacaaacccttagttgcagcatatgggacctagccccaccaggaatcgaacccaggccccctgtattgggagtgtggagtcttagccactggaccaccagagaagtctctggacaggggctcgttgtaagccctggtcttggcttggagccttggcaccacaagggtgccctcggagtggggacgtccacacctcttgcatctctcaccctcaccccaagttgaggagtctgacctccatcccgaagactgcagtctggggcccccagtccctctgcccctcaccgtcagcctcctttctgcccagtgccagcgcttccctcctgcaaggtttctggtgccagccggcaagccagctgtcccgcgaccaacttgcagctctcatcaggaggatggcaacgcaacatgtcctcctcagagcctggcaggtcagtggcagccaccaccaagactgcttgggggtcgagggcagggggggactccctggagaagggccccagggacaggcaggaaggaggcgcccctagcagggggccccgggcggcacaaggccaggatcggggtcaggacgcagggtagttctcctggagcgcgagggccactgtaccgacagtcttattataaaattaatgtaaaatcagtaatacatttgacatgacctgaggggaacgggacaagatgtccagcaggggtggattgggtaagtggacccttagtgagccaccatggtggggcccgacaccggaaggggaggggctctggggctggtgttccctgtcctgttctcacctggaggtggatgcaggaagaggcggacaggaagtcaagtgacagagagctgccaggcaggaggggttggtggacacgggacagaactgagaggtgggtgggggctccagggaggtcccagtcagaagcggagggcccaggagagcc

SEQ ID NO: 36862 - DNA, 625 bp, Bovine  19866881022419
aaacccggggccaatggtgaagagtatggctctgtgagggaacacagcagtgcccagccggcccgactcgagtcaccagcactcaccagagaagccaatggccacaaggtgggccccagggcacagactcatggacacagcaaagaaaggcagcgggatcttctccaccacctgcgggcagcaagcatgaggctctgggggaggggcccctggccctgagacctgtccctccccagccctgggtccctcaggctcccaggaccacagcgaggtacacgtgcctgcttctggcggaggctgtagaagaccacctcagggtacacgccgaggcctgcacacaccagcaccgccgggtcccaggggcagaaggcggcgagcgagggtggcaagcagccgggaacctgtgggggcacagtgcagggtgggagccgggggcactgcgcccacggggccgccgggactcttacctctgtgaggccgggtgctgggaagctcaaccaatccacgagctcacagtggtcccgcagccagtcagaggcccacacgctgactcgctggtccccgctggcggccagccacaggtccgtgccctctgccccgaagtctccacactggggaacaaggg

SEQ ID NO: 36863 - DNA, 1115 bp, Bovine  19866881058158
caagcgaagcctgaggccgggggagcagagcggctcctggcaggacggccactcaccggacgtcacacacgggcggccgcaggtccagcgggccgtgggcgaaggcgcagtgcagcccgttcttcacgcagtggccccgcgcgtccgtctcgtggatgcaggtgcccgtcttgtagtagcgcaggtggtacttgcgctccgtgtccccggtcgtccggtgcaggtacggacacctgggggcacaggacagtgcgtgtcggggcccacctgctccccggccggctggcttgcgtcagcttttcccagatgcctgctctggtcggagggtgaacagcaccagagccccatccctgccccagacccctcacatggccctcagaccccacgaagccctcgacgacacgtgggaggaaagcacaacacccaagctcctggaaaatcacccttcgtaatttttttgaatcaagtggaaaacaaagttcccatcagacaagcggctggcagcctctccctcctcccatccaggtgcttccggggacccctcggcagaggcggcgctggaggacgctgtgggggacaggccggggaaaagcgactgggggaggacgggggcagtgtccctggggccacacaaagacccagagcctcacatgcccagggagagccacgggcagctccaggagcaccaagggtcagggtcaaggccaaggtcaagggtcccacgcagggagatgtcagcagtgagatggcatggatggtcccagcacagacatggcgggaatgagcccacctctaggtcggtccctccagacaaaagccatggacacagaaggatgggacaggagcccctctgagcagccccaggacggcccgaggccgatgcaggccacagctgcaggcccccaggtctaagaacacggcctcggcccctccccgagacagcaaggcagcactgtgtgggagttggaaaaggcccactcctgcctcactgtcaggcaggccgtggcccaggcgctgggagcacctgtgggggtgtgggggctcccgggcagagcacagatggatgggcaggaccgagggtaaaaggaaagcaaccgaggggcaagcaatccgca

SEQ ID NO: 36864 - DNA, 897 bp, Bovine  19866881641982
gccccttgtgagctgtgacatttgaaaaacaaaaacccaacatgagagggggcttttctttttggtcagttttcccttaactccttttagggtgtgttgaaggtcagccactacggtggctagtgacttcatttttgcagaaccgggtggctagtgccagtctttgttggcagctgcaatttgccacctccctggttccgcacctttgcctcgagcatattctgcacctgctttctggtgggagaagtgccagcctcggggatcccgccacaccccaggaatgctggagacacttgagcaagggtggcggaatggaggtgttcctaactcagcagcacctgggaagtctccccacctggggaagcccaactctgaacccctggtggtggctcagctccaaacccagggctgtgtccagagctgctgtgtcaacagaggtgcctgtgtgctcacatcctcctcactgggctccgccccacctgttccaccccagaaccccacccagagtcactgctgaaccagttcagccacagggaaccccaggagcaccaactataggcaggaggatggaccacaatcattctggtatgcagcctgtagggcttcctggaggaggcaaagataacttgaggaggaggttaggggtggagctgctgactgcagcttatacaaccacctggttggtctgttttcaggcatctgggcacaagctgccctgggccagcagagggggcccagagctggggaggtcaagggcaggggctgatgggggagctgggaccccacccccgtgcaaggccgcctctaaagggtcactaaaactgtcttgatgactgccttggatgcgtgacagaaattagacaccggacaggcacctcttagcctctgcttcctcag

SEQ ID NO: 36865 - DNA, 956 bp, Bovine  19866881793423
tagcatttatgcaatggtttacagaattcatggaattatttttatcagtatggaaattaattaaaactctgatctttattttgtctgcatctttgaggacaacccccgagggcctgctggctcagaaggagagaaaggtccttaggccgaagcccacagtcctgagggtcacagggtgtccccacgcagtccagggtcacctcgcaggggctctgccatcccggccgtgggcacctgggggccccagtgctcagagctgggggtttctgccgaaacaccagacagtgggagttaggacccgaccggcaggcataaagcccgggtgggcttggccccctcaccccccaccaggcaccacagacctgtgggcttcccgtaggggacgccgtgctgggtcagcacgccttgcagtctctttatctcctgggacagggccttatgtgcctagaccggaagtggagaagaatggtcaggcccttggtgggaggccgtccttggccagggggccgtgtctgtacctcctggcagctctccagcgtctcaaaccgcagggcccttggtgcctccttcctgctgcgccgcttcatttggttctgatgtcttcagataaccagcatcttcaaaaattgccctgagcgacttctcgtagccctgcaggtggaggatgaggagggagcgcccattgggctgcccggcccccatctggggcctgcccacggctcacctgggccgtgatcagctcgtccaccaggtcctgctccagctggtcccaccgctgctgcagggccgcaggcagggtcggatacactgagggtccaagagaaactggctgagctgagcccctctgcccctcaaccccccgccgcccgcccgggcacccacctaacaaggagtgggggtggcagacgaggggcgtctcgaaggtcagcgcgtagacacaggtgcttgctcagaca

SEQ ID NO: 36866 - DNA, 729 bp, Bovine  19866881855946
cctggctcctcacggacctcggcaggcacttgacacagccacgactcctgccctcgctgcaccttccaagcccctggaggctgtgtgtctctaccagggcgaggaggtcctcggccggcgcccctcccatggccgcaccctcagggtctggtcagggtggtgtacacaggctgctcccagttactgggggggctgtgggcgggcggcacagacaggcccccgagcaggggcgaggcgtagggccggcggggcgagtggaagtaggggtactggtagaggcctgacgggtagccagggaacgggccgtagtagctgggtgcctgaaggtcggtgtagtcgcactgcgagctggtgaaggagctggcggctgcggcgggggcggcggtggtgacgctggcctgcgcgctgtaggagccgtagtcggcgtggcccggggagccatgtgactggtcgccgtagtgcccggggctcagctgctccgtcttgatgtgcggccgtggggggcccgcctcggtgggcgatgcggaggccgacggagtgcccttgtgagcccatacaggggacgccccgatgccggccgccccggaatgcgagtaggacgtgcccccataggagccggccgccgcgggctggccaggctcagcgggcagggccgagtggccgttgaggggcaggtactggtcaaactcgtggacgtcgaaggtgtccatgttcccgatgacctcactg

SEQ ID NO: 36867 - DNA, 1703 bp, Bovine  19866880255039
cattagaactgattcaatgtattctttttaatagctgagtaatactccattgtgtatatgtatcaaagctttcttatccattcatctgctgatggacatctaggttgcttccatgacctggctattataaacagtgctgcgatgaacattggggtacacgtgtctctttcaattctggtttcctcagtgtgtatgcccagcagttttttagagatttttattatgtttcaaaatacttaacaatattcatatgtgttgactcaaaatagacgtcaaataatgtatcaaatggaaatagagatgtgaaaaaattttatatggagtcattgattgtggcatcatttataatagggaaaaatagaatattctaaatttataataatatgagatggagtaggtaaatcacagtgtacataagacactggcctagaaaatctgcagttattaagagagagagttaataaaatgggataaatgtttactacagattttccaatagataaattaggttgtaaaatagcatacagaatacattatatgatgccaactttgttaaatataatgggttattgatatttgcatcctatctgaacagaaaagtgaacttgaaggaaatatagctaaatattaactggttacatctaggtgtcataatcacaaggtgatcttgatttatttttgtgcttttgtccaagtttccaaattttccgtaaagagcatacataacatttatagtaagtgaaaagatctaaaaagatttttcttaacatataattatgatacagtaacttgtattgttaagtgggcttgtgagaactgcaaattattgattatacataacactttattttatatgtgagttgtgctacttttgagcctttacttttgtttatttttagaatagctttcatttttcttctgtaattaactaagaactgaaatgagttttctgaatagaatagttcttaatataaatgcaaaatcttgttttctctaatataattgtacctgagtgaaagtaactgcaacaaggactataaaggaagacaaagtagggatatgatgtataatttccctttgcataattgtaactctgaagaacgcatgctctcggcagaaaggtaatttaaattgtatcacaacaaatgccatattttaaaatagaaactgtccatcatgcactgagtaaagctggtagcgacatgtaagtctcaaggatatactgaaaattcctccgtgaggaattttcctccattaaaattcctccattaaaaataaattggttggtttaattctagcacacgctgaaataaagtctaagtgacataatataatttttaagtgcataaaattactaattgtgcatttaggggaaaaatgatataagataacaagaaacattgcaagttttttattatagaaatattgagacctttaccatgtaaatagaacaatataataaactccatgtatccatcatgggcactattctttttttggcacaatctctctttggagcataatttttaaaatctgaaacaatactgagtacctactttttggcttcatcttatgggaaaaactagttttgaacaaaagtgaacattttagtggttgtagactgcagattttccttccttatgttggggttatgtcctgataaacccatcataaatcgagaatatcataagttggtaacacat

SEQ ID NO: 36868 - DNA, 935 bp, Bovine  19866880400377
cgcagctcaggagaaaggcccctggcgccgagcagcggctgtgttggcagaaggaaaccaatcatgccacttatcgccccggttggaaaagtaattgcagatacatgtgtaaagggcagggcaatcttttctgccaattatgtgccctgctattaggcgattaggagctggtaaagtcccggtgggtgtgagggattagcagcacaattctctctcccgtcacctcggcatttcggcttctctccagggcgccttcttccctccccaggtgccggtctcagcttgaccaggtgcctctcccaaattatgtccccccagacacacttgtccttttctataaaaggaaaaaagccctgccagggactcctatcaaactgcagttgaaaaacaaagttaggtctgcccggccaggaggttgcaaacttgtatttgcagcaatatttgggaagactatttggttccaggtgtttccaaagttgttcacggcccagacggtgctggtccttgctgctcttttcacgcacatgctgcctttcttgttttatttggctttcatgcctgtgtacatctgcccgtttctttgggccttactgatccacctgtcccttcatttttcaaggcactatttaattaagcatgtatttgctgcccagcacagctatgctctttgaaataatagcaaagtctagtggctaagagcttcagggtcctgaatagtcctgaattcaaatcccagctcagctcctttgggaatgcagtaaccacatggacctggaagcctgggaggaagaaagaaagaggggcagaggaaaggaagaatggagcagacacaggggaaggggactcccaaaagtgtaccttgagaaccatggcaagaatactgaagcggtttgccattcccttctccaggggactacctttgtcagaactctcca

SEQ ID NO: 36869 - DNA, 843 bp, Bovine  19866880406555
cttccggatctgtggaccctccggctgtttgcctggtgccagatgtctttggcctgacctcatttttcccttctctgtaggactgtggtcccgctgggtaccaatcactgtagctgcaatcattgttatcttttctgatgcccccaaagcctccttaagagcttaccgactgatttagttagagaaatccaagtgttgagaaaggaagctcaaatgagtttgtttttgtcttgcttatctgcctagagaaagcatccttgctctttcaaacgtctgataaatggacttgattatcctcttcaagcaaacacgtggtggagcggtgggaattgtggtttgttggaaagtctatgggccgccagcaaatccttctctttgctgttttcttttccatcctggtcacagaaagttttctgagacacaaagccctgatgtaggtttctgtactctgcaccccacaaagagccggagtgtctgagaagggggttgccatgcctggggtcgaggtccagcagagcaaccctttggtgtcagttcaatactaacagtgttgttggttagtcaagctgatttttcctattcactcaacaatttgcttattcagcagacagatattaaactcacaacatagtggttcccagcatgtgttctgcggccatatttcctgggtttgcatcctggcttgccacttagcagctgtgaggcctccaatgagtttttttttaaaccttcctgtaccttttcctcactgataaaattgagataaagaaagatccatctccggggttgttgtgaggattaaatgggttattatttccatatgttaactgagagtcatcccta

SEQ ID NO: 36870 - DNA, 958 bp, Bovine  19866880449026
gaatatgagagcatttagagacctttttttttttcaatagaaaaaccaaataaaatagcatgatttagcatttacttgcaggtgttaccaaaaatatacagaacacacatggggccaaaaaccttcatactttaaaggtaaatgatacacagtttaacattagctcctggctggcaagatctgtgtataatttattatttcattgtctgcatggtagctgatagatgctcagtcagtgttttcttagtcagcttaggctaaattctactgtggtaacaaatgaccccataattttagtgaattatattagctaaggttcattcctatctcatgtcaaagatccattccagatcagtttcaaccctacgctacatctttttcatttcaggatccaggaaaaggaagcagctcctctctaggacctgctagtctcatggcaaggggcagagatggcaaaatcgtggcatggcctttgaagttcctacttctacatggcatgggtgattcccactcacatttcatcggctgaagcaagtcacccattcaagcctgactctactagggcagggcttcctagggacaggccaggaaaggaaaggagaaaataatttttaataataatacagtttttcacagtgacaggttacgtgaacaagctttttttattattatttttatgtagaacttccttctactctacccgccctggaatttttcctgttttactaatataaaacagttactcatataatataaaacagttactaatataaaacaatgctcatcctattgatgttctagggctaccattaaaaagtaccacattgtaggcagtgtaaccaacagaattttcctatcccatagttctgaaggtcaaggtgatggcagggttgcttccttctgaggccctgagagagtctttgtttcatgcctgtccactaacttttatatttccaag

SEQ ID NO: 36871 - DNA, 2223 bp, Bovine  19866880460706
tctcatgctcaaatgactgcggtgacaatccgcagtcaactgaacttcatgtcacatattctgaaattgaaaaatctcaactaacaagagagctagagtgttttactctgcttgatccccaccatgacccctttatagatcttcaaagtcttactctcttggaaaaatgctacagcccatttagagaccctgcatgttctactggacaaatatagtgacttctttcaaagacatgccatctgtatgcttttcaaaaagcctttttgaagtttgctaacttatggcaagggccaccttcctctcctctgctgagaatcacaagacttcatcttttccccacaatgtcacaagacccctcctctcctgatgaccacagggcaacatccacaggggcctttggttgtgttcatggactttcttaagcctgaaaattgacgaagtgaaggatctgggatacagaattccaaggcctctgaatggtgagcactttcctcttttccttcccgcaacatgatttaaataaactacaaatttttctttaaaaaaaaaaaaaaagtcaatctccccccccccaccccgcttttactctatatattaaaagcaaaaattggcttttctagtttcaactggcagctctccctggcaccaagttcataccactgtattagttaactactgttgccccagaattcagtggcttaaaataagactaaacatttattatcactcagagttcctattggttagaaattcaggagcaacttagctggataattctgacttggggatttctgttagggccaagaaacagaccaggactacagtcatctgaaggcttgactgggattgttcagtagttagtccagttcagtcactcagtcatatttgactctttgtgaccccatggactgcagcatgccaggcttccctgtctatcaccaactcctggagcttactcgaattcatgtccattgagtcagtgatgccatccaaccatctcatcctctgtcgtccccttctcctccccagcatcaatcttccccagcagcagggtcttttccaaggagtcagttcttcatatcaggtggccagagtattggaatttcaccttcagcagtagtccttccaatgaatattcaggactgatttcccttaggattgactggttggatctccttgcagtccaagggactctcaagagtcttctccaacacggcagttcaaaagcatcaattcttcggctctcagctttctttatagtccaactctcacaattcatacatgactactggaaaaaccatagttttgactagatggacctttttggcaaagtaatgctttctaatatgctgtctatgtagatcatagcttttcttccaaggagcaagtgtcttttaatttcatggctgcagtcaccatctgcagtgattttggagctcaaaaaaataaagtctctcactgtttccattgtttacccatctatttgccatgaagtcatgggaccaaatgccatgatcttagttttctgaatgttgagctttaagccaacttttgcactctcctctttcactttcatcaagaggctctttagttcctttttgcttcctgccataagggtggtgttatctgcatatctgaggttattgatatttctctctgcaatcttgattctagcttgtgcttcatccagctcggcatttcacatgatgtactctgcatataagttaaataaacagggtgactacagacagccttgacgtattcttttaccgatttggaaccagtctgttgttccatgtccagttctaactgttggttcttgacctgcatatagatttctcaggaggcaggtcaggtagtctgatattgccatctctttaagaattttccacagtttgttgtgatccgcacactcaaaggttttgccgtagtcaataaagcagaagtagatgtttttctggaactctcttgctttttctatgattcaatggatgttgacaatttgatctctggttcctctgctttttctaaatccactttggacatgtggaaattcatggttcacatactgttgaagcctggctcagagaattttgagcattactttgctagcgtgtgagatgagtgtagtagtttgaacattctttggcattgcctttcttagggattggaatgaaaactgaccttttccagtcctggggccactgctgagttttccaaatt

SEQ ID NO: 36872 - DNA, 964 bp, Bovine  19866880467315
tttgactcacagacagtgtcttttcacttctgttagctctgcattttcattctgatgctcgttcttcttggcaccttgtcttgagttggaggtgaagcagatgctgaggaagtctgcattctctttaccatccttctcttttgctcacctgaagaaacgggctttacgattcaactttctgctctaaacttagctttaaagcccatttgggtgtccttagaagtttttctatgtgtcagctcatatgagacaccccactccagaagtcttgttttttcacttttcaacttaacaaaacacgtaatcggtacccactgtgaggcaggcgttatgttacacttcagagacacgaaggaaaaccagatgcagtccctgtttccaagaggctcagggtgaaaggagagactcaaaaagacaaatgcaaggcagcgtgcaagaactccactaaagaggggcaccgcagagctgggcacctccacctgggggctggaggaggcaggatggcttcatggagaaagcggtgtttgagcaaatgttttactttagtctcctttattccttttattcacccacctcactccattcccttctctagtcctactggcagccactgacaatgtgtacaaatgtctttttttgcttggatcgtactcaggcaaaatacatattgccattttacgtctgtggatttagttttaaattgatgtaaatgaccctgtgttacttaccataccttattttattgcttaacttccttcattaaacattctttgtgtgaacatctaggctgttcctgtaatctctgtctattcccatgggttgctcatccttcacgcttcacttttccactgtctccatgtggcacatccattgtggttccaatacccactcactctgcagtcacacattttacgactcatctgtgtatcagtgtgaaaagttcctgactcatatatatgcaaga

SEQ ID NO: 36873 - DNA, 3356 bp, Bovine  19866880471684
atgtcccatcgtgtatttggagcctgacacaagtagagcctactttctactttttctagaaagtagtggaccctcaatatatttgtagctgagctgaattttcatttaaaataaaatgagctctgtatttaagagtttcagcatcaactccctcccactcaagttaggtacaaatgcagcaagttaagcaataagttgccaaacgctctgctgcaacatgcttgaaattcagttttgaggccccagtcagtgctgaaatcaatgcccactttctccaggtatagtaattatttctcatattgttattgactatctctttaaataccagccaggacaaatctatttctcaagctgttgtaaatgatttgaagcaggaagatgaatggaatggaacgagggttgtttaaaagatttctcccccttcagcactggtcaagaaacgaatggttagtggccaccaacccatcccaggcgaaagctaggatcattttccaacccattcactagtgacctcaatcatctaagtgctggtttcaaaacccttatttttatcctgatcgacagcacatattcccagacacactgggaatctgtcgcttactttgggtctctggtttcttgaagacctgtgtcaggtgtctgaggagctaggagtctggaaacctattatggaggaaaagtctcgttgggagcctggggggaactctcacatggaatttagattcaaatttcagggccccagcaagagtgatggaggtgaggctcttgtaagcatgagactctatgttgagtgtgtctcattatcacgatcatataatatgtacactgtgatatgtctgtcttacaacggagaaaaaggaggcatagtgaggtcatatatatgcagaaagtcacacagctagtaggtaactgaactggggtttaaaactcaggaggtctcactaaggggcttgtgcttttaatcacctctctctactgggatagaaaaggtcaaagggaacttacaggatatgaagagaacaaacatacacacaaatacacaaaatgaaaactggagtaaatgttgaattacctgaacgttcattcatttattcaattattcaacaaacatttatttagcagctgttttatgatagtcactctgttaagtgcctcaaagtagacaaaatctcagccttaattaagcttacttcttaggagggaaagacggaggaagcaataagtaaaattggcattccagataccagtgagtgccatgaagaaagtaaggcaaggaggagagatgagcaatgttgggagctgaaatcgcaaaggtgtggtccgagagggaaacatttgaatcaggacccggaggaggtgagggagccagcccacgttactaacgaggtcagaggtcagcaaccacagcctccaggccaaaggcggctgtcacctgttttcataaacaaagtctattggaataaagacgggcccattcatttatgcattgtctgtggctgtttttgtactaaaatggcagagttcagtagttgcaatagagatttttgtggcctagaaagactgatgtatttgtaatttggcctttacagaaaattatctacctctggtcaagaggagggtgttccaggcagggggagcaaacagcaaatgagtgtctcatgatatgaaggtgcctgatgtggttgaagaggctggtgtggctggagctgtgtgatcctggggtgagtgggaggagatgaagttagggtggacgcaggacataccctgtggagtctcctgggccattgtaaggcctctggagacagtgggaggagagagcgggttctctgtagaggagagtcacacttggaggcatcaggatgattcggactgtttgtgatccatgagctgtcacaggctggggaagcaaaactgaggtggagtttaacatgcaggatgtttctgactccttgggatcaactcctgtggaaaggaggggcaggaggcaggagtgggcaaagagaggagttgtcatgatgcagcccaatgacggctttagcctttcacgtagccactcagtatattaacttcaatcctgtcactttcagaattgtctccatttagtctgagatgtccaggactatattttccagtgttgatcattcgttgaaaggaggtctttgaatggcagtggcaatgacccagaaggagtgtgaacaccccctgaatggctgacagctgaggaatgtttgctcactgtgctcccaggagctggggcaatgggtcctcccctccactgaaggaggatgtgatggtatgttgttgcgcccaccacacagaggcctggggagcaaaagataaagccagatgagtaagcaggctactcgaaaatctaactgagagatgaaggtggtttgagccaggtgaacagctggcaaatgctaaatatccctaatgttagagccttcatgtattcttcatgtcctaaggtcatctcagaggagcacaataaaggggagtaagcaaaacgtttggtgacaagtcataaagtctccaaatccattgattattgtttgtggatggtctttggttcagtttaacctggaatcatctttttccaaggtgtgtcgacaaaatgcgacataatcaccaatgcttcactgacctccatcagaatagaacctgtcgtgggagacagggcgtgtaagtattcatcacatggcccagtctgtcccagcagtgactgtactattccttgactatccagcaagagtgttgtactgctaaccttggcatgaagcagtgcagttacttatgcatctccatggcatggggtatcgccttagatttgagattctgctacggctacatgagtgggcaaaatcaagaagttgtattccataatttaccttcaatctgacaaagaacactgtctgtaatagaaggagtgagcttgtaggttttagcacatttattacagcatgatgtgttttgacatggtgtctatgagccatgtgggatgaaatggaaggtataaatggattccaatttcattatcccactgtgatctgagggaagctgataccaaaatgttgccacccaataaagcacttaatcaaattccctccctggctgaacagcatggttctgccaaagggagctatctgctgggtaaactgttcagcgagttgcatttttaatgcaagtgcccagtcagccaatggtgtctgccgggctttgcttacagtgtacatggctggctatttacacgagattaacaacacgagaaagaaacagattcaatgctccctagcccgatttagaggcttctctgctcattgaattcagccacgctggtcagactacccctggaaaag

SEQ ID NO: 36874 - DNA, 1544 bp, Bovine  19866880478642
accgcttgtgatgaagtgcccttcctggatttttattactacccatgactaaagcctaccaatatacagtagcctactaaatgagttcttactcttagagtttaatttttttttacaacagctttattgagatatgattcaataacatacatttcactcatttaaagtctacaattccgtggtttttggtgtattcacagagttgtgcaactgtgacaacaattgattttagaactctttaatcagccccggagaaaccctatgtccattaataatcgtgcttcatttcctgtatcttaccctcagcagctgggaaccgataacctactttctgtctcagtggatttgctttttctgggtgtttcatataaatgaaatcatacattatattatcattttgcctggcttctttcacttagcatagtgttttaaacattcatccctatgtaacatatactagtacttcattcctttttattgccaaataattctctgttgcatggatatatcatgttgtctttatgcactcatcaactgatgggcatttgagttgtttccgctttggctattgtgcataatgttgctatgaaaatttggttttaggttttctttatagacacgcgtcttcatttcttctgggtatctccctaggagtggaattgttagattatatggcaactctgttttaaacctttaatgggctgttaggctcttctctaaggtgggctcagggtttattgatgactagactgctgttcaactgagtacagtctgactcacattgtttggcaaaggagaaaaactcccactatgcacttgcacagatagatttcaatttctaaagcatcaagaggatgttatcagtgcgctgtcaactgttaagttgatcttggttctccgtgcctgtacttcttgctttctgctgataaatgattaacactctagcttcaccattatttgtttagtttatgattatgggttgtctggttaaccctactgggtgtagtaatgcatgttttcatcaagagtatttttggcctgcagtttctaagtagctagaatttaaggcatattcaagtggcagttcattaaacatgcatttgtttttatttggcatctgctgtgagtcagacaatggcagcccactctggtactctcacctggaaaattccatgggccagaggagcctggtgggctgcagtccatgggggtcgctaggagtcggacacggctgagcgacttcactttcacttttcactttcatgcattggagaaggaaatggcaacccgctccagtgttgttgcctgaagaatcccagggacggtggagcctggtgggctgccgtctatggggtcgcacagagttggacacgactgaagtgacttagcagcagcagcagcagggagtcagacactgtgtttggtactaggaatatagttgggagtgggggcaaaactgacacaactgttagaaagaaatacactttgagaggaagtgcaccagaagatgcacttctagtcactgttggggacctcttccccaa

SEQ ID NO: 36875 - DNA, 806 bp, Bovine  19866880504001
tgcttttattttgttatttgcatctggaaatcattcctaaaatcccatagaataaatttgtcttttctttttttagggactttttcccccttattataagaataatagatgttcattataaaaactttaaagaaaaagcatgtatttaataacagaaaagtgtccctagtttcctccacttgagataacagttcttgacatcccaggactgtgcttcttatcctttgaggtacacacggatttgtgaaaacgcacattcctgagcctcatcttcagagatctggagttgccaagtctggaatggagcctaagagttgccatcctagccagcaccttggttctgctgacgcccccaggtctggggcccacactgcaagacgctctgtcctaaacgtgcactaaccacccacacgtgaccctctggcacttgccagtgtctcagaaacatctggcatatccccagatgcctttcttcagtatcatatggaaagtctgtgtggcatgacatgctgctggaatggccatgcttgagtttcagggcttcttaacatgggcactacagacccaaaggggttcacagagagatcgactgcacttgtaatccaatgtatctttttttttcttttgacacttgaagtatttttctgagtaggatgccacaaggtttaccaactgccagagaagtctgacaaaaatagttaaaaacctcttctgctctctccagtgaatggtgtttagttgtttccctctactagctcccagctataaatcatactgccctgagcatcaccatttataaaccttta

SEQ ID NO: 36876 - DNA, 2136 bp, Bovine  19866880593647
cagtgtccagagaacaagataaaggaggagccaggagaccagccagggggctgtcgcattatccctgggaggtagccatggtgtctgttctcaacaggaggaggaggcagagagatgtatatggaattagagatggctaatgggaaacatctacaaaaactaggactgtgttgatatagaagtgtgtgaggtgtcaagagtgactcctagggttttggcttataatgatggatttactgaggatgggatgtcagaaagggtccatggatttggactaaagccaaactcggaggcacgatgaccctgagtttggtttgggacgtgttgagtctgagatccctctcaagtatccccatgaaaacactaagtagacagtgcggctaagtgtctgggactgaggtgtgcataggttctactctcagtcttgaggggacaccagaatagcgagaacttgttccttggtagcgaagcaagctacatagaaacgtgccagccttcagtaacttttcacactgcatctcctactttatcctctcttaaaagtcatgttgcaaacacattgcctttcggagctggtgcaatggccccactttgatagaattctactcaaagagaggagctacctttctagttcctgcagagttaccttgctggactgaatccacacgagaggccagggcagtaaataaatattaggaagtcagtaggatatttataataattggagcatcctatttgaaactgccctgagataattgagtgagtagagtggcaaggactgaatgagaagagtggcgatcagtaaccttaaggatatccaagttcagtggctagcagaagcagacaaaccattgaatgaggctaaggaggatctgctacagagatgggggaaagcccagtgaggtggtggagaagataagaggagatggtgcctcaataggaagccaggagacaactaaacagaaggttgaaaaagaagactgaaagctctttgttggatctagtgataacagagggtgttcatggtctgggatctgtgtgatggaatacagagatgaaagtaatttgagaggaggggaaataatcactttttatagcagagagttgaatgaatgaacagatgattgaatgaatgatgcaactatctttaatgatacttatgtattgccccttgtcttaaagaggagtccttcagtggctctagaaggcagagtaattgcacttgtggaaggccgactgaagcaggcccctggagaggatgtaggtccctttgtcttagaagcacctgctgttggcttgggccattgagttctgaagggcttcatacacctgtggacgtgtaggtgaatatatgctgaggtgagctggaaactgagctgctttgctaatgtttcctgagtgagttttgaaattggggttgggaggggcattgtttgggcaggaaagattggatttaagggctctgggtggttgaaaaataagggtaccatccttggagggggcttccctggtggctcagatggtaaagcacctgcctgcaatgcgggagacccaggttcgattcctgggtcaggaagatcccctggagaaggaaatggcaagccactccagtactcttgcctggagaattccatggacagaggagcatggtaggctacagcccatggggtcacggttggacacgactgagtgacttcccctttatccttaggggagggatccacggtgaggatgggtttagggcttcagagccacatgttccttcctctttctgggatcagagctaaaatatctctggttttccagtccttgcttttgacccctgcatccagctggagttgcaagcctctccagactcagatactaaaacttattgactgatgtggactcttctacgcatcaaagggctcagtaatggtgttagctggcgggctctttttaagtgcagaaagtgcttctctgtagacagcatgctgagatacctggagttaagataaaaggcttcaaagaggcagcagtctcctggaggctgcctgtggccactaaccttgctgctttggccacactgaccccagacagccagggccagcctttacgtgtctctttccatcgccacgggtactgtagccccagatt

SEQ ID NO: 36877 - DNA, 1386 bp, Bovine  19866880631672
ctacaaaattttaattttaggtataaccccagcagaaataaatacccatgtgtaccccaaaaatgtacaaaaatgtctatagtggtattactcacaatagagaaaaaaactggaaacaacccaaagtttgtcaatagtagaaaaattaagcaaattatgatgtattgtaaatctgttacaatataattctatacaataatgaaatgaaattaattactactgcattgaactaataaataaatttcccaaaactgatatcgagtaaaaaaaaatctagacatgaaagaatatactatatgatttcaattatattagtttcaaaagcagactaaactgatttatgtagtagaagtcagaataatggttatctggagaagatatgtagagaggctgctgagaagctgacaatgggttatttttttttttaatctgagtggtgtttacatcagtgtatttaacttgggataatccataaagctatatacttatgaattattcaagtgtcaggatggatattaacttcaattaataagcttggcttaaaaattacttattcacacattatttggtattttttataatttgagataaactgaattattatataatatattcacttaatagactttatcaagcacctactatgtgccaggcaccatgaagacacagagctcacaggcaatgcatggccctcccttcatggatctttcttttatagtcaaatgggagacagtatataaaaataaacacacggtaagtgagctagagaagaaaaaaaagaaaaagaagaggaaaagagaggtaatagaaattcttagaggcagcttcaacatcgtatgagctcatgcatattgcatgtgaaagaaaatattaaaatgatatatttgactatcacaaacagatatactgaaacacattgtactgataactaataaattgcaatgtgcttcataaaatgttgatgtggctatatgcaatatattcttatctcaaaatttattgctaaattatttaacagtttaaaactgtgtatatggatcacaattttgtcaaagttgcaaaaaaagtttctattttaaaaaattaatttctttggataatttcttccttcttaaattttagaatattaaaatataactacctgggtatgggagtggagcatggggagtgactatattccatgctcttattccatattatccatccacttagagatctcctccatctactcttcccctacagcttacttactcatgcactggtgtccagacaacctagactcaaactgtgactccacctcagctatgtggtaagtcagaagagaattaggaaagaaaaatcacccagaaaatttagttcaacagttaagagctcaagctccagaga

SEQ ID NO: 36878 - DNA, 1395 bp, Bovine  19866880640384
tcattaacatgatttattatgaagctacaggaaattagttgctgaatatttcaatgtggacaggaaataatgtaattccattgttaccatagaaccactgtatcttggagtaacctgtagccgtagtaacaagataaggacatacttcttaaatgttcaacaatgattctatacttcatgcacattcaagaacagtcagttcctgttatttataattgaattaagtttctgatacatttggggttcacttttcaacagtggttttcaattaccttaatttaaggcaatgaggataataagattttctttagggcattattgttagaactggaatagaacttcttattgtattaagaggacctgaacatggcctttaaaaataagtaaatatttttgaataagcaaaataatgtctttgaggataaatattaatgacataagggtaaatctatctcagggtcttcaaaaatgacactaccactgcccaccgtgagtcttgaaatctgaagatattaactgtatcacaataatagtaacactttccaacaatagcttataaggtttgagaatttaccaaatggcagtatatgctcaatgactgtcttatttagtcctcagggaaatactaataggtaggtactgctatcatgtccatcgtgtgggtgtggatactgagggacagagtcatcacatatgctgaccagagtcatctggctgcaaacagcaggggtggaactgaacccatgttatcctactgcacagtccatgattttatcccctgctcctgctgctctcctagctctcccagaccatcacaaaggacgctgagtccacatactgctgactgtgttctctcagcccttgtgcctacagtcatctctctggtccctgaaagagtaaagccgcaaagaacaaccaaagcctactggctcctgacctccctatccattcactgggccacagctatggctcaggttggggtgcgggtgttgggcctagagccatagaaccaaggtgagtaaggcgaggtgtcagctccttacaacttcagatgccagtgggaagaagacaccaggtaaacagatagatgccccctagtggaatgtgtaccttccaagaaggaagctccctctccatgaggaagtcaagtaaagctcagaggagagggcacttgccccaactggaatttaccagaagaaaagtacttgatagagggggaaatattcatgctgagtatttctagaacacggcatatgaaggctgtgacaagttgtggaagaaggaagtgatagggaatgaggccgaggtacaagttcagttcagtttagtcgctcagtcttgtccgaccctttgtggccccatggactgcagcacgccaggcctccctgtccatca

SEQ ID NO: 36879 - DNA, 804 bp, Bovine  19866880644286
cttgacatgagggcacagcgctctgcactgctgacagaactgagctggatagcttctggatgtatgagagagtacatttaatttttaacagattatacacaaaataccgagtgacattaaacacaggcttaaatcaaccatcacccattcaaagcagtcttgcagataaatgtcccaaatccacaagcctgccaaatacattttttatctatacacatttgtcaattctttccacaacattggtcctttctgtgcttctccgggggttgctgttttctctctcaaacctgaaatacaggtgacatcaactctctgtgaaacagatgggattgacaaaggaaaacccctggatttgtgactattaatcttttggtgatcacagacccttctgaaactctgaagaaatctttggactactcccccgttggaaaagaaatgaggtaaacatttataaacagattctgcacagtctattgtgttgcattttagattgattctattcactttcacatcatagagtataaaaaacaatctttactaaaaacaggtgccactcactctagatttttcagatatagaaaacaaggactactttaaaaaaatttcagaaaaaaaaaacaaactaagcaagttaaacaaaaagtaaatcttgctgctgctgctgctgctaagtcgcttcagtcgtgtccaactctgtgcgaccccatagacagcagcccaccaggccgccccatccctgggattctccaggcaagaacactggagtgggttgccatttccttctccaatgtatgaaagtgaaaa

SEQ ID NO: 36880 - DNA, 736 bp, Bovine  19866880662818
tggtgggaactttgctgcttctgaaaacacaatagctcactcaatcttctcaacaatcctattatgaataaagggtgaagaacttgaaattcactgggagcttatcatagctgcaactgtgctaggagcattaattatctcatttatctgaatgccaagtttatgaggtttcatgttgatctgtcaacactgaggccacaggcaggatgaaaatgagctttgatgaaaatctatccatcagcagccctgactgaaagacaaataaggcagtgagaagctcctgtaattctctggattggctggaaggaaagacttactctttcggggcactagggtaataatatttctctgcaaaattttcttccatgttacttgtcactttcttattgatttacaggagctctttttatattaaggagagtagctgtctgttatataacattgcaaaattttcctgtcatcttctcatttgtcttgtaaccttatggtctcccaaatacacaggagttttagttgcttttatattttcttttgtagtttctggggttggagccttacttagagaggacttctttaatccaaaattatatttttagcatctcctatattatcttttggtatattctacagttttcatttcatctttagacctcatatccacctgaaattgcatgttgctatatgtcctaaagtaggaagctgttatttttcctagatatacagacaatgtcccaat

SEQ ID NO: 36881 - DNA, 1490 bp, Bovine  19866880663401
tgagtttgctcagactgaatctggaacattggttgctttactttttcctgttctccccaccaaggtagctcaggggcacccctaaggaaacctgggattcctcagaataaagttgagaactaactcacacctaaaacgttgagggagaggctctgccatttggagaaaaagtgtatagagctaagtatatagcctgaaattggccaatgtgcctactgcatgtcattcaatttcaggcggacccccaagttcagaggtgaggaaacagcagtgccttcaagacactaggtttgccttggtaactagatttctcccctcctgttccccatccctgtcctctggcatagacagtgacagctcaggtagcagccagcgaggattagtcactcctgcaagtgtgcgaggtccgatcgtccttgtgacttggaagagacctggagctgacctctactcaggaggtgtgacttcctgtggcatgcagcgtggaaaagcagttgctgccccgcagaagctttagagtggaggctagctctccttaacctggtaggtgcaggtacacagaactccgggaatgcccagaagattcccagccaccagaaggaggtttctgaccttcttcagcctagcctagcagctgtactgtcacattattatagatgcttgtcactgaagcatcactgtctgcaaccttgacatgcaccgtttcagattcatttttcagaattgctctgaaagcccagggcccgtcccatccattagtggaactcctctgtgacaggtgttgggagtgatggaggtggtaggaaacgccccatgctctgctgattcatgggagacacatttgaaaagatataagctggctggggcaaagcctccatagaggtttgcaggcagtttcttccctctcagaggaaggcatcctgcttctatagggctgcatgaccccttcctggaaaaacagaacttgcacacacccctgagggctgaactcttcagaactgagggtgtcacctgtccaacctgtatgctcttaggctgaagaggaaaagttaaaattttacataatctccttctccttctgcctctgtaactcagcttgccccttgcaaagtctagatcacataggtcacgtagtctcagaaagtggggacttgcaatactaggaactggactttatctcactcacccttgtcctgctctttgcaatcgcccagcccctgcaaacctgcttaaccgtgcccgtccatataaagaccagacatccccctccccatcttgaccactgtccccacgcatgaaacctgtgcgtggatgatttgagagaatagcattgaaacatgtatattatcatatgtgaaacagatcgccagtccaggttcattgcatgagacagggtgctcagggctggtgcactgggatgaccctgagggatggggtggggaaggaggtgagagcgagggtcaggatggggaacacatgtacacccatgg

SEQ ID NO: 36882 - DNA, 4608 bp, Bovine  19866880709037
tgaataaaaatctgcccatctcccttggagcaatcaaatgtgtattcccatccagcagatgatcaagaaattcattttctttctatccatttgtgttttgggagatacagttattgtttagtgatggctgatctagatgtgtgagcttattgtaacatggcaatgttatgaaaattatttcatatcgttttttggtttgtttctttgtggtggtagtagttgaaagagtattagattcatatctctcactgtgaatcttgcacatgatatagaaatctaattataacagtctatagtgacagcagtctttacccagtctatagacagatatgtttagtagattgcattttctaatttcatctgaattttcataactatgttgatataacaaaaaaaagggggggcaaaggaggaaaatgaggatgagaaggaagaggaggcagaggagatggatggaaagttacacctaagttgtaagtgtctatttgctgtaaaacacttaaaaactgtcagaaagaccatgcattaattagggttgaaatgcaacctagacattgcaaaacttattttctaactggtttcatgttcataattaatggctaatattctgccatttataaggaattaaaataaacagtggtttaatgagatttcactaggccacttgcaaacactcaatcaaatcttatttccaatatgcaaagaatgtctccttgactcttaatgcatttaaggtcaacagtaacatcttcatacataaaagattctattccacttttaaagaagaggtaattataagagaggggtcacaccgaaggtctacgttttgtgtaacttctattctaattaatttatcgtatgtgggattttgctttggcttccaagtgttgatcttttatagctaccacattccatgtgataatgggtttcattcctttaaaaggtcacacttgatataatttcaccgttaacagaaggaacctaggcgcatgggtgttactgtgtcattgcaccgtgaaaagtcatcggcaaagtcctgggtctcttttgcccttagacgtcatttaaaaaccaaggggccaaggcatttgaacaaaaggtgagaaattcaattaatcattaagaagggtgccttcacaatggaagccccacagaagcatgtggatcaacagaaatatttgtatctgagaatgtgtttttgcttgtgccttttgttttataagtgaaatgaccggaatgtgactgttattttctcttgtatttattctgtgagtggtttccttggggtggcatgacccacagctgggctcctcaggcctttcatcatcagaaacctttgtgttgctgtttgggtcgtttccttctgatgcttctcatccttagaaaaatttgggtcttccaaggaaactgaagttattaagcaataattacttcatttcccagggccttcctaccctgccacttaaaaaaatcaaagacatacataattgtcaaatagaagcatcttagataaccaaccaagctgagaacatagaattctggctcaaggaagagaaacttgatgttaacctagctcaagatacacgtgtgagttcacctgagattcctgaaatacggccagtttgcagatcacaatcagtgactgaccgcagaaaaacccctagactaaggcagatcacaaacgttctgagtgcagatgaccgagggttttgtgaagatgcggattctgatcagaaggtctgggttggagtctgagaacctgcatttctggcaagccccccacccccgatgatgctaatgctgctagtgcctggaccacactctgagaagctgggctctggacagtaaaggagagcaaacggggaactgggtcacaaatgtggctcagtttcacccccaaggaagatttgttaagcatcttctgtatgccaggcccattatatataacacatgtccattttttatgcagtatataaacggggcaatatattggtatttttccttcaccggtccacccacatcttgccacataaaaagtctgtgcattcctgaaaaaagccagatcatgcttgggacagggaatatttctttggccattataacatgcacttactatcattgtaactggccctcctccatgcatggaatgattcacagactaagtagcaaatatttatgtgccagatggggcttccctggtggctcagatggtaaatatccccctgcaatgcaggagacccaggtttgatccctgggtcaggaagatcccctggaggagagaatggcagcacactccagtattcctgcctggagaattccatggacagaggagcctggagggctacatacagtccatggagtcagcaaagagtcggacatgactgagcgactaatactacatgccagatgctatgctatgtagtagatgtgtgatgccaagagaaatagatacagcctctgccttcatggaacgtcaagctagaaagactctgccaggacacagaagaaatacacagctatacatttatatatgtgtgtgtgtgtgtgtgtgtgtgtgtatctcatctttttagtactcccaaccctcaccaacttacaagcaaatggaactagttcctcttcttcccttctgctgtgtcactccccacttgggctagaacattcactgtgccaggcaccgtgcctgatgcaaacaacactgttcgctgctcttggggactccaagggttagcgaggaaaaacagatgctgacttccaggatcactgtttcacactcagcatgctgtgtgcatagcaaaagctagtgtggtgtctctcatgaagctagagttcagacagagactttggagtgaatgaatgaatggaagagtcagtgggtacaaggccaagtgtgtttccatagtgagactctaaaacgctgctgtacagtggctctaattagctttatgtgcagagtagggtacaaatcccagtcctgccaccaaccagctctcagaaactttgttttctcttttggaaaaacaaaatatgatagtaacatttttcttataaggttgttgtggggattaaatgagatatctatgagatagatatctcatagatatctatgatatcttcggagaaggcaatggcaccccactccagtactcttgcctggaaaatcccatggacggagaagcctggaaggctgcagttccatggggtcgctgagagttggacacgactgagcgacttcactttcacttttcactttcatgcattggagaaggaaatggaaacccactccagtgttcttgcctggaaaatcccagggagggcggagcctggagggctgccgtctatggggttgcacagagtcggacacaactgaagtgacttagcatgagatgattactccacagcataacgctggttactcttaacaccatgtttattattactttcctagtgactattatggaagtggcataggatacaaccctccaaggagatgaagaactctgagacgtggagatgatgagaaaggttctgcagagaaaacaagtcagattattgcttacacactcaataagtattccactggttatttgtgcttgccagggaattaggtggagattaattaatatttataaagtattttgatatccatgtaatatctagtaagcaattagttctgtagcacaaagccaaatccttttacataccaaacaatgtagaacaaaccgaatacagctgtgtaagaaggaacagcatttcattagctcctgttgtaggaaatacgaagtcagttgaatttttccccccttttagtaattttcttgctgattttctctggcttcctactgcattttcctgccttaccccctgcagcaccaaatcaaatcatttcctcttgggtagcagtaaaagcaggaagatgaagacacatgaaattctggcctctcctgcttggaaggtgttctgaacccaagaatgcacaaagggtttaacagggaggcaggtggggctccctaggtgcgtgtttccatatccattgccccagtcaggtggtgttcttcttctagatcttcacagagaagaacttcagggcagggaataaaaaggaaattcactcaaaagactggttcctcactggcatgctttctcaggttctctccagtccacacatacatgtatatgaccaagcccccgaatgacctggctggattctccccacccttgctcatggctttccatgcaccatccttgctgctgctgctgctaagtcgcttcaatagtgtccgactctgtgcgaccccatagatggcagcccaccaggcttccccgtccctgggattctccaggcaagaacactggagtgggttgccatttccttctccaatgcatgaaagtaaaaagtgaaagtgaagttgctcagtcatgtccaactctcagcgaccccatggactgcagcctaccaggcttctccgtccatgggatcttccaggcaaaagtactggagtggggtgccattgccttctccttacttatggacaatatgttgtcacatatccataaatcccttgtccccatctttttactaaagcctatcacgctagcttaaaaatt

SEQ ID NO: 36883 - DNA, 1015 bp, Bovine  19866880718452
tggatggaaactctatgaaggaggccttcgacttgatcattagtgcatcctcagtgtccagaaaggaagcctgtgccagcgtgagctcacaacgaacattactgaaaggagaggttggacggtgagtagatgcaacactgcagacacgacacatgccatgccagggggtgtgtgctttatgagcacagtgaaagttacttgagtggaagcagagaatatgcactctggagacccatgggcctggatttacagctaagttctgacttttagaagttctggtccatcctcttgcaccaacctgagccccagtttcattatcagtaaactgagaatgaaaatagtagctctctcattcaaccattgcttgaattatctgaggcaacgcttatacaacccataaccctgtacctggcatataaatgattaaagcaattcaatgaatagtaatagatactggtatttccatgcatcccataaggatggaaagagaaagaggtatccatagtagctgagcacctgcgagatgggtggtatgtgctgtcctgtgccaagtcgcttcagtggtatctgactctttgtgaccctatggactgtagcctgccaggctccagtaatcctgcccaggtggattccccaggcaagaatactggagtgggttgccataccctccccatgtggatggtatccccctggctaatcctacctgcctaaacttcttcccaagctgtcttctgaaacaggcacgctctccctggtttctagatgagaaaacggaggcgcctggaaaccacatggtttgcccagcgtccttcagttcctaagtgacggatccagatcacaaagccaggctctctgctttttcattacagtagattgcttttcttgaaaataaaaacagagcacagaaaacaaacaggacatggacacaagcagccccagggtgtggaaactttattttgaggctcagtttaaattctcccaagtccttcttcagacagctccaatagaaaaggat

SEQ ID NO: 36884 - DNA, 732 bp, Bovine  19866880735478
tcatgttaactgtcttggaggatcaactggatggagacattcagcttggaaagtggcactccgggctggaatcacaaatgtttaaacaagctagggaaaaaaaaaaatcagatgactgacttagtaaattaatccttattttctccacttttaatgttcatcttataagcctcatcttggtcgggaaaaatgattctactcgatgtttgcttttaattttacaaaaatgacctctgctgtgtgggaggatatattttgacatcacgaatgtgcatgtttaaccccggttctgggggtcgtgctacttctttcagcaggtgtgtaatctcagagtggaaggagaggatgggagctaggattgcattttgtacctggtgccctcagcaatttctgatgcattgtaaacggttagataggaataacctctttctaatgttggaagcaggttagtgggtttatttaatcaccgacaaaagggtatattttccaggtggaaatgagagcagagaagggtgtgtgagcagctagatggaagaggcacaggcctgaggctttgagcttttacacggtccaatggtaatcccgagagccctgcgttagaggggagggcagtgtcccctccctctctggtgaccagcaatggcctcttgcaaataaatctgtgttcttggggcagcctggtcaaccccgggccctgcagagttctgccagtattaccacatgccccaagag

SEQ ID NO: 36885 - DNA, 877 bp, Bovine  19866880749700
cctatgagtggaccaaagccagtgggtcctcacagggctcaatccctcccccaatctcatgagcacctcttgatgaggagggtcccatggaaattagaaaacatctgccttcccctccagattcatccagattctccccgctcctcagcagcctggtgtgccctgcacttattacacagagctgtggagagcagaatgaaggaccctaatccatgtgacatttaaagagcagcagctctctttgagaaacatctgtcctttgtaagcctcttttattatttgctgtgactcactagctcatatttagggggtgcatttagcctcgatttctggatttgacattgaagcagttcgttttgcctgttgaaagcattcagaattgaaacaataaggcaagtatttagaggtggggtgcactcatgcagggtgctggtgaggtgtgatatacaaatctgaatgatgtacatgtgtaacaaatgttttacaggcagtatgctgcaatggtcatttttttttttttaataaaaatgattatagcctggattccattctcaaaatgtccagactgaagccaagaggtaggggggtcactagcttctgacacaagagcagggtatatgccataccaaagcacatgcaaagctgagccctcatcaaatcatttaacatttccagctctttacaactcagccacagagatcctcatctggaagcttattctacccaagtaaatcatatctggtacagaacacactgccacaggttctgtcccccgctcccatctttcagtggacttaaatgaactgccagaccctatctctcttttccataaaattaaatctggaattggttcttctctccttgggatgacatagat

SEQ ID NO: 36886 - DNA, 1606 bp, Bovine  19866880770240
caggccttttacgtcagaatgtctgtatcaacctcgttcttctgagaataggcagagtgatcaattaccaggacacaccatcatttatctaacccagcactatccagcaggtttctgtgatgatatcctgtatctagactgtataacctggcagccactggtcacacaaggctgttgagtacctgaaatgtgcctcatgaggcagcgggactgaatcattcatttttcactttctgtaatttggttaattcgaatttaaaaatagtcacatgtggctagcagctactctactggacagtgcagatttaatgagtcccctaattgaagggcatacattagtttttcctaaattatctccattagatattctgatgggatgcacatttctgtgtgtgtgtgtgaatatctgagttcattattccctaattgaggtttcccccaatactttgtgttctctattaataaaaagccggtttcctataaactgcattcatttgatggaataaaaggcagatgtgtccatatatttgctgctaacgagccttgaggcacagagcctctatgggcattagcctccagtacggaggtgcacagttgccctgaagcaaccaaacaggctggaccttctacaaggtgctactgctgatagctaggctttcaccaaggaggcaccggcgctaatctcccacttgggaagaagggtcttctggctgcctggcatgaatgagctggcagcaacttcttcacttcggtgtttacaatatggcatcattaatagtgctcatactaaagcacaccaagcaacattttagtttgtttcttaatgttcctcaattacccattcctatctcttcctacccatccccagaaaagcataaataaggtgtttggctgcagctcatgtaattaggctgtgaccagagctaatctgttgcagtggatgaagtgtgtgttctcaggactatctctcactacaacatggggagggagcccttgatgccaacctcactgggtcagcatgaacaatgagctgatgttggagtgggaagagaggcaaaggaaacagacagctgtgtccctccagcatgaaaccccacactgacccctgggtcatcatcacacactcagcgcctgcctccagggctgctgtgaagggaccactgtcgtgttcctgggaaggaagaagatggtgggtgttcagtttgtttttatgacttcatcaatgaacttaaaataattttttaacctagtgaatattaaattctaaccagttacatctttccaaaggctcttctcatctttgttaacattcacatatatttttcttttatagctggaacaaaattgtagcagcatcaacagacctctaaataaaggaaggaaaaaaaatcacctgtgatgctgaaagccctacaaatcaaactgttttcattttactgtgctccctttctgtctttgttcatgggcatacataatttatgtctgaaactgctctggtgattttggttccaggtatgcaccaatgggattaaatataactcaaccctctagcacattttcttctgggccctaagccctcttatttcttctgcttctacccggcctg

SEQ ID NO: 36887 - DNA, 1119 bp, Bovine  19866880781731
ggcgactaagctgccgtcggtgttcaccctgaagtatgggcttgagacctcatagtgcagcttgtcatttcccttgcagtcactgaaggtcactggcaaaaacaaaacaaatgaacagaaacagaaggagtgtgagcaggctgggaagtttaatgctggagctgtctttgacccttaaatatgacttaccactctgcaccccagatccacgagtgctgagcctcacccactgcaccctcttgtggcctcatggctttgactatgtgaaggactccactcagtgaagagttccttaatcacctcccctgtcccaggcaggtgctaagccttttaatgcccaaagagaacctcttccctgcttccacactgggagcagaagatactgcagacaaggctgggaactgagacagagggtcccttgttacttctcatctaggttgagcccagcagtggagacaggtaggaaatgaaggactcagccacggcctccccttacttccccaggctctatgaacaaccattcatgacagcatttagcctactttgttcaactttcacttagctctttggtgaagtcaggggtggcgccttttcttccctcagaatccctataaagctttgcctagctgctaagtatggttggtatctgtgtgtgagtgttgaatgaagttttgacaaaggacagttatgacagcatttattgatggcatctgagtggcaggctctattataaggaccatacattcagtctctccttccagtctcacaaccattctaagttacggcacgcatttcccaggttcatttttattatctcccccaacaagagaaatgtttttaggtattgttgcctgatcatcaccactctcatgcattgtcagggtcatagagctgttgtatgtctgtttacttaccgcatgtatatctgtactctacacacacacacaaagtacaattgcttgtctttctcccaagaaccctgtgtcacccctttggtgacatagagccccctgagaatgcacagtctacacacatcatttccatagcatgggaggcaagactgagccttgaagagactgactgacatgctcaagaccacacactcagaaaaggcagaca

SEQ ID NO: 36888 - DNA, 1511 bp, Bovine  19866880787815
ataaagctcccttggttacattagaagaagtagtgggatgccacgttttgatcctagaagcttgttgaaaaatggccctttaaagacgaaagcaagtctagttactggaaaggagagcagaataaagagttatttggatgtgaggaaaataaaaggctttagaacaactgaaggaaagacgtatcggagtgagcggtgaataaaatattatggaaataaaaggagcggaggtgaccattagtaacagttaaaacagaaaaagataagtcattgagaattgagaagaaagatgaaaaaagataaaaggaaatattactgtctgaacacagacagcaggaagtcgtggacagaataaacatttactggaaggtgctgaacgctgaacacagaattggttgaatctaagtctggggtgtgagcagatattctatgactgccaggcaaagacacaacactttcagacaagtttatagagtggtgaaaagtgtggacatcaattgattgattatgttgtattttatacttcctgcaagacaaaagttcatgatgattggaagccaaagctcttgtaaaatattacagagacaaaaataaaaattggaagtgtcagtgtcataggaggagttcaaggtcatgttactaacctggtttcttgtaacctctatttttacctagatcatcagcttatgtttacacgttactgaatgatccctaaccatttccaggatcttggcagtgacctcacacatctaagtatgcttaaaccactgattctgtttgattcttcccagttttcctcccagatgttagccttgtgaccatatggtcttcattctgagagaatgcaccactcactggctttttggctaatcacatttttcagaaagagaaaaggtcttcgttggaccacagagaaatgcatgaaggaactaagaatcagaagggaaggagggagatgtaaaatgttggttgcttggggaaaaggtctgttcaaagttttggactttttatttcctcctgcatgttgaacagagaaaaatacattgttattacttctggaaatccagattttcccgaacagtagtcagtaggcattttcagctccgtggaaactttcttctttatttaggcacaattaactttattcacagtatctatgacaacctatgctcactgttttgagatagactgaaaagtagcagcccacatctgtttgtccattttctcccctagtaatacatataggcccacagtttcattgacaggggagggggctggtcaaattttgctgatccaacaattcacttacaaaatcacatataaatttttaaatatcctcaaatcaccgacttttactgaatgtgctgtcattgataatcaacccagttccgtttcacttttactagcttacatagaatcaacaaccataacccactaaattacctagaggattaaaaaaaataaaaaaaacctacacagacacacacaaaactgtaatatggaatgtacag

SEQ ID NO: 36889 - DNA, 949 bp, Bovine  19866880789806
catagattttcctggtggagatcgaaagattgcaaactgacatgtagaaacacaggatacttcttgaaatctaggcggaaatggtcacatggtcacttcttaccccctggccaaagcaagtcatttgggaaaagtaatgcattctgtcacagctactgtgcattgggattttttaaaaaaggaatggttgttcaaaacgggttacctcttcctcatgtgcctatatttttaaagtaaatatgttgctcttcattgaatggatcaagctaaaattacctcacaattgccctttacctttctcattctctaaatgattctcattctctagatgattccatatcttcctttccatccactttctaaaatacaaaacttaccatgtccattttctgctcagaaaaaagcattattgagtccctgttttccaccgatagagctcaaatccttggctggcttcaaaatatccttcacaatatattgactgtctcctctatcaggctctgtcggatactctcttttctttctcccatctctgtgaattcttattcatttgtcagagcccagctgaaactttacaacttctgtgtacccttcactcattccctggagagttttctgcctccttatctgtagtttcctagcatgttaaacatatgtcaacatggcacttacgataatacattggaagtggtcactcacatgtctatttttctactagcctgtgaaatccttgaagatagggtccatgtcgtcttaattttctatccttagcacttctctctatgcctgtaacgtggtagatttcagataagatggtttgattgatttgaaggagatttttttttaattactttttttaagaaataaaaatggccatagcacaagtagatatgttcagtcttactaataattagatgaactacaaaagaacaaaccaaagttgcagaag

SEQ ID NO: 36890 - DNA, 1937 bp, Bovine  19866880793245
gtttaaattaacagactattgcaacacactgttccatgtgcagaagaccaggtcttgttctgcaatatatctggtgtgtggtatgtagtaagaacccactaatcctttgctgagtttaagttcattgtgtcataatatttctctctatctccccacttgctcattgacttcatttcaaatcttgtttccttgatcctctaccaatattgtcatttttctcaaaatttccatcactccttttttagaaaaattaggctacatagtcactatctccacctccttatgacacatgcactctcttgcccctttattctttcaaggaatttgatatgatcactccccatgtcgctttaaggaaagggctctctggatggtcatcccagacctccatgctgctgatccagtggcctctttgagttttcttcctcctcactctcttcactgtgttgtggttactggccactcttcccttgcttcttggatatagcataatattggctctttttcctcctctctgaatattctttctctgcctcccttcattcctttacttcttcccaacaactcagtgacttaaaaaatctaactttttataccttctccattagcatttttcttttcaggtatcctatcataatttcattcaagagctaatgcctaatccctgtatacattcctgaacactctagaacagtttcacctgcgtgctgggtatctggatatcctgaaggtgtacaaactcatcatgtcaggaaccaaactatttctgacttactaacttggtttaacactagggacactcgcttagtcacccaggctgaagaccaagggttaaggtggcactttctcctcctcctctgctgccctccagactgcttcagtggccgcatcctgtccattcatccatctctttatctctattgccgcatttccatgccgtttctttttaactcccctcactggtgataccacagggtctgtgtcatctcccactggataaaagaaatctaaccacagaaatatgttccttattgtggaagttaggggtttggattcttgagctctgccccagacacagagatttaaccctgcagagtctgctctgggttttacaaacagcactttctcaacacttaattctccttctcttcctccatgacctttaagtttgtttgtttgttgtttgttttcactatactcctttttctatttttaaacagctttactgaagtatagttgatatacttaattttatgagtttgggcataggcatatacccatgaaactatcaccatgagcaaggtaatgaacattcatcacctccaaaagtttccttatggcccccttttttgagggtgagagcacagcacaaaatccagcctaagtttttaagggcacaatgtaataagcttcaactgtttcactaattttaaagagatgaccaggtaagtttacaaaggtatgaaatgatttgagcctacttagactccctgttggagtgatgaaaagatttgacttatttattttaaaaaatattagaagaggaagtgctactttaagataatggaaggcacaggtatttatctctgattatttaaaataatttaaatcttggttcatccatattttaaagagcaccttgcctttgcaaaagaacaggaaaatgtggtgacattcaaacttttgtcagcgttttcaaattatcaacaagttaaaaaaaaaaaccagttggttctgaattgtgagctaaatatatgccacctgtaatatttgcctaaatagtgtacattcagaatggaatattgtttaatctcttttaacttgcaaaaaacctttcttttttctgaaaagacacttaaacttttggtgttggctacatatgaaaatatgtcaaacacccagattcgacatctctagatattcaaaactaattattc

SEQ ID NO: 36891 - DNA, 836 bp, Bovine  19866880829664
ataataataatagtaaagacagcaacaaccatggctaccgttattattgccacatattgactactctttctgtgtccagcattaggctaagtgcttttcagaaccatcttgtttaatcctgtaacaacactaagagagagagagaaatatccccgatttttcatgaggaaactaaacttctgtagattaactgatttatctgtagattaacttctgtagattaactaccaaagctaatcaggcagaaggttgtggagctgaggtctgaacctaggcttaggcaagcgtatactggggacgtgaacggcacccattgtgaactccagtccaccaaatgcaggatctgtatagcaccttggatcttacaacattcagttatcctgggaaaggcagtgtttccctagtctgtcagacctcagacctccccagagctaaagggggagtttcaatgcttcagaaatgatctgaacctggtgttaaatataccagctttgtatataggagttttgtaaattattctgagtgcatttcgacctaaattctataaattttccttgacttaaaaagaggctgcaggaagcagtggggaggcagacatagtgaacagacttgtggccacagcgggggaggagagggcgggacgagtgcagagcgcggcagggacgcacgcgcgctatccacgtgaagcagacacacagtgggggtttgcgcatgactcagggagctgaaacctctgctctgtgacaaccaggaggggcgggaggggtgggaggtaagaaaagaggttcaagaaggaggggacatatgtacgcctgtggctgactcatgctgatgta

SEQ ID NO: 36892 - DNA, 1919 bp, Bovine  19866880889610
agcctaagacaaaggactaggtacaggtagcttccttcggcaggatgcaggcgtgagtggcaggggagggattcagggaaggagagagagccagtgtatcgaggatcattgatgtcactgctgcggaccatgaggtctcagcccaccggcccctctgagtggcgcacaaatgcctctcagaggactaggtctggaatcaggcaggttggggcacttaaccagctgcgctttccagcatcgagaccgacactggaggttgtcctgggaaccttccctcctgtgactttcccagctccgcttgatctcactgtaacctgtagcagagcagcaagcccccgggcagaatttgaaaaggttgcgggtactctgcagggcaaggccttgctcttgggaactgtagtgactgggatcggaggctggccacagtgatggattcaggtcctgatctattgagctgtctcctcgaatcccagacctcttcctttagaaagcctcctttgttatctccatggaattagagttttttgtgtagcccaaaaaagtgtttcagtcctggcaatggcagatatttcatatttgcttcattgaatttcctagggctgttaaggctcacctgagattatctcacactaagagtcctttatcaacttaggggctgcaggtcttaattgatgtttggctgcactaattttattaccaaaatttcatagacagacacatataccatcgattctagggcaggtacagcctctagtttctactaagagccaacaaaccaagtcttcctaattttgcattaagtaacatttttacaaaacactattttttgttttaaaaatttccaactgtctaattgattaatcctggaatcttaagagtgaaaaagtaattccattcagacaaaaactgtgactttattgagtgaattctttctggctctgttttagccagactcaaggacacatacctggtgaattcagtcctattttaggtggcaaaatactttcaaataatcttgaaaacaatacagagcttgttatccctgggaaattgctccctgtctcttcaactggcatgccctagtgcatttaccaaatccctgcatggaacactctctcttatactttgcacttgaaaactgtcaatcttctttccaatatggccttatttgtgacatggttccgtttcctattctcatctaaagagcatgtttttccttattctgtattttcataatacttaatacatattcctttatattaatacaaataataacaataggtggcacgttgcacctgttatgtggagtaggaaatggcaaaccacttcaatattcttacctggaaaattccttggacagaggagcctggcaaactacagtccaaggggctgcaaagagtcggacatgactgagcacagcacagcacagcacctattataatcctgtccctctcttcaaccttttgatttatgttaactcatcaaaccctctagtgactgtatgcatgggtggtggtatactcatttagagaaaacagagaggctgttcaaggttaagtaacttgccagaagtcagagaaatggccacataggcagaatacaggctcagattagttttggcttgttgtcccacgtttttccagatatacacagcttcccttttaataatttgaggaaaagatactgagtagcatttaattagaaatgaggtctagaatgctagtttcaaattgtatatgaggcaacagcaggacttgccaaactggaagcattctccccttttatcttcccaagaatctcaaaatcattgctcagcatcttacattaatggccaagaaggtggcaggtgttctgggtctggaggctgtaaagcagcaggaatatttcaaggaggtcagactcagggaggatgtagatag

SEQ ID NO: 36893 - DNA, 2647 bp, Bovine  19866880899225
aaataaacaggcacagttgtttgctttcgtcactaggaacaagatcataaatggcaacagctcagaacggccaatttctcgtttcttcccatcactgattcatgctcttgacattttccactaatttgctggcatcttccattcatgtgtgccctgagaatctctacctctcatccatggaaagtgtctggaaaacaattatggtttcccttttgttcctgtactttcttgtggaagaaaagaaattataccttagagcagattttttaaaaaataaaatagtatttggtcatgaaattactgcttttaaaatgttattgtattctgaaaggcatcctagttgttggacttctgcagacagccttgtgatctgcccctggcagtttgggttctcttgttttgttgttgttgttgtttggtttttgcttatttgttgaataccatttagaagagtattaaggaaaaacaaaaagacccatgttacattcagagaagaacaatcaagttgggaaaatataaatcgtatgcattgctcttatgatcacatgtatgtcagtgtcataagcacatgtatgccgtgtacataagcatactgttgcaggcatattcccaaggtaaatgggtgaaacacgcctccaggtttaattggcacttctgctgtgagccccacatcttgttcactgttctcctgggtgctcactgtggattcagactcatcagaggctcaaatgcaccccctcaacatcaagatagactctgccaaccccaaggtgtccatcactgattcaccttttgccttcacagctgcctctgaatatcggtagctggacaagcacaactaggtggatattttaataaagcagaaagtctaaattgccccccataaggccttcaagttttcaccttgggaaagttctgtgttatggtgccttatctccaagaggctccactgacctctaaatacctttcctggcagggttaacaccagtgattctggatctgatagcacattagaaccatccagattgcagaaacatcctggcaccacagccatgctgcagccctagcagcccaccggtacagaagatcatagtatatggtcaggcttgagaaccaccgggcttcaggattaggaaagttacatttctgagtgggaaagttgtatcagatgagttcctcacaacctgggaaaatcaaaagcttgacttgaaagcgcaggacatgaggatgagttttgatggggagcatgggctagagagcgaggtattgcccatcaaggcacacagatgtccccaaggaaggagaagacagatggtgattttaaactgacattgtaacctgctgttttcataagcataacttattctctgatggatggagaataggctgtggaaagagggaaatgagatagacaagggggtagcacttgtaattactcagaacatacggggctcaagccagggccatgatggtgggaggggagaagggtggttgtgaggtgtgatcagatcctgggaatgtgtggacagtgttctggaatgataatggcagctctgcctgcccagccatatacctctgtgaagtttcctaccttcttccctggtcctcctggtggttttgcagagaagctggcatcagctcagagagatgccattacttgcttaaagccctgtgtccagctttgaccaagcatctggctctcactgctgccctttttctactctaacaggctatatctgttccaaagtctgcagaaaatttaagactttcagaatttcttattgcatcggtatgaatattattaaatttcccgtaaacttgaattttctctgtttaaaaagaccatagatctttctttttagaaattgaggtgattaagattaatgaccaaccataaaattttataagcaattattacggtttactgtgcttccttcagctgcttgacactctacctttccttcccttgtttgtcaaagtgggtttgcacatcactgaccaagaccttggaatggggagagtgtacagccaggtcattggtgaacccatctttttaacttccggctataatgatggtctgtcagtgatagaagtttattagcatttactcaccttgcattagtaatacagcacggtacgttttccattttcattagcagtgtttgatagaatcattagaaaggaagtaaattctctggttcaacaaaataaatgcagcttttgctttgtgacaggtaatataaaagctttcttttgtctctgtgtgtgtgtgggaggggctctcatcctgattgagagccctagggttctgtagacccctgcctcccatgtcctcccagcacaccagacactcagcccatccctccagctcctcatgaagagtcatccttccaagcaggattgctctctgcccagcttctctgagattccccaaagtcccatctcaagtttttagccctcctctacagcctagctcctcattccacttaagacctcaggttcttactttttctgattgccccaattttagcaaactgaaggaaaagtagctggaagggaattctattagtcaggacttggagattgtatatgataggagcacattcacgttgctgaagtaaaagggcacttattattcccacaacca

SEQ ID NO: 36894 - DNA, 1301 bp, Bovine  19866881016886
agctgagttttacttggatattgatgatctgtactgcaagagcatcagtgagttgatgaagccacaaggcagtttgccctggttcaaggagtatacaggtgatgatatagagaagacagatggggagtgaattctatcaaaaagcttggctgtctagggaaggtaagagatagggaaataacttcagaggtgggtagaattgaaaagaggatttttttttttttttttagttttctagaataaataagacttaaacatgtttgtaagctgccaggaagtagccaatggagagaaagtgattgaagatgggagagaaaggaagggtaattgatggagcaacgtccccaaggagacgtgagggatgaaatcaagagtgcgggtcaagaggtgaggctgggagaggccagctctgaggcaggtgatatttctgtgcaggctttcggcttttgtgcagaagagtgaggaaggcatcaatcacctcctctgtggctgggtaaatgccaggaaattctacggcagaaacttccccaggcagcaggctcagaattaattgtgaggattaagcataaaccaaaaggagcagggaagtcttaaacactaaatcccaggaatggggccttttcggattaaggaaatgcttctgagaatggtccggcagccagaatgcggagggagacctctaggtacttggcaaccacacgaatgccccttgtaggattgcttcacatggtcaaggtgtatgttgattttttttttttttttttttttgctgtgattataccttcagaacaagaacacaatcttggagaattaaacacaaaacacaattttggagaattaaaatgtctgcatgggagaaaaaggcattttttgaccttctgttgacattgtcttattcttgtctcagtttgtttgcaagcgaagcaaggaccccaagttagaaatctccttgcagtaagttagaaatctccttgcagttgttcaaatatgatttaactgaataacaaaatcttggtggaacatggaggatttgcccaatgtggagtgtgtgtgtgtgtctgtatatgtgtgtaaatgaataaatgacattcttgggtgaatgtcatttattcgtgtcctcctgccagggagcaggggtgagaacatgctgaccctgtgttttacccagcatgatgacagtgggccaagccagcagtgtaaaacaaaatataagtatttggtgaacaaatgagtgcgtgagtgaacagaggaatgtatggatcaaagaatgaatgaatctacctgtcaatctctaggctcta

SEQ ID NO: 36895 - DNA, 2815 bp, Bovine  19866881028887
tctcgagcccgggagcccaactcctgaggcctgcgtgccctagagttcctgccctgcaataagagaagccaccgcaatgaactgcaagtagagagtagcccctgcttgcctcgaccagagaaaagcccatgcagcaaccaagaaccagcacagccaagagtaaacaaatagatgtaaataatataaacaaagaaacaaacaacctggaagagggagcggggaggttctaggagaggagaaactaaccaccaagtctttaacagagtactgggaacataatagatattcaatcagcggcgctccccgccccagtcctcatgtgatatttcaactgttttacagaaggcaaaatgcaggccacttggagaggttgagttgcctatggtgcaaaggttagtgatagagttcaaactgagttcaaacctagttccaccacactccaggcttttcactgcactgctctgcgccctttgactactgtgtttgaaaaattctctaaacactagtaattaaagagaggaatatttcacataaaatataacaaatcaatctttattggattagccttccaatccacttgatgcacaaaaatggacaaactgactgggtatcaagaattagtaaaatgtcagactttggtttatgacctagttgagaatgccacgtgaatgtcatcattccctctagttcacactagttcagtgaacataaatggctgtggcatcaaggattagagttttgattcactatcagtgtgcattgggaatcaccaacgcatttccctagatcctgaagacattctacaaacccataatgctgatttttcatggttgatgtctaccttctctgctactgctactgctaagtcacctcagtcgtgtccgactctgtgtgaccccacagatggcagcccaccaggctctcccgtccctaggattctccaggcaagaacactggagtgggttgccatttccttctctaacagttaccatttacagctagatacttaatacatatttctttcagttctctaacagtcccatgaaggtagtgtttcatggatgagaaaactaagactcagagagattaagaaaacttccgtgagtcacacagcattgagtagcaaagctggagctctgctctttacatctgttctagagtcctgtctcaggtcttggggggaagaggcaagatcattccaggatggtgaaattcaaagtaaatgttagaagtctattctgtagtttaggagcccatggattaacaggaagttggtctgcctagaggtgaaagaggttgtcagtggtagagatgagcagaatgttgaagccaatgattaaatccatcagcaggaaaacccatatagcagaagccagaagaccctgtagatcaaagctcagggaatacttgaactctgaaaaaggtttaggaaaatacatgaaggggacccagccagatctttatgcagccccaaaacatctaaaagttttcaagtgcttttattagcatggtttctttaaaggatgaaagaaaatatgtgtggaatttgctaccattgatccgtctataacttttatcaaggaactttggagatttgaactttctgcagaccagtgctctgctattctacagattcatcacaaatccccagattacaggcgataagacaacatggaggggggaaaaaatagcatggaaatttggtccatgatcttcagaatggtttgattttcattaagactcgtagctggtctgcagccagtgtgtggatgggcatcctgtgtatgaagagtcctgaggcattttgaacaccccatcctgcattccctgtgcacatctagagtgtttccatgcagagatgtccttgtgctacctgcagagcagtgtttggaggctcaagtgtttgttgcctgaggcaagaatgagtgcccttcccaaaaggtacgcctgagatattgagaggttggtgacttaataaccagaagggataccaatcaaactgtaacacagcgccaaacactgacttgtccccttcccaattttctcctgacctaggctttggtaacctaacctgggagcttcgtaagaagctccatctctctggctatgctctgcactaaccctggtaaaagttggcagtcagaaatattagtggactctctgtggttgtaaccaattaattcactcacctcctccctaattgcagtgggtgagatgctcaccagctgtgattacaaattggttctgtctagttgacaagaccttatcaggaaattaaaataaagtgatctggcttacaatacatgaagcacaattaattattgcatacatatatgggtttctgatataagcaaggaaatgatcagccctctaggtcatgcctattcatcctccagttgccaagagatttttattgcatccctgatgccatatggcattgtctctagctttagcctcatgggaacgcaggaggcggcctgccaagaatatctcatcacttgttaaaggtaccccgttttcctgtgatttcttctcttgacaacaatggcccacattcatttccttaagaagtgaaagctatcacagctgaaggctttccaccctacctgaattatcaggggaagtgcaaaagccaaacataaatcacagctttccatcaaaagtggcaacttttgcaattgaaggattcttataggggatcttgagtatagtactgtgattacagaaggccctgtgtgtctggaagtgttctttttgcacctacccacggcaagtctcaggtcccgagatttattgcttgtgctttttctttatg

SEQ ID NO: 36896 - DNA, 1794 bp, Bovine  19866881081398
tctccaaatttgtttaactcattatttataacatcattaaatccagtgacactaaaaggtgtcactgtgagcatcaggcaagtgcaattttaatcctcagaaaacgtgtccgtgtctttctttccttccctcccccaccctcatcagggaggatggatggaggcaaatgctagatttgcaggatgtgcaacggtctaaactttcactgaatcctaatcaacttaatatcctgttgcctttttgaaattggatgatgaaatgtaaccccgagacagcttaaacagaactcaggcccgggtgctttccgcaaaatggcctaatttggtagttatagcactagtgtggtatgtgcagcgatcaaatcccgtgttttcaattgtcctttttatggtcaattaaggcagtcttaggatatagatttaataccggagcagcctaatgtaacagactaaagcgtgccctccaattatggggagaatgtctttttgtgacagtggttctcccggtaagttttacaggcttctatttttgaacttgactccaagggccaaagcagcacagtttgaaaatggttttgtaaaccgtaacgagggcgtctttctttagcagcttcctgcctgaagacggcagagtgctttacaaacttatcaaagtgatatacagggatcgtttgttctctgctgaaatacagaggcctagggggaaaggcagtcactgatgaaaaatctcagagtgcccgtgtggacagcaggcatggggagcgtggagcatctaaagcacactcctcaactggaggggctggccagataggcggaggggctgtgctctggggtgccacgttgcttcagggaagggtgcctggtgagctccttgtaaagctgcctcttcccttggatcatcccttatgtctgcggcactttgaggtgcctcctgacacacatactctaaaaaaatgggcacgtttcactgctcttgatttcttagcacaggagatcatcagaggggctctgatacatcacagcttctcgatgccaattaactatcctgaagacctgtctgaatcatagcatgaaggaaaagcagtctgggccttaaaggactctaagaaatgttcaaagcatttctgagcagaagtcttttgggctctgttttaattaatagtttaaaataattcatatttaatatatcaaatgtttctgtggagctgatgatgtttaaatgcctccagacagtggttccttttcatcctattgattttacatagagtccaaaggtcagttccacagagggagcatttatttgtcactttccatgtacatcaccacattcaggatgcagtagaggatgcagaagtgaattaattcgtgggctctgagaggctccggagttgtaggtaagagatccacgtgtaaaagattcagaagcaagcagagctgtggttaatgccatgatagatgcgcacgcacagagcccagcagcatcctcagtgtatcagcatctttacgtctgttgagttgtttaattgtcatacatcttacgtttggttatgaattaataaagtagaagatctgaagaatttcccccactaggagatgcttatagagtatgtagaatttatacttctgcattttcatgtgacacatttgggtcttcctaaaacaaaattaaatttaccacagttcacgttaatgtgtagcagatggaaatatgtggaactattcaaagacaaaaggatgggaaaattcccatatccacactcacacagctgctcattgtaaaagtgatcactggatg

SEQ ID NO: 36897 - DNA, 1395 bp, Bovine  19866881110023
tggtactccttaagagattaatgcatctggagatccattggtccatctgttctcattggccatagatcatgtgctcattcatttctttaaaagaaagaaagaaagaagattattgagtgcctgcctgtcatggaccaggcctagttctaggtcctggagtaccatgatccataaacagatatttagttatcatcatgaaactcttactgtagtgagggaaacaaacatagaaagaagtggacaataaaatgaaataatgacaaatgatgggaataaataaggaaatgaactgatgagggatggcttctcctctgaagaggtgacgcacaaacagattctgggaggatgaacaacctggaagtagaggaacaaactttccagaaagagagactagaatgtgcgaaggctcaggtgtagggaaaagcttggcctgcctgatgactgagggacgagcagggtgcagtgagcaaggggacagtgcaaacaggatgaatttggagacggagacagaggagagctttgcaagtccttaggggctgtgaccaatttcccttttctgtcatgtgctaggagagaattttgtaattcaagacatactcacttttgaattttatgcaatagaaacagtagacaaaacgtccatgtggagtttggggactgaatggggacacacagtgggccaacagtttgagagccgctgctctgggcgatggatgctgatactagaggtgcattgtttggtagtttgctgcaataatatgagaatgaaaacaacagatgtgcaggccgagcaggccctctcctgcgcacgtgcactgttctatcgatgcagcccactcgcgtgtactcagtgtctactcagagccagacggtgtgtggccaagggaggttcacgggagagaaagacagatgtcatccctgacatcatggaaatcgcacgctggccatttgaactccataaaagctcagcttaagaaacaaaaaagagtgttggatttgccttttctggttctcatttgattaacttcctgcagctgtcacacattcagaatcattaaaatatagttttctgtgcttaacttgcttccacagattaactttccacagctcattatggtggccttgacctcggtctattcataaaagaccacaaaaaccattaaccgggtgggttgctctttctaggagcagcacaattttatctactagaggcattggcagatttggattgcattgtaaataaatttatccactacaaacattcagggatctgcctttcattgtaaataaaatttcacaagtaattgttaagtgatggcctcacaattatactggcacaagaaaaccagccagagacagattcagggctttgcagtaaatattcaaataggagcc

SEQ ID NO: 36898 - DNA, 1457 bp, Bovine  19866881110592
ctcagaatgaagatgtctgctgacggattcctaatcaatacttgtgtgtgtccaggagtccccagagggcgttccacacagggcccacatgcagtctcactcctctctgcccagagctggccggccttgcaacatcccttgcttcatactgaagtcctgttttctcctgctggaaaacagagctctaccctggaagctatctctgtcccacggcggagggccaggatttcctgttttttgcacagctcccctaatgtatcaggagaccaacagccctcttgtataccagttctaagaaatgatgcctgggtttcagaggcctgccctgccttcatgtccagtttccacttagcttcatctgaaacctcccagctcagaatttgtctttggagtctcatttggagttgaactcaggctattcagtattgttgatcatgtttttataggttcctaactagactacaaacacctggaggacaggatctgtgtcttatccatcttagtattccccagagagtttagcgcggtaacttatctatgctgggtgttccgtgaatgttgctgattgactgcctgctacgccagccccaggaggtgaagggcttctgggagagtctctgcagggaccaagtatttgtctcttagcctattcaattgtaacaatagatcaaagcaagacttcaattatccttcactttcattcccaaactctctgctttgttcattctattgaaaaggtctggtgacagagagcaagactctgagagagagagaatgcttccagagccttaagaaagcagtgtagcaggaaggacatatttcaatgtagttattttccaccaaggctaatattgtgctccaatacttcagggtctagtgagctcatcaacaatgtttgcctttaattttaccatttgtacccagtcatatgttacttgttatggtttctgtctagctccattttatcaaaggcatcttagggctttcattgtctctgaaaagttgctgtaagatggacgagcatggatatccatcacgtttaactatctccttcatcactcttccatcgtctgttaaaggacaaattgttcacatgctcgttaaaaactggaacttttgtgattgaatggaggaaggaaattgcatattggattggggtgaggggaactctctgcctgatttccccctggggagggcccttggcctttacctgaaaggtggggaggcctcttgcttgcaggagagaaaagcctgcattctctcagaaaggaatccatacagcttcctgagagatcctcaactctaagatgtgtcttagaatcatcaggggatagatgctggcctcccacctgctctggtcaattaaataaaaatctcttctttggggcttgaaaactggcattgatacggttttaaaaaccctccatgtgggtctgatgtgcagccagaggggtaag

SEQ ID NO: 36899 - DNA, 2294 bp, Bovine  19866881145258
gtgtattctaatgccctgaaacctatgacagtggtgagtcatatggcaaaagaaattagggatacagacggaattgaggttgctaaccacttgaccttgaaatgggaagattatcatggattaatggattatctgtgtaggtcccatgtaatactgaatgtcccggtgaaagacgggaccagagacaagggaagatttaaagatgctgttggttttaaagatggaagggagagttgtgtgtcaaggaatgaaggtagctctaaaagttgggaaaggcaagaaaattgatgttcctctacagcctctagaaggaactggataacaccttgatttttgccccgtgaaacctttttaggacttctgatctccagaactaaggcatcttttgttgttactttaatccatttagcttgttttaatttgttacacaagcttacacaacaggaaattaatacagttctgatgtcagaatcttgaaagagaactgtagatattaacggcataaattctaattttctggggacctttataaatgttttaaatcaattctcatgtgtaactctacagagtgggtatcattatccccattttacaggtgaagatgccaggactaaaagttagctaacaagtgcaaacactgaaagttgaatcaaggaaataaggtttcatagttcctgtccctaaaacagcactgtacttcctttttcagaatggaagaatagcaagaaacagccctcagacagtaagggaggaggagggactgtgtgttaagctacagaagctatgggaggaccagttttgagactggggtaagaaaagaagaaactattattagaagatgaagcatgggctgtgcaatggtctagactagggagccagtagtgtagcctttgagagacttactgtaattgggaagaagagtcaggaaggtaggtgcagtggtgcagcaaaggctgaccgtgagcactgtatgtggggagatatatcaagaaatgagagtttccccaaaaattcagaaagtggaatcaagcaaaaaaaaaaaaaaaaaaagggaaagaaaaaaattatgtggtttgttgtttatggggcaaaagacctgagtaaatactggactgagctgacattaaaaaaggaaaatcttccttgtagaattcacagttgaaaccatagaaatccagatggttgtccaaagaaactgtgtaaagacagattcttgcagcagaaagacagtagtagtggaatagtggtttctctaaacagttgtgtaattttttttttcctttttgacaaaaaagaagaaaggaaaatacttgaaggggatggagagaaagggaaatacagaacagatggccttaagacttaaggttaagtcttagcaaaaagagatggtccttcctctgagaggagaggaggaaggcacgcacagagggtggagaggaggatgaggacgttcatctggacctcactggatttaccacctcaccctccagagatggggtgtgggaggattgcctcaagagtggagatttagaactggaattatggtacatgagctggggaactgaggaaagaggaataaagcgtgcttcagagaacaaatttatcagggcacaaactttattcacaagcactgaggattaatttacttttgcgatatgctggtgagaagcaaaatggaagtatattattagtttcctccttttgaattattttgaagtgaccaagtgaaagtcagtaaccagatcaatggaaaatgactccgttgaaatggagtcccttttgaaaactgccctcagccgatacggtgtgtaagtcagccaatcacaggaggccgagcctctgatgatggtgcttcccaggctcccagccttcctttgtgctgaaatgacagaatttgggggaaggaaaaaaaaacaaaacaactcagcagtcatgtgttgtcctgaatcactaaccagaaagccccaggagggtttcaatacactggattaaggagaggagctgccgacaggaactccatgacagagacttcaatgcaaacagttgttcccttttagtgctcatgaatgcctggccatgaaacaaacaaacgtttcttgactattaggagtcatgagcatgaaacatgaggaccagaaaagacaagaaggttcatggatacagttcatgaagtctgagagctctagggctttgcctgggcaagatactgaaaccaaagtctcagctacttctattccagaacatagaaaccaccccctagcttgttggggaggattaagacggaatttttttta

SEQ ID NO: 36900 - DNA, 762 bp, Bovine  19866881239041
cttgcttgcttgcttgcttgtaggcaaagtgcaatgtattttgatttcatcagagtatacaaaaagttcccctttagactttatgcataagacagggaaatgtgtgttcatgtggatttatcacctagaccaaagatcaataaactttttctgtaaatatgcagtcagtatgtatgtcaaactttgctgcccatattgtctgtgttggaactactcaattttgccattgcaatgtgagaaaaatagacagccatagacactatgtaaacacataagagtgcctgtgttccaataaaactttatttacaaaaacaagccactggccggatctggcccttggctatagtttgccaacccctggcctagatggttgaatgactgtaaccctaatgtgccatggactgaactggcaaagagtttctaagttgatcatgtgagaataggctgactacattgatgagtgatacaaagctaggagaaatattcaacgtgatggatgacaaagtcacaattttaaattaggctgagacaccaaaacaaccagtccaaattaatgtgatgtaagttaatgcctaaaagtatactgttctttgattaacaaaacatcataaataacaaaactaagctatagtctatcaacacaatgaaaggagaaaactgggtttggctgtaatcgctcaaaaatgactgggggctggccagcgacttcacttgttattcattcactcacttctgcagttttcagcaataaagtccctgtgg

SEQ ID NO: 36901 - DNA, 774 bp, Bovine  19866881292203
ccccaaatggtgctctggtctatctaggtatgacagcagaattctagctactcagccaaacgtaacaggaaatcagtcacactgttctattcatccttatgaatctaagaaaataggagacagaggaatcttagactttacagcatgtgcgttttgttagaaagatagttcctctgtcatggggcttaacaacttttcccaattcaattaattggaatctcacagaaaagcaaatgccgtaaaataaaagactcaaacatctgggaccccaagcagcatccagtggaaaacactaatatgatgcagtttcacagcttgcggatgggaatattaagagccttcatttctaagaaccactgctcagagagtgtgcggcttcttttaacagctagttcacaaggcaggtttagatggtgggttttctcagaatgcaatttagtgaggcatctccaatgcatgcatgcaatcaaagtatactaagtgaatgtctctttggggctagccatggtgttagggtataatggaacacacacaaagaagacacaagtcatttctggcctcacagagcgtggggtctaactgcctttcaaaaactcctggcctagaaggagagagtcagggagaaaaggtaaccccgacaagacatgtgactgctggtcaagagacgcaagcagactgaggcccctgcaccctttgttccctcttagggctttccacggccaaccagggtccacaggaccaaggagccctgccgacagcatccatgcacacggg

SEQ ID NO: 36902 - DNA, 1276 bp, Bovine  19866881297171
tagccctagtaaaagagagaggggtgtaaaagtcgaagacaaatgtgctacgattctattcattctataaagcataaagagcacacatttgtcatcagcatgggaaacaaaagtcttcctgtatcatatttcagaaatatgtaatgcagtctctgccaccaacagaaagaaaaaaacatcatctatgtcaagtctctgcttccttggcttgagtcttagcttctctctcattccacaatcattgattgagctggatggtgtgggaagccttgtgagcaagacaactgtaattttgccagtgagattattcaattcaggattgcccacacattttgcctgtgacctctatggctggaacccttactcccctgccccttgagagcagctggtccttctgtgccaacaacgtatacagactcaacaccttatcttagcctatccttgtgtgatgcgattatggaagaggcagccagagggcgtcaatgcaatctctcaccactgtgataaggttgtcattccctgtcactgaggtggcgagaatgtaggagtaggctgggagatttaaggcactgccactttatggcaccaagagtaggtccagaaagccaggcatactggactagggtttagaaccataatggggcagaaagggtactgtggcaagaagacaagctagaaagatcaggccagaatgctaggctcatgcagatgaaatgtgggcagaaagggtcagaggtgacccagatgtgggaaaataacagccaaagcagagagacagagagtttagcgagaccacacgagggtcataccttctcatttgtaacttgggttttttttttcagaatgttgcttatgttataattattacataacataataaatcctggttttaagatgagaacactaagccacatggaggtcaaagccaaataacaaggctaagttcagagcgctagtaagcggagagctgatgtccttggtggagatgggcactgtttcctgcaggtagagcccggacactcttaggcttgagctgagctgcgggcaggggctgtttgccctctgccatctggattctggaacgtggccagaccatggctcagaggaaacgcccatctctaagtgtcactgacttccaaaaatagcaagagcagagggttaggccttctgggagatccttccaatatttttcttagaagtgagcacatccatttcccaattaattatctccattagctaagctcaattactctgggtccacctccaagaatacaac

SEQ ID NO: 36903 - DNA, 1297 bp, Bovine  19866881324861
tgttcttgcctggagaatcccagggacggggaagcctggtgggctgccgtctatggggtcacacagagttggacacgactgaagcgacttaacagcagcagcagcaaatgtgttgggaatctatccactcctctccttctttcataccagcactctgttctgagttaccatcatgtttttgctttgaataccgatatgcctcccagctggtctccacatagccacttttcccttcctccagttgctcttttctcctcagccagagccatcctttgaaagctttgatataatgcatctgatcatgccactcctatgcttaaaatccttcagtggtttctcagtgttttgaggataaataaaaaacaaaccttcctcatcagctacaaggccaggcaaactgctctgatctcctctcaccgctctgcactgtaaactccagccgtaccagtgttggctcatttgctgagatcttcatggaccaaggcctttacacacacttccttctccatcaagaatctacctgcaatccaccccagaggcttcacctaattcagactcattcatccttctatgtcatctctatcatcaggctgggcttttcttctcttttcgtctctctcgtgatgccacgtgcatctgccccataggccaggttataaacatcacttccacttattgatggtgaataggtgattacggtttacctctcctgactcaatgcgatatacaagggcaaggaatttctttttaactcatcgttgcatccccactgctgggctaagtgcttggcttgtaggtaattaattaataatgactgaattaatggatgcatgggtgaggtatgtagaattagacccttttaacagattaggaagctagggctcactctaagtgagaacttagaagtatcaggggcagggtgcagtccccaggtcacaaagtgtaagacactttaatacatacagtagcgatgacagattttttgttgttgttgaaagaccctccaatcacgctacactaatttcagtttgcactctacccttttattttttctgggcacataggatattttgagggtaggaaccagacactcttttttttttttttttactgtcttgatgttttctggatgtcctgcttaagcctttcttcaagtgtccaatcaaactaatccagtgaacttggctgctgaccttgctctcacaaatttgccatctcagaatgattgatgtctgcttggtccctgttggaaaaatggctgcagatatgatccaggaaatctatagtcacaaatcta

SEQ ID NO: 36904 - DNA, 814 bp, Bovine  19866881357623
tgactctccctgtgagtggtgaattttaagtctgcagttccctagcagggaagatcggtcaatctctacagaatgacaacgcacgcacagcgagacacagcgactccctcagctttacgaaaaccaagctgagcgtctcctctttgagaaaatctttgccgtcatcatttgtccagtgtcctaactatggggagagaaaaggcaccttaaaccctatctctgttgcctttttcaagcttcatgtgtttcatcaacctaaagaactattcttccaacagaaaagaatgaattgataataaaaccccacaagaatttcattaacctagataccacttactttacatggccagacgcggactagagtagggcgcaataataatccatattttcataagctcaggaaaacacgacgtaagtacggattcttcatcaagctaccttaccagggtcatctgaaaaatataaggtgtgtgctaggtcatctttaagacccactccattcctagcacttcacagtcagcgtccacagactcatatcctgttcttgccatggaaaaaagtagaaaagatgtaaaactaccaccataacatcactgcctgaaacaacgacaagaagtttccctggagtgtttggtgctccgttaatagggcataattagaaaatgcttatatcagaagttttttgttctttttttaatgtgctgcttcactacgaatgtaataatagaaacattagcagacaaagacccaaagcaagctgaaatatcacccaaagctcactgcaatgtttaggctataaattggaaattaaaat

SEQ ID NO: 36905 - DNA, 1594 bp, Bovine  19866881395957
cactgtcatattttgccttgagcaaattgcccctttgctgaatctgttttttagacctgtaaagtagagatgctcaaattaacaaggaactcatggggtaattataagactagaatgagctagagagcatcattttactggctcagaggtaaagctgggtacaaactttagcagttgtaactgtgactgttattattatcaacattttactctgtgggtccatctggattttgcagtcccctggtccatagtttcttttttaattccaggtttgactaaggtgtatttggctggattcttcttacttgtctcagcttagctggctcccacttcacgcatctttcaagatgtttgtggaaaactaatcagcatctacgtttgttttctaattctcttttgctcccacataccatggccacttgattagcaatcagcactgtgttggcagtcacatacaggccccgttccccctaatcagggatgtaggaagcaaatgctggtgttaaaagggaacccttttttgagctcctgtcccatgactcctaattgttgtatttctcaaactcaacccagctgcaagctttattagggaaacatttattcagataacaggcctcgtgtatgaaagaggaataattattttgcaaatgcatttgaatcgctgtatgctatagtgcaactcatctcccaaatggagaagatgcacatttggactgaaatgttgctttgtagatggacaatgcagcaggcatatgaactgggagcttctggtaaatgatagaaaaacgaacatatgaaaagacaccatcaaaataagaggtaaaaaagtgatcgaaactctgaaaactgatcaaggtgaacaaaatgcctaaacttcattcctgaacatgttcattcactcattcattcattcattttccatgcaatatttttgagctcctattatatacctaagggcttccttggtggctcagacagtaaagcatctgcctgcaatgcgggacaccaaggtttgatccctgggttaggaagatcccctggaaaaggaaatgtcaatccactccagtattcttgcctgggaaatcccatggatggaggaacctggtaggctacagtccatgtggtcgcaaagagttggacatgactgagcgagttcactttcactttcattatataccttgctctcaaggagcttcatggaagagaaccaagcacctgggctctaacatcctataaaatgtaaataatattggttcaaacctccattccatgccttgtgaatgctctgtgatatctaagaaatttgaggcattccatggagtcccatcacttcatggcaaatagatagggaaacagtggaaacagtagctgactttatttttctgggctccaaaatcactacagatggttattgcagccatgaaattaaaatatgcttactccttggagggaaagttatgaccaacctagacagcatattaaaaagcagagacattactttgccaataaaggtccatctagtcaaggctatggtttttccagtagtcacatatggatgtgagagtggactataaagaaagctagctccaaagat

SEQ ID NO: 36906 - DNA, 1990 bp, Bovine  19866881422744
aatgtctgagtgctatcttaaaccctgagggatattccaccaccaaactcaatgctattgaattgaagacatgtaagttgacagccaaatactatttacagccaaatctgctaaaaattcaagtgaagtgaagtgaagtgaaagtctctcagtcgtgtccaactctttgtgacctcatggactatacaatccatggaattctccaggccagaacactggagtgggtagcctttccctcaaggggcaataggagtagctaccacattctaacactactgcccagtcagacgttcaacttttgcagagcattaaattagtctggattcttttgaaaatgtggtcttgtcatttcagagatctgttacgtgaaacccagagaggcataaaggaattcacgtgaaagcaaagtatgtgttagttaaaaagattcctctggcccctttatatttacccagctaattcagacccatctttgagatcaaagcaaaaatgttccttctgtgggtttgctttctttaattcctctaaatgatgttagactccctggctcccagcttgtccatgctcctgaagagacccgtgatttcctttcacattagattttaattttagttaatcaattaattaatgatttgttaatgcctctcaccttttgtagtctataataacagcactcttgactgcctatcctatgctgctgctgctgctaagtcgcttcagtcgtgtctgactctgtgcgaccccatagactgcagcccaccaggctcccgtccctgggattctccaggcaagaacactggagtgggttgccatttccttctccgatgcatgaaagtgaaaagtgaaagtgaagtagctcagtcgtgtccgactctgtgcgaccccatagacggcagcccaccaggctcccccgtccctgggattctccaggcaggagcactggcgtgggtgctgtcgccttctccggcttatcctatgcagcactgttctagttgctttatatgcatcattcattccattggacccacaaggccattgtcatcgcacatcttattttttcatgtttacctacatgagaaaactgaggccagagtgatgggaaaaatgccaagtggcacagtcagtaaagggcaaagccaagaatgaaccaagtcaaatgactctggaattcatgcttttaacaactgtgttacggggcttctctctaagctccaggacaacatctagccaagtgctaactgaatcccaggagtttaacaattgtttgggagcaagtgaatggatggacacaaggaggaggaagtgagtgaattatttggttctaagcctgctaagtcactcttgcccaggagagtgctgtgtgttcatattgccaagcacttaacctgaagcttgactgctggatggagtgatccaagaatctgcaaaaacaaaactgagcctctgagagttctcgcaccactcccaccctccctgagggcctgcagttggaaagggcttattttccctttgtggttccagaggaatcctgaatagaatctgccaagaagccaggacagagactgagccacagacagataaaacaccaggaatgccactcacctgcactttcagtcggtcctggatgcttagctcagcatctctggagaaatgtcatctaccttagcttctctgggatgactggtttcctggtctgagatttgagggaagaattagctgattaaaaggttaatatataattgtaggcacacggtgcctggggaagaccctcgaccatttgatgtttaactgaattaacgttcgccagttatagattttctgcttgtaaaattgccagcaaatgattctgagtcctgaatctgcattttctgtgtacaccacttgggatgtcagtgttacaattgtctcagaagcaacctacccagaccctgctctcaaggcaatggaaagatttacacgcagaagtgctcagatatgggactacagcatc

SEQ ID NO: 36907 - DNA, 986 bp, Bovine  19866881479046
tggaaggctttctagaggaaatgagttgagtctgagtacctgaaggccaagtggggttcgaaccttcagggaaacaaggaagagagagagttccaggccagggggacagcagatgaaagggcacagaggcagaacgtggccagggaccagaagggcgggggcagggagagtgctgcttaagaaaaggctggaacgagcggagaggcaagacctcttccacccacacaggactgctctgaatcctgagggccaggagaagaccctgagtggttttaagcaaacttctgggatctgatcttgccctagaccttgctctgtcagagctgaggggtcacccctacagaacacatttttaaaaataaaactttcctttctgctagttattctttgaaaagttgaacttagaaataaaacacaagtaaaacaactcccgccacagacatattctatcacttactctaaaacaccaatttccccatgatagaaccactagttaaaataataataataaacaaaagaaaatgcttgggatgaaaatttgccaaatcatgcttccaagacgaaattgcttccaaaatatttcatgaatctagcagaagcagaaacaacacaaatcaggacttgctggtttcactggaggtgaaaaatgttttaaacatatttagattctttagtcagaggtccattcaaccacgtgtgacggtaatgggattataatggatacaattttcctctatctgctctggcattgacaaaatattcatggtaaagagctacttctgaacacctggaggcatcttgcagaatgttacagatgggcttgtttttgtaatacacatacgtagtccagcctcaacagctgtatgcgtctgagtatgtactctagatgcatgagcacatagcccagatcccaggcattccggtcagcatgagctcataaacgtgtgactggccttcaaagaaaggcctgttagaaaacccacacg

SEQ ID NO: 36908 - DNA, 681 bp, Bovine  19866881586015
acagctttcactgcctttggcatttcagtaacgaccccagaactgccactgacctgccagctcgcttggtaaagtgacagtctgctagagtccttcccctattacaatgtggcggcagcaggcaggaggaaagggagagagaaggcaggcgagaaagaataatgactgcaaagaggcccgcatccaaagcctcggaaccacgttacatttcatggcaaaacagaattatgttgcagatggaattaaaatggctaatcaaatagctgactttacaataatgagagtaatctggattgtccaggcagcccaacgaaatcacaagggtccttaaaaatgggagtagagtcagaggggacgtgactaccgaagcaaggtctgaagacgtgtgagggtggtttggaagatggaggaaggggttatgagtcaaggaacaggagtgtcttccagaaggtaaaaaaaagcaaggaaatggattctctctcccctggagcctccaaaatgaatgctgcctgctgataccttgattttagcccagtgggaccggtatgtggctcctggcccacacaacactaacggaataagctgtgttgtttcaagccaccacgtttgtggtcgtttgtaacagtggccatgagaaactcacacacaaggccaggagacagaggcagaaggttttctcag

SEQ ID NO: 36909 - DNA, 1343 bp, Bovine  19866881679004
ctccgcttccctaaccaccagtaagagctactgtcagtgacagcaatggtgtgatacaaacaacacgtgcatttggtctttggagcatatcatttgacccacacacctgtctcaggaacaagggtgacttcgtggaggtaaatgtagatacctacaaggggcaggtggaataaaggaggaagctgattagtgacaggaagacagtggagactggagaaccaccaggaaggcctcagctactgttattgctatcctacttccagcagagttttcagaggcctttacagacctgagcatttaatcctcagaacaacctacagaggctgctaccactgtgattcatttgcctctggggtctatattctggaggcccagtacttcccagaagttatgaatttttaaaaatgaaattctcaatgttgacaacaaattcctttcattaaacacttcagactcctacactgagctgccaaacaggacaagcaggacatatctgtgggacaaatttagtccatgagctgacaatgtgattcctctggtctatttattcctttcattccactgataagaaagtttatgccaagagagctctgcccatatccacattcctcttctcctaaggcccacttagcctgttacctcgtatgtttcccaatctgcaaagtacaacttaggaccctagtctcatggaggatctctaagcattttaccatatccccctctggtgtgtatatgtgttcttttcactctgcaattattttatatcactttacatttatgaaatgaggcagttaatataatgcatttatgaggatcataataaatattaattaactgattagtcgactgtcacagttatgttggtggtggtgggtggggagcaaacctgtaaaaatatttttatttttaaatcctttttattaaaaaatcctttctataggattctgtttacatatagtaaaaagtcatgagtgtaaacaggagtccacattcagacccaaagtataatcaccttcatgatgatggagtgaattaagtgacaccagaataattttccttggtatatcatgacagtttaaaacaaatataccacttgtaactgcaacctattcagatctatgtagactgtggtacaggtcatgttaaataatttcactaatcagttaatcagtctcccaacctgaaagaacatgcaaggtagtagtgcagaggacaatcagaaaatggaaaggaaattatcattggtttcttttccattttttaaatcactaaaactgaaaacccaaagaacttaggaagttctcaaggtatagaggatatacacagacaaaaatcccaatttc

SEQ ID NO: 36910 - DNA, 1148 bp, Bovine  19866881748064
catccatagatatgaggtttgtatactcattcatccatcgatgtgtccagccagcatttatggggcaccagcccttggctgggcccttgccagggcagaagatacaatgatggattagacagaaaactttggttttaaagaaattagtccagcgcctggctttagagcaggattttcaatctttccacactattaactgtttgggctggacactccttttttgtcagggctgttgtgtgcattataagacacttagtagtgtgcctagcctctacccactagattctgtggccgttgcccttctagtcatgattaccaaaaaatttctgcagaccttaacgaatatcccctgaccagggagggcaaaattgccccctgttgagaagctttgctttagagttagaaacatagcttttgttcctgccttgatctcttactagttgtttatttaacaaattgttatttaacttttccttatgcccagcacttaacagtttctggcacagagtaggtatgtggcaaatgtttataggttaaatggatgaatgagtgaatgaatgaatgtctgtaagaccaacctattcctaaggagctgacaggctgttaggaggatcttgagtcttgctatacacaaagccgagcaagcaatatattcaatcaaaaatatgcctcagctaagcaaggaaaaaagctgcttatatgatgtttagttgtgtaggcctgacagataattgagcgactggatttttcagtttcaacagattggtttgccattctgtagccacaataacagagcaaagtaacaatcatgtctatgtttaattttccggagggtgttgcatctctaaggctcacagtctggccaattaaatgtggccgattggcactcccacacaagtttgggggcatttaaaatagctctctgcaaaagaaacaaaaaagccaagctgcagagaaagttttaactctctcaagatttcatatttcaaaagcaggcttgtgatggtaaaattgctctgggtgacagtgaatagataagccgtccattttgagcatccctggtgtcaatccaagcgtcagctttgtggctggtgtctgtgtctcttggtggagttggatagttttttatatttaaggaaatcatcaag

SEQ ID NO: 36911 - DNA, 1226 bp, Bovine  19866881788854
aactctagtttccaaatatctgatttcaggaattcttatacattcatagaagctaaattttataaagattttctttatgggtatccatttcttcagtgatactttccaaatagactgcttgacaggccccttagttgactgacttcatccacagtcgtttccattaatccaccttctagctgaggcagctatgtgccagcgtttggaacaacttgatatgagccaaaacctgtatggtaggactttctagagagcgtttccattctttattgaaagaggttggaaaggacagcagcctttgcctttctcttttcttcccgtgtcttgtagagacaaggtctggaggtccttcagccatttttcaacctgaagcaatgagcctgaagaaaaagaacaagagaagctcagagaatcctgaccttggctgatagtgacccttgaaccaacactggcagccttctgcctccagacttctaatttgtcccttctcaaggatgataccagagatgtggagaaagagataggaaatgtaaaagtagccaaaataataaaaaaggaaaaaaaatagtggcagagatccgtatctctcttaggattttaaaaaatcacagaaaggaaaggagcacacaaccaaagcaagcccatccccattccctccagtggactgagcagctcgaaagcagagatgtgcgcccgtgctgtgtcgtttgtacctggcatcctgcctggcgtagtaggtgtttgttgaacaaacaaaggaatctttcttttcacctcttttaactttggccaaatctatctggctcatcagagcagtcgtgatgacggttgtttggtggctttccaaagacggtactatttaagatagagcacacagccgtagggggccaggcagctggagaactgaacctggctgcccagacctgtgttcacaaaactcacacatttcacctgaatcttaaagaggaaggggtttctaagcacttgctccaatttgtgattctccttggagaatttcgaatgaggagtcaaatataaggttgttaggagaaactcgttcattaaagttctggcctctatccccaggatcgtatgaccaaatgggagacatgtcagcaattttcaggatcctacctgagcttccaacttggataccaggagcagctgccagcatctcacctgcaccacagaccgcttccaaactgtggcttcccgaaaggcagcga

SEQ ID NO: 36912 - DNA, 805 bp, Bovine  19866882006043
ccagcagacatcactgatcagccgtgtcatgatgcaccactgagcctggatttggcctcagattccttctcaagacactttccccaggaatcactaccattcaatgagagctgaccccaggatggaatgtatttgccatccccaaatgaagtctttgttctctgatccagctctgttcttattgagatcctttgggtgcttcatggagaacaaagaccatccatgttccttgggtttggtgcttattatctggaaatgctctgattgctagaagacttgctgtacagctgattatgcttaatgtgaatcctcctcatatattgacacacacaaaaaatcatggaagcaggacatttgtaatgcagcactgtcccttcttctttcaatacattaccataaagtaaactacaaagttgagaataaggttgacatttaatgaatgttttctttaaaaagaaaaaaaaaaaactgtccatgtgttttccaggctcccttgggaaagccttactttgtctcaggttcccagatctcacagataacccagcaagtgagaaatgagcaatcccaagtctcatgtatgtgtcgatacttgccctctgtcttgggctgacttactgtgtctagagttgggctgcagaatggcacccatcaccctaaagtcaattccagcggtgccttctctggagaaagcatatcttgtggctaatatgaaatgcaacagcacaaaacacagatttgaagcaaaaatctgaaattaatttctttaattcttcttaggaatcaagtctcttctcatatccaggca

SEQ ID NO: 36913 - DNA, 2938 bp, Bovine  19866880352014
cttgactgctaatgatttgtttctttatcttaaaagagaaagttacttcttaggggctcagataaaaactgcttaagttccatttaaaacaaaagacaaatcctttatatgtgcaatttaagacaatttgaagttcctctggtatctgatcattcttagaaaaattatagtaagttgctttatcaccattgggaaaaaatgttttgtaatattttagattataataatggtttccatgggggcaacaggtatcagtgggggagtagactctgtgggcaggctgcacagtattactttttattttttaaaactttcttattttttgtgttatttattttactgaaacaaacgtgagactgaatccactgcagaacttaacatggaacttccttgtctctctaataaaggacacacagaaacaataagcttattagaaatgataattagatcattaccatttgtccaggcctgctcacaactcaacacctactggcttcaggacagagacaagaaacatcatgctggcaagggtagttactgtaatttgcttagattgtgtggccatgtcattttacaagaaggacagattaagtaagtactctgatttgctgtgtaaaaatagtaagggttataagaacaattttccatcttgcagtctttgtctctccctttctcactctcgcttcacccatttgtgtgtgtgtgtgtgtgtgtgatgtttccccctttgacatcaacagaacagctatgagaaacaggtgagttctcggcaaaaatttttaattgaaccaaaaatatttgtcctattctcccctctcttacccaaaattctatataccctggatcagatatgttaaattgcattcttaaaatcatggtatgtttcaataaaactaatgactaatgtagatcattggaattctcatttatgatgaaatgttttagtaactataagaaactgaaagcttatggaaatgttcttctccatctaacattatactaaaaaatgataatatccattagcagatcctaccaaaaatctacaggttggctccaaaagaagaggtcttaatggcatctcgctttgaagttatcagactggaaacagttggaggagacaggatgcactctgttggcagttcttgacctgagaaacagcaaattcatagggatattgaaccgacttcctgctgccaagaggtctgcagtccgtttaaggaaaatggcccacagcacccaagatgagtgccaagtgaacggttccagccagagggtactacttaggactctagaaaagagactctgtgggttaaagaagttaggaaacacttcacggggaaatggtatttaaacatactttaaatagcctaaatttctgtctacaaagaaaagcaagactggaaagcaaaatgggaagaagcagaaaaataaagttgaaatacttcacttctctcctattgttaaatagataacacaaataataaagggcgtgggaaacgggtacagggttgtcaaaagagagttattttccctatttaatatttctaatatctgtcccctgatcggaaagaggtaaaaatgaataacacttctgggaattagagcagggaaggagtcacatggattagtccatcttgggtgatgggtaagtgtctgacctttgtcaaatatctctatggcatttgacttaatctcactgagtagatttctttgctatggttcagaaaaaaaaaaaaatgtaattaagtctctgttccactctgggtaggtaatctcagcagtatttttcaataaggagtaacttctagaacctgagatgatggaatccaattccaaattggcaagcagctcatctgagagttctagatatgcagccagtaagacaggttaagagtttttctgcaatgcaggagacccatgttcgatccctgggtcagaagatgatcccctagagaaggagatgtatacccactccagtattcttgggacttccctggtggctcaggcggtaaggaatctgcctgcaattccttacctgcctgcaattgctcctgcaatgcaggagactcaggtttgatccctggtcaggaagatcccctggagaagacaatggctacccactccagtatacttgcctggagaatctcatggacagaggagcctgatgggctacagtccatggggttgcacagagttggacatgactcaaggcaagtttaatgtggattctgccactgacctttggagcctgcgtttctcacttgtaaaatcagcagctgggagatgacagtgaaaatcaactttcttcttaccctaattaatccctttctgatgctacaattccaggaaaccagattatcatttctcttacaaatatgtataaattaaaaataaaatcagatctgtgttggagcctaaaatatgttcctgagtcaagcagatgatcttttgcacatggatttcatgatatctattttggctgctaggcaactttttaaaaatggtggtagaattgcagttatttagttataatatccatggattcttaatactgcctgatatttttgtataaaatgaaaagaaaaccctttatctacatgttctgataatgcatctatatttttcaaatagaaagtaagaaggaataggatgtgtgtcatcatgggcttatttctgttctcccaaaactcatgagttcaagtcctaaaccccagtttctcagaatgcaattgtatttggggttagggtctttaaaaggtcgttgttactgttgttgtttagttgctaagtcgtgtccaacgctttgtgaccccgtggactgaaacccccaggctcttctgtccatgggatttcaaaggcaagaatactagagtgggttgtcatttgtttctccaggggatcttccgaaccagggatcgaacccatgtctcctgcattg

SEQ ID NO: 36914 - DNA, 1774 bp, Bovine  19866880565730
cctatcctaagccttgcaaacaagttttccagtcaccctattatggggtctaatgccttgttgtttcacagggacaaattcatgtctaaagggggtggggaatgaaggtatcagaaaacacagacaaatataggtatttgaagtgaaaatacactagctttctcagtacagtaaatatcccaatttgtaggaaagtttagcttaacttatggataaaattaatttaaactgtatttgaagacaaatgctttccagtaaacagcaatttagccaataagaacttgagtatggtgggaggtacattatgttttagctaatcttatttattaaaatgagctaaagggacagaaatttaatccctaagaaggtattggatttgtcccaggccaggaaaaagtaaacatgtttgttctgcttcccccttcctctgaaactgcagttttttctttgtgtgttaattttcttccataatagccttaaagtgaagttaaagtgaagtcgctcagtcatgtccgactctttgcggccccatggactgtagcctaccaggctcctctgtccatgggattttccaggcaagaatactggagtgggttgccatttccttctccaggggatcttcccgacccagggatcgaacccaggcctcctgcattgcaggcagatgttttaccctctaagccagagtaaactcttcaataatagctttatattggtccatatactctcatttgtggcattttaaaattctgttcactccttcccctaaacctttagtttctatgacttggcattttcataattcttcactcatttttatatattagcagaaattaactttcctcaagctttacctgacattcctttttccaccattaaagtgggcattctataagacaaggtcagcccatatttcatccctctattcactctctcattgatctcatcagccacacatgctcacctgatatggtaatgtgaatggttatcactggccttaacctctgagataaactgatgcatttctaattacatcctgcataattagtggcctctgagtatcccagtggaacagccatctcaaagactgaaatccaaaccaatgaaccttacagccttaaaataattctcctgatattatgtctgcttattgtagcatagcttctttttttttctgttagccagccactaagcagaaaatttttaaattatccttgatccctctgtaatcccaattctagcctttggtcatttgcccagacttacattccttctaatacagtagttttcatattcagcttttcactttgttccaatgccatcattctctatgaagtttatattatatcattattctgcttactaatttttctgtttctacctgccccaggaaattacttcctatttatatctaccagacttttcctattgcttgcaaaatgaaatgtaataattcaaaatcctctagagtatgcaccaatcctgtgtctggaagcttatctttttgtacacagatgatcctcaactaaattcacagtgggggaaggagagggtaggataggctgagagtagcactgacatgtatatatacgatcccacgtgtaaaacagatagccagtgggaagctgctatgtatacttagagctggttaacgttattgtacagtagaaaccagtacaacattgtaaagcaattattaaataaacaattaaataaacttaagaaaaagactgtttttcagactctgtctttgccattgccaaacaagtatctg

SEQ ID NO: 36915 - DNA, 1651 bp, Bovine  19866880609809
cacatatttgtttcttaaaatgcattaaatagtaactgtatcatgtcttttgggatttggtgctttgttctatatagtttttatgtgaaacacagatgaagatagaagtgtctagtagagatcaagaaccatgttgtctcaaatgacaagatctccatttttaaggctgaataatattccattgtcctagcattctcttaatggatatttgaacaaatatttaaagaatatgtaatgaattcaagttttcagctgccccaggcaccaaagtattagtctgcttggagttttcacttgttttctcccctcctttgttgtgatgaatttcatcagtcatcttcccctccaggaattaattaaacttaggctctttctcctttctctttacacacacgcacgcacacacacacacacacacacacatacacacacatacatattccttgttaaatcttgctggcagcaaatagtagcagtagaaaggctctgttaaagcaattaacgccagggtgtaaatagctgacaaaacctgaaatgtgttacacagtcagacatatttgcatgataataaagaacagagcattttcccaaaagacataagttttaatgtaggaatctaagaagaaggaaataaggacaattttggagtcagtgtctgtctaggtgatcctctaggtctgttcaatccaacagataaatattgagcaataggaaaatgacaggtttagaaaattcagagatctgtacaacccagttccagcttccaacaactcataatctaatgacaaaagcaactataacataatataataattgccataatgagtagagaagtataaaagattgctaaagaatggggaaaaggaaactaatcagctttggaaattaaaaaaaagaaaaaactcttgacaaggcaatatttgcagaatgaacatcaattagcaaatggtactaaagttggagagccagggagtagtaggatggggaagctaccttgcattcctgggataaaccccactggcccataatgtattattatcagtatatatacacttttacaaaatattcaattttacattggattgcttttgctaaaattttaaaagtatctttcagtatgttcatgaaggatattggcctgaagtctcttctcttgtaatatttctatcaggctttggtatcagagtgttaccagtctcacggtttgtggtagacaaacattaaacctattgtgatagtctaccttcaataccaatacaacactttcaatatcaactccagagctgtagcaaggatcaaatgcattaatactcgtaaaacattagaatagctcctgacacacaatacatgctatttgcttgctaatatatacatacattttaaaattgtttgcctttcaccagtagattgtaagcttcaggaaagaggcattttctctattttgctcagtgttgtattctgaatgcctagaacactttgctgactaattttatttatttgtttgtttatgtgtttattgcatttggctgcagcaggtctcggttgtggcatacgggatcttcattgcaggcttctttctggttgtggtgtgtgggctccacagttcacggctcaggagttgcagtgagcaggcttagctgccccaaggcat

SEQ ID NO: 36916 - DNA, 1563 bp, Bovine  19866880617513
cagctttgtaagactaaataaaagtttgcaatgccaaaccaagatgaggagttagagcagaaatttgcagagataatttatatagcttcttttagtcaataagcttatttttctttaatgagaacaaccttgaaaattaataccagaatattcctcatattatgtttaatctctttttaggtgtactagaaatgtgagaataacaagtgtgttaagaattccctcttcttcagctttctaagacacgggttctgaggattctgtcttttgctctttggagcagtaatagacggttgcaaatcagtgcaacagttaagtctgctggagaaacagcacagctgcccagtgaagctttagaaacagtgtgaacttaagaaaagatacccaagatattttagatagttttaaaagtttctgtacatgccactctccctatcttaaatagaccttcaaggaggatcttcattaccactttaagttttcatgtttcattttaatgtgactaaaggaaatggcaacccactccagtactcttgcctggaaaattccatggacagaggagcctggcaggctacagtccacggggtcacaaagagtctgacatgactgagcgacttcactttctttctttctaaagctaaggaggatctggaagtgagatggctccattttatttggatggcaagtaggaacactccactttggttaagtgctgagtgatctttgcgtatttcatttcacagtgtgagtatggtaaccctctccttttggatgtctagatgaaaagtccttagttaaagaatcatttctgggtttactaagatcctgaagatgaaaacttagtgatacacatcctcaattctgtagtggctttcatctctaaaaattaaaactcagtcacacagtctggaaaattcaagtaccagagatgtaatagatcctgaaaatcaggtgagctgccacagccccctctccccacatcctcgtctctgagtcaccgtgggtgtgctctttgttgctcaccccagtctatgctggattgccctgttatgatttcctgcagtccttgtttggcatgctgacttacatttgctcggatgcccacagtcaggtgcaccatcacaggtcctgcctctgatctctctccctgggaagcagaagtctgctgagcatttctttgaggccagtagactggtggctcagcatgactgcattattaggggcctttcctttgtcctttgatgttgattcatccagaaactggatgtgagaactctggcaatttccattgtcacactcctctgtatggattaggttcagggtgtacaaaaagcagagacaatgtagggatcacctctgtggagcaatagagactgaacagcatcagccctaagacccagcaggtgactgacaaattgaagtcaaacataaaagaacctttcaatctctgccttttattcacctgtttgctctcacatctactccccacccttatccactccagttggtatcgttacgtgtacttcccaggttccttggcctctagtggtttgtgtttagtca

SEQ ID NO: 36917 - DNA, 784 bp, Bovine  19866880657718
ctcatttatttttctaaaaagctaaatatttgacagtaaagagttaaggataaatcttgaaaactgaaatgttctcatccaggcaggcaaataaaatggaaataaaactataatgattctttcgattctacttaagtttaatactccagaaaatataacaaccagtgaaatcaattctacttcctaaaatttccttctaatttcctttcattatgtttatttgccttcttttaaattagtgcttatataccaaaatgaacagactattcaagtggaaatagcaacaaagagctgtactaataatgaaggcattgagagatgtttgggaatagaaagaagctataaaactttagttacagataatcttgaagagatatagttattacactaaaaggtcaatgtttgccattagattgctgtctaccaccgtataaatgttatatattagatagcttacaaattggagttcattaggataataatggactacaattgcttgggaaaatttaagagggttgttattaggctttgagtctactgaaaaacaggcaactaataaaggcaaggagcaacatgtaaggttttaggtgacagattcccaagaaattcccctgaagtatagttctgctgtgggcttcccaggtggcgctagtggtaaagaacctgactgtcagtgcaggagatgtaagagacatgggttcgatccctgtgtcaagagggaggagggcgcggcaatccactccagtattcttgcctgcagaatcctatgggcagaggaacctgg

SEQ ID NO: 36918 - DNA, 1146 bp, Bovine  19866880707991
atttgaacctcttggacccaagcccttttgtcactaaaagtgtgaagaaaaaaaaaagaggagtgataattgttcttggctacattttcaggttgttgtcttgagattttgctcagagaccatggcaacaaataagaaatcaaaacatagaaacctttaataactgaaagctgaaaagattcaataaaaatgttttagtggactcccttcctaatgaaatttattgtttttaaagagtctaagtctatagggcttcaagaatacctaagaataaacctaattcccaccggcttatgagtgagaattctataatgatataagaagagtggaaaatgagagaaacaaatggcaccagggaatgtgaaattttatttccagcccagaggataactttttagaaagagatcttggatttaatgctcagttttttgcatttgctgttttcattggcccacttgtgcctgaaccaaatgcctgcggttctgagaggagccaggaagagggatgaggtggagccccacaggagagagaagtgattattttgtgagatgactttcaggaggctgactctgcacgtgactctgaaggagtagattttcgttctctcaaaaatccccatcagtaagtctaacagcaccatcatcattatggggattagtactagagtttgctacagcagcagtggggagagaagatgagattgtgaacatgtcagtgaaaacctgtaatctatatcacagcttcagaaacttctaagtgttttgaactcaggagaagaaaatcttgcaaggaaaatctaatcattaaaacaaacaaaaatgattcatagagatatcaaaagtcctaaaacacccactgttctgcagttaacacattcttagacaaacactatcattccatcacattaccttgttttatttctctatagcaggcagtatcatacaggtcatctacttatttatttagagtgtgagttccatgagaataaggaacttgttttatacctgaaacacgtaggatgaaatctgacacacactagtcgttgttaagttcttaggttgtgtccagctctttgcgatccgatggactgcagcacactaggcttctctgtccttggctgtcacccagagtttgctcaaattcacc

SEQ ID NO: 36919 - DNA, 1375 bp, Bovine  19866880787963
cacacaacaaaatgctaccaccaatttttagtaaaatcttgattacaatttttttatttcatgaaaggaaatggatataaattcaagtctagataaaaaagaataatatcccaaggtactaatagaactctcagatgtcacaactaaatgttacctctgaacaatcatcaagaattagaatgtagtagaaagctggaaatgggtaaaaattatctttattttccaaaagagggcaaccactgaccacaaaaggcattgttgattcagattacagacaacatcatgatatgaaatgtcattactaaaggacattcaccttatatgcatctcagtggtaataattatttctggcaattatcttttgctttttggcccgtgcagcttagtaactggaagaggactctaagcaatgccatcaagaatttataataatacccctttcattaaagaccagaatggtgatggaaaaaaaaagaaatataataaaaaataatttggaaattagtagagaaaaatttttaagaaaggactatttctcaattatgtataaggcataacaactggctatgtttgggaagtaattttatcatacagaagtagccaaaagggtaacagattaagaaggataaaggtattaattgtacattagaatatgtccgaattccaaaataaatttagaatatatacatagtgatcactaacttgctctctgacacttttgcacaaattttaattacacctcaagagcatcttacattcttcaagagaaatccatgaacaagatggtggttaacagaagcagattcctcctgaaattctgcatctgagcttcagccgagggaaaggctgttctattaataacatctttagtgaaatctatcacatttctctgaagaactgcaaaggcttcattatatctgacttctccattaacttccacagtggtgcattcccccactttaatgtttgagccatactccccttagcaaccgaggatttattatgttgttgtcattgacacagttcagctttagaaaaagcagcactgaaccaacaaaagaaagaaaaagagtggtagcagttcgtgaactcttagctgcagcatgtgggatctagctccctgatcaggtagggatagaacacacgagctttgggagtgagggatagaactctgctttgggagtgaggagtcttagccactgataatctgcgtgttgcaacaaagatctgtgtgctgtaactaaagatccctcaggctgcaactaaaaatcctgcgtgcctcaacaaagatcaaagtgccatgtgccacaactaaaacctggcacagccaaataaataaataataacataagtattttagaaatatagtagtcaa

SEQ ID NO: 36920 - DNA, 728 bp, Bovine  19866881102515
caaatagaaagccaatgtgtcctattggatgataaataatttgaaatttaatagaattataaaaaaatcaatttgctcttcatttcactggagacacaattttaactttttggtcagaggggatgacaattttctcatcaaaagggcacagctaaatgaaacagtaaggcctgccaaagtgtcttccatctcaaagtccaatttaaaaataactttctgtcttctctaaagatatagaagcagtgtgaagagggccttgagcaggctccatgagatacaggttttttttccccaacccattaataaacactgacttgaactgtcttttaaagattgtgtggctccaggacctgttaaggctttctgtggataatctggaccacacagaggtccttggacaaagaatcagcttccaagatcccaagaacccagcggcatcacactaccctccagcttccgggaggggcttcttgatttagtcctacatgtaaatgtacagatgctctcaacagcctggcagggtacccagtgcaataagaagtgttatacttctttttgcaaagtatcattaaaagctatgtaccatgcccagactgagttatcagatgctccttagattttgtcttacttagtgtgtctttagtgttagtaaaactatattcatttatcagttcttatattttgggcagtacagtttggggaataattttcccccactctcaataagt

SEQ ID NO: 36921 - DNA, 1010 bp, Bovine  19866881224533
ctggaaccagcctaggtaacccctggccaaaaatctactcaatttcattattcaatcaattaccaaggctatttggttctaacatgtaaatgtaagttgaattcatccatttgccctttaccattcccactgcagctgtcttcaaccagaaattctcaccaactgtttaattcagagagaagttacttacattatctaaccctaaattttcttatctgtaaaataaagattattatagaaccaagtgttgttgtttttttaagtactatatgcaaatcacagatgctagcatataacaagctgtggcacacaatgttggagttatacttagtattcatttacctttccttgcttaccaaaagaaatccaattttgggagaggagtcaggagccttttgaaaaatactcatttttaaaaacatgcttatatttctgctttttttttttaagggaaaatcatattctacccttcttagtcaacagaaatgaaaaggataaagtgtcatccactcttttttatagcaataatgtttaccacaccatggctttttattagtggtgcttagtaaggactgaagccattagatatctcaatatcaatatgatgctcaattaaaccttataatttccttttaaagtatcattgaccctattttgcagtcataaacacaattctgtagactttgcatactataacacttctttggttaacatggattcattccttagctagcaaggaaaatatagttatcactcactctagaagttgctttaaaaaacagcaatgaagatgttcctgaaaactgacctcatgagactcacaggtctctggccatgagtttctcttcttaactctttgctctgaaagtttcttttccccttaactcaatttctatgtcttgtacattttattacagaattgcctttcctacctacccactttttgcatacccactgttgtgtctcgacttcaggcaaagctagctcttgcttagaatatctcaaaaagt

SEQ ID NO: 36922 - DNA, 1551 bp, Bovine  19866881249138
taatacctgctgccatgaacatatactttgaaataagaagtgaatacaagtccacaatccaaatccatagtttcttttcattatttcccaaaggaccttagctgccaaatattgaaaataagcttttctttatttgtgatgtgaggtggtggttgcagataagaagttgattcctagctgattaaaaaacttttcctggctgaaaatatcaggagtagaaataaagagtgcaattatttatacatttattggcaaaattggcacatgttgagtagcgcttttctgagtggcttattctcgaatgaacagcaccatgtgttaaattgagtttgagtatttgtggatgactgagctaagtttattttcaagcttggaagctttctaattgactgtataaccacatagtgtaattgatgctgtatgttaaaaataactaacctgaatacattcagtacttttttcctgtagtagtataaagccacctgagtatctataaaaataaattcaaagaggcatatatatgataatttaaaggtaatatttatgtttttaggcacaaatgattcagtcacttcatcaattccaaatggtgccatgcttattatagtacttgaggtaatataatttgtatgacttggttttctttcacctgcaaattcttccgttttgactacaatgtcctcatattagcatcatgagaaaaaagaagctctactgatccacaagtaccatcttctactcaaaaagcttccctggttggaattcatctttcccctaagctatttcaagatttagtgtggcacactcatattacacatgctgtgaatatagaaataaagcaataggtttgtatcacagctatagacataattatgccccactgtttgtgattttcagagaagtgcatttttattaaagcaatcatgattagaattattagaatatactagccagaattaaaataattatttctacactatgaaaaaaacatattttaagtgtttttgcattctgcagctacccaaggctctgcccataatgaggtgctcactaagaatctgctaaataagcaaattaaggaacttgcatccttttattaatagactatatcttaagaaggtagaatagtaatgcagtcctctgagctgacagaagggaaaaagactttctttagcatgctaaaccaaccccacttatttaatcagcctgcaaactcagtgttaagtacagctcaacaattagcagagagagttctgtatagacaaatattaaattttaaatgagtcttttcatcccttaatgctgaatagcatggttgtgctacctttttaccatggcagttataaaatttaattgtacaaataactcatactgtgtgtgctgagttatttttattcatattctataaatcaaggaaaatgtatcacttggttacttatacaacggaatatccaaataatataaccatagaataattttcatagtagcctttaatgttcttttagcaaaattctggacaccctgctgcttcagtattaacattttacagca

SEQ ID NO: 36923 - DNA, 871 bp, Bovine  19866881457503
tgaatccattaggttgaccacaaatgcagagaattttttcttaaaatcaatgaagcaaactttgtggtatctatacatttttaaaaaatggccttaattttctaagctgtatgtaaaatgtttcttgtacttaatttctataaggttgtatatttttacacagtattatagtgtatattctacatattgtacagcttacacaatggttaagcattaaattatgcattaaattagattctaagatttcctgtgtctattcactttgtcttacgtatatcaaaatattccaaagtattaaacattttactgatcttaaaaatatgaactacagctagccatttgttgaattattttttgtttactctttgtcacagacactgacatgaaatataaataccatccattcttaattaagaataaacattctaagtaattaaaagtaaaagaatactgattaataattagcatttttcaaactgtcatgtctagatcaacttatgggtgatacataaaaaatttaatttacgaagaaagtgataatttattcctccatgattggtcattctaatgcaaagatatttaactttctcgtaggatatttcacattaataataccctttgaagatctaaacttaatggactcccagaatagaatatcattcacgagtggatcttttatttgaaatttaaaaccagcattgttttctaaagaaaaggtcatttttcacacttgaattataaagtagctcagctctactaatgaaagctatgagtataaacagtgtccaattaatttacaactgaaaatagaataactttcctcaacatcttcaactaatgaaaccagatttctcgcttaactcagcataag

SEQ ID NO: 36924 - DNA, 1418 bp, Bovine  19866881667246
cagacatctggagaaaattctatttaaaaagatacatgtactccaatgttcacagcagcactatttacaatagccaaggcatggaaggtttccctcatagctcagtgtcggtaaagaatctgcctgcaatgcgggagatctgggttcaattcctgggtcaggaaaatcccctggagaaggaaatggcaacctactccagtattcttgcctggagaatcccatggaaagaggaacctggcaggctacagtccatgaggtcgcaagagctggacacaacttagcaacctggctgtccaacaacagatgaatggataaagaagatatggggtatatcttctgtgtatacatacatatatatgcatatatatatatatacatacacacagaatactactcaatcattaaaaaaaaatgaaatgatgtctttgtggcaagatggctgggcctagagattatcgaattaaatgaggtcagacaaagacaaatatcatatgacaacatttatacatagagtctggaaaactgatgcaaataagcttatttatgggaaaacagatagacattagaaacaaatttatggttaccaaagagaatgggggcaggaaaacaaatgaggagttttggattaacatatacataaaactatatacaaaatagataaacaataaggacctattctataacacaggaaactatattcaatattttataataatctataatggaaaagaatctgaaaaagaatgcgtgtgtgtgactgagtcattttgctgtacttctgaaactaacacaaccttgtaaattaactatacttcagctattaaaatgtaatactataaagtaaagccactaaaatataagcaagaataattttcattcaactgtattttaaaaaaagctagattgagaaaacttacatttataaatcatgactctaggtattaattctatctatcacctattctgagaatgagagagaatctacccttgaattaaaacaaataaccagagtgctataagttttatttttatcccaacatatggtactcaggcacttctcaactgagtattaagggattaacctacagtatttgttgtccttcagccaaggtggtcaaaatctctctactatgttcatttggattagtgtacagtattctgagctgaatttttaaagaaaggatatcttttactacgcaccatttatttagacagtgctttatctgtacttttccttgcaaatggaagtttgtaaagaaaaatttatgtaattccctgaaatataacacattctaaagcataggttctctttttttcttgaaaactcatcttattcaaagtggctgtgagacaaagcagcctggcatgaactgcctcttgagaacatggtcactgacagagacaaacgagtcctaatg

SEQ ID NO: 36925 - DNA, 795 bp, Bovine  19866881850298
ctctcgcagacattcatttgtacatgttatgagagactcggtgtatgtccgcaccaaaaggaggagggaggcaaagagaaagtgagaggaagactgagccagcggatatattcatccgaaagagacaaacatccttgaactccttgagaccttgtcacattgaactcctatttgaatgatgttacagatcaggaaagggggagagtgtggctctggatgcagaaaattcagcgtacagctaggtgtgcattagaaagtaacggctgatattaatttcatgagtacagggaattgtacatgtatgtgtatgtgtgtgtgtttgtgtgtgtgtagttgaaggagagaggcagacagggaaagagactcgattctttgtaacctaacccagggtaatcagttggggctttgcagatgaagctctgcacctagggacagacagctgacctccttacacttatccttgatttttctctggagcttcgtatgcataagatgggatttcttccttcccaaggccactcacatcaattcgctgatcttccagcagccaatactgagagaaaagtgtgttagggaaacctcaccagagctgacctaacttttcaagttatataatcaatagaacatactaagaggcttgcgtgttggtcagtgttcaatgatgcctcaccagaaagccaagatgccttggaatctagatagaatgtaatgaccctttcagatggggaaagtattctcaagtgaaacttacagcttgctgctgatgctgaagaaagcattctgagattcctcgta

SEQ ID NO: 36926 - DNA, 1589 bp, Bovine  19866880683908
tcatatttgatgacttttggtgagaaagacatcattactggatttttaaattactttatctgataattttactacaggaaaactgaatacctatgggtatgtttaaagttttaatgtatttattatctgaccagatcttcagggtatgatgtctttatagtcagatttatctaaggtcttttccctttacatattttggctattcagaagttcagtggaattcttcagctttgtgttaaaaggtaggcattcttctcccaaaagccattcattagaaataaattttgttcattagcaatttgaaaaaaaaattgaattttagcatattttctttcatgaatgtgtatgtgaaactttacaacctggtcataactctatactagtaaatccaaagcaaatccccatgtagcgttttccctattctgctcaaactagcccagctctggctggtaataaattcccagaaacacacatttggaaatgtgcacagaacaaatttaaatttcagtaatcctgagcacacacatgtcaaaaacaaattatgggcacacaagagggtaattagcaaggttcacaaacagcacatgtaaaaagctttaagtgttcacatgaatgtcatagcttgtgatatagtcaatccaatttgaagaatttttccacttgccactgtatgatttcagaaactatattcataaccctagtactgtgctctttgaatgtgtttagttgtgagcaatgaatagcaacttaacatgcttgtttccataatattcttgaccatagaaactgggatttaaactttcaaagacataaacatgtcacatggcaatgtttacaatggaaatggactcttggaaggcttcttattggattgttatatttgtagccagtgtctgctctcttaacatgcttacgaagtaaagctgatgcttttctggcctatgttctatacaagcactaccaaggcacaggtacacagatgtacatttaataagatacttcaccaattagatgagtctcccctttgacagagtagatttctgagttaacgcatacagctttccaatttgtgctaacaacagtttcctagcacagggagttccagtttcaggagacccactgacagactatgaggcaggtagtattcctccagcatcattcctagctcttctctaggtctaccagatgccagaacatagcccaatagagcagaacagcttatagttctaaacaatccaagaccagaagagcaagctacggtggtgagaggaatcagatctactagagatcatggaatattaaagactgactgcaatttccatccttcctgatggcactgtaatcccagaattaatttcaaatagaaccctgagtagacctgtacaccattcaataactcacatggttaaaagagggggggacaagagggaagctgtgaacagacatgaagagagtgttactctgagttgattactgttttaagcagtgtaattttttttcttgtaacaactaacttatggcaattttatttaaacaaatattttgtggcttagggaatgatggaaatagcaaagctagtaagcaaagtt

SEQ ID NO: 36927 - DNA, 3307 bp, Bovine  19866880480111
tagaagtgatctatgaaaagaataggtgtttaattaattgcatgttccctcctgtctcctataagtgggcttgtatctgaggtggagctgagaagatatgttctgcactcctcgccttgacctcatccgtgaagtacttggggcaaccataaattgagcagaggtcaacaggtttcttccttgcaagactcagagcctttatatctccaagagaataaaatagtatgcagtgcttcatcttttccatgcattttgacttcggctcacattttatttcacttttcattttgtagtgaaatttatctgtctcctttttttttttatagtaagtgaaaaacttactataaactatagtaagtttaaaattagactgtaagcttcttgatacttaagattacagtagatttatattctagatcccataatactcagtatagtactgagattatgttattaatcccatgtttcaggtatagaaattgaaattaagagaataaagagagttttttagggtttctaatcttggcacaaagactcttactgtcttatctcggttttcttatctgcaaaaatggaatgttaatagtatgtacctcatttttaaaaattggaggatagttgatttacagtgttatgttagtttcagttgtacagcaaaatgattcagttatacatacgtatttatattttttcataaatatatatatatataatgtatatatatttatattattttctcttatagattatttcaaaatattgagtatagttccttgtgctatacagtagatccttgttggctcttacatagtggtttttgtaaaataagggttaattaagttaatttatgaaaattctttgatatagtgattagcaaagagtaactactcaagattaggtatattattatatgcagattaatacatgaaacaaaatagaatatgttgtggtcacccagcaaagaactattgcaaattaagtcttcagtcaagttgtctgtaattcaacaactgtccttgtgctttatctgacatagaagtaactttttctcttggtaacttccatggagttcagccagtcacggaaagacagaatagcttgactatgggagatattctattctgaagtgttgggatataataggattcaaccccaggctcactgtgttctaatctggaaatctctgttcctgctttttatgaccttcttttagaaagaaaatactctactttagttcagggcatttaggatggaagaacctgatcagttgtagcatgtcttagttttactgtttttacagaccagaaaacatcaaatgaaagaaagaagggaatggaaaaaaaatcaaatagacataaaacttgtatcctttgacaagattacaagtgttcgaatattttgaatttgggatgatgagtggtgagatgggatagaataggatgtggaattggagaaccaagatttctgtcttggctagatcgtttgttcgtgtgtgacagtgtgagttggttttctcatctgaaaatgggtacagtaactaccccacaggattgtggtgagggtaaagtgaaataatgtatgggaatgcatccagtgagcattcactaatgtcattagaaatgaagggctgatgttgtcatcattcagccacccagaaaatgcgacacactcagcactgttctagcctgttgttcagatggaacataaagcagtatgctgcttctgcaaaaagacataatcctaggacgcaaaaaattaggacccgtgattttactagagtatgcttccaaatctttatttgaacttttctattatttcctttgaagatagctacatcttcctgagtatacactttttaaaagtgtatataagagaagggcattgaggaaactttaaacttgattgttgcttattgagggtcaatcatagacagtgattaaaatagaatatagtctgttcaagctgtggaaaatagcactttgattttgccaacattaattacattttttaagcttaggggtactgaatgaaggctgtgtgtagagtggttaagtgttgagtggttaagaacacagagtttggtttcagaccaggaagtagtttgcaagctgaccattgtatgctgcaaacatttggatgaaagtatgtgatttttagtcttagtttcctcattagaaaaactggagtattcgttcatatgggctgtaaagaaaactgaatgaggtaacacatctatagatcatcccaaggacttattaagtatctcatttactttgctgctactgctaagtcgcttcagttgtgtctgactctgtgtgaccccagagatggcagcccaccaggctcccccacccctgggattctccaggcgagaacactggagtgggttgccatttccttctccaatgcatgaaagtgaaaagtgaaagtgaagtcgctcagtcgtatctgactcttacgaccccatggactgcagcctaccaggctcctccgtccatggattttccaagcaagagtactggagtgggttgccattgccttctccgctcatctattttagttattcctttttcttactgttgaacctagggtactgttgtaccatactgagaggtggattgtatagaatcctttccatatccattgcaaacttcttgagctatagaagtatacagaatgtacaagctagtcaggacaataaacagcatctaatttcaagccatcatttcccaaaatgttcctgatgctcaatctatgtactgtttagaacccagatcactgtaccttcttccccaaagttcatcctcttcattccaaagggacattagacagtgcaatgggggtataggttgggaaaggggcctggagacatgaagaggcttaaagggagatgagaggaaatttaacctgttggaaaggaaacttggaataagtttagacttatatcagaggagaaatatgcccctaagcccttttcacaaaagcccatagccagaggcaatcacttggagcaaaagaaaaagttgagtgagatgaattaaaagttgtgtgtgccaaggcggaacagacttcctaacagtgaaagactcatttaatgaatatcagccaagatatagatttatgcacaataaaattctgcatttgacagatttttactattctacatttcaagcttatacaaagaactaacaatttttctcaatagggtcattcttcccaaatgcgtttaatcagtgataagaacaacaaaaaggcctcattactgtgcctcagcctttatagttctctgtatgctttttctgttttt

SEQ ID NO: 36928 - DNA, 2605 bp, Bovine  19866880614726
agggcaaacttacagagatgagtgagggaaagtgatagagaggagctagaaaaaggagagggaaagggagaaaaaaatatgggattaggaccaggttgtttaaagaaaacatcaactagaggagtgactgttttttatagtctcaagggtgcacatgtgcaaacacagagacagagacacacatggttaagtgttccctccacccacagacactacataggcacacagtatctttatagtcctcaacatgtacaacctgtgtgtccgtccattgacgtttagtcactaagtcatgtccgactcttttgcaaccccatggctcaggggtttcctaggcaagaatactggagtttgttgccattttcttctccccgggatcttcctgacccagggattcaaaccacgactcctgcattggcagataaattcttcaccatctgagccactagggaagccttcatttgtccatgcacacacataaatgcacacctacaaatcacaccccccacacacacatacacactttccaccttgcttatattcacaagagtagcagcagcacctcagcaacagatgcagaaatggagcgcataaatgctttaaagacaggcagacagtcatagggacagaggttgccattgtcaatcagaaaaacagagagacctatccaaatgccaacagaaagatcagcataactgatacctgcttccctgagcaaatggtgagttttctgtacttctgtaaatagaattgaagagggaagaaattcaggttaatggctaagtgctatcattagccagatcactgtccgttttggaaaggatattttagtgacatgtttaccaaagggtctaattcaaatactaaaatagaaaattataaaaaatataaattattctccatcttgattcatctcctcaaaggtacagaagaatcaagtatgacacaaacaaacacacacttgaacatctgtaattatcaaatatcactcctaatgcccattatccagctgtgagttatcaaataagtttttaactactatatctgaaggtcatattgcatgggatggaatgagctgaagaaatgggctgttgagttcacttgaaagctaccatttattaagaactaactgtgtggacactgctccagcatcttcacattatctcacttaatcttttcaacaactctatgaagtaggtactattataatctccatattgggggatgagggaaactgagacagataaatcatgctgaggaaatatgtataatatcataaataatatgctgaaaaagaggcagagcttgaacttgaactcaggtggtctagctctagagtgttaggctaaaatgaggatatttcatccccatgtcaactatcaactatcagtaaccatctgtgatgctatatggagaactgtttctgactgtattcaaacccgacaaggagtgctacagtcaatgggggaagtgtactacccacaggaagatgggagagatgtgcatagtgagtatttacaacacagacctgagatccaaagactgaacaaccaccaaccacaaccgcaaccttgcccaaatatgacagataatagtaaaataatcaaagataaggtcacaggtttagcaatgttgctatgggtttgaacactggtgaggacctcttagcacaatgctggatggctcaaatagcttaatatactaagatcttagatcattatcctctagttcaaaacatgatttcacaattccaatctttgtttttttaaactccatccatctccatgtttattactaaaaataacagaatacattcaacaataaaactcctctgtgcttcaaactagtgtggactgaaatgcatgtctaaaagtcaggtaacagttaaagaaagtgaatttccatactcaaaacaattccatgcagaagacaaaggaaaggacagttgaaattctcacacttaaacaacatccgaaatgtttggcagtttgactagctctaaaaaaaaaaacaacaacgatatttattcctgaacattgatatgggtaaggggagtgctctgtgtcaatttaatccttacagcaacttccaaaagccctgctagaacacttatcctaggtcatccagccattctgatcagatgagaactattgctccaaatagctaaaactagctcatttttttctatggcctcaagattgccatttgaggcaattggacaaataaagcatgtctcaatttctcttataaccaagggtctatagacgtgatgggcaggaaagagagctgtggactatgactgcaggatggcctggcattcagcctgccttcatttgaatcacactctcaagtgacagaattaaccagccatagagattgagttcactgaacaggaaaaatgaggctgccaagaaaaaaaaaaaaagctaatgcaatctaaggctgtgttaaatagaacaacagccatttatttattctctcccctcctccaagaaagatttaaaggggcaataaacaatagtgtcctgaaacaagtaaatgaaaatctcattccatttcggttttcaggcaacacattgcagacagtcctaaattccaagaaata

SEQ ID NO: 36929 - DNA, 1263 bp, Bovine  19866880637986
cccactcatgaggttcttgcacttgtcttggggactgacctggcattgtagacagattaagatgtgcctgtgcaggggcatgagtgtgtgtgtaaatgcttgggggtggacatggggcacatttatgaaatggatgtgacatgcaatgccagggcaaaaatttctggtgagtttgagtggtgaatttaggaaaggttgcattttaagttttacctattatttataccatatatgtccatttgcaaagtgctttcacattgcagtctctaatcctaactagattccaatgacattactaagacaggcataattatctttttttttttccccagatggtacaactaggttacaccacttgcctgcggtcacatattcagagttgctaagtggtacagtcatgacataggactcatctctaaaaacagtgtctctccctattcccaaacttgctgtaaacatataataactagttagtttgctagtttaaactctttaaaactttaaattctgactatatcaaataactgtggggaatctggtttatcctttcagggtgagggcattttttccctctgatgtaaaaagaaaaatttctcataaagttgcagtaataatactgctgacattcaaattgtcttcacacagattatctcatttgaattgcagaacaactctttgagatgagcaggcaggatgtagttcttacgacagtttagtgtccctagcagttcatttcttacttatatgaagtttcacagcccatcaaatgcacttccagccttggaaaatttctccaacctttgttggtaacattgtgtgttttccttcatccttttttttttttttcttccatatcctgcagcctataaatactacccttcgacccagccctggcatccaatactctgaacttgactgcgagttacacattcttacttatttgggaaaagagtcagttaaactactttgacaggaagagaaactgagaccagcaaatttcagtgactcacctagagcctgcttataactcccgacctataaagatgcaggaatttcatcattatgaaggcccatccagagtctcccacaccagcgctaacatctgaaagaagcctagttaccgtgtatctttggtgtacttcttatacctcaaatagggcattatgtttctctaaatagcttctccaatggattattgatagctggaatttcatcttctggtaaacacttcatttatgtctttcacttgtccctaggagatca

SEQ ID NO: 36930 - DNA, 1046 bp, Bovine  19866880680445
accccatgaatcgcagcatgccaggcctccctgtccatcacccaactcccgggagttcacccagactcatgtccatcgagtcagtgatgccatccagccatctcatcctctgtcgtccccttctctcttgcccccaatccctcccagcatcaagagtcttttccaatgagtcaactcttcgcatgaggtggccaaagtactggagtttcagctttagcatcattccttccaaagacatcattagggaatggtaaatagattgaaaattttcatgctaattctaattggaagtggctgcctggattgtgtgttaaagaggattccaaggctcagttcaggctttatagaaaattggcagtaatggccatgggatagtgttattccacttgtcatatgtattactgtttccataagtcattttgtgacttgaaacgaatgtcttcaaaacgtacagtagattctcagatagttgtgttgagtgacctttaagcatcacttaggttttaaagctttgtgattatatgatgcaatgattcaattccacgtctttcaaaaacatatccactttaaaaaaggatttaaaaaataagcaatgtcagtagcaagcatgcacagtatgaaatatttgagctggaggagtatataaatagctgtggtcgatgatcttgccttgttcttttctaaatacagtgcttctcagtgctagcatttaattatgcactgtacttgggtaaaaatgggcattaggaaagattagcttttatgatggatatattgaatcctaaatatggcttaaatctttgtactgtaattggaaaactaacaacccacagatgaatgctcatttcttatggaagtgcattgagatatatttacttgtgtattatttgaagaccaatccacatgcaatcagacttcaacaagacaggcgcagcaatcttgtaaggggtctctatttccagacaaaatatctcagaaagcatttcaattcactttccttgccactgtcttatcgacgactccatcctggactgcgagtctttaga

SEQ ID NO: 36931 - DNA, 2141 bp, Bovine  19866880696238
tctcatatcatcccaccctcatcttctcccacataatctaaaagtctgttctttacatctgtgtctcttttgctgccttgcatataggatcatctttaccatctttctaaattccatatatatgtgtcaatatcctgcattggtgtttctctttctgacttacttcactctgtataataggctccagcttcatccatctctttagaactgactcaaatgtgttcttttttttttatagctgagtaatatactgatgtgtacatgcaccacaacttccttatccattcatctgcagatggacatgtaggttgtttccatgtccttatttaagcctcctaatattgatgcttttgaactgtggtgttggagaagactcttgagagtcccttggactacaaggagatccaaccagtccatcctaaaggagatcagtcctgggtgttcattggaaggaatgatgctaaagctgaaactccagtactttggccacctcatgcgaagagttgactcattggaaaagaccctgatgctgggagggattgggggcaggaggaaaaggggacgacagaggatgagatcgctggatggcatcaccaactcgatgcacatgagtttgggtgaactccgggagttggtgaaggacagggaggcctggcgtgctgtgattcatggggtcacaaagagttggacacgactgagtgactgaactgaactgaactgaactgaactgaatacatataactgattatagggggcactaaattatattctcagcagcagagaataagaatttttgattctctctgtcctaactgttaccattcttcttgctctcaggtaaaattatacccctgtcctgactagcctttgacacaaaatagagattctagagaaagcaaaccactaaaatagaaagaagcaataaattcatacacacacacacacattatcccatggttgtatttttcttaattaaccttgtaaattaaattcttatgcattgatgaaaatatattttcttctgcctgactcaatttgggctgtgaaacattatccttcagactgtttctgctattggtctcttcttgaatataagttgtagcttttatgacacacataatatgcatgttcagtaatgtttaacagtcatttgtcaagtctgtgctaagagcagggctatgccagacatggagaaggaaatggcaacccactccagtattcttgcctagagaatcctgtggacggaggagcctggtgggctgccgtgtatgggatcgtgcagactcggacatgactgaaaagacttagcagcagcagcatgactgacactgggcagtgctgggggaagaaatgaatatgacatggcccttgtgcattgtgggctttctcacaactgagtgaatgattgtagtcataacccaaggcccactgggtatgcagaggctgtatcagaggaatcaaactcagggagataacagataaattatagtaatatggttgctccacttaaaactgctttaaatgctcgttgtgaaacatgtattaataatttattaagtgcttcagatatcctatttcattcagtcatcatcacatcaatgtgaactagctactgtcatcgatttttgtatgaggaaacaggatgggtcttcccaggtgatacagtggtaaagaatccatctgccaatgtaggagatgcaggtttgatccctgggttaggaagataccctggagaaggaaatggcaacctgccccagtattcttgcctaggaaaccccagggacagaggagcctggcaggcgacagtctatggtgtcacaaaagagttggacatgacttagcgactagacaatgaaacaaaaactgaggataagcaagttgcctgcaattgcattgttagaaagcaccggaggcaatggaaagccttttgggaaaggtagggtatgtgatccagaagaagggtcaggcttcagcagacatcttggagtaagagggatcaggcaggaatagagcctgagaaaatcactgcagtaggacagggcaggccatctataaagaaacaggattaaggaacagaagccaggagaggatagaagataaaggaagataggatctagtatggaaagcctagaatgccagat

SEQ ID NO: 36932 - DNA, 918 bp, Bovine  19866880748902
aatcttatttgtttgtttttaatttgatgttacgatgtgcttttaaatttttatttatttaattgggactgcactgggtctttgttgctgtttgggcttttctcaagttgcagtaaacagggactcctctctagctgtggtccatggcttctcattgcagtgacttctcttattgcggtgcacgggcgcaacagttgtggagcaagggtccagttgccccgcggcatgtggaatcttcctggaccagagatcaaacccatgtcccctgcattggcaggcagattcttaaccactggaccagcagggaagtcctagacatgaccttattacttcccacctttgcctaaaaatctgtttctctggtcctactagggtcccagtgatgaaatctactcccagatggttttcagcagtgttttctgagacagaacccagagttctggtttttcttcttgctgcctgtctgcccagacttaagagctgccgaaccggacctgttgtgaagccattggttggctggtggagtctttgctccacaccatgtccctgtattagagacaaagagaaaacttcaggatgagcttctttgggagctgacacataagagaccataccctgttttggaggcatttaaacttatcttacagttaatacagcatctggggcacattttcctacttttatgccaatttttatgtgtttctgtcacacagtcagaagccaggatcataaagaagaaggaaaatggtacaaaaaaataaaagtaaataagcgcattctgctttaacactcccaggagcgctgagtccggcaagtttatgagttagagaaaaaaaaccaaagcaaacacctatagcactgtatataaaggaaaggaaatactactcctttgcattcaagtgcatcaagcaaagaggg

SEQ ID NO: 36933 - DNA, 2076 bp, Bovine  19866880762100
gtttagagctacactgtccataaaacagccattgttacatggatctagtgagtatttgaataatggctagtctgaattgagatatgctgtaagtatgaaatacacattgattttgtaggcttaggaaaaaaatcctacaaataattctatattgattgcattttgagctgatagtattgtggatatgttgaactcaatataataggctaatttatttcacctgtctctaacactgtgttttgttttgtttttttttttagtgtagctactagaaaaattgtaataacgtggcttgcatgtgtgattcacatttcgttatctctctctctttttttttttttggccatgctgggtcttcattgctaccaggcttttctctagttgtggagagtggtggctactctctagttgcggtgcaagcttgttgcagtggcttctcttgttgcaaagaacagactcaagagcacttagactacagaagctgtggcatgtgagctcattagttgcagatcccaggctctggagcacaagctcagctgttgtggcacacaggcttagttgttccgggacatgtgggatcttcctggaccaggaatcaaacctgtgtctcatgcattggcaggcagattctttaccactgagcccaccagggaagccctctctaattttttttttttttaatttcattttattggttaacttttttcatttttattttattttggagtacagttgattagcaatgttatgtcaatttcagttgtacaacaaagtgactcagttatacatacacatgtatctagtctttttcaaattcttttcccatttagattgtcacagaatactaagcagggttccctgtgctatattgtaggtccttgttggttatgttttaaatatagcagtgtgtacatgtcagtcccaaactcctgatctatccacccaccccttgaccgttggtaactgtaagttcattctttaagtttgcttttctgcttctgttttgtaaataagttaatttgtaccatttttttaaagattctgcatacaagtgatatcatatgatatttgtctttctctgacttactttacttagtatgataatatttctatctaatggtgctgctctagacatttttgcagtataaataaatattaagaccaaaaaaggccaggcctgaatgtactaccagatggtcttcaggtcagaatttcatcattcttttgcaataagaaagaaagcaaagccctccaataccattgtcatactggctaatgtttgccttgtctttcatctgagggagctcttgatgaaaggaaacagcttcaaccagaatagtttatagctgctttggaaagaagcttatattgaaaaggaagagataaattgaaatagttctgactttgaacaactgctcatgtcaccacaaagccaaggccactgtgtgatctgtcagctggctgcagaaagagggcaaatcacttgtctcctcaaaatgttgggtattgcaaaatcctgaaggcggcacagaactgatgaaagctcagcctgcgctgtgaagagggatctttatctggctcgctgatccttctgtctgtgggagcggaggaaagagaatggctcctcacacagggtcccgatgatcttcccaataatgatgtttctttaggggcaatgtggcctccctcccattaaaatggacgcttgcagcactttgcagttggctttctcattttgtacatgaggtacatgactatgtgaagtaaatgacccagaccctagaatggaagtgtctgttgaagtagaagtcaaaattcaagttttcacatttatgatgcaaagctccttttgtagcagtttcaactgcctataatagttcttttaagagggatatatcttagctttttctccacaaaggtttcaattctcatttctccttgaatgagcttcatcagttggctctggacaaagcctgttctatactggatattttgaatacaagttatctttattatctaacttctttcctctatcctcctaacatttggctttattgtttgtttttcattttttgt

SEQ ID NO: 36934 - DNA, 3271 bp, Bovine  19866880788048
tcataactttcccttccaaggagtaagcgtcttttaatttcatggctgcagtcaccatctgcagtgattttggagcccaaatactgatacaggtcatatttatagtttgccttcctccaaaccatttgatacctgaagaaaaatagactcatgaaatctagccaacttttgtagtgatctgtgggtaggtgatttgctggttagtctccagcacactcagaatggagaggcataggtgaattattcttcttatctgtagctgcaataatattttgttgaatgtagcttattttctctgataacagtaaaagctcattgaacaaaatttgggaaattgagcataaataataggagacagatgagctataactttagatctcaaggaaaattcacattatcatttgtatcttgcttctattgcacgcatgtttgtgctaagggcagcttgctctccataaacttttaataatgtgaggtacctaaatggcctagcataaaaatgagccatactgcttttttttttttttaaagcttttaattttatactgaagtgtaggtgattaacaatgttgtgatactttcaggtgaacagcaagggactcgaccacacacacacacacacacacacacacacacgtgtatattgctgtatccattaacccccaagcccctctcccatctaggttgccatgtaacattgagcagggttcccctgatccttgttggttatccatttcatactgatttaaatggcagggatatgtccagtgttcactgtgattgtttctctttccgttctcattgggttgctatgatagaagcagtatattggagaggttctgactcaattctggagccagaatatctgggtttgagcccaaggccacaacagctgtgtgaccttgattaagtttcctaatatcttagtgccttggtttcttcatctgcaaactggagataaaaggagtactgagtagcggctaagtactttgttgaatgatttaatatgtagagaccagaagaattcctggcacatacagagtgtggaataatgtaagctgttaaccacagggggacacaaactctaatgcctataaagggatcatgcggatgatgtaataaagtcaggtgtaaaaaaatgcagctcttttggtctttcattttctagcagtgtattcaaaataaaaggatagaggacacatctcaaacatgaaggggaaaaaagccccttgaaagcataataaatgcagataagtcttatttattgttggaaaacagtaataaataatcaggaccatagacagaggacttggaagctaggtgtactaagatccacacaacttctgccaagagaagctggaacactagattaatatgtgaaatttcccagtgtttaaatgctagcacccaatgcacacttgaaagaaaaaaagtgtgtgtgtgtaacctaagcaacttatgccctcaagctacatttgaccccgaagttggcagtttaagaactctgaacttcgacttagtatgttttgagttctagccaaagagatctctctctgattcctggactccttctatgacagctggctgtagtgtcacacatttattgaccactttaactcttggattgaaaggaccaaaagatgtgacccacactggtactctgccaattgctagcactggtatatatggatccgggggctgcaataaggaatgatcagtcagagaaaatagcactgtctctagttcctgtccctgtcccttggccacacaataactattttgtcttagctggtaatcccagcctctgcctaaatcacggtctacttactggctgatgatggaggctttccaaatcttccatctgactttggaaatgtcattgtgctactcattctgtttaattgctccctcctgtggaaacactgtgatgtccctgctgctccttcgagtggagaataacaggtctttaggtttttcttggctctttcttgctgaggaaggagatgataaatgctcggtgctgagggggctgctttctgaaccaccctgaggcgacaattgcttattcagacttaagaaaaggaggcaggcatgcagggagtagcttttgaataaaacagtttatgatcagggaaggcaaaggagaaaggcagacttgacttgacctctggggatgtcctctcaccatgacaaagagcagactgaaaggagaaggactgcaggggaccagagcagcagcatttagaactagccaaagggctgcctcgaagcagtctggttggctttacgataactgtctctaacagctggtcaaatagaatgaaatagggaaactctgacaaccctgttgctctccaaatctcagactctcctccacccccagccccaacaaacttccaattatatttgtagagagaaatcttacattgtcatttctttaactagtcttatctagtgagactccattctttttatttctgtcttatctaatcccacgaccctctacctacgctctagtcttctcacttgctgtacactgtctttgcctttgcacattgacttttctgtctggaatacccatctctcatctcaacctacagaaatcctgggctcgcttcaaactttgtctctaccaataaatctgtctggatttctcccagtgagacagaaatcatgagcctctaggaaggaaaagacattcttcatttttcttcccacccattcttccatcctgcatcctagtcccaggaaaatatataattatctgatgggccaaattctaatacttttatgaagcgacttagcagcagcagcagaatcgctttacttctaaagctatgtgtcaagatgtttctctctctctctacactgtgttttgttcttatagtgagaggactgattgcaattagggactggcctcctagaaatgacacaaccagctttctaggaaacccttctcttttgtcttgaatctttgctttcctacactgatattgtggaactgaggtagtaatgagataggaatctgagttcttgtccatggagctgaagaatggaatccacaaacaaacactcatggtaacaagtgaagaggatttattaaagagaggaaagtacaaagctctcagcatagacactgagagggagtagagagcccccccccccaaggtgggacttagaacagtttttatatccttccttaaatcacattatttcttaccaaccaatttaaaggtcaagatacttaacatctttaggcttctactagatc

SEQ ID NO: 36935 - DNA, 789 bp, Bovine  19866880807711
agttctgtacagaatgatagatgaaatcatggtatatttatatatctaagtgttatatttgagatcttagggctagagatgcgaacatagaaacaattatgattcagatttcatcgtcatttgttcctgaaattgaactgtccctaggaaccccacagcattctccatctatctcactgagcagtttcatctcaccagtttgtagcccaaatgtgcacactcatgttcaactcaaaagaacaaaggtagataaatttgtaagaagctttccaccactcccttttgttatctctgtatattttaaaatctaatttctaaatagacttggtgctttttgaatgtaggattagccttcaatttatgtttttctaagtacacaacacttagcagagtatttttatgtattcagtattaagcatggaatgaataaaccacagatgaaacccagactagtatcccatactttgttgtctatgcctgaacacatatctagagctacatctggatctctactgagctcgagccaatgtccattaacagggataacatttagcacatttagacacgagaaacctatttacatttatattggtgtctaaaatcatctgttgggactgagctcattttaatttattacagtctttaccgcctgccaggaagcaatgaagtactcaaatttcacttgcatttcttagtaggagcccagcctcaatcaatatttggggggatgacagttttgggggaggctcaggatctgattctagctgatatgttatgatcattcataat

SEQ ID NO: 36936 - DNA, 957 bp, Bovine  19866880912477
tcaatagggaactaactaaatagggctgtctccacttaatggagaggatgtaattggcttttataagacctatagtataatatcaatgtttcagaaaaggatttaaaaattagcaggatatgaacgcaaaagagtgagatgatatataaaaagtgggcttgaagcaatagtataaaagtgagtgttctgtgttttactttatgtgttgtgttgtttaaagcttttatatggaaatgccttgtgtaactaacaaacttaaagcttgatagggaaaaaaacgaagaggattacaggggacccatatcatcttaattttgattcagacagacttttgcctatgtagatggttggaagtgttggaaactcaagaaaagtcttgataagaaatctagtgcttatgaaatactgccacatacaggaggaaactgctgatttcagcaatttggacagcaggagtagagctgattggcagatcacagtgagcttgctgtgtgcaagttggcagaaatgcaggcccacgaggtatatagagatcttgctagatctttcatagctaaggatggcagcattacagttcataactaccattcaggttaaaccaggtttttccacctctgtgagcaagggttttgcttcttctgcacttacctgcctgctctctcaaactcagactgtataactatagaccaactgcattcattttctattgctgctaaaacgaatgaccacatatttggtggcttaaaacaataacgcaatcttaggatgtgacagttctggaggtcagaagcctgaactgggtcttacagggctaaaataaagatgttggcaaagctatgttccttctataggctctgccggagaatctgttccttgccttttccagctgctggaggctgtttgaatcactcggttcaaggctgcatgactgaactatacttatattggtacatcctc

SEQ ID NO: 36937 - DNA, 1059 bp, Bovine  19866881069668
tcgtgtctgactctttgcgaccccatgaactgtagcacaccaggcctccctgtctatcactaactcctggagttcattcaaactgatgtccatcaagtcagtgatgccatccagccatctcatcctctgtcgtccccttctcctcctgcccccgatcccacccagcatcagagtcttttccaatgagtcaactcttcacatgaggtggccaaagtactggagtttcagctttagcatcattccttccaaagaacacccaggactgatctcctttagaatggactggttggatctccttgcaagttattcataaaaatctaattagtaatttggttgaaagttccttttatactagttggtcttactaaaattgacctgatctactaaggtctgttcttttcctgtctggttctaattccaattatgttttattttacttctaactttgattataatttcttatttaagttgttcctgtttcatatatatatatatacttctaatatcttaaataatagtgtgatagggaaagcttccttttcttttctttgcctttttatattatctgagtttatacccttgcatacattaattgtgcaaattaaaaatcaagcaaaatcaaaatgcaattaagccctaatcaactaaaggatcaaccaagtccctgtttcttctgcctcattcaaactttgtccatgttaataaaaccaattaaaacaaaacaaataaaacctgataaacttgggagaatttttactgtaattttctattattattatatcaggaactcttaaatacagccctaagtgttgccataagataggtcattaaggatgaacccagctcccaacatggtttttagtacaacatgcccatatgccaaaagggtgggggcgtgagtaatttgggcatggcagctcccagaagacacattcagtatcagtgttccaatcagacacttggctatgagcctctggatcccacttgtcttcctcctactgctgaatgtcaactgaggagagcctgttcttaataggaaggaaaaaagagataatagag

SEQ ID NO: 36938 - DNA, 568 bp, Bovine  19866881084893
acagggatggtcctgtggctacttagcctaattagaaattgacttttcctcccacttgtgggtggcttcaatctattggcatccattcaacatcagttgttgcccataacaatatatcctccccttatcatcatggaatttgtatactgttaggaagtttgaagaattgcacagacaaatggaaaatatgttaatatatgaataagttctaaattatacagtatgagctctaacttctgctggagtttgaaaatggcactaatcagtatatataagaatagccggtagaaatcttccttggggaggaagtgtcaatgaggatcctgagagataagtcaaatttgaattcaatagttgggtgctggttagcagagatgagtgttattttaggctctggctatgtcatgggaagagacatgaaaggtgaaatgagtatattttcctgtaactaaaataaattgagaacataaaatgtatgatgcttgtatttctcatttgactgtgataatcttctgaatagtctcatgaggaagagagttgttttacaaatgaagaaccaaaagtgatt

SEQ ID NO: 36939 - DNA, 1026 bp, Bovine  19866881224538
catggtataacttgtttatcactcaccctcacatatttactatgcttcttcggtttatctttggttgtcttattttttttccccctcaagaagcagctgttccctctgaaaattagatatgatatagcattgtctttgttttgtctccagatgtggccaattttgctgctcagtcagaggatggcaaacaaatgctttctcgggagacatcaaataatgacatttaagtcttaattgctcctcagaataaaccattttttaaaatgtttgactcaaatacagtgactctcatggttctctaagttaaaagagctgttgagttaaaaaaaaaatacaaagcacttctatagcatttatgaaaactatgagttatatttttcttttaaatttaagaaagtttatacaactgtttatatattcatgaagcatgactactatgtatttagttctataatagtttacatttcatctcccacatacctactgatgtgcaaaatccatttcttattgtaacatggaaatactgcaaacatctgtcatcctatatcccccacaactatacaacaatagatctcgtatttgtgaacaagcaaattagcatagtttctttttgcaagccctggtatctaaaattctgtcctcaaaattaaattattttatttaaagaatgtgcttctaggaatctcctgttaaaattcaaatactactaggagaggcaatatattcatttattagctgagtgatgcaatttggttcaatatatggtgaaacactgcaagcctatgctaataaacttgtccaaaggaaaaatgagacacctaaagaggtgatgaattccctactgtagaaggttctcaagtagaggccaaatagccacctggaagaagtatcaaatataaatatttaggcattgaatggaatattaaacacaatgactgctcatatacatatgaaattctaccagtttacttgcatctttctccatttattcatgcattcaagcatgcatccattcattagccatca

SEQ ID NO: 36940 - DNA, 787 bp, Bovine  19866881357332
gaatgtaaacctaatggatggggggagataaaggagctatgaggccagggttctcaatgattaaggactgaccaataggattatttctgtgatttttgatgcacagtctttattcaactatcctgttcttcaactctactgttcattagagagtgtaccaggaaccaaggacagaaaagggtgagttggaaaaagtatgaagatataaaccacataaacaaacctcttggacaagttcctcccccaaacagcatattaattaattctttggatgatgctacagaaagtgtgcttaacacacttaagaatgccaagcagaaaaggatagacagttcacagaatgatagaagcaacattctcatatcttaatatgtcagagttgtgagctgaatatacctagatgaaataaaacaaataaatgcaaattcctaccctgaaattcaaacaccaatggcacaaacataaggtaggagatacagagcttagaaatagcccacaggaatatacttagacttaacaggcaataaatgccatataaccaatgtgatgaggctgacaaacagaaaaattaatccttttaaatgtgcattagaagtaatggaatacataaactgacggaaacagtagacctatctgtattggccaggcctcctttagaatttcaggttcatttgttcccagaagaccaaaaaaaagtacattttgaacaaagtactgaataaagaacgggtccaaagctccgtcctggagaaatgaccaaagaaactaaaggtgttgaggtaaaatg

SEQ ID NO: 36941 - DNA, 1531 bp, Bovine  19866881420938
tgattctcatacaaagaaagttcagcagagggagacattgctatgggctggtaaggactgggagtacatcctgaatggtaagggacagaaggaaggcaggaagaattcttttggacactggcacaattcctaaagaagagacttctgcattcctcattcctgttatttgtcaaactaactgggacgtgggataaataacatgagtagaagatacttgagatcatattttaaaaagctttgaatatcaggataaggtatctggacttcaacctgtggttcaactttgttctggggggctctcaagccatgtgcctcatctggagtgctcattaaaagcaaaggttatggatccattccagtcctgctgaattctagtttaattgtttcatagtttaataagcatcagaggggactctaggcaccttgcagtttgagaaactgtgtcacagaatttgggagaatactgtttgtgaaaggaccttcaagttagaacaacactgggaacttattgaggaagatggttctggtagcaatttggaccagggactggagaaaacagtgaacccattgacggctccagcaactgtcctaaaagatcatgattccagattgcccttgatagttgactatgaccagatcttgattgctagaatcctgtcatctccaataaatgacatttttcaagtttcagttattcttccgacaggctctaaggttgtcaaggtactacaaaatgcacggtctaaagactagctttttgactagaactgagatgtcttgatgtcagacgaggacttttttgacaagtgacaaccaggggactaaagctatatgtcctttttatcaaaaataaagaaccaacatctacatctcccagggtacactgcagtgaagcttttagtttcaatgaaaatccccaagttatgccctgtacttgactaaatgtatagaaattgggaaagtggacagctagaaatgtatattctctgaattatactgcagggagcctagaaaaggctgaaggaaccccctggctttgctgggatcataaaactaaggcagataaagccagttctgaatatttcttcaaatgctactcagtgagtaaagagaacagaaccctgatggaaagcgtatatgactcagcatcattagtgtttccttgagtttggtacagcctgaatttttagggaatcagaggggtaggaatggtaatgagagattaaagggaacaaaggattgaatcacagtgtttttcagtttttcctttccatccggccactttgtttcaagccagataaaatgcaggatcaataaaatagcaagtcatctactgcctactcccttccgatatcagttacatatcacatctgaatcccttcaaaatcatatttcttttacagttattggtccacactttaaattgaccatctatatccattaaatgggagatttactcaggcttcaagggctggaatcattagaaacagagattggggagaaattatcctctggcttagtcatacattaa

SEQ ID NO: 36942 - DNA, 777 bp, Bovine  19866882228394
tgaatatactttctgagctactagaagacagaaaagctctaaaccaatgcatattttgaaatgcatatgatgtattattatgctaaactgacagctactgaaatttgtaggtaatatagcaatggttgattgttgtcatctctctcctgtaccatgggccttttcttggggctcaaggaaagatatcttgctgtggcatttagggacgtgaaagagagggcattggtgcaggaatctgaaaataaattgctgtgatcctacagctgtattacactatcttaagcaatattcccattggacccatggataaaatactggctttaaacagtgcctcatgactaggtccatgactctaaattatgtctgggtttagccacttgttacagaggttaagatggatgcctaggaatacaccatgccatctgaagccctccagaaagtggacagagatgaaacatgttgatggagggctatacttaagactgatacattaaaaatggattagctggagaggtagcgattcttggtagaacttggcctgtgttgattcccttgttgcccttggaaaaagagagactccccaagctgtggcgcagaaatgatgaagttgagctaagctagaaatattaatatcattcctaggcccatctctgtaaatggtaaatcaatagcttgtgatataaaatatatatatatatataaaatacatcttctcaccaagaatgagggttttaaaattacatgatttctgtgaacacttagagtcagaactctgtg

SEQ ID NO: 36943 - DNA, 1976 bp, Bovine  19866880656317
tgtatcttatcttgttttaatccaccctgttcatagattcaagttcatttacatggccaataccatgcatataatatacttttttaaactatttttctgaatatttaacatatataaataaaaacataagattacgtatatgtttacatatatatgtaagataataatgaatatacaaagaaatgtagctatattaaatatacatactgtccacactaagtggtaaataaccctcctgtcagtccaggagatataagagacacaggttcaatctctgggttggaaagatcccgtagagaagggcatggcaaccagcttcagtattcctgcctgtagaatcccacggacagaggagcctggtgggctacagcctaaggttcacaaagagtcacacatgagtgaagtaacttagtaatcactttcaaactaaaaccaattcaaatacctcaatcacattttctttgcacttgttttactaatttaaaaagtatatgatgaaataaagtaatacagtagtcataaaagcaaaaaaagttaaataagttgccttcaaataagttaaactggatgaattctctatattcataggagagaacatttacactgtgacattaagaacaggtttgagagcaagctagttggtttctttggaactgaagtatgtaaattcaggagtggtctggtagcaaactttggctgagatcaccaagaagcagaagataatgtgcagaaagcaagaaaaatgccaaaaggcagagagaaagtacatctaatgttcatgattactttccatcttgattcaatatatcttagtagtgattcatctcttcccttgtattccacaagatacctctctgttcatgtagtaactcccatggttttaatttaaatcagttcaatatgttcctctaatttgtaaccaagagcatcttaataatatactgtacttttcaagtaataaagtaggactgtctcaagaaagtcttgcttatctgtgggctctgtggtttgactctcctgtttctggggcactctcttctaccaggaagattcagctcctttgaatgatcaacagtgtgaaaacctcagatttatttcaggacctaaaaaagcgttatgatcaaaaataaaataacagcaggacaacatgtattttgagtagctatagaattgctgatgcagactcaaaggctatttagtctttgctgtccagttcagtaataaaatgatgcaccaagggaaaagaaaaactatggaaatacactctgagtgtgtattcctctttcactgacttttatcttattagtaaatcaagaagagtactgtgttcgctcagcatttaaatgatacattcttgtatatagtatttcaattacatatcttcttgagttttctatgtcatgccatagggctataaggtgaccaagtaactagcagggaatttcatactactgttattgatcacagtatgaaaagaaagcaataaagacatcaacactacatggcactggatgacatctttacagcgtggctaataaagatgatttgaaatagcccattgactttttctatgcccagaagctcgagtaaatatataatttaatcttgctgtctgggttaaaggcattttttttttgagaattatgacattattcatgttgttaaagataaggcctgccccagctttcagtttcaaagctcagttattaaattgggcttcaaagtgaaatgtggtgaagtaaatgggaggaattgagagactggagatgaaagtttggatctctggttacagaactgagagaaatcaatatgtggagtcaaagcagtatgatagtatcaccttaatacatatgatttggcatgcctaatagagtgatttggggggatatatgtggaatatctaacagataaataagcagtcactggagaagaacaagttttttcacttccttgatgactttttggttaaaagaggg

SEQ ID NO: 36944 - DNA, 1608 bp, Bovine  19866881610720
ttcctaacagtgcatgaacaggaataatgatttataataagtgggctgttctttaataaaagatttctcagatgggggctagggtagggagttctgcttcactggagcaatcgtaactgtccttgaatgtcctcaacactcacacagagtctcaggagaaggagcagaggaattacattgatcaaatttcaatttttatctctttcttgttaagcaaggcagcaaaatattatcaaccctccactatcatttgttaagcagtttatgatatacctgttgaaatggaagtttctagccctatgttcataaacctattattatttatgcatatgtgtaaacctatttttatttatgcatatgtgtttagactttctaataccaaataataactttttttttagcatctcgcactttgctttcctataaatgcattaataaaccaagatgaaatttcaagtcgtttgctggacaggttttattactagaacttgaaaaaaatataaaaattagattattaattctaccaatattaaatttttatattatataaatatgctttcaaatcctaattactaaagtattatgatcataaatttacaatattttctccatttatcttcaaatatattcaaagtacttattaaagcttagaaatagcttcttaccattctcctcattcttttgcaatttttgtgtttgttccaaagaatcaggaatgctatattcaaagaagttacatttctgaggtggaactaattagcaagtgctagaatcagtattagaacttaaagagacaggtcattcattttaccacctggtcatgcaggctacttatctgacaccttcagaagaaacttactcttcagctttagaagaattaacacaccacactgagataggaggagatctctgaggtatttagttttagaatatcaagatattttcaattgccacctggttttcctccttatactatatattatatttgtcatttttatatgaatttaccatctttaattctgcagatagtttattctgactagtgaaacagagcaaaggtatgttttgaaaaattaataccccatcacttgcacttaattaatgatatcctaatataacaaaaatcaacagctttgtgttaccttcaaatcattctccatctcacaaactatacaccaaaataggtgattttgtcatagtttgcacattgctcttaacccatatttctctattagtattataagtggatatatcttcatttaaatagcttcagttaattatatgttatgcatgcattagaagcccttcaactatggcccatgtggtgtacattcacattctttcaagatcttaaccagtgtcaaaattcttgaaataaatattgctatacatgtatctttccatgttgttggcattcttatgtagttatcattattgactgaaagaatatattgctttagtgttaatacatagttcagttcagatcagttgctcagtcatgtctgactctttgtgacctcatgaatcactgcacaccaggcctccctgtccatcaccaactgaggagtttacccaaactcatgtccatcaagtcagtataccatccag

SEQ ID NO: 36945 - DNA, 1926 bp, Bovine  19866880127193
gatcatcgaaaaagcaagagtgtgcccgaaaaacatctatttctgctttattgactgtgccaaagcctttgactgtgtggatcacactaaactgtggaaaattctgaaagagatgggaataccagaccacctgacctgcctcctgagacatctgtacgcaggtcaggaagcaacagttagaactggacatggaacaacagactggttccaaataggaaaaggagtacgtcgaggctgaatattgtcatcctacttatttaacttatatgcaaagtacatcatgagaaacgttgggctggatgaagcacaagctggaatcaagattgccgggagaaatatcaataacctcagatatgcagatgacaccacccttatggcaaaagtgaagaggaactaaagagcctcttgatgaaagtgaaagaggagagtgaaaaagttggcttaaagctcaatattcagaaaactaagatcatggcatctggtctcatcacttcatggcaaataggtggggaaacagtggaaacagtggctgactttattttcggggggctccaaaatcactgcagatggtgattgcagccatgaaattaaaagccacttactccttgggaggaaagttatgaccaacctagacagcatattaaaaagcagagatattactttgtcaccaaaggtccatctagtcaaggctgtggtttttccagtgctcatgtatggatgtgagagtcagaccattaagaaagctgagtgccgaagaattgatgcttttgaactgtgatgttggagaagactcctgagagtcccttgaactgcaaggagatccaatcagtccatcctaaaggaggtcagtcctaggtattcattggaaggactgatgttgaagctgagactccaatactttggccacctgatgcaaagagctgactcatttgaaaagaccctgatgctgggaaagattgagggcaggaggagaagtggatgatagaggattagatggttggatggcatcactgactcaatggacatgagtgtgggtaaactctgagagttggtgatcgacaggaagacctggtgtgctgaggttcatggagtcacaaagagtcagacatgactgaacaagattgaactgaactgagaattattcagttaacatcaagcttgagactcaagtaataaagagtctttaggaatttttttcagtgtataagccaatgacttattgaactatttctgtttgccaagccaggcttaaagtagtggtgctggtgtactcctggcataccaaaaaatcggttgtctaagaattctgctggtgtgtgtattaactaccgggtcttttggattaaaagatcaatgtattgtttcttttcaactctaactagcagaaaaaaaggaattgttcaataattatgttagattccagattgtctttatcttttcttgacaatcaaaataaagacttgtgactactgctgctaagtcacttcagtcatgtccgactctgtgcgaccccatagatggcagcccaccaggctccctgtccctgggattctccaggcaaaacactggagtgggttgccatttccttctccaatgcatgaaagtgaaaagtgaaagtgaagttgctcagtcgtgtccgactcttagtgaccccatggactgcagcctactggtctcctccgtccatgggttttccaggcaagagtactggggtgggtttccattgccttctccaaaagacttgtgactagataccattattagtgttgtcaaatatttgttgaactacataggtttggtggagaaggggttatatttttagcaaaggaattgtttccttggggaaaaatactgaacatggaagcattaaagcaagtgacaaggaatggaggttatttattgtattcatcttctttgtcctatatt

SEQ ID NO: 36946 - DNA, 1778 bp, Bovine  19866880362281
atcaggtggtctggtattcccatctctttcagaattttccacagtttattgtgatccacacagtcaaaggctttggcatagtcaataaagcagaaatagattttttctggaactgtcttgctttttccatgatccagcaaatgctggcaatttgatctctggttcctcttccttttctaaaaccagcttgaacatcaggaaattcacggttcacatatggctgaagcctggcttggagaattttgagcattactttactagcatgtgagatgagtgcaattgtgtggtagtctgagcattctttggcattgcctttctttgggattggaatgaaaactgaccttttccagtcctgtggccactgctgatatacatacataaaagtaccacagtttatgaaaatagaaaattcagtcaatttacttctgttagatctcatcaagcactttctcaccattgaaacgttgaaatatggaagacaagaattttcccttaaaatgtattgaatgtcctttgactagaactccctggaaagccaaaattaaaccatatgttagtaaatagggatacagatcatagcaaagatattgcttgtaaataaaaattcagtcgccattctttgtcctgctgtttgctaaataggtcttatgattccaaatatgttgtaattgcttagtatattttgccaaatgaaaggacccaagtgaaaaatagtatattatgttttaaagattagtgacattggtaggcttgtaattctcattgtttcagagttgctttgattgtgtcttgttggaaaatcttattatttttttaagagtaagaactttagaatttcataattcttaatagcaatgtgaactgatcagttactcatcacataattttgaacaggatacctaaattctctgagcttaaatttccgtatgtatgaaatcatgaaaattctacctagttagcacaattaaatgtaagaaaatatatgaaacctggcacaatgtctggtactttgtataaacccaaagttcatgtcttctctccttccaattaatcatggcaaagcaatcctttttaaaatcataagtgtttttcacattaaaacttctgtagtttagcagtcaagtcttaattttgacagatgcagttatttgtatgtgtgtgtgtatttctgatttaatggcaaaacgtgttgcacttttctagaggaccagggcaggtaaatgatcaataaaatcatatgaatatgtacatatgatgtacattctgtaaatatgtacattctgtaaataaaggaagagtttgaaaaaggttgacatcactgaatttgtgttgaggtacagactttccttcagtcttcatttcgtcaacaaatactaattgcatacctagtgtgtaataagtcaaagatccaatgatgaagaatccaaacatggtccttgtttgaatggaatttattgtactagagaggtgttaagcaaattgtcataccattaatgactgatatctggttctttgagtgcatatcataggaggctttgacgtagttaggaaggtgaggaaagtgaggaggtgatgattgagctgataaataagaattcagtaggggctatttacataaatagaggtggaaatgaaattccaaataggaagaacaacactcaccaagtacttaaggtaagagtccatgcaaaacataaatgagacctaaaatatactagtgtggccaaagcatagagaggaagaaaaagatataaactttagaaataatcatcatccta

SEQ ID NO: 36947 - DNA, 3198 bp, Bovine  19866880565431
atattttatgactaagttttacataacatcccggatacaccaggatgcaccaatgactgtagtgagaagaaagagtttatgaaataatggtgacctggaattcttagtcttcctgaagatatgcatgtatggcttgatatttcactttggaataaatgtaacaccttagatacaacttccttctaaatatgtgcccattattatagacaaaccttatacatatcagaaaagagagactcttctgcaacatataccagagaaaaaaatataataaatctatttactgagttgtttcatatcattttcagctcactgcattgtgtcatacttttgcatttaggatgttacgtttatgctggatcacgtataacactgccttttattagaggataataccctaaaattgcaaccaccttaagagaaggaaatatttttaacaagattcgtcttaaaatggtgggggatggactttaattaaaattgaaattccctttgagtatgcaatggcaacccactccagtatgcttgcctggagaatcccagggacagaggaacctagagggctgccatctatggggtcgcacagagtcggacacgactgaagtgacttagcagcagcagcagcagcatgcaatatttatactacttatttgctgcattctgtaaaatgtctgagtttctagtgataaaaattcctgccaaaaagactgttatttcctggaaatgtttccttatgtttaaagtaaatgaatttagaatagtttccagaagagtcatcatctaagcaaggaactctgagtacttaaactgaaaaccacagtcagtgactgtctacacagtctgactgtagggaatttgggtctaaatgagccacattggctgtttacacataatgatgactcaattctatgttttactgggcctatactaacattttctaaaggggagagaatgattgggttgaatatgtcaatatttgtttaaataattatcacttgagtcatctgtccttaaatagtacatgcatcattggtaaatttaaattcaataatcatttattttcattgtttaaacttagacattgggttagattcttagggttggaaagtaaatgaggtataaggtttcaagaaatgctcttgatttacctcctcagcacatcttgattaatttcctttcccacccatcccacactccccaaatacaaacccccattaactctagcctgaactactcctggaaggatcttgttgatctcaatacgccctatactcaaacgccctatatctcagtatatcctccgaagtcattctccacactacacggtggtcatttacaatgccactttgatagtgcttctgccagttttcaacttttatatctagcctgcacagtcctgcttgacccatggcccctatgtatctttagcctcagctttggcctctttctcttctctatactccaaccacactggactgttccgttttaatccttttaacatactgtcctacctatctcagagccacacatgctctaggctctgcctattacatcagcacttgtgtcctcttcaccatttacttgcaaattctgttgtggattttagctcaaatagcactcttttaggacaatctttctgattcaccatgtgtaccaccgccaccccgcaaccgcccgtttcacacttgcatagaaccctgcacatttccttcaaagaaaacatgtgtaataatcatgcattaggttatttatgtctatatcactcaccagatggcatgtttccactaaaggatctttgactgttctgcactgtgtctttggtaacatgcagggtgcttaccaccctaaatgaaatggaaggaaggaaagagtgagggagagaaggaaggaaggaaggctggagggagggagggaatcatttcacttgccaggaatttattgttttgctttattttgttttgtttctgctgtaaggataaatattaaaacatgagtatgtttacttcaagtgaatcaaatggtttctgaaaatcataatatatatcaaacattactacaaggaactcaatttcttggccccttattttctcaagcttaatacaggactgagatctggctaaacaatcctaaaatcatgtatttataaaaaactcaattgttttatgatacagaagttaaaatgtattaatcctagttctttgacctgagggtcaatgaatagaactgtggaaactttatcaagtaaaagtcctccatatctctccagacaatgacaaggatttttaaggaatatatttggccactggcaaagcccattaacaaacagaaaataaaaatagaatctgggtaataaaataaagtctaaccttttgaaaaaaaaaaaaaaacaacctttgtgcttagtttctcttgttcataggatgcggtgggcaaaggccttgcccccagcactttggaccagagtggaatttctagtgtgaaatggctacattgaacacttccgattcaggaccaggatggtgtgcagaagtcctgtgcctgaagccacaattctgtagcagcggtggcagtaggcagtgttctgagatgctgcagctagtgcaatgcaatctggactgttgagagctgtaaatagcagcccaaccatggtctgtgtgctctagaccacaagctcccacatctccattcttgatcaaagaataatgcatttcagctctcatgacacgcgcaggaggatccttattggtgcccaaaatcggtcattggtaacaatgtctgagtccaggcttgaaagacaaaattcattaattctgctactagccactgagaatccatggaaaagcacaactgtagggaaattagaaatcatctaggcagtgatatagttcctttattttgaagatgattgaatctaagagcagctgaagaccagaaagataagtggtggtagagtaagacataaagacataaagatatgtgatggtacagcaggtgatatgtttcaattaggactttgagaagccgaaaaattgttgagaggagatggatgaagagaagagggtaggagttaaggaagtctgtgtcttttgaactggagtaagtgtggcatgtggatgacagggaacattttcaatttggttcagttcagttcagtcactcagtcgtgtcaaactctttgcgaccccatgaactgcatca

SEQ ID NO: 36948 - DNA, 976 bp, Bovine  19866880638204
ttaattataataaagcatcccaaaatgttttccttgaatgatagccttgggtctgctattatgtttttattaatatcttaccttatttcatttattattatgaggatgagataatttggggatctctttttccactgctcaatgttattttcggcaacagattattttctgttatttgccagtattcttaaacccacctactcattcgtgtctgatgtggtcagacttctgtggtgaactaaagaccatcattactgtttgttcagtgtttacattttgtttagcaggggtttcatattagtggctactctaggagatgtacctcaggtaattatggcagaaaagcagcaaagggaaggctgaatgaaacaaccctaggctggaattctcaatcgtgcctgcaagtgaaaaaaaaattttcattacactcacctctttctccacactctcttaaataaagaactttttttctttttatagtggactgaaaatataggtgcttagtcttttgttgattttatatgttgtgaaaatagtttctttgaatacttagttatattcttcttaggttctacttgcttgcagctaccctttatttattttaaaaaatattttatgtacacaaaggtgctgtggctatatgccttgggatccttggagagttctcccattaaagttatctttctgtttgtgacatgatagcttagcagaactcagtaggccattaggaaaataagcaaattcttatctggaagtcattaactagaatcagtcattctctttttctctcttgcctggaagttggttcttttcacatcctggaaaaatattttgatagagaattaagtgctggttaaaggtgagtttgtggcagagggactggaatggggaggggactaaaactatatttgcctctgtgttcactgaggggcgttaacaaagacaaggtcagtgaccagctgctggcattgtcata

SEQ ID NO: 36949 - DNA, 709 bp, Bovine  19866880658708
cttctcagcagtgttctgcaatttggggaggagtgagtatctttttataaaatcacttagtgagtccctttggtaagcctgtacactctattacgctgaggtttagtgtataagaaaaacgtggtgtgttggagtttgcctgcttgtgttactttttctcctttacatgctgtggtagcttactcagccatagaaaataaattcaaagctgtttaataataaggctactgttgtgtagtagaaactaggcattatggcagtaagtaaataccttatacatcaagaatatttcaagtttctggtgaaatccaaagtatcacaagggcttcattatgcccttgctttcagcccacaacccctctgatcttaatgactcccaaacagagtcatccaagattttgtcccatgtagggtcactgagtaagtttgtgatgggtctctgtgtgttctctatgaggaggggagagagggtgatgactcacactgagtatgaacaactggaaccccaattttatgcacttttgtattttttggaaaacatttcttaagcatactccagcagtctgatttatcaaacagctttgcctcttattgctgagtcatcctactacgaatgggaaaggcacccaggaaactacaaagtgacttacatgggagtttgattctcataagttccaggagtctcaatcaatttaacaatcagaaaggg

SEQ ID NO: 36950 - DNA, 2449 bp, Bovine  19866880698108
tctggaagtgatgtctttagttattcctcatttatttttatctctccagtgggaaggagaatttatttcaacttaaaaagttgtagaaggcttcccacaattagctagatttaactcttcattgcttccaggatacattccaaactcctggcagtggcatttagagaaatcatcacattcttaaaatatatctctagtctttatttttcatttttctaaactcttatgccccaacaatatcgagctactggattttctgcaaacacaacatatatttcaatccttttctcattttatcatttaattcttctacctaaggtcatccttccttcctttctccatctgctgccatcttaccccacttctaagtcataattctcaaatactttcttcatgggaaatcctctcctagactgctcaccttaccccagcctccagattgaccctgaggaaggtcaatgactgtttatcaagcacttggttgtttaatcactaagtcatgtttaattcttctgtaactctctgaattgcagcccaccaggctcctttgtccataggatttaccaggcaagaatactggagtgggtttccatttcctgctccagggatctttctgatgctgggatcaaatccatgtcttctgcagctcctgcattggcaggcagattctttactgctgagccacctgggaagcccctacattaaggtaggcaaagtctattcttagaagaaaagaatagatttgaaatgaaggaggaaacggagaaagaaatagagaagaccaagagggctgtgaatctttacagtgatatattgaaggacagacaacaaaagaggaagcagggaaagagcaaataaaccaaaagttgaggaaagggtaaagagaaaatcgaggggagcagccttaggtgtttatcagctgtggggaatgactgggaatgcagattttggggctattttgctgtacttcatgggaaaaccactcggcatttttcaagaatgcatacaaaataatttaattttcaatttttaggttgaatttctcatgcatgtcataccctggagaacaccattctgttgaaataggccacatggtgaaaagaagagcaaagtcgctcagtcgtgtccgactcttggtgaccccatggactgtagcctaccaggcttctcagaccatgggatttcccaggcaagagtactggagtgggttgccatttccttctccaggggatcttcctgacccagggatcaaacccgggtctcccacattgtaggcagatgcttgggctgtgtgtgtgtgtgtgtgtgtgtgctcagttgtgtccgactctttgtagtcccatggactgtagtccatcaggatcttctgtcagtggaattttctgggcaagaacactggtgcaggttgccattttctactccaagggatcttcctgacccagggatcaaacctgaggctcttacatctcctgcattggcaggaacactagcaccactcgggaagcccttattcaggttacctactataatatttattattgtaattgtttcttcagtggcttgtcttactagactgaaatctctatgaagatagatattctgtcttaatcatttttgtaacaccatcctctaggacaatatctggcaagtactaggtgctcagtaaacattcactgaatgaatgaattaatgaataagtatggtactagaagccttgtaccaactttagtcacaataacatggaagaaaaatcttcagatagaaaatgtcttcaaagtttgggaccaattatgtaacaatatttttccccaaaggtaagaaccaacaccacctaaattttacttcagtagtgattttcttttttgccttggcaaattgcacaccagagctcccacacccagtgtcttgcaaaagagaacaaatatgatatacaaacgcattctgctgattgtagagaggaaaagacacagagtagacggtagagataataaatgtgttggtgtctataatttactgcacttaggtgataatccaccatagccacaaactatattttccccaaaaggtcaacatattcaagtcacatagttatattcttaaaatattctgattgattatgagtgaattcagtagaagattcaacatatttgtaactccaaaatttgtaagtcaaattttgttgcatagcaaattatattttaattgctgttttcaagggttctaatcaaggagatgcattcatttattagccagatatttactgagaattattatgtaccaggcacagggcagtgtactagtgacacgaagtgtacagtgaacaaaggacacaatccatatgcccaaggaacccaggaataaatgcaatttaatgggaatataatgggagtgtttgtggaagtgagcctcagtcctgtgtggaggtgccagggaaggttcacgtataaag

SEQ ID NO: 36951 - DNA, 3037 bp, Bovine  19866880746684
taaaatagggagggagacatagagtttgagcttttaaggttgactttttgactctgaaaagaatttttaatggcaacataagtaaggctgaagcttagaatctgcctctttcaaggtctccaaatagtcacagaaagaaaattttcagctctaaatgtggcccttattataaaatgcatcatttatactacaaaaatcattttacatacatacaaaaaagattaactagttaaaatggagacaaaatattggctaaggttttaaaatttcttataaaaataatttattaaaattggactacagaagacagaaaacatttcacaacttcgtattgctcattgttgccctgaagacatcatgaaacatacgcaggtccacagcatgggcttgggcacaatatagagaaagctaaagaaacacaaccctttccaaccaaagactagagttgtaactagtggacttgtgaagctctatcacccagtgtccccaggagtcttccttttttagtggaacctgtaactaactttaaaacttgtcaaaatggaaagagtggccagcaagacgctgcttcaggtagtgtaacttcttcacattggtatttcattttattgactggttcattactggttcattgactggttcattaccggtgatttcagagagatcacttcttttaggttatggccagtaaataagtcttaacagcctcttctattcaaaaaaaagatgtaatattaaagctgaaaagatttatacactttgttttgtatgaattaaaccagtatccagacataattgtgggaatttatgacccaaatttgagctctaaaatttaacttcggttctagatgtgtctttaacaaactaattcatttagtaccttttatgtctttcctgtgtaacaattattaaatttgtatcaatttcacatcaaaaggaaattatttcttagggccctattttcaatgacagttaaccttatttgcagcattattataaattccttcatcctctttcaggtttttataacacgttttggctaactgctttgactagatttttgaagacaaatgagaatttggataaaagaacttccattagcataagataaaattttaatttaaaagaaagactttaaaaaatgtaactgggagtggtagccaaagggataccattatgctatcatggtgttgcctaagcaaacacatataactatttcttgacaaaatgttgtctataatcatgtagattttattgcagtgtcttattagattttcattttctttgacgtaataagattcaaagccaaacatagctctgtaaaattaaactttattgtcttcatgtttgctaagtcaaaattcctttccttaatattgcttaaatacgattaggtttttgaggtttaaattcctttctttaaaaaaatagaaatggattttatatttttccaaataaaagatagagcagtgatgatgacccatacacaaaaccatccaaattgattatagattttgctaataaatcctaatttctttaatagtaaacctatattttagttgaaactgttaagtttacagataaaatatttgtcatatggaatacatgagaaaagctctagtttctagacattgataactagattggatatagtttctatttctgatatctcttactggttttcctgatttctcactatcattttctttctatcatatatttaacttgtagtgaactatatacgtgcgtgcttagtcacttggtcaggtctgactctttgtgagcccatggactgtagcccaccaggcttctccatccatggggattctccaggcaagaatactggagtggattgccatgctctcctccaggagatcttcccaacccagggactgaacccaggtctccctcattgcaggcggatggattctttaccatctgagctgccagggaattgttcagttcagttcggtcgctcagtcgtgtctgactctttgtgaccccacggactgcagcatgccaggcctccctgtccatcgccaacacctggagtttactactcaaactcctgtccattgagtcactgatgccatccaaccatctcattctctgttgtccccttttcctcccaacttcactctttcccagcatcagggtcttttccaatgagtcagttctttgaattaggtggccaaactattggagttttggctttcagaatcagtccttccagtgaacattcaggactaatttcctttaggattgactggtttgatctccttgcagtccaagggactctcaagagttttctccaacaccacagttcaaaaacatcaattctttggttcttagctttctttatggtccagctctcacatccatacatgactactggaaaaactatacatgactatatggacctttattggcaaagtaatatctctgctttttaaaatgctgtccaggttgggcatagcttttctttcaaagaacaaatttattttaatttcatggctgcagtcaccagctgcactgattttggagcccaagaaaataaagtctctcattgtttccatcgtttccccatctatttgccatgaagtaatgggaccagatgccatgatctcattttttgaatgctgagttttaaccaaaccttttcactttcctcaagaggctcctcagttcctcttcactttctgccataatggtggtgtcatctgcatatatgaggttatcaatatttctcccagcaatcttgattccagcatgtgcttcatctagctggcattttgcatgatgtactctgcatgtaagttaaataagcagggtgacaatatatcatcttgacgtactcctttcctgatttggaaccagtctgttgttccatgtccagttctaattgttgctttttgacctggatacaggtttttcaggaggctggtaaggtgatctggtattcccatctctttcaaaattttccacagtttattgtgatccacacaaaggctttggcatagtcaataaagcaaaagta

SEQ ID NO: 36952 - DNA, 1036 bp, Bovine  19866880776718
atttcaggatttaagcttattttatatgcctatttacaagtttagaagaagaaagtcagctttgttaaacaaaagcaaagtcttaactggccagtggcatctgatctccacaagtaacaagttgttccactgctaatactttgcaaaatgttgggaaatttattaaatcagttaataaattatctccttgatccattttccaagggaaaataagtaggcgtgatcacttagtagaaatatacaccaaacctagagataatatatcgtataacacaaatgatagcattccttagaagatacagttgagaaggtgagatatgatgtctggtttactagctatcacaccataatttttttcctacaatttaagaaaacacattggaatttaaatgaatagaaataatgttagtgtactaaaatactatgtcctaatttacaaaatagaaagcaattcattcataaccttcagtatcttattatgggtaacaacttgtgtcacataacagatgattcaggaactgctagtgttttgggtaataaatttagaactttgggatataatatcatgttaagacggatgttcacaaattcaatccaggacggaactgggaccagttattccaatcatctctgttaagatgcttcttactggtgaaaaactggaagaagaaagtcgatgactcatggcaggtacatttcttttcacaattcaggtagactcagatgtgagatgctataaacttaattgggacatgggtcagactttagagcttgctcccatgggagtggtgtacaagaactggaggctaacctgcgcacgtttcaggccagtgcccaggaattcggcatctattgagtgggactcctgaggcaaatggacagctagtctggaataggtagcttttcagatctcttattttgaggtttagatttaaaaaggaactgtaaatacctaccatgaaactaaactgtgaatccagttaaatgcattgagcaataaacactatatctgaagacaacccatactctagcaaaa

SEQ ID NO: 36953 - DNA, 1495 bp, Bovine  19866880789114
caattgtagagctgagaaataggatttgttacaggattgctgctcctttaaaaacatccttattcctgctaaaatggcccgggctatttaagttcttgagttgcactgattaataatgaatagagcacattaaagtagttttatttacctaagtttctattgcatgcaaactagtacacacatatattatttacatcctatatatctttctgctatctaaatttcacaggataagaaataaccagtaaagtaatttgcaaaatgtgtttatatgtcatgtgtaactgataaagtaaatggttagagtataggcaaatatcaagaaagcaaacgcaatttccctaattaaaatgttagacatgtaaccatgccaaatagcattttaatcaaataaacccagaccttattattaaagacaagtacttcaattgcagaattttaaataacttaactgcatatggaaaatgtggcttgaaaatataaacacaattaagacaatttgttttagtctctttggtcagcttaggaggataaaaagccttgcatgtatttgagattagatattaatttgtgactctttgtcacaatattccattaagtgttcttgattgttcttgcacaataaacaatgtctttcttccaatttttttgaaagttttatttatgttagttcaaaatgtctttaggagttgccaaaatcttcagtagccatgagacatttaacacaatattacatattccacctatttgttctaaataactcaaatgaagcagcagttttccagtagcttcccgcatcacttggctttttttgaaccagggtttatagtaacaaaatgtaaattggataatagttattaatggtacaaaagcaacattggggtgagcttcctggtaatattatgtcagtaacatgaaaagatgctgtgttgttttggtttggaacttttctgggttttcaatcaggctcagcagatttgagtaagtaggcagccattatggttttatttggttgttgtttttttcctcttttttgatcatcaaggcacatacaaacattaggctcaagcctaaagccctaaaacaagccattcttttgctggtgaaattctaatctcattttattacattgtcaatgagctgcagagattcgtcttgtcttgttaacatgatagcagacagatgagaagaaataaaaagtactggcctgtgaaagccaaatcaaagagccagattgaagggattctcgagttactcaggtgaggccctcagcccctagctagtgacccagctaatggtcagaatgccgaaggttccgtttggatgatccaaaccttcagacatggtattcaaatgtctgcataaatggctgagaatttgccttttctttgtaagcttactatacaataaacaaaagacgggcatttgatactaactaaacatagagaaggaacagacagtaatacggatgaacgtgttcaagacaacacaagtc

SEQ ID NO: 36954 - DNA, 904 bp, Bovine  19866880862667
ttaaataagcagggtgccaatatacagccttgatgtactccttttccgatttggaaccaggctgttgttccatgtccagttccaactgttgcttcctgacctgcatacagatttctcaagaggcaggtcaggtggtctgatacgcccatctctttaagaattttccacagtttgttgtgatccacacagtcaaaggctttggcatagtcaataaagcagaaatagatgtttttctggaattctctcactttttcgatgatgcaaggaatgctggcaatttgacctctggttcctctgccttttctaaatccagcttgaacatctggaagttcactgttcatgtattcctgaagcctggcttggagaattttgagcattactttactagcgtgtgagatgagtgcaattgtgcagtagtttgagcattctttggcattgcctttctttgggattggaatgaaaactgacgttttccagtcctgtggccactgctgagttttccaaaatcaagtatattctaatataaaataaaaattaaattaaaatatgtgtgtgtgtactgacatacaaatacactggaaaacctaagataagtgtgatggggaggagtagttgtcaagctgttagctttgtattaatttcggattattagaggatttcttgttcataccttgtttttcctcaaaaacattaataaacatgagatattcattttataaactgagggaaccaaatgtgcaattattgcacacaaaagtaaagcttttaataatcacaggtattaaagtattttcttgcctgtcattacatttctttgtatcttttggcataaatattttaacctggttgtgattcatcacttatttttctttcatagtatcaccttacaggtataaactttctg

SEQ ID NO: 36955 - DNA, 1416 bp, Bovine  19866880875600
tggaatttactcgatgtttaaatgctcttttgatgaatttgtggggaagaaagtgttctccccgtcctactcctccggcatcttggctcctccctccaggaggtggcatttctgggatctcagttgaatgcgcctatatctaactcttggactgaactccactggaaatcttcgctctgattgtcagcatctcagtgactatctttcctgtgtttccaaagctttttcttctataagtgcatcttagaagttaactggcagccagaggggaaattttacacatattattagggctccttctctttagtttttttctctccaggactcagccactccattccagttttcttggctaccctaaactctgatctctgtttctgctgtccaacaagactattgtctttatttaggctcaatttccctgaactgtggtttggaaaatgccctgaggaagaaatctggggtttatgtgacgtttattttgtttgcctcttttctctctaggactatagccctgcagtggctgctgtccagtgcctgcaaacaattgttatatatgttttgtctagattttatacttgtttataacaagaagttaagtccaataatagctactccatcatggataaaactagaccttgacaatgttatttctttttatttctctttgcaccatctcttgcttttaagacacctttattctaccatttcagtgacaagacctaatcagacctttattctcctttctattattcttggaccagcctcaaatgctttctccaggtttagcttctaaggctacatttttagtatgtaagaatcagttcagttcagtcgctcagttgtgtctgactctttgcgaccccgtgaatcacagcatgccagacctcccggtccatcaccaactcccagagttcactcaaactcatgtccattgagtcggtgatgccatccagccatctcatcctctgtcatccccttcttctcctgcccccaatccctcccagcatcagagacttttccaatgagtcaactctttgcatgaggtgggaaagtattggagtttcagctttagcatcagttcttccaatgaacacccagggactgacttcctttaggatggactggtaggatctccttgcagtccaagggactctcaagagtcttctccaataccacagttcaaaagcatcaattcttcggctctcagctttcttcacagtccaactttcacatccatacatgactcctggaaaaatcacagccttgactagacagaccatggttggcaaagtgatgtccctgctttttcatatgctgtctagattggtcaaagtttcctactaaggagtaagcatcttttaatttcatggctgcagtcaccatctgcagtgatttggagcctccaaaaataaa

SEQ ID NO: 36956 - DNA, 931 bp, Bovine  19866880916291
tatttatgtaatttattacagaagtaagctgtattaatggaacaatgaatacatatggtcagatgaactaaactcttgcatagtgggatttctttccagaaagcagagtggtctaagtttagcagcaaaaaactacttatgttcaaaccacagtgctaggttctaagagtacagacctgaataagagagacaacagtggtgtttcgtccaaaagttcatttcatagagaggaagaaagaaaatgaatatgtaactatgataaagttaaaactcacagctccaacttatagggtatccccttgtactggaccctacgtttagaacactgcggtcataaacatttatggctccattatatatcctgttatacacaagaggaagctaacattgaaatagcttagcattaaggtgcaaactcttatatgacatcaaatatgcaggctcttaagcactaagtgatgttgcgtttcattggttttcaaaatgttaactagcagactccctctgtgtgatttgatttccatattgtcaacagctgcctccttactcttttagcaatggaagaagataatactgaggctgccagtttgaataataaaagatgtgtgttggattccactatctctatgtttgtgttctatgtgtggggcgtgttatggttggaagagggaggagctggcaggaggagggaaggcacagcctgacactctcatctgtgtttcagctctggtttcccactccatcagagctttccttctcttacactaattcttctgggtctcactttttttcagaaactaatggtcagctggtacaaaaggtggttctcatctctcttgctctttcaactagggaatgcagcccaaagcagatggtaaactccattaaagctaaataccaaaagggcactatttcctttcaataatagtaa

SEQ ID NO: 36957 - DNA, 1021 bp, Bovine  19866880929356
catggcaaaatgaagttcatacttgtactttacacagatgatgggtttaatattgctgttgttttcttagagggaggggatagcagtggagtacttgtctttttcttcttcaggtatttatattcagttgtactaccatcaaaacacagcataggtgtctccagctccagttccataagtgtccacatgtaaatatcaaccactcactacgtactgagtaactataatattcatggcacagtttcacattctttttagtgtggtgctagcatcatttctactcttggtggtctttagttatgtatgttattatagcttagctggtaactgtttttaattctcaatcccatatgtttttttgcatgcaaaatagtatcaacaacattatgtcagacccaaagatacagaaggtgatgaaaactgagctggtggatcctcattcatctaataagctggaaaggctttacagaaagaggaaccctaattgtacatacaacaccctcagtctcacatgtcttcaaaatgacctttaaaagaatgctttaaatgtcatagcttttttagaaaacattgagccaaacatggaaattgcatgagaagaatttctgaatctccaattaaaggcacaaagagccacattttcaatttcctcttctttttttctttctctaacttgtcaatgcaattatttaataaaaaccaacatcacattaaaataattaggcataagcagttgaatgttgatggatataatacaagcagtttcttagacagaggttaagtttttgagcaaagttccaggatagaaaacgtggtgaagcaaagtttcagtggagtgaccttagcaataaaagtgctccaaaaataacagcatacattttttaaggaatgtccaatcttattcaatttcaaccttgtcaaagaaatttaaatctagctcccaaataaatgtttaagaatcctgacttactcatctcttctcttacttttagcaactgtatataaatgatgtcataatcaa

SEQ ID NO: 36958 - DNA, 1639 bp, Bovine  19866880969707
cgatcccctggatcgggaagatcccctggagaaggaaaatggcaatccaccccagtactgttgcctggaaaatcccatggacagaggaggctggtaggctacagttcatggggtcgcaaagagtcagacacgactgaaagcagtactactttgaagatgcacaaacaaaattcgagagactttttaagactcccacaaagattgtgacaatagtgggatttgaaacccaactctttccccaaaagccaatgctaacccaattgcctcattttatgatttaaaaattaataccctaagcatatgaaaaatgtgttaaatagttattaaaatgtgttgaatgtgttttcaaatattggatgttacaacatatcttcattgtcaaaacaaggcttataagactataatagcaaagactaaaacccagttctttccaggtataagattttaattaaagatgtgctaattactttcattttttgccatttatgtgtagttatattttggcttagagaaagtgttcaagctaggtttgttgggtggctgaatgaaatatgcttcaacaatttgatttcatgccattaagtatccttaggaactctgaattggcaaacttgaatccatgggaatctgttcttcaagaacgctcagcctacataatttgttactcgtacaacatggacatttgcttagaactttaaaagtacttgggaacagggcatcacaaatattgtaatcgtggctattgggaatcatgatagataaacttctttatgcctttaatagaattgggggatctagttctgtccattgggaaaaagtattattgtgtatgttcttttcttaacagcatgggtgtgctacttaacagcccctttcaaatgtgtaagagatggcattagttctgcttccctcagaccacagggcaggaagccaccttctttatgcagaacaaactttcacgtgcttactccccaatctcaccataagccatgctgtactgttccttcatcacccacaagaacatgttactcacagtccttccctgctcaaatttgcattgccttgtaaagtccaattttctctaactgcatcatgccatgcactataaatcgtatttgcaccccatctaaaacttaaaccacagtagacactgaagaacaaaagaaaccacaaacccaggttttttgatgaaaactcccacacattgataattggaagcacataaatctgtacccagacaagatctgctactcctgccatgacttatgctgcctgactcacagcccagcccattttcaatgctgccaccaagtcccctggaaaagtatgaagggcaagaaaacactaacaaaactttctggggagcaacagaaatgaaaacaataacatgaattgcctaacaaattgtacttctggagtctgcatttaagcatcattgagatctgtctggttggttgatattataaaaatcccatggtgagaattcaatctttaggtcagttctaaaacaacagctagttactaacatgttaaggtacacatttagaaaaacaaggtttgtttaagaagtccaaattattttcagaactaagaaaaaattattttgccccccagcctgtgtaaacaactcccatgaaca

SEQ ID NO: 36959 - DNA, 911 bp, Bovine  19866881052198
tttgatgaaatctagagattgtctggtttatctctttcccttctgtaatagatgacaccgggggacctagggatatccaaggacttatccaagcatctctaaaagattacttagagcctgaaataaatagttagtacatgttctttctactacaacatgaggctcctataaacatttaaaaactgttggcagccaggcaaaagttttctatctacttaatgttttatagactaatttatcttggtcattacacagaaacaattcattctagttgagcttgaccactgcattttatttataaagtaagaaaaaattttaaagctaacataaatgattagaggaattgttccatgatatattttgctaaatgatcaccatgtcaatatagataattactctaaagttattcctataaaatatctatcacatttactaaatttaatacttttctttaatacaactaaatgtaatatctaaatatcttttttcatcaatttaacaaaaagaataaaatggttagtagagcacatcttaatgttggatttctagtaagaaatagtcttacttgatgcattgaagtgttcacaaattagctaagaataaatagccctgagtagcttaagctacttactgtacaacaagttttagagttcaagctcatggctcactttgaacatgtattttgtaaactaataaagcttttgcatgatatggaatagcatataatgtttctttattctttcaaagattcctcccatagttacttagatagtggatagttataatactaagaaatacaaacatgactatttagcatatacatttttattttgagtatgcaaaaaacattttagctatttatatatacttgtcaaattaaaacattgattcatttgtcatatataaaatta

SEQ ID NO: 36960 - DNA, 1137 bp, Bovine  19866881082881
tgtataacaaaagtctagattccacttattttacagtggataaaatactatatgaatcccatacaatgtataaaccccatacttgtacaagaggagttaatgtctctaacaatgactgtactctaacacagattgctctgatttcattattaaaacacaaaattacatgtaaatttgactaatctaacccatataactggtattctctcactgcagaataaaatactatgaagcaacatcaaccaaaatcaaataagcaaaataaatggtctgaaacagttaaatataaacatcatatagatactggctaaagtttactatttaaatgaaaactttaggaaacttgcttccttttacattttatttttcattaaaaaaatgtgcatcacataatgtatataccagaaatagttgtggcctacttagagtactaaatgttaaaattctgaatcaataataacctttctctgtttctaagatatttataaatctttcctcctctttagggtcatcagggactttctactgccaagaagctgaaagaatcttgtacaaagaatttgcacatcgtagatgagctaaatgaatatttgttgataatgaggttgatgataaattatcacttatttgttatgtctcagagcagtttccctgcactgaaatgcttcttgttaaaaatgatgtttccctcctacgctttggtttttaacatccattgatgattgccttcacagaaattgatgtaagaaagttgtcatcctgttctctgtgtcccagtggcaattacaaacagtctgtagagcctgaatgaatgaattcttttaaagcccttgtttagataaattttcagcatttatcaaattacaatagaaatttgcaaaaaacacaactttgtaaaagtagttttaaaaagacttcaaagctattgtcaaaaagcaagacttttacaaatgcagttttaaaaggatatatccagtatttctcccaaggaaagaattgactttgttgagaaacataacttgaataaccattctgtacagagagttaggtcctagaggcagatcaatagaagtatacaacggaagatggggaagattcctccatataagaaaatattctagatctgtcaaatattca

SEQ ID NO: 36961 - DNA, 774 bp, Bovine  19866881288841
aatttttaaagttcccagaagattccagtgtgtgtgcaaggctgagaatctctgtttaaggaagtttagtccttgttttcaccttcaacctgttttatgggaagcacatgaggataagatttttgagaaaccaaggtaaagcactttataagaggaaaggttctaatcaatatttcagaatcagtgcttttaagaaaagcttatgtattgaatgactacaatattgtaaaggaattagcctccaattaaaataaatacatttatattttaaaaaaagaaaagcttatgtaaagttctaaagcattaatttttaaacaacaaatggttggtgggtagttaggtgatttcaacacaggtttcacgtgatgtcagcatcaccccatgtcactactttaaaagatgatggaatcatctgcttccattttcccactgataaaaacctcatgtcagaagtgaggcctgatgacttgagcctcatttagccataaacatgggaaatgacggacaattctgatggatgtttaggaaaagccaaaccactatgtgcagctttctttggcctcaatgcaaataaacaagaatttgtctgcgccccgttggtatctgatgggccactttggaacgctttcaaaaagtgtgcagcacagagtcctacagctgctgccggttagattggttggttggagcacagtactatgaggccaagattgtgggtttgggggtttaattcctctgttccaggccacagacttaccaccagccagtctcagccag

SEQ ID NO: 36962 - DNA, 1207 bp, Bovine  19866881481608
tacgtaatagttatctctggggctactgaatttctaggagaaatgaatacaatgtgtaaaagaatggaacatatagagtttattctgtctgtttaaatagttctaaaattcggagattaagcctatctgagtataaaccatcttcaaataatcattaaaaaaaaaagcctgttttccttgtttagcatttaataatgaataagactgtcacaaacaacaaatttatttgtgataatgttgctgccaagaagatttttaatgactacagtgaaagtattttttgaaatcattttgtttttcaatgaaacacaaatgtggttttgtacaaattatcactgtctaataaaacaaaaaaactcaacttttaatttatgaagtggtaattaataaacttttactacctcagacgtacaaaaaaaatagaaaatcaaaggtttataagaccctgaaataaaaagaattttagatggttagtagtttgtgtgacatatgtctaaaattttaaaataaagacattaactatcaatgttttttactggtgacatttaatactgctgtataattttgtttgctgtcttcgatgccaatatgtttatgaaatttaatttgaaccataacatatacaaaactctttggatttatcttaacttctatgatttgaaatgttgtctcataaagcatactgcgttgtgatttataatttctatctcctaagtataaaattgatcgtttaactcaatttacatgaaatatgttggattcattcaaaaacattttctaatctatttttctgcttagtatgatctgtgtaaatacttatgagtttgccctttaaaacaaaacaaaaaagaaattttaaaattcaaagcaaaacacaacaaaagaaacaaattaggaaagtatttttttcttggcaagaaatctttttgtgaatatttggcctaggatactattgaaagttgcaacattttattcttctggggcaagagcttcccccttccttcttccaaagtaattctgggtgctggttctgatgtctgtttgtttttatgtaatgatgacagcacatctttatgttgatcgattattgactaaaatcatacttaggtaaacagtaacagttatgccagcaaatctgtttctcttctgtaagttaatttacaatggcagccttttctttgttactatcttccaaatgtcccatatg

SEQ ID NO: 36963 - DNA, 2378 bp, Bovine  19866880346490
catttaaaattttcctcctaggaattctcattatctcttcatgacatagtaaagttttaggtttctattgataactaatgcaaagagacacctttctgtataatttccagagacagaattttttaaaagttggcatcagatttggcaatactacagaaaaattaaaatatctaccatattatataactttacatttgtccaactctaatcaaagccaaagacatttttgcacaaagtcattgtactaataacatcaaaagttttgacttccataacagctattaattaagaaatatatattagagtaaggggctaagtttctttgatttaaaatcaggtttaactctttcttcaaattgatcttctaaattgttggttgaatattgataggcatttagacttttaaaaaaatattgatacatacatagctctttctatggtagtgcattgtctattttaaggtaatttatgcaaatgagactattttttcttgatatttattcattataaaaattagagttacagagaaattttggtcttgctagtaatgtcagttaagaaattatgaggattgttcacaggtaacattttttaaaaagggaaattatgagccagactctaggacatgacttacatccacatgcatccagagcttgtgtgtctcacaaatatctgcgatgtcatggagcgggtcgaaggccccgaacacggtgctgccagctgtggccacaacacagaaaggagtctggccctggggaggacaaaagctgcatcattcttacaatctcaggaagcccgttgttgtttagctgctaactcacattcgaatcttttgcaaccccacggactatagcccgccagattcctctttccatgggatttcccagacaagaacactggagtgggttgctgtttcctactccagccaatcttctcaactcaggggttgaacccatgtctcctgaactggcaggcggattctttactgctgagcgaccagggaagcccctgactaaggacattagataactaataacttcaaatatttagaggcacctacagtaatggaaaaagtagcttaaccataagatgaacaaataccattgcctctgagtcccatttattgttatttctctctgaatttattttcagaagatcataccacaacaataaagacgactaaactcctttagtagtaaataaaccactttatttacttttggtgataacttgtcttttgatatttaacaggaacaaaatggtcagggaaatattgcaatgtcatttaattatttcacttcagctttagaagaaatttcctacatttagagattactttatttcctgtagcagttcttatcagttgcttgccactaatgaaagtcagtaaagaaaataaagatgcatttgcaagttaaatatggaacttcagaacttacctttcttttagcttgtaatatatttttctctaactcagctggaatcatctttccccttaaaaagtcaaatacacattgttttcttatgagtgaataaacatatcgattctaccagttagaagaattaataatattcaagattaaaaaattagtttttagtgactcccaaaggtatttataggtgtggaaaacaagcaataagcagttccctaaaaccaagataaaatatcatgttatttgaattaaaggaagctgagtttactattcaatcatcttaaaatctgcattatttacatatcagaagattctgatttttctaagatacataatggttttcttccttccttttctttcttcctttttttctctaatgattaacctttaattataaagacttcttagggcttccctgatagctcagttggtaaagaacccacctgcaatgcaggagacccccagttgtttgattcctgggctgggaagatcccctcgagaagggataagctacccactccaatgttcttggatttcccttgtggctcagctggtaaagaatccgcctgcaatgtgggagacctgggttcaatccctgggttgggaagattcccaggagaagggaacaggtacccactcccaggattctggcctgtatagtccatggggtcacaaagagtcggacatgactgagtgactttcactttcataaagacttcttggcattaagacataaaaatcaaagatacaaattgttggggggaatgtggcaaaaattcaggtggtctcacatttttcttcacagcaaatttctgggacaaaaaaacaaaagccagtatcttcctgctccaccctgttatcagactgaaacaccgtcttcttgtaagcattcctcttaaagtccggaatcaagtaagaatgcctaccaccatcaatattacagca

SEQ ID NO: 36964 - DNA, 1570 bp, Bovine  19866880452684
ccacccaaggacgttgtccctgcctcagctcctgggcgcagccagctctgtctgatccagctttgcctcgcctggaggaggtgatcggtaacctttgtgggatgcccttaccgctgcccttaccgtgactgctccggcgccttcacagaggttctctcggtgaggagtcagacgtcattatgaacacccattgttgaagtggactacacggcagagattcccccggcttctactcagggttgcaggactttggcccctattagatggtcccagatgctgtgggtttttagattcctatatcaagtattggagtttttgttgtttttatctgcagataaaggagaccactgcactcttttcagatgctctggcacactggtagatttctagtgataagtcctgtgagtaaaaagggcccggtgagtgaaaacgtgaaccttaatgaaagaattttgtaaactctcctgctggctcagaagcacacacctccacctcttttttaagttttttttttttgattctcaaatatgcataagagaaaggaggctgttgattacgtagttgggaggtcacattttccaaacctaaatgctcttgtagttagagtctagtttacagattcctagggatcgagtctcttagtgtcagtgttctcttggaactcatgcattctataaacctgtaagctacgaacgtagtaaaagtcgtacttcaacctttaatatcacgaatctttttaaaattaattattttaattggaggaaaattacaatatcttggtggtttctgctgtacatcaacatgaatcgaccacaggtatacctgtgtccctgccattctgaacccctctccaacctccctccccaccaacaaattttcaactccttacaaaatggaactgaccttggaggatttatgtgtttaatatttataaagtattttaaactccttaggtaaaaactttctggtagagatattggagtttcactttcacatttatagcttttaggaagacagcactgctcagaacactgcacattttgaacctcttacagctctcatgcccatggtctaatttgatcaccatgatggtcattcataaatacaaatgattgtgagatctgtatccgtgaatctgtaatactaaattctcaaacctcacttggttctaaaaaactggcctcctgaattttcctgtccgagatattattcatttcttgtgtaaatgtcagacgccagagaaaactaactcccatcctgccgcttggtgtgaagcaaggaatctaaaccagcatcattagtgagctcggtcttggtggtaagcacttcaaatactgagcatgtttttccaagctagaaggaaagggcttctgctgcctttacagccttcttttgaccattttaagtttccttggactttataatagtacatcagctatgtcattaagaacgtttaatgttttacatatgaatgtggcatgcattatttctctaagatatatgtgaaagaactggacatgcctataaattcttgtgctttttaataacaaatattttatatttttaaaga

SEQ ID NO: 36965 - DNA, 1731 bp, Bovine  19866880617548
taaagaacctgtctgccgtgcaggagtatataagagtacatgggtttgatccttgagtcgggaagatcccctggaggagagcatggccgcccactctgatgtttttgcctggagaatcccatgatcagaggagtccatagggtccatagggtcacagtccataggctacagtccatagggatgcaacgtgacgcatgcgtgcacataaatatttgttagtaaattatacaatatttattccacactagggcttcagtcactctcaactaacctaaagtttctgtgtaagtagctcagtgatgtccaactctttgtgaccccatggactgtagcctgccaggctcctctgtccatgggattctcaggcaagaatattggagtgggttgccatttcctacaccagcagagtgtagctgtgttgcaataaaactttatggacactgacatttgggtttcatacaatttttaaagtcagagaacataactgaattttttctaccccaaccactaccccagtgcaaaaatcaattttatgcatatgacaataagcagcggcctcagatctaaatcaggggacctgttgggggcacccattccattggggaaattttaggagacatttttggtcttctagtgaagtcttccccgaacatttacacattgaaatacattctattataaaatattttcctttttactaataagggattatcaaattagaaatgagttgaacactttaatggatcagaggacacaatgttttagcatggatattgtgtatagctaagtaaaacaaaatctaggactttgaaattatggggaaaagagaagtaggaaggacaagtgaaaattaatagtataaagctcattgtttcaaattttaaaacaaatgaaacttctttgttaactatatctagcgtgcactatttacacacacacacacatttacacacgcacaaatacccagtgagtgaaaacacaaggactcttacaggtttgttcctgactctgacctccaactcctgttttctacagagatagtttctcaacttgcaattttatttccacagggatttttaaatacatgaccttcaagcatcaggagggaatgactgcaactgaaatattgttcttgaagtcagtgcatttctgaataactcatctgtttacaggtggcctttctctgctggaatcctctattagacatgctgacttgtagcagtgtgtattcctatcccgtaatgaaagaagggaggccgtttggaaaacgtaaggccaatagtcttatttgtcgcaaggttagctgtaggttacataaagtcattgcttctagctcctaatgagctctttgcatttgccgtttattagtctttcctgaaactgagccctccgggcagctgtcagtcagttttgtgtaatgacacacagggcgtgggtatctggggtagaaaatacctcatttttctttttagttctattaaaaagatttttttcctcctcgtatgcaaggaaatgtatattttatatccatgcatacaaatggattgcaaactctgcgtgccctcatttccttgagtctaggctcctcggttcagtaaatgccatgccccgataatatggatggcaatcccgaagaaggctgtagtgagtcactgtacaacacctataacaagacagaaaccatttcattatcagcagttaatttttttccagtaggaaacaaaaacccga

SEQ ID NO: 36966 - DNA, 2149 bp, Bovine  19866880622781
aacgacaaataaagagttaagaattatctggctcaacatgtccttagtaccaaggataagaaaccctgctgtagggaagacagtgtaactgcatgattagaaccccaaacttgggagccggagacacctgggtttgaaatctgcctaggagaccacataatcctgagcctcagattctgcatctgtaaaaggaagatgggagctatagtggcttcacaaagggatgaatggggtcatgcatctgaagccctcagcacagtgtctggcacaggggcgaggactgactcacggtggctgtttccatggcccttcctgcgtcctctctcagtgctgtgcgttgtaattggccacgcgcaccatgcgaaggggaagtcgcccagtcgtgtccaagtctctgcggccccgtgggctgtagcccgccaggctcctctgtccatgggattttccgggcaagaagactggagtgggctgccattcccttctccagaggatcttccggacccagtggttgaaccccaggtctcctgcactgcaggcagattctttaccgtctgagctacaaactcagcacagtgtctggcacagggtcaaggactaaatcatggtggctgtcgtcacggccctgtctacgttgtctccgagtgcattttaattgacacaggtgcactgcacagatgtatctaaagaaatggacagcacttctatatcatgaagaaatctgttgtttttctgtatttaaagaaagaagcctcagcaatttgacctcaagtactcaccagccccatgaatcagatgatcacctctgtgcttagctgcctgaagtattccactgaggtgctgaactgccaaatggattaattttttaatgactactcaaggattttatttccaaatacgagtatgccttatatttttggactgaataaatgttcccaatattattgagaggagaacacaggctatggataaaggtagatgccattataatacttcaaaaccataagattaatggaagaagtactttgactgctagataccatttgcttaaaatacaatttgtagtgagattgtgctcagtctctcagtcgtgtctgactgttttcaaccccatggactgtagcccaccaggctcctctctccatggggattctccaggcaagaatactggagtgggttgccattccctcctccaggggatgttcccattccaggaatggaacctgcatcttttatatctcctggcaggagggttctataccactagcactgcctgggaagcacaacacatagttattctctgtcagctacttgcataacgatttttttctagaatgtatcagattatattacaacactcttggacatgcctttctgaataaattgagattatccccaaagcaaagcccgggcttagttttccttggtttagaagtacttaccacaatgcttggtaaagagtagacagtgagatgcacagtgtttgagtaaatgaaaaacaggcagatagataattggctgcatgaacagttagacacatatatttgatattataaccttgtctgtaaaacaaatgtaggcagctttactagatttttcctagagagctctttaggcttagacatgatataaatagatataaatagaataatgatgtaatactgtgcaacaggattccacaacagctgtgatgcagacagttaggcaaggtaatgttttgttgtaggtgctgtcctgtgaattgtaacatttttaacatccctggcctctccccagtagaggccaatagtaccaccagactccccagctctgaaaaccgaaaatgcctccagatagtgccagctgtccctgggagggggagggtcaaaatcaccctcagtgcagaagccttgatatatagtgtctgatttcagggtggtatgacacatttgtctaccttttgtttttcctagaaagtgagtacataactgagttcggaaataaagagcagtgccattttcctaactaacttgggaaagataagaagaaatctttgtgttccagaaaaaaaatttttttcaagtgatttatcccactacattgcatatatccaagctataaagcgaaaagaatcttctgatggccaaaatctgagtgactactgaagcactgg

SEQ ID NO: 36967 - DNA, 550 bp, Bovine  19866880635561
aaataaaataaagtaagatagttaaaaataaaatataaaaggtcagaaaacatcttaaatatctctgtttgttcatatttgcatttttttgtattttagataaattaatatttttacaagaaagaatatcacccaattctagcaaattggaagtgtttagaaaataaaaagtttgaatagaggactttgggttgagaaatatgcagtttttatttgaaaatgctcagtaatgtcttggttgattgaaattgctaatcaaggtaaaagatgtacgattcaagcaattacagagcaaatgtagcttcttattttcaagacacacagtggctgcctaaacagcattttaataaatgttttaaatactttgcaccttagatattttcatttgctcgctattgcttcttttttccttttttccctctatctctattacacgactggctggctatctaacaggtcccaggttttctattactttctggcacatattaggtaaccaagaagtctttggtgtgtgaataaatggatgatggatgaagagatagtggat

SEQ ID NO: 36968 - DNA, 2655 bp, Bovine  19866880657000
cctgggaagtcttttatttatattcatgtttaaacagatatgtttgtactgtgtgtgtgtgtgtgtatgtgtgtgtgtgtgtgtatgtgtgtgtgtgtgcgtatgcagattggagggaattgtttccctttggggttgggagtgtgtgttgaccttgtggcatcttggcggtgagttgtaaatgatgaatgaacagaacaggtcccctgctggaggaaagagagctgcagaggagcaggaagaatgaagacgcacttagctcctttttgattttacattcacagcgttaacatgatcatcgaccatggctgagctcctcagggatgcagtgtgtagcctgagtgttgaatggaatggagtcagtttggggactctcatgcaattgaaaagagcatcattcccaataagtatgttctgtacagatacaactcgggatcaaacgccttctaaacttataaatttcagaaactgtgaaggagatattaaaggagaatttgatttgtacaggggcttccccaggtggctcagtggtaaagaatctgcctgccaatacaggagactcaggaaatgagggctcgatccctgggttgggaagattccctggaggaggaaatggcaacctgctcctgtactcttgcctggaaaatcccatggacagaggagcctggcgggctacagtcccatgaggtcacagagagtcagacacgacttagcaactgagcacagaggcatgacttgtacagaaattatctgatctagattttcaatagtttttttttttttttttggagacagattgctgttttctgttgttgctttttgcttgcttaatttcaagttcatgtgtatctcatgcaaaaaaccctggataaatgtagggcaaagaagctacttctcactcattccttagagtcaaaaattattaaaaatagaaaaaaaaattgttgagacagattatccatgtgattgaaggcatttaaaatgaaagcttagcacaatcttactaatgattttggaatattaaaattagagtctgtcaggtgccaggtgtgtgaacagagcagatcacacaattaggcaaaatctcaggtaaaattaactccatttcaactaattcatacatgaatttaatgtatctatctgctgggcttagagatggattgcagttgggagcgacagcttcagaagaacccaagacatcctgctttgcttgaagattcaagacaagccctcggctgactgttgttcctttcacaaagactatgtgccaacattatcattcttgctggagtaaacacaaaatgtgagagtctctattacagcgcattttcaccatgatattttaaaaccactcctgtgtttttacttagcattcatataatgctttccgctgggagaacactttgaaatgtcccttgtcaataatctctcaagccactcaatgagataggttggtattcctggcgccatctcacacctggggaaacaaaagcagaaggaggttgttggacctgaaccagatcataatgtttgaatacgagaatgagaactaatagccctggagtttccagtctgttgttcagccagctggcttatgttcctccaagtcttgttacttgtgtaaactcgaaagaactgttaggtccttgaaaggtacattttcaatagaaagcaaagcagaatcagcgctctctcaagagaagtactcttctattgattacctaccatagagtcacttccccccttcactccttgtttatactttcccatatataatacagaagaaaaacaactatgggaaatgagccagatgtttcagctaaaaaaaaaaaaacttctgaatatctctggaaggtcttcattctgacagctcaaagtattagatttgggaggaagagagccaagaaagaatttcttcaaacttggaggcatgcagagaaaagactaatagcagaggtgatgagaaatactcaagggaagaatgttcttgtggtgccagaagttggtatggttagagcatcaggaaaatttggatcagataatgcaaataatatacacaactttttcacagatacaaattagaatttttacttaggaaatcaaatgtccactaatagagcatttttagctgcttggcaaaaagccttggctgaacaaaaggaattcaaatgcatttggtgacagctgatgtggaaaaactttttatagtacatgctctatcgtgtgatgcagtttgtgaattttctcaaaaaaaagtgacagtcaacagaggcctgtgtttgtgggcttaatctgtaaaaataaaagaataagattccatgaaagatgaaattgacaacttatcaacattcaaaatagaaacagttttcagtgctgttttaaggaggatgaatgaactggagaattgttcaccataaatttccaaacttatggtacagaatttagaaaattaaaaatgtagttttgtattatttgctgccagggttagaaagtagttctaaagagatccccaggaagctataaggcagtctaaagacttctagataaaattaaagtctttcttcattttctttcaagattcttaattgcagtagaagacattctacatgttcaacttccttttgtcttgaattatctattattctttaggatgtg

SEQ ID NO: 36969 - DNA, 2186 bp, Bovine  19866880700909
aaaactcagtaatttaattaacaaaaactttccaataaatttttaaagaaagacctctaaaggatacattcacctactcattctttctcctaaaaaccatgttttattccttccctgaaagtttaaaaaatcacttttatattttttcgaactcagccccatcacagtccactgacatttccaaaatcaacagtgacttgtgagagtcaacctcatttctggttgtcagttctcccacagtttacacaaattacctccaaatgacctggctttaattctaggatttgtgcaaactctgagagtgaaagtgttagtcgctaagtcatcttcaactctttgtgaccccatggactgtagcccaccgggctcctctgtccatgggatttcccaggcaagaatactggagtgggtagccattcccttctccagaggatcttcccaacccagtgatcaaaccccagtctcctgcattgcacaatgattctttaccgcctgagccaccagggaagcccttatacaaactagagtttgtaataaaatccatgctgtgaatatttgccaaacccagaaggtgcctccccatgaagcaagaaggagcctcactgcacaaattcagatatgcagctttagtgttcctttatcccacttcctttctgagtctccattctgtggaggtggtgggcagttaattcccggcagtcagcaattccactgttcccggggctggcctagctttctgaggacagggagagctttcatagtagaaagacactgctaagggcatttgccattcatctacatgaagtcgccccaagacattcctttatggctctgcacaatcccttcaaaactggccgttctctccgcagtttacattcctgggatccggaacgcgctcaggccttggtgccaggcgggggcaccagaatctctgtgaagcgatccgtgagcccatttgcctcatatgctgctggctgttactgcttccatgggcatctacccacgatgcagggaccagatcgcccctgatctcagcgtcttcgagtttctgggtggttggctctgcccctaagacctttcttgggacccgcctacactctgccctcccccatacactttccctccccctgcaaactcctcatattccaggaaatccttctctccccgctgtccacagaattcttcaggcaggagaattcctaggtgaaaatctggtccacataagcatgtccaagtacttgtccttcaaggagggcaggatgtcccctatgactctctaacaagaagaaatattactcttttcccagattaaagctattatcagctcttgaggagaacagagcagtcaaaagtgctttaatctgttggtttacatagcaggactgaaatttagtcaagcatgaggaatataaaacttttatcgcaactggctgacatcagatggaggtattctgcagcgaccaccctgtcagctccagaccccgtcctgattcagtgttcactgctaattcacgtcaaggcctcagccgcattcagagggctctggcgctgaatccaccctaccgagtagagcatctgagaagttttctctgattaaagtgcctaacagcaacatgttctatattccaccactaacacacaatgtactcaatagtctaacacttcacctctcttctgctttctttgggtcccatgtcccagtttttaaatctctatggctttatggccatatatagcaatgctatctctctgttacactcgattttgtgccaataccatgattcatttcatataggcagttcaatctaccatttcctctcccgtctaaaatctcatcgtgttttgttcagctcactggatcaaatatatactgcctatcattttctccaccggaaaacatacttactatcattgtatttttttctttgaaatcaggctttgtcctttgcacattgctcctcatctcccccaccaatgcctctctccagcctccccctgcctaaaatttttcatcattccaataaatgtatatattggaatgggaaaaatttagtttccgcctcagggatcaatttacaatgatcttaaataagcctctttttaattgatgagcctgctgcaaattgcatacttcagtttactctgtaaggaatacaataaaccaaggcaaagctgcttatgactca

SEQ ID NO: 36970 - DNA, 2173 bp, Bovine  19866880744146
gcatatggagtggtctagatgcacaagtttctagattttgagcaggctggttagcatacttaaagctgatgatgttaactttgtacaaaccctgaaagctgaaccacctgatctgggtagaaatgacttccaggtgaaatttcagtttggttcacatcagcatcttcagtgtctataaaaattggttttgggacttccatggtgggtcagtggttaaggctgcacactttcaaagcagggggcacaggtttgatcccctggtcgggaactaagatcccatgtaccacagtgtgaccaaaaaataaaagaataaataataatttacaaaaagaatttaaaaatttgcttgttactttataattttatgggctgtatatgttactatgttactatatacagcctataaaatttgaaaagctaaactggatttggctttacttgaaaatctctggcttagtctttgcccacaatgtcaagttggaacccacaggtgctaactctgaattttgttgctccataaagttgtttttctttttcctttttgtatttgctcttttccgatcaaatgctatgaaataaaaacaaaacaacaaataaacaaataaactgaacagcaagagagtcaagactgtgccagtggtacggtacttttcatctggtaataagaatattatgtatcatatgacacacatatcaaatagcattaatattgtttaattagaatattatgcagaatttcaagatctttactgactgtattcatttttcttattaattcactttaaaaatagacttaataatcagaacacaaataaattgatatcattcatgcctgctttttcttatgtcttatagtagcatgcttctgctgcaatcaaaaactgtaattgctggtagcatcagtgtcagattaaaataactcagtgccatattcttatttatgaatcacaagaataatataatttaaaatatttcttttcctctgggggaaaaataatgtactgtagcattaagcctaaaagccctgctcaaaatctaagagaactgattcattgctttctttttaaaattttctcaagcctgaactacaataattctcctttaactggtcttcccactgggcaaatataacctccaaatggtataagactctgcagctcatccttccagttggagactaactaaatttgcatatattctcttcaagggagaatttaccttgccttccaggaaagccgcatggtgatttgaaaatgttatcgttcagtctttagaactctgaagtctggcttctaactccaggacctacagatagtacatgccctccagctactataccaagagcctcttaaggactcttggcattaatcatatagattttagtattaaaggttttgcatttgttgtcctgtcacttagaatatttatcttctagccaggaaatatttgccagtctgtttctaagtttcaaaggaagatgaaagacatttttcatctgagtttggctacatgcaagtgtcctaagtagctttgtttttggttttgtttttaaaagttgaaaactatgggaataaatatgctctagagtataaagaagtcgtgtgccaagaaggagcctagattaaatttgtgtgggttgttgaggctgacgttccaaaggctaccttagctgttgagtttggttagtacattgcagagtctgggataaaaatggattgaacgctcatgaaaaatgccagaaggaaaacactagtgacttcattcggttcaagataagaagtctattataaacattcataaagaagactttgccactttgttagggattttccctgatcgccaggattgtaaccgtcatcaaaagacctaaatgaatgatccacatcactcatcctccacgttgggctcggatgtttccttctcagtgaaacctccctcagaactcgcccctcatcctcctcctttaacctcacctaaaccctcagctcacacctttcagctgatgctgaacttagctgctgagctgtttgcatcactggaacatcaacatttggtcaataggaacctgtgtgtgtctgcttagtcattcagttgtgtccaactctctgcgaccccgtggactgtagcccaccaggctcctctgtccgtgggattccccaggcaagaatactgg

SEQ ID NO: 36971 - DNA, 1344 bp, Bovine  19866880790026
taattgcaccaggtgagataacagttggaatgcgatttcacccagcacaatgccgcatatcaaaggctttcaccttcggaggacatgaggatgaattgactaagagtcattatgtttccaagatatacacaacactgctgaagagtttatatgatgcataaaaccattaagacgaaggtttatgttaatcatagtgggagacatttctaggtcaggcccacatttccattgtcgtcttaccatgttctagatgaagctgtaagaaataatatacacattgagagaaaagggagatgcacagtttttagtcaatttctttttttttttcctccctccaagtttagttccttatcagcttgcgaaaagctgctggaaagaagcagggattttgctgccaggtccgaactgcaggggtgggactggcagtaggaaaaccaaaaagatcgagcaaataagagatagtatagatcgtctcctgttgtgtctgttttcaaattgctgtgtttaaatgaacttcttttttagcaaactgtctttagtctctttcttcctggcctccagtgacctttaactgattttttatctcctttgtgcctcaaagcatctgaaactttgatctttctcttcatgtgaataaatatgacatagactattgggataagcagtttgatcaggatttagggactattggggaaataaaatgcaatttgacattatgccattatttgattcatttattaaaataaaaatacttttaatagagtatgaaaaggcaaacagtaaatatagtgcagttcatctccagaagaggggtgatgatgctggaataagaccagcgtttcatgtggtctgtaatgccaatttcagcttgttagactcacttttgagagagtaataggattcctcctcatatctgtttgataaaaaacaatgtgccttcaaagagaaaatcaacacttagggaagaggaaatgctcaacaacagtaatagttcttctaagtcagccagcttggaaatgcaaatattgaaccatttctgagcaatgaaaaatggtaatagtaagccctcttatttggagccgcaagtgccccctgcttgctgctgctgctgctaagtcgcttcagtcgtgtctctgtgcgaccccatagacggcaacccaccaggctcccccatccctggggttctccaggcaagaacactggagtgggtttgccattgcctcttccaatgcataaaagtgaaaagtgaaagtgaagttgctcagtcgtgtctgactcttagcgatcccatggattgcagcctaccaggctcctccattccatggggtttgccaggcaagagtg

SEQ ID NO: 36972 - DNA, 977 bp, Bovine  19866880807984
actgaaaaaattggtcttcatgctgagaccaggtttcatcatcacaaactaaatttaagacagttttaacaaaggcttgctttgctaacaaatccttaccaagaagcatgtcatctaggaatgacagcatcaatttcatagaaaattcatgacgtattaaatagtgaaagataattttctttctagcctctattattatcacaaagaagcacaaaaccatgaaagaggatgagaaggtaaaagctatgcattgacatgtagctttttctaccggttgaattattccagctgataacataaatgtatttgcacagttacatattattattgctttgtaatctacaaaaggatattactgtgcaatgtaaactggtattaaactactcactatatcaaggaaggcatttatatactatactatgaaatgatagatacagctagttacaatggtgttaataagcatattattatgtaagtatagctttttgttcaaagaaaaaaaaaggaaaaagaaggaatcatcacacaaagcactcaaaaattgtttatctctttttaatgttatgggttatgaaacaatatggtctttcttaggcttagaattattttacctgttagaagaacatggcagtagagactagcagtatttagccctgtgtatccagagtccagtgctccatgctactatcattcaaagcaagaagcttcttggccaagtggccaagggaataacttcctttgagagtaggaaggagggtcacctgctaattgacagagtccccctgggtgtaaaaggggaaattataatatgatcttttgttgcttttcaaagatatagcacaaaaaaaatgactgtcatatttgtttcacagatctcaagataagaacaatgtaagttgaaggaatttctaaatatttatactaaataccttaaaataaaaaatggaaataggattaagtatgttcaaaacaggcag

SEQ ID NO: 36973 - DNA, 947 bp, Bovine  19866880969886
tcaaaagcacaatgcatatttttaagatattatattcaaaaagagaaaagggtcgtagaaatcatagctttcttatcttttattcctttctaactttcatgttaggatttgagagtgtctgtttcctactcaggctcagactttcctgctgttttcccaacttaactttgaatcgaggcaaaacctcaaagttccagggataactttggagacgggaggggatgagagccgggtggacgaggcccaggacccttcatcgaagcttcaccagaatagctcccttttcatctgttctctaggttgagcttctttgtaagaataagtttgcaagtttcacaaaagaattctactgtttaaacgtgtgagagtcagtgggttaagggatggaatgttccctctgaagtgtaaatcactgatcagaaagggctgacaccttattgaccattaccaattaaggagtcagaatcactccccagtacggcttcgggctgtgtagatttgggttgaattcgttggtcctcatgatttcagagactcaaggaatgtgacgtggtcacactcaggagaaaagctgaaaggacaggggtgagatccccatgtgaggacaaaaatgtcctatacctgttttgcattgattcttagaacagtcagcctgttgcagacaaggggctgcgtcaagggcagcaacggtctcaagcagaagcagagcctggtgactggcacttgaggagtttgttaggaggaaagaggttggttggagctaattgttatctactcaaaccagtcaatcctaaagcaaatcacccctgaatatttgctggaaggcctgatgccaaaactgatgctccaatactttgcgtacctgatgggaagagccgactcattggaaaagaccctgatgctgggaaagactgtaggaggcaggaggagaaggggacgagatggtt

SEQ ID NO: 36974 - DNA, 1293 bp, Bovine  19866881007279
cagcagcagcagcatacccagaattaactggacccagggcaaaggcatagggcaactaaactcacaaaagatttgcatggaaatagtgtcaacttattgatttgtaatgattaatttaagtgcaaagagtataagaaattgtgccaattgatcaattcagttttacctctgtaggaaagtctatatggaagccgaaatataacaaatcacttagaactaattcagtcagagaaaaggaaagtaatcagctagtttcaaatgctttgatgtctgatgcatgcatttcttctataggagctctctgatgactaagaactcgggtccggagaggctctgtctcttcagcttgactgtggatacctacgctcttcttttttaaaaaatgcatttgtttttaactgaaggatagttgctctacagtattgtgttggtttctgccatacatcaacgtgaatcagccataggcttacatatgtcccctccctctttcctgaggatactctagttattatctcaagatgtgcgcgatcctgcttaaccactcttcctttacatatacaggaattagtcactatgacttagagcagggatttcaaccctctttagcctctagccagagatatacggtgcaagactgtgtaagacaagtattcctgctcctcttcctttgcactgtcaaacccagtgcaagcctgaactggctctcacctgttgcctttctgcagcctaaaatttcattcaatttgaaggattcctctggctttattcttttcacttctttctactgtctttaatgctcatctctgtcttttctcttgtaaaattgtgttaacaagtcagcaggggtaagcttgctttagggaacttaaaaaggctctcccttctgccctccgctacattgcccccgtccatcactttgcattccgggcgcggcctcctccacagcctgagctcttcgtgtcgggcggcagagcttgcattggtctcccgagttcttggttccctcccaccaccaggctcttgccaaccatccaccgtatacaatatcgcagctccaagctgttcacagaaaatacactcaaaatagctgaggagcagctgcttctgtgatattttcaaaaggaagaaatttgtattttttcctgtaggctaagggtctgttggttttgcattgaaagaggcaaatgaagtccttcacacccgctgaaatcctctgcccctctctttaactccaaggtttttgtatggatagtgggcagggaaaggaagagattcggaaaaagcagcatcatt

SEQ ID NO: 36975 - DNA, 1500 bp, Bovine  19866881009105
ctccccacctctccttctctctctctgtccttccatacatgcacaaagagaattccaaggaggcaagccctcgttagactccaactctgctgagctgggacttccattttgccacgcagcctgtgctatttgatatggcagcccgagctctctcatacatgatcttggccttattctctaggaatccgtttaaataatcagctccagtttgtttgtgaagatataaaccaaagtacagcgtcacaagctacaacgtgagagtgatgaaaacatccaattttgatattttcttttatcacacacatatggctattttggagtttagcactttggtcttatttgggatgtggctgcatttggtttttagtcttggtttggagagtgatggcttgaatgaacagattctaattcttgatacagaacctgtaggtactgaatctgtagataaccatgtaaaactaattgtcactgtactgtataggagtgagtctctaaaagcgcatgctaacaaccatgaaaagggcatacttctttacatggcaaaaatagaatggagttattatagaatctgtaggaaacgctcattaagaactcaaatttcttctaaattagcctgtttcctggatgtctcagattcaagcatctcatcctgggaagacatattcagagaatgactgtgctttatgtttaacttgtaaacgagtatttcaaactgctaatggttaataaatttctccagctttcctctgaaagtgcctatctccaggacttaaatccacctgcttattttggattcgggttgggtttgctaggaggaggcagatggtggaagtcaaacagaagattttttagctggtagggcacagagaacagatttgccaaaatgccctctggtgcctggaatttaggaatggagaccacgggctagctgttgggtaattccgacgcttctcacagccactcctaaagagcacacgtttcagcctctgcagtcttcagccttcaaggcacagcccccatgcagtttaaagagaaaattcacttgcaccagcacatcataaagctatacctagattccaaggtgtaaacataaatgtaattattcatatgcattttttaaaggctgggaaatttcctttctccatgcaattccgctttacagctcctttccatgcctttcgtgagttcccttcctctagtgctgattgttctcttgtgcctctcaccatcgacctttgcagctcctcgtttcctgggacggcaatgaccatctggggttcccatctttctgtgcccgtgccagccaatgagctgaggggcgtgtggacttagaacattcacagcatcgagctggcacaacagagtgtttcaaggtaggaaagaaccaaaaaaaaacgctttagggctatcataaagcagccagcattggtactgatgagccatcaccatttggagcagggaaccctgtgctgcagcaaaggaaaacacaccgtttctgtc

SEQ ID NO: 36976 - DNA, 1166 bp, Bovine  19866881273416
agacagggaatattcaagttgaactttgtaattgtatctcttcttgcaggagatcatgggcttatctccttatgtagcattacatgtactattggcagagataaaacaccccaaacttataagcaaaaaataatttcatacaaccccataattttttgctttttatgctaaacgtacatcatcgttactgatagttatccctacttaaaacaagtcttattttggccttactctctgaggtaacaaattggtcagcaggccaaatctgactccagagagaccttacctttgttcatggtgtgtttagaagggaggtcacgagtgaccacattttctatcacctattctgtttctcaccactgtctattgtcttatccctgatctcatccacacattaacttactacctggggccctacaccacggggttttgtgacactttagttacccactgccagtgttagctgctcagtcactctgcctctttgcgactccatggactctgcccatgggattctccaggaaagagtactggagtgggttgccatttccttctccaggggatcttcctgacccagggatcgaacccgggtctcccacattgcaggcagattctttaccatttgagccactagggaagccccatggttgctaattaaggggcagctttcctctacaggccaaagggtcctgcactacatgaattcaatgaggccataatgattttggttttgaacatgcacaatgaacctagtcatgaccaaggtctccatcacatcactactcgaaaacagagatcatttactttttcccgggtcaggacagcagagcactgaaggggcacacccatgagtttgtgggggttccaggtcacggagtcggccctaggcaataaaacaagtcctgttagtgctcacgggctaaggagacaaacagaagcccgaagaggcccttccacttgcatgagcagtggcccagttctcacctttcaatgccactgagtttacaggaatgctttctggacaacagcaatccacctccccaagctgcctacagtcgacacaaaggatttgtgtgtttacattaacgatttctttttacatagcactgactgctctttcctatgttacatttatttcaaaagttgatgaggatttaattgctata

SEQ ID NO: 36977 - DNA, 682 bp, Bovine  19866881376470
cctgcatctgatggcaccagccccgaagttctgatatttgaaactgaacgatgactggcagatactttcatctccatcttatagagaggggaaaatcacctaagtggaactaggatttaatccaagtttgtttccttctaccatctctcaactatctattaaggttgaccgatcacagatatcaaacatttctatagggtttactaagtgccagatactttttcaagcattttaaatttgttgactgagtaattctcacaacaatccttataaaccagatattttaaaaaatattatctttattacacaagtaagggactaagaaacagaaaggctgacgaactttcccaaggccacatagatctgctccacagtttgagttcttagtggcttggctgcctccatctcaaaaacaaggtttccctttatcttacattttgaggtttcgttttgtaagttacttttgcaatttagtcttaaccctgtgtacagatgttggatataagctttattttttatagattcatcaatttggtcctattcaacttcttcttcctagaatgttctgaatatctgcttaatatgttgccagtgtaatggaaatggtactgtcatagaactatggaatatcaggattggaggaaggcctattaattatctagttcaaggacttgaattctct

SEQ ID NO: 36978 - DNA, 1478 bp, Bovine  19866880495002
actttattttcttaaaatcagtgacattttctcattcacactgaggtttattctggaagataataaaacataagatcatatcaaatcaacaaacagcttgatacaaaggtgtgcctttaacactgatttaccatatgtttatatttcacataggaaataggataagaggcccttatattttaatttttaattcttcactgagaaacacagtagacagtttatattatattgagaaataagtaaagattttaaaagtcagacattttatgttaccaccaaataggagttcacttacactcatatatttaaggacttataattttctttttaactttgcatgagacatttcaaattactttttactaatgtcttaatattcctgtatattggaacagtttattttttttcaattcccatttacaaattgcataatagcagagttggaattacatttgttcccaagaactatgtttatctattaaatttttatggttgtactacttactaggcaattatgagtttcttttgaattgtaataggaatattggggacaagtggaaatcgacacagttcttactcttaagttcatcctgtatctgcattttgtttttaatcttaatagtattatagtgctagaaaatggatataaataatgctcattaatctctctaatagtttctcatatgaagaagcttagcttttattcaacttttccttttattcaagtacctcaacaggaattctctttgactaacattatggtaatttggtaattgagaacatgaattttcaactctactaaaatgcctcccaacactctaataaatgctgtatcattcctgtctctagtctgaagcttcttaagcatgggggattttctcaatcattattccattagtcacaatgattagaaccatacacaaataattttcttattcaactggccaagttctttacaactcattgaaatttgtttaaaatatgagaaaatatgatttatatctaatcattaattggtcagtctttcaaagatgtttagaatttagaaagagcttaaaattggtgtttttttcctactttctttattaggaaagatactatataatttcagatatttgattttatagtttatgtgttcttaaatatatgaaaccagctttgaagtatggatacgaattttaaaatccaaagaaatatatttttaaaaatctaaatttttctctaattatgaaaataagatacgcttattgttaaaattctgaactgtacagaaaatattaaagaagccagaaataaagatcactcagaatgacaataccttgaggtaatgactgtgaacattttgacagtttcattccaaagataaattcttataatgtagaatacaacgctgtttaattgttgagagagtacttccaaacatgtatgtagaatcgctttaaaacaaaatcatagtttttgttagagaaaaagaccac

SEQ ID NO: 36979 - DNA, 1530 bp, Bovine  19866880550518
catcatggtttgatttcatttcttgttaatccttgagctaactactgggtaacaatagactttagggggaggaggagggtacacaaggaggttaagagcaatagtaaggagctctcttaggaagttctgttgaggaaatcatccactacagtggccaggctatcgtgcccatcagtattctatagatcaggcccttcaaggtcagcaggaagcctgttctgctggagctagggagtggtgaccggcaggaagcctggcagtcgtcctatttggaggtctggtgggccaccctgaacagcaatgtagcagtgcttccagcactaaacagccactgttcggttggcactggggagcaaagcagcggtagctgcggcgcacagaagcactggttggtacacacccccaccaacaggaaggtgggggtgaccgctgcaggaaagcatgactaggagggcgccctgggtggcctcagtaccagggtagcctcacatttgcatgcatcagcatggagcattttagagttatgggaacagacactgtggcaggatgagcttttgtaatattaaccagtgatttaggcatctaggctttgcagcatcaattgcctcagggaaggaatgttgcagcagaagctcagtaaaatttcaaatgttctctccccgaagagaactcagggtacggagagctgatgcatcaaaacaagtcttccagctccctgggccttcgggtttgggggaggatgaggtgaagaggcaaagacacagcaaaaagggcagtcactgtgagtgtctgggagaggctctgccctgctcaagcaagctaagatgcagcagtgaggagcaaaccctggagaagtctgggggaatacgacagcgggaggtacttgtgtctttttgcccaggtagactcaaggagaggaaagaaccctgagaggaaaggcctgcatggtttgtggagatatgtgcagcatactcaccagggcatttgcacttggatggacctgagattaacacctatttggttctcaataaataattattattagcagtttttaacagattttggggccctctcactgaggctagttcttgtgtagagatgaaggggaggaataggaatcaggcgtcgtatacttagtggtctgggtaccactctgtgaccactaggacataccacatgctggccacccttcctataggcaggaaggtaaatgcattagacagagctgtggggtgagaaaggtgggtggatgctcagatcaatgctaggtaaataatgaaaaaaacagtttattattgacatttttttcacagcaaaacctctctgtcgaaaaaacaaaaatatttttatcctcaaccactcttctgttgatgccttcactccatacatgcatacacataggatccatatactcttgcctttctcttcttccatttctagccaagctaatttaacagcaactaagattctgtcatagtagcatattaacaggtaacgacaggcctgtagttggactgctttccttcctct

SEQ ID NO: 36980 - DNA, 1492 bp, Bovine  19866880713066
cttttgttttgctgttttggaggaaaggggcagctccagggctttctcttgtgctgcattcctatcataatagctctcatttcacacacagggaggcaatgttgagatttttcagtggccagaaatgcttaattccaactctgcattcgggatctaagaagataaccacagagaaggcctgcagacctactgggcgctttgggagatgaaatcaagcttgtaaaattgtcaacacagaagtgacatctgtcatgcccacttggagcccaaatgcattcccatgcctaactacaagggggctgggacacacgcagaagaacagagatatttgttgagtagtaaattctctgtctcaactgtcgagcaccttttgttggaagacaagaaactgatttcagtattattcttctgtaggtaacttttttggttttgttttattttgttggatgttttatggtatttttttccttatctttgttgtttaaatgtttcccaaggtgaatgtaagtatagatttattttcattgattttgctgggaacataacctgctaccataagtctctgactatttcttaccggattgttttctgaaagtcactatctctggatagtggtgtcagtgttagtagtgaaaaagaagatggaaaaaaccaaagggcaaaggcgagaaagtatttactttgtacagatcaaagcagcagaacagaggaagaataatactttcttttggttggctcagacctagaatttctcagtccattgacacagtgggaaagttatctttctgcttttttaaagtagcaaggcaaaatctaagtgtgctatgacatcaagccagattggggtttttaaaattttgttctacctgccttataggaaggaaagattttcagagtttccatcttcacgttatttgtacttttcagcgctataaggagctgtcacgttttctttccccacattttcttcagttttgtggaaggctggaagagactgcacagacacatttcttttgatcatagagcacagcatcctgatttaatatattgttgatcacactgcatactcaacacagagggtacactggcacttacagaatatgagtattagagtggtcgaagtatcctgctctgtgttagtggaagtttcactaaatctaagaatgtactccatgtttgccggctctcctaagccttctgtaatatgcaggatgtcccaaagcctctttagaaataccagtttacaattgtactctctttcctgtctatatgtttcccagtccaatcttgaatcctacatgtcatggaaacttactggcacaacatccaaagaaaaaaattaaagaaatgaaaagaaaatgagttcttcaaactgcatgtttctatttaaagaagtttggaggatatacttccttactgagaaagaaaatgcatatccaacaaagcagtttctgacttgtgtattttctttttctgtcctccatatatccta

SEQ ID NO: 36981 - DNA, 2112 bp, Bovine  19866880783230
ctgactgcttctgtaaatttttcatttttcatgttactttccagagaataacttccctaattaagggtaatttatagcagaaacaacctgggtgctggactgttgcactgggtttcgacttagtggtggggagtcgtgcccttctctccaaattattttggctcttcctagaggatcagggtgccataggattttcttgtgctttattgccaggtcatgcttttggtacatagtgatactcctggaattcttgtttgaccttgttgatttcttcttgactacagccttatgttataatattgtctaaagttgattttattttctgcttctaagtattttgtatgctttactatttacatgggcctgtattttagagctggagaaggcaatgtcaccccactccagtactcttgcctggaaaatcccatggatggaggagcctggtaggctgcagtccatggagttgctaagagttggcacgactgagcgatttcactttctcttttcactttcatgcattggagaaggaaatggcaacccattccagtgttcttgcctggagaatcccagggacgggggagcctggtgggctgccgtctatggggtcgcacagagttggacacgactgaagcgacttagcagcaatattttagagctagaaagatgttcaatattatctccagtctaaagagtgattatggttctttcttctgatacttctttatagcagttttctttgtctcactgaatctagcccctttttctactgattcttactttactatttctgaattgtctcattatagttaattataatctcaggaaaaattcacatttaatattaactctaggggactataaatccagacttcattataaataaaattataaaccttatattgaaacatatttatatcatgcatcaccatgcatccatttaacattatatgctctacatacctggtattctagaatacaagacttttattctttaaaacatggtactcagttggttcagttcagatcagttcagttcagttgctcagtcgtgtccgactctttgagaccccatgaatcgcagcatgccagaccaccctgtccatcaccatctcccggagttcactcaaactcacgtccatcaagtcagtgatgccatccagccacctcatcctctgtcttccccttctcctcctgcccctaatccctcccagcatcagattcttttccaatgagtcaactcttcacatgaggtggccaaagtgctcagttggttactagttttcaagtccttttctcagatacttgacaatctaccttttgagggtgatttcagccttattcagttcagttcaatcgctcagtagtgtccaaatttttgcaaccccatgggctgcagcatgtcaggctttcctgtccatcaccaactcccagagcttattcaaactcatgtccatcgagtcggtgatgccacccatctcatcctctgtcatccccttctcctcctgcctacaatctttcccagcatcagggttttttcaaatgagtcagctcttcgcatcaagtggccaaagtattggagtttcagcttcagcatcagtccattctaatgaatatccaggactgatttccattaggattgtctggttagatctccttgcagtccaaggcactctaaagagtcttctccaacaccacagttcaaaagcatcaattctttggctttcagctctctttatagtccaactctcacactcatacatgactactggaaaaaacagctttgactagatggacctttgttggcaaagtaatgtctctactttttaatatgctgtctaggttggtcgtaactattcttccaaggagcaagcatactttaatttcatggctgcagtcatcatctgcagtgattttggagccccacaaaataaagtctgtcactgtttccactgtcttcccatctatttgctgtgaagtgatgggaccagatgccatgaacttagttttctgaatattgagttttaagccaactttttcactttcctctttcactttcaacaagaggctactttagttcttcactttctgccacaagggtggtgtcatctgcat

SEQ ID NO: 36982 - DNA, 1446 bp, Bovine  19866880790085
cccaatcccaagcaaactgggaggagttggttacccctacctggaaggtaaaatgaaaggaggctgaggctagacttggtaaagaagcaaagtcactcacaggagccaggattcaggatatttggttcctgttgtggtttggataatgttcatgtttttgcctggattcagacatgaacgcaaagtagcctgatctctgactggatccatcatggtggcagcgtggtctactggtggtgattttctgtgagattgttggtgttctacaggacaggaggccactgcctagcaacaccaaggccttcagaaggtatcagaacaatttctagctgtcaggagctgttttccttttctccagtacccttcttcagggatttgaggggtgcttttgtggttggccaaagacagacgacagttgtgagtgtccgttgtgagagccttggtttcagtcatattggttctgtgccctaaggaaatgctttggactttggacaatataaatattgtccatctctcttcgcacaactcttcttcaataaagtttttttaatgattgggaccaaatactgaattactgttacatttttaaacaatcgaatacttttctccttcttatattcaaaattcacattagcatattttagtgttcttaataatactaccataaagaaacccatatcatttaattgaagacacttttttcacaggacacattaggattttgatgaacactaatatttcactattaaactaatgtttcatagaaaaattagtttgtttagtgattgtctcctagttatgcctatcgtttttaaaaattagaaatatacataaagggtaaataattgttctgagttaaattgttctgattttaaatgaataaattttcttatttacagtcattgaaaggagatagttcatgtttttcagatttactgttttaatataaagtatttggattttttggggggaaaatatttacctagtagatgaaaatatgtatttgatttagtttaatagctaaggttataatactagttaaattatgaggcaatattttaattattaacattggttcaattattttgactatcttaagctcagtttggttgtcccatatattaattaaatcaactgttccgcaattagttttcataacaatggaggaacttaatgtggccttagctgtattataatccatattaatgaactttcctttaggttctgcggactacctggagatcattattccaccagacctaagaaaggaacattctgggcaaatcagtgagggaaaggaagttgaagaattatcagaagcttcaggaagcgccatatcacaggcagtggtgcttcctgctgagattccatgtgaggtcagtaaaaacacctcgttattgttgtaatggatactgcatttcactagaatgtggctaacacgagaag

SEQ ID NO: 36983 - DNA, 1550 bp, Bovine  19866880806474
ctgagtcagaactaatgggcaaggtccttaatttaacatgattgatcattcttttcctctagagtttgcatattttgtcttgtttaaatttcatttcttccaaaatcataaacatgttctttgcatgttgttcagaaacgtatttcctgtcccaaagttatcaagataatctactacatgtgcatttgtaactaggaattgattttgtgttgtgtgtgaaatagggttcaatttcgcttgttttctcacctgagtactgcagtcacttcagcaccatgtatctgttctctgctgatatacaatgctggcttgtttccacacagagtttttatacctataccaatgtcacactgtcttaattcctggagctcttcagtacgtcttggcattgggtaaggcaagtcttcttcctattacaggaagtttttagttatatttcgtcctttgtttatcatatgcatattataattagcttgtaaaattcttgaaaacccagattactactggatctatagataaatttggaaatgttggagggctttccaacattgcttcattatccaaaataatcatcatttttttgtctatgttttatttaatgcctcgtataaagttaattcatcatggtcttgcatctttttaaaaagaattattcttggttacttttaatgttgtcactattttgcaggtatttttttaatgacattttctgagtgtttgtagatattgtatagaaatgcaaatgaattgtgtattatataaaggatattttttctcaccaaccagattaaaatccacaattgaatctaacactttatctgaataatattttgagttttctagttagaaaattatgcacttgccaggtagcactagtggtaaagaacccgcctgccaatattgtatgggataatgattggatttttaaaaattcgtttacaatacacacatttcttcctttttatttttctccgttgttgccctcaaagggtcctctagtacaatgttgaacaacagtgagagtgggtttattctttattcattaatttaaatgaaacggttttaatcttttgccacttaactatgatgtatgcttagggttttgtttttgtatttctatcagattaaagaagtctccctacatggttaatgaattttgttaaatgctttttctgcatctattgagatgacgatatagtttttctctttctattcattaatgtggtgaagtacattaatagattttttcctaatgttaatccaaactttcattcctgggataaacgcaggttggtcatgacatagtgcataatgtgtgtgtgtgtgtgtgtgtgtgtgtgtacatgcacatgcttccagatacatggccaagtttattttatcttgtttgcactactggcttatacatttttttccttatactgtcctctagcatttttaatcacaaatttttaatgttagcctaaccaaataagtaggatgtttttcctctttcatattccaagaagaatttgtaaaaaatcaggattatttgttccttgagtgagtgg

SEQ ID NO: 36984 - DNA, 1070 bp, Bovine  19866880834195
ctcccttccttttggtatgtatgccttgtaatttttcttgataagtagacataatgtggggttcccggtggcactagtggtaaagaacccatctgctggtgcaggagacataagagacacgggttcgacccctgatttgagaagataccctgtaggagggcatggcagcccactccagtattcttgcctggagaatcccgtgggcagagggcaggctacagccatagagttgggaagagtcggatacaactgaagggacatagcacacagagcacaacgtaatatactctgtaaaaagaactgttgcagatagacctttggtaatgcagtggtgaagtgtggtgaggaggctttctagagacctgtgatttaggtctcagtcctttagtaagcctacgcctttcaactgtgaacctcacaagagtttattccctttaggtgagagaggattgttatagtgggctacagttagttatttcccttcctgtggtcagttcgtctctgaaaataccttaatagattaggctctgattaactaatttttcctgagggcaggccttgttaagaagactagagtgctctggagtatctaaggttgtttccatttccttagaaatactgttccccaatatttgctgtgggaatctggtcgagctcctagagctaaatctcaaaataatgtgtcccctccaagcttttagctgaaccctcctggagattttaactctcagacttgtcctctgttgagtgtccagcaatttgtcaattgcacttcaaaagccacgaccacgaggagcccgtgcaccacagctagagagtagcccccacttgcacaactggagaaaagccggcgctgcagtgaatacccagcacagccaaacaaacaaacaaaaaattaatcaaagaagagttgtcgaatttttagtctgttcagctttttgtttgttaggatggagtggtgatgtccaaaggtccttaaatatggaacctgaaacagaaagtcctatacttcttattttactaaaatgggaacctacaaaattgacaattttgtaacttgaattttttca

SEQ ID NO: 36985 - DNA, 3164 bp, Bovine  19866880876830
tgaggaaaaaaaaaaaaagctcaaaagcttagttagatttcatagtgctaattatatcaataactacaacaagggtggagggaggaaaaaatccaaaagaatctacagaacaagtcaaaacataagaataataaatgtttttcttgagtcactgctgtcagagtcctttccctcgctgggagtcacagtccagctcacctccctaggatcccctccaacactgtgtgtattcctggacctgctgtggaggcagctcagattttaatctggtcctactcctgtgtgttcttacttccaatgtccacagctatcagaactggtgtgttttcttttgtgggatctctcaatgcccccgtgtatattccacagacacagagtctgcctagttgatcatgtggatttaatctgcagcttgtagagctggtgggaaggtttggggtcttcttccttagccacactgcccttgggtttaaattgtggttttatttccacctctgtatgtgggtcatccactggggtttgctcccgaggctgccctggaggacttgggtttgcccctgtgagggccaggtgtggaggtggtgcagctgcttgggtcgcaggggttctgacagcaccaggtactcaggggtgttggcaactagggcagcaggaaatatggtgctctagaaggatatggcaaccagtactggccaatacgcttcagtattcttgcctggagaccccctcctgacagagaagcctggcaggccacagtctacaggattacaaagtgttggacacgaccgaagtgaccctgcacgtgtatacgcaaaaattttttgcctgtgacagctctgccccagtgagagttgagtgtgaaggtggtgcagctgcttggcttgcggggaccctggtggtgccaagtgtgcagggaaacgaactgcctccaccacaggagttttgaacctagcagggtcctttttccagccttttgtagctggtgattagaaggcctctttggccagtctttctccatagctccacccgtttgggcacttaaagggctcccttgcctggggtccttctttattgttcagtgcatgaggcacatagagggcaccctctggctggggtcctactctgtagttcagtgcgtcaggtgcatttgatgggccagcctctctattgttcagttgcccatctctggcatggagagagagaggctatagtaatgggtccacccctatgcatgactcagcagtatcgccttgcttccatggctattcaactttcctcgacaggcatttcccaccacaatctcttctcccacatctcctcgatccatctctccacagtcaacagcagccctcactctgggattgcttcacaatccctaaactccatatcccagccacttacgccttccaggggacctgcgtccctgtccgtgatatgtatggtcgtggcaaggactgtctgattctcattccatttaggctgccacagatcagctgtttcactctcagccttaaatgtttctcctctgactcagacaattgcccctttgtggggatcagatccctgcttcagttcccccacctgctgagggcagatccagtcctactaacactcctgtttttccccctagttccttggtcctactgagttttgtgtggttctatatattcttttccactggtcaggtactcctgtccactctcagctggtgttctgcatgcactactgtgtctgaaggtgtattcctgatgtatccgtggagagagatgtattccatgtccacctactcctccaacatcttgttctcctttggatattctgttcttataatggtacaataattatgctcatctacttgccactgaaaaaattttaaacattccagctcagccaaaattcatggagaatttattcattcttgcattctcacttcctagactttgtgttaagtggaaatttcatacacaaattttatacacaaatattagtcatttactatgagcaggctcataagtcttctctagctcataagttaaagatttcctacagtaagacaaaggaaaggatatccttctcaagtaaaagataacagtgtcaggttacgtgatgttaggtgatgttgagtgagtggtttagggttctacgagttcagtgagagatccttgtcaggctgcagaaagctgagaagagggaataaacagtctgtacactcttaactatatcagcttaaatcttcagcataattatctgagatgttacaaaaactgccttcaacaaggtgcaatactaagctttaccatgcagatttcagataaactgatgattcttgccaattactgtataataagtgggcatcatgcatgtaaccacatgacaatcatttaacaataaccaaatgataaactgaaatgataaacaaagctagtcattgcaaggagagtctgagtgtgggaagtcagtcagtaatgataggaaccacaaaaagttgtacctttaggaaataaataaccttacccatgaaatcattttaaataagaaatgagggttatggtacctctttgagtctctgaaagaccctcaggataacagataatcaagtgaagtgaaagtcattcagtcatgtctgactctgcaacccatggatacaaagtccatggaatcttcctaacccagggactgaacctaggtctcccacattgcaggtggattcttaaccagctgagccacaagggaagcccaagcatactgcagtgggtagcctatcccttctccagcagatcttccagacccaagaatcaaattggggtctcctgcatggcaggtggattctttaccaaccaagctatcagggaaaccctacacataaccaaagcaccttatcactccagtgaccaagaagccctcgatcagtaattcctagcagcaagtctacaactcaggtcaaaaaaggacaaagtacagtatacacaagaaaacccaacaccttgagaagttctcagaagatcctgcaaacaaaagaatttaaaccaacagaaaattatgaaataatctgaaaggcatttttaaaatataattgacccatgcaaaacatggttttgaactgtgtgggtccacttatattgaaacctttttcaaatgtacatactacagtactacataatcca

SEQ ID NO: 36986 - DNA, 965 bp, Bovine  19866880996379
gatatgacctcctcctctcactttagccctggactctaatggctacacagatcttatcagtatcttcagtccttcataatgtcaattttaagcatactactgtttctactattttctttttcaaatgttctcctagcccactttcgccttcactccactaaacctcacttcctcatatcctcactccccttctttcccatcttgagtttcatggttcattattataatcattcttctgcataagccatgactctttagtcctttgtttgttcataccctgaaaaagccctagtactggataaatccagtctcccatattaccctgtatctggtaattaccactctgatgactggtctcacttcaaatccttgactatcaaccacaaatgagtccttagaccttcctagtaatctaatcatatttccctttccaactcacttttctgtattccagatcacttttatgatgactttccagatgacttctactctcttcaaatttctaataccatttccattttcttcactcttaagtaatgactttgcctctccttttattaataaattagaagtcatcagaaaaagaacttccacaaacttttatcacaaagtcctcttacaccctgctttgcctacatatattacattgataatacagcatcaaaaccataataatcctcaagataagtctagacagaatgttgagggagtttaagaagaaaacagggcagtcaagtacaggaaaactcagcccctatagtagaaataaacaaggatgtatataccacattcattgacttaaatatttattgattagctctcatgttccagtcagtattcttaacaagtccttaggtatctaatcctcctgttcatgtgtctgttaacactaaccataagcagatttcctgtgtataatttagattgtgaggggctctatcggagacaagcttgcgcagcctaag

SEQ ID NO: 36987 - DNA, 1132 bp, Bovine  19866881027800
tatgaggctcattttaagttttaaaatcgctaactcctctggcaaaaatgagtttttcttttttaaagcctacagaatctctaattcccaatctgttcagagacttacctccctttacaaactaacaaaaatagatatgcaaccaacctctgaaactcagaagaaatagaaattgctgctttagagtttctttgcaactcaacatcttgaattatatatgaggaagcaagtcaccttttctatcctttgagaaacgcagagaaacaaggtggtctctggagttgatctgagtgagaaatcccacctttcctgactctaaaacaggaagggtgtccgtgacagacaagtgaaaagcctgaaggaaattgattggagaactgtgtgagcatcaggaatggggccggggtggaggtgggtggtggtggatggacaaaaacgaaagaaaaaaaaaaaaataggaatgggaaatgagtgaatgtaagttaaatccatgcttgctttctcctactcctaaagtgacataaaaacacaattttttgtttgttgttgagtccctcagtcgtgtccaattcttttcgaccccatggactatagcaatcaggctcttctgtccattggatttcctaggcaagaatgatgaagtgggttgccatttcctactccagagtatcttccttacccagggatcaaaactgcatctcctgccagtcctctgcattgcaggattctttaccactgaaccaccaaggaagcgtaaaaacatgtttcagttcagtcgcttcgtcatgatcaactctttgtgacctcatagagtgcagcgcaccaggcttgtccatcatcaattccccgagcctactcaaactcatgtacatcgaattggtgatgccttccaaccatctcatcctctgtcatcctcttctcctcctgctttcaatctttcccagcatcaggaaaaaatacatttagaccatgcttaaaaaaaaaaaaaaaacacttttacttataaccatcttacttataaaatgattccaacattctaatgaatgttagtagatttatctgtgacttcaaactttagactattcttgttttaatcattatattgtctagtgtttatttcttcagaagattg

SEQ ID NO: 36988 - DNA, 1670 bp, Bovine  19866881079309
tctctattcccctgccgttgtaacatcagaagccatgtttccagggctgttggtataagatggtatagcatccattacctgcatggcaacccactccagtgttcttgcctggagaatccccatacacaggtgagcctggcaggctacagtccatgggttgcagagagtcagatacgacagaagcacagcttccattagcctaggttctgagttattgtgtagagcagaccctcctcttcaaatcctgccagcctatgttgaacgagtgatatatctcacatgctgtattaggccataagacattggagtctgtctgctgctatagttgttactaattaccctagtacagctagtaaggaaaactgcatgcattttaagaaatcattattacattttcggctattttgttataggtagtcagaagctagttttgagattaatataagatttacttgacacaatctcaaatcacaatgccttatgacaaaaagcaatatttcaaaacagaaaagatagcaggaatagagattgtgagtagggacagagaattttgtagaacccattcgggaaggaaagttgctcctgtcaaggcacaaaaaaatacaaccattcaaaatattgaaagaagggagatttcagcaaaagattaaggtttcattccatagtatttcagggaagaatatatctcaggtggaggggaaggtaagtggcacctactgtttgaactcattttcaggaacagaggataaaggaaacttagccatgttactgccggaagtaggagagatgggtgttgtattttggggactataaaatgctgtatgtaattttcataaaccatggcagtatgaagaaagagcatattcagactctgtatgcaaaaatttcacagactagctttggaatatagtgtcattagtcaacaatgggtctcatggacataggttccccaagagttacctaccattcactaatcatgactgataaacgtgttgtcatttttttttttctggtaattaaacttcttagtatgattgaagtgagagggtttgttgcacatttcatttatgccctaaggccatgcataaacgaattacttgagggaattatgacaggttctatcaattgttacatatatatgaaattttcaacaatatttgatgataaattgaatgataaatgtgttgaatttaagaaagaacctttttctctcaactctccctcttttattttgattttgttgttcagttgctaagtcacgtttgactctttgtgacaccatagactgcagcacaacatgcttccttgtccctcaccatctcccggagtttgcttaaactcatgtccactgagtcaatgatgtcacccaaccatctcatcctccgtcttcccttctcctcctgccctcaatctttcccagcatctaaagtcttttccaatgaggcgtctcttcacatcaggtggccaaactattggagcttcagcctcagtccttccaactaaaatttggggttaatttcctttaggattgaccggtttgatttccttggtgcccaagggacactcaagagtcttctccagcaccacagtttgaaagcatcagttctttggtgctcagctttctttatggtccaactctcacatccgtacatgagtactagaaaaaacag

SEQ ID NO: 36989 - DNA, 1392 bp, Bovine  19866881134989
cttggaaacctgcctttcttcaagattcatgtcaatcctttcatggtccggtatgactcactttgtgccagtgttatttcaaaatgcatgttgtgggtgagggtcctagtgccagtctctgagttttgagacatttcctctctctaattagcagcctgctagtagatatatatcttcctgctaaagactagcaggggggcactctttctgtccccttctgatgtctaggtcagaagccttctctatctcttttatactttaataaaactttattacacaaaagctctgagcgatcaagcctcatcactggccccagattgaattcctcttgtctggaggccaagaatcctggagtctttcatggctcagcaacaacctttcaatgtgatctgctgtgaggagactggcactgcatctctgtagtctttcttgcctaaacccatatcctctgcctaatcctgagagaaacattggacaagtccctcctgagggacagtctacagaacacctgaccaggaatccataacactgagaagtcgtcaaaaacaagcaaacagaaactgccacggccaagaggagcccaaggagacatgacaactatgcacgatgtaataccctggatgagatcttggaacagaaaaaggacattaggtagaaacgaagggaatctgaaagtctcaatgaaggatatctttttgtggatggtaatatatccatattgatttactaattgggacaaatgtaccatacaatgtagaatgctaataacagggaagactggctggggagtatatggaaactctgtgccatcttcataactttttttttaaatctgaaggtactctaaaatataaaggttattttttaattaatacaatgacattacaaataatgtttttttctatttgcaaaagtgaagggaaaagtcccttccattgtaatgtttaatgtacaaaacattaatcattgtaattacattcatttatctagagaaataagtaaatgcctcataataatgtgcaggggaggaaaagttgaaagaatttatctcttaggggcaataatcgaaaaaataaattagagtgagttgacaagagataaatgagctctgtgtttaacagtttggtttatgggcccatctgatggtcaatagggaagctaggagctgaatttgttcctgctcacttaattgtgtcatttagagaatatctgagtagcaccagagaaacttgtctgaggagatcagtttcagtagttttagtgttattttttgaaagtttcttttatatttatgcaatttattttgtctttgttatgctgtcacaattcctacacagattaaaaatgcatttttattaaaatatgttaagtttgaagcttgctttatcctaa

SEQ ID NO: 36990 - DNA, 1292 bp, Bovine  19866881139826
tacattttctcattgagtcaaaggaaatgatatgttagaagaattttctaagagtcaattagtaggggtttgaaaattcctttgagaatgcaaagtattaggcagatgcaaattattagccttgcattcttaaactactctattgcaggcattttacagtatattttaatcacatctgattacagctttgataattttaaatgccctaatggcctttatgaaagacattttttctagcatttcattgtagatatttcacttcctattacttcattcatctctaaggacctcgaaagtagcaaaactctctaaaattttatgattatcagttggaaactgtggttttctattctattacttattaagaatatttctaagtggatctacttataagtaatggtatcttatatgttgtacattattctattaaaatgactttctgtatatatggctattttattgaataaaaaaggaaatgttcacgtgggagggatacctgcttgacctggatgtatatgtgagtttgcgtgagaaagaagtgagttcactacagagacacatacagtggccaagaggccaagctttggagtcaggctgtcatggagtccaattgggcaaataattaacatttctgaaactagattacctatttgtaacattcggataatagaacttatgaaattggttgttgtgaaaattaaataagataaagtatgttgagcatttatcacagtgcctgacacctgtcagctctaaataaaacttcttttcaaacttctggaacgtgatctgcctttcaagagggcatttgtcagaggtaggaggccaattcctgggacacagtgactggaagtcatagagggaatgtcactccctttagaacacttctccaatcctgactccttcaaggcctatattccactttggagctcctacgacttcatgaactccaccactatcaaagacagagtgacccaggtgcccagagcttgtacttagctacttttttaaaaattatttgattttcaatctgtgtatttgtatggtcaccatctactaatggcaagaggtaatgattttatatttatggtagtgatagaatctttttaaatgtatcatatttaagctaaaaaaatttagcaaaaagaaaacattttcttaaacaagattatgggtagtatagtcaaaaactggggaaggtcttcagttcagtttagtttagtcactcagtcaagtccgacccgttgtgagcccatgaaccacagcacgccaggcctccctgtccatcacca

SEQ ID NO: 36991 - DNA, 781 bp, Bovine  19866881158852
tttagatgtgtgcatggttgtttcatttctttatgttattttctaaattccagctttccaactcaatccttagcgtatactagcctacagagaatgctgggactcttgagttctctgaggaaggacaggctcaagatgctcaccacaggctactaatgcatcctcttgcatgatttattagaggtatttcccactatgatgataggtttgcctggtggcagagaacttcctgtgtgcatttatacaggctctgaggctatgtagggagagaaattttatggaatgactttgggtgatgcagctgcagaatcaattagactgaatagagcccttggttgccaattttagtaataccagaaaaatgaaaatgctgaagctggtagtcacccagatgtttcagccctgctgactggcacatcagtgttcattctttctgttctgtctttggttcttgggcatgcctcatgataaaaataagtcctgctcttactctcacatgaagtccaattactggagaggctcaaaatagtacagtaagaaccatatccattgttccattttcatggcgcagagtctcagccacccaacaagtgaatcatcaggagggtccatataaaaacaaaaaaataaggaagaaaaacaatttaaagaaatactggggaactaatagcagtattaactgtcaaaatgaaaaatttgaaataaaatttgaagcttatttttattagaaagcaaactttctactatcatctttatcaaatatatgtaaatcaaatatatt

SEQ ID NO: 36992 - DNA, 1600 bp, Bovine  19866881264651
catttattgaagagaggctgactttttcccccattatacattcttgtctcctttgttgtagattaaaggcccatgaaagtttatttctaagctctctgttcagttccactgatcgatgtatttgcttttgtgccagtgtcttactgttttgataattttagttttgtagtatagtttaaattaggtagcatgatatctccagctttgttctactttcttgagatttcttgttctactttctactattatgtttccatacaaattttaaaattatttgttctagtttgtgaaaaatgccattgattttttgataaggattgcattgactctatagtctgcctgtagtctctgtgtactgacaagacaagtgtatagagagggtgtctgtggccatagtaggtggggggtaggaaattaaaagattttggaatgttgcttatctttttattattttccattgcaaatactttccctgcttttttcactaaaacttatagggagatatagggatagaaatggagaagatgactgggttgaacattgggaatcattgaaaaatacggtctgtagatgacaatcagattttaaaaagaagcttgtatttgatataggtgttgcatgaattggggaaacacacatttggaagaaggaaaagaatacagtataataatgttttaagaagactaattgggcagccaatggcatttgttttagcactcatgacttcagtaaaattaaacagaatagatggtgttacctcaatgtaatttgtcttaaatacctttcggggggctctgttatatcaaattcaaggagaaaaatttaaagaaaataaaaagtcaatcttttactttcaacataaatcttttctcataaaatatcatgaattcattttatatcacattgtagtttaattttttggcaatactttcaggcaggtaactcaggttgtatacctagaaaagaggtaaggtgtacttcagatgattatggagtttacgtaatgcacaaagaaacttcttcaaataataattgtatatatgtgtgtgggaggggtgagaaagagagagagattggaggtatagagggagagaaggaaaacatgcatctctgtttcttctgaaaattcaaagattgttaatgatttaacagggaatagagtttcagacttgagaaaaccaaaataactcacccaatatatccttttgtatgcatttaataaatgtctgtataactgaattttagaatctttgtttatattttacaacgcattcaatgcaaagtagagagaagagtttgttaagtgagttagcaaatataattgaattaaaatttgtagttgatatcaaaagataattctccttcacaggtgttatttaacaactgtatttattggcacatcagaaactgaacccagatagctttctttataaatgtgatctggagatactgttataaaaaggaactttaaattctttaatcattagttgattttcagatattaaattgctgctctgagcttttgggctcttggcaatcaaaatactaagtgcaaacaatagcattctctgtgcccagaactacctagcaattattccat

SEQ ID NO: 36993 - DNA, 1052 bp, Bovine  19866881311286
cttttgcatatactaaacatataaatgagaacccaattagtagataggaccacacaaatgaacaggaaccacgagacagagtgagattaccctaagaaactaaggattttctacattatcctcttctccccaatactttacttaccttgttatcactaatgagtaaaatgtccctccgatcatcagtcaggtgactttctgaatatgttcactcactaagttgtgtctagctctttgcaaccccatggactgcagcactccaggcttccctgtccttcactgtcttctgaagtttgctcaaattcatgtccattgagttggtgatgctatcaaacttgttgaataccatataaatatttaccaaaataaatcgagtgtttgacagaccaagaatcaggtaccatgtagtagcacaagagttctaggagatctgggttttcaccaaaccaaagcatcatatcatttcatcataaccaaagcatcaccaaccctgaaatatatatgaataggaaaactaggtatgacatgtcttcagttatattcatggtcaatatcctataaaatgattaagataagtaagatggaaggacattaaaacagaatggacatggagatattcactgagtatgtccagaaggtcttaaacactgactgtgttaccagttggatagacaacagtcaggataattaaagtgagcaatggtaagatttttaaattttcttaaagttttattatatttgacaaagttcaatttgcctgcagtttactgggcaaacacaaatatgtgttataggtattacactggcttttttattttctgctgagattttcattatacattagcttctcagtcatttcaaaattcctcgaatttctttctgattctgtcatttcatttagcaactggatagaagcagctgaaagtatttcttggtcttaaattagagttggccatgacaaatgttcctgcaaaaatataggatgaatcccacacatttatcacggcatctgggccatgtttgtttctgtaggacagaggagagggtagaaa

SEQ ID NO: 36994 - DNA, 1877 bp, Bovine  19866880466129
ataatgcaggaaatgactgaggtaattcagtaggaaataggaatatgtttttagtgttagcataaaagaatgccttgctgatgaggtatgaggcatcctgttctggaatttaataatggtgactgacctgttaagacctttttttttttctgctgctctagaaaaagcaatggaagtaatctatcttctaccagatatttggttcattacattgtctttccctaaaatttctcctctattatcagttctttacaacattcctgtcttttgcatttaagaaccccaaattgagaatttaatatcttaagaacttttatagggctatccatcattagtttgttcttccagagcctattttagtcatctcttaggcagagctttgtacattccctgcttactatcacttgtcctaaaactgctgttctttccagttttaaaattgacttattaggaacttaggcatttttcggtttttcccctgtgtattattatagtcataaataccaacaaggccacatcaagggtatccagactcaaggcaaagaaagctgatcctatcaccctgttcttctcccagtacttttgctattttgtagtatctcttttaattctgtattcaaactggacttaattatgctttattttttcaaaaaaaaacgtgtaatctgttatgttatttaagatttacgcttttatcatctgtgtttcttctttttacacctttttctaaagcttttcttccatgtcagtctatccacagttaaataaatgctgtacctcatataaaatggcatagtatttgcttataacctacacatatcctcccgtatgctttaaattatctctaaattacatataatacctcagttcagttcagttgctcagtcatgtccgactcttcgtgactccatgaaccgcagcacgccaggcctcccttgtccatcaccaactcccggagtctacccaaactcatgtccatcgagtcggtgatgccatccaaccatctcattctctgttgtccccttctcctcttgccctcaatctttcccagcatcagggtcttttcaaatgagtcagctcttcgcatcaggtggccaaagtattggagtttcagcttcaacatcagtccttccaacgaacacctaggactgatctcctttaggatggactggttggatctccttgcagtccaagggactctaaagagtcttctccaatccacagttcaaaagcatcaattcttcagtgctcagccttcttcacagtccaactctcccatccatacatgaccacaggaaaaaccatagccttgactagacggacctttgttggcaaagtaatgtctctgcttttgaatatgctatctaggttggtcataactttccttccaaggagtaagcgtcccttaatttcatggctgcagtcaccatctgcagtgattttttagctctagccattctctaatagatgtgtagtgaatctcactgttgttttaatttgcattttcactggtagctaatgatgttggccatctttccatttccttatttgacatctaatttttttttttttggtgaagtgtctgttttgttcactttttaattgtgttgtttccttattgttgggtttacagagctctttgtatattctggattcaagtcctttatcagatagatatatactttgcaagatttttcttccagtctgttattatattcttagtatatatatataagatctctgcttattcttgtcgcttttataacatgctgttctttttaatcgatgtactgtttcatccttgtgaagatataaattatccttaaacttcttttcctttatcttctgcactgtttatccttggcctctcttcctct

SEQ ID NO: 36995 - DNA, 3702 bp, Bovine  19866880527674
ttatagatcatctggcatatattactcagtcattaataataagaaatctctttggaggaagaaacctgtccagttgctgaatgattatctgtgcactttctgtggaaatagtaatgacactcttggttcatttgggaaaagttgtgaatcagaatgtagtgcctttatttcgtactagacactaccactgtatgaagtgccagattcattaaggaaaatatggtagtgtttggaagttgtaagcaatgataatgtatatatatgacaagttaatatataggggaaatggtcttgtttaatacagggatggtgcctgtgatgggaggttaatttgccttgtggtcagtattgattagtggcagcattacttcatgtaccatcatcattttgttttccaccaaagaaatgaaatccacttgccagatacctgactgcaagctagtcttttgggcagaaatctgccagagggaggtttaccccaaaaggctaaagagttgttttgttactgtacccctactagtgttctcacagtttgtacctgctcatcaaatgtagcctacagaaaatattttgctagtgtattctgtgaattgcaggtgactctaaaaataaagctagtcctacttagtggcaagaactgtgtcaacttttcccaaatattttctggtgtttcactcatattgtcctctttatagatttgatgaaaacctcaaaattcaaaattataactcaactttagttgcagttaaaatggggaaatggcgctgttatttctttgtgtgttagctttcccctgctgtagatacagttagtttactgatgactctgtaagatttggtagtcataattaaaacccaaatacacgatggttgtcatatggagaattcatttaaggttgcatgaggaaaatcattcaatctgtatatttttttaaaacaataaactgaaacttttttcatctaaaaagattttaaatattaatttgtagtacagcctgaatgtatgtcacaccaaaaatattttatatttgtagtatatacgctttttgactttcttttactgctgaacagatgttttgaacctcgaagttcttgaaaagttactcaaccacttcagatatctttcaatctcaaggcctttttgaaccacagtatacagtgttttaatcttcgaacctcaaattaatatgcctactatttacagtatttccctattgctagcacttttgttctaatttagtgtgtttatattgaaaatattggacctatgtattagagtgtttaggactatggagaagaaagaagttacaactctagccccacagtttggaaactaaatataaaacatatgtcaaagtatatcaaaccaatatagaattatactgacaaatatgatatacaaagtgttgctaaacttcacagaatcataaaattgtagaactggatgggatcttggcctccaatccagtagatctcagaccttcttacacattgaaattacaaagggagctttgtaagactttacagaccaatatcccaccctgggcaattacgattcagcatattgtatatatatgtgtatatgtatatatgcgtataaagtgtgtgtgtgtgtgcttctcaaatgattctgcgttaatatttgagtgggatctggaaggtatgttttctcatagtgaaatacagtaagaaaagaattgagaaagtaatccaggagtagtggacatgccaaactcatctgatttccgaaaagaaaggagttaggggaaagaggagtgtggataagttaggaatataattacttaaaaatatctctttaaagggattcaagttcacttttcttttttcagaaaaggaaatctgcctttattcagataattacaggtttttgtgtctaagttgagaattagagatgagtagagcagatttttttttttttaagtggtagaaatttgtttcctaagtttattagttctgtgtgtgtttccagacttcaggtgcctagcagcaagtcatctggtgaccttgtcgatctgtttgacggtaccagccaatcaacaggtaagcttcgacattggcttttggttggtttcagagtaattttttttaatggcaaataagagatggaatgaaaatttctaaaaaatttttcttacagtagatttatttttaaagtgaaattaatgagccttaagcattatttaggaggaaatatttaattgcctaaaataaggaaaacgagtacttaagtatttggtaattcagtaatctctcaatttccttagaactgagtatttggggtccctttactttctctataagtgaaatatactgctcttctcatttcactgtcttttcatattctgaaattagccatgcctagagttcatttcggagaaggcaatggcacccccactccagtactcttgcctggaaaatcccatggacggaggagcctcgtaggctgcagtccatggggtcgccaagagttggacatgactgaatgacttcactttcacttttcacttttatgcattggagaaggaaatggcaacccactccagtgttcttgcctggagaatcccagggacaggggagcctggtgggctgccgtctatggggtcatacagagtcggacacgactgaagtgacttagcagcagcagcagcagcagagttcatttacacttttcattcatttattcagtaaacatttattgaaccagacactggcctgggtgcttgaggtattgatataatgcttagtaaagggtcacaaatagttacacatatacagaggaaaagggcattctgtgaaagtgtgtgactatctaccttacatattttaagagggctatatcaaaagaataatagtccattcaccatgattttctcacagagaagttcaatgatttcttcaatttgatttctaatatgtggtagatttttttttaattaatcccctataagttgttttcaagaaaattggtatttttagggttgcatttgaggactgtggggtcataataaactactacaagtcaaagtagcttaataaatctttgtttaaagtccatttcacattaaaatataactggcaagataggcatagaaatgtcaaagtaaatctattgtttgtagttgtgtgtaatgatttttcaaaacttaattattttaaaatttacattagagtttaagtggatgtttatgatgaaaattatttctcactgatagtttagtacatgtgattaatttaataatttacagtgggattattttctcccgctccttacctattaccataaaattaattcttagattgggtgttaacttactagggtgtctggttcaaaccaatgtctgagattcttcaatttccagtctctctttttctgtaactataactgttcctaaaattattctttaaactctattgaactgtcatgcccaaagttacaaacaaccacattagttgtttaacaatttatgtgctgtctttttgtatgctgaagattttaactgtagtattaactggtagttagcatgtaatcatatagtagagacttagtgttacagaatatcaactattttggacttcctggtatgaaatatttaagagcccctttcatgcatctgtgtaaagttttaatggagcaatcagagaagaattaactaggaaggtcagatgaggaatccagcttttc

SEQ ID NO: 36996 - DNA, 1345 bp, Bovine  19866880604500
tgggattttccaggcaagagtactgtagtgggttgccattgccttctccattcataagtcccaaaagtagaagagggagataaagggtctaagaagatatttgaagccataatagctaaaaacatctgtaacttgggaaaggaaatagtcacccaagtccaggaagcgaagagtcccacatagaattaacccaaaatggaacacaccacgacacattgtaatcaaaatgacaaaaattagatattaaaagtagcaagggagaagcagtaaatagcatacaaaggaactcccataaggctatcagctgatttttcaacagaaattcagtccagccggaggggtataatgtttaaagtgatgaaagatgaaaagctgagaaccaagaatgctttacccagcaatgttgtctttcagaattgatggagaaatcaaaagatttacagataagcaaaagctaaaagagttcagcaccaccaaaccagctttacaacaaatgttaaagaaacttctctaggcaaaaaagaaaatgccacaactagaaataagaaaattacaaaatgaaaaagctcactggtacaggtgaacatacagtaaagacaggaaatcatccatacacaaagctaagtagggaggttatgagacgaaagcagtaaaattatctatatccacaataagcagctaagggatatataaaacaattgatgtaaaatatgacatcaaaaagagtaaatgtgaaaggaggagagtacaaatggagggtttttcaatgcatttgaaattaagagatcaacaacacaatcatatatatatatacacatatacatatatatatgtaaatatatacatatatatatggcacagtctctctccctatgtatacagactgctataaagggcatttagaaatacttggcaatttgaaaatcctagtttgcttgctagtaattgaactatcttatttttgacagaaaaaataggagctttaatgaaagcgtaagtgaggcatgcttcacaaagacccatttttcaagtcgtcttttataggaaagtgataaagttagataaaagaaatattaaagtaactttaattaatttagtaggcttatcagtgttgtcctttggacctaattgaacaaaggaaaggatactttgaaatttttcagttgttaggaacgtttcacttacttttaacttctcccacatggaaaagtatgtatatattatctccacatgtaaaatatctgcctatatatatttactattatataataaagattggctcttaaatgctgtctcttctccaaatttttagatatcccaagagctctcaaatttgaatgataaa

SEQ ID NO: 36997 - DNA, 1299 bp, Bovine  19866880874851
atatgtaacattctgttagtttcaggtagacaacataatgatttgatctttacaaatactgtgaatcgatcacagcaatctagggtattttaaaatttcttatttaactaacacagaatgaggaagttttattttcctcacattcaaggatatgtcaaaatgaagttcagttagttttcataaaaattctcttaagatacctaaatttcaaagaaatgaattttggcaaaatagtctgcccaattccaatgtccctgaatttcattcaagaaaatcattaatattttcttttgctaagatgagatttacacttatttcacactcctacccacctacccccacccacttcctccctccaaagaaaacgaaacaagagtcacttatgagtgaggagaattttatttaggtgtacctgagtagtttgcaatgaaattaattcattgggcacatttaggatactgctgctgccgctgctgctaagttgcttcagtcgtgtccgactctgcgcaaccccagagacggcaggccaccaggctcccccgtccctgggattctccaggcaagaacactggagtgggttgccatttccttctccaatgtatgaaagtgaaaagtgaaagtgaactagcctaataaaatacctttgtgaataaattctttgataagtgggaattacaaatactacaagtagaaaaatggccgaaagaagcagatagggaacagggtgggggaagagctgttttggtaaccttttcactgcctctagatatctggccagtcaaatcatatcataccttgggaagggaagttgcctgatgcagcagctgagccaaagtcagcaaatcctccaaataaatcagctgagccgcctagaaattaaatatgagggaaaaattgttaggaccacagcacaattgatagcagttttattaggaagctattttagcacagtactcaaaaattactcaatatattagaccccaagacctatcataaaagctagttagctgatctagctttttatgccaccatgttccctttaagctatcaccaactctctaacaccctcagttctgtatctactgattgatacaactgttattaaagttatcccttacttaaacacttcacaaacctaatggaggcataccgtttatctggccaatcacgccctatataagaatcttaaatggatgctaaaacctgggaaacatgtttcagggtaataggataatcacatattctcaaatcatgaccctacagattatttaaaaataaaaagggatgaagctattttta

SEQ ID NO: 36998 - DNA, 1318 bp, Bovine  19866880884063
tttcactttctcacttttgatttttttcttaatattgttgtttaaactcttaaactatcagaagcaaaatttcaagttgagaggtaaaatgatcacacaagccattacaaaattataatctacaataaaaccaactcaccaactggatgagtgatggcgttctgtaggctgggaattaccacagagtaggtaggtgagcgataaggataaattgttggatttgtagagatgatattctgtgtggtaccagaaaatacactagaaacgcttagagggaagcgttttcgcttccctggacgaggttgataaacccaacctagagaagaagattaaccatttttaatttgaacctacaaatcctatttagcctttaaatagttcttttcacattaaaagtccaaaacacttctaagtcttagttatctaaagtatcttttccacttttatgataactatttttgtgcatttcagcatatctatccatatggctcctagctagtggccaatgttgtaactaataattcaaaggaagaccaagagtaaatgtcttttctccaaagacacataatgaatttacagtaaaatcaacattaaaggcactgagtctgaattccaaagtttttcctctacccattataaaaaaaaaaaaaaagccccagtaagacgctatttgtctcctcccattttttttactttctgtaagatacaattatctatgtctttcaatgaagcggttattaatgaccagtcactatttttatgccttctttgggaaaagtcaccttcttagacttggcagtctccaaatctacaaaccacccagtttccttctaaactcagaaaaacagagttatggcagtttttgccactgtacaaccaaaagtatcactggttccctgtaaccactactctgaccattcccagtctgaatctctctgctattactttaggaaaaaaattcttttccctccacgcacaatgtgttggtcataccaatacatattaagcttttaccaagcttagtaacaatgtcctcactgctggggagaaagtcagaatttatttcaaactatgtcatgatgaggataaatttatcaggcaggaggcaggactacattctgataaccatataatattaaaatggagcttggtgctaatgcctgcagtgtgcactgcatattttttctgttgctatgagctgaacacttcattttctaatatatttgaaatatcatagcatagaactctggagcttcaccatcattaaatttatatttttatattaaatcaaaaccactgtaaaactgtatatccccag

SEQ ID NO: 36999 - DNA, 1569 bp, Bovine  19866881106316
accccagactctggggagtcaaataattgtactcagatgtttttgtttaattttacctctctgccttagtttttcataggtaaaatgtggacaataatagttcctaccttacaggtttatagtgagaattttaagtggcatgatgcatgtaaaacacacatagactagtacaaagcacactgtaagtaactaataaatacttttgttattagatgctattttattattagatgctacttgcaggtaaactgtgaaatgagatgtgttgtaataactcctaatacaatgcctggtacattataatgactcagtaaacagttgtcattattaacaacagtgataaagatgggtagcaataataggaagactggtagatgtagccagagtttggaagcgctgaatttagattttgattcttaagtgtaagagcaccgttggccttggaaactttatataatctttctaagcttctgagcgctcatctctaaaatggagatggttatgagcgtcaaataaaacatacaaactatccagtacagaatcaatgctcttaactattagtgcctctcactccatcacagtagtgattggggaagccagttacttgctacagaagagaactttatggacttttgtatttaaataagatttgaactgctcttaaaattcattaatacctgtatgatgtttgatgaaatgcttccacttcttgatttgttgctagcagtttagatagagagtggaatggataggtggagctaggggagagaaaagacctacagagccttttatatttgtttttatttcttcagggaactcttgcagcagacaagaatgagattttattttctgaattcaacatcaactacaataatgagccactgatgtataggaaggggactgtgttgatatggcagaaggtaatgctgttatgtctaagggaaaacgaaggtcagaaagaaagcctgtgcccaacccatgctttgtcttgcctgctgcctgcgtgctgatgtgactccagtcattggcacagattagaccctttccaaaacgagatgctatagattattattatggatgcttgcttcgtcagttcatcagtcaagtttgtgatctggactccccccttctataagcagaattttagaatttatttttttgtgtcataagctctccccaaatcaaatcaaacccctttaacaggtttagtgccgttaagagaatttttgcattcaaagaacatttaaaaaaatgccacactggaccattaaatggcccacccatcccatgagaactataatttgaggaactgatgttgtatgtgaaggttctgtcccttacagaatgtttgagagattctctagacagtcatagttaacttaatattctgtctcctttcatctaaatccttaattctaccaatattttctctctgatccagctcctgggcataatgatgtctctaaatttatttccttccgtctaaagtatttttttctgaaatgcatgtttttaagtattaagggagtaagtatcctaagagctcaggatctcacggcaacttcagct

SEQ ID NO: 37000 - DNA, 737 bp, Bovine  19866881575199
tagagtattcgatttaaaagagtgaaaattcgtgtgtgttgtttgttttagttactaaagagcacgctagggactttatatcttggagtatttgtgagagaagaatggatttttagacaaagttgcatgggacctctttggcatgttatcagaatttcagacttttcattcatcattatatttagaaattcttgaacactgatcatatatgaagcttccatttcattgtgtgctagtcaggtttctgttctcaacttgtaaagaagttatcttgctctggaatcaaattgaacatgagaaaggtaagaaatttcagttttagatacaggactaatgatgggaatcttcaggttatttgttgctaagaaggtagtgacaagggcttttgaatacttaatcagaactagtagattccttaaaatgcttgtagataaaaatacatttaacccctttactcagtgtgggaagtcattcttcttgattcttgatttatacaggctccaaattgatttatatttaagtagaaattgctttagtcttagttaatttgcatcagtaataatactcataattttaaggagaattttaagtattttatttcagaatatttataatttaaaccacctactctaaaattaagaaataaaggtaatggaacatatttcaggtaatttctctgtctgacttgcaccagaaaaaaacccctcaatacatcattactggagaatacattattg

SEQ ID NO: 37001 - DNA, 1507 bp, Bovine  19866880142656
tccctcccgcatcagagtcttttccatgagtaactcttcgcatgaggtggccaaagtactggagtttcagctttagcatcattccttccaaagaaatcccagggctgatctccttcagaatggactggttggatctccttgcagtccaagggactctcaagagtcttctccaacaccacagttcaaaagcatcaattcttcggtgctcagccttcttcacagtccaaccctcacatccatacatgaccacaggaaaaaccatagccttgactagacgaacctttgttgccaaagtaatgtctctgcttttgaatatgctatctaggttggtcataacttttcttccaaggagtaagcgtcttttaatttcatggctgcagtcaccatcttcagtgattttggagcccagaaaaataaagtctgacactgtttccactgtttccccatctatttcccatgaagtgatgggactggatgccatgatcttcgttttctgaatgttgagctttaagccattagaaggtagtaaatagagaaggtcatgattttgtatccattttaaaaggatcgctctggctgctcccttgagcaggaaatgtaggattatagcaggaaaaccaattaggagactacacagtagttcagattagagaagatggtagtttagaccaggatgggagcagtggaaatagagaacatttggattttgacacatttcaaaagtggaactaactgcatttcctggcatattcaacatgggatgtaaaaaaagtaaaagtcaaggtttttggcctgagaattaacaagatgagaaagacagtgaaagctatgaatttggggaaagacaatgagaaattcactattggagatactgagtttgagatggctatttgacatccaagtggcaatattaaaataggaagttggatatatgagtctggagctaatgggaatggtacagactggtaggttaaataagatgaagaataaaaactgagctgaatttaacaatgtggagatctttggtgaattttacaagagcattttttgtgaaacagtggaagcaaaagcctgactgggaggagagaaattgaaaatagagtttaaacaactttttcatgcagttttgctacagagatgtaagagggaattggagcaataaccagaagggagggtagaatgaagagaggatatttaagaggggggaaatagctgattgagtgtttgaatactgatggaagtaatccagtagagaggaaagaactctgataatatgggagagagaaggaagaacttgttagaactatgctgtaggataaatgaaaggggaatggcccttgtctttaagagaaagtattggctttagataagagtatggctaattcatccgtgataatagataggatagagtatgcaggtgcagatgctgctaggaatctaagtgtgatggtggaagttctcgtctgattgctgcaatttgacaagaaagtaggaagcaaggccatca

SEQ ID NO: 37002 - DNA, 1032 bp, Bovine  19866880352068
aactgggcgataatgttaccttcacagttttatgaaattggcaaagagatgaaacagacacaaacaagtgtggccgaaacactgtagcagaaacaccagaggcatgattactgtctgggatgggagaaggaggtagtggttaggctccagctgccaagctggcctgagttatgactatatctaaggttgtagagatacatgatacagagatatgtagcaagagaaatacaatggcacttaactctacttctgaagttcatcctatacagcaggatttttcagtgcactaaaagcaaagacttctaaaagtaattccaaaataaacctcctaaacctgatgaagacccactatactaaattctatttaatttctaagaaaaagtacattgctgttattcaaaatttgatgttaatacggcatgtattctgatttaacagtattatcttttgaaaattaaacatacctttagagaccgaactgaatcgtcagccagaccaatcacgttaacataaagtaaattgctatgcttcaggaagagaacacaatgatccttaaacatgtccaagtctacaactttggtatttctcttcatcgtgaaaaacaaatcccaattcataatagcaggggtatcagctgctgttctcattagctgtgtggaacaaaattagaagagatctaggtatgagaaatgatgactacagcatccagagatgaaaccactgaaaaccagcccttattagtctgcactgtttatgaagagctgaaggaacttaactctgcatcagggttaagtgtgaacatcaccttatgaatgagccctggctagcctgctgggtgggtatgatgcagtgcttagctgatggtcaagcaccaagagccagtggggcctcagtgagacctcggctccttgactgttggggccatcactgagcctagctgagaccagcagaggaactgcctgagatcagtccaaactgatctcaaaatcttgtttataaaagtttgaaaagtttgttaagccactaagttgg

SEQ ID NO: 37003 - DNA, 1902 bp, Bovine  19866880360345
atgattataagaaacaaattatttcttaacaccagggtcctgtcaccttatacatcatttaacagtatgatttggacaatgtctcaacagattttgcaagacgaaaaaaaatgagctttaaaaaccaatctatgagtgtaaaattgataaccccaaacaagaaaattaacccttcacttaataaaatctcagacatgacaagaaccttaaagaaaatcttgtacaaccccaagttcatataaagaacttgagggcctggagaaattactcttttatttataattagttctaattacaaattttatttataattagttctaattataaataaatataaataattataattatttataattagttctaattatagaactaatacctcttgatccaggtaacactgtcactgcatttttttctgatgagtctattaatgagaatttactagaactattcctatgatcccactattttatgtgtcatttgtcaagattgtcttttagaaatgacagtttaccctagtaatttattacattataccaatgactttgattatagactattctctatcttgcaactaaaacttaccatctgtctttatatttcttagtattttcagtatgaattacttttataataaggaaatgtagatgcaatatttaaaggcatccagtgtgtcaatatgaattagtataatgctcttgggatagtctttgatttatggagtcataaaaatactcttaatcattaaaatagtatttctattactaagaatttatcctaaggaaataattataaaaattatggagaaggaaactatcttcttgatatgttcccttttatatttattacaatgaaatagctaagtttttaagaattatgataattcaacttaataataggatattaggaagccattaaaaataatgatcataaactgtataactaatgtggggaaagatgataatatgtgtagtaagaaatgcagaacccaaaattgcatctctattttaattataactatttaaagacatgtataaaatacaaataagccctggaaggaaaaacagaaaaattaaactttaaaaaatgtgttagtttagtgagattgtggaggggtttttattcctgttacttggtttgttataaaaactgggagagtaggaaaaaaggatatccaacatgcattcaaaggaaaaacaaagaaaactctgtctcttttcttccctacaattacatatcttctccaggaagtttatttcctcttctcagcaaaaacccctgtaatctattaatgtaattgagtgttaaatgatatctgtagtttaccttgaaatgcatttttttttaaagatggattgcaagctacataaatatgtgataaaggaaatacagcaaaatgttagcaggtatagaatcttggtggtgggttttaaaaaatattcataataaaatgttagagaaaaattattttgaatgcctttgcggagaaaatcagaaaacataatagccagtttttacaagcagtatttcactaaggagtttttcttttctgtgtgcattagaaattaatatatatactcaataccagtgagaaattgtcattagcaatgatagcttacatttgaaatttattggatttttcctctctctctctccctctcttttttctgcatagtttttttgtcttcctttatcttacaaaagacagtcgttttctcaccatgaatatcatgagcaagaccacttctgaggtgtggttgatagatggcctgagcccttgggacccaccagtacttatccagaagcgaatccatggggtcctttactatgtggaacatagagatgatgagttatacattctcactaacgttggcgagcctacagaattcaaggtaaatc

SEQ ID NO: 37004 - DNA, 1840 bp, Bovine  19866880386846
aaaccttctgaggcagtggtggctctagatgactttttataaagaaagggtttatatagcagcaatttggttagaagtggatgaataaagtacttgttggaaagctgtattcacctagctggcccacattttttcattcagattatatatttttcgggggtggtctaggggagaaagctgatggaaattgtggagggggaagatatgaaacaattctaatcccatctgatgatatcactgcttgcaaaggtagtctcagtttgattactgcttttcacagatatgaaagctgagacctgggaaggataaggaacaccccaggctttgtaagtgcagcagtagacacaggtagaatgacccacagccctgctttcaactcctacaaataccgtctcaagtaggttgatttcaaactctcacaagtgagactgaaagcaatccacttttaacaaaggggctgaacacaaccaaagcagggccataaacaaagtgcaactctgaaccgtctcttaaaacccggggacatctaaaatgactccaggcttgttgtgtctggtcttcataaatattgctacattttttaacacaatttttaaaggttactttccatttacaattattacaaaatattggctatattccctgggttgtacaatatgtccttgagcctgtcttaaacccaagagtttttacctcccactctcctactcctctattaccctcccaactggtaaccaccagtttgttctctgtatctgtgagttttcttctcttttgttttattcactagtctgctgtattcctcaggattccacatatgagtgacatcatgatacttgtctttctctgtctgacttactgtacttagcataatgccctccaaatccacccatgttgctgcaaatggtctttataaacattttaaactttttatagtttcaaaactttgtctctttcttgaaccgactggtcctatttctgtagttaagtatccttcagagcaaatccaatctctctttcagtggctacccttcaaatattaaagatgccattatgttctccttgagataggatttataaaagctaaatagcttaacttattcatcatgtgagattttaaaattttgcacttttgtgaaaattaaccaaagaatcatgaatttattcacaaaaattaaaatgatacagaaatgtgagaagacaatatgaaagtctcctcatcaccaaactccagtctcctgttcctactctccaagaataacagatgctgataattgagtgggctttccagagcttttttctatcaaatctaactagaaacagaaaatatggatgcattatatatttgcgtgtgtatgggtatgtatatatgtgtgcagttgtgtgtatacacatttctttttgtatacatgggatcatacgcatacaatgctctaaaactagcttttttcactgaataatatgtcatggacacccttccctgtcaatacatatacacaagatgtgcctcactcttgttaacaggtgcgtagtatgaatgtgcttccgcttaactgtttcttcatttgggttgtttgtctccactttttcttaatacaaacaacggggtagggaacattcttatataggcggtccttgcttttctctcagcttgagatggatttaccatgagaagcaggaagctcaagctccatggctttccatatgcatgagcctcttctgaggccttgggaggaggcttgaagtttaagcttgcactagctgtcaaaaactgagaaggcatttgcccatttttagtgttggggcacctctaacatgctccatgatttcttaaagattt

SEQ ID NO: 37005 - DNA, 1358 bp, Bovine  19866880395230
ggccttataccccgaggctgccagatttgcatatttctctgttgctctcttggccccccacttaattggtgaatttctaagccttgtgctacttggcgtgatccaaaacccaaatgtggtcaacagcgtggtggccctgctctccattgctggggtgcttatgggctctggcttcgtgaggtaagatctaacaataccaaccgatttagactggtgtggttttgatgttaatgatcacctaatgatgatgattgtaaggcattccagaggagcgtggtgatcctctatcgcctcacagtccagagtgtttatagcgcttactaatcaatattgcttagactctgaactgtttacagtttattcaataaaatgtcttcagagtgagattcaggaaatgatgatttaggtgtgttatcaatatgattcatatgtcataagacattacagcaaaaggagaaaaaccaagctatgctccagaagcacagcctattacaggctaactagcacgcatttagtccatttcttcccctggcactgttgagtttctagtccagctctcaattcccaggtatttcaaggaagttagaatagtcagataagaaaagaggtaagagaaggtaagagactgctgaagaaagtatcaggaccagaaggacatgcaccaaatgttaacagtaattatctctgggtgacattcattttaatttttctttatatttttctctcttttgtgaactttctataatggacagcattattttataaccaggaaaaaatatacttgcacacatacatatgttttaaaaaagtagtagtaagaagggtggaaaattttaggagggtgaaagtggttcctggtgggtgatgtgagttggatctagcaagcaaactatgggtccctgagaaaaatgtgaagacggctatttctttgacttaaaaaccaatcaaataagctactgagcagctattacatgtaatcatatttctttgtttacttttttaactcacccccatcgatgttcaggtaagaaaactaagctcagacttgactttgttctgctcacactgtaaaaagcctctcaggaagcatgtggctccctgaagtcagtcttcctccaaccattcagctgccaagtgaccattggcaagtcgcttttccatcttaataagtttcgtttataagatggagataatgatctcagccccctctgtctcaagggaacatgagactcatgaggtcatcggtgtggaaacacttcatgaactgtagtgacttataaaaggtgagataccattaagcaaagtgagctaggttttggccagttgagatatttttgtgcagtgacaccatgacatta

SEQ ID NO: 37006 - DNA, 734 bp, Bovine  19866880567744
gacactttgttacagtcagtggaatatgcctcacaatttaggcttcaaaaatcaaaccaagaaaaagaacatagatttcaaattagcccattattttagaaaaattattttcagtttaccaaagcacaactttctaagcattcacagtcacagaatcattttaaactctgattgaacactcaattgaatgtaaaatttagactgatgaacagaaatttgagagaattcatttatccctggagaggagttccacaaaacaacaatgatcttgtttacactgtaagctcagttgttgttattctgctagactaatctatactcatggagaaggtgacggcaccccactccagtgctcttgcctggaaaatcccatggatggaggagcctggtgggctgcagtccatggggtcgtgaagagtcggacacgactgagtgacttccctttcacttttcactttcatgcattggagaaggaaatggcaacccactccagtgttcttgcctggagagtcccagggacgggggagcctggtgggctgccgtctatggggttgcacagggtcggacacgactgaagtgacttagcaatctatactcatagagtaaaggatgtgcacttctggaaaacataagtcttcttcagacttattttgcaaagaacaggctacactttttcatttccaggtgatccaccattagctatcgattacatgtgtaggcttaaaatttatttt

SEQ ID NO: 37007 - DNA, 748 bp, Bovine  19866880620073
tgatactgctatgattgcactgttattataggtttaatgttaggcaatcaagctacagtggtctagatatcaacaaacagcatcaaaagaaaacatcatattgtccctatccttttgacactgtagctgagaaatttttctatgttagtggccctaaatgaacaataataagtgacaatttagtgaaaaacactattttcacatcttacaaaagtcatgcaatatagattgatacaagtatgatttttctagggccacttgaaccaggggattaaaataaattcagtcctgtgaccacacctttctttcctttttttttccacctacatcatttaaagaggatttatgtaaattttctctgtactcataatttttcaagcattagtccagtcataagtatagggcaccttgacttgatttaattaccaccgtttctactacagcacacttttttattttatttttgagccctgattgctagttcattctcaatcattaacatttagaagaactagtcattactggttttcaatagctgcttgggttcctataagcacttagtcttaaaacacaaaaatggaaaacagatatttcaaaggtagaacaaatcttgattcctagagttagagtccaagaagccccgaggtgtgtggtcactggagcacacaaattcttaaccttcccatttgctttttaaaaaccacaaggaattgggtttaaaaaaaaaaaaaactaggacacctcattt

SEQ ID NO: 37008 - DNA, 1952 bp, Bovine  19866880663171
ctttaccactagcgccgcccgggaggcccctctagttgtggcgagtgggggctgttctctggagcatgggctctaggcgctcagctgttgccgtgcgtgggctcagtagttatggctcaagggttgagttgccccatggcatgtagaatcctcctggaccagggatcaaacctgtttcccctgcattggcaggcagattcttagccatgaaccacctgggaagtcctagggcttcttatattctcccagcctgggacctgaaattgtctcaaagcacgagagtgggttcaaaccctagacaagggataaggaaagtacaaggctgcagaagggttgggaaagcaactataggaaattccttcatagtgagagagagtttccaaagtctccatggttgtttttggttttgtttttaattttattagggcaattttcagtcacacatgaaaatagacaatgatattaaataatgaaccccatgtacctaccacatagcttatacaattctcaacatttggactatattgcttcaaccatccttaccctcagttttcttaaggtttggtttttagccctctgatttttataccatcttccttggaaatttgtttcatgctctcatgactcccactactgcctcagtgaatctgagctccaagtgtgaaacaccagccccatcctttaataaaccaatttagttggtgtatgtttctttccagtcccagagattaatcttggttattctaaactatccttgatgatttcattccccctagagtgattggtttaggaatgtgcatgtgatgcagatttggctagcaactcttgaggggaaataggcaagaagtaggaggttctacagacttttccttgctgttataaaggaacaggaaaaactaccctcttcatttgttggagccagtcttcctatagttgcatcttagtgatggcactcactagctaggtgactctgaacaagttacgtaactttactgtacctcagtgttcttatctgtgaaataggatgatagaaccaactcatggggttgttgtaaggaacaaaggaattaatatatgtaaagtgcttagaacagtatctggcctatcaaaagtgcaaattaaattttagctatgattattattttgtaaggatgtgatgcttggagctgtggcagctgtcttatgcccatggagaggcaagcttgaggagaaagaccagcccactgtgcacgaaagacagaaaatgtggaaagaagcttaatcattgatgtcaagctactgaattaagcaagcttggaattactctacccctgaatttctcaataaggaagataattttccttattaaatgagtctctttggttgaattttcttctattcatagccccaagcatcctaattgatacatattgcctcaaataagtttcctttctcccaaagcttgctcaaattttttcatcagtcaaggcattgcaatttccccattcagtcttctttataatacgccatatctagccagatttgtcaatatttctttacaactttttctttctctctattgacaaagttactgttggtggcaaaacaaaaattagtgcggttaatgcctgaaatagccttcatgagaaacgaggggctcatataaagtaaaagtactggtcatggccatctctgtcttattcacagactttagtctaatgggtactcaatatctatttgttgaataagtgaatgggggattggatggatggatgagacattttccaagtgaagattttttaaggaatactttttcagagaaatcttcccctgccacatacgtttatttgattaaccattcattgaagttgctccaggacttctcagagccttctgtaaatttccatgcattatgaatcaggaagggacactactgttcagtgcttctctaacttaattgactagacaggcat

SEQ ID NO: 37009 - DNA, 858 bp, Bovine  19866880735693
tttgcagaacaagacagccatttgtaccattaggccattgctcctttttagttgtgtttagggaccttctccaatttagtctcctttgacgtgagcagagtgtctattcattcaaggggaacaccatgacacagctggagaatatggcttgggaacacagagggcattgtgttcttgtttcccaatttcagaaactcagagttgttttatttgccggactgtccaccgaactctggatactgggcagttttgtacatttatagttttgtgttgagattctgcaactctgaagcatcataagatctacaagtaccttgtgagtcattttttaaaaagactaaacattaacaatgttttgttcagtttggggcttacctgaattttatctatttgtaactatttatttgaaaagtaatggttttgtaaatagatatttcgtaagtaatttaaatcaatacctcaagtatcagtaattttttcttaaggcaaccttagacaccagaatagtgctgaaacaataataataatcctaattaattgtgtgtttcctggtagatgccaaagcacctccatacatatatatatgatcttgtttgttttaaaaagatagtgctataatcaaagaaggggctgccctgatggctcagtggtaaagaatctgcctgcagtgtaggagactggagtttgatccctgggttgggaggatcccctggagaagaaaatggcaacccattccagtatgcttgcctggaggatcccatagacagaggagcctggtgagctacacagtccatggggttgcaagagtcagatgcgacttagcaactaaaccaccaccaccgcataggcaaagcaaag

SEQ ID NO: 37010 - DNA, 3420 bp, Bovine  19866880790517
tagaagtcctggtcctctggtcttatcttcaaattaaaaatatttttgaacagaaaagaaatagaaacaaggatgtgatggtttatattattataaagctctgctttataaagcacaacctctgctgcttctagtcagtgtttactatgaaagagaactattattaatttttgtattaatacttttgaatatttagaatatttatgtttagtgagataactttccagttgcctcttggaataactgaggatagagaaattatctctaagcaggtcgttcttgtgaagaataagaagttcctttcatttctgtaaatgtagtgagtagaccccattgacctaatacttaatagtaatggttattattataatgttaacaatagcaacttttatcagtgacataggcctcactctgcaaatctctttgctgagaagaaagctgaccagcctttgtaaagcaagcctgttatcactggtaggtagtttgtatatgctatttaattaaatttaaaactttaattgagttttatttgtatttaaaataaattttacaatttaaatgtattttatttataacaacactatgaagcaagtgtaacagatgaaacagctgagatccattcaaagaggctgaatgcacttacccaagaccatgaagcttagagtggctgctgtcccttaggcagggcttgagtctcctggtttgccaccattcaccatcccctcactttattttttttaattgaagtgttaattagtgctgaaaagcaaagtgattcagttatatatatttttttcttttgatattccattacggtttatcataggatattaaatatagctctctgtgctatacggtagtagcatgcccaccttcctgttgagccccaccctgcctcctccactcattaatgtgcaccatcacaacctcaagcacttgtggtccaggtaccacagcactggcattatctggcaggtggttagaaatgcagaatctcaggcttcaccaaaaatctaacgaatcagaatctacattttaacaagatctccgggagattcgtatgcagattaaagtttgagaagtcttgctggaggggatctccaaaggtcctcccccctccacacacacaagattctgaatgttgaccatgggccaaaccctggacttttcactttgttaataggtacagctctccgttttaggtgggaaatccaaataaaatcctatattaaagtaactgcccttataaggatggatatacaaatgaataacacagtcaggaattctgcaagggctagaagagtgtccatgggagtagcggaaggcggatgaagcagggcctgtaagagaggtgggaacaaatgtcctgaacaggtgtcccaagttgacaatgaggagaagacagtgagtgtggctgatgggactagagagcttggtttggggatactaagagaattaagtttagaaatgtaataagtgtgtagactgtagcttggacctctaggctgagatatttggagttgattctctttataatgagcaaacattgatagctttcaagttgccatttgagagttttgagaaaattaatggtctgacagattgtgtagtatgagtgggcttcactttaaagatatattcacagtggttttatgtacatggcttgatgtgggtaaagcactttcccaaaagtatgacatgtttagtgttttttctgcctatattggcacttgttcctctgatacatgttcacagagaccccaacccagcacccaaaccattctgaatgtttctgggctttgaggcaagccttgctgagagtgtgtccattaaaggtcagggaatcataaagcctcccccaggaatactgggtctgacctgggaattgaagaattcgcttaacatccaaggaccacatttccgtggcagtagattacagaaaatgacgtttgtgtcccaatgaagttcaaactcgcagtgttctcagaagactgtagcattttaaaagtagcatgtgagtcacactctttgaatttacagtgagactattcgtggcagtacaatgtctatcaatgctgatagttacaagttttccagaacagctcagtgtatctgtatttgacatactggtcacagggtaggtaagttggcatttagctgttgggtgctctttttcaatagaactttgttaaaggccagatattatatattactgtttcttttatgattctggactgttttggaaaacaaagtcttcaagcagtaaagaattgagacattccaaggttaaaacactttataaatcagcccattacactgtgaagtaaattacattgttggccagtgatgtcacggaaggacctaattatgcttgttggtgtgtgttgttttattttgtaatatttggccaccaagaaggcacagtggtgaagtgtgactaactgtggctatggggacttcccttgtggtccagtggttaagaatctttcaatgcaggggatgcagtttcaatccctgttcagggaactaagatcccacatgccacagggtgactaagcttgcatgccacatcaaagatcccatgtgcctcagctgagacctgatgcagccgaagaaatacatacatattttaaaacaaaagcagtgacttctgggttgacaacagccacagaaatcgccaagctgtgagtatcacaaacttgggtctgagatacacggaaacacctgcctctcatcaggtggacgtagccaatttagggctgcacctggtgctgtaagtgcctgttggaaatacaaatcaaagtgctgttacaactcaacaaaaaaagtcacataacctaattgttaaaatgagcaaaagacttgaatagacattcctccaaagatgtacatggtcaacaagtacataaaagatgctcatgtcactcatcatcagggaaatgcagatccaaaccacagtgatgtgcgacctcacactcatcaggatggccactttaaaataataaaatacagaaaataatcagtgttggcgagcatatggaaaaactggaacccattggaacgcttgtgcactgttggtgggaatgtaaaatggtaaaaccgctagggaaaacagtaaggtggttcctcaagagattaaaaattgaactaccatataatcccacttgtgggtgtatatccgcaagaattaaaagcagggtcttgaagatacttttgcacaaccacgttcatggcatcattattcacaatatctgaaggatggaagcaacccagatgtctgacagatgaatgaataaacaaatgtggtatatacatacagtggaataacatttagtcttaaaaaggaatgaagttctttcacatgctacaccatggatgaaccttgaggacattatgctaaatgaggtcacaaaaagtcaa

SEQ ID NO: 37011 - DNA, 2339 bp, Bovine  19866880870860
atggggtctttccaatgagtcgattcttgcatcaggtggccaaagtattgaagctcagcttcagtatcagtcattccaatgaatattcagggttgatttcctttaggatggactggttggatctccttacagtccaaggagctctcaagagtcttatccaacaccacagttcagaagaatcaattcttcagtactcagctttctttatggtccaactctcacactcatacatgactattagaaacaccataggacataataagaaatcagtaaaattcttacaaaatgagatttgtctttatagttgtattgtatgtcttataaatacttactgtgaatcacagaaatcgtacattatctcatgtctttacaataaggaaatttattatagttgtcttctgcaagcctggtgaacattaatgaaattcgagtgtcactcagggtgtcccagatcttctagttgagtggatgtgaggttctgacaggtgactgtgatttttgtcctgtgcaaccatttggattttccaggagtctcacatgaaagacttttggcactatagtactaggtaaaatctgttttgttatacttttggatggttatacttctgactcaggattagtctttccgtgtttcattcatagtgatgacacattggttttacagtttgggtagaattgaatatgaagatttgtactgtatcttggaataatacttgagctatttcatgtacatatttattatctattctagactttcagaatttcactcttcattttagcttcatagcttacttcataacttcaggcagtaaatacaaataagattcacttgaggaaaatattaaaatacgtaacaggggcaatagcctgcaacactgttgattaaaacataagctcaaagccatagaatataggttcagaatagttgctgtctctacatgtgtgtagaacatcattaacctagttctcatgcatgagttttacagtatctaccaaagtttttccatctaaggctgatacataaacatacagttaacttcatgatatattttatattaactttactttttaaaaactttcgaacttatatcttatttgaaatgtatttaaatctatctgtcagatgttgttcttttttgtgttctatttttcaatttcataatatttataaaattttcaaaggtatttgttgaagttatctttcttatgagattacttttttggattatcataagaaaaaaattttttttaagattacacagaaagaattctccttgttgattagatcataaaagcttgatccaggttattgtatatattaaaatcagtccattaattcattttgtcatataacagttgattccattttccaccaaaaatatagcattgagattaggtttctttctccatgactccctggcctgctctatttctcctgttccctttcctcccatcttccattccctttgccccctttcttcttcctttaaaaattgccaattcttcattcagtccctctgtgtcccattctcctagaaattagtgcaatgcagtaatcaccattgaattgacaatagttgataatgttgtgtcttttatctgttttaccatgttacttagaattgtaacttactcagttttttagtgaagaatcctttaaaaactcacttgatggctggatttgatagtgtagatattgtttcaagctaatccattagatatttatttcaaaggaaaaagaatactgatagcctatcatgcacattcactttcaagactgtcccttaaagaaaactgattttaaaagagataaggcaaaaagctttattcaatacttatgatctataataagatacactctagttccatattcttaaccaattaagaatattatgtattaataacatacacaatttggagagatagaagacatttcttttttcactcatttagttatttttactctttctagtgatgactgcttatttcccctctctatcagagttgtttagcatatattatatgtaaactctcggttgttaaattctgaaaggggtattttattctgtttgtattatttttcttagcctcccaaaaatgtaacaaggaaaatctattcttcaaaagattatttcatcatttaaaaaagtcctttcccacattctattctttctttgttagtgtaatgatcaaatttttttatccttatgtttatttaactcctcccttacttgtgtcattcaggtttgacccaagagcaagcagttgaagtacttctaatctatcattgttagaaactctgcatctcaaaattaatgcttgtaggagtgtgagggaaa

SEQ ID NO: 37012 - DNA, 1570 bp, Bovine  19866880943007
tgttggctaaagcaaggattatacattggctatggaaaatctttctacctgtgatttggccaatcatgccagggtggcttgtaagtgtatcctaaaaataccaagagtatataaacctggaaactctgacctagtggttctgtttctgagaagttatcttaaagaaataagcccaaatgtacaaaaatattattttaaaagattaaaaatactaacaaataggatctatcagtatgttaaaaaataatcctctataataggaacaggaaaagttatgtatttggaaataatataattctccaaaatggaagatcaagagagaaaaatctttgtgtataagcctcattatggtgttatttatactgaatataaaaacaatctgtatatccaacaacagagaaatggaacaaatctatagcagtggttctcaaccaggagagaaagacatctggcaatgtctagagacatttgcggtcgtcacaactgatgtgggggagaagacaagcctggcatctagttagaagaggccaggaaggctgcaaaacgtcctgtgctgcagaaagccttgcagcaaagaacagctcagatgtcaacggtgctgaggctaacaggccttcgtctacaggacgaagtaccatacagtcgcgtcagcaaaggactggggggcaacatatttacaatttaaggaaaaaacagcacactatatttaagctatttgattttaaaggcaattaaagaatcccataagaattcaatccttcaccctctcccacacccttctaaataaagcacctgaagcaggagaggagtagatacatcaggctagtttcagtcttccaaagcgcaatgcacagggaagtggcactgtgtcagatttcaaggaagcaggcatgacagaagtgttttatctttaactaaactgttgttctttcaaacatgtgaagggatgcaaatttcatcccagtggcataaaaattattttgagacatttgaaaatcaacagatgcagaaagaggatttgtctaaatcccattccccatatctatctaaagagcagagtctaaaagaattatctagacaaaaatgcttctttcaagggagatttccaataacagagtagactaacgcctatcacctgagatgagaaatcaatagtcacaaaactatcataactgccatctactttcctaaagacgtatttgtctttcctaaaagtctcttgttttgtaagtggaataacacaacaccacagcacataagtaaaacctaccagtaacacaaaggtaaagaaccagaaacaacagagcaacattaattcaccactctttgtctatggtagatcaaattttttttttctggacaaagctggaataatctgagcaataaaataaagtcgtattggattataaaacaaagtataaatactcaagtccatactgataaaaatcagtgattgaaaaaaatgaaagaatagacaaacctccagtgcaaattccaagtattttatgtagatgactatacgaataagtagaaactttccacccttctaagtgtaaactgagcacgggga

SEQ ID NO: 37013 - DNA, 1800 bp, Bovine  19866880973385
aatcttcctgatagcttagcctgctgctgctactgctgctaagtcgcttcagtcgtgtctgactctgtgcaaccccatagacggcagcccacgaggctcccccatccctgggactctccaggcaagaacactggagtgggttgccatttctttctccaatgcataaaagtgaaaagtgaaagtgaagtcactgagtcttgtccgactctcagcgacctcatggactgcagcccaccaggctcctccatccatgggattttccaggcaagagtgctggagtggggtgccattgccttccttaaatgtgctcagaatatttatggcagcttacagttgagccaagttacctagcacacagcctattttataataaagtgttgaatatcttgtgcagttagtttattgaataacatactgaaagtgaaaaacaacggttgtaagtgtactgcttgttcccctcatgatcgaggggctgactgggagctgcagctcactgctgctgcccaccatcacaggaagagtttattagtacgtatcgctagcccgggaaaaggacagtttctactgagtgtatatcaattttgcactttcataaagtcaaaacatcataaatggaactatcctaagttggggactatcttattttatgatatatataatcttacatatatataatagagatagttgttgtatatatgatactattttatttttgtgcttcatgtgtctacctaagggcatgttaaaggcatgataacagaagttagtcaggaactaacttctgtgtcaatgaggctacatctttaccaggtggcgtcagtgcccaggtagccagagcagccttctgtgtctgccctgtgtcccagaaggatacatggactttggaggcctctcagtaaagctgaaaaaagtaaagttccgaaaaaagtgcttagagaatgtgttgtttgtgcatgtgattttggaagtggtacagtttccagtagtgaaatgattcaagatagaaccccgaaagtgacatgtggcagaagtggagtgaaggaaagagtctcttgaggcaaagggcacctggaggtcggggtcataggtgggttgcccatgcccatgtagggggtgaggtgaacaagactaatgacagtagctgagaggggaaggtagcctgaggaagagataaccaagagggtgggctgatacaagcctcttaagattcctgcaagaggagagaagtagagtagttgcctctaggtggcactggagagcagggagggccctgaagtgtgtgggggtgatgaagaataaatagccttctttaataggaccacagaggaagttcaaaagatagtcatatgttagtgcaggccagcaaatagaatgttccgaagaagaagttgaggattcagggcagctggattttagaagggaggagattattatgcccgatgaagggatatgtagaggattatggaattagagttgcaaggatgacaagtcagagggaggctggacttctgctgtgatggacgtaacggaagggagtgtgggttcattctgatagtcactcagtgaacttgcactgtgtcagtgcttcttggactcggaaacccaggagtctgtggatgccttctcaaatggccacagtttactagtgaatttttaaaatttggattgttattttaatgataatctaaaagctgatttcagtgccccgagtcgagtttatttttatttgaaattccaccaggtactcttatacattaatatgacattataataaaaataatttaaatcactgctgggaac

SEQ ID NO: 37014 - DNA, 832 bp, Bovine  19866881007768
ttgaaaatgcattctaataggtcttgaaacgtgaacagtttctctttttttaaaacactttttatggatttgaaatggtagtatatatagctgaatgatagcagtgataaaaaccagtctaaactgtgaggccatcctaaaacaagggctatgacaagagtaagccaagaggcagttatttggttcccttcaaggtggaagtaattcatttaaatgtgatttcattcaattattcattcaaacaaatatttactgaaccttactattagaaattgagaccacatttcctactctcaacaaggtcactcttcaggggaaaagatggaacacaaaaatataagtcaaacaatgcagttagcacagggattcacataagcattttttctattaccttgttatttttcaaacattcaaatggacctagaacatggcagaaactaaacatacaaattaaaaatcaaatactgtctcctctgttatatagtcacacattttgttagacacacctttaaaaaaagacaacctgatgtaaaaaaattgaattatgtttccacacatgtcaaacggtttactagcatagctaagaattatcacactttggagtgaaagttttaggattttaaattttgtttggacagcctctaatttcacagtacccattagacactttcacatgatacaccacatggaaagcctaatagaaaacaaagcttggaagcaacttacagtgtggtacagtactctttggcctggaaacaacgcaaagagatgattctattttattttactgctcagggcatttccccaaagtcagataatcctaaatcctcct

SEQ ID NO: 37015 - DNA, 4105 bp, Bovine  19866881025325
tagtctttggggggcccatatattttggaatatgagcattgttagtttcttttgaacaactgtacaccagctcatgaatttgcatacataaatactactagtgaaaatttgtttattatcttgcatttcagtgctatttactaacagatttcaagacaatagacaattttataaccttagttttataaaaaccactagtatttttggtccctagcaaccatttagtatgtaaattaggtattctcaggcttaatgtacttcatttttataaaacaaatacatcattaatctgattaagttcttagatgggagtgctgtcctcagatcattgtggatcatttattgttgggcatgcatccaaaaaaaattcaagcgtggcacttacagtctaggtttaggagaattgttgaaacctcctaaatgacattttccagaagaatagaaaggcactgcttacttacaattgcaagcattacctaaaatttaatgatgttcttacccttaattgcaactcagtttgatgatgattcagtgcctgaaattatgctgtgttttgctttgatgttaaaaaatgtgaaataaaggtgatccaagtgaatcaaaaatagatcctggctttccagtagtgacttaatcactatgtttctgaattcagaaggttgcttgactgtcatggctattatttggcatgtctttagcttttagtcaaatttactacttttaagaactgagaatgtttaatattaaggttaaagaaagttcatgatgttttaatttatatagcagaagaaccttttaaagaaaatttacaacatagtttactgaattctaccttacttccttttacaaagttgtataccctctgtttgtaggtagtctttgtctaatgaagcatgatgataataatggcttttgtttattgaatggacctcgttcattctcctagaaatcttgtgaagttgttttgtttattcccatcttacagatgattaaacagaggctcagagagattaagttagtgcccaaaggcatacagatagcatgtggttaatctgggactcaaacatagttcttattccagagcctctgcctcctcagataggcgagagaaaggaagagaacagattaatatacaaaggtcattggggttgtcgaactttttctataaagggtcagatagtaaatgtttttgggcttccctcgtgactcagatggtgaagcaatgcaggagacccaggttcagtccctgggtcaggaagagccgctggagaagagaatggctacccactccaatattctttcctggagaattccatgggcagaggagcctggtgggctacaatccatggggttgcaaagggtccgacacaacggaacaacgaacacttgtacatgttttaggcgttgaagaccacacatacatggtctttagcacatattcttgttttcactttttttaagaaaccttaaaaaatttaaaagctgttagaaaaaagcaagtggaaggccaaatttgacctagagtttttagtttgccaatctctaatttagggcagtgtcagtaagccctaaatattttctctggattatgttaattatagtcagtaaaataatttataatagtgactttaaaacatcaagaaaatggacaagttatgttctgtataccctatttgagaaggcatgaaaacatgacatcttagattttcattaaagaaatcaaaataaagtgttaatatttttagtgatttctggatatctggaagactcaactttttgaaactattcattttatagcagcaaaaacaaaaggttatattgcaagtagatttgacagttacagaatgcataacatataattttaatttcatccttgagtgtttaattttatttaaaaaaaaaaatcttaccttcttgatacgtgagtgcttagcattttgtccctatatttttgatattgcagattactgattccccttttttatagtacacatcttactgaggaatactaaagtatggctgagaaaattttttttcatttcttaaggaaatagcagcttgtatgtgtggatacaaggtatccaagatttttgttgatagtttatatttacctagatgtgaatgttttcttcaactcctttattaacattctagtgttttttttaatgtatttaaatttttttattttgttttgttattgttattatttgttactattatgatgatgttggactgcgctgggtcctgtcgctatgtgcgggtatctctagtcctggaggacaggggctactctctagctgtggtacttgggtttttctttgtggtggcttctcttgttgtggagcaccgggctctagaatgttcgggcttcagtatttgtggttcatgtgcccagctgccccatggcatgtgggatcttcccagaccagggattgaactggtgtctcttgcattcattacaaggcggattcttaacctttggaccactagggaagcccatgttaaagttttagctggcttaagggacacagctgctgctaagtcactgcagtcatgtccaactctgttcgaccctatagacggcagcccatcaggatcccccgtccctaggattcccaaggcaagaaccctggggtgggttgccatttccttctccaatgcatgaaagtgaaaagtgaaagtgaagtcactcagtcatgtccaactcttagtgaccccatggactgcagcctaccaggctccttcgtccatgggattttccaggcaagagtactggagtaggttgccactgccttctccgaagggacacagactccagcccttttcctaaagaggccccaagcagtatgggggggggaagggagaaagcgggaggcaggaggggaggggtagttgtcctcctaatggggcatgaggaatagctggagccctgggactttcaaaccatgtggctagtattgtgtttttgttcagctcacttgggtaccatgtgtttacatttttctatttttcttcaagccattagtgatattccttttgagaaactcagtacatattgttttggttgaactaagaaggtaaagagatatttatatctcttagcaggctagaacatgcctgctgaatggatgggtgtgctgctaagcctaggagccgcagtggcctaccagtcctttctttttggagggtagtcttctcaaagctttcctcccagtgttcagttagctgcaaggacaaaatcagctcccaaagcctcataaatgacattacaaaagaccaaaaaaaaaaaaaaaagttaaatattattatctgtattatcaaattatagagcaaagattctgagtcattgtttaggtagtgagggtggcttttgtttgtcatacttgcccttccttttaaaaaaagtagtacgtagtggaccaaacacacagtcctgcaacagaggggatattgaatggtttgctgtgtaggtcagtcactaagccaaactgccaaagtctgacgtatgggcagttttcagatgacgtttcctgagcatttattgtatactagattctatccaaaatgatttccattccttatctcatttagtctttgcaaatttttcaagaggaaactgaggtttagagaagttgagttacttgtttacagtaacatgactagtaaattacagaggcagaatgtgaatatgaacaacatgacactaaacctatgcccgtctaagggcgtaagaaatgttttatccttcagtataacagtcttcatttgaaggaatcaagttcttcagaatggaactgaaaagaggacattgtagctacaaatggaggctataaaaatctgaaacaatgtatgggcaatccttggagcaatctaaagaataaacaaataaaaataaaggtctctgagtttaaagtggatccccaactaattagaattacttatatgtattctgatgtgactgcctttagcttgcatgtgatgggtttttgtttcatgtgaacatgaagcaatatcatgtgaaaattggtcgtttggaaaaatgtagggaagattaagcctaagtgaaagattaattcagcaaatatttggttgagtgcatcttatg

SEQ ID NO: 37016 - DNA, 958 bp, Bovine  19866881049871
tagcatagcatatatattatatatattctgcctgaaatccggagacctgggttcaaatcctgggtcaggaaaatcctctggaaaagggaatggctatccactccagtattcttgcctggagaattccatggacagaggagcctggtaggctacagtccatggagttgcaaacagttggacatgatcaagtgactaacacatacacacacacacacacatatcaggcccccagcaacttcatatacatgatggagaatgtctttgtcatcatctcttgttctctctaaggccatcacattattaaattattaataataattttaaaaaacaacctagacctggaaatactgtgtcatggtcagaatttaacaaatacttccacaccttaaaattttagaaagatttaaaaaaataagaacttaaatgatttcttaaaatacatcagatacccttccctttccttttctctaatatataagacaggagcattgggaaggaacatcacccatgaccatcaaaaacactaaatcattcatcaagtgaaatgtgtcctgtagtgatattgcatggactttggccctttaagaacattaaaatattgagttggagaaaatacattgactgaacactgacaaagtacaatgcggttagaatcattcacatcaaacacatcatcagggatcttctagataaaatgccaataatgtagctaatctttttggttaaacaatgcttttagaagtgtcttaagagctaaaatgaacatctagaaattctttcaaatgctataaggccattagtagaccagcacatttgtcaacaatttaattcaatatttttaagtcatctcaaagtcacatagtgggtggatttttttgttttccaagcatcacacttgttattgatatgctatgtaacagataatacattccgcatttttctttgtttattaacaagc

SEQ ID NO: 37017 - DNA, 1609 bp, Bovine  19866881073769
tgtagcgaatgtaagtgatatagtctatatcacaaagagtctatatcacaaagagtataatctaaaattaaagaataaaacagaaaaatcaccaaagcaaattaaatggaaaattaaccattttcacaaagttttaagactttttgggatgctttatgatttggattagattcaccctagccataatgatcgttacctgagttatttactctctacttcaataatataattaatgtgcttgagtaccaagttcaaatactagaggctcatatgtttactttttttttttttaaagtatctctacaaaatctagtgttgatctttagtgagacaaaatatctataccaataatttcctattatcacctagagcatgaaacagatcactagaaatctttcttgaaactataacttagtgattagttagttcagtcactcagtcgtgtccgactctttgcgaccccatgaatcacagcacaccaggcctccctgtccatcaccaactcccgaagttcacccaaactcatgtccatcgagttggtgatgccatccagccatctcatcctctgtcgtccccttctcctcccgcccgcaaaccctcccagcatcggggtcttttccaatgagttaactcttcacatgaggcataggagctgattttttatttccagatatatgcttatctgttctgttaattcctattagaattagagtcaggagagctacaaagagagtaccttgcagcccccagcacatcccagaccaggagctgagctctgccacttttcaacactggttctttctgattgagagccgtggttaatgcaggactaaaggcaacagggctgggcccaatacctatcctcctacacttaccttacagtcttaattttttttctgtgtcacaaatccagttgattttatctgaaccaaaaagcctgaaatcaacaggattttgaactgccttaataaagtagaagtagagttcaagcattttgtaaatgattcctcaaaaggaaatactcccagggaaactgagattttatataatattcacaaagtactccaagttggttttggtttaagttctgtcctcaacaatactcactggatgttccaagctttcatttcaatgctagctagcattatcattagggtatgcagccaaacctatcgatcttagccaagcatcttaatacattaatagttcattggttttaagggcataaactgcctaatggagctgagatgaggagagctttaactttaaattttaagagcttacatgtacagtgtcactttattaatggaaaaaagaaccagtcttcctcatcttctgggtggcctactacaaaaccattttagtaatgaaaacccttaagatagaaaaatggaatatgtaaactttattagagcaacatcattgaactctaaagacagaaaaatcacacaacagaagaacactgggcagctttgagtaaagatggtgccattaataaatggctaattccaagtctgggacagggagagtaaaaagtaggcttaaggacgtttttgtgttagaaagcaagaaagtgttaaaggcttatgggagatgtgtgaaaagaaca

SEQ ID NO: 37018 - DNA, 1702 bp, Bovine  19866881076156
taactgttaaccctaatttatttttactcttcagtgacattacttttaactggctacatttggataataaaagccatggatttcaaaccacttagtaatttggtttcatttttaacacaaataacaccttttcatccatttttatataaacttcaaacaacgtatgttttaacttactgccaaataagaaatgtgttacattaaagtgcacgttgtttgcttgcgcatttggaaataccattcattttatagcaattttgagttatttttctgtcactttgtattcctattcaaagagacatacagaaaccctcactcaaaacaactcccttagggtttactcctggatgtcagtagacaggagcgggaggaacagtatgcaacaagcttaggtcatgaaaatgtcatctcttggtgacttgcatttattattattctttgaattgtgtcctcttgaaattctgtgcagggtattttaatatatttttgtgtgtgtgtttaggtaggtaagacatagataccacttcacatttttcctccttccctcttctgatatataaaacagagacactcattttctaggatttggtccaaatttttaaaatgtattgccaaaggataatgtgtacagaaggtgaaatgttaataacgtaaaagactaggacataaaacttgaaacttcaacattaagatgcagtgtaaagtgttagattgtttttaatctaatgaagtgaatcagatgttagagaaattcagagcaaaatacgttttgttgcattcttgctgtaacttcttgggactagagatggggtttcttttcttttctttttttttttggttgagaattcaaaggaataaagggatgagccagccataggcactaatacctcttttgcctctaatgagctgtgtgaccctgggcaagccgttttattttctgaggcatgtgaactcaggttctctctaactgtaaagtctaaagttctaatgtgacagccaaggcagtacacaattgctgcagatggtgtggtgatatctgggtgctggcagggatgaggggtttgaatactgcctcagatttagtctctttcgatagcataaaaacatctggggaaagggagttattaaaaacagctgataaggacttccctagtggtccagtgtttaagactgtgcccttccagtgcaaggggtgtgggtttgatccctggtcagggaactaggatcccacatgccatgcagccccccaaaaagttgataatatagtccatcttttttcttttatatcccttaataatggcatcaaattcaatttagtaggcatccacaaaagatgggctaatatttttctcaaagaaaaatgagcatagctcttaatagttatgtatgtgcatacatacatacacatacacaccaagaaagagagggagagagagagattgagtagttgctgtattttcttacagtttgaaaagtttgttagagtgacctgaattttttctaggatcctgcagcagattctgtggcaagctctctggaaagggtgggaagagttttgttacctgaacggcgagtttgccagtttactctccgtacttgtctgtctgccgtatttaacatgattgaagagcaccacaggataagatgtggaggaataatagaaaaaggctctttggacattcattgggttctaagccaatag

SEQ ID NO: 37019 - DNA, 1644 bp, Bovine  19866881219273
tggagaagagagaaatggcacaagggaagcttcaagggtcctattccttgcctaaagtgggtggtggttatgtgggtgtgttcactttgagataagtctttcagtgatgattttatttctttgtttttctgttacataggttgtacttcaacaaacaagtttcacaaaaaaaaacaggttgtttttttttttaagctcttcaaatagagagcagaggaaaaactggccagaaggtggtaaggggctctggagaccctttttctgatttgggggagctggttcaacagaggagcttaattaaactgttcactcagctgcaggctcataacatgtgctgatgttgttcatagagtgtcatggtgctgcaagattctgtggactttggttctttgcctacctgcaattgtgtttatggacctgaatgttgtcaaggccaggaacttgagtcatagaacttacagccattgagcttttcagcacagatgccacttcctcctgaaagcctttccggagctgtgagtttgggccaggtgctcttcttctatgctccaccacatgaatctttagcatatatacccctgccccctccagacactgtaaggtgctgctgctgcttttttaaaaaaaaatttggctgggcaggtctcagttgcagcatttgggatctcagttccctgatcagggatggaaccttgggcaccctgcgttgggagtagagagcccaaaccgctggaccaccagggaagtcccacttcttaaggataactttgtcttgtttatgatttaaatctcagtgctagcatcactgactcaatgggcatgaatctgagcaaactctgggagatagttaaggacagggatgcctgctgccgccaatggggttgcaaagagtcggacacgactgagcaactgaacatcaacatgtaagtcaggtgttcatagcatgaaaagtgcctgtgttcagccattaaatttatttatttatggccacaccacttggcttctggaattttagttcccagaccagggctcgaactcaggcccccttcagtggaagctcggagtcctaaccactggaccagcagggaattcctctgtatgtagacattttatagatagatttgataattttgaaatatataattcttaatagcactgaaaattaggatgaagaatttaagacccttttccaggtacttttgttgttgtagttaagttttacagttaattaaagactgaaaagatatttctggttctagaacatagcactttcctcagagtagtagagtgctcttctggaaagtctctgattaccctataatatgtgaaataatttctttttcctgataacatagagttcagtgttattttcaaattgctcttgaatcatttaaaactagaaaagactttataacaaagttattatagataatagtgtctcaaaagttttgagtttttggtatttcctttattatacaaagttgaaatatgaactgtggttataattataatcaaatagagaagccaggtttgaatttcgtattttttactattggaatgctttctgtcaaattaactctgtttttaaaaagtgaaatttgacatgggagtcctaagaacagaggtttatgtcacactacaaat

SEQ ID NO: 37020 - DNA, 759 bp, Bovine  19866881222897
ttcgcctttttaggttttagtttcttcagtaccaaagctatttgctatctcagggactttgcaagtgctctgccagctgtctagaacattatgccccactcttttgctagtgtatcatttaagtttatgcttttttaaaaaaataaatttttattgaagtatagttgctttataatgttatgttagtttctactatatagcaaaataaatcagccatacaggattgcattccttaaccatcctagtcccaccatagcaaagttggatctccttattataaattctaacagcaacttttatcacacttgcaaataaacaattaacctctccagggctttcttgtaaactactacatgagggcaggaatagtattttgtctcatttaccagtttcctcagggctaagtaagcactcagtaaatgaataattctagatgcatggaaagcagtgaacatcaacactgaaaccagcttctaggctgtgctgttgaagttaatgcctggcttggctcccaaattctgtattctgccaaaagttgtacaagcagggttgtgccaaaacagtagacttaactacagaagaaacttgacccaggaaagcatctctttttatcttctttcaattctcatccctcccacatctgtctctgcctaatagcaatcttttccttccagaaaacaagctgagccctaaattgagcttcatccaaaaggaaccccattttcattagtatactcgcctatacaatgttactcaaaa

SEQ ID NO: 37021 - DNA, 1030 bp, Bovine  19866881230545
tttatatcaacatgcagctttagaaaggatccctccttttctccagcaatcttgtttggaatgataaaggtaaaatggacataaattttactttttaaaagaaattagaaatatatgaagttataattaggaaaagagtgagcttcagctctgttcatctttgactcagaactaattcctgcttttcctgtgaactcgtgggagaggtaggtaacagataaatcaaagatgttaccctctgtggcagctacatttttgggatttgactttgctatgggagctcagggattagtagcagcccaaggaatgcaaaagcaccccactttatgtaaaggtaagattcataaaatcacactgttcgtgctcaccaataaaggttatgggactgttcatcagggggagactgaaagctggggagaaagagttaacagtgaaggctgtggggtgctgtggtgctgccccctcctcatgcctgccttttttttttttttaatgtggatgaatgtttaagtatggtgctgtggttgaaggcaactcttttaataatgcaacacacagcttcctgaggggacagcagttgatttggaaactgaatatggtgcactctaaattctcctcctcgaggagggctgactaactgataagtgccatgagcgagcgtggggactcattctgtcaaatcagcttgctccagaggccccgtgcggaaccctctccagtctctgggagctaatacgagcagacacttgtgacattagacagtgcagcaggcctggcataaaggaaaagttcaccatccgctgacaaggtggtctttagatgacaaggataaagaaatcagtgcgaatttgttaatgtaacaacttggaaaagtatgcttaaagaaaaaaagccaccctatggagagagacgatcaaaagaaaaagaaggcaagtgtagtacttggaagcttttcttgggctttctgcaccttcagggccattgacttttctcttggtccttcttctaggctggggtaccttcagttgag

SEQ ID NO: 37022 - DNA, 1624 bp, Bovine  19866881282344
aaactgtgcactgcagggtgttgagcagtatccctggcctcacacactagatgtgtgtgcatcccactcttctggtcatgacaaccaaaaaacgtgtcttctgtagctcatcaaagattcaggcttagtctgtattattaactctgcagcaaagaacatctaaacagtgattaagatttaatataccactctgcatctgataaccgagaacatgtgaagtgagacgtttctccctaaagtataattaggctatgtaaattacctatgcattttgaaatccagaataaaactgaaaatgaaaagaatcccattaggacaccctgatacactggtcagaacttcctctgaccttgggaggggcatcttgcccccaacatcttcagaatctctgcttcaactgagtttgcttcagctttcaagaaacctggggcagaactcagaaaggttttctgtgggcaaaaggcgctccagtgaggattccctggccagaatgaggaggactgaatctgggacataaatacccgcttcatcatcaaagcctcctgcccaagagaaggctttcatgagaactctgggctcattgtgtgaaaattcagatgactgaactataattagctcgattagtcaacattttaattcataggattctggctttgaagtgttcctttctcacagaatcaaagctaataattctggaattgtaattgggagctgagtgccagcttgaagctcagggagctccctcacctccttggcaagctctacttccaagactgctgcttcctggccatgaatgaacctggcccaggcacctcagccttgccttttcctgaacacctcctctctgtgagtcaagggctctagcatttaggttctaaattcgtggtggttgacataaaaccatgctatgagtacctccaaagcctgtgcacgtaatagaatgctgacaaatttttttttttttttggatgttgctaaacaaacagtgaagcaggtaattggctgattgtctaggtaacaaccatccttccagctttaggaataaaatctgactgaaacaaccaattgtggtgattggattgacctaatggttactgaagatggatgtttcttcaccctaggcactatgaagaaccaataaatgaattaatccctgtataccacacaccccgagggctctcaggtagcaatcttgccaccattgcatgctaacaagtttgaagaggaaagaggagatccaggggaaacctatggaagccaaggcaggaagatacgtcgacatgaagcgtgtcatcccactgggccaaatgtggcttagaggccaaggacaacagaaaggtgaccattatctgaagcgaagtggagctaactggatgaccatgagaaaagtagtttgggagaagtggtaggaagtgagaaatagcagcggattgtgttgaagacagaagaggaggggaagcaatatcaacagacaactctttgaagttttgctgtaaatgggatcagagaaatggaatcggatatgaaatcaaaggagagtttcagataggagatattagagcatctttacatgcttttgggagcagtcctttagagacagagaaatggtgatgcagaagagaga

SEQ ID NO: 37023 - DNA, 1627 bp, Bovine  19866881291326
ctatacaggtgtgagtgccagcaactctcacctgggtgctgcaggaggtctgagcatcatcagaccacagagcatcatctctggctcagcaagtgtccctatgacagcattcacagccccacagcatcagccctcaccctcatttttacacccaaactccccaaccctgtccctcacttcactgaagtgcactgatagtgttgccacatggaatacaggacaaccagttaagctttaatttaagataaaccatgaactaattttttagtagaagaaagtatcaaatattgcactagtcattgtttaactgaaattaaaatttaatcaaacatcttgaaatttcacttgctgtgccttggcagttctgcgcagcagcccccaggtcatttctgaaatacatggagctcagtctcccccagaaaattttgcatttgctcttctctctgcctgaagttctctttccctagctgttcacatggctcccttgcaaacatcaggttttgtgcaaatgggacctcaacataggggtgtctctgagcccacttctcactggcactgtgaagctctctaagccttcatcaccacctgacatgttaaatatttagctgttgtctgccttcccctaaggatactgggaattccttgagggtgggggtttttgattcactgttgcattcccactgcttagaaccagaactgacatggaacagataataagccgatatttactgagtgaatacagaaatgttgtgcgtgggttataccaactcatgttccaaaaagcccctctgagacaaacactgcaccatcaatcgtgtctcatagacaaaggatccaagacacagaaaactaaataattcacgcagaagctccctgaagccaatgatgaggccaggtccagacccaggagctgtgccagcttagcgcaggcagagaggcatctcatagctaaggtaacaggtgtttctgccttccacccatttcaattatttggggttagaggaaggaaagagccactgacatatctgagagtctgtatttgcatcagacaccttaatcccagaactgaattgcactgcttgattttgctcatacaattactatttaacacaaagggtagcaaataaccacctaagcacccatgaaatggagaagtttacgtggatgtctgtactcacttttatttcttcttgaacatcaggattacggaaatttaaatcaggttgctctttcataaactgatgaaaatagcattgttttcgtacttcatcaaagtgccaactggagtttccatatacacttaactagcaaacagaaaatagcagatcagttccttagcatggtttctatgatggtatcgcccacaaagaaatgatcattgtcatcgtcagccccatgcagaccaagtgcacaagtccccagaattttccttctagtgagagcactagttaaattaattccctgaaattccacttgctggcctagtgccccacaaaagtggttgtgatgtgtttgtacagtagaaactgttcacaacaaccacaacatcaaaacaatgctctcaatgtaaggagcaggcatttctaatctattttctgaaacttctgtccaggccctggactcctgt

SEQ ID NO: 37024 - DNA, 1095 bp, Bovine  19866881324032
atctgccaattttacttctgtaaatcaagcatgttgggacttacccagttgttgggtggtatggttgtaccattttcatggttacagtcatgccagatataataatcggtatattttcctgtccggttccgactccattgaaaccaagcatgtttatcactggtgtggtttggtatgaaatcgatgattaattttaaacctagtgcgtgaaaacatttcaaatggtaagataatattatattatataatatcatattagaataatacaatagtgaggaagaaaatgctctaagccaagaaaagactctgatgctgggagggattgggggcaggcggagaaggggatgacagaggatgagatggctggatggcatcactgactcgatggacgtgagtctcagtgaactctgggagttggtgatggacagggaggcctggcgtgctgcgattcatggggtcgcaaagaatcggacacaactgagtgactgatctgatctgatctgatctgaagcatttggagaaatgctttccttaaaccatcccacccaccttccattaaatttacctttatcatgtatggctgcaaccagattctcaaaatctttcattgttccaaaaatgggatcaatttctcggaaatcttcaacaccatgtcggaaatctttaagggatgatttataaaatgaagtaatccaaacagtttttatatttaaagttgtgatgtaatccaatttatcttgaatacctgaaggcaaaagtcaaagccatgaaaaatagtttgttttttcagttgaacgattaaaaataaaacgaataggcttaagacagaaatatttggggttgttttgaatttgggtaaaattcaaatagcaaggtctagttctacaaccaacagcaaattagtcttctagcaataacctttgaactttaacatcagtgcataatatttaaaaaatctgtctgtggtttgttcatattttatacttaaaaccaaaactacactattgttaatttattctacacatggtttcaagcatctaatccaagccagatgctgctaagtaccaagatacaaagaagaatagcgtatgcact

SEQ ID NO: 37025 - DNA, 1460 bp, Bovine  19866881358991
aagtattctatttaaatacctctatacgttacttgagtccacaggaggcctggctagttgagatacatagcactaagcaaaagaccattcccagtttatacacgtgcatcctaagagttggtaagagataaataattaacaacttaaaagctgagcttaaaacataaccttatacggggaaggggagctaaattaggagtttgggattaatatatacatattactatatataaagtaggtgaacaacaaggactcaatgtgtcgcacagggaattatactctatatcatgtaataacctacgaaagaggaaaagtgttagctgctcagtagtgtctgactctttgcgagccccatggagacagcctgccaggctcctctgtccacagaattctccaggcaaaaatactggagtgggtagccattccctcctccaggggatcttcctgatccagggattgaacccaggtctcctgcattgcaggcagattctttaccatcttagtcaccagagaaggctgtaataaactataatggaaaagaatctgaaaaaagaatgcatatatatatatatacatacatatagacatgctgctcagttgcttcagtcatgttggactctgtgcgaccctatggactgcagcctgccaggtatctaaatcactttgctgtgtacttgaaactaagaaaacattttaaattaactatacttcaataaaaaaacatagccttataaaatactatttctatttactattggcaatggtgaaaaagatattaacatcacagctcactagaaaatgcagcttaacacacagcacacattcaaaacccagttatttgaaagctaattctgtctactccatcactccaagtcacatttcccaaaagtaattcttatagttctctaataggtctttattccaagcaagctcacatttctagttagctccggtgcagaatttataacactttgtaggatacatcctatgagcaatttcaatgtgctttagtgggagtgatacataatctcctgaaaattcaccccttaaataagtcctaatgggctcagagaacagcagtagcttaagtggatctattaaaaaaaggttgagtggggtcagtgattgggatgaagataccatttcaactctcccttcagttactgatcaaaatacattgacaaccagtctagtttggccattaaacacacacacacacacacacacacacacctctctataattcacttgtggaatcaacgcttgctttgttccattgatctgaatcatagattgtacgacaaaggaaaggtgccaggccattttcattgcctcccttagaatcagtcagggttttctgcagagcgcagagcagcttcatctcctggcatagggaaattaattagtacagagaacaaggagacatttctgccagcattctcagagaagaagacctctgt

SEQ ID NO: 37026 - DNA, 925 bp, Bovine  19866881410997
ccaagggatacctgagaaatggacagaattctgtttacactacagtacagaaaggggaatatttaacaagctttatataatagttacaacatcactgttgtgatatgcagttgtataatcaagaggaaaaaaatcttggcttcaaggaatagaatgtcttatcacacttaaacaaagactccttgctgaaaacaagccataattaatcaaagagtattacagtatgaaatttcaaaagcactcacaaaagagaatttttaaactttacattatatgagagtggtattcactctacatgagccatcaaggactatatagcagcataaatgctgatgatttgtttcagtgccagggtactcacaattctcgtttcaggttcaatgcatcttctgcattatcatgtcgacagcacaaatttattaaagctgcatagccaccgacaaccatatctgattcatattttgccttcaattcaagagctttttgcatgttctaaaataaaggaaggaaatgaaaaagaagaaattaatatacaagtgtaaaatttctagcttccatgttcagagtgtagaagttaacactacttttaaaataaatggatacacattattaacttcatcttgctccctggtatttttaatccaccttctaaaaggcaggaaagatatatatgaaggattcaaaagatttgttatctgcgctgcaaaactgatcactatgctaaatttgatgttttaggtttaggtactgtattatgaaaaaagacttccagattaaatatgtaccaggtgagtccaatttccatgcacagaaatatatatttctgttcctcacagtctgtaatgtgcaggacacattttagaatttaatagcgccatattataaccttaaagtcagctgtattttttccccctaaaaacacagg

SEQ ID NO: 37027 - DNA, 1403 bp, Bovine  19866881458220
ctgtttcattctgtactccaaaggccaaatttgcctgttactccaggtgtttcttgacttcctacttttgcattccagtcccctataatgaaaaggacatattttttggatgttagttctaaaaggtcttataggtcttcatagaaccattcaacttcagcttcttcagcattactagttgggcatagacttcaattaccatgatgttgaatggtttgccttggaaatgaacagaccctcattctgtcgttttggagattgcatccaagtactgcatttcagactctcttgttgaccatgatggctgctccatttcttctacgggattcctgcccacagtagtagatataatgatcatctgagttaaattcacccattccagtccattttagttggttgattcctagaatgtcgatgttcactcttgccatctcccttttgaccacttccaattgtaccttcctctaaatgcagcctgcagcctttgctttattctgacagtatataacagtccaccataaagactgggacggacgtttccctcagcttccaacacagaagagaaaatgttaaaaagacaatcccttagtgctttgagaaatcagaaggtaaatggttacgtagaggcctgcatgaaaagcaccacaaaaggagatgaagaaactgaattaattgtccagggttaggacctgtatcctgaatccaataattttaggagtaagattaaattttcttaatgtttgtgccaggtaatataaccagaaatagttttggccagactttggtgactagttagatagagagattgatagaaggatgaacttgatgatgggaaacatttttagggttgttgttcatttgctaagttgtgtctgactctttgcgaccccacgtactatagtatgccaggcttccctgtccttcactgtctcccagagtttgtttaaattcatgtccattgagtaggtgatacttcctaactatttttatggtagcatgccatagatggcccagaatgtccaaatatatccacggtctgccctcgaaggactaaacaaatctagtgctgccttgttctgagagcaagtgagtactggtttatgggagttgctaatttgtgctaggtagaaagtcaaaaggagtgctgtgcagattaatcaaaggtgtctaactccaaagcaaaggatgtcaagatgataagaaaggcaaaggaagcgctaataaagattgtaaatgtagtgagagtagggactttttctgtcttatttatcgccctgtttttagctcttagattaaggccagatacatggtacatgctcaataaatagatttgaatgattgtaggagaaccttctgacagtgcaagttcagctatatccaaggattatgctttatcgatcaat

SEQ ID NO: 37028 - DNA, 1659 bp, Bovine  19866881496516
tactaaagatctagtgaacacagtgagttctgtatcacgccagttactctccatcctcctcctggcgtagctgggggaccagcccagttctgtcactttacagcttccagaagggagaaactacgagcacagcatctcagagcaatgccctcaccattaccattggtaaaaaaaaaataataattcagcacttcccaattaaaggcaaagtttgtggtaactgattactgtttattctttatgagctaacaatccttgaaaccataagttacaggtaagataactggtgaactgagttaatgtcattaaaattaaaccaagctataaagactactttggagttaatactatggaaaaaattttcttcaaagtcattatagtgttttgaaactttcaacatttaaatttcaatgacttagaatatatgtacgaaagagatcatctgccatttttctgaaaatgagagtgcagttttcttttcctcgcaactatgaacttcagttacattaggcaaagggcagggattgccttatcttgcagagtaaccactttttgcttatctgaaacaatgatacactttgtacacttagacactgaacaacatggaagaagccaaaagacaatccccttagatggtcccttttgcatgttagttgtctcatgaaggttttcccacctccactcaagtttatctttgttttatgaattgtaaaagtaacatatactcaatggtgaaaaaaatcaagacacataagtatataatatagaaaatgggagtgtcctgccctctctccacctagctgcctttctcatttggcacatacagcactattatttttgttggctgcctacaaagtcaggcatcagtgagcactgaggtatttaatcagtccttaccgtgagatgtctaagccatttccgattgcatgccagtagacagtgcagtgaatatccttctgctcttctctattgtgctatatgatggatgtctaaaggtataatcactgggtcaaaggatatgtacattttaaatattgatattttcctaacttcaaccacaatttgacaagagttgaacagcaaatgtttaaaaataagatcatttttgtattcttaaagcatccatgaatgtgaaagtcattcagtcatgtctgactctttgtgaccccatggactatacagtgcatggaattcctccagccagaatactgcagtgggtagctgttcccttctccaagggatctcccaatccgggaatcaaacccaggtctcctgcattgcaggcatattctgtaccagctgagtcaccagggagcccaaagcatgcatataacaatgcctaattttgttacttgaaaaacaatgtggatgcactatttagaatataattttgtctaaaattttaattcatctccaagtgctacttaggctacatagatatactctgaagactacatttctagaagatacctcccgagtatagtcatttataaagtagttgtcaagaaattttgagagtgataatacttttataaaggatacactgttacaccccaaaaatgctaaggcagttttaaggctcctagtttaaattttcaagttttttactagtaaaacatgtttttgttttaggaacggaacagtacaaaagaagttctt

SEQ ID NO: 37029 - DNA, 838 bp, Bovine  19866881566695
ctttgaattaatgtacagagatatggagaatgcagaaaatattctcacagtaatgaaagaggctggaattgagcctggtccagacacatacctagcactattgaatgcatatgccgagaagggtgatattgaccatgttaaacaggtgtgacttacataaataaacactacttttaaatcactttgtataaactcttgaattttgcgtgatatggaaaagtatagtgtatatctgtttttaatgatatctcttatagatagtcttgaaggagaattcttactgtagttcagtactttgctgctgatgtaacaattattgctgaaacagaatattttctgttttacaaaagaagtcttaaacctttagatggtgtgtgtcctcagtctctcagttgtttctggctctttgtaactccatggactgtagcctgatagggtcctctgtccatgggattttccaggcaagaatactagagcgagttgccatttcctactctaggggatcttcccgacccagggattgaacccatgcctctttgagtctcctgcattggcaggcaggttctttaccactgtaccatatatataaaattttaaaatcttggtattttaatttatttagattcagtttaaaaaattttgcatctcacttgttcttttaatttctggacctttctttagaccctggagaaagtggagaagtctgatctttaccttatggatcgtgatttattgcaaattatcttgagtttcagtaaagctgggtatcctcaatatgtcccagaaattttggaaaaaattacatatgaaagaagatatattccaggtagttttaaag

SEQ ID NO: 37030 - DNA, 1757 bp, Bovine  19866881884558
tgaagttatatgtgtgaaggaggtagagaaaagattagcttcctaatgaaaatggagacccgaatgatttctttaaaactaaaggaacattgagaaaatcctatttaaaaaaaaaaaaaaaatggataataagaaaaccaaaaagcattcagtgaaaaaaaattctcctgacagactaataaggactttaatatgataatctggtgtttatctacaccttgcttgtacaactgcagttttctcagctattatgcaagggctgcaaaatgaagaatacctaattgcctcctggagaaaagtattactattgaaatgacttaagcaaacacattctgaactaacaaagtattttaaaaataatttgaactgaaaaatgaatgacagctaaatgactgccattaactctcctacaggttcccctggccacagcccattttggttttagagaacactcactaaccttaggccagcttcagctgcactatttcacatagtttggtaatttgaatttttccctctaacctgccaaaatcacctgtcaacttgtagtactactctgttgccaggtgaacttgtaatagagaatgtcctcggcttctgtttctattaacagtaacatgcctcagctgtttgaaataggttaggtaagatggagcaagagataggcatgttggcctcaacaatatgtaggcgggacacaaaatcaacgctgggggagaagttggaaagggcaactgaactcgctcctacctgccattaggattgactatatccatctatgtacactttgctcttaaactatggaggaggtatacatagacggatatagtcaatacattctcatataatttaagaagaacttctttcattctatgagataatgctttttaaaaccataaatagaagtgttgagagcttgaaaggagagaataggaatgttctgaccagaggataaatctggggcacactgacttcttccgagccacgtttctttcagcctttgtgtctcactagagccaggttttcggttccacctaggcagcctgcctcagtgactgcacagagattctgtgcagtgaagaaggccacctcttcaggcactcagcttttccttgggggctggttgttcgcatccaccctccaagctcttacagacctcatggttcctaaatctggtaattctaatttgctggtttggaggcaccaggtcctaattctggtaactctgtcttccagaggtgactatatccatctatgtatacttcctctgtagtttaagagcaaaatgtacgtagacggatatagtcaggactaatggcaggcagtaactctgtcttctggtaactctggtaacttctggttactatcctgtcaaccacctggcttctcattctgcctgccgtcttcagctgctctgacttcagctttactgctagcccgtactgctatatctgggatctccaatgctactgttttgtttccaaggtccaacttcttatctaggatgccaagcttttatttctccacttctggacataatacaggttcagccaaaactaatttgccgaagtgtaaagtgatggcttgcatgtaacaaattcagttccactgaggggaatgccagctccacactgggtattctactattttaaggcacttggctagtctactgtattgtatctgaataatgccacaaataaccatggtctaacctagacttttaacctcttctaagaagaaaccccagctacataatc

SEQ ID NO: 37031 - DNA, 1351 bp, Bovine  19866881974275
tctatgacccagctctctctgatataatgtgtaaaatgtataaaaactgctctattaacctcagtaataagtcacctggataataataatagttatgatatagtttatacattcatttgttatatgctagggggtttatattggagtaggaaatggcaacccactccagtgttcttgcctggagaatctcagggacggcggagcctggtgggctgccatctatggggtcgcgcagagtcagacacgactgaagtgacttagcaacagcatcagcagcagggggtttatattcataagcattgatccttgaaacagccctgtgagatattatacccattttacagatgaggaaactaaaggacaaggaaattacatgacttatccaaggtcagccagcctgtggattacaaattaagtgtattttaatttaattaatctattaaattaatctatttaatctattaaatctattaatttaattcaattgaaaacaaaaattattgagtaactgctacatggtacacaccatgctaatgtatttttctacaagacagtgtattttacaaaattgggtcacttgaaattcttaaaaacgcataaagcactataaaatccgaatgacatatactatcacacaataatctcactgcaaaaaaaaaaaaaaaggattcctcagttttatagcaaatgctacaaagtcattattaatcccattacaatatacaaacctattagtgttagtcactcagttgtgtctgactctttgcaaccccatggaatgtagcccaccaggctcctctgtccatggaattctccaggcaagaataccagagtgggtagccattctgttctcctgggggatttttctgacccagggattgaacccaggtctcctgccttgcaggcagattctttaccatctgagccaacagggaagcccataaacctgtaaagggaccccatgttgataatgagtgggatcatttgaatttacaatattcttggatcttcaaggaattaatcatctcctacctcatttttcccccaacatttacctttgtcacttttgcagtgtcttcattgtgaaagcacttgcaataaacagtttaaaagctgtaattttctttgtaggtgcagtattaaatcgcaactcaagcaccaaggaattatagtattaccctgaggacaaaaggcattttagatgtcttaaataatatatattaagaggaagcctttttttaaccataaataaagtcatctcattccttttaaaaatattttaaatcatttttggccacactgtgcggcatgtgggatcataggaccccgaccagggatagaacccacaccc

SEQ ID NO: 37032 - DNA, 743 bp, Bovine  19866882063231
tcctttggggcgaatttggaatttctttccgtctatgtgctggaccctatgtaagctattgtttgactcacataggggcagtcctaaagacctatgcaccacaaggcccccgtaggggcttctagttgatggtggaaggatcaagtgaccgtcttctccacagcagtgaaatatgatgttaaagtgattttttaaaaaatatcaaccataggaaaggaggttaagaggttgtggtgaatcaaaacaaatctaggcctttgaactgacaatcagaaatttatttaatgttgatgaggagatgcagtttgaggagttgtataagaatgatcaggtaagggtgctttgaattgaaacagtttaaggcaaacagaaagcatgcatgttaaaacatcacagttgatactgccctccatgcttataacaaggattgatgtgaatgtatattcaagagtggggccctgatttgtaaataattctcagggagacaagattaccgctaggattaaacacctagtgatagcagaaagcagaattggaatgtcactatatagccacagtctataaggaagcttaagggagaaggatagctaccgtgggaaccagtattccagaagtaaatttaccagacgtaaattctgcttgggagagttaccactagaccagaaagattccagtgtgggtctgtaaagagtgtcaaatctatggttctcagtatggaattattaggatgatttaatggagga

SEQ ID NO: 37033 - DNA, 1851 bp, Bovine  19866880397543
gggaagccctatgccttagtactgttcttttaaaaggcattgagggaagcctttcaacctggaaagtttattctttagcttataatatgcaaataataccaaataatatgactattttttctttgataatttcctctttgcatgttttctgttccttttggaataaagtcctaaaagtcagactttgaaacttctggattgattttctacatctcatcttttctttcatactttttaccttctactttttaaaaggttttcttctaacctattattgatcttttaaaattttggaaaccatgttcttaatttccaagagttctgtttttgttttttgagtagccttttaaataacatccatttcttgttttatggatacaatacttttgcaaatttctatggaaatactggctcagatggtgaagtattctcctgcaacgcaagagacctgggttcggtccctggatcgagaagattccctggaggagggaatggaaatccactctaatattcttgcctggaaaatcccatgaacagggagtttagcgggctacagtccatgggatcacaaagagttggatgcaaccgagtggttaacattttccctttttttttcattgaaatattagaacttactgaaaattttcttctgttccctgcattacctctgttaaagctttcttaaaaccttcttacttttattttggtctttctctcatttgaagacatgttacattaagtatgaaaacctctgtgcactgaaggctgactggtacctccgtgtacatgcaattgccagattggctataggttaattaaattttgagttaggtattaggatgtggaaactcccaactgtcaaaacataaaggtctcttctctgacatcatacaatttctgtagaaaagcctttctgttttggcctagggagtaacatttcattctgaatggtcacccagcagaggggtgtgtgtttgtgtgttttctgttccttattcagacttttagttaaccctctgttttctgtcatgcatttcgccccttccctctgtatcctctgcatcagcccgctaagcctcggctttatcctgctgcatcagttactattcatcttctgtctacatttcaccttccagagagatgtggaaatctctcatcctccaatggactctgctgctcttggtgtgagtttatattttctttttactcttttaccatcattttggtggagtcttgagaaggagaggagataaatacatgtattcaatttgccacctttaattggactgcttaatttttaaagtgtttgtgttacaaacttccctctcctataaatctggtcttgtgaataatgtaaatttcctaccaagaagattaaagaagtgattctctatatgattatgggagtaaggttcaggtaactttgggtggtttaaggtttcttattgagtaatctggaaagtactaaagatactgctcagggcagtgtgagataaactctcccttcatgacttcaaaagtctggttatttatttacaactggggtaagataaacagtcaagcaactagagagctgctacaaaccacttgtacatttaagtttttatcctgctaccaaaaccatgttctgtccaaatctttgatttccctagcttcccaacgttgggaggagaacaagctgcagtgtcacacaggcaggcccctcctaagtcctactcactcacaaagaatttcccctttgagcttctatgacactggctggttactcacaccgtagattcctcaggattggctgggactgcaaataaaacattgtttgcccataatcaagtcgataagctacaacataaa

SEQ ID NO: 37034 - DNA, 824 bp, Bovine  19866880402345
ttgtggaaactgaatacctgtaacagctggaaacagtctgaaagaagtctgactctattagcagcttaaactttgttctagtagttacataaaaataataaggcaagattttatttgttcccaaatatgattatttggaatcatcaaacatgcacaaaattgtaacattttcattcacaattatcattaccacatagtttgctaaagtgcttggcccaaaataacaattttctagatattattctgagtttaatggaatttaggtgaaataacatttcaggaaaagtttgtcaacttgacaatttgcttttcttatttggcctgggaaaaaaaaattaccctttcaacttcatcagcatctgttcctccacttggacctcagtgctgcttgaagaatgctaaagtgtctcctcttgatttcatgtggcttttcacaaatccagttaacttctggaacccctccattagcccgtccccagtgacggcacagcagggctgcacgcaccagttccggtcactgcagagttgcttcactttgaacatcctggtgatgtcctcggcacttagagctccaggcatatcttgtttgttggctaacaggaccacaggcacatttttaatgtactcattcttcaagatgtgctcaaactctttcctggagtcttcaagtcgctgtgtgtctgtactgtccacaacatacactagcccatcagtgttctcacagtagaggccccacgtggctctcattttctcttgtcctccaacgtcccagaccgtgagcgagacaccttttgccaactcaatcatctccacattgaaaccta

SEQ ID NO: 37035 - DNA, 1511 bp, Bovine  19866880466880
ttgatgcttttgaactgtggtgttggagaagactcttgaaagtcccttggattgcaaggagatacaacccgtccaccctaaaggagatcagccctgggtgttctttggaaggactgatgctaaagctgaaactccaatactttggccacctcatgtgaagagttgactcattggaaaagactctgatgctgggagggattgagggcaggaggagaaggggacgacagaggatgagatggctggatggcatcactgactcgatggacatgagtttgagtgaactccaggagttggtgatggacagggaggcctggcgtgctgcaattcatggggtcgcaaagaatcggacatgactgagcgactgaactgaactgaactgaacaaaaaaaactttttgttaaagctattcataggaaataaaacgaggcttagatgaattgagttaaattgtcttgtatttcttaacctcaagctccaatcagtgtgttgtaagcagtggaaatgcacttaaaaaaaaaaaaggcagagactctggataagtcatgaaagaattcagtcactggatagataagaaaggactggctggcggtgtaaggcaatgaggttaaggtgctaggaaataaagcaagtcgaagtcacctggggtccagagtccaaattcgccccggaaatgagccccagataaatcaactaatcttatctgtgctcatctgtggctcagttgtactagtaaattaacattaaaaaatactggacaaagagatctagatcacctccacttcctttctcgatgaggtaggcccacttggggctccaaagccagatccaaaattgttatggagaagtccaaaccagaacctaggacttctatgttcatcaaaatttggtttaaaaaattcttttcctcctccagttctatattggttcaaaaatacggaaccagttaggagaaaaatattttgttgacaaagtcatccttttctctttaagacttatcaacattcattagcccaatgtttttatgaaaaaaaaattagggataggtaagttttctaggatgatctacactaaaatatacagcctttgcacatagttaaaatctctctccagttagccttaatatttcatatttgtgattttcagtcagggagggacaggcttgacctgtgtactatagtttggaaaatataccacagtgatttgaatatatcaagtcagtatctatccaactctaatgaacactttcatgcgcaagcacgaaaatcagggtctgtgtcagactttatcattccattcctttacagtgccttctcacagttgaataagtcatccacaactgaacagattttatcaaacctaattctctaaggttgtattaggaaaacagtagtagtcatattcaatacactttaaaaaattacacatgctctctcactctgagaataattggtctaagtttacccttcaattatgctgctaacagcaccctttcttaaatatatttctcacac

SEQ ID NO: 37036 - DNA, 1103 bp, Bovine  19866880538293
catgtagaatcttcctggaccagggatcaaaccccatgttccctccattggctggcagagtcttagtcactgtgccatcagggaagtcctgaatttatcttcactgagctcactgaagacagaggccataccttatttacaaaacaacatcacggcaattaacagcataggctttgaagtgcctatttccctctaggcagttatgaaccttaaatgaatagatgtgtgaaagtgtttaacacagttcctggcacacacagtattcaaccaatggtaactgtaattaaagatatgtctactttattacttgaatccctgccatgcaacacaggaggatttgtcgccaaacaacaaatcagggctagggtgagagaaaactacagaaggaatccaggagcaagcactgtaccttactgtacaattattgctttactgtacctttattttcctttgtgaccttaaagtttggactccctgaggctgcagtgggggcttgaggcctgcttctaacccaaatgagccttgttggtggtagggtagagggaaagagtgtcttctgttagttccagggcctctctgggacttctgagcctctcgggggaattccagttcaatctccagttctttctcccctcttcccctctccaacaatgtctctggagaatctccaactgatgggaccttccagtgactaacctgtaccttcaacggggtcccctggagttgaggacttaacaccacctcctgcatgaagcacttcttgtttccccaggtcagaatgaggctctcctgttacagcacttagtacttattgccgtatcctatctgctggctttattttgtttgtctcccctgtgaattgccaggtctctgagagcaaagtatggctctggttcctgcttgatcagtacagtgagctgtacatacgttcccaagttataactgttatattgaattctaccaaagccagtcttggaattgcagcctccagctgaacgataagtccagaccttaccctaagctctaagattctctcttaatccccagagctctaagatacaaacttctgctccctataggagaacacagccactgggcaattg

SEQ ID NO: 37037 - DNA, 1201 bp, Bovine  19866880550371
aatgctttactctcagggatagaggtgaagtacaaaccaaaacaatagcttattcatagctgatatttggagatatttcttaagtccagaaaggtcagagggaaatccagcaaatgtcaacactgtttgtcaggtgggaagactcacagtgtctcctgaggaatttaatttatattaatgaggagtgagacctgccttgggctctctcagacatggctgtggtgccaatttaaatgatctaacttcacgaaaaggattcctaacaaattattcagcgaaacagcctcacatgagattgctttttaatcctgaggcctcagttactctgacctctgctgaaccacaggcacaaactgggacagagtctcgagacctggcctcactaaattgatagcttgctgtcatttctctttcttgttgggttatcaggggaccaggctaacccaagtgccctgtgatgtgcatattcagtcgtgtctgactcttggtgaccctgtggactatagcctgccaggctcctttattctcgggattttctaagcaggaatactgaagtgggttgccatttccttctccagtggatcttcctgaccctgggattaaacccatgtcttttgtgtctcctgcattggcagacagattcttttccaacagtgccacctggtaggacagcaaagtgagattctgacaataaagttctaattcagttcagcagtccttcatgaagactcacaattgaggctatgtgggagtaatgacaagagtcactatttatgtgcacttattatctgccagactccctactaactgtcttgtatttccagtttctaatctttacaacagttgtacagaattacagacatggggaagaagactcagcagaatcagatttggtaggtctgtttagttcctccctgtccatcaccaactcctggaattcacccaaactcatgtacatcgagtcggtgatgccatccagccatctcatcctctgtcgtccccttctcctcctgcccccaatccctcccagcatcagagtcttttccaatgagtcaactcttcgcatgaggtggccaaagtattggagtttcagctttaccatcagtccttccaaagaacacccaggatctatctgctttaggatggactggttggatctccttgcagtccaagggactctcaagagtcttctccaacaccg

SEQ ID NO: 37038 - DNA, 1941 bp, Bovine  19866880593621
ttccactacattccattagtccaccagatttaaggcatgagaacacagggtccccacttctcatggaaggactgtgaaattatcctgtaagagcattatgttgctgtttagtcactaagtcatgtctgactctttggcgaccccatgggctgtatgtagacttgccaggctcccctatccataagatttcccaagcaagaatactggagtgggctgccatctccaggggatcttcccaacccagagatcaaactcatgtcccctgcattggcaggtggattctttaccactgagtcacgtgggcttcccaagacaacattatgaatcaattatattttaataaaaagaaagaaaagcagacagtttgctccacctgatataagaacataacacaatctataaagcaatcctgcagggagggaagaaaattttaaaccattaagcctcggagaaggcaatggcaccccactccagtactcttgcttggagaatcccagggacggggaagcctgttgggctgccgtcaatggggtcgcacagagttggacacgactgaagtgacttagcagcaagcctatagagtcaactgtgaacttgcagaaaatacaaagagaatagaagaacatgttaaactatactataggaatgcaatcagtaaaatccagactgggaaattacaggactaacaatcctttgagacatacctaatcatcccacatcaatttaaaagctatccaggaagattcaacattctacagtctagtcagattaatagggtagaattatcggtattcttagtcttgtttaaatggttgaggtacttagttaaacaaacaagtatttctacaggattccttgtctaatcttaacctctttgtatttcagttttaacacagtttccttttattttgcccttagcagagatgaagaacaactgatcctcaaaggctaaaatcaaaacacttcatgcgtatgaaagcttttatgataacatatcacctttgtacttttgctcttctggtataaatcagatgtgtcccttcaacctctttctgttttggttttttagaccccattgataaatacttcttgattctttcaaactgccttctcccactcaagctcaaatccaaaaaagaataagaacagtgtcaattataagaaaacagtttagagaagtataacagcagatgttgaaactgaagccttaatatttacatatatttttaaatatatatatttaaagctgaggtaaaatgggatagaatttttaaagcatcccagaagagatctttggatttcaaaccaattactcttaagttacctatttaaatttccagctctggattcaatcaaagggtcatgctatttaatttctgagaaattacaaagatgtgctcaacacatgagtaggcaagacccactcatatactgagatttaaaaataactactctttaacatacctgccttcactttttttttattattattattattattattattactacaagatttgccaagaactaaaaccatgctacaacacttgtttaaatgaaatattacaaatataaatttaaataatctctattattctgtttttataaactgagtgtaaatgcctgtcttatgtgggaggacctcaggaagtctaattatcagcttcagaccacaaattataaccttaagcctttagattcaatggctataaagctaccattacctgcctaaacatggaaatgacacaaaaatgtcacagttcatgaattactgtgaagacacagcagtgttctgtatgtgtccaccaccatgtctgtctgtattgtggaccttaggccactatgacatcatcagctaatgatttgttagtagttactatggcctgtgccagagcatgtggcttttaattattataatggcatgattttttttttaatgta

SEQ ID NO: 37039 - DNA, 1539 bp, Bovine  19866880723826
ttttaaaacacaggtcagctttggcagattattataggagccacactgttgttcacatgcactgaaatttttttaagtgattgtgactaacatactgtcattttatgtcttataacagttttagtcaacacagtatttgttatactgcttgaaaatgcacccccaagtccacttgatgaatatactaaaaaccaccaaactgtgtatactttaacgggggggggagttttatggtatgtgaattatatctcaatttaaaagaaaactaaataaatctcaagaaataaaatagtagccaaaaatgaggaatgacattctgaaatgcatgaacaatattttagcagagctcttagctaggcccagtaagttaaacaagacgcacacagcaaggctaacatgctggtgatttcagagttaatgtgtttctgtactttgatttcaaaaagaaaataaagaaagagcctcagactcaacccctgaatttttattcttcttctgagaagcttccatgtgaaaaattactattggttttctaaatgtgaccagacaaaagcagggtaaacatgctacagtccattacttgcagaactagccagcccgtcagcctaaccatgtggggcaatggcaggagatgaggacatacaagtgcaccctgctttgtacagccttccttcaccacaggatatctttcatgtcccctgaactctattgaatgtggaatgcttttagagaagacatctaagaggtctgtgtggccgagctattttccttttcttttagtacaatggactcctttttggtttcaatggacttttacagtatagacaaataaaagcaaagaatacatcactcatttgcagagggagagctacaagatgactcagtctatccatgtccaaatataacaatacccaggtctgaaatccctttccagaagatgtgctttttaaagcaaaagaaaataaaagcatataataaggtcatccctaaggctagaagtgtcagtcacacctattaagagtttacataaagccatatgtagctttgaatgtcactaaagggaaaaaaaaaattttttttttttctgttaaaaactaaaggataatggccagaagggaacaagagtacagtaatggtaatattctgttaagtgctaactgcatgagtgggttcaatttgtggaaattcattaagctatcaaattatgaggtgtacttttctgaatgtgtgtatgttcataagagtatttttaaaaataaaaaataaagtaaaagggaaattgagttgcttaaaagtaaagagtttatttctaaactgaactaaaacataaaatttaagagtaatgatgagtataatgatgatgactatgatgacatcagctaactcttgttaataataaagctctacaataagagctaaaccctgtgtatatactttaccttgcatttataaataaaatgcatatattcttgcatttataaaggactgcaccatgtgtgacctataaacatgtccatctaaaaccccatacctgcagga

SEQ ID NO: 37040 - DNA, 1521 bp, Bovine  19866880779244
ctatacaagcaaaaataatctacaacttatgacctccttaatattttctttagatattaaaacttgcatctaggacttgctctcagaccatccttagcatatgcaagccacgtgccctgtcagttgttggctggctgacctctgccttggtctgggcaatgcaagcttagtgcccgctccaagagtctctggttaaaatattttcaactatgctgattcatgcccagctgtttgggagctacaaagtagaaacagaagatggccaccaggggccaatttaacagcaacaaatgttattttctctgctgaactaaacaagttggaaacccaagactccagattccaaaagctggcacctaatttcaaagagggcatgtggaaccacacagcccagtccacaggtaaatatatacaggccaattttgatcacagagacaaccagcaaattagggtaggaatgagagcaatgaaagcagctcccttctcgaattttgccccttttgtccagttgcataatcccctcttatgaaacccaagactgtcaggaaaaagacctggcccaagacctactaacagattaaacaggactagaaaaaactgaccaactgcaaaagccaattaattacaaagtgcaaacaaacatggaaagtgcttccttgtgtacaaagggcatggcaacctcagtcatgatgaagatccagcaccccaaggcttgaaggtatgtattttacattcagtatatcacatgatcatcataaacttgtaagagaggaaacagcacccccaatttagagatgataaactgaggctggggaaaacatatccaaaatcacacaagtaagaaagccaagctggggaattccaactgtgtccgtctgggatcaaacttgccctttcatttcatcaggctttatctcccacaagaaaaataacaaaacagagcatagaatagagaacattcaggagttatacagacaggtggtattagtaagcagcagggctccaagctcaggccagactctatcattccatcagagagacagcaagagcaagccagaatgcaaaggccatagttacaaatgacatcatacttggcaacaaccatcttcccaaagtcagttccctacacccagcactgtcaacatgaagctagaaaccaggtacaaagtgtggagagctgggactcagttggcaccatgggattccagggtagggggttgtcacctgccaggaaaggtaacctggaccccatccaccaagaggctgaagctgtttaaatactgtctgtcttggctctgctgctgctgctgctaagtcgcttcagtcatgtccgactctgtgcgaccccatagacggcagcccaccaggcttccccgtccctgtcttggctctaaggtagttcaaaaactaaagttgagccttcaggggagaaactcaatgtggagagggaaagggcaggagttttaagacaggactgacaattttttaacctcaggaccagggcaaatacaatcaactttc

SEQ ID NO: 37041 - DNA, 1644 bp, Bovine  19866880811506
ctgatgattgatctatccaaattcatagcaggagcacaaataaggatttgttgagataaattactgtttggcagggagattacataaggcaatgaatttgcctttgggtgacagagtatgtcgggggaaaaaaataaaaacaataacaatgttttaaaatactatttatgttacatattaagtccaacttcttgtgaagtgttaaacacacaaggtaagcttcagagcctacacactcactgttctctgtttcctgggaaaacaaagtgtgtgtaacctgacctcatttatactgtgtgggtggcttgggtttgtttttgtttttttccattttccctttcactagtgagtgctatctattattcactaaggctccagacttttctgcaagatactctttattcctgattaactattcatatagtagaagatggtttgcttggccttttacaactttttccagtccattatcaatatcaaatcatgttccaatagccacatcactctagcaaataatactacatatgaaggaaacagtatagtgaggagatagtatcgaactattttaaaactacagtgatgatacatatatatacattaaatatcctaaaatgaatttgctacaagttacccttagtagaatgaaaatatggtaagttcaaagatgctaaatccattattaaggtagttgctaggcaacagctgaatccaacttatttaagtactagttcatgtaaattatatattctttctagatacttctaacctaaagtaagtataagattctcttccaaatcccttttttggtacttaaaaaacttaactgctagagccatctttacctgtaaggttatttctgtggtcctatacctgatgcccatgaacgaagttctaaaattaagcatctctacatttctcctgggaaactgcaaaagacatcgcagaacactaggagtattcaagagtgaaaaaggaaatacggtagagaaatgctcaagtgaacactgcaataaaatatgcgtattgttttgtgtaataaaatacgtaaaagtttgtttcacaagtaaaaagcagagacattcaatatggggggggaaggctctagtgattccagtcaacctcagaatcttgacaactccactatttaatttctatacatagtatataataaataccattcttttcctgaggattactaaaaagtgtgctctacaaccaaatcaccataatgaaatatctgtacttgaagatatgcagacaagaatttggcagtcatttggtcctgaaggctttggataaaagctgctctgagagatgaggcctcttaaagagttcttaaagagttcatgcagccttctttgatgataaacagacccagctttggaagtatgtgtatttccatagtttctcaaaagttccactggaccatgaacaaaccaaagtaatttttaagaaatattaaaggtttggggtttttttaagcaatcactactttgaaagaaaaagttttaaaccttcccagaaacctaaaagcagtacgcaattatagaacacaactcaacttccacaactgcactcccactgtatatttaaaacttaagtaaaaattggaatatgatcaataatctataatgactttgtata

SEQ ID NO: 37042 - DNA, 823 bp, Bovine  19866880815542
ttattgggggatggacaacaggggataatcttggtccatcagtttgacataggaaactctataaataaaaacaatttcatccactttcaccttcatattttgacatctggaggctggttttgaaatcaggaaaacaacagataagactgaagaggaaatgctatttggttcatgtcctagggatattatttaacaaaagggctgagtgagctatttcaatagctcagcaagagagaaggcaaatgcactatatgctacttacgatgcttttagaaacatcccaggaggtatccattttggcaacttatacacattcctttaggcattttcctgtattggttccctgacttctatatagagaaaagttttatccattgcaagaaagagaggcagcaagaagtatatgcattttgatgatgacaagaaagcaagtgcaatatattttgagatacatggtcaggaagtgaagatatcttgcttctgtgaattactgaacacagccttctttgatctgctatgtgatattttacatgcattgattatatatatacatattttatagctttatacactatatattatattattacatagttttacttgaaaactattaagaaaaaattatgaggatctttttcaaaataccaaaaacttagattaaaaaatatatatagtgatacagcaaaaaaaaatttgatttctactgaaatgactgatatttattatcctactataaataaatttcaggaatctaattgtaatctcccctgtttccagaaatgaagatatatgggtaaaaaacctaaattctatttctaatctc

SEQ ID NO: 37043 - DNA, 876 bp, Bovine  19866881049489
ctgtttcttgcattttctacttattcctgtccaacaagtttcactatttatttatcttctaccgaataaagtccaaattcctttgtctggaattcaaacactttctgatttgaattcaaacctacctttccaactttatttcccattattcttcattactcccctattagatccaaacaagtctactcactgttgaaaaggcaggcacattccagtccagccacctttagtaatgccatcatccctcctacccttgttctcctggctgaatccttcctatttccaaggatcaactcaaggcccagctcttgtatgagtcgtcaccagccacaccaggatgcataaaaagtctctctccctttgaagtcctgaattaggttatgtaatattcaaaaccactcatttggggctcaatataaattctctcatactaatatttcttcatcttatttctatgtcttaagtcctcaaataaatcttaagttccccaagggaacagatttcagtcttctttatcactatattttatattacctctaaccagtaacaaattaatattacatgagcttcagctaataggattttaaagcattcatgccaggatgcttaagcaagttactatttgtaagccaaacaggggagtatatatcatcagaaaatttcattatttcattgttttcacatgtcataatataggacaacaatttctttaaataaaactatagaagtcccaatgtgttctcaagccaggaaaggataactactaaagacaaaacaatttccacctgctgaaaaaagcagcaataagtttaatcacagcaaggtagtttctctgcttgactccacataaaatatgactgtgctgcaccctgcagt

SEQ ID NO: 37044 - DNA, 1938 bp, Bovine  19866881933498
caaaactaataaaatattgtaaagtttaaaaaaaaaagggggtcttttaaatttgcagtattgaaaagatttactatacatttggaaaccagatatactgttcataaagaaattccagacattaagaatctaaacttaaaaagcagaatgataaaaaaaaaaaaaaaatcagaccatcgttaggatgaggtagttattcacactatttgccaagctgatctggtttgctcccttgctgggtgcacagtgggacagcacttcctgcctccctgtggtcacatgaggccatggaactcattttggctcatgaattgtgagcagaagtggaaggggtgcctgtggcccagaacatttaattggctatgtaagatccctcagatagtgaccggcagtgttcatggcagtggctgctccataagcctgcatcccagaatgaggaaagaaatcttgcatcttgtttatttgttgatgtatttatctccccgctcccaccttgcattgggcttcccttgtagctcaactggtaaagaatctgcctgcaatgcaggagacctgggttcgatccctggatcagcagacctgggtttgatctctgggttgggaagatcccctggagaagggataggctacccactccaatattctggcctggagaattccagggactgtgtatagtccatggactgtgtatagttgcaaagagttggaaacgactgagcaactttcactttcacccaccttgcattagaatgtaaacgtgagagcagagatgctgtgtcaatcatcactgtacctccaatgcttaaaatagtaactgactcataattaaatgttatacaaatatttgttactggttgatttcgactgaggccgaatttaatttacagattactttaggagtgaactggcatttttacagtgttatatctctttctttatttggctgattttttaaagaccagcagtaaagatttaatattttcttcatgcaggccttgtgtacatattaccgagtttactgctcaatattttacagtttttattgctattgagaatggggtttttctcagttactgctggctatgaggaatgctactatctttgtatgttcatcttgtgtcttggccagaatgtcttcgtttgtcattcagttctctgagttttgtaggtatgcagtcacattgtctacaaatttccttgcctttccccgtgacttgggattcttgggtgactggcttataatttgggggctccctgaacattatttaaattagtatttcatgctatttctatactacaaatgtacttatttggtgttctggatcacagctgagaggttatgcccctcctctttccttatgaaactgatgtttgttattcataggctgtgtcagatactggattattgtgagcctgtaacaaggattctggagaccatgtatatgtgggtgggagcgaacatcatcagtaaacatttgaggaaaagcaagaagctaataaccccagctggggacaagcttggtcaggtcatcgaactggttgatgttggccagctagctccaacacatgatctgaggaatggaggcagttctccaacctgaaatagaaactctggagggtagctgacatagagaaggtatcaagattctgttcagggccctttttgcccaaacctctagggaagcaactctccataggaggaatattttgatggaaaagaaagctgtggctttcaagaaaggaagccccccacaagctgaactctccaagaaaggtccaagtcttggagaatattggattaccatttgtctctaatatgcatgatgcactgggcctcagactcagcacgatgcagcagccctggggaaggttcccttgacctgagacagagtcacagattcttccactaggcttcttagtagccctctgtgcccgctt

SEQ ID NO: 37045 - DNA, 863 bp, Bovine  19866880452466
ttgaagagttgtgggactgacccgtgtgagaccagggtctgccggttgggcttgtttaatccacaggccagttttgccagaacctggagcatgggaagcataaaaacctcattactgtcaatacccacacacggtgaatattaatatacacacatacccacattcacacacaaggcacagcttaagggctgtaactagtggtttccacattaaaaacaaaaacagaaccagaaactcgagacatctccaaacctgggtgtccaaaacatccacagtggaaaacatgacccactatcattatcctcattgttcttcccacatcttccattctgtttttctttagtagtttttcccacccatctgttccttaaggttctcctacttcaagagggtaaagaacaaagaagctacagaagagacttaagaggcatttcttagtgtgtccatatgaaaatgctgaaacaaactcattttgccctaccccacttagagacagacatttcttgattaatggtcagtccatttttcagtcccagtttaatacagattaccatcatttagtatctgtgacaaagactgggctcaaaatcatcatccaatagcaaacatctcatactattaaataagacttcaaaatgaaaaacacccatgagaagtcttttcaaagaataaggtacttcagtggtatcatttcacaaattataattggtaggaaaaaatataaaatcacttcacattcatgggagaaattctctgaaactttctactaggtcatatttagtttaaattactacattgagatttttgtttcctttccctccacctcccaaaactctactgggtaatttggcaactttcctctc

SEQ ID NO: 37046 - DNA, 1560 bp, Bovine  19866880471251
tctttgtggaaatgcgccatcgttcttataagaagctgagggtcccctccaggcctgtgtcgcaggcccttcgggggacaaattacccacaggttagctccaaagtgcagaacctttcactgaagggggtaaggccagagagggagcaggtacaaagtaaactaagcagctgacaccaacaaggagcaaccagactccgtgagagacctgtccagggcgccagtggtgtggaggcagggggagccctgtgggcaaggagagcagacagctatcaggtcagcctttaatcgttaggcaggtagctttgcattgagctgttcactcctgcagatgttctgagctgtggaatatctcggggtgctggtggtacaagaggttctctctgaagccaagggttcaggtttacctgtgaggtcccaccagtgaccttgacctctgcaatccagagctccattgcaggcactgagagcctgcacacgctcagtgctttgggctgtagcggatggttcatagcctcctctaggcaactgcaggtgttttcagtggacccgcctctgccacgccttggagatgctcaggggctgcccacaggcagtgaagctgatagaagcagtaggagctagtgctcctctctgctggctccctaggaagttgggtggctcctgattgtgcagagcccagtctgcctgccacccctgggtgacccctcttctatatcatgagccacagttcaagggtgctttaaaatctttgcacctgatgtcgggaatattatccctcctaactcagaagatcagcagatggaatgtcctggggctggtcatttgttccctatggctaagaccacgaagttcctctatatttgttctcttcttttatggtgataaaagttttacttcagaacaacactctccaccaaggactacattctcccatttcctttgctggtagatgtggctggtgactgggtcctagccaatggaatggaaaggaaagagtgctccctttcctttttccctttccccctggctggaatgcagatgcaatagcaggagctggagcaggcattttggaccatatgatgaaggctgcccattgaggaagacagagcaacaagattgaaggaagctggatacctatagcaattaagtcaccacatcctctgtggactatatacttggatgtacatatgtgggagagatcaaattcaaccctgttaagtctctatatttcggagtttctgtgttccaacagctaaactatatatactcattattgttgtctctcaatgaaatggcatcatctggggctacatggttatgtctggtcactggagcggctggggctccattctttggcagactactacttttatggtctccaacagatcatccctcccactatttatacccttgtgtggtctctgctcacagtgactctggatctagccatgtgacttgttttggccaatggcacattagcaagagtgatgcaaggagacactgggtagtacctacataacaggacttgtactatgagaattctggctctcgggacacc

SEQ ID NO: 37047 - DNA, 1426 bp, Bovine  19866880478509
ggaatggctacccactccagtattctggcctgggaaattccatggaaggaggagcccggtgggctacagtctatgaggttgcaaagagtcagaccccactgaataactaacactttcactctctgttcacctcaactctcaacaccagttccatggaccttgtacccctcatctagccctcagtccctgtgctcccactcctttccttctacaagtaagctttcactggccccacagccctcaagctgttgaagcacaggcacatgggcggcccctcctcagtcctctgggagggctcaggtggatcctgccccgacccctgccagagagaagctcagagtctggggagcaggtcggcaccgggcaggtgccctgctctgctcctgtggctcctgcccaggagggcgtggcccctgagctcaggtctataaataaggtatctgggaggaacggctttaatttgcactttacctattggtgtttactttgctatttccaatatggcaatttaattctgtagggcgcctggctgggggtgggggggcacccgggccatgcggttccctgaccgcaccaggactgactccgggtccctgtgcagctccggacacagatgccgccgggacagccaaggtctgtggaggccccgggtgtgggcacggagtggagggccttgtcgggacatcgagacccctctgtacctagacgcccggtcctctgggctctgtccagctcctcctcgggacagcactgtcagtgtttctcttccctcctgcccaccttccacatctcttcccgccttaggtcaaggcctccctctctgctgagatgaccaccctcttgccacccattggggagctctctctagagttctctcatagatatgcggctaattaagggacagtctgagatttttctctgcctcgatagtttgctgttttaaatttttgtattttgtttctccgatgagactgtgggctccctgagggcagggctgtgtctcccccagacttgggctccttgaaggcagggactgtgcttttccctcagattaggggtcttaaaggccttggtcctgctgtactccctctggtcagggttgtccaccagggccacccagagcacccttcccctcactggccggaaggaccacactaagacttttgcgggccacgggcacctttgcctctgtgggccctttcctccatagacttcactggcacaaagacaacttcactggaataaagacaaacctgtttgtattatatatgaaaaccttttctttggcttaaaagaccatctttttccttttaaccttaaaataaaataaacatattcgtgggccctaagcaattatattccaagttcttaaaaaaaaaaagaaacaagaaccaaaactgtaattgaaaaataaatttcttaaata

SEQ ID NO: 37048 - DNA, 1466 bp, Bovine  19866880498101
tggcctctattgcatctcttcttgaggtcagatattctgcagctttggagagttaattccatgttgtgagaagctgatgtgatcctcttagaatgtattaaatcctagtgttgtaaaaaagctttcctgctaaaagcaagtgtgtgggaggccattaatgctgggtggacaaatgagaagtaatggggaagagtgggctcttggagtgcatggttcaggcaaggatggacaggcagacccatatttgtaaagggcctgaaatgccagtctcgagtcacatgatctgtccagagcaatgagcttatagctgcagaggctgatgggatgggaggagtccgctggaaagctctcggcagagtgagagctctgggagagtgaattgaggccctggcacagtaagggtagtgcctcctctaatctacctcatctttcttcctggccgcaggacaatccacgggctgatctacaatgccctgaagctgtttatggagatgaatcagaagctgtttgatgactgtacgcaacagtacaaggctgagaagcagaagtgagtctctcctggggggtgtttctctcccacaccagcccccgggcttctctctcaagcccatccaaatcttgtctttgcttcctccctaggggcaggtttcgcatgaaggagagagaagagatgtggcaaaagattgaggagttggcccgacttaatccccaggtgagctggttctgccatcaccctgcactgagaggtccccgctgggggtgggggagggacgtttgaggagggcagggaagcggacagggccacacaccacccgggtggccacttgtctgcctcctttcctcccagtatcccatgttccgagcgcctccccctctgcctcccgtgtactcgatggagaccgagacccccacggcagaggacatccagcttctgaagaggacggtggagacagaggccgtgcaggtaggagcggggagcacaaagacaagccggccctgggagggagaggaggctggagccgcagagccggggactaaggggaggaagacggtggggttactcggggtactcgggtcgtcatccccccaccctctgcacacgcacacacagatgctgaaggacatcaagaaggagaaagtgctgctccggcggaagtccgagctgccccaggacgtgtacaccatcaaggcgctggaggcgcacaagcgggcggaagagttcttaactgccagccaggaggccctctgacctcctcacctcccacagcagggcaacggcccactcggccctgggacactgccccagccctcctccaccctctgctccccactgttgacttggggcaaggcagggcctctctgctctggggagggggggacgcggccctggaagcaggggcacccagagagtggcccctcttctcccccaaaggtgttcatgcctccctgcgcctagtacagacagg

SEQ ID NO: 37049 - DNA, 1877 bp, Bovine  19866880499676
atcgcacctgcgtctcttatgtctcccgcactggcaggcagcaatgagccacgggtgtcacttctctccctttaccatgtgtgatattagcagagaagcacccacgttttcagacgcctgatccaatcaatgtctttccatcattctgattggtcacagcggactacagataccagcaaagtgaatcctctctcctctccgaagccctcccactcccccatttgcttctgcgtggtgaactcaccttcctaaacactctggaacgttcttccatctattgcacccttgaccaagtgttgtctctcatacttcatctgattttcatcatcttgtctccttcctgcctcctacccaacctgagacacctccatagaagataccctgaaactgaattgagcccatcctaagtccctcagcattaacaccaacctcttttttatcaccacacctccactttatcttgtttttaatatttatttatttggatgcgccaggtcttagctgcgggatctttagttgtggcattcaaactcttagttgcagcatgtgggatctagttccctaaccagggcccccagcatcgggagtgcagagtcatagccactggaccaccaccagggaagtccccccacctccactttagactgacaaattctccttgtggctatgcactggttctcaaacttgagtttaggtaagaatctcctggaaagcttttaaaatgcaatttccttttgagacttgagctatgtgactggactggtcattcaaaaaacacaatgtaggggacatccctgttccctgaaggcccagtggttaagaccctgtgcttccaatgcaggggggcatgggttcgatccctagtcagggaattaggatcccatatgttgctcagtgtggccaaaagatttttttttttaatgtaatctaacaaatgagaaagtaaactacatgttctggctcccccaccacaacgattctgatgggcaaacctgcagtaaggctcaggcaactcaaattttaagcagtacctctggttacctgccctcccactatattccccaatggactctggactgcatttttgagaaacacacacaaatgcccatcttcttaacatgtgattcccaatccctacccccatgactcaggacccagttatcataagttacctacacacctaagccagcaggtgcatgtccggtgcattagggtctaagcttctggcaggagacctggagtctgcaggttgcagacctgggacctgggagactgtgtcccactcacctgtgcgttcactcggagttaatgcacacagggacacgagagctcggggactccaaaccgagctgcaagaggggagaaggcacccgcataggttagccctttggacagggcctcctccctgccccacagctgccccacagtgtagcattactgggagggaaatggcctgaactccgagaagaaaagaggatggaaaaagtgacatactacagagggcttcctcaaaccactgattagctggagcagcgcctgcgccagccagctccaccaaagtgccagggggctcggcagggctgactgagcattgagctgtgaactcagagaagcccaaggcaggacctgcccccagccaccatggcagaagccccacaccctcgggacaaaggaccagacagctggggggcagggagtggcacaggactcaaggagggagagagacaaaccggcagcttgtgggcgaggccagcgcctgcgcccgcggccccaccacgtggctccgccagggccacagagcagagaggtatgtactgaggttagggagagctgagggaggctcagggacacaggccaaggatacccaacccggttta

SEQ ID NO: 37050 - DNA, 1966 bp, Bovine  19866880533375
ttgcggttgctgaggtctcagcctgtttctgggctccttcccccgctggaggattttgctgccttgcaggcttctagcctgatgtgatagttgatgcagaaggctggctgtcttcggggaagaaatgctgctgagttgatttctcgtttcatgaaggagctccatgcttacctttcttttcatgtcctctgtcccaggggaccctggggcctcccacagccgcaggtaaagtgtgtgggcattcctgattgagaggaattcctgcagtagaagtgatatcactttatttgcaaagatggaccctaggtcttgctgggctttagttctgggtccctgggggtgttcccccttcctaggctgagacacttgttaggaacaccagggtggcacccaggaggtgtggaccctgccccacatttgcctcagattgctcgtgtgaccttgggcacatcccacctacctctctggcctcaacttgacaagcccttgctggaccttgctgtggtgacctttgaggccagcacagccttgccatctaccactccttgtgcttctgccacacagtgtagaattgtcctcctcgcctttggtgttgggagagtgctttcatccgagggttgcgttttattcaggagtgtctagtgcgtgggcaccgatgcgtctagactcgatcgactggaattagggtgtaattgcctgggtgccaaagggaatgagaggtttggggagagagttcgtatgagaaaaaaaaaaagtgagagttcttaatctgagtatgggaaggcagcagtccttacctggttgtctcagtatttgagggacaagtgtccgggtggggggctgcttttcttttgcacagaaggggagggctactggagggaggcttggagctgggaagagggttggggtgtgctttgggagcgcccccttgtgtgataaccaacggctgtacccagttctgcagtttacagaatgctttcacccacactgacagtccatcctatcaagaaggctcagagccaggatgagggcgattgggtttttgtttgtttctcaaagagtggaggtgggaggcatttgacaagtaaagaaactgaggcacaaaatgtgatcccctcaggacttcagagctgataagtaatagagctgttcccaggctctcatatgtccttgtgtgaacctcatcactggaagctatgaaatgctgcacatgtgccttgaaaccaggtaaatgttggggagtggattttgcagccaggataactctctgggtgggtttagaggcagtcccgcatagaatcagagggagtgtgtcaataacggaaacctagttctgggtacctgggggtgttcccccctcctaggcggagacacttgttaggaacaccagggtggcacctgccccacatttgcctcagattgctcgtgtgaccttgggcacatcccacttacctctctggcctcaacttgagaagcccttaccgaacagtgagagttgttgggccacagcattcaggattgctggtctccacccccaactcccgcccccttttggattacaaaacagccaggttaaagtgttcttttttaaaaaaaaattatttagttttggctgcgctaggtctttgttgctgcatgcaggttttctccagttacagagatccgggactactctctagtttcagtgcacaggcttctcatcgcaatgacttctctcgtggtggagcctgagctccggggagcgcaggcttcaatagttgcagtgtgtgggctcggtagttgtggctctaggactccagagcacaggctcagtactcatggtgcatgggcttagttgccccatggcttgtgggattttcctggaccagggattgaacctgtgtccctggcattgcaaggcggattcttaaccactggaccaccagggaagccccaggtaaagttttcagggcccattcagagattt

SEQ ID NO: 37051 - DNA, 1312 bp, Bovine  19866880600226
gggatcttccagacccagggattgaacccaggtctcccgcattgcaggtagacgctttaatctctgagccaccagggaagtaggttaaaatgattacccctcaaacaagtgatccaattactttaatctaattaatgtagttaatacagtatatgctgttatccagataattctataattccctttaacactataagagatgggtgataggtgacatcaagtatagaaaagcaagatctacttaatcagattacttagcaaacagggacgcagctcagccatcatgaatttctggcggatctgccataaactgaaaaggtcattaccataaatcctaatgataattatctctccagattttccgattcaaggcttctatctattcaaggcctccctgtaattgttatcctgcttgtggtttactgtactgtcaggcttatcttattatgtaaaaatgaacactaaaccctgcagggcttaagagtcagagagacctacctggtcccaactctgctatttcttaactatttgaccttgaatacgttattcaccttctctgaatctcagtttcctcttctgtgagatgcacattcacatattttcctatctccctaccagctttaaaaagatcaaaattattatgcaaccagcgtgggaaacaagcacttacttctttgtctagcgttcgaaacatctggttgatcacactttccaaaaaaaaggtcatggcttcccactgcacaaatgatggtgagaatatggagcagaggctgctttctccagttccagctgtgggagaagaggattttaaagacacatacacacacacacacacacaagcactataggatcacagaagacatcgagccagtggggcctcagaaaccactaggtaatttcacagttgaaggaacaggataatctaaccctgctcagccagggaaaagaaaacgatgaaaagcagaaaggggtccttatcctgcttccacctctaaaaataagctatctagatttacctctgtgagccttgtctgcaaaaccagtttgactactgaatgagaatatacacataatcatcaaaaccagtgcctggccaattagacaattgagaaatattaatttccccttccttcccctttataatctgtccatgggaatctaaataaagatatctaaaccataaggaatccctccagcaaggaactgataattaagatacaaaactctgcttcacatccagcagtctcatgacaactacaagggctgtgtgcagataatggtgccccctccaaattcacaagtatcatcgaag

SEQ ID NO: 37052 - DNA, 1672 bp, Bovine  19866880635135
actgatttccttaggatggactggtttgatccccttcttgtccaagggactctcaagagtcttttccaacaccacagttcaaaagcatcaattcttcggcactcagctttcttcaaagtccaactctcacatccatacatgaccactggaaaaaccatagctttgactagacagacctttgtgggcaaagtggtatctctgcttttttatacgttgtctaggtttgtcatagtttttcttccaaggagcaagcgtcttttaatttcatggctgcaaaagggctcttttgagtagatacttttgtaaaagtgaaaactcaccccttagaggttatctgtaggaaatttaggttgaggtgaggtgtgtgtgtgtgttttatttgtttgttttataattagggtcttcatgttcagtacaaccttaactcagaactgtttttatttctgtggtgaaagaatgatcagaaatggtagagaaatgagaaaatggattaggttaatccaggaagatttcctgggagaaaagaccatgagttccaggataaaatgggatgaaaataaggtatacaaggcaggaaagggaattgattccctccgtgagtgagttgctggaggtctctctgggccctaagtcagctgtgatgtgccttcttttctctttcccccctttgtccccaggtatccagattacactccacgctgcagtcccggctggcgcctccgactcacagcctctgtcctgctcgccgtctttccactgctcgacctgcttccagtcattttgccaccaggggcaggcccagggcccacagggctcgaggtgctggcagggggcgtggcagctatggcctggatcagccacagcctggccctgtgggtgttggttcataccccatatggccactcccgggggcccctggccttggctctggctgccttcctcccagccccggccctggtgctgaccctgctgtggcactgccagcgaggcacactcctgcctccacttctcgcagggcccctctcccgcctgtgtctcctcatcctgcagctggctgctctcttggcctatggactgggctgggcagtccctgggcagccacgggaaccctgggcccatgagcccctcctctctgagggccaggagcccgaggtggctgaagatggggagagctggctgtcccgcttttcctacgcctggctggcaccgttgctggcccgcggggcccggggagagctccggcagccccaggacacttgccgcctcccccacaggctgcacccaacctacctagcccgtgtcttccaggcgcaatggcaggagggggcccggctgtggaggaccctgcatggggcctttgggcactgctacctggctcttgggctgctcaagttggtggggaccatgctggggttctcagggcccttgttgctgtccctcctggtgggcttcctggaggaggggcgagagccactaagccacggcctgctatatgccctggggcttaccggaggagctgttctgggagctgtgctgcagaatcagtatgggtatgaggttcggaaggtggctcttcaggcacggggtgctgtgctgaacatcctgtaccgaaaggctttacaactggggcccagacgccctcctgccggggaggtcctgaacttactaggca

SEQ ID NO: 37053 - DNA, 1407 bp, Bovine  19866880635436
cggcagctgcccgcctggcaatgaatcgtcccaaagtttgctgccttgtctcaataacttcgcttctgaaatgggcttgtgacaaagggtacattgatgtcctccatgggatgaggagggctgctcacatgtgcaggggaagcccctttggggaggcggcgggaagcggcagcatggacccagccacggagcaacattctccccggaatcggtctggtgggtgtggctggtctgaaagggctcagacccgggtgtatgaggtgatggaagacctccttgtttggctgagctggggtgggggccccggagggggtggggctgagctggtgcaggcagagcacttggctgtttggttgaggttgtgagatgcagctgtcctttgctggacactcccctctgctggggtcttcacagtcaagaggctccccagacctcctcaagaccccatcccaggaatctgtacttttagaggttggggtctccatgctgcctgtcgggggcccctgtggcttctggcaagctgagcggcctagggtggaggcccctggagctcatggttctggatttgattaggattttgtttgttcaaaagttactaggaacagtcttttttgttgattcaatttaatatgcatacgcatgtgcctatttggttttctccaccagaaatctggctctgcagagctgcgttggtttgtggccccacctttaggcctgaggtgatccgtgtatttaatcagtggattttttatgagtgtggggtgagccaggtagtggtcacacatctgtaggcccacgggctgccctcactagatggcctgcctgtgcccagccctctgaatgtgagagaaggattggacaagaaatagccctgaggcggcccttgttgagcccaacagggacaaactaatcatggcttgatggggtgtctgccctgggtcttcagccacgccatattacgggacatcctccaaatgtctgctcactgccaggcacaggatccacagaggtttggcccatgagccctacaggcttgcatcatcaaaatatgtgtgtgtacgtgtggtgtatgtatgagcatctgtatgtgtgtgcatgccttaccaaaatgggtattaataatcctgactctgccacttacctgtatgaagtcaacaatagtaactctatggcaactgacttattctccgcatacagtacctttgtttcctcatctgtgaaatggggacaatggggataactacttcattgggttgttgtgaggttaatatggcaaaacccttaagacaatattttgcacacagtaggcactggcctggagaatcccggagatgggggagcctggtgggctgccgtctatggggtcacacagagtcggacagactgaagcgacttagcagcagcagc

SEQ ID NO: 37054 - DNA, 1034 bp, Bovine  19866880653031
aggtgtgggatggggggagtggtaggaaggaggctcaagacggaggagatatatgtatacctatagctgattcatgttgtcatacagcagacaccaacacgacattgtaaagcaagtatcctgcaattcaaaataaataaaaataaaggccagctctcaattaaagtcagtattcttattcttacagggtctggtgcgggatgccaaccctgccttcatcacctggcgcctgttatctgcctaggcaggatggctgtcccctctgcacagatggagagactgagccctgaaggggaaaagtgacctcttcaagatcgcacagctggggatggcagaacccaggtcctcttggggcccttcccaggccatcagctgtctcttgatctgtaaccactagagccctcccccagcctgacccctcaccaaagcgataatgagtcccgctggtcaaccccagcaagggaaggtgagggccctgacaggtgtgcgtgcagcaggagcctggctgagcctgtccccagggcctgccgcttggctggtgcctccagccagcccactcaggacagtggctatttttagcaagtgctgtttgcccggtggtgggaatatttgcgaagggtcagtccagtggcatcccttggctttcaactagaaacagctctcggatgtacagtcgattggctgagagcatgaggctttggcgagccttttccctttacagaatgtggctgtttctccttcctgtccaccctgttgccaagcccacagcttctgttcctggctccctgccgccaagatggtgacagccttcccaggtctgatgggatgagcaaattgggcaaagtgtggtttcctggccctggccgggcatctcccctccgctaataaacctgtggctaaccagccacggcctcgtgctccgtgggttagagcatcacgccagcgaggccaaggtcaggctctacgcgggccagctggcttcgcgggggggtgcgttctgccccacgcctcagcctgcagccctcgcgggtgca

SEQ ID NO: 37055 - DNA, 1133 bp, Bovine  19866880670041
ataattgttttacagaattttgctattttctgtcaaccctccaaccatgaatgccatgtttaactggaggatgaactccagaatttattagaccaaataatccttggtgggttttttgttttttttttttgctgaataattgccaagcacaggctctctagttgccctgtggcatatgggaatcttagtttcctaagcaggaatcaagctctcctcctgtgcgttagaatgtggattctaactactggaccactagggaagtccccagtcctcagtcttgtcattattttcagcacagcaaaagcttactacctgccatgccaccacatgagtattttaggattttagttgctaacttctggatgcttcagtacactgtctttgctgttctgagtgcggaagaattataattttgtacaaagaatctgttttcctttttgacacattttcctgtgataaaacccagggtcttgagtgtggcggttcactgaactggagttccagtcctgtgagtctgctctgtcccagcatggttcttcaaagggcattagctttcgtctatcttgcagaccttctctgtcaccattctttgtcctcacaggcagaggacgtggtgaagaagaaacctcgggccactgctgaggtgagcagcaggaaatgccagcaaactctggcagaactggagagtgtcctcagccacctggagggactctttgcccggacactagtccctcgagtgctgatcctccttgggggcaatgccctcagccccaaggagttctatgagcttgacttgtcccgattagcccccaacagcatggacccgagcctgagcacagcagcttgtttgcgccgcctcttccgagccattttcctggctgatgccttcagtgagctgcaggtccctccactcatgggcaccatcgtcatggcacagggtcaccgcgactgtggagaagattggtttcgacccaagctcaactacagagtgcccagccggggccacaagctgactgtgaccttgtcctgtggccgacccgccatcccagctacaacctgggaggattacatttggttccaggccccattgacactgaaaggcttccacgaggaatggaatgctcatcgtgcac

SEQ ID NO: 37056 - DNA, 1602 bp, Bovine  19866880678430
cggtcacccttgaggggcagagaaggactgagaggcactgggtaaggctgtttattgatgtaggtgctgattacatggaggtgtccactttgtcaaaattcatctgcctgcactcacaattcgtgtccttttcttatgtgtatctgtaccattaacattatacttcaagatcaaatttattacaaaaataaggcgaaacttttaacagctccagaggcacacttctcaagcaatctcgctactttgtaactacagtcaacatttttcaaataccttttgattgacttcgggattttccaaaagcactgaactctctgacaactgtcttgtttccttgcccgaccaggggtgcaccctgttttcaagtctaggttcctaccacagggactctggccacaggcctgagaagtcagtgagtcttctgccgcctgacttcatcaccttcttatttctctaagctatagaagatgcttctggtcttagaaacatatatatggtaacaaacctttccttgactaaatattctactaccctctcaacttgcaagccatacttctttgaaatctcttttctccttttgaaatcagaacaaaatattatctatttccacagacatgtccataatgacaacttgttcagacactccagccctccaatttggtcaacattaacttaaaaccttggattctgttgccagcagagcatccctaagacatgagtaatttggtctgcccaattgcgactgtggtcttacaccacagggtaagaggccaaaacacagcggaacagagctctcacctgaactcagaaacactctaacatgtaaaaaagcaatcacattttgctttggtcagtaagaactgcttctctccagaagctctcttgcgctgaagagactattcttggatcatcaaacatatatcaagtaatcagtaagtctagattttgtgtgtctgggggtgaaaccctaattctacattttaaccaagctctcaggtgactgctgatgctgctggtctgaggactcagctttgagaaataaaaactgaggaccctgccgtggaagaggtgccatgcctgcctttggcatgactggtccagttgagagcatagtcactactaataaatctagatgagctcatgtgaacatctaacccagaaaagcaccaccacggaaagcaactgccccgctcccaatgaacaattcccttagcggcaacattttagactaaagaaaacttggtagggaatgaagttcaaagaagtaaaagaactcagggggcgctcaaaatgagaaaagccattttgagattagaacccatggatgtgttcacttggaacgcaggactcagacaagggagagccaatgttatttttaaaaaagaaaagcccttccagaaagaaccaagacttaatctctcatttaccaccaaattgtctgaagaaatataaacaaattaagctttggagatttgtcaggtaaagaggcttaaatacaacagagaaaaacccttagtctgactcaccttataagggcaagcaaattgtcaagaagtttcaggcatctgttctgtgcaggggttacggaatatgggttcccag

SEQ ID NO: 37057 - DNA, 2567 bp, Bovine  19866880689035
gaggcggacaggtgtgccaggagggagatgtggcttagggcggtgactctgactgaagggcctcctcctgtcccccaggtgggtgcctgaatctgcccgctggcttctgacccagggccgtgtggaagaggcccacaggtacctgctccgctgtgccaggctcaatgggccgcctgtgggtgaggacagcctgagccgggaggtgagagtgaatgcatgatgtgcttgtgtgcaagtgcatgtttgtgtgtgagcgtgggggtcagcaggttgtgtcaagggtccccttcctggggtccacactgtgcaagaaaagctcctggacccccgtagaacatcccaaactcttcaggatgtcctactggcccttggtgggccacaccctttgcttcagggcccaccctactcagctcccaccggcatcccctccccacctactgcagcagaggacagagatccagggagaacaaggtaccttgctcaggcctcacagccaactctggcatcacaaaccctcctcctctcccaccaggccctgaacaaagtagctgccgcggagcggatggtccgaagaccctcgtatttagacctgttccggacaccacggctgcgatacatctcactgtgctgcatggtggtgtggtgagggagcctgacctggcccaggcggggtgggggaggggcgggctccagctggtgctgagtgtgagaggacacgggacaagtgaaactgtaactgcgggtgtcgggagggtcagcttctggagggattggactctggaaggtcaggatggagccggcgtcagagatatgcgggtcaaatgcaagctctgctgcttccttactgtaagcccttggacaggtaggtcacttagcaccctgagcctcagtgcttctgctgtacgacaggacgctattagttcctatctcacggggttgttgtgaagattaggtaaaggcgtttgggccaccagaagagattatggggactgggaaggtcatgggcagtgggctccgaaggtggggagagatggtccctctgaaaggcctaaggctcctgagaggacaatggggcgcgaaggaggacccctgagcggcatcgcgaccccctcaggtttggagtgaacttctcttactacggcgtgagcctggacttgtcaggactaggcctgaacgtgtacctgacacagctggtgttcggggccgtggagctgccctccaagctgctggtctatctgtcggtgcgccacgcgggacgccgcctcacgatggcgggaacgctgcttggcgccgcgctcgccgtgggcctcaggatactggtgtcccccggtgagccccgcccattcccgtaggccccgccccctggccgagaacccgccccatcccatcccggaagccccgactcaaggccagttaagtcccgccctctcccgagactgcacctcctatcctgggagaacctcggttatccggcaaggccggctcactgcctgaacccctttccctccagagatgaagtcctggagcactgccctggcggtgatggggaaagctttttctgaagctgccttcaccactgcctacctgttcacgtcggagttgtaccctaccgtcctcaggtgaggggtcccagacaagccacctggagggagggcttgttagtcacatctcttactaacatcctagacacgtacactgtaccccggtccctgtcatccattccttacagacctaatctgaaccgtctgagtttgtctaaatctgggaagaggtggggcatttaatctttacaaagtgaacctgagcaaagtcagacaacttctctggggctcctttaaaagaaaacagtcgcagaaggccccatctgtccaacccatcccatcctactcaccacagcctaagcagagctgcccttggggggttgtctctggacataaggctcttctttcaggtagctattgacaggtggagaggaggtgggcagacagctgggcatgttcagaaagccctctgtcttctctagcacagcagtctgttccagctgctgacctcttcctttcacaccatcctctccccatcctctttctaatgacttctttattttccttctgcagtacctgattggtactatcagaacaggagcccatcctcctgtgggtgctggcttgggggcccctgggcttgggcgggtggtgggtgggaagaccacctgaaagaatccccagtattcgtagctgtctggggagaagggggcaacagggcctgccagcccagaaggggagccccgtgaggcatgactgcaagtaatttcaggtaccagccctctcctccgtcctttttctgaacagacagacggggatggggttgactgcactggtgggccggctaggggggtctttggccccactggcagccttgctggatggagtatggctgtcattgcccaagctcgcttatggggggatcgccctgctggctgcctgcactgccctcctgctaccagagacaaagcaggcacagttgccagagaccatccaagatgggagaggaagaggtgtgtgcacagg

SEQ ID NO: 37058 - DNA, 1713 bp, Bovine  19866880703532
atcagagtctgggtttggttttcctcctcgtgtaatgagggcgtgtcttgagagtcctcgctgtgatctggggacacttcactctcttcccacactggagctacaggaacccctgtttgctgtagctcttctagagctgtcgtttcacggagagatgatgagggcaaacaacagtaggggcataattcactttgtttccacaatatcccggtgaagtaggtactgctttcatccttgttttacagaggaggcaatttgaggcatggcaaagttaatgcacccgcctcagatcacacagctagaaagtagcagagctgggatgcactctggggtatgaaacccaggcagagccgccagtcccagctgctgttctgcatcatgtctggagatggggcaggcctgggggatggacacagccctggagaaatacatatttgtccttcagagttctggtgacattaagcaccctatttttaggtttcaggtgatgcaggctttgggccagtttgacctgcacgttgtccctgtacccctctgtggaatgggatgactaagggcagagatcccggtcaggtggtgagagcaggaaaggccacatgcccatgggatctgaacagaacaactcaactaatctcctgggctgggagccttggcctcacgccaccccagggtcgggggtggaggtgttctttcaccctgtccccgcccttttgctgatggccacttggagtaacagggaacttgcaggccacaggcagtgctctcagcttctttgacatggaagtttgtagggtcctggccatacctagaatcccagctgtggatggggaggggaacccacacctgcgtgaccactgcggggtactcttcctaccagccgtttccaggaaatggacttggctctgtttatgaagcagaagaaatccaatcccctccaaggtaaaggccggagaagttgttttccttttcacccctttctgctcaggacagcgccactctaagctgcagagagctgtcagcctccttggcagcctgcagtgggggcagtgctggggctgtgagccccgtgtattatccccagataatccagtccaagttcttttcatcagattctgaggattacaggggtgggaattgggggcctgggtcccccaggagctgaccagtgattaaagcaaatctacagttatacagcgaggcgcctgccagggcagcgaatccgtgtgaggaccaggactgtggagacaggcatatcaggcccctgggggtggtgtgggagactttttctttaacccctgccatcctgtgagagttgggagtggacttggtctctctggatgctggctttgtttatcattatttccttgactcatccaaagcagtctgatggttcaaaggaagcccaggaatccattcacatctggggacagggggcgtagaagatgtgggatttaactttacaacttgacctcatcctcctcagcttattgctgcctggcgcttcgttcagagggcatggcagaaggtggaggggctctctgcatgtcttctgggctgtggtgtgtagcctgtcatatgtagactttgggggcggaaatggtacaggtcttccctcctgtgtgtaaatacataacataccccctacgtcacccaaagaggataacacactttcatcaccaggagagatactgtgggtgcatgatagcttgttaa

SEQ ID NO: 37059 - DNA, 867 bp, Bovine  19866880729404
cccaccaggctctcccatccttgggattctccaggcaagaacactggaatgggttgccatttccttctccagtgcatgaaagtgaaaagtgaaagagaagtcgctcagttgcatccaactcttcgtgaccccgtggactacagcctaccaggctcctccatccatgggattttccaggcaagactactggagcggtgaggtgtaagaaaggacttcccaatagtggaggttgagggaaagagcccattggctgaggtaggagccaaggttctcctgcctaaagcttagggggctttgagaaaagaatcatttgaatttatcttcggcttccaagttttaaaagtgtttgcctaatcctcatcttacttcatccgcatagtaagctcttaatatgtggcgagagtgtcatttataacataggtggggcaggcactgtggctccctcccatgcagggaggggaggtccccgaggcctcgagatggcccaaggtcgtctggcagagggtcaggaaactggggtgagagctctcgcacgagtgagcccaggttactggctttctctcatcctttccagggcttagtaagtctggcattgttttttgaagctgaggttttttctttttcaaaaaagcatttatttatttatttgactgcttcgggccctagctgtggcatgccggatcctcgctgcggcacgcgggatctgttattgtggcccaggctcaagagctctggctcagtggttgtagcacgtgtgcttagctgccctgcggcatgtggtatctcagttccctgaccagggatggaacttgagtcccctgcattggaaggcggatttttaaccgccggaccaccagggaagtcctg

SEQ ID NO: 37060 - DNA, 1085 bp, Bovine  19866880754087
tctctgagaggctatacagcagggaaaggtctcacagcaaagcagagagccctaagaaatccaaatgcctcggggttgggtcgcgggctctgagcggcccctgccctatggcaacagtagttctagggggtgacaccatgggtcctgaacgtatcttccccaatcagactgaggaactggggccacatcagggccccatggaaggcactggggattggagcagtgaggaaccagaggaagaacaagaggaaacaggggcaggaccagctggctactcctaccagcccctgaaccaagatcctaaacaagaggaggtggaactggcaccagtgggggatggagaagatgtagttgctgatccaggccctggggcttcatttgccggacccaccactagaaagtgaggacgaagatgagcagggagctacagaattgaaccaccacagctctattcccatggacccagaacatgtagagctggtgaaaaggacaatggctggtataagcctgcctgcaccaggggttcctgcctgggctcgcgagatatcagatgcccagtgggaagatgtggtacagaaggccctccaagcccggcaggccgcccctgcctggaagtgaccatcctgagagctgccctaactccctgcattccaggccagaaccagcacaggactgaacatatcctggtgtcacattcatctccatcctccccagctcccctccacatcaagacttcttctcagagacccactttattcagttctgtagatatggggacatcggcccaagcccaacccaccgtagcatgtatcactttgtggagaataatagcaccctatgtacacagccaaaaaaaaaagaaatccaaatgcctgagtttaagacaagcgtttacgttccacatacctgttttcttatctgtaaaataacggtggtaataatagcaacaggttgatgagggaaatagggaaatttatatttgtaaagcacttacaacaattcttggctgctaacaatttggctcttaggtacatcttacctcccaataataataataatattactactactactattattataaa

SEQ ID NO: 37061 - DNA, 2930 bp, Bovine  19866880790775
atggatgtgacagctctgaagcagctaagtgttagaaaaatgacatcctgagataaaatctcatcacctctccaattcaagcctgcccaccaaaacctctctggtcttccccttggtaataagagccacagggactggctgctatgactggctctgtccttgtctatccgtcactgagcttccctgtctttctttagtctggagactctcctagggcgtttgaccaacgaacctttttcacttcgaggtgactgatgaaggtctcctggctggttccaactgggtcccaggagaacagagcttcgtgtagctccagggctgtagatggctctgttgggggatctgtacaaggaagaagccacttaccttgggcttctagtccacaacctacctgcccagggatagtttggcctcagtcttggtctgaggattcaccccggggaaatgaccacctgccccacctagactcttctcctctggcttctcttggcagcatctgtgtaccacaactgaggggctacagatctctgctcccctgtgccaggttctgtccactagcttcccattacctgggctgtagtaggcctgggggtcatggttgggaaggtcgaggaaacactggatccggtccagggacactttggcctcaaggaggccattgatcacccaagggaagttgttgaggggaagaatgagcatgcgcaccaatgccagggcggtgaacacctaagtggggtcagaggttggggggggaggggttgaaagccatacctaaagcttaggaattatctgaaggcctgctctataggtggccctgcaaacaggtctgtggaggggagaacaggcagcaacagaactgagggcttagctggctgatatttgggttatagatggtagaggtggccactccaagaatatcagaaatcccagatatcctccagggacccaggtcactccctgataaacacacatgcccaactcacgctcatgagaccttctcagaatttctaaggggcaacatctcctggctagacccagcattcgatccatcctgcacaggatcatgagttttccccccagggccatcagaatgaggctaaggggacctaaccagaagttggggaggaagaggtggggaaaagaagtaattccttcgcagagggaagggtcatatatccgaggccccagatgaaaggtcccttcagagaactttccttcagtaggggaagaaggcagacagggaccctccactcctccttcccagcagcacgagggccctggcccaccccctactgcattgcagtctctctgctgctgcttccgtctcacatctccctgcagccatccccccatttctggccctcaccttggtggcagtgagctggtgccccatgaggacataggtgataaagatgacaatggagatgacgaccggcagggcagcccagaggtacacacaggctgcatccaggtacttgatgacccggagtcgccccagctctcgagctcggcaggcctccacgcgggtccccagcgcctgctcccacccgaagaacttgatgacacgcatgccactcagcagctctgtcacgagctagggacagggacaagagagcagtgagaagtggagatgctgctcacgtgcgttctcctctgcccagcctcccccaggctcctggcacgggatgtcaaggacttggagctcccctatgccccagctgggggcaggctggagctggaatcccccaccttcttagaagatgaagtggtggaaagtacaggggcagtggggggaggtcaccacactggggtaaaagcactccatccattagatgagggacaaagaaccattcccaaagccagaagatgtgggtttcaggggctgatcaacagcttgggtataggaaccatttctgtagaagtacacaccacagcccagggttgggcaggctgatagacccaagtaagataggctagggccagagaagctccttggatcctaacattcaaacatctccagactgcaagccagggaggcactgggagccttccaaggaggccctagagactggtcagtagctgtcatgggtagggaaaaagaccatgccataccagctatcagggacaccccctcaccattagcacttggagctatgccagtgagagatggacaactatgctatatggacccaaagcccatcatcccctctgaaaaggtaccacaatcactgtacattccagaactgactcagccagaccctcacacctagagttggcccaggcagaggagacagctgctcctttccccatagcccatcccgaagaggcagctggggttctcctaggcctccacatgcggctatggggcactccatacctgagatgaggaggaggctggagacttggatcctggctctaacactaaaatcccatttgggcccagacagctcagttcccacctctctcagggttgcaattagggctgcagaagctaatactatattactaacaggccacattaacttagtgtttactttgtaactggcactgtgatgagcagcatcttgcacgatcctcccaactgtgctatgaggcaagctatgattaccctcatttcacagatgaggaaacgggagtctcaatgaggtgaagtgacttgtctgatgtgattgaactagtaagtggtagaatcaggatgtgaaccccatctgtctttctctagtctgagctcctaacttttagagcacacactcactctctcaggtactgtgcatgggagacctgggcaccagaaggctgggtggggtctctggatggctgagggaccccaggcagcccctcaccttaactcgtgcgtctttgtgctgtagcatctcctggttgctggccatgatgcgggtggcaatcactttgttgacgggtaccagcag

SEQ ID NO: 37062 - DNA, 961 bp, Bovine  19866880809488
agacggctgtttgagtgttagacaggaacctgttcctacaccagagggggccaccctgctcaggctgaaaggcagattgattgattctaggatctaaaggcctttctctcctgttccataaaacctcaggatctcatgggatgccatacgcagctgagcaggttgttaactgtacaactctagggagaacattcacaatctagtctacatggatgctgccttcaagttttacagtatatgatctgatagctctatacggtggccctaccccagagagccctcccatttctatttctaaagtctcattttgccctttaataaccccagtgctattactgaaagtttgtagaactgctctgacattcccatagcaacccagtatgatgtcataaacagaggattagcacattctaatgcccaaccagcagatcttcttacccttgttacccatgggctaagtgccctgctggggagggacaaggaaggacgctgaggctggcagagggagagtaacagaggcgtgcacagcggtgggactgatggggtggtggggtggcgttcaggctggaagggacggagcgctccagctttcctgagctgcaggatgagctccaggagctggcctccctagcccaggtctgtgtacctgttgagtcggggtttggtctttggaacaaatccttcaggaagcttgggcctgtgatttgggagcagacctgaatggagggaaaagcatttaagaggatggtctctgcactccctctgcagctctgggggctgaacagaaagcccaagggggtaggaggctggcactggggggtgagtataatgcagtctctggacacacactgcccttttaggaggggcttggaggtgtggaaggtgtaatggtgcccacagccccctgccccctctgcccgaggccctttacctgctcggtgggccatcttcacacactcct

SEQ ID NO: 37063 - DNA, 806 bp, Bovine  19866880811941
gacaaggaggggctgaggaagatctcctggggaaagtcataaagagaccaagaagtggaaatgccaggcctggctgagacttcgtctccaccttttgttcctgtgtttttgccttcccgcccccaggcttcctgttacctgaaacaaggcaaatatgctgaagctgagactctctacaaggagatcctgacgcgtgcccatgtgcaggagtttggctctgtggatggtgagtggtgagggcctgggtggggcgctgcagggaggaaaggaaatgcagaccaaaggttggtggggggagggttgaccacagtggttccagggggagccagacccctgtagtcccatgctattggcctctgggtcctggatccctgcttagtgtccagctctgttctctaacctcgccaccccatcccgtgtatcacccccagatgaccacaagcccatctggatgcatgcagaggagcgggaggaaatgagcaaagtgagttaggggcccaggctggggaggcggggactttcggggcctctgacttattactgcaccagccctagctgcatggcgccttcccacacccagcctgtaccccatccctgtgccagcttgtatcccagcatctctgtacattcacctctggctttccctcccgctctgtcctgcagatccggcaccgtgagggcagcacaccctatgctgagtatggaggctggtacaaggcctgcaaagtgagcaggtgagaagccggcatgggcttgggcgtgtgggcttcacgccctctattggccccagatcccccctcctggcc

SEQ ID NO: 37064 - DNA, 761 bp, Bovine  19866880819002
gcccgggaggaagggatgtgggagctccacaggcactgggtccgcccgataaggcccccgggaccaacagaaggacggagagtaagggggagcccgggcacggggtccccaccgtattgagctctgtgttgatgcagctggcgctgtcacccccaaacaccaccacccgggctggcatgtaactcgagtcctcactggccaccagaagagtcagctgcctgggagaggagaaaggactcagtcagaaccaagggccctgatcttggtgcaaaacgacctctgcccaccacatcctcttcagaatcctgtcctctgcttaagcgttggtcttccccaggctccctgctcttcccgtaaccttcccccaaagcgatttcacttaaacccatggtttcagctgaaagttaacacctgaaggactccaaattcacgtctctaccctagaccgctctcctgagcttgcatgctgcgcatccgacaggtccatgccgtgcccacaggcacccccaggtccatgtgcccacatggatcggtcatctgtccacagaaacctgctcctcttcccacttctctcttggggaagaatgggcacccatccagctgtccagctaggacacgtgacacctccctcgtggttcccctcacccagccagcggcaggtacccgcagaccacctctcaagctcccctcttccaccgcctcctcaccatctatgcccgttcccgccgcctcactgaacgatcagcactcagtaaaccttc

SEQ ID NO: 37065 - DNA, 1025 bp, Bovine  19866880837480
tctttaccactagcaccacctgggaagccctggggattaggaaatgggtctaaagaaagaatcactttggagttcctcgagcaatgtcatcacagaactggcagcacgtgtgccgccaagtcctgctgagtctccccagcgggtcccctgactcactcctgggacggtggagcagggggagacctccttcctctggcccctccctgggccactcagttttgtgcttttcacttggatctgagttcgccgactcatcgattataaacatcctccactcaactgagagcattttgaggtcaggggctattaaatttcttctctgagccctacagggcccagagctggggctcaagacctggccatgtgtgatcaccaaactgtgggccccgggggaccctcactcagggatccctgctccccagaaaggtcaagaactccaaataaggatgtccattgcagccccagattgaaggtggagacatggtaggacttcctgggattcaagagccccgcttctgagcatcgagaacaggagagacagtcaggtggcgtccgggtaggaagaggaggagagggttggcttcccaggtgacaccgcagggcaggggtcgtcttccccccgacagggccatcgcccctcctgagactcacccaaacatggctgccgtctgccgggtgttctgctggggcggggtggaggtgctcgtagacaggagggcgtcattgcccgccttctcccagtcaaaggcctcgttctcggcaatgccccgctccttcatgctgttctcaaacactgacatgatcaactgcagggggcgggggtggcgggaggacaaaagcggtgaccccgggggctagccaggagggggtgggcaggtgcttggggtcgcagaggggaagacaggggccttccaggacagggaggggccaagagggggcattggaaggagaagggcacattgattttaaatgaaaacatgcacacaatatgcaaatcagcatgcaaattattgtctggacttcag

SEQ ID NO: 37066 - DNA, 946 bp, Bovine  19866880845079
tttaggagcaaagatcatgatgtcttgtagcttattttcaaaatggtttagcaaaaacagtgcgtatattgttgacatctattattatcacattgctttatattataaattggaaatagtggtaaatcactgttgtgttttttggttttttttttaactaacagctctttttgttcttttttctttcttttttaatttatttttcttcttttttactaacaactcttgactgtgatgtaaggtgtatggttattcattgtactctttcagcttttctgtatgtttgaaattcttttcagtgacatgaatgattgtcggggtaggggacaggaaggagctgggagaaatggagacagtagaatgagggcccagagaggacagggggcagtgggtcttggagcctactttcacccactgaactctactgctggtctggtgctgactcctttctctgccccaagcatcaactcaacccagtcctgcggaggcgtccccttgggtctcttttgctgggagccggctcccagcaaaaactcagatgcactcagtcggtggtgctgtgtcttctttccccagtgtgtaaatatgttgctgtggagctgaagtcagcctttgaggaaactggcaagaccaaggaggtgatcgacacaggctatggcatcctggaccggaaggcctcaggcgtcaagtatacaaagtcgtaagtagaggggagggagaggggcaccagcctgccctgctttgttccttgaggcatcagcgtcgtgaagttcccttctccctccccactaggcagacccacaaaaaggaggcagctctaactgagacccaggtttgcccactgattctaccctgaactgattgtatggccttccgaaatccccaagtgcccctgggcttcacatccttcatctgtaaaagcaagactattggacctcaccagtga

SEQ ID NO: 37067 - DNA, 2425 bp, Bovine  19866880874022
tgaaacccagggggcttaacctaccccctggacagcatgacttcagggggcaacgatttttttaaaaatagattacagtaggtttttctatctcattgttaaattgtgtaattagctggagaggtagtgagaccccactgttaataaagtaagagtaagggacctaggttggctaggtttgtggattaggccattttgaagtttgggtaattatgctgtaaagggctgaggagctttctgaactttgagatccccattgtgataaatatggtggaggaggaggaggaaagggcttgatgtttgaaacctgggctgcttctccccaccatcggaatggtcggttgcggtcattacccatccctgttcccaccctggtctctgggttctttcctccaggctcttgtttctttggagagattgagttgttctgtcctgagattatgcagcctgtaattcaggccatttatcagtgacgggcttttctcagatgttgggatgtatggcgggcgggcacgggtaatctctgcccatccttgccaaaggatctagtcagactcctggcattcagagcagggttgagtggtggagagggcccaggccgtggggatgaagtgtttggcagtacggcagctcggatcctttgacaggccctgtggccctggcaggcttcttgacctcacagtttgcctcctctctgaagggacttacttcctggagttgtgctgaggattaaatgtaatgaagtatataaagggcccctttcttgtgcttccctctcctgtggtgtgctgccagcatacctttccagctttacagtcacccccaacaataaacattttccacttactctccgtttcaacccagctagtctctttcccatccccgaaaacaccccgggggttcgcagaccttgctctcctctctggcccatctggtatgtgcccgtccccacgtccacttcctccccgaagctgtccccccatctctcctgctagaaggtgaatgcttggagaacctctggacctttaagccgtcttccatatttttgcccccccttgggtttttaacatactgaagggatttacttactgtagaattcattaccgtatcttatttataatagactcttatctaggtttattaaaaagtgaatgaagcttttgggtacagggcagagtgaccattggcagaggtaagaagccccatttcctgctaggctgtgtgttgggggggtggtctttgtgccttttccccgctttggattggggttgcctgctctactgtgacccagctaagacacctgacagatcttcctccctatcctgagctgtctgttctttgtggcagttttctgagttttgatggcaggatttttctccaggagttctgggtttgggcatccatctctacgtaggaaactgacctgccttggaaaggccacagctcaaccactgtgagcttggtgggggcttgggttacctatacctttgccactcgaaacaaggtccccagagaagtggcattagcattctctgttttaaaaaaaatgtattttatattcaccggggccaagctgtcagttgtggccactcttcgactttcattgtgatgtgtggggcctttcctttgcagcaaagcctttcctttagttgcagcacgtgggatctcgttccctgcccagggatggaacccgggccccctgcgttgggagcatggagtcttagccactggaccacaaggaagccctcagtctgcattttaacaagctcccaggtgaccacaccgaaggttctaggagtctactctcagcgtccctccttgcatagagactcaagggacagagccttcctgttgcaacagtacaaagcatgggccccagatcttgcacggtatttaaagactgaccttaagtaacttttagttcatgtgaacactctccagcgtggtatgtacacttaagaatgacctccctttgggctgagtttgaattaggttttcccaggacgtttgtccattaaaggtgtgactccagagggtttgcaacactaagtgtgaagttcagttccttggggagcctcagtttttcctagaggagcatgtgtaacattttacaacaagagccggtggagaaatcggatttgttcgtcaggagtttggtctgtagaggacttttcaggaacatgtttggttcacaaagggaggcagtgtctctgctaggctgtaacagtcgtagttgttaaaagttttggaggatttcatattttggagtgaggcgggtttgggtgcgttgtgtgtgtgtttaagccagtggcagcttctgtgaaggagagtggccagttcagactctaacatttgagccaagagcagtgtggggccagggcttcagtctttggtgagtccctgaggaagaaagggtcattaaacc

SEQ ID NO: 37068 - DNA, 1729 bp, Bovine  19866880877634
tgttcccactgcaaaggctcctgggagggccctggagcaggtggtacctggaagggggaaaggcactcacttgagagggtacatgcgaagggccacatccatgcctgggcagtaggacaggaaggccgccagggccgtctcctcaaacaagccaaagatcaggatcttgttcctgcaggcacagtcagggctggacccagagaagcccacccggcatccccaccccatagacacagaggcactcccccggggcaaacggagagagacagacaaggagacacagagggatggaaacagaaagaggcagtgaggcacagatgggtccagggagatggcgacggtgaaatatgaagacagagacacacagacaggccggggtataaaaagataagacagatctggagagggacgcaggaacatcccagcagcgcgcgcgcacgcacgcacacacgcgcgtgcacacacacacacacacgcgcgcgcgcgcgtgcacacacacacacacacacacacacacacgcgcgcgcgcgcgcacacgcacacacacacactttttggaagaagcaaacatttccagaaattgctgggaggtatcaggcccacagggacacttctgtcctcatccaggccctagagagcagagagcaccttggtggtaccaggtgtggctgtggtccttggaggtgtggctccccaggctgggggcggggatcccactcggctgcagccctgaggacgtcacctgtggtctgtctggtacagctgcggggcttctgatgctggagcttctgctctaccagcaggcttatcttggctccctggaaaggtggccccccgtctccacaggcatgtcaactccttgattcctcccactcactgctgctggcctggctgccccaaagccgtgtctcttgtagttaaaatacacactcccacacacatgaacaaatgcatgcacgcacatgcacacacatgcacgcaccagcacggcgtgccggcttccttctctctgccctgttcctggccgattctttcctgcatacctggcctgcacaggtcggggttccatcagctcccttctggagcgaggcccctgggccactccttgccaacatcagtctctcccctccgcagccccccgcacctccgcagagccacagtgtttgccaacgggtccctgcagctgacccaggtccggccgcgcaacgcgggggtctaccgctgcataggccagggccagaggggccctcccgtcgtcctggaggccacactccacctggcaggtgagtctgagggtctgggatgctgaggtaggggctgccttcagcgttgttgcccatgtagaggtttggcttcctgtttcctactcagagcagcttggagggcagagggaggaagaagatgcctggggtcggaagaggaggtgctaggggtcccggggatggctcgtgctgggagcggggaagcgggctacggagaacatcaggtgtcctggatcccatggtaagccggctgtctgctctcgcccctgcagagatcgaagacatgccaccattcgagccacgggtgttcacggccggcagcgaggagcgtgtggcctgcccgcccccccagggtctgccggagcccagtgtgtggtgggagcatgcaggagcccggctgcccgcccacggcagggtctaccagcagggccacgagctggtgtttgccagcactgctgagagcgatg

SEQ ID NO: 37069 - DNA, 1707 bp, Bovine  19866880881824
ctttggtggcccggggacgggggtgggagtgttggcatcccgtggtagcagcagcagggcagaggcccaggttgcgtggggtggagtggggtgcagagtttgaggagaagggcgactcagagcttccgtggttgggatcaggcattagaggaactccagagaggtaggacgaccaggcggacaagaagttacagaactcgagggagaggtttttcaaagggaggagcggctaagtgagatggaagacggcttcaagcaaagtcttgaatatacgttgaggctgtgaaagggctccgtccggaggggacgctgcacacgggtggccacccacccctgcactcatcgagtctcggtcctggcagagagaagctgcaggctcatgttaccccggaaccttgggttttctggttggctttcttttcttttcttccttttttttttttaagcctttgatgtcccatcactgcctctttcatttctatttgcaaacagctcagttgccccagagtttgaggtctggaatgcagcccggctctctctcctgttctgcacagaggccgtgcccactcctgactctgtctccataccccctacacaggcgctgaagatgctggccattgccagctcctcagagatctccacatctgtcaccagccaagattccatccatcctttgtttgacgcccagatgaccagggagatcttcgccagcattgactcagccacccgcccggactccgagagcctgctcctcgctctccctgctgctgtgatcctgatgctgaacacagaggggtcaggacctcccttcccgaatgccagactcctgttaagccccacgccctgccgctcccctgccccgggctcttgtgcttcgcagaagctcccttcccactgtcgtctctggatgaaatgtcctgcttggggtggctagaagagaggctaagtggttgagggtagcgaggttccagagatcagagacccctgtcctttcctggggttgggaggagtgacctgaggtcaagaggccaggtgtctggcctcagagggacccctggaacccctctgtccccagcttcagggctcctccctctgtgccacctccctgcttccatcacattcattctctttcaatttcttccgggaacacctccctcctcccaggtgctcctcagcggtgagaaacggcctcctcctgctcaacctgcttttgtgcaatcaccacacgctgggagaccagatcatcacccgcgagctgagagacaccttgtttagacattcgggcatagcaccggggacagaacccatgcctaccacccggaccatcctcacgatgcttctcaatcgctactcgaagccgccgggcagccccgagcgctcaggtaccgtcgtggaggtagttgggtgtgctgagcagctggtccccacccgcggccggcagggtccaggcttacgtcctagttccttggtagaaagacgtgatgacccttcaggaaatgaatgagggctttcgtgctcaagtttggtctcaagtaggacttcctgaccaggaggagagggggacgtttaggataggtgcagggagattggtcttctctgtataaacatgaaagggctgccatctgtctgagctgagtgcagtccactcttcctggtcactgcagggtcggttgaaatgacttctagagaggctttctgtagaggaat

SEQ ID NO: 37070 - DNA, 1368 bp, Bovine  19866880906384
cctacccaagccggcccttggttgtttatcgtgcaaagtgtggaccccaggggctgaggcctttcccacaccccaggactgagctgtcccgtccccagctttccaagaacggactctgtagagtgcacacgttgtgaaatgatcctgctgggccctccaagggatgaggccatttatgggctgagtgggctgctgctggctgccaagggtcaggcctgggacctgcatgtgccgggagccaggactcaggccatgcagccttgaggggtggaggggggggggggcccgcctcctccctgtagcagcctttaggagctgggaagcaaggctccaggcagccatcctggccttctctcccctactgaggcttcaccagaggagaagacggagggaaggaaatagaccttccaggctgaggggcaagaccggaaatataatctgtggatccagtgaaaaggaaaacacaggtcctttgttagacatcggagcactgagctgagcaggagggcccgacacacatcctgctggaggtgccctcagggtcctggggccgagctccacctcgtgttgaggaggcgtccgtggcctgagaggggcagagccttggctgctgccctctggaatggagcctgggaccctgctccctgtccaaagcccgttctcaggacctcggaaagtcttctctgtgtcctgggccctcccgctcctcttgtcgtccttgctcgtttctgagcctctggaaatgttttctgtcccccagaatctcttcctccaggaagccttcctttgctatttagaccagtttttacctgctgatcttttctgtgcttcttacccttccccaaaaggctcactcacagagctttgcccttgaacttctgagtctttgtttgtttgttggtatatgttagtgagagcatagcctcctccctagagtcttgcggggagtctccctcatcaaactttgggcttcctgaggacaagcatgacctctcttcagactgggggggctccccggagttggaagcctctcctggggcttcttccctcaggcttgcttctgtaccccagaggctctccatacattgccctcaagaggggactgtgccccatgagatggcctgctgtgtgtgccttgcagggggtcttccttctcatcctccaccaccttcgctgtccttccctgaccaggggcagcagattctgtgagtggggccgggtgggggaaatggagtcggggtgaaaggggggggactctttctccctccaccctcctcctagcagggccccagaggacagtaggccatacaacgtccttcctgtggcctcccgctttgggtgtgcgggaggagggctggtcttgagttg

SEQ ID NO: 37071 - DNA, 1783 bp, Bovine  19866880928512
ctgacttgacgggattctgacttacataaaaacggacttatgtaagatttgccagaacggatggaatactaatgtgattggggattgcatgtgttcgttgactttgtgtgcagatccccagccatcttgagctggaaaacccaaatttaacaccaaaaaccccttcaaaacaccccagaactctcgaggacagttgttgtaagatgggtatccgccatttgaggaaatctgtgaaggcaacaatctatgatgaagttaggaacaatttgaaatgaaatcgcctatcactaatctccatagtgggcttccctggtggctcagcagtaaagaatctgtctgccagtgcaggagacgtgggtttgatcccaggtcaggacgatcccttggagaaggaaacagcaacccactctggtattcttgcctgggaaatcccatggacagaggagcctagcaggctacaatccatggggtcgcgagagtcagacacaacttcaagactaaaccaccgccaccatctccatagtatctacacaagttggaaagaataatagcaaatgtattcaggaatcgtattcacttcactaggtgagcagcaatgttcattgcagcgttattatttaaagtgaaagagctaggatctactgggggacgttgtctataatccgggtagatgatgccactatctaactgcactgtgcagaacggtgggggcactgtaggtgaaaaatgggaagggaagacattagaacatcagaatgttcgcttgtgaaaatccagtggtccttgacaggaggagggggaagggtgggtggcaggaaggagccacactgatggtctcatatctaggtgctggaattccattccgagagcaaataagttagtgtctagccttgagatatgcatgagggtggtggggagaggaggcaggcaacaggtagagcacgcagactcccatgggcgatgctaagcagaagcttcttatccttagagagaagatgcttctctgggtgcgatgtgagagagaactgggaggctcttcccttgtgcgagttgagatccttcttacagtggttcctggtccatcctttctttgtttctctctggtttaattgcccactgagcccagggcagctgagtctagatcttcaaactacagttccagggaccctaattcccaacctccaaatctggacctgaggtctgacaagtcccagaagagctgtggggagatacaataatcaggacctccaggaaacaagagcctgagcagagaagctgggggcccactctcccctcccctactcactgtgtccttctgcctcccccgcctcagggagcagagagccatcagcccaaggcgtccctgggtctccgtagcgtcctccagcccgggtgcttctcccagagcaacgtgctgagaaagcacttgtgaggttgggggcaggggtgggggcggaggtcagggtgctttttaatttctcgttagcaatgacagctgtagaactcaagcaattaaggaggaagactcctccaggatgccagaggccaccccaccccccaagctgcgcacatcttcctcccttcctccttttccattacacccctcatcctccccggtccttcatcctcctggggtcaccctcacccatccccacccccaccctgtacatgcgcacatacatagaggcttcccctctctaggtccgggaagctgtggactgcaactatggggaggcaaggactgcacagggaaccatttctgtgggctttaataacgggaaca

SEQ ID NO: 37072 - DNA, 879 bp, Bovine  19866880956448
cctttcctttgcccccagatgagtgagcagttcgcccggcacattgaccagcagatccagagtggcctgatgggtggaacccctggagtggaagtgctggggcggctccagtggcacctggagcccatcatggtcctctctggcctggagctcgccacgacttttgagcacttctaccagtgagtgcggatctggagaggcagggtgtgcgaggcctagagtctgagggtgggggagacctgcgtcttagagggaaggcaagggaggtgcagtggggaggtgaggttaagatgcagagatggccgtggccctggggagggggaggatgaggcaggctgcaacagggggacctgtgttctggagcgggaggccctgccgagcgcccacattgaggctcggcctgggctgtgcacgctgcaggcactacatggcggaccgtctcctgagcttgggctcgagctggctggagggggccgtgctggagcagatcggcctttgtttccccaaccgcctcccccagcagatgttgcggagcctgagcacctcggaggagctgcagcgccagttccacgtgtaccagctccagcagctggacaagctgttcttggagcaggaggacgaggaggaacagggcctggaagaagaggaggtaagagcaagggaaagagtgggagaataggcgagcaggagagtctggaccaaagaagggagcccaagagcccttggaatccttctgtctctcaggaggaagaggaggccgagaaggagctctttatcgaagatccaagtccaacagtctctgtactggtcctgtcaccacgctgcggccggtctcccctactctgctacctgtaccatcccagaaagtgccttcccaca

SEQ ID NO: 37073 - DNA, 2069 bp, Bovine  19866880965932
tcagtcctcaaggaaatcaacccctgaatactcattgaaaggattgatgttgaagctgaagctccaatactttggccaccagatgtgaagtgctaactcattggaaaagaccctgatgttggtaaagattgaggcaggaggagaagaaggtgacagaggatgagatggttgggtggcatcactgacgcaatggacatgagtttgagaaatctccaggagatagtgaaggacagggaagcctggcatgctgcagtccatgaggtcacaaagaattggacatgatggagtgactgaacaaccaccaaaagcaaaaaataatcacagttcacatggaatggacttgagtatttcatgccttgtcacagttttactttttattgtgaaataacaaagaggtattacagtactccatgtgtaaataccagattaggtgctaggttttgagtacctgtgtgtgactgaacacgtaaagtgtctttgaattcctttttcaaattgtgccatatatatatatataatatatgtataatataatatatatttttataataaatacatcttccattttaataaacacaaagttaaaaagactgtctcactactggctttgtgtaattagaagtcatcagtttagaggctatttttttaagggtcatccaggatatcttttattctattatgaaaatagctaaaataatcaggaagttaacatataaaattttaatgtaggcacaaatgctttctacattttggtttctttccctaaacactttattaaaaactaaaattgtatcctgctttataagacataagttaatgaagagacaagttgatataactaaagtttaccaaaaaaatatatgtgtccaatatatgtgataggctaataaaatcacattttatattgttttaatataatctggaaaatttaaataaatttgaattaaattacctgggaacacaatgatacaagaaagcaaggctaatatattcagtgatcaaggtacacccagtgaaggtctatgcagccattaactatcaagatttgggaaactttaaaaaagtaccttgttaggagaaggaaatggcaacccactccagtattcttgcctggagaatcccatggacagaggagcctggcaggctacagtccatggggtcatatggagtcagacatgactgacgcgccttagcaggcatgtacgcctagtctcgaggaatcaggacagcaaactgcagtagggagctggcagggccacaaagcagcaaatctcctaaataaacagagccaggtggtgctgtagcccgcctccaagcctctacccaccggacccacctgagggtactgtggtcccagagcctctacgaaccagagatggagctgggcctatggacgcccccaacctgccggacctctcctgtgcccccgcccaagggtgatgggtggtctccagggctagaggagagggcagccccccaccagccttgcccacggccccctcctggcctccacagggtggtcaacgtgacgccagtgcccggtgacctgctccgggagaacaccgaggacgtgttgcagggcgagcacctgagcgaccaggagaatgcacccccgatcctgcctggtcggccccccgagggactgggtcccagcccccaccttgtcccccaccctgggggtcctgaggctgaagtctgggaggagacggatgtcaaccggaacaaactccggatcaacattggaaaagtaactgcagccagggagggcgacatgggtggccttctccccctgcccccttgctccccacccatgggtccctctccccagccacctgcctggtcgccctgcctccttggcctgacgccctcccgggatcactggcacccagtgctcagacctcctgctccctcctttgccctgagaaaaccacagccccacagccgccccatcagccccagctcatgggactcccctctcctgcagacccccgctgtggtggaggaggagcagacccgtggtgtgggggtccccagctccccggtgcgggctcccccagactcaccgacaa

SEQ ID NO: 37074 - DNA, 1375 bp, Bovine  19866881034829
ccaggaatggcccagagatgcatcgtctcttccaaaggaagctccaggcaccaggccgcattttgtcagtcattctagagctgtcatcctagggcttgctccatcccactgctgctaccacgaggccccgtgaaaccaactctcagacccaactgaccccccccgtcagaccccccaccccctgagagaggaagccaagagccccaaaccaagacaattggtcacggagagggagaagggcgaaaatcgtggccacttacttttcttgccttgctttatctttctttggtctgcagtaggtagagaaagagaaaagaacaaaacagagaggcgttcagatggtgataataacaataacagtatttatgatatatcagtacagttttaatctcttgacatataacaactcacttaatccttgtaacaatgctaggcagtatgtaatactattattgtgcccatttcacagatgtggaaactgaggcacattaaaataaaacctaaatgcccacagttatacagctggagggtgaaaatgagctaacatgcttaactctggaacacgcttaactctggtccacagcaagccccctgaagctgttcactgaatgaatgactccaagactccatcctcacctgcattcacatttgttatgctgtaggaagctcatctctcctatgtgctggctttggtgaggtttgatccgcataatctgaagggaaaggaagcagatcacagaggttagtgacccagccagccatacccaggtgggaaaccccatggctcctgccacttagcacccaggggttctacagagcagaaaagggtggtagaagtgtgggggaccaagggctctatcagaaagagcctcaggcccactccaactcctcccaccctgctgacctcaaggagcccctgcttctcttgagggcagacatgtctgcagggttggccaggctgggaattcaggtcctgggttcttgcctctccccctccctcccctcctgttatcccctccaggcctcacccaacccccaggagccacccaagagccacccactcctccctggggtctcagagctccctccagccccatccaggctgagacacgccctgtgaccaggcagcagcaaaggactggctttttaaactccccacagaccagactcatccagcttcccaaacagagccccagggaggcagggctgtcttcctccaagagaggaagggaggggctcctgtcacaggtgtcagccctctcctgagcccagccggcagaggtcaagaaggaggaggaagtgatcaggggttgttggaaacctgggctcagaaaggcaagcatctttttctccaaagagggtcagatgcccgcat

SEQ ID NO: 37075 - DNA, 971 bp, Bovine  19866881046034
aagctttgtgattacctcttagcactcagagcagttccctgcacccaggagacatgcgagaaatgtctccaaggtagaagcaaatgagaagtggacagaggatgtcccacggtcagtcaaaggtcttcctttccagggatgttccacatctacctggacagggtggtgctgactacagtcctgccggggaaaagtcaggggacaaagctggactctcattccccctaaattcagcattctggatgtagggattctagtgccttgccagacttctctagaatgaccttgactcttccaggaggaggtgggggaaggcctcttgaatcagaaccattagccagatctacagagagctaaacctcatgggaaacccgcccatagtctcagagaccctcagagttcccccggctgctgtgtggagcacctggtcaccagcccccacccttgccaggtgctgcgcagacgtgggacactgcgaggaccatagcctggcggccagtcctgggtaaatgacgcctgagcacaagcaaccccttcccagagaagcaagtctctgacctgcggtgtcagggacatggggaagcgggtggccaggcactcacactgaggtcctcatcgagggcgcaggcctctagcacttccttgtacagctgggcgtcaaacgtcttcccaaagagaatgttgtctcggatggtggcaaactggatccagggttcctgggtggccaggccgaagcctttggacagcccccacactgccacctgccctcggagcctgcagagaccaaggccagcagtgtggggggccggctccctgctggtcccctcccggcccagcccctgcctctcagaagcctctcctgatggctgtcttttgcacgggggcccccttcacgtcacatgactctctagattggcagccactgagatcaaggggtcctgaggaggctggaggccccctgggaccggtag

SEQ ID NO: 37076 - DNA, 2467 bp, Bovine  19866881082580
tggcctttgttcctgtttctgcccagagcccctaaaacccttggaatttccgactgataaaagtggtaaaagtgtctatatattcacacatgacctgttaatgaggtgactgttggccagcacctaaagatgggggctggttgccagggaaatcaacctcctgagtccttcctgtttcccaggaagcacatcagacggcaaggggtcagttgagcaccgattgctgtaagggtcctgatgggggggaggggcagcctctccctccccgccatagactcacatggtgcagaacacaccctcacgccatcagcctgggcccctgactgctctcagctttctgctctgtgtcacctcttcataatttttgtaaatacttttaggtttatagaagagttgcaaagatggtggggggagtccccgtgtatccttcacccagcgtctgctcatgttagcatcctacggtaacagccgcagtacaatttgtccagcagaaaaattaacgtaagttcagtgctactggcttccctggtggctcatctggtaaagaatccgcctgcaatgcgggagacctgggttcgatccctgggttgggaagatcccctggagaagggaaaggctacctacccactctagcattctgacctggagaattctatggactgtatagtccatggggtcacaaagagtcagacacgactgagtgacttgcactctcacttctcctgcaggctgggtggggggcaaatccagatacccatatcatatcacctctctgagattaagggtcttcccactgtttctgcctttctaagccaagatttatcttggttccatccaaggtacttggcaagatcttgccctattgtggctagcaatcatggcttaagagctgaggggttgggggtggacagaggccataaaaagaccttcaaaagtacccattgtatgtgttctctcatgaagagaaaccagacaaatgtggttcctgaccttgaccagtctgaatctaagatgcagcacccaggggccccacaatgggtaataatgagatcaattcactctgagaacatcttgagagccttgcgttaaaaacctgtacaaaggcagctatctctcctccctgcagggatgcattttgttatccacactggagagggaagagtgacaggaacgatgggcctgcaggtacggggtttgggggtcagggcagaatttcaaaaagaggactgcagagtcatcctgagagggactccctcagctcttcgcctatttaggagtgaggcagtcagaaaagaactcaagggcaaaacaatttcattgcatgcatgtcaggctgtacttatgtcctcttatttaaccaggatgcagaaagacaacttcaaccaatatcctaagggagaaccaagctcataacccacatttggcaaataaaatcaaacagaaggttcttggagattctcacatggtcgcccagtttcttcagaaacagagaagccgtggctttcagcacaggaactggcacactgcagatgctccataaatgctagggagcagaatgctggtcgtgatgcccttctgactgctaattactgtaatagaaaatgtgagtgcacacagctatagctaggctgaaaattgtctccccaaatgctaaaaccatattttaacagcagcttggctaccacaattagttctactcagctctggtcaaggaaagaagcagtacagattagaaagaacctaaggttaactttgtgaatctaatgaaaagttacggacctcgccctagaaacacgtccctcggtgtacacacaattagacatggattacaggaagctcgcagacccctgcagctatgtacctaaatggtaagactggttttccctcagtggtggcaggaggtgattttctaaagtttctaaaataaacatgtacttcttttgcaataaaaaatatgcagtaaaaacagagaggctaagggaaaaaaagtgaggcaattcgaacccacccggaggcccacggcagcatctgtgatcactgagctctgtgactgacaccaaattggacccagactgcctggaactatcccccattcgttttctgggcatggccattcataaagacccattactccaaacaaccaacctgagagcccttcaactgcgactccacacacacaagggagtgacaactggccagaaaggccccgaggctttctccagagaacactacagttactaatcaactcaaagacaaactaagctctccctaagagaaaatgcgtcaccccatgcacggatctacttgttctcaagaagccagcctaaacgggatgtgggtgagactcaacctggtactcagtctggaggccagcatgtctgcagggggatggtcactgcgctgcgtcagcttacaagagcatccgggcaggagggccgagccctagcccagctgggcacccaggaaa

SEQ ID NO: 37077 - DNA, 791 bp, Bovine  19866881085003
ggacaccgcggccggcacgctgggtcccacaggttaatgtttgacctgcagccacgtgtttttccactggttatttttatcctctgtacctggcagtgggcagcgggcgacctcctctgtgggcagaggaggggggcggggtgtgcagctgggactgctctgggcgagcaagggctgcaggcgcggcttgggggtcaggggcaggggagagagagaagggaccggccaggagccgggcagctcactactgctcagccacagcccaggccctgccctggggcctctccaggcccaggtctcctctcccgagaaggaatggcacaagtgaggggaccaaagagctgtaagggggtaggaaagttaaaaatgccctgccccacctccctgacctccttgcgttactgtcaatggtaacgacttactctcagaccctggacatcacaagtgagaggtttctctcttctgagaccccatggtcttatccagatggtaagagaaagtcaaagctgattggtcccaccccctaggccactccgatgggggaacacagccctgctctcaggcaacccccagcctaagggggtgggggctgggtcttcacttatgacaagagcttggctccttggcatccaagaaccccaaaactgaactgaagactcctgctttggcatacagctctgggtttctcaagccctcactctctctccgttttcctcctttgcagtgggtgtccgccctgctctggctttaggactgtttatggcccagtggccaccgagcctttctctccc

SEQ ID NO: 37078 - DNA, 1281 bp, Bovine  19866881132341
agaaaatggggatagggctttcctggcagtagggtggcggagagtccacctggcaatgcgggagacatgggttccatcactgatcaaggaggattccacatgccacagagcagctgggcccttgctcttgcgccgcaattgcctgtgctctagggcctgggagccgcaactactgaagcccatgcagcctggagcctgtgctaggcagcaagagaaggcaccacagtgagaagcccgagcccggcagccagcgggtagcccctgctctccaaaactagagaaaagccctcgcagcaatgaagacccagcacagccaaaaataaaaaaagaaagaatctattttaaaaaagaaaatggagacaataacactaccaattccacagaactatggcaagaacctaatgaggtgacatgtatgcataaagcacaggggtgactcccctggcggcccaggggttaagaatccacctgtcagtgcaggagactaagatccctcatgccacaaagcaactgtgcccttgctccacaactgctgagcctgtgccacaactaagccctgatacagccaaataaataaataaatatttttaaaaataaagcacaggggttggcatggagtgagtgcttataaacacgtcaggctatggtggtgtcattctgagcagggtagaggttcccggttgccaaccccactctggcctcagggaagcagcttctcccagcgcttcttccctcctgtctactaggatgtgctcccggaaagctgccttctgcactctcttagccagccagtcacacctcagccacccaaagacttagaatcatctttgaaccctgagacctcttcccgtccaactttgttttttctgacttggaaggcaaaaccttctgccacctacacagcttgccccaaatcgtatttgcttccagactacctgcaaaatcctatatatccccaaaatggagctttacacaccttggccaaaaaatcaagtttgctcaaaacactgtggactctatttctttttgtgaattgacctcagacttcattgtacaccaaacaaggaaatcaacctcataatttggtgccacaccttgtcttgaaccaaaaaaaaaaaaaaggtgttgttattacctgttcagtctgctcactcttctgggtcacacatcttggcattaaataacttttggctatttccacatactattcagttcccaaagatgaaatcctgatatcattgaggaaaatttgaacggaataaaggttctgaagccgcttca

SEQ ID NO: 37079 - DNA, 922 bp, Bovine  19866881181043
ttttttgatttgtgggtgtgcacaaaaagatgttgtatacacccacaacagaaagatgttccattgtggcacaaaaagatgttccattatgcctctgttgagtatacctcttcaccagtgcttttaggatttcatatatacactaaggaaagaacatagaatatgacaacttggtgataacagaagagcagagagtgggagaagatgtaatttcttgtttggctttggactttttaggaatgagaagcttagttattaatcctgtgagggttaattcatgagaatctgaagtttgaaataagaaataacatcagatgaacttacggtaaaatgtaaaactcaatggatgtgttggtgaagggtccttaaatcagataaagtcaaatatgtgaataattatttggttctctgaagagaacagccacagaatgcatgtgttacagttacagcatatattaacctttttggaggacacatgcacataaacttgtatatacccttttagggatacatggagtctctctttgaaacctgtccgtagatctttagctaataacccctacctaagagataatgtaatcactcaacctttacttccataggagcatcacctaaaccggcccatgtggagggcaagtctcacctgcttttggatgtttcatggagagacattttatgagcataaagtcttaagaattagtatttatgactgaaaaatggcttgttaattttcctgtgtttctttctgttgacatttgactactcaggggaaatgctgcgtaagaaacgaagggagaaggatggtcacaaagatccactcctagtagaggtgagtcggcttcaggataacattatgaaggacattgcagatcttcgacaagaggcagaagaggcagaaaaaaagcagtctgaactggacaaa

SEQ ID NO: 37080 - DNA, 1999 bp, Bovine  19866881195600
aaatatatatttttaaatttttgatttattttgtatgcatgtgtgctcagttgtgttcaactctgtgacctcatggagttaggctgaggctggtcttagttacagcatgtggggtctttaattgcagcaggtagaaatctagtcccctgaccagggactgaatcccagtcccctgcattgagagcatagtcttttaaaaatatatatatatgtatatatatatatgtacgtatgtatgtgggtgggtgtgtctacaggaatcccagaaataaaactctctaatcttccgggctcagtgacttaacggcaagggaagtaaaatggctatccagttccaagaaggaccgtgctgggtcacccgctcatgaatgtttctgccagagcctcacgctccggaaccaaaggagagtacggagtcttaactgctggaccattagggaagtcccctcgtagagtacatcttacagatttggaagcaagttgaggccgaatgagagcacagaaggccagatagatgggagccaggatgccagttctcagcaagtaggggtctaaaggttggggagatacacagaccacctccagcaagttaaagctaagaatgtggagcaagtgataaagcaggtcaggatccattgaagccaaaattttggagatttttttttttaagttcatatctagcttctgtcgaaatgttcttgcttcctgaagagttggtgtttgtgagcagttccagaattttcagttcttagtttgttcttctaatactcatcacactgcacctggtaccttgaaagtgctcatctcccttactagtctataagcctcctgaggcctgacactatcttgctcatctcacccccattgtctagtgagtgctgtttgcaaagggatgtcaacaaatatctcttgagttgtagttttaaagttgaattgaattagtggaaactactgtgaatttaattttacacatgttgagagtacagacttgcagggcattcagagggaatatcggcaatcagctgaaataaaaagacttgagatctggagggagtggctggatggacagacatatttggatgttctccacatatggatgaaaacctaagaagtgtgtgtagaggtaaaagagctctaagttgaaaattgaatagagggggaatacaaatttatttattaagccaacatttaccaataatctattttaaaattattttaaaaatgttaacatttatttatttttggccatgtcgtacagcttagttccctaaacagggatggaacccaagccccctccagtggaagctcggagtcctaaccactggaccaccagggaatttcttaactaataatttagggcgttccaagcatttaagtcggagaaggcgatggcaccccactccaatactcttgcctggaaaatcccatggacacaggagcttggagagctgcagtccatggggtctcgaagagtcggacatgactgagcgacttccctttcacttttcactttcatgcattggagaaggaaatggcaacccactccagtgttcttgcctggagaatcccagtgacaggggagcctggtgggctgctgtctatggggtcacacagagtcggacactactgaagtgacttagcagcagtagcatgcatttaagtgggtatgattatagaaataccatcaaggatcttcagtcttttagtggtagcaatagactaatgaagagatgattgtaaatatattaatattataaatattgtaaatatattaatattatatataataatatgcaagaaagtgggtatgacagtgatttaaaaatgcttttaaaaattaacacaatagggttttttttttttttttggttgtaatgagatcactgagcatcttataaaattctgcttcagagcagaaatgaggcaaatctgcattaaaatttgacatacttgttatgcggtgacctaaaaaatatatgtacattttaataaattctaa

SEQ ID NO: 37081 - DNA, 947 bp, Bovine  19866881257198
aaagagtgaggctttacacagaatagggctgagactgtcctggcagagagaagagcctttacaaaggcctagaagtgcctgagaaatgaagattcccccaccccacccgcttcgggtgagagagggggcggagctgggctgatccatggaaaaaaagcccctgatgacggatcagggccaatccgcctttgatgtgccagttcgaataactgaggcctggatgcttctaagaggcaggggccaggccggcctcctgggggctgctggaggagggggacttagcagcgtgaccgtcattgcgcaggtgctcaataaatgtcttaatgaaggcattgattcactgattgattcactgattgattgataggggtggcgcttttctgagagactggcaagtgcccccttctaatgcctcagtggagattatataaataccctgcaaattccacccatgggttagtgcctcctccaggtggcctcctcaactctcctggctcctctactcagagacatcagcctctacaacagtacaaaattagcaaaaaggatttccatgtacatataaaatttcgtgtacatataacagcaataataattaacatttagtgatcatttactgcatgccagttgctttatgtgtctgacctcgtaaacctcggaacaacccttgcaagtaaacacaactagatgcaggaaaaaatgtgcgtccaagagaaatgtttttaaatttcttttggttctctgacacacatttttcacattttaacgtctctgaaatcaggattgccctgcaatcaataacaagaaggcactgtgtcagagtttaattagcagtgttcttttcttcttaacggtgcgtaatttgtttgtcttgcttttgatgaaatatagttgattacgtccatggtctacataactgaccacctgcccttttcagtcaagagcga

SEQ ID NO: 37082 - DNA, 1297 bp, Bovine  19866881290103
ctctgtgaagaagtcttgccttgaagaaatctacagatctggtaaggaagagccatgtacatggtaagtactgtcttttattagatacttaacacaaaagtggaaagtatttttggaggaagaactaatttgctagacacagtggttttcaaatattcccccttcaaactgtaggtccccaatttataaataagctaaaataagcctaaaagtactggtttgagtacatgtaccttatgcccccatcactcagttgacctttggttggcttctctgtgtaatcaacatgtcccacatcagaaaagccacagctgacagccacacacataagcaaagtaagtatacagtaatataaacagacaagtgcaaaaagctacaataattcatttaaaaccttaagctaaataaatattcacacttcaataggaaagagctgaacagggcagtgaccctgaaggctcaagcacttccctcttaaatgtgtatttagggtctaaggaaatgacattgcccagaggacagttattattttctcgatcaaattcatttctcaagttcattaatacacagattcagcaggggtggggatgaggctggagaacacattcctttgtgttgctgctggtcctcaaaatcgcactgggagtaacaaggtcctggacaaggtgacttgcttgaggacatattctaagaggcaaagccaggtttggaaccagatctcttaggctccaaggctcaggcattctaaactgacactgcttccctgctgctgctgctgagtcgcttcagtcgtgtccgactctctgagaccccatagacggcagcccatcaggctcccccgtccctgggattctccaggcaggaacactggagcgggttgccatttccttctccaatgcatgaaagtgaaaagtgaaagactaacaattaaaaaaacagttatgatctgaaaaatgagtttttacatccttatcagcaataggatttgaatccatgcctacaaagagatgggagccttaactcaagatctggattatttttcttattaaaaatttcatgcagttataagtctccttgagaagtgaacttattcccacctcccaggttacagataaaatattaccaccctgctgcaagcctgagggcagcactagtgtgttaatggcttaaaaaatgattccagtgtctgcatgccctcaggcctgggccgtttattatgtgaggccagagggctcttgggatttcttttgctttgaggagaactggcaggaacaacctgcgggtttgaggagtgggg

SEQ ID NO: 37083 - DNA, 1357 bp, Bovine  19866881322742
tggtggctcagctggtaaagaatccgcctgcaatgcaggagacctgggttcaatccctgggttgggaagatcccctggcgaagggaaaggctacccactcccagtattctggcttggagaattccatggactgtacagtccatgggggcacaaagagtcggacacaactgagcgactttcactttcacttcttcagtgtttccaaaggttttggaggtggggaatcctgtttagcattcccaaagtagctgaatttttcaaacacacacaccccagaactgactattgtgggaaagagtgtgtcctttaaagatcatgactcaaaacattttgtcctctgcgggacatctttttatatgccctccgtagtggaggagaaactgtcttataagccataaagctctgagctaaccagaagtggtcttaagaccaggaagtggtcttgatattattaccttttgagggtagctctgacttttggaacatctaaggctatttgaagccacgtgtgctgaagtaagttcatgtgaagctcagcagacccccatgtggtttggaatccagttgcttgtctctgggtcctgggctgggcagggaagctgtgagcccagagtgttgtcaagcttttttcttaagggtttcccaaggaagatgccagagtgtttcaagaaaagatatcctgcctggggcaaacgcatagcctccctgaggtcagctttgaaaaggaacagcactctttatgtattagaagatgctatttttgtactttaaagccacaccctgcatgtagtggtggcttccaattattaattaatttattttatttaacagtcactggcacacagagcttatcatgtgccaggcagtgatctaagcactttacaaaaataactcatttaatcctaatagcctaggaagtagatcccagtattatctgcattaaatggattaatcagaatatctaatttacaaaagcatattaaaaccccccgccaatgccgaataactgaggacttgtttgataggagttttaaagtgtttcagtctgtgttatggtctgtttattatttactgtccttactggttggcccctccttgctctattgaggaagaaggaagttatctatgaatcagactctccttccttctccatcccactgggcatgggatggagttgggggtggatgggtggtcactccagagttctggggttggttgaaatggctggaccctgtctctccagagaccccccaacctctcagtcccacatggccccaagcatgcccagagcagctctggggattaggtgggggagtaagagttccagcgagaaagcagggcttaaacccgtcctcag

SEQ ID NO: 37084 - DNA, 1021 bp, Bovine  19866881340104
cccgcctgcctggcagggctcttgcattcctcccgccagctgtctccctgctgggggcgggggcgtcgtttagccctgccctcctggctgactgggtcgcccgggaataggaagggagcacttatgggttccagggtcctgggaagccagcactgtcagcaggccggctgattggctacgctggagactaccttactagccagccgcctgccccttcaggatgtccgggcctgcgcacgttagggagtgtattcactcggctgttagggatgccggccctggttacgcctcccccttccttttcccggtaaggagagggggcggggcttcctcctcttactgctctcgggagccccaccttccgggtggcccttcacgaactggccaatcggaggaagcggcactgtttgccttagcaacgccttcgccaatcaggggcttcgagctccactgcttcgccaacgtccggcgctgacccacctccaggatctgaacccccctcagttctctgggcttggttctcagctcgtggctttctccttcttctaagaacaaaggttccctgaggggagagtccgtgttctagactctccaatattttagtggtagggttagtttattcccaggacattttgctgaatgaataaagtctttggtgcttcattgccagacccctcaagatcgctctcaaaccctaagttccctgaaaaactgagaaacctatctcagaagcaggatctgggagaggctcaccactccatctttactctgggtgtaggatacactgaagcccggcgtttaccgtcaccaacctgccgggtaccacctccaccatccagacagcacccagcacctctaccaccatgcaagtcagcagcggcccctcctttcccatcacaaactacctggcaccagtgtctgctagcgtcagccccagcgctgtcagcagtgccaacgggactgtgctgaaaagtacgggcagtggccccgtttcctccggaggcctcatgcagctgcctac

SEQ ID NO: 37085 - DNA, 752 bp, Bovine  19866881370755
ctgcaaagtgcccatttccttcacctctcccaaccccaaatcaaggctatgcgcacaaagtgtggttttggctagtgaatcccatccacccccaagtccactcccgcctcccgccatgcctgactccgactgagtttctttaacttgtagaaagcaagagcaattgggcccagatacctaaggcccctggctggagtaccagtctggacctttaagatcagccagcactagtcccactgcctttcttgtgcaccaagactcaaaaaagagaaaaagtgttgcaaatggaccagacttccaggctctgagggagagtccccacatgacttcaggacggctgccggccctggggctgcgggcagccggagccgtggggccattacctggatgttttcttcgaaccctccccattccgggccggccccgtttcgggcgccgccagtcggcgcggctggagttgccatgtccctcgagggctcccgtcgctgaagcccgcgcttgtcccgcgcgcggaggaggagtgggagagacgtgggcctgagaaagggacaggtctagggacaagaaagaaaggtacgatgggtcggaacgcaaaaaaagagaaacccggatgtttggctcaaactgacttccggtagctggggacgtggacggaggcaaggcacagtctcgcgatatttaagattctaggaggtggtgcgttgctacagaaacagaggcggacgactagtgcgcacgcatcagttaggtac

SEQ ID NO: 37086 - DNA, 680 bp, Bovine  19866881373866
cgcatgggggctggggtacatcatgtggccgcccacagttgtgggcacagatgacgtcatgatggtggcaggcaacgtcactggcaaacacagacacacgtcagggaggtcaggactggtgctgactgagagcccccatcccacccccaggaactccaggcctccagagccctcctgccattgcccaggtcgaaacctagacaaagctccttcctctgttccctgtcatcgactgagaaaagccttatttttttcttgaacacaaccgcaccaactttcagtgtatcctatcacatcgtgctattcgattatctatctgctttgttccaagaccccaaggccctgggaaaaacaaagattacaatgactgacccaagccaaggagactcagatactcttctctgacagagagcctacatcccatttcacatttgttcttctcctccctcttcctcaacatgcggctaacagaaccagcttttaaacaagcacttctccaacgttaatgtgtgtacagtcactgggggatcttgttaaaagtgcagattctgattcaataggtttggggtgaggcttgagagtctgcatttctatcaagctcccacgtgatgctggtcctccttccacagaccacactttgtgtaacaagggttgtgattaacaagaacttcaaagtaatt

SEQ ID NO: 37087 - DNA, 1393 bp, Bovine  19866881462904
acctgtgcttgccccccgcctcaggtcctgcaggctcccagtatccaagggtctctgactggtggcagcagtcctgggaggcaggaaagggcaagcagagggagttcctctttctggaaggacctcccagttccagagcagtctagtgacttgtcctaaagtccgagtcaatcaagtgacctgacatctagaaaaagaggtgttgtatttgctttttctggttgggatgtgggaggggctggaaaaaaatcttttaggctggccaggtagtcctgggtggtagaatattccttgtggtcctccccacggtgcctactgctaagacgtgcctactgtgcaccctaccccctccaatctgcccaaggagctggtaagggggagagagcagaatccagaaaggaaggagcgagaggccagaagggggaggccgaaagggaggaaagggcttggggacagagggagctggagaatgagcaaacaaactgtgtcctggaaaacaacttgtttcccctttccaggctccctgcctgccccgctggaggcggtgatttagaataacgagccataatttgattatgttctcttccagcctcgcagggtaaacaagaatctcccgtggaaggaagggacacgctgcccaggctctggcacactccccagggcctgaagaggggttccctctcctcctgggtgcgcctgaaacacgtagttgagcggcttcaccccccctccattttctaccagggtttacattctccggtgtctcctgcccctcctccccttcttcctcttggcctgccccagtaaggtcctcaccctgaagcctgcataccgtgtaaatatttaaacccatctattatttcctgtttattagcagtgtaaatcctgagttcattcattgtgcatctgtctccctgaaccgtctcagaagaaaaggcccgaaggcagggccgtgtgtccacccttccctgggaacagccttgctcaggcctgtggtcaggcatgtcactgattctttaaaaatgcgcttttactttttccacatttaaaaattgtggtcaaatacgcataatataaaatttatcatcctaaccgttttttttaagtgtacagctcaggtgtgtaccgaacatttgtaatgtaccactgtcgccaccgtccatctccagaactctcttcatctgtggatgaaattctgtacccatgaagcactgattgcctgttcctctctctccccagcccctggcaaccatcattctgttgggttggccaaaaagttcattcaactttaagtacaaataaaagataccttttccattttcacttagaactgtattgaacaatgtattcattaagctgaaccaacttttggccaagccaattctttctgtct

SEQ ID NO: 37088 - DNA, 1873 bp, Bovine  19866881502593
acgtggccaccatgctcaacatcctggtctggtgtatcggtgagtgctgcgtcctctcaggagcctgcctccaggcatcgttccaccttgacccgcctctggctctcattcctcctctccacagggcacctcttttctcccccccaccagggggcttccttgtctcatgcttttacacctgagcccttgacctcagaatcctcacccctcgggcttttggcttctcctgtctctcctctggggagggtctttgtctctgtctcttgtgtcctgtgcctttggcctcctccgggcatggccactctctgggggtggggtgaacccctctcactgctcccaccaggcttcctgtctcctcatggcggggctagcccctaaatgtaccttagctgtcccgaagggaaggaagtacggagatggctcagcggcagagtttgggctaaccccttgtcacttctgtgctcttacagggaccagaataagtacaaggaagctgcgctcctgctcaatgatgccctcagcatccgggagagcaccctgggccgggaccaccccgctgtcagtactccttgccctccttgccctgtgcttcctccgcttgtccctctgctgccctcagcccactccccaggggtctcaggagcgaggcgtggggactcttttctcctactgtccactcatcgcagtggttctcagctctctcagacccaatatcttctttttaaaaaaaattttaatggcaaaataattgctttccagtgttgtgttagtttctgctgtacaaaggcatgaatcagccatatgtatacatatatcccccttcctcttgagcctccttcccacccctttaggtcatcacagaatacacaactgagttccctgtgatgactccctcttataatgaatattttcctgaaatttaactcatataatgtaacctacctacctgtataatttcctcaaaagttgaatgatactctattaatatgagagaaacaaactaaaatataataagatatataatactttacagtaaagcaaaaatatagtaacaggttgtgttgagtacagcaatgttagaagacacagtagtctgatatacaatgaatgaaaaaatttagatatgaaagtcgctcagtcgtgtccaactctttgtgaccccatggcctatgcagtccatgggattctccaggccagaatactggagtgggtagcctttcccttctcctggggatcttccccaacccagggatcgaacccaggtctcctgcattgcagacagattctttaccagctgagccacaagggaagccctttagatgtagaagaagtaaaactagtaagtcttttatgtaaaagtatgtactaggaatgcaaagtcaagtgggccttaggaagcatcactgtgaacaaagctattggaggtgatgaaattccagttgagctatttcaaattctaaaagatgatgctgttaaagtgctgcactcaatatgccagcacatttggaaaactcaacagtggccgcaggactggaaaaggtcagttttcatttccaatcccaaagaaaggcaatgtcaaagaatgttcagagtactgcataactgctctcatcttacaggctagcaaactaatgctcaaaattctccaagccaggcttcaacagtacctgaattgagaacttctagatgttcaagctggatttagaaaaggcagaggaaccagaaatcaaattaccaacatccattggatcatagaaaaagcaagagagttccagaaaaacatccactttattaactatgccaaagcttttgactgtgtggatcacaacaaactgggaaaattcttcaagagatagaaaaccagaccacctta

SEQ ID NO: 37089 - DNA, 592 bp, Bovine  19866881594095
gctggcttcccctggggaattgaggaggggtggggggcagaaacaagcctcccaggcattcctcctgcattcccggggccatgccctccttcctccctgcctcagcccagcaataaactatttcaggcttgcaaaatctgggctgttactctcctgcttacagcccccagcgaggccaaggcctgggcccgcatcaggaaacccgcagcatccacagagcccagatggttctggtcaagttggatggaggaaaccggttagccttttgggccaccacctataggagccggggaacagggagggtggggtctggcccacttcacaggtcagagccccagagctggggacagggtaaagggaggagaggtgaggaggacaggccagcattgtctggggatccagcaggggctcagtgtattcaaagagatgatttttcagtacaaggctcatctccccttcccccatccccagggtcagtcatcatctccattttcagttcagtcattcagtcgtgtttgactctgtgaccctataaatcgcagcacgcatccctgtccatcaccaactcctggacttcacccagactcacgtc

SEQ ID NO: 37090 - DNA, 1769 bp, Bovine  19866881730068
cttgcagggtgatatatcagataatctcctctcattctagttttagaaggattcctagaggcctgtcctgtcagaccctccctcgcacctgcgtgggacagcctagccgtggccttgtgagctgggctcagctgaccagactctaccttgggactgggtatcttgagtgtcctaacactagcatggaagaggcctttggaatccagccaagtaatttatgtctcatttccagtcttccagtccaacccctgagctacttcctcaatcttttgctaacaaatgctattggtggtggaggaggggcggggaaccttataaatgccagagctggtttctgttactcacaaataaagaggagccagcaaaggaaaatgagctggacgggacttcagagaggccagaggaaaactaggggagtggagtttcataaaaaataagcaaaagagtatatatatcttgaaggaaggagtagccagtggtgtcaatttttatttaaaaaaatgtccagtgtgtttaaataagcataggaggagcaggcaagaaggagacacagctgttaacaatgattaaccataggtgggaggctcagatagatgctctgttttaaaggaaggaacctaactcatacttgctcaagacaagaacaacaaagaagttacttattggcttattggacctgtctttggcacagcagaaataatgtcatcaggactggtctctgctcccctgcatcggcttccttctcaggcagcttctgacagatgcgcatccagttagcaactccagagcagacaactattaatattctccttcccaggggcttcagtaaaatcccagcattggctctattggcctggtttggttcatatgtgacttcctgaaccaattaggacgtgttggcacttgagtggccaggcctaaatcacatgtctccccctggagatgggggcggaggtgagtcatctccatctaagtcatttctatcgagggctcagaagaaatctagacatgatgatcagaagaaggagtgggtcctgggcagggaaataaaaatctgtagcccaatttaccaggaggaacggtataagaactggttagatttgggttccctgggccatccctggaggtcagggaccaaggcccctggaggcatatttccctaaagcagtgggtactgggcagacctggaacatgaaggtggtcctggtggtggggagacgtgagaataataaaatagcttaatggataagtgaagtcagagacttggatttgaatccaggctctgcagcttgctacctttttacttgtcagtttcatttctggaaactgggttaatgtcagaggtagaaatagtgcctatttcttaggattcttatgcgactcgaagggaataatctacataaaggtttagctgtgttcctggaagatggtgagtgctcagtgaatgtctgccattattacagtgttctttggggtgtcctatgccctcgagagggaggcaggcagtcttggaagcccccttccttgtgccatcagagtctccccagttcagggctcggaattcactcacgcactctatcacaacccagccagatcccagccccagggatggggagacgagtggagtcctggtggcagggtgtagtcagagtacaccccgacagggctgggtggaggcactgggggagatgctggagggtcagagactgggcaggagaaggtgggtgaggagggtgaggggaccaggaaggcaagggataaggggaggg

SEQ ID NO: 37091 - DNA, 1514 bp, Bovine  19866881777674
actgtagcaccagggaagtccctcattctcttgagtatagtccttttgattttgtcagtggtttaagaagttactacatgcttccctagggatccgaagtccttcctaggtattgctgtcttttcatgcagtttcttatatgcattgttttgtggagtcatgcttagagtttacattactattccaaaataccccagtaccatataataccccaaattagggtgcctcttaaaggatgagattgcattgaaccctcttcctcatcgatctttcagcatttggttggaggtctgggggttgattttttgttttttttcaacagtaacaatcacctgaaatttgaatactggagcacagaccatatacagtccattccaggggaatatctgtggtgctcttgatgtgctgctgatctcactgtcctctcatctcacaggaccgctgatggaggaggcttagtcgaaaaacactatgtcttcctgaagagactctgtcaggtgctgcgtgccctgggcaatcagctgtgtgcattgttggtgagcactttctggagcgtttcaaggccatctgaggacaggatttagaaagttgtatttgtgtaaggggtaacacgtgtccttgactttagcttgagggaacattgccctacagattatttcttataattctgtagattaaattatcttagttgaatttgaatgatagagatttatttaatgtcagttattaatatctatagtaaatgttcacatctgttattccataaaatcagtgttgcttctcttcattttggtacttgtaaaatttgagtctacctgttgccttaccctttaaaaagtcctattagatcatgaaacatggattcaaataaagaacccttttcccaaattaaaggatatattattgaatcattttaaaaaaatctttagtctgattgacctgaaaataactcccttacatgttcaaagatcgaatgttggtacagacttttgtacttgatatcagtgccttttttggtggcttgaatggcttgaggggatagaagtttcaggcataagatgtgtaccatcaagggattatttaataggttgagtcacagatatgtgactagaccaggtctgaagaaataagtgatttctgaaatgaatattcctttttttttttttttaatttttattcatttacttgtggctgtgctgggtcttcattgctgtgcaagggtcttctctagtagtggtgagcgggctactcttcattgcggtggtttctcttgttgcagagcacaggctctaggcgagtgggctcagtagttgtggtgcacgggtttagttgccctgaggcatatagaatcttcttggaccagggatcgaacctgtgtcccctgcactggcaggtggattcttaaccactgaaccaatagactttaatgatgattgagcagcttttctggggttttgcccttgaaatgatgtcttccttaggccacaaggaagtataataaagtcctttcaaaa

SEQ ID NO: 37092 - DNA, 1272 bp, Bovine  19866881898618
tactgcataccccttgtttggaaagagtgtccaattctactagcatgtcaggccagtgctgtggccactcccgcttgatcatttctactacaattcgagacagaacatctttaatatggttctcctcttccaaaatgttcagtgttccctgcaaaagaataagtgacatcaagaggtttgcaagactgaattcaaaggaaaaaactgggctgtaagagtgtagaaaacttaggagcaggcctactttcaaactaaaccaaccaacctgttctccatgtctgagtcacctgtcctgcattctcactgatcattcttccctcttaaagcttaacagagggttgcatcagctaataaaatggctgtcacatggagcaaggaagacatcactgttctttacaaactgaagagactttcttattgtttcattttgtatgagggccagagtagaagagtatggaaataaggaatacattgaaagactgataaagtgagagattcaggagcaactgaatattttcctaacagttctaggtttagaagacacaggaagaccattattgggactctcttctcaagtctggtatcaagtttaatggattaagatttctatcacatctccccagaactaacaaaatataaattctaggtagctaagttaataattttgaagagagttttttttttctatcaaagacactagactctgggggatgaaaaggacatgaattccccttttcatgtcctttgttaaaaagaacataaaggctgtggattctaaatgtgtttgtacagttatagtcgaactcccaaaataaactcatttagcctatttttttattgctagtaacataaaataattcagtttaaaataaaaggaaacagcaaagtgcaatctaatctataactgattaatctaagacttttattcatttgttaaaaatgtttacttatctctaccctgtcttcataatttaaaaaacagaagtcaacacataaaggattaattaaaccaagtaaatgggatgaactgtgatttccagtgatgctggttctttttaatttgaaggtaacatttaatattatataaatatttaatattatgtagaacccgtgaattgttacacaaatgctacactggaaaagtcacactttgtctaaactacctcgtaaacccaagtcttccaatcaaccattccttacatttgcgatcagctccatgacactgttcttcagatagaccttctccaatcgagacatgttgttccatcgaaa

SEQ ID NO: 37093 - DNA, 1999 bp, Bovine  19866880518607
actgacaggccccatgctggggtctctctcttgctgccccccaggagagagccaggcgaacagatgcctcgggctcggagcctttgtctgtctcctgacacccgggacggatgtgctggggtctctctcccactgccccccaagaaaacgccaggcagacgaacgcctcatgctcagagccttcgtctgtcccccaatacgcaggacggcaatgggtacatcagcgccgcagagctgcgccacgtcatgacgaacctgggcgagaagctgaccgacgaggaggtggacgagatgatcagggaggccgacattgacggggacggccaggtcaattatgaaggtgagctgccggccccgtctgcgtgcccgcaggggctgggggagcccgctgtctgctgacctccctgtctttctctccacagagtttgtacagatgatgactgcaaagtgaaggcccccgggcagctggtgatgcccgttctctcgatctctctctccccgcgcgcgcactctcttcaacactccctgcctatcccggttttagcaaacaccagttgatggactgagaatctgataaagcaacaaaagatttgtcccaagctgcatgattgctctttctcttcctcccgagtctccttgcaggcccccgccatctcttctttcggccctcccgccttccattcacaccttccaaggcctgatgcattcataagatgagccccccagtccccttcagggggcctctgccctcctcctccagcccgggtggctcttgtccgttttggtttgttcctgttcgtttgtcatcttgttttggggtgccggggtggccgccggcgctgtcctaggacctgatggggaggggcccgaggccctcaggagggccaggcgcgagaggcacgccttttgctgttgcatgcaaccagcctgtgataccctgtgcccatcccagagcctgtcggggcaggagtgcccagtgcggcgttccagaaggactgagggtggtgggggagggcccggagctgcggtgttgcctggatgtggcccaggaggaggccagggggcgagggaggcttggcagctggcatgctcttagcacgtgaggaggccggccaggctgggtagcgctcagatcccattggctgctcttgtgaagcatcagactggctccttgaggcggggtgagtggggccagctcccctggtgcccctgcacgctgcccccatcccgtgttcctgaagcgatctcaagctgtcctggtgctaacgtcccacgcccacccgcatcccagtcccctcgagggaacgcatgtggagttggccgctttgtcacatgctactcatccttccattttttctttatactccttaaaactcttaattttgtctgaaaccatgccgggctagctgaggggcggggattgggaggatgtgccccaccaagcgctcaagagaacataacctgcaataaaacagccctgccgggccgctggcccctcccgcttcccgtggtggctcggcagctccccagccccatctgtgctgtctgcgcgcccgcctgcctgcccccacactccccagcggagagcatgatccgcaacctggcttctgactttcgcctctgggacaagtaagtcaacacgggcagttcggtcgtctggatttttttttttttcctgttcatttcatctgcccccaaccctttcatcccaccccacccctcaggtcgatcaagtggcttttcctgggacctgcccagctttgagaatcttctcgtccaccctgtggcaccagcctccagggaagagggggtggggcatagcgggagacccagccaagagctgagggtaagggcaggtaggcgtgaagctgtggacgttttcggagtgttttggtttttcttttttttttttttcaaaccgggcaatatttgtgttcaagctgtgaagaaaaatatatatcaatgttttccaataaaatacagtgactacctgactgct

SEQ ID NO: 37094 - DNA, 1016 bp, Bovine  19866880592497
ttgtccctgtcgccatcctccctgtccttctcccagtcctggctgtgttgcccccctctccagccctttctctggctgctaatgagcagaggagcctttgaggtggccagggttgggatggggggctccccgaggggggcggagggggcaagctgctgctaaggccctaatgaggccccctctgtgcccctcccgccgtgatcttaattccttcttctccctggagccactgctaattggcctggggagggccccctcctggttcttgcgctctccccgggaggtgaggacacctggatctctggatccaacacctgtgttcctgtccttctgtccctccctccacctgcctctcggcctcccatctgtgcttcccctcgccttccctctcttccctgtgttccttccttcacctgcctctaggtaccccatctgtgcacccctccaagccttctcttggccctctggtccctgttcattggtccctctttcggccggcttcttggtcccccatctacgcagatctccatctctccccttttcttctgtttttctgtctcttcctccactctgtgcaccgcatcggtgagcccttccacgcacgccgctattactgggttccaccaccaccgccaaccctatctagggacccacctttgccctagcctactccttcgcccccactcccaccggcttttaacctttccccgccgcagccatgtccaacaacatggccaagatcgcggaggcccggaagaccgttgagcagctgaagctggaggtgaacatcgaccgcatgaaggtgctgggtcggggtggggaggaaggccgcgggcttcggggctggagtctggactggtcagacttgggagtggagccgggagcccgggtggaaagatccccttcggaaccggactgggctccaaggaagcggggtggggggtgaggagcggctggacaagggggagggaccgagaaggggcagggccacacctggggtggggcctaagggcggg

SEQ ID NO: 37095 - DNA, 1258 bp, Bovine  19866880632235
ctttcctgcattggagaaggaaatggcaacccactccagtgttcttgcctggagaatcccagggacgggggagcctggtgggctgctgtctctggggtcgcacacagtcggacacgactgaagcgacttaccagcagcagtggcagcagcaggcaacataaaaactcaaataaattcagagaattcatcagaattcttttcatcaaatgaacagaaatgaacaaaaatgaaccaaaaccttaaagtcaataatggtgaaaacaaatgtcaaagataatttaccagattctgcttgtcacaaaatttaaagtcctgagaacttaggcgaaaggagccataaggatctactgttcattccctctcactgtctcatatacaaatgccctaatgtttgatgagtcagtggtctaattctgtagatgacaacgaatggtttttatttcacatgtattcatacagaactatttctaaatttaagtggtgaagtaaacaaagtttgatcatagctcagttaagaaagtccttccagtaaatgctccttcacagctggatggctgctttaatatgcaattgccctaggccacaggggggaaaaaataatcaggcttttgatctacttaagaaataaaataaataaacctagaacatgcaaaaggttccctctcccaagttaaggaaggagaatgcttggacggttttctgtgaaaccacctcttcctctggatgaatttcctatattccacctccaacagaagatcactggagaaaacagctcagggaaaggcagcaaaggcacatttttcaggtaataaaccaaaaacccaatcatatcagcccattcctggcactcatttctctatcaaatcagggcagtcaaaaggcctgggagtgtcagggcccacccacatactcctggttcaccaatgagttccctccttctccccaagcatggagctacctagagaaattcagcttctgcagctggaagcgcctgcaataccagagggcagaaatctgagtgacacttggcactctttgtttcaacaaacaaccgcaaagagctttccaaagccaggccctcaccattttgaagactaggaagctgaatccttcctggggcagaggtgaaaaagaaacaagcccaccttccttcaacccttcccaaaggtcacacagcaaaccaaaggccatcaaggaagccaagcaagactggcagcttctgcagacccagaacagtaaacaccaagcgggccatacc

SEQ ID NO: 37096 - DNA, 1147 bp, Bovine  19866880767627
tctacggagaaggagcccggtccacaaagtcgccattaaatatctgccctgctaaggaaaacaagggggagtgctccctccctagcccctccaaccctgctcctgttggcactaccctggggccaagaacgccagcagggctcggggcacctgggctctcctcactttttgggtctgacccagtagtttggcccctctgagcctcaggaggtaccaaggtccccaatctcgcctgcttcttagggaaactgacggcagagggaaagaccctaggcggttagccggcttcagctctccctgcaatacaggcccaaagccacagggcaatcgggacatgggcctggtagccccgcccagtggccattcatggaacaattatcctaacatgagcaaatacttatacaatgaggaccggggcccccgagcctgtgctcatcccaggtatgaacacgctacccgtctcagtagcctgatgaggcagatccattttacaaacgacaaacctgaggaactgagaggtgaagagacctgcccaagttgcacagccggaaaagggcacggccaagagggaagccaggcgtgggcagggctgccccaccctcacgtactcactcttcagcaggacacacatccagccctgtttcaagacgaggagaagccagggctcggacgcactggcttcatgcccaggtcacagcaggcgcgcaccagcccgggcctgtctggccctggagcctggagagcaaggccggcggctgctccagcccggcttggggccagggtgctcatcaggcctctcccttctcaggttcaggcagggagtcctctccctcctgtactccacacttgggaggagaggccggggaggaggagctggcccttctgaggaaggatacgtaggggttggtctccgagggtaaaccgttgagctcaaatatgttcaggaggtcatagaactggccgtgggtgtccccgcacactgtaatcttctctgtctggaagaaaagaggccgccggagagggaggggcccagagagagacgtgtggagggggcagaggggagaggaggggtgagaggtcacagtggagtgagaagaaccatggaacagacacaggcggggaccggaaaatgcaaaggggaggagag

SEQ ID NO: 37097 - DNA, 1375 bp, Bovine  19866880781930
ggaaccagtgcaggtgcagctgggccggggctggctccagagccctgactctgcttggagaccctggggtcgggggtgtcatcgggtcctgggtctccagcctcccgaatcaccagacttgattcccagtcctggctctggcatgaccgcccttgcccaggtacatggactgccatgtggagctggccgcaccagcgggggccgggctgagcaaggaaagatgtgccaacctgtgactaactttctccttcctgcttttccaggctgaccagctgaccgaggagcagatcgcaggtgagcttgcttccctccttccctcccccattcccccttcctgccctcaccctgccgcacgaatgcctctgcacccccagctgagtcttaactgcagccaggagggcatctgacagagaagctcccgtgtatgagagcgcgccagtgacaccagagcccacagtcctgagccgggccctcatcaggtggcagggctgtgctcccctcccgccagggatcactgggccttttaatcagtggctgcagggcgagcctggccatctgtcctggctcttgccagttaggctcagaaggtgaactcccctcgggggtcctggcccacttcaggagccacccaggagagggcttgtcacacccacctctgcattgcccttcgcgcatgcttgcactcgcttcttcctgggccggaagtgccttcccccagctctttgcaccaggcagctccttctcctcctttgggtcttgattcaaatgtcatcttggaaaggccttccctggtcccatctcaaataaacagccttccactactctctgtttccttaatagcctttctcaccatctgaaattaatctctgatgtctgccggctgcatctgcctgtcactagacaagtcccttactgggggcttttctgtgtgttggtccctgctgtgcctttggtgcctgcagcataatggttgctgcgtacatttttgttgactaaataactaaatgaacaagggagccatcacgtatcttccagtaagtttgaagaagtccttgagtcccatgtcattcatttttgtagactcccctaaagcccagtaagccacagctacaggaagtactgtgtgctgagaaggtttctgtgtcctgtctcccccgcccccccagactgtgagctactctaaaggacagggaccagctcccagttaagtcccacagccatgggccagcacaaagtagcccttggacctggctttactgtcagggtcaacaggctgcatgtgacaagcatagaaagcccagcttctgaagtccaggaggcaggagtggacttgccttctcttctttcttcccctcccttcccccctccaccgaca

SEQ ID NO: 37098 - DNA, 1038 bp, Bovine  19866880796307
aaacgacataaccctcaaccactgaagattccaaaggcaaggcttaagcaacatcccccaccttgccttgggtaccagcggttcctaagtcctagccacatcctcttccacctgaccaccagctaccagcctggtgggtacccttgtacccacctgtcaaactccacagagtagatgaggatcaggtagcgcttggagttgagctgggcagacctcgaaggccaaggggcctgggcggcccccccatctttcggttccgcagggactccagatctgtgtaggtcagcaggtcaagggtgaccgacttcactgctctgttggagagaatggaggagttgccaaaagactcaacatggccacacccaagagcacacaacccacacgcccaggccatgccctgatcatctgttgggctagctgggcttgcctacccagccgtggtaggctgtgggtcaagatggccctctggtgcaggaaatcatcagagggacaaactggaaagaaccgcaaactctcagccacaggagacagcttagtggtgtgacttccaagtgttgtctgcgcacccctgggggtccccaagacccttttaggggagtacatgcagtcaaaacaacttgcggaataataactaagatgtcatctgccttttctttctgtgctgacatgcgcactgatggtacaaaagtcatggtgggtaaaactgctggtgcccattagcagaattcaagccaggggcgtcgaatgtactagcaactgctatatattccacggctgctatacagtctccacgggggaggggaggcagggagaaacacacaaagaaatagataaataaaaacaaaatgaaacctatgaatgtccctgatgaacctgcaaaacttattaatttttttgaatcttgacccttgagcacacagatgtttactactctgtgtgacaaaacagaaagtccacatttggctgcatatccaagtatgacactttctaagaaaagcacttgtggggctgaatttggagctaaattagccacttttt

SEQ ID NO: 37099 - DNA, 1351 bp, Bovine  19866880801446
aactaagatcccacatgctgaggagtaactaagactgagagccacacctactgagccaggaaggccacaaccagagagtccatgtgccacaacgaaagatccctcatgatgcaactaagacctgacgcagataaataaattttcttttttaaagagtgggataacaaggcaggggaaaggaatagatgccaactgtggagctcatctgacatgactgacgtgacttagcagcagcagcagtgcagctcatctatgtgatataagaaaaaaaacagtagccatctcctgggactgggtgtaagatgagctgaaattagttctactccctaagcctcttggctccccatccccgggcccctcatcctactcctcttctcccatttgggaccccacatccaccattttatggagtttccagcctctaggttcactctctccaattctatctctgtgcagtagctagagggatctttctaaaatgaaaatctgattgcacctttctgacacaatctctcctctgcttaaaatccttccatgactccctagtgccctggagacaaaccttctatttcagtcctaaattttgacctccagcctttctgtcactttctctccctgcactctgcacctaactcggagaaatgtccccaaaggttctgcttttatctcacatctgtgtcttggcatattgtttccttggccatgtacattcctagcctttggtggtcccaaccattcaccataccctttgactgggtaagtccttcaggttttagctcagatgtcttttccaggaagcccttgattccctcccagtctggttcaggtaccagcgtccaccccaggcttgtacagcccctttagctgtcccaccccagccctacccattccaaattttcctgtctggtgacatatttgcctcccctttgcactgtgggccttgtaaaagcagggctaaggtggttctggtgccatccgtatcccagcatcgcctgcacaaagtaggagtccctcttacctgactgaggcccaggtgtttgctgacattttctgacaggtaagccatgtctccctcggcggtgagcaccataacaaagccctccagggccttcaggtagcaggcatccagcggttcgccccctgctcccacctggttccactcccctggtgtccgggccaggatggatggggtgtgtccagtcagccgtgagcccgccctggctagcctccctctgctttccttcactcagagggacttacaggtacccccaggtgagtggggcacatcccagtgacttggagtcccaaggaagagggaaggaccaaggaggacggaattctaagagaacaa

SEQ ID NO: 37100 - DNA, 782 bp, Bovine  19866880956158
tggcttcccaaattcattcatccatccatctatctattgattatctatttatcaactgttgctctttcatctatctatatttctatctcatatttatcctatttatctagctattgatcattcatctatcaactatccacctatactatctattgatcatcttatcaactatctatctgtatctatcctgcttatctattttattttatctatctatctatttaggttagacctcatccttgaattcagactcatcagttcagctaccctctcaacactttaacttagaaatctattaggtacctcaacacatctaaagccaaactcccgatccccgttcgcccccctgtctcccccacctgttattcatctaaactcgataaatgggaacttcatcttggcagcttctctgctcaaaaaccttgcaatcatttctgactcctctttatctctctcccaacacccaatccatcagcaaattctgtcagctctacctttagaatagatgcagattctaaccacatctttccacctccactgctaccaccctcggaaaagccacctctcatgtgaatgatttttttgtaatcttttgcttaaaaattgttaaaaattgttttattgagatgaaagccacataccattaaattaaccacttaaaaaggcacagacaagaggcttttcatacattcacagtgtggtgaaagcatcatctctatttagttccaaagcattttcatcatcccccaaagagacctcacacccataaaggactccccatt

SEQ ID NO: 37101 - DNA, 1532 bp, Bovine  19866881092245
catctgccctccacccaaatcaaagcttgttaacagatggcagggacctccaccactccacatcgcgctgtaataatcctctgtcttaaaacctcccaataaattgcaagtctgtcctacaagggcatttctacgtttcaccatctgctgtatcctactttacacactttccccgttcaagagcctcatgcgaaacagaaagcagcccccgactcacatactaccctctgtctcacaacctctcacgaaagcgcctacccgtgttaaaggcaacccctcccgattctcacactactaggtcagatgcctgctcagccccttctccccccagagcaccccctcgcccccaggatcgctactccgacccacgcacccgcaaccctagccgtctctcaccttctccagggacgcccctcctcgcgagcggttcaactgccgaagctccaaccccgccccaggatccggccttctcgctgctgattggttctggcttactcgcagccaagttctcattagtcaaaacagacgcccgtcacttcagtcccctccagagcttgcaattggtcaactcggaagagaagttccaaaatgtgtcggagcgtcagtttcctctccaatcactattggctggaaactactgccaatcatagaaagaaggttgcacctcggagagggaggaaatcccggaagtagctctttgactccgcccacaaccccctgcggcagagcagaccacgcccatatggagggacgggggcgggacgggaaagtgtccgacgcacatgcgcagagcgaggtcttcgcctcgggttaagacgctaaggaaatgttcttagcgtgaagactggttgagatttatcgtcggtcggtgtgttccaagcctgcacttagcagtttgcaggccttggcttatttaaaattagcaaaaaccctgcactgtgggagctattataattcccatcttgtcactaaggaaataggttcagagaagtacagccactggcccgggatcacacagcttgaaaactacccctattttggtttaagagttatcaacagggtgatatagcttacagaatttaataggggagtaagggaggggagcgttctttaagaaaaggaatacaaaatcgctaacacaaaattcagtatgggtatgaaaatttacttagaatgtgaaataataacatattacatatttaaaagagctggcaaataccacaaacattgcaaaatcccagaagataattgtcacgcgagtgtatgttcctcggttctttgtctcatcacaacagatttggagcaacggacattaaagccctcggcacatcacagctctcgggtcttggacaaactgtgttacagctcttaggcaattcagtgttacagctccattttatttagaagatagagagagagagatataaagaaaagagcgcaggcacgtgggagagagagtctgaaagaaagcgctttggctcctccttttatatgttttttcctccacctgggcctgccctatgcaaattggg

SEQ ID NO: 37102 - DNA, 1032 bp, Bovine  19866881124229
caatggcaccccactccagtactcttgcctggaaaatcccatggacggaggagcctggtgggctgcagtccatggggtcactaagagtcgggcatgactgagcgacttcactttcacttttcactttcatgcattggagaagaaaatggcaagccactccagtgttcttgcctggagaatcccagggacgggggagcctggtgggctgctgtctatggggtcgcacagagttggacacgactgaagcgacttagcagcagcagcagcaggccagaaatacatcctaaaggagaggttggctggtgggatgtggataaacaatgagaacagtggagggagctccagaaggagggcacagcccaggcaaagacatcaagattgaaacaaatgtggcaagtgctggggacaccaagggcctggctggagcagaggtcagggtagggggaacgatgggggatgaggctaaaagtggggggcaggagaaagatggggtcaggggccttctctccacctcccttttatctaccccaaccagggattgaacacgcgccctcagcagtgaaagcacagagtcctaaccaccggactgccagcaagttccctctacactgcctttgtatccctgctcgactgcagctcacctcttccgagccccaaccataggggaggatgctgagggatcccctctggaagggctggagcaactcagccgggggtcactcccccagcggggcagcagggaggtctcaggggttgggggcgacatgccgtggaagctccgagcacggggccgggggacagcccctggaggtctgtggtaggccctgggtagctgctcgctggagttgagctgaaagtcatcatccatggagatgtagggggccagcatctccaaatccagagcatcgacgtcctgcagagggcaggaggcagttaagagcataagctttggccttggggtggacctgggctggagtcccagctccaccacttcagagttatatgtctgaggtcaaggttctgagcctcagt

SEQ ID NO: 37103 - DNA, 1490 bp, Bovine  19866881168146
gacctctcctgattctaaaattccttcagattttaaacaactgcctggagccctggaccctaaccccagaagaaaaacagatacagacactttttttttttaatgtattgatttatcacatctttgtggccgagtttaacatcttatgtattcttttttaccatcaaaaatacaaaagcaaaattgcaatcattgtatgcctccccccaacacatacacacgcatagactccacccacaccaagtttagcaccgggtggctaaatgtttaaaagcccagacttgaagccagacccatgggttcaaaaccctgatttttcactactggctgaatgaatttggacaaaacccaggtgccttaatgtccttagcaataaatcaagaataataatatcacctgcctcatatattaaagtgaacaaatgtatatatatatatatacatataaagtgcttagaatgatgcccggcaattggtgttatgtaagcaccagctgttattattagatattctttcacggtttaactgagtcccccaaagcccctgtggatcctggttaagaattacaagggggtgtgagatcacagactccctgagctggaaggaagcctcacagagatggagagcagggccacttcagccaggctctccctggggccaccccaccccccaagttcccaccctgacccacaccctttcctatttacacccagacggaggcagcctatgcgctgactcacgcttggctcagaccaagccattgttctggggtggaggggagtaagagtgaggaacagaggcccagaggacatggaggatgtcagctacaccagtgacccaggacggggacacccagacacatggtgagactggcatgccaggctgagcgacggcaagcgagggattggggtgtaacaccagcatgctgcattggtatacccacaggacactggacactcacccccaagtgtcccagacatgcaggcacatggagcctggtgcactcaggacccaatttagatccagggagctaactggtcctgcaaacggagtccttcccagggagacacacacaccacacctagcttgcctgtatcatccaggcactcacagcttcaccccagccagtcctggtggagtcttctttgtctggctgtaattcagaccctcacacatacacacaaatacatgaattctccaaatatcaattcttacatactgacatctgggtctgcctgtcggtttctttctcttcctcatgttcaccctcatcattcacagtgtcttgcctgttacttgtacatgcgcctttgcacgtatatatgcagtccacacaccatttgtccaggtagtcttttgaacacccagaggtgtccggatatctttttcccttacgtaaacacacacacacacagacacgcacacacacaggcgcactgtcatacaatctccaagtgctatgcatttatcgtacaacgtcaacgccacttc

SEQ ID NO: 37104 - DNA, 1645 bp, Bovine  19866881351996
gaggcctagggaagcgtgagaccctgcacaggtgagccgcctgacagggtgtgtgggacagccgtggggacagaggtggtcaccgtggggagcacgcgagcatttctaacaggagtgcaggggagaggggagtttcccagagggggctgagggagacctgagaaaggagtggaaatctagcagggggcaggagggaccaggtgctctggactcagagacaccctgctcttcctggagccccaaggccagggctccggctccgggcactccgttcccctcagcgtggtcactgagcgcctgacctgcgtgggaccctgtgctaagccatggtgggggccctggatacagagtggaggccaaaacaggcctgacaccagacagggaggacccagggtggtcccggtcaggatggggcagcccagaggagattcctgaccctgtggggagaaggggagcaagggagttcaggtgggaagagctggtcaaggaaagcccctgaggctgtctcctctccctcaggccccccctcatgggttcgtgtacctgcctgtgactacctataagcccactgctggccacaagctcctccctgcagggaccaggccttgatgtctccctgtcctcgctgccagcacagagcctggcccacaaggcctacactgaccggtgagaccaggccctgcctaaggacagcgccgtcaggatggcaggagcactgggctccggcagttcaggagcgggggtgaaatgcggtcggagcccgacctccaggccaagctgagaagacttggactctaccctgtgagcagtgtccctgggcctgggacaccaacagcagaccagacactcgcatcctatgaagtgtcccccagagccccccaacctgacttaaggctacgctgggagctcggccacatcccctaagggtgctggggagggaagagaaaagacccacacagcccctggctcagggagctcactgtctactgcgggagacagagctgggggcacatcagaacatttccaagtcccactgtgattgggctggcaggaaggagaacacgccatgagagggcgtctcggggctggcctggcctggggattcaggataggcctcttggaaacatcagagcccaaggagggaatgtggaaagaatgacgggggtacaggtggagaaggggttgccctaacaaaaacgattaaggtgcctcggaagggaccagaggccacagcatggctggcaggagccgggacgtggggaagggatggagcagccctcagaagagccgagcacgccctggaggccctctgcggaagggggtcctgctgggcgtggccagcgtgctcaccttcactcgctgcttcctgtgctgcgcaccatccagctcatcatcctcgtcactgtcatcgtcctcgcagtgctgcaggaaggggatctgctccagcaccgagccacccaagcgctctctgccgtccttgccggccgcgttcctgcccaggatgggggtggggcaagggggggggggtcagtcctgccgggcgacaaagctcggctgggagtcacggaggcttggggggccggagcctgagcccaggggagcctcgactctgaccgtgcatggggcttggagcccagcctcggca

SEQ ID NO: 37105 - DNA, 1033 bp, Bovine  19866881414187
cagattggatgtgggtgtgagggaaagaggggacgccaagggcgaatgcaaggttttggcccaagagactgggagagtttggaatttatcccacaggcagtaggaagtcccaggaagatgttgaggctggggcagaggaggagggagagatgtggtcagaaggcgtgatcaccagagaggcacccaggatggggaacacaggtggggatgaactctagccctggctcagcctccaactaaccgtgggctcccagcaagataaagctgttctctggatcttcacttcctcatcctacacacacacacacacacacacacacacacacacacacacacacacagctatgaggaataaaagaccttcaagtctctctcagcacaagaatttttgctctaagtttctctgactcaggtaaacacaaatcccacaagatcagacttcctctcttcatcccacctcccaaagcccatccttgctccactggacaggacacagatcctccctggtccgggaaccttgcagataatgtcggtgacaatggcaggccacgtttgtggtgctgtgctaacggctgtccacactctatcacacggagaccagacaggagccctgagaggtaggtgctttattatcactcccatccgaaaaccgggaaacagaggttctggagagatgtaatgatcagtcgaaagtcacacgggtgaacagggactccagcgttatctccccagctgcgctatctaccgccccggtccagccatcagcacctctcacctggatggtcaccatcgtctcctccctgggctccttacttcttccccagccccccacatagtgtccttcatgtacagccagaaagagcttgtgataaaacctaactcagggacctccctgggtgttcagtggctaagacttgtgcttcccaatgcaaggggcccaggtttgatccctagtcagggaagtagatcccacaagctgcaattgagttcacatgctgcaactaagacccagcacagccaaataaataaattt

SEQ ID NO: 37106 - DNA, 968 bp, Bovine  19866881425700
ttcccaggagtctaagaagattctagaatttgaatatttggggattccagcatgctcctatgataggattcatttctagattccaacaaattattataacgtttagacttaactacctagattagcagtagcctaatattttaatgttgtagggatctgccaaactaggattctaatatttgaatatcttagcctgaaagttttcgacaacccagcgtaccaaaattctaacattttaatgctctaggattctaacaacacgggaatagaatattccaacattttaatgttttagtatttcaaccacctcagggtctaatgtttgaacacttcaataccagaggagtcagttacctagcagttgcatattccaacaatgtagaattctaacatttttaaagtcaaaaattccaacagtagagtagcccactattctaacttttagtgttctagaattcaaacactgtgtcccacccgcttttccccttgacgagattctccaggcctcaaccccagtgaccgtgatgtccaaagcaaagagtggggtggagtggggaaggctcgtgttgacaggccagcctcagagctgaagggtggggacaccgatcaggagcggggacagagacctcagaacctctggggattttgaagaggcgcgcctgcccctccacacacacctctgtcctgggggagggcagaaattggtccctgagacctcacttgcccctggcagttagtccagggtgcgcactcacacccacacccacacatgtcacccgatcgcccaggccggcccggcttcaatttctactgttttcaccaagtcggagggaggctggggtgagcccaggcagagaggtctcccacatctggggctcccgcctgctccttctgggcgcctacacctggctggcccctcccttcctccctgctgtctgcagcaaacaacaacatgcagggacaagcaa

SEQ ID NO: 37107 - DNA, 802 bp, Bovine  19866881485416
ccccaggggctcattcagttccacaaggtgggtgctgggatcctgcccggctccctggggctggtcctcctgtcagaaggaagctctaggggacagagacaaagccaccatcattaccatcatatccaaggaggcaggatggtgcagtgcttaagggcaccgtgggggtcagtggccacttatcagctctttgaccttgggtgagctgctgtcccagacatgctgtgcggctccttccagagccttgttcttccctcctgggccccagcaagctgacctgctcccatggactccatcgaggtgcagccttgctagtccttgtttgtttggttttgctccttgttttcccttgggtttcaaggtttcagctcttacaaggcggaccctactctctcaaggatccgggcaccaccgccttgccctgtgccttcaggctagaggtggtgttgctaatcccagggtcttgcccacacctttacacacagtcctgttactaaattctcctcaataccccatttgagcatgctctctgtgtcctgtccagactgatagagttgttcaacctcttgagtgtaaatgtgaataataataattggggattccctggtggtccagtgtgctttcattgctgagggcccagatttaatcccctgtcagggaactaagatcccacaagctgcctggcatggccaaaaacaaataaataaatttaaagaaaaaaatttaaattaagtattactattcaagagtggctataggaactgaataatttactcatgctaggcatttcatgcagtcagca

SEQ ID NO: 37108 - DNA, 885 bp, Bovine  19866881811260
ccacagcctttgaacatgctctttcatctcccctcatcacactttactgctctttacctagcccactcttttattattctggcttcctcctccaggaagcccttccttgatcatctcagtctgggtcaggtgctctgtctgggctctctccattctttgggcttcccccgtcccagccctgaccaccctaagtcatgattggtattcagtttatcttccctactgggatgtgagatccatgagggttaagctggggtgtctcagtcactgctgtgtccccatctctgtctggcatggggctgacctggagaagatgctcagagaatatgaatgaatggagggtatcaaccagaagcagagaaacacatgcgagagcagtagcatctccatttcctatgttcctctgggtcctgggaagtcccagggataggactgggatgtagggctattcctgcatctctgagccaggagccagcacatgctgtatgacctggaagttcccaatgggggtgggggtggggagcaggactggctgcacatccaggggctggggagagatgcttagctcacggtgcttgtttgaacagtatctggcccaggagcgagtcaatgactggcccatcctttggggttctcagcttcctggccagtggggcgtgtcactgtgttgggaggggatgacgtatgttatgtcacagaatgagatccaggggcaaggaaccaagtgtccttggatgggtgtcctaagcagaggtctcatccgtaccttgtgggctagaagggtgaggggaaaactgggccagggtggaagagaaaagggggttgtgccaggttccctggactgttctctaaacctcttgccaaagctgcttagtgagatgggag

SEQ ID NO: 37109 - DNA, 3280 bp, Bovine  19866880376745
tgccctgttttctgcctcctcagcggggcaggacgctgctctcaatggggatacagctgctgtgctgccgtctgaaggaaggtgtcccgggcctggggggccggggcagccgtaggtttgcgttctgagagtctcaggcttgtcctgcctgttgttccgatgccacccccacccccacccccccccccccgctttatggttgtgctggcaagagagctagttcagaagctgtcacttcatcatagcttggagcagaaattgagctgattccacatattattatcttaaataataaaagctcagtttcctccaaggcacccattgttacaagccaactgaaagttttaattactttttattttgaggtagtttaatttgttcagtgtttccttatattaagttagataatttatatgattaatatattcacttagaacaaaatgagaaagttagtcactcagttgtgtctgactctgtagcccaccaggctcctctctccaagggattttccaggcaagagtgggttgctatttccttctccagggtattttcctggatcaaattgtagctaaagtattgacagtgtctgataatgctgtcttaattcttgttttaagagaactttctcctacatgaaaatctttgctgtggttttttgtttattttgttttgttttttaggaaactcagaaaaataagatgcttcctggcaaaaggaagaaaccaagaagttacaccacaggtataggaagtgttttatatgtagtcaatcgttcaagaagttcttttttaaaaatatattttttaatttaataaaatagtacattttaagtatataaaatttccactttaaaaagttaaaaaatatatgactttggagtaactgagttttccagcagtctatcatgaaaattttcaatatacaacaaaggataaagaattgaacaatatatattcatataccctactaactagattttaccatcagaatttatttctactttgccctagcacctattcattaatctattttaatttttcatcacgttatcactctcttcagacatcaaactatgcacttttagaagccttttttcattcaatgtaactctgagattcatgcatattattctgcatcatttttattggcacaaagtttattgaaaaatgggaggaaaataaagcattttctctccagttttttaaaagataagttttgtttttctaattataaaaatgtttattttagaaaatttcaaagatatagaaaggatgataacatcacctacaattccatcaccccaaagtaactgccatgttttttggtctgtactcttcagtccttttactgagcttttctcaccctaagtgggctcatatcctgtcattcagtattctacataccattttaatgaatatgtaatatttctttcacaaatgtacaaagttatagttaatctcttatatcagctgtctgaatcaatatatgcaataaccttcctgtgtcctagaagtgatccgtcaggtagattaaaactaacaaaacacagttaacaaagatctgcatcaccagtagcattcagtaacagccggctgttaaaggcgcagcagggtaactaagggacggctgcttttggctgcttcagaagtgggccaaccaaggaggcaggccactagagggcgccctaccgacaggggtttgtgagcctgtcttctcccatgcgtttcttcaaaacctcttactatttttagcaatttggtggaatacttttgttgtaggctttcagatccctggacctagagctaaattgctgataatcagtatattaaattaacctatcctgatgttgtagatacttccgactgtgcacctatttggtgtttaaaagaaaagaaagccagtgacatcatggaattagatgtgtttttgtctgcgttcgagaacattcttctagagtatgagtgagtcttttgatgttgtcatttatgtgcctaataaatttcccttgaaatagcacttctgttcaccccacagcttgatatgtagaactttcattatcatttttatgtacttttaaatttctattatacttttttctttaagcctctgatttagtagtatgttattgtatgtccttgtatgttcctttttaatttgtatttattaatcttctgtcttaaatagttacagtccaatttcatggactggtaatacctatttttgaaatactgaggcttcatttatggcctagcacataatctctgtggaagctctaattattggatctgtgtagaatcagtattactcagtttttcctggtatttctatcaatttatgctatctctatagaggttattttactaggatatcatgtttaaaattgctcttttagattgaacattttatccttatgaagtgactcttttcattcctaaaaatgctttttttggttttaaaatcttttatctcatatgtcactagatttctttagtatttgccagattttacattcttttaacttttacttcctacctttgtctcatgttaaactgttatttattacaaaatcctttttaagtccagtgtccatctttgaatttcactttagtccattacacttaattatccttacctttagaagaatgtatttatccttttttaaatttataactccccaccagtaagattagaactttggcaagctgtgatatcttggtcttctctccctgcccccaccacaaagtgcatcatgtttaacctggagactgtttaattctgggaaaagggcgatcagagttgatatgaaatggctgtttgaatttagggtctagactttgaacttgccagaaccagttaagaactgcagcttcttaatggttcctggagtcctcctcataaggcttttagggctatatgtggttgttggtttccctgtggaggaatgaggtctggggtttcttattccatcttctgatgtcaaaagtgcaggccatctctcctgcttagcgtctgaagaattaggccacgggcctagtccccttctcctgggtgacttttcctcatgtatttgccccaagaaaaaaatggctatatgacaagctctcactcacacaagaggtttattttcaattcagactttaaattctagtgttgttctgtgacgaggccgagcaggggttagctccaccctggcagggtgtgggtcaccatgggtctgtgtccagctgtgagggagggagactgggctcttctgtcccgacaacagggacccaaaccagtt

SEQ ID NO: 37110 - DNA, 2623 bp, Bovine  19866880407621
ggctccttattcctgaaggctcctaaactggcctcattctatcattagtagaaatgcctgagtccctttcaacctctgcatgatgttctccaggtatcagacaatcacaggtgaaatccttctttctctaacaactgacagccctcttcttggctgagggaggggaccctgtgcttgccttctcccctctcagggccctctgggcaaagcgcactgcccagcggtgggcagaagccccatgcaatttggggatgagcctctgctctgtgtgtaacgtgggcagacacctaaccagcaccaccacgtgcattcctctgccctatattttgacctcttcctctcatcgctgctgaagtcctgtctggggagcacatttcagtttgcaaagtgccctggaaaacaaatatttgcttgggattgtgatcctgctggatgtcaccatgatggggcctagaaactggggagagaggcgggaaacctgggggcggccaggttccacttaccggcacctccactgactgcatggccaggtcgcatggaggcttcagggcccgtggccgcgtggcgtaccagaaggtggtgagcgccgcgaacgcgccgaagcccatgagcgtgttggttggaagggtgcgcacgtactgccggaagtcaagcagctctggcagccgaaagtactggaacagctcgtgggcttgcatcatcctgggctggcagcgtcctaagccacagtctgtgggagagaaaaaggtcatgttcattccagggaggagggatgctgtgacaaactccccaaggccgatgaccatcaacttgatggttggctcatcaacgggggcattagagccacgggctgatggctcaggccgtcttctcctggctgccaaactcacttttctaaaagcactttaggaattcattttactctgttggcttgtgtaaagttctcattatccacattcaaaagacttagccactcagaattcttgctgtaaaatgttaacataaggggcatgagttaccattttcttgtcttacattctctccctgttctctgccacctgatcaaatacactcaactctcattatcaaggcagatggggagaaggacaaagaggcagacacacgcccaaaccacccgagggccatcagttttcacgtcttctcacaaaatgcagcacaagctccccagctggtgaaacaggtcacgctgggtttcagggtgtgtgtggggtgtctctcaccttccccacactctttgtagcataaaagcagccacgtagatgtaggggaaactggaatcagttatcctgataaaacagtgtcttttatattcctcaagctattatagctaaataataaaagggtgtgcataaatatctagagagattcattcagcaactatctagagagattacagaatagtatttgaaagaaagtgtaaaatagtacttaagattccagattctagagccaaatcctgcctccctggttcatttgctgaataactggggacaaatcactcccctctctgtcctcagtctcttcatcagtaaaaacagcacctatctcatagggcttttatggttcacataaagaatttagaatggtgcaaggcatcacaatgagttcaattaagctgagcattattattatttcctctactaatattctatatttctcctgcatgaggaacaataagagatacaggtaataaaaactgacacttatctacaaggagtttacatgcaaaattaagaagccaaaatacacagaagaaaatcagatgaacagccacacacacacacacacacacacatatatagaaaagcctctaactgaatattatagacaatttatatacatataatgatataaaaaattaatgtgcagtacagagaacaaataataattctaagtaaaaaatgattgatcagtaactactctcaagtatgtctggcacacatatggcaggaaatcctagtaaactatctgaaagacttctcagaaaactcccccgtaatgcggtaagtggtaacctttatcataaattcagacagtatgtttgagctccttactatatgttcttttaaatagctaggtcccaagactgaaagtagtttttctccccctcagatacagaaatcctcttcaaatttaaatctatattattgtataaatatcttcacagtcacagaataccaagaactttccctggccatcagtacttctagaaggcaatgtcacagccagccttgtgctcccacagcctggggcaggcatacagaaaagacacacacatatacacagacacagacaatttctagctttaacacgacaacagagaagaagcaggttaagtgcatttcttcaggtcaccactgcggagagaacgcactcaccgtctgtgccaccgacagctgactgctgggtgacacaccaacctcagaaagggaccaggacacaggggtgggggcggggctaggggtgtacgcgctcagccgttgcctgcacagcctgccaaggtctctccgggcattcgtcacatgcccagtcctgtgctgctgcccactgggctaaagggtaactagcagacaaaatccatacgtgacttctcaggagaaca

SEQ ID NO: 37111 - DNA, 1021 bp, Bovine  19866880414775
tcgtgtagttatctcaaaacctttttcaatctaaaactatcaagaacttagtctgttcagatagcagattccagtttgtccacttaaagactcagtctccctttgctgtagcccatctgtgtacaccggagagggcgtaccacggagctgcaggcatttccaatgtggagttttgtgagtgtcccacaaaggcagcaacgatgagcccgtgatgactgcattggagactgtaccgtcccgtgtttggtatctgttgaactgaataccttaatgcagtacagatcaactgtatggtgaaaccatcacacattctgtttgagtaatcggtattttcttcctactctgctctccctcccccttggaactgcaggaagaggagtttacaacagatacaacagcggacactgagaccaagagtcctcatggaccgtcatccagcgtgttgtcgaaaggggcattttccgacgctgactgggataacggcattgatgatacttacattttggaggctacagaagatgctgaattagcagaagctgcagagaacagtcttctggcttataataggatggatgaaattcctgatgaactactaatagaagtgttacaagagtagctaattatggacactgacataactaggctgtaatctacatgaaggcagatttagtaccattaaattatagtaacttattaaataagcctgttatatcagctgttttatttatcactttacttccaaatcttatgtactcaaataaaccagttttattgaaaattagctccagtgtgcttattaaaattcagtagaattctccttatgtgattaactatgttcacatcagcttaattttgcatgtttatttgtagggtagagcttctaagggctgacgaggtgtcaacactgtaaaacatttaaaaacttagtacttgggtgttaactagaaaagttaattatggcctctaaaactactatacttagctatttaattttaatgacaaagcaatattaaattctggt

SEQ ID NO: 37112 - DNA, 1414 bp, Bovine  19866880543224
gagaaggaaatggcaacccactccagtgttcttgcctggagaatcccagggacgggggagccttgtgggctgctgtctatggggtcacacagagttggacacgactgaagtgacttagcagcagcagcaactagtattaagacccaaggagatgactatattggtatctccaacttacatctgattcaaaagttgtttattaatggtgtagttattgcttgataagtagccactcaaaattccaccttgatgaagaattatttggcaagaacaagaaattcggaagctagagcaaatagtgaggggccacaggaagacagggaggataatagaagcaattttagaattttttaaggtttgtttactggtacctgttttttaagcaaatcctttcatatctggttttactctcccctcttccaaacttagctagattgaaaggcaccttacaataaaaaaattatgagtagcttgtcattgtcaccatgtttgaattaaatgaaaatattaaagaagggcattatgtacctgaatctctgacttaccctgaattttgctattaaatgtaattggtctttagcagaagcaagatctgtgttactctaatgtatcattttactcaagcctcgtggagttctatagctcatgttagtgagcttacatttatgttaacctcaaaagaatgcaagtatatctgttttactatgcttctttaggaagaagtatgtatatatatttattcaatagtaaaagagcattttaacttctaacccagttttttttttttttttatgctattgagagtggggttggaaaactgttgaatgtggggaaatagagaaggatgtagaggagaatgaaatatgaaggaggaaaaaactaaaagaagccaaaaaggattgttcaaagttgccagtatgcaggaggaataacagctcctgattcttcttgctaatcaggaagtctaattaggcactctggagattttgttcctttatctaatgaacatttgctaagcatttactgtcctagcctcatttcttggtagtggagatacaatatgtttatattctagtggggtcagatgtctttagtagtcattgccttattattaatagcatctttctccagctcttttacttcatttcctctttctgagtctgatatcacaaaattggcttactttgaggtcattttctggccctgagtctagctcatggaaaggtctgcacatggaaatcatatatcaagtgatgactgaccatccatggcaagcagcataaactcagatgtctccaggggccacgagggtcacacatatatgaaaatgggccaggtgtcatacgcttgggagttaagggtattttgccaagatggagagtagatgttccatcttaaggcactgacctaaatt

SEQ ID NO: 37113 - DNA, 1304 bp, Bovine  19866880695963
cacacacaaccgtttcttttatactataaaattaggaaatgaagaacctaaattcctatgagatatcagtattagatagaaagacaacttcatttttcttttctttgcacaatgcttttccaaactcctaccctaggaccactccaccagaatggaataaaggctcccaaacgaagggtgaacatgaaggacactacacctggcttacttttctggctggtgacactccagcctctgactagaaggttcaagaaccctgttgtgaaaatggatattggagatttagagaatggagatttggctcccgttcataagcaaaggcttctttgagaaagaaaagactatgttattttacaaccctatcaagttatacaaccctggctgatttctggaaataagtttgtcattgaaggcatgaggcaagcccctttttaaattattgcaagcaatctgtggaagcataatgccaatccccgctctcaaaggcctcattgtgagcgctggtgctcggagctgctaattgctggccgccttccatcctcctcctgcaaacaccataccatatttgtctttcagctgtcactatttgttaggggcctataaacagagaagatgctttcttagcaaccactgtgaaaacgtagaacactcccttcccccacctccaaaacaagcctgaaatgaggaaagaaaggaaaagggaactgaccaaggtccatgtgaaagtcagaaggacaatccagtacggaaagtttcaaatactgctggctgcctttggcttgggggaaaacaaagaaaaaaatccacaagaagctttcagaagccagctgccaacagattaaagggcgactagaaatgatctcaccgccatttgtagacgtctggtcacacggatatctgcaagataaccaagaataatctggttacgttattcaattttacttctttggagaatgctttcggcttcatcttgctatttttagtctttggtgtcagacaccatggaaagtcatcgccaaggcagttcaaggatgacatgttcctccagaacaggtaaaagttctggaaaccaaaatgaccgaaaaagcagctggagatcaaagcattcaagagattctggaaagaaggagcagggaggagatagggagggtttttgttgataaccacagaacaacatgatggatgctacattttagagagcattacagaaaaccatcatgtctgtaaagaaagcagaaacttaaaaaaaaaaaaaattaccacagagggatctgtgggagcacccctggccattgaagctttca

SEQ ID NO: 37114 - DNA, 1106 bp, Bovine  19866880769733
aaattccctaactataagctatttaaatattgcatatacaaagtatttaaaggggggaaggggaaaaacttatttataaaacagaagtcggatgtagacttaacaattaccaggggatacaggggagtggggtacattggaagattgacactggcatatacacactactatacataaaacagatggagtgggaagtaacaacccactccagtgttcttgcctggagaatcccatggacagaggagcctggcaggctacagtccatgggtttccaaagagttggacgtgactgaaacaacttagcatacataaaacatgtaactaaaaacctgctgtatatcacagggaactggactcaatactgtgttctgtatgacaaaagaacaagtggatatatgtataactcattcactctgctatacacctgaaactaattcaacactgtaaatcaactatactgcaataaaaatataagaaagtattaaaggaaggccagtaccatataaacagcatacacttaaatacaaagatgaatatttaacatacagggtaatgttttttttttttccccactaataagctaaaggtccatttcaagatgtttctttctttagtatggttaatttgttttattagcaagcaaagccctataaaggatggcatcatctagtccttagactcagattcatcttcatcttgtctaatctggaagtaacgaagctcataagtctccttgtcagatgcaaccacaggaagccaatcatgaagactgttctttttaaggtatttcttggtaaagtacttcaaataccttttagagaactgtttctcagaaacaactatgattttattcttgaagtgttcaatgtgaacgacattcccaagatttccagtctttccattcactttaaccttctccagcataaactgttcaacatttccagaatcaaaaactccatcttctactggatgagtaaactccaaattaaacttccaggttgactttttaggcttcttgtctttcttctgcaccatcttgaaggcttcctgcacaattagagcctttttttttttttaagttgactttttcttgtaatttggcatta

SEQ ID NO: 37115 - DNA, 596 bp, Bovine  19866880875661
ttgcttgcttctgagcggggcagcatggcatggtgaggtgagcccaacactactgaggtggagagtgatgctgtagggctattgtaccaccactgggagaaggctggggaaagcggaagcagaggggcaaagccttggcctgcctgtctctggatcccacatctgtggagagctttataaacagagtcactttctgtctggactagcctaactgaaggcaggtacacatttagatgactgccccacctgtttccatccaccagtttgtctgctaaattgaagcacgtttgttaaatacgtattaaattgttcttgtgtgtgctcagtcttgtccaactcttcacgaccccacggactgtagcccttcaggctcctctgtccatggtatttcagcccccccaccccccacccctgcccccgcaagaatactggaatgggttgccattttcttcttcaggggatattcctgatccagggatcgaattcttgtctcctgtgcctcttgcattggcagtgagctcatttactagtgagccacctaggaagccctttaaaatgttcttacagtcaagtttattgggcaatcatttccttgt

SEQ ID NO: 37116 - DNA, 845 bp, Bovine  19866880900181
cacagaggcagcccttaaagtcggaagacatttttgttagttatttgtttttatttgtttgtctttgtatagcaaagactttgccagtttctgtttggggacctggtttaaaaacaaaatttttttttcttcccccctgctactgctaagtcacttcaggcgtgtccgactctgtgcgaccacatagatggcagcccaccaggctcccctgtccctgggattttccaggcaagaacactggagtgggttgccatttccttctccagtgcatgaaagggaaaagtgaaagtgaagttgctcagtcgtgtccgactcccaacgaccccatggactgcagcccaccaggctcctctgcccatgggattttccaggcaagggtactggagtggggtgccataagaaggacctagtttgggttttcatacatgtaactctctaaggcacaacacagagctatattagtggtgatcagaccacagaatctggtctgaagcagaggcgggggtgaaccctaactgactcttatatcgagaattctctgagctttggttgcccagtgcgtaacggttaatacctcaggtctgttctgagcgaagatgccaataaactggtctggagctgccttgaagcccttgtggagcagtgctgagcccacacactctgccatatcttcaacctacaatggaggagaaaaaaaatcaggaacagcatcaggtccaactcaaggaacacagcttcccgtgacggccgagcctaatatcttcaccaagaagcagttctgcccagagagaaagaacaggggtagacaggtatccccgtagttacaaatttttgtaaagttcaag

SEQ ID NO: 37117 - DNA, 955 bp, Bovine  19866881030046
ctagtttattcatcaaacgcctagatcacactgtatcttaacctacccactgataaatgccttttgagaaacagagaatacaatttttaaaaacctcatctgagacgtagttttctcttaaaagacaaattcgggacacagtgaactggattttcagtgagcaaatgttggtttactacatcaaccttttccgggatgctttttggcccaatgggaagccggcaccgccaaacacaatcccacgccaagaacaaagccgcgcgcgcagccaggaaacaaagcagagagcccagcagaagctgctcgagaacattccaggtgaggcctgggttttgctcctgaaagtcggacagaaagggagtgtcgtcagccccactaaggcatctgccacttaggaaacattatttacagtgaaaaaaagtgatcatacctttttctttcaaatcatgtcttgtcccttgctaagaaattatactgaagagtccccaaaagaacagtactgattataatttcactagaacaatgttttagataacagaattttatactttaaaaccccccgttttgagagctatggttttaattggggtattaaaattatagtctgtataaatgcctgtcaaaaaactattttttcctgaaacactggcaagaacccacccctcacgttcctcagcgcctttatgtgctgggtgcgcagggcagggcctcactggaggtctgtgcacggtgcacttttatcagtagcagcttggaatataaacttaatttttcagatatgcttcagagccttgttggacagcaaaatgcccgttatggtataataaaaatattcaatgcacttcaagaaaagagagccaataagcacctgctatacgtgagtaaagcctcccagaggattcactgtttcttcagttgtacatttctgttcacatatgggggtagattttaattc

SEQ ID NO: 37118 - DNA, 1780 bp, Bovine  19866881169379
cttaaaagtaactaaacttgaatatgttatttatcaacttggtaattattttccagtaattctctctagccttaacttaaaatctgaattgtctcctacagtttactctgagctctcttaatttgccagcattcctgccaccttcccttaaacttggtgctcgtgctttctttcttaaagaaagtgaaatatatcttacacccatgtctccatcaaacataggaaaacatctgctccccttcttgcatttattttatctggtctccaggcattttgagtttctaagaatcactgtgaagtactttctagtcccagttgatcagttttgcagtaatataaataatgatattccaggtatctttaaatgaaataatttggttacattataataatatatccatgatctcaaataataaaacacacctactagaaaaatcaaggcaaattcatagcatttaatattaagctcaatataatattaggtttaatatttaaattcaatacacaggacttccctgggggtacagtggataagaagccacctgccaatgtagaggaaagggtttcgatccctggtctgggtggattccacatgccatggagtaactaagcccatgtgctgcaactactgagcccaggcacctagaaccagtgctgtgcaacgagaagccaccaaaataagaagcttgtgcacgccaactagagggtagccacccccacttgccacagctagagtaagaccatgcagccaaaagtaaattataaaataaaggccctatctccagatgcagtgatttaaaaaataaattccaaacacagtgtttaaaattaccttttaaaagatgattcaggtccattgtgtcatgtaagactttttgtttgtatctgtggtctaaactggaatccaacgctgttgactttgaggtgagactgggttcatgtttctccttcccttttttggctgatttcaaagatttcgagttatttttcaaatcctcaacattttcatatacttcttgcctcacattttcttgccttttaactttcattttttcggtcgcttgaggcacccagttcgaaagactgaaccgggctgatgtccggggtcgataaaggagtgacgtccgtcacggtgtcttccgattcttcggtgtcatcaccaaccttgggttttgtacctgaagcgtgggctcctggtgatttttctcctggtttatatttcagtttgggtgacaagtgggtggcgccagggagatgcttcttcggtgatggagatgaatcagacaggccgacatcagatccggtatctgaacagcctgtatcggaacttgaagatgagagggacaaagacgaagaggagctgcttctggaatactttttacttaggcttttcttgaagttattcggcagcttagctgacttggacctgacatgatgctttttctcatcatcagtgctctcctctccatctgtatagtagtcgtgctcaccgtctttcacagtttggggaaggctatttggagtgggcaagtgtattttatgttctactctagcattacccagttttgatcttgaagaagtggttgaggacgaggaatttccagtttgtgcattatcaccttctacagggtgttcctctggaggagttttcccactgctctccgttcccttctcagtaagatcatcttcctttctttgtagtccaagtttcaagtttacattttccgtatctttgtctgttctctcttcagcgtcatcatcctgcttgtcaaaaactgag

SEQ ID NO: 37119 - DNA, 647 bp, Bovine  19866881250188
taagagggattgatgctgaggactacagatcactaattctcgtcttaattaccagtgaagaagcagcagcatgcattagggccggaagatactactgaaaattcttcaccggctgaagagactgcttcggcaacttttaaacagtctatctgtccatttcttcctttaataaacacactgaaattaaaagtctctccctccattacctaagagactactgatattttcagttgtttaacctcctggtttccttcctatgttgccattatacactgtaaaaaatgaaacctgaaattaagtgaaccaacacaaagcaaggcatgccagtgaaacagagcagactgcatcccagaagtcagcatctaaaactctgtcagaagaacctaagtcatatacttttaaacgggaaaaaggtacaaacaagtacaaaacccgtgtgcgtgtgcttacttagcgagctgtactggctgagagtggacctcactcgtctggagatcggggatgagctgagataacccatgttgcggtgataatccatcagctgttctgagcgtttcatgccaactgttggcttcacagcttcaagccttttcagaaaagcctgcatttaaatgaacaatttaaaagctaacgttagataaaccgca

SEQ ID NO: 37120 - DNA, 1729 bp, Bovine  19866881509302
ttaataattagattgagattctcttaaactctgaatctgagagctggaagaggccttacaggtcactgaacccaatgctttcccataggaaactgttttgcatcttgcctttttaacaatttatcttagagatgttccatatcagcatattcttttttattgttttatttatgactcttctaaaaatctctcaggtatttatttggcacttcattttcaagaaagtgatcatggatggccattttagatgtaaatgtaaatgctatttgtatagtagagtgtcccaactaagcgaaaaaaaaaagccaatggttcagtcccttcatggctgtgattccctttttgggctttccaggtgggatgccagtggtaaagaatctgcctgccaatgcaggagcgacaggagattggggcgattcctgggtccagaagattccctggagaaggaaatggcaactcactctagtattcttgtctgagaaatcccacagacagaggagcctggagggctatagtccatgggcttgcaaaagagttgaacacaacttagcgactagacaacaacaaacaaacaaaaaaaatttctggaagaaaactgccaggcaccttgaaaataaatacaaatacctatgaggagaatatatgaaagtaggatagtccaagaaaacgagcttcctgatcttacaaaaaaaaaagatctcttactgctactaaaatttcacaggtgttttcaactttatacctaaagctttaaaatacagaccattcaaaaagatcatttaacaaacattaaaatcaaaattttatagagggaacatccactcttaggctgtaaagaaaaccaaattatacttacgatcaaactgtgacacatatttatcccccacagtgatatattccatctcactgaagaggccaatcctctccatatccgtcttccctccttccgcaggcatggctgctccctgttggctgggtgctctatgctggtgacttcagtgggtttcttagtgctacttctacagcaaaattctactctacactgaaaaatacaggagaaaatttagggaaaaggtgattctaactttcagtccaaaatagtttcagtccaaactatgagtgttaacatgcacatagttacatcataaaacaacagtcccaagctatacatggggaaagaatctactttgtggggccgagggggaataacagagactcaaaattatcaccacgaaccttccccttgagtctccagctgaaatatccacaaattacaaagaaatgtttatctgtggcactgccattcatccgtcacaaacagtaatattatgacggtacagtgtggtataaatactgtataaacaacatccttcttttgagaagttcaaagctgactgaaagattatataaggcagtcgtttttagtttaaacccttctatctaaacatactacattgtcccttgtattaaaaattataacttacttttacagaatgcacaacacacctaggcattaccctatagttcttgaattttttcaagtttaaatgtatataacaaatgtgccacttggcaaaatcagttcacaacggggacaggaagagaggacaattgactaagcaagataaacacgaagaacagcaagacaaaagctacaaggaattcagagtatttgtgatagagcagactgcaactctgagttcttgaaaatatcactctaaatatgcaa

SEQ ID NO: 37121 - DNA, 1158 bp, Bovine  19866881516949
tacccagtggtatgaaatacgtgttcatttttcttgaataaatcagtagatgcaccagtgacataagctagcaacctcagatcttcccagaagatgacttttcttctgcacacagagagtaattactaattgcatttttgaaaactttgcaaaccacagagggacatctgtgtgatcaatggaattgttgttattgtcatcatcactagggcagttcctggttgaatgactgttctttgttccaagagactctggtcatggaccacttatgacctgtggggctctaccctcttgggcacggaagactgtgcctgagttaccgcggggagaaggcagaggtggaaaatggctctctctctcgtactgtttacttagacggagtcattccttgttctgaacatttatagatagagatttacctaacatcacattttctagactgctgctgctgctgctaagtcgcttcagtcgtgtccgactctgtgcgaccccagagaccgcagcccaccaggcttccccgtccctgggattctccaggcaagaacactggagtgggttgccatttccttctccaacattttctagactaaacggtagcttttaaactggtctcctcacctctagtatttctctcttgttaccctaaatcgtcttttcagattaatctaactaaaactgaagttctaatcatgttattccattctctctaatcttctgtgatcccctcttacctgcttatttcttgaagagcagtcctagaaaatagatgtacttaagtcataacagcattgaattttttgttggctgttacgcctttagaagaaaagctgtttgcttggcagtgagaataagtgttctttcatttcttactgtggtttgttacattactcatgcatatttcttaatgaagaacataaaatgattttactatcatgaatttctctgtctccttgaattgacacagatgatatattttaaaatattttgggtttttttgtacttgcatgaatgagtgtctgtagttatataacacatagaatcgtgtctttgttttgtacttttgtatttttatgatacttagtttgaagacgggtgctgatgaactattgaaagaagatacacctgtgactagcacatacctttattactaagtacaga

SEQ ID NO: 37122 - DNA, 949 bp, Bovine  19866881856921
atgggcgacaagggactttgccatggcctcttcccgttgttccaagtgttaatgatccccacctgtactgacatcctcattctggctgtttaaagccttctctgccttggactctaattttttttcaatactgcggggagaaatgtctcaagttgtacttttccacctgaaatggatagtacgggccctcaaaagtttccgaaatcatactttaagtcccagtgaaagttttttcattttagacaaattcattttatgcttgcattaatttgagacagagccccgaccctatttgagtggattatagatgaaatcctattaaatagaactctgttggacctgactgcaatatgcaaacaaattggaatacaacttcctggtcattttgaacatgacaaaagctaaaggatttaactttttctgtctagtacttgttccctcctaactctcaggtgagattatcattactctctttttcatatgtaacccaatctagttagttcaaaatttaggacaattagatccatctgagcagggtgaccattgcaatccgcttagcgttttctttctcttctaatgttttcttaaaatctgatttaaaatattctgttaagtgtagtttgttataaaatatttcttgctttccctttcctctttgtgatttgtgggaaggattctctttaagttaaaagcaattagagttgctttttgaaaattacaaaatatagcagaagagttgaagggaataattcaagttaatgaaaatggatcattgaaaaagtattaagtacatcaataggtaaatcatattatggattatgtctgtaaatatagtataataaagaacatctttataatcataactatcatctattaaaagtctatcacttgtcattttaaacctacaaacattttaaaatggaattaaaacctttacttggaatcacca

SEQ ID NO: 37123 - DNA, 865 bp, Bovine  19866880491794
tttatttattaaggcagcacagtctagactgactggtaaaaagggaattttaaaaataataacatggctttattaagtggagggattgggggaaggctttgtgttttcttaattacactaagaagaaagtaacaatctaataaatgtgaatgttggatggctgttgtggtttggtgattttatgaaagcaaaagcccctatgtgctctcaaacctgtcacaacctgagacgacattaacaaacaacctgaggtcacattaatgaagcccacggaacacccaagccatgtgtgacagcagcttgttcaaatgcaagcacgctcgctgcccaccacgctttgctggcccttcagggccaaagtgatgaatcagtgataaatgactcagggaataattttagacacagagcgctgactaaatgtttctgaaagatgttgaaaagattaaaaaaaaaatgcaccagatgccatctctgaggctgttcctacagaccaactcatgggcctatttccagctggtattttcaagggtcgatagcttcagcaactccccaggagctcagaagcccagccacaaccatccccgttacccgttatcagtgccctcaggagccttgaacaatcagtgcacagtgggaaggcacataggttgatatactcgggggtaaatttagacgcagaactgttttgcatccttatttttctgagtaatctgttctgccaagttttcccctttatagtctgggaccaaccaattaccatgaaaatcagatgaataaatattgaagagaatgtgttcatcgtctattttcgtgtcctcacagcaagcaagcgacattatatttttaattaagtctttatttccat

SEQ ID NO: 37124 - DNA, 947 bp, Bovine  19866880669910
tacagattcagcattaggggacaaccatctctccccccatacgccctcctccccggggttgggggagggcaaaggtcctctcctgctgagcaggctgtggggacttctgcttgaacaggtctctgctcggtaacatcagtgtccaaaccgaggcccggagggaaaggaagtaaggagtatgtgccaagtcctaggagggaaaggggtcttcaggatctgacctggtgcagcacagtgatcgcagcagaacccgaactgtgcacacacactgagtccacctccaggagggccaatgaaagggctggttcttcaccatgaagaacactcaaaaaacagtcaccttttcatggtttcatcaccagagataaaaacgttgtttctccctctttgggggaaagcataagagaccctgattttatagtgtttctgctgaaaacaggttaggggctagttttccctcaacagagctagagctgtgctgtggtttttcaaaaaaattttaaacagaagatttttatatgggcaagcggtattagaaatgctgaatatttgcaaatgcaataggattgaacctggtctgtgaggctgtttagactgccaaacaattatgcttaatggaatttgataaaataaagtttgtcagaagggtcccagcagagaggctgggtgaaggctaagttccactgagtctgtggagttggtacaaatttaaatttcttaaaatttgaaatcaaatctttgcagattttttgcccattcaatagacagaagtgaggaaaggttcttctgaggggcttttactttagcaaaacaacacgtttcagaaaaactaggatggcttcaagtcagcttgaaagtaagcagctgggacctccctgattaagattctacacttccactgcaggggacgatggttcaatccctggtcagggaagtaagatccttca

SEQ ID NO: 37125 - DNA, 1946 bp, Bovine  19866880769791
ctttggatcttgaataggattcctgttggttttaagtcctgaggacattgtacaagacttgtaaatggagaaaacgtggaaatggatccttatagtggccaataccaggactaatataataggcctatgtaaatatgctgctgctgttgctgctaagttgcttcagtcgtgtccgactctttgcgacctcataaatggcagcccaccaggctcccctgtccctgggattctccaggcaagaacactggagtgggttgccatttccttctccaatgcatgaaagtgaaagtgaagttgctcagtcgtgtccgactcttagcaaccccatggactgcagcctaccaggctcctccgtccatgggattttccaggcaagagtactggagtgggttgccattgccttctctgacgtaaatatagtcctaaataataaaaataatcataaaaatgtatttttgaaccttatccttaatatgataaggattcatataagcactcagtttcttttcatgtcctctgcacctctgcagtcctttccaagtatttctttttatttacttaaatttctttttaaaatcattattatttttgaccataccatgtggtgcaggatgttacttccctgaccagggattgaaccccatgcctcctgcagtggacatgcagagtcttaaacaccgaactgccagggaagtccctcatttgttcctttgcaaacttatgtatataagcttgagatttgtgtatctgttcctttattacccacatgtggctgtgacatgatgctatgacaactgactgaattaggagtcctaaaatgcttatttcaaagacaagcaatattaaatgagagtcaaggccttctagattagtactaaccaggcctgaccctgcttagcttttgagatcagaggagataaggcgcattcagggtggtatggaggtagacaccaaatcgtcttttaatgagttttgctctgattagggaggagattctcctggaaattttaatctgtgttaatcaaagctaaaaagtatcaaacatctaccttccccagcccttctgccagccccttcaagtatgttgttatcaacattatgggttttttagcacaaaaaacccattatagtaaaagagtatgcatgggatatacatatactaaaaaaatgattttgtttagttgaaatttaaattgagttgagtgtcatgtttctttgttcagcctggcaaattgacagctatgcaaaataagaattctatccttactggttttgttaagtgcttcctagcagagcaagacaagctatgatggttagcctccactcccccactccgcccacccctcagacaagactcagtccattcgtgaggaactggaaacattccagctctgaacttcccacctgccaggcaccaggcgggcacccctatgctctaggacctttcacctctccaagggcatctgactcactccgcctcatggggggataaagaagctttgtcaaggccaggcctcatttgccacttcagagcaccatgtctgttgacattgcaaaatagcagaagaattcaacaagaggtcttttcagaatgttcattgtgaatgcacaaaggacagtcccaagtgggtcagcagctggcctggagagctttccgggtgagaaatcacatctaagtattcggcctttgcgttccccgtccatcctgcccgcctcctccggccactcacagggacatggacaaaggcagcagacatctccctctcctcaggcaggcagctcggtccagtgagttcacacttggagggacttcccgtgttgatgtctgatgccctccccaacttcggcattctagcatatacgaagaggtcctggccccatccatccttgcaggaacccccactctccactaaacaccagctacctcatgtttaggggctctcatg

SEQ ID NO: 37126 - DNA, 1275 bp, Bovine  19866880780087
tttcttgttcatttttgtattgtagtggttggcatatagaaacattaaatacttgttgaattgtgtagttacggcatactcaacagaaaaacacacatgccagttaacatatagacttagagagaaggtagttgactcatagaaaatgtatttatttaaaaattataattagtcactgggaaactctaagcatgtaattcatttggaaaactaccaactactgaccttttagaaaatgcacctgttataccaattgaatgttacctgtatcaatttccaggatactgctccatatggggaaaaactggcacggaggtaaactgagagaaaatgttgaagtttatagcaatagtgttatagtctgcttttttctattcctgaatttttaagcatctttttattttgaaataattacagaatattgttgcaaatatttattgtgctttttactcttctcctcctttgctaggatcggcattcccatctcctactgtgttttccttattgttctttaacttaaaatacacactgtcagacactcacttggattaatatagctaagtgaaaaggcctatttaacagttaaatatctaaattccagaataatttcagggaaacacaatcagtgaatgttcgagtatgttacatatcacaaaccagggtaaactgctgctaataagtgaaataaaaagttaattaaaaattatgattcatgagattcccacattatcaaatgaagtgttataagctttctggttctattgctggagagatgctgaaagcatctttaacttcattagcctttagtgaatatattcaccaaatgtttactttgtacccatttcattgaggcattaggaatgcaaagaggaataaagacacaggcctgtggattcttccagctgacaaagtgtgtgagtgggtgctggagcctgcactgggtttggggatgagggtgcagggcaaaaacgggatattttggagacaagctgagatattggggaattgagagggagggagggcatggaaatgtcagagaaacttaaaggtttaaattttcttcattttgaattttggcagcatcactttgttacattctctgtgtaaagcatcatgccacactaaaatggtgaaaaaggatcatgcaaacaggcagaggtcatggctgcagaacacaagaagtgctcttgcaagataagggatattaccacttgaggagggagggcactttactgggtgtctgatatttgacacaaatcatgaaggattggaagt

SEQ ID NO: 37127 - DNA, 1160 bp, Bovine  19866881106950
ttgtgtcattgcctccgctgcttccaaggctgtgggtcagctctgttttcatagcttgcagacatttgtgaacccacagagtaactggatttcaggcagataattttggatgaaggctcaacttgatgcgctagcctgtgtttcaatcagcccagggcagacatagaggaccaggcaggctccaaaattttgcaaacaggaatgcttttatagtcacatggtacttgaccagcagttctcagggttccctcacgatcctcttgacaaaagtgggggaagcaatttctattttgaggctccactctggtatacttaatcagaatctcctgggtgggcctcaggcatctctgtttttaaatagctctggcaggggattcaaaaatagtgcctgcctggttaagaactagtatgcattggcatcttagaagagggcatgttctaatctgaaagggaaggatggtggggcagttggtccctgtgccaaggacaattctggaggactgtttaatgcaccagttggagcagaactgggtctgtccgtccttgtgctggccccagacccaacagttttaactggaccatttgattgttcatcagccccatgagctggcccatttagtctagtcctgagtagtttcctggtgggatgaaaccagtttctgaggctgcaaaacttgtggcccgtgatgcttttctgaggcttatgagtgacccccatgagactgcatcccagacgagctgcctggtgtactgacacctctgaccttcctgcagggtcctcatctcagtgtgtgcatgttaggtgttttagtttgcatactgcatactctagaattgatgtgttagggtcagatctcaccctcccagctcatttctgtgacattgccttcatgggcctgatgagaggggatggtggaggttgggaaggtgtggcagatagaacagcgtgggggccctgacagtgtggcctccctagaatggaaagctaaaataatgcttcttcatttcacagcctccgagcaaaatgttgtctagcatcttgggcaagagcaacctccagtttgcaggcatgagcatttccctgaccatttccaccgccagcctgaacctgcggacgccggactccaaacaggtctgtaggtgcccaggccctgccgtgc

SEQ ID NO: 37128 - DNA, 825 bp, Bovine  19866881200368
aaagagttgtggactcactgatgcagagctcagtgccagtttgaatactgttattaccataggtgaaccacacattgggttttctcagtcagaaaactttcactttgggcctgctagtctaggcgctctagtctcctgacaccaaggatccaaaacgcaaaatcagcccttaagatacagatgcaatgattcctcgaccaatattcatctctgaaaatgctgctttcctctttatatttgtgaattccattaaaatgcatgactctcctaattttctaccatatgtggatactgaagctaccatttcctgtacaaggcctaccttatgatttggcctaatgactttatgtctcaaaatttagggactgattttcctttaccaggaaatgatgacactaatttgattccatggtatctcttcgactccctaaaaatgtttcaagacctactgtctatgcatatatttttgttacaaagacatgggaatttgagcataaaataatcttgaaacatttgttgttgcccaactggagaaaccctttttctctgccaggacttgggactatgactctggggctgatacagctggcatggcagccttgggcaatctactgtgttggccagttagccgagactgagctgcccccgggctatacaaggctttctgtttcctcacatttggtttcgtgattcctttcttatcagttttcgagccattttgtattattcccttgccatatgttttctgtaaaattggttaattaccttaagcgcattgaaatatacacattaccatatgtaaaattaaataaccaggaagatttg

SEQ ID NO: 37129 - DNA, 1597 bp, Bovine  19866881218604
tgacctctctcctcagctctagcccctcccagctgctaggagcttctagtgctgtccccatcatttcatggcctgatgtcctgcatgtcctttctccagcccacctcctgccttgtgcctcttccttgccgcactgcttcccacctcaggaccttttgcacgtgttgctctcacaccctcctcatctcagtagatcctcgtcacactctggctttcagatgaagaggctcttcttgcaggaagtcctgcttgatgcacctaattgtctctctgtttcctcttggccactaaagagataatgctcctctacttcttcctcccctcacctttcgtctgtattccacatctgcctccagaccctaaactctattatcaggagagccggggtctctattatctttggaaagcaacactttctagagggttttgcatcatttcagccagtctcaatgtagaatggcaggaattctgttttcccatgtagcagaaatacaatttacatttactctgctggcttgctaagaagtatgcacagttcctcatccttttttaacgtgaatttttgaattttttgaattcatgtaattaaaatatacatgtaacataggttgacattgcaggatgtgagaagtatttttgttctcacactgacatgccacagccgccccatgctggggcctggcttgctgcagccccaggaagcacctggggatcctgatcccctccagccaggtggctgcttacctgggggtaaaacccccgaggtggccaggtgtgcagaggagatttcatttaatttacagccttccagggtcaaggggttttcattcactaaattaaaatgtttgacagttgattgcttaatataagtgggcaggagggaaatctacacttgggaccagggctcaggaaaacagacctcccctttggacgtattccaaacccagagactagagaaatgttggctcagcaactctgtggtctaaagtccagtgtgactctgggaaaagtgtggagtgtgcgtgtgtatacgtgagtgtctgcatgtatgtacgtgagtgtctgcatgtgtgtacgtgagtgtctgcatgtgtgtacgtgaatgtctgcatgtgtgtacgtgtgtgtctgcatgtgtgtacgtgtgcatctgggcacttgtggggcagagatctcaggcccagacagcacttctcctcaggctgactttggagtagccaccctgttgtctcactagctcctcgcttagcagttgtcctgcagggctggtggctctgacagtgacttctgaatttcatgtcaattaccactttggtgtgtagtattcttactctgttttctgttgactacactgaaagacaatttaacatgaaattattcttatttctctgttattttcttccccacactcaaccttatgtgacttggattacaatgaggcaacgtgaacctgtgttcaccttgaattttaaatattcctgctggtccttatagcacgttcacctgaatgtgcaggatagtaaccatgccatgagtttccacccagttgattagatccacccacttaatcagtgactatactcatgtcaccttgaat

SEQ ID NO: 37130 - DNA, 1611 bp, Bovine  19866880356998
accttttatagtgttccataatcttctatattcttcttttttactcctttaccctatatgtggtttcagtcttgatattttctactagttgaccgaacttccacttcactaaatacttcatctgttgtgtctaatgtctcatgtaataatttactatatattttatttctaggatttcttaattataacaactaatttaatcaaaattagataatgattatccatgaatgctaaaaacatagggttgggaaaaagaattttcacgtgatcacaaagaatcatccacagattattcactaattactatagtctaatgtatctttatcttaagagacttggtggttgctcgatgaccagatgaccaccttagcatcagcagttgtacaattggctatcgcatgtcttcagatatgatacaataaaaaacaaggctatatcatgtattctttccacaaatgtgtagttgaatctgatgagagaacagtcagacaagtttagaccatcagatgtcttgcaagacaaatggccaggtctctttgagaaacaaagaaagggcaacaaattccagatgaaaagagattaaagagacataacgaacacattcaactatgtaaaaacactatgtcacttcatacataattagatcccagaatgggaaaaattcaacatggaatgtttatatagacattactgaattgttaattttcttaggtattatacatataagagaatgtattcatttataggaaacacatactgaagtaatcagagataaaacataaagtcatctatagcttatttttgcgtgcttcagcaacagatacacacatatacacatacatatgtgtatatatttatatatataaggtaaattaatatacatataaatgtaactaaatatatatatttaacaagtaagttaaattccccaataataaaataaatataagataataaaccaataaagtattttccttctgaatcaatagagaagataaattaagcttcttcacagaatttactaaagcagataatgtgaaatatattctaaatagcttttcttgaaatattgaaaagtaaatatttgaaatctaaaggaataattgctacatgacttgaaaatatgaacaatcagaacattcaccagctatcagaaacaaaatcttaatgttattatatattaagagagagctgctactttttttctataagcaatatgtccagccctgtggagtctcttaattcttccagggtagtaatatataatttgacaaattatatttctgcctgtcctttatagtcagagttcctccattccattttattgcaagtagttttactccaaaaaagtaattttaccttcacaagaagagattcaagacttttattttgctagcctgagaatgggacttctgggtacactttcttaatggattatgtgttactagctttgcctgtgctttctaggctagcaatggcacaaagatatttctatattacttttttttcacagtgtaatagattctagtacgattcccatgagttagattctgtggaaacattttccttactgagaaaaaaatgcatgtgaaattaacttgcttctaaatc

SEQ ID NO: 37131 - DNA, 876 bp, Bovine  19866880424728
attctccaggcaagaagtcgctcagtcgtgtctgactcttcacgacccccatggactgcagcccaccaggcttcctccatccatgggattttccaggcaagagtactggagtataactagtacgtacaaataaatagaaatgctatattcttagcagtggttatgtttgagtgtaagagtgtggccttgagtgagtgtgttgctaatggagaatcataactgattttataaatgaaagccaagtttacatttatcacaaaaattttaattatgttttaagttttaattttaaaacaaaactcaaagaaaataatgaccaaaagaggattaaacctggatcttcattcttgatgaccattaagcttattttatttgtccatagaaattatacattggcagtttgtaatttttcttcttttccacagcatctgaaactcagcagatgctcttaatcatgtctgtatgcagatcccatacactagctttgccatgttgttcaaagaactgtggtctctagggagagaagtttctttcattagtcagtctatcctcaagggccaaccaaacagcccagtgtctgctggctccatgcagagttgacaatcactttgacttcttaagccagtaaaatcagtttctcttcatccaagtttattattaagaagcagtttcacatacattactgcatttatggtacagaattaggttgaagaaagctgatcacctaacgtgattactaaactcagaaatcagggaagaagattaagctagaggtaaggcgatggcaccccactccagtactcttgcctggaaaatcccatggatggaggagcctggtgggctgcagtccatggggtggctaagagtcagacacga

SEQ ID NO: 37132 - DNA, 2991 bp, Bovine  19866880513819
gaggcctggcgtgctccatttctggggtcacaaggagttgaacacaactgagcgactaaactgaagtgaactgaactgtcaatatttagattcatcaattatctattcaccattgtcatgaataattggaagttgatgatatgctccatatataaaaatatataaattctgctacctttatgattaagtacatttttacttttaattattgccaatatttattcagcattatttataaaaagatttctggtgcaaaaagaatgctagtcatggaaaagatacaagcccttggttataacattttgttgatctacaaaatcagtgaggactcagaaaaaaaaatgtcttcagtagtagaaacttgcacatcaattattgctgggtggcagtacattttgctgagaacaaacggcatctgtagaaaatcaaataaggcaaggcaacaactcaggaattgccatttgagttttcagccatttcctaatgtcatgtttttcaaattgcatcatgttctcattcctgctatatgttgctactttggaaatagaaaccaaaaattaaactacaagttgaaaattaaactacatcttttctcagttgagaaaagatgttatcattatcctcatggtaagcatggctatttatcaatgcatttgattttgtgagccaggcactaaagaaccatattttcaggagcattaatggatcttcgctgctcccatagaggaaagcatcctcacccatcttctgtagtcttgacattgtccataaacttcataaatgtctatgcaaatgactttgcagaaatgacttggagaaagatgaaaaccaaagactcaatgtatcgaattccaggcttgctgtgtgcgtgtgtactcagccgctccattgtgtcactttgctatcctatgggctgtagtcccccaggctcctctgtctgtgggattttccagacaagaatactggagtgggctgccatttaattctccaggggattttcctgactagagctataataatcaagagggcatgactttggtgtaaggtaaacatatgcagaagtaaaatacacgtcttaaaaattcttcagccatcaaaccaacacaatttccatagattgtgtttcagtgtcttgtaaggtaaacattttaagctttgttatttttcctttattgttaaacatccattttgccataatgtgcattctccttctgacttattctacagactaaccataatatattgttaggtttctatggatttcttattctaaaagagtctttatcttcaagacctgtcctgttgtaacctgacttttgttaactacaaattggcactagccatgggcacttgccacctacctctacgaggattaaatcagtgttgctgcaactgctgaccttcaacaccccctgaacggagctcagggtggagagcagaagtttaggcactctgagcccagggaaaaactggcaggacaggtcctcagagagttaagtatttttaggagacgatttcatgagcccaattcttgtatcgcctcatatctagaaaaacactaaaatccttcatggtgacaactgttactcatgactagcaaaagcttcttgaaactaatagaaaacttctgggaaaatatgttcttaattgtatttactcctccttcaccaaaatcacatgtgtactgaccatccccctgctgctttgcagcagtttcaaagctctccgggttgctgtctcctgcgccacagacctcattttgcccccaataaaacttaaccagcaagtttgtgcttttttctcacattgtgcattttttttaaattgacactttgaagctgtaattgttttacagtctgcataatattatcttagtgttctaggtaaagtacattaaaggctatccaatcatattttatactcaggagcaaatgtgggcagagctttcactgtatccagtaagcctgagcaaagagctattattaccgttctctcaaattttccctgtggctaaggcaatcaaagagaggaattcagtctacaggaggaaaaacagtcattaatttcttctttgagattcttttaagctctgcacaaaatctcatgttacaatcctggaaatacctaactaagatctaagatgaaatcagctctgcttcatgccttataaagagctccctggttaaaaggtgcccctgccactagcaaagtggctctgatggtagggaattcttgcctgcaatgcaggagacctgggtttgatccctgggtcaggaaaatcccctggagaaggaaatggcaaccgaccccagtattcttgcctgggaaatcccatggacagaggagcctggggggctacaagtccttagggtcacaaaagagttggacgcaacagagcactgcctctagcaaagacaaaagacaatcctatgtagtcactcttcactgactagggctctgcactagaatttgagactaaagtcttattatattctatccttagctttggggaccttgtgggataaggtgaaaggtcaggggtactattatgacatccctgtatctttaggtcaaatattgtttatttcttgtctcattgactcccagcattaataatctggtttatgtattttcatgtcatcctttactcacatacttcacatgggcaggtggtggcttaattttccaagaaatatcctcctatgttaacaaacctgacatgatctcctagcactatcttaaaacctatagtatgttattgccttgggaaactgagatagtgtttgagaaggaaccctgaggctttcgagtgcatggaggtcctggaaaattgtggggtcctcagtcatgagtgagggtgaaagtggcacctgaaagggcaggcaggtgaagtgaagggaagtgaaagcctctcagtcgtgtccgactctttgcgaccctatacatggactatacgtggactgtatagtcctggaattctccaggccagaa

SEQ ID NO: 37133 - DNA, 1448 bp, Bovine  19866880656972
cttttgtccacatttcttttttctatttatttttggctctgcattttgagttgtcttttctcaaatgtccagttattatcagcactcgttcaagtgtgaaaatgagaagctgattggaggacgtgcctaggtgtgggttggtggaaggtataaacccgggctgtctaacaaagcagaagcagcttcctagtccagcattttaatatgtagatgtttatataacaccactgctcttagcaccaacagatactttatcctgtatctgttgtcgctgaatccagagctctgtggcgtagtttctccagactgcacctgttgccccgaaggatggatatgttgaggtagttccctgacttctcagggaagtgcaggggagcaggcaagttcaaccaattgacgtacaggtactaaaccaatcaggtcttgttctaggcgttctgcaaggcaaattagatcaattcttgtaggtacttcacctcctgtaggcatttggatttctatttcttctacccaagtccatcaaatcttccccatcattttgttatctaaacatttttcgaaatctttcatccatagttttctccttatgttgtctttatccttgtggttaatccttttttgattcttcactggtattttagtgaagtttttggagggagagctaatggacaagagtgggcaatccgctaaacttaactggaagggctcagtagttagcagtcaatatttctgaaacattggacagtatgacagcatgcatatggatgggttggaggtcatacatattgttatatatcatttgcagcattagaatattatttatgactctaccttcaaagtatgatcaaaatttgaacactccagaagctgtcatcctaatccagtgatgtcattttaaaccaggacaccaccatctgtcatgtggactgaaacaatgtagcaaatgagaaaagccaatctggatttattctgactgcctgaaatcagtccaatagctgacttcagctccaagttatgcctgctagccttcagaggagaggtcctagctaaggcttgaactgttcaatgagtacaatgcctagcagtcgtttcacagaataggctttcaatttccccccagatttaaatctgacctaacattcatttcctgccttaatatgtgctcaccagccccttaactccctttcatttctgccttctatagaagggatatagaccattgacaaccgtgtattctatggcaagagaaagagtgtggaatataaagtagaaaaaatctctttaatgcaagaaaagatctgtaatacatgagccttcactgacaagaacaatctcggttgatgttttgtagttttgtcaaaatacatgcagtaaactttcattgagtaaccagccttctcttgctgattgtgtaaataccattcctcagcaaacccataaagaaagat

SEQ ID NO: 37134 - DNA, 1274 bp, Bovine  19866880687112
caaggccagaggcaaagcatccggaacacagattttgtagaaaaatccaataaagcagcagcataagactgagaaaatattgtttcagcaatagacttcttcgctaactaatatagttgtctctggcttttctgtgattcctggtaaaaccaacagatattgaaaagtacattactcctagcttatcgatcctgcttttctcatctgtacttgtttttcaaccaggaactgtctcgtttatccattcagcatccatttattgaggtccaagtatgagttttagcctctggaagtttctcaaggtgttcacaattgttttagagactaatggacagaaagacctattctagtgtgaaaatgggtatagaatggtgggttgaagagcaaagacaacttaacctagagaagctgagttacagacacaacaacctatttgcattcaataatgcaaattcatatgctggaactcagaacaaatcttttcaagagtctttgttcaatcctctattttgagaaactctggtaatatatttgagaaacctgatttttgtggacttcaggttttggaagttggtgataggacttcaagaactctcatagttgcctcttgtgaaattgggaatacaataagtcctctatataaaaccttcaagttctgaacttgcaaagatgcaaacatgagttcatatgtccagccatgtaagttagttcacatgtctggtgtacatcatcatgtgcagcatcccctacaaatggtggtgcttttgtgtacattactgtacaggactgtatagagtagagaagtgtctttatttcaaacctagatgactggaagcaagcataaaagtaacagtgatatagctggtactgctaagcagcaccaagctgataatgacagaaacaaaagtgaaaataattgagacattggagcaaggataagagaaaagctggtagacatcattcgttcttataacatgaattgtttaaccatcagcacaattctaagaaacaaggataagatcatggaacagatgaagtcagctgtgctgatgatgttgacaataaataatattaaggaagcctggaaaagtgatggaggagatggagaaacatttcagtgtgtggattcaggatcagtattagcgtcctgcttagctgattccaaagaaagctaaaagcctttatgaagacgtgaagaagaaacacagcaaagaatcaagggtatatcttttaatcccagccatggcggtttcatcgattcaaagctaagccaa

SEQ ID NO: 37135 - DNA, 2396 bp, Bovine  19866880770978
tttcactttcatatatataaatacatatatatccctccctcttgagactcccttcccctcccactgcacccatctaggtcatcacagagcactagccaggctgggctccctgcattatgtagcaccttcccgctagctagctattttctacatgatagcacatatatgtcaatgctactttctcagttcttcctactctccccttccctggctgtatccacaagtatgttctctacttctgcctctccattccttccctgcaaataggttcatcagtactatttttctagagtcatatatatatatagttaatataggacatttgtttttctcttttggtgcaatccgttagtgtctggtacttattttttagcatagtatcaaatggtccaatccagtcttgctaaagtgcttaaagtttctaagatgtaacactttttttactttgtttctttgtaaatattgttccctttatctggaataacctttccatcttctccctctgaccagtgcctgtctatcctctaagattcaactcaggtaatttatcatctgctcagtttctctccaactggcttccatctctgtgcatttgaacatggaggacacttctctaatagctctttagtgtttggtcattgcccgattgtgtcttttccccctggactttgtgacacttaagaacagaactttgggtttattttttaattatccttatataaagatacatgttttccaataaatgttcagtaaacatttcttaattttaataaacacttaacatttaagaaaatgaatttctttgtattttgagacatgcaatgcatgcttgttatagctgtgagtagtttctctctgtaaatcaaaatgtgactctcaagcctgaaacactggagataaggtagagtgaggggttagaatggcagagaatagaaacactgttggtcaccaagactgcaaggctctcagtgactgactgaatcaggactccagtccaaggctgctgctgctgctgctaagtcgcttcagtcatgtccgactctgtgcgaccccatagacggcagcccaccaggctcccccgtccctgggattctccgggcaagaatactggagtgggttgccatttccttctccaatgtatgaaagtgaaaagtgaaagtgaagtcactcagtagtgtccgactcttagcgaccccatggactgcagcctaccaggctcctgcatccatgggattttccaggcaagagtacccgagtggggtgccattgccttctccgcagtccaaggctgctaacaacaaattcaatctctttccactggttcctggtttccttttagtcctattaatcaatcttattactccagcttttcttcccaatgctaaaagttcctgcacatgttttaccttcttcctaaaggcactgggattcaataaataatgtagatatctaattttataacttaacaccttaaatttctacttaggagtccatttctgccttccctggactacctcacagacatctcttatcatcttatcattgagatttattggtgtcatttcatttaccaactgccgttttcaatttcgatcagaagcagatgttcaatctggcatcttccccagctgcaatcagtgtacataatgccacagctccttgattggcttcaaaacatcttcctgtgtgcagtcaggaagacagttttaggtttctgatggcacatctcaagatgctgcttaatttgtctccagttctcaatatcttagttgtttcacactgatctttaaaaatagactctctgttgttgtaagctgagaagtggtcctaaagaagaggagattaaaattattatagtgcaatatagattccagatatcctattgcactatggatattaaaaggaatatgctggagaaaaatgtagatgtattgaacatgagcagttagataacccctgttagttgataaagttatttactgtgattattgttgctttcctagtcagtttttttttttttttttcaacttctcttgatatgaaaagaagactcttgagatccccttggactgcagtaagactaaaccagtcaatcctaaaagaaattaaccctgaatattcaatggaagaactgatgctgaagctgaagctccaatcctttggccacctgatgccaacagttgactctggaaaagaccctgactctgggaaaggttatgggcaggaggagaaaggggtgacataggatgagatggttagatggcatcatcgactcaatggacgcgagtctgagcaaactttgggaggtagtggagaataggggagccataggccatgaggtagcaaagagttggacatgactcagcaactgaacaacaatataaaaaaagtagtaa

SEQ ID NO: 37136 - DNA, 1693 bp, Bovine  19866880772009
aagttgtatgaaagccagaagagaaaaaagtacagaaatatgttggtccaataacatttgaatgaaaatggtattaaattccaccctttctccagctctgagatcacagaaatgacctctggcaaggacccaaccatctttgttgttgttctggcagtgatgtccctggacagctggagaagttatctatctctatttgaacactaactgcttcaaaaattagagcaagtgctacagtagacaatgcgcagcaccatgaatatattcagttcgaaaatctgtgtttggaactaaacgtaaaacagtgagaaagactgcaaaatacaagcaccaaaaatttatttctgcattctctttaaaatgctatgcagcattgccagattcagcaagtaaaaattatagggtgtctatttaatttggaatgtcagataagaaacagaatgcttttagtgtaagtatgacccataatctggtacacacatttatcctaaaagcacttactttttgtttatctgtaatcaaaattatctaggtgtcatattttatctgtcaaacctacagtcataaaaacatatgatataatacaatacctgagaaaacttgaggacaaaaactcacaacatgccaggatccaggaaagtttatactaattaaagtatttactgatgagaatagttaagaattgatgttcatagcagcttttgctcaaactcttaaagcaaatgaaacaactgacaaaggatcaatttccaaaatatacaagcagctcttacaagtcaatatcagaaaaacaaacaacacaatcaaaaagtgggaaaaagacctaaacagacattacaggaaagaagacatgttagcagatggctaacaaacacctgaaaagatgctcaagatgactcattattagagaaatgcaaatcaaaactacaattatacatcacctcataaaggtcagaatggccatcatcaaaaagtctgcaaaaaacaaatgctggagagggtgtggagaatagggaatcctcctactctgttggtgggaatgcaaatcgatacaaccactatgtaagacagtataaagactccttaaaaaaactaggaataaaaccaccatatgatcctgcaatcccactactaggcacataccctgaggaaaccaaaattttaaaagacacatgtatcccatctgtcactgcagcactgtttacaatagctagaacatggaagcaacgtagacgtccattgacaaatgaatggatagaggagctatggcacatataaacagtggactattactcagtcataaaagggaacacatttgagccagttctaatgggatggatgaacctagagcctattctacagagtgaagtcagtcagaaaaacaaatatggtatactaacatatatatatatatggaatctagagagacggcactgatgaaatgtgcagggcagcaatggagacagagacacagagaacagacttatggacacggagatggggaggaatgagggggtggggtgcatggcaagagtaacacggcaacttacattaccatgtgaaattagatagccaataggaatttgctgtatgactcagggaactcaaactggacctctgtagcaacctagaggggtgggatggggagggaggttaaagaaggaagggagatatatatatgtatacacccagg

SEQ ID NO: 37137 - DNA, 1734 bp, Bovine  19866880854839
gcggcatcgggaaactaggaaattgaggacagtaccaccaatgattaaggattaaagaatgattaaaaaaaacaactaagattagttttaagatgtcaggaggaataccgtctttgtcatttaaaaggtagcaactaaaaataataaaaacaaaaatctaaaacaaaaagcaataataatactaataggtaaaattcagtgagggtatctgtcctcaaaaataattagtatctgttttaattctgcaaccatattgcaagtacattccattaacccattttaaagaaaagttgcagagactaaggtcaaagctctctgttttctaacatgaattgattctctgaatttctctcttattaaaacaagaatcttcaactataccgaacacaaatatttagaaaataagtattataatattccaacaaatagcattttatacaaatatatatgtacaaacactcatgcacagacacatgctaaactttggtcatcaatagtgcaaaagtagctaagccacaaaaatgaaattcctaagctttattcctgatttctcttacgggtctttatatatagtactttttcaaggtccttataaaataaatagaataataaccaaatgctgattcttcataagcaaaaataactaagcaaagaggcatcaggctagaaagcaactgtgtgttcattactcggacaaaccatacattttgctcctaaagtatctttaaaaagtctgaagcttgcatgagtggacaagtatgagctaggttcttctcctttacatatttgttaaaaatctattttctagctagagaaagatatggttgttttcacaggttatttagctcatttagactttccagagcaaggtttgcaggacttgcccttgatagagagacaatgaagggaagcttctgaatatttaatagagctagaaaatcctacagttaatattctcttgagcttgcacagtgctgacttagaaagaaacccaaagtgtatcttttccacattgtagaatcttaaaaatgctgtgtgctttaaaatgacactcacaacttgaattggtttcattcttaaaggtaaaacatttcttttaaactatgtgctaaaagtctttagttaatcaggaaaaggtaactttgacctttaccttatgtttctgttaatgtctcattttttatcactttatttcttgtttttagaacttcaaaatctggcaacagctcaagttttatccaggttttattttgttctgctttgtcacttttgttttgctttatttgaatcagggacacattttaggaatgctaagcaaatcagccatctaatgccattttaacagcttttgtacatccaacatgctttgttgattttgactttataaatgtgaaaatttctttaagacagtaagttttgaaagaactaggactggagaaggaacccccatacaaaaaaagtccttcttaaatggttacagtaatccttcactgaatatatttaatgacctactgttttgtttcttctctgttctgcagttttattaattgtgcaagagtctaattcaattcagtaaatgtttcttgttcgactattaagttgaagcttctctgcctgagattctggagaaaccaagacaagttctcatatacaaagagcatggtatttgtggggggggatataaaaaaataaatgcctcagatagagataaaaaatagttcattcaataagaaa

SEQ ID NO: 37138 - DNA, 1109 bp, Bovine  19866880988323
acatgaccctggaaaaacctagccttgactaggtggatctttgttgacaaagtaatgtctctgctttttaatatgctgtccaggttggtcataactttccttccaaggagtaagcgtcctttaatttcatggctgcagtcaccatctgcagtgattttggagcccagaaaaataaagtccactgtttttactgtttccccgtctatttcccatgaagtgatgggaccggatgccatgatcttagttttctgaatgttgagctttaagccaactttttcactctcctctctcactttcatcaagaggctcttcagttcctcttccctttctgccatcagggtggtgttgttcacataactgagattactgatatttctcccagcaatcctgctgttctttatactattctcttaatcatagggagaagcagacaagactcaacacatagctcagccttgacatttccaatccaggaatagaaaaccagaatgccaactggagtctatcccagtaattttatttcacatgacctggaatattgatttcaaaaaagagaaatcacaggaagttgtatatgtgtcctggataatatgtttaacactaatttcttcattcactcctgacacttagagtaccatttgttgcccttcacatgtaactgaattattaaaaaatactgaagaattttgaagttccaggaccaagttccatagaccactacatttatcctgggctatcccaggttgtttttacacatatgacttagagctaactagttacaagatgcagaatcaaaaagttccctttgcatttttattttactccagcctctcctccttcatcagcagtcatcacttttcttaacttgtcgccttaacacctcatccttaagtggtgactctcttaactcacttatcttttttttcttttaattaaagaaatgtgtttatttatttgcctgcatcgggtctcagttgcagcacatgggatctttgttgcatcatgcaggattggtgtcaccgtacattagactctctagctgtgtctcatgggcttagctgctccacagagtggggggatcttatctccctgaccaagtatcaaacccg

SEQ ID NO: 37139 - DNA, 739 bp, Bovine  19866881015536
tattaaaggaagatgataaaattgtctttttgtacttcacacaaggtcgaatttgtatatgtcccacaagataagttcaatctcttgatatgcttcattaacattctctataaacaaaaataactctccactgtgaaagtatgatgtgtctttatcttgggtcagtcctgtgcttcacactaaagagagactttagccttacctaaatatctaaattcaataaaatattattctaagcctaaaataaatatctccatataataagttgtctcccacctacagaaacttacacccttgttataattacttcagcactaacaactcctcctcttaacactcaaagtgtgttctgagaaggcagtacacaaacctggtaattttaaaaagagtctaataataacacgtaatgtttttcttcttccagatggccacgtatcatcatttacttttattttttcttgtttcactgaattttccatttaaaattaagtatgtctatatcacttattctgaactaaatctacacatatggaatttattcatttgctttgccatttattcaaatttgtaaggatgcaaatataagaaatataagacccagatgactgcacataggtttaaaaatgtgccacaaatgtgattcttacgaaatcaacaaaaatctccccaagttttgtgagcttttgcatttctgtgaaatacgggaatgctaaaggtgatgattatgatttattgagtg

SEQ ID NO: 37140 - DNA, 1537 bp, Bovine  19866881077149
ttcaggctgagtttactggttacacccataatgtctctctcaacctcatatccatttcagctttcagtattctagttctatagcaaaagtttgtgttttctgactttatgcttttccctaattattaatcagtcaacaacatgtatttgtatgcagaagaactagagtacttcactaaaggtgaagataaacaggaacaaaataacaattcacagatctataaaacagtcagatttccccatttagttaaggagcaaacattataaagattttctttttcctggtagtttactgatattgattcaatgctttataaaatttcaaagcacatcctctatctcattgttcacctttctgtacagtgtgtgtatatatatgtgtgtatatatatatatagagagagagacagagagagagagacacagagagagcccctggctgtgttaggtctaatttaggttctaaacttgctggtttggtactaaacctgaattctttatgaagaagggagctgtgccaaatggagacatttgaagatgctgaaactcctaagatgctgtgcatgtggtctgtaagccatgttcattagagacactttacagcagcattttatcagtcaagtgaagtgttagttgctcagtcatgtccaattctttgagaccccatagactgtagcctgcaaggctcctctgtccatggaattctccaggcaagaataccggagtgggtccccacgcccttcaccagggatatttctggcccagggattgaaaccaggtctcccacattgcaggcagattctttactgttaaagctacccaggaaccaactatttttatcagattccaacaaactgacaaaggttaagagctgggttgccatgtttatttattaatacaaactcaaatctactcattgccctaagtaaatattcattccagcttgtaaagaattatttctgattaaaagcacattcctaacatgatgtagaagtgataaatgttttatttctttagagaaaaatgttgaaatatttccccatccatctctatgtctaaatatttagcagaaatttttatgatgcaacttagttcttcacactgtcctaaaatccttcatctgcactaatttttacccttcggtaatgtgccattggattctctgtcatgcttaaaatagaattgcactgaaaagaaacaaacatgggtagttacagttaatgatctattacttgggtatctgagcataaagaaacttcatgactcaagggaataaagagaagcacaaatgaacacttttaatcacagcctaattatacttgtccagaaatattgtattgtttatagaaagcttcttgaatgccacattattgtttgaaaattaaggccctttttcagatatatcttatatttcgttttctggcagtgctaagcatttacctctcttcatgttggaatgcatgactctcagtagaccaacagaccacatgcgcaataatcattagaagtccatgaagtaaaagaaatgaactttcaca

SEQ ID NO: 37141 - DNA, 1209 bp, Bovine  19866881194531
gctgaggattgagtaatgaccccttggggaggtagcagggccatctgcaactatgcacgatctttcaaactgcaggattcttaactggatgtattacgctgtggacagcagttcagtggggcattttcctactcttgagtcactagttaccttgccagtctatgggtctgacttggttattatgccaggtcactacctgcctcccacttttcagggcagaagtgaactacggaagagcatcatggctagccaggaggctgagctttcaaagttgagcccagaggggaccttttccaactgtagtcagtaatgtgctgggagccaaggagcaatactgggtcatctctcatctgactgtgcagtatcctatcgaacacccctgttccttgggttgggcagtcacaggggttttgttgtggtgaatatctacacggtcaccacctgcctctcacatggggcagtgctttcccctcagtcccctttggactttcctgacaactagagctgtccttttgttgcttgaaggatgggacctttcaaggaaaggccccccagaaaccccctggttttagagaatggggtaggggaggatgggaactgtgagctgtgtatcaaaactactctccacttgactccctgattgaagtttatgctgtgtagaggggtgggagcccccaaggtgagcaggaacggtgctgctttatttgaaatgttttcttacctcattctgtgctccagtagggggcccagcctcatttttctggctcggccccacatcctccagtccctgctccactgcctatctggtgcagctcatcacccagggtgctgcctgccactcttcattaatgctgaccagttttaatttatctcttgattctcctgcttctgaagcctgcccagtttccctttccttgacttcttttaagtttgttttgttttcttgtgtttgtgagagagagcagaatctttcttatggctccctctattggggttgggatgggaggagaaagtaacttttttttgtatatgataagcagtgtcatacctaagcatttctcctgtaggactgccttgctggtatggcttcctgctgtgtcttactttctgagaagttttatcttcccacctccacttggatactgcctctaggacctgagcagaacagcagtaaaggactgacacacaggaatgggagtaggtcctgat

SEQ ID NO: 37142 - DNA, 1127 bp, Bovine  19866881230742
ttcttgcctggaaaattcctggacgaaggaacctggtgggttacagtctatggggtcacaaagatatgattgagtgagcgcacacacacacacacacacatttctttgtttagctaactacttatctctcttattttctctagagagaactttaggacactaatgataggaaactgcacattgagtttccacgcagtaaacgtttgcatgtgtgattgaaataacgcaacctgcctggtagtaaagaggacacattaattaactgccaccatgaccgcgttcacacagaactgtgcgtacgtaatagtcagggattcactggcacttttttcttacagttttgccagaaacaaacacctggcctggtgcctaatgaacccagccattctccatctgttttatcctggacttattcccagtcactatgtcactgtgtgtagggattctaaggaggacagatatttgtgacccgaggtcataagaatcagtataatcttgatttagtgactggggctgtgtaacatttgagagagcaaataggaaagtattttgtatttatttagagaaaaatggcctgatactggttatgaataagtttactagaaacaattatttttgtgagtgtaattataattgtatgaaacctagttaatcagactaagtagagagaactctagtttaaatctgtatttcagaacatttaaagcaaatgtgattttgttacttgcaaatgaacattgcatttaatattagattgaaagtgttttctaagagtaggctttaagaaatgccctctattataaaatgattataattgtatccattaattatctgtgaatagttgtttctggaaagactgatactttaaaagaatttataatcttagtgccttgcataatccattctgaatctaactcaaaacattggattgatctatgaaaagagaataacaatgccgtttatggtctatggatgggttggggctggcagtgttacaaacatgtatagtacatgtttatgtgcatcacaacagcctccaacatgagcttagatggtgaattgtttttttaagtcatcataaagatagccatacctatttttctgtcattctaacatcatgtttaaaa

SEQ ID NO: 37143 - DNA, 1713 bp, Bovine  19866881270084
ttgatcgatactaggagcactgttacagtttccggcaaagtgctctaactttggaatatgaactggaataaatttaaaaaaaaatctctgaattaatctaaaaaacaaaattacagacctaaacacttggagtaaaatgaaaagtattagaaaaacattaacttttagaaaggctgactcattgttaccatcaattatttgcctctgagaccaagaatatgtatatattaagatacctctactgctgctgctgaagtcgcttcagtcatgtccgactctgtgcgaccccatagacggcagcccatcggggtgccattgccttctctgaagatacctctgctgctgctgctgctgctaagtcgcttcagtcgtgtccaactctgtgaccctatagaccacagcctaccaggctcccctgtccctgggattctccaggcaagaacactggagtgggttgctatttccttctccagtgcgtgaaagtgaaaaaataaagtgaagttgctcagtcgtgtccaactcctagcaaccccatggactgcagcccaccaggcccctctgtccatgggattttccaggcaagagtactggagtggggtgccattgccttctctggaagatacctctagtacaatttaaattgaactatccttcacactggacttatttagtgacaggactggattatattttaccaccttcttacttattatggtagattgtatagtttctctctctcactggctgttgcagaaagctaaatgtgaactaccagatgaagcaataaaattcctcttctgataaaactcctattcaggagaaagtgactaaaggtcaagggtcaacagtggttcaatatttacttcaccatgtgaaaacacaagaaacatgtacaatctttaaagatgaagatagagtccaaataaaatcatttttaaaatcttgtttattgtcatcgtttaccatgaggagatgcagtttatttacaccagcagccataggggcaaggggaatacacagttagttagcaatctgtataggatggactacttatgcaaaaataagactctccaaaacaaaggacaatgagtttcactatacttccccaatgatcccagcatgcgacaatgccaggcaatggcccctgggcatgcggtgatgggaactaatgtatggaagaaaaagtcacaaaccacagaaatttgtaaagaacccctccccccccatacatacacactcagatacataatagaattacagggtgagcaatacacttatgaggagattaggacaggaattctgctgttaagaggaaagataggtaagcaaagggagagttcctaaccactgtcaactatatggtagggagaattctctccctcaaaacgaaaatagtctatcccctcagggcacctgttagacctagcccacctcatactcaatcagggggccactgccctaataatgggggggcaaaaaaaaaaaaataacacaaaccaagagggaggtaatatgaaccaaccactactcaaaactatttccaattcttccttctaaccaggagaaaaggccagaaaggaaacagtaatgtcacaatctgagctccctctctgaagtaagagtggaccatgaccttaagtttagcctgtttcccagacattattataggtaggccagagtctcgcttagaccctcctttccttctgcatctcc

SEQ ID NO: 37144 - DNA, 666 bp, Bovine  19866881312521
tagtatctataatcttagttacatttgcaaaatccctgttgttatgtaaagttacatattttacaagtctgactgtgttaaggatttcactctgcctgccgcaatcacagttatatgccattgctttcagtagtcctattttaaaaaaagagttcctgattatcaaaaattttattaagagtaaattataaagaatttaattaatatttgagggtaaaatctgtgagaaattattgtaatatttatatttaccttttgatttctggatatatgttgaaaaccaaatgtttcaagataacaataaaaattatggtccttttccctgtgaaatattctctttcataggctgtgagtcattctgtttttatttgaggcattctagctgacttgttgcattgcatatctgaaaatttataatcatctagtcttatttattttcatggaaatatataaaatgacacaactgcttggaagctttaggtcttttctcaacatatgtttgttctagttatatcctgaagggtattccacacatcattgcattggtgcatccaagcagcaaaaattcagaggacacaacagatggaattgcttttatctgtgaatggcagatattggtcattcattcagaattgccaggaactaaagtagattctagggtagata

SEQ ID NO: 37145 - DNA, 736 bp, Bovine  19866881654122
gctggtgtctttgacaggccttttaaatggaaataaaactgagattacctaatcagttacccttgtgggtggatggctatacacctgcactgaatcttagacttagaaaatgacagagccgatcatctttatgggtttcatgacagagcggacagcaaaatgattcctgagatcaatatgtggttgaaagaaagctgttttcaatggaaacaggaagctaggagccaacctgtttctatggtaaccagagcagcagctacccaacagctgtaggaaaagaaaagggcagcaagttaaaattcaaaaaaaaaaaaaaaaaaacaagagaaatccatgctagtttaccttaatagtgtgatggtccctagaggacaatcaaaatgagtgcagacatgctcttttcctacccagggattttcagcgtcactatccttgttttttcctctaaacttcaaaatcttggagctggaaagaagtttgaatacttatctaatccagtgtgtcatccccattttttctttcaaaataaagccaaaggaaatcaagaattagaaagatgaagtaaattctcaaaggtcacacagctagctgtgaaagcagagttagtgcctaggactcatggattccaactcaggcatttttccaatgcactttccatgtactctctactctactctcttctcctcccaacacctacaggtttagtcacttttctgtgaaaatattgactacacag

SEQ ID NO: 37146 - DNA, 707 bp, Bovine  19866881752351
aaatccatatggttggttacatacttcctgtcttttattcagaagtcgtcggcacagtgtctttttgtttaaagaatagtaagaggaagacctgaagctccaaatcctctcagaaatttcgatttatttttagataatacttatggaaaaagagatagataagaatattcacttgtatgatgtttttaattattaaatttgttcatttaatatctgatagatcattcattctgccagtagtataaattggcatttgtatatggatttttccaactgcttataaatatgtgaatactagagcatttcattataatatttaattgtcagactgttgtgttttcctgtatagggctgtaatcagtgatccagagcaaaatttaacctctgagaagccagaaatttctcatatccttccagattcaaagctggcacctattcgatttaggaaaagaacactgcatgaaacgaagtaagaaggcttttatataaaataaggatgtagtatgttatatttttcaaatgtacttttgtatctaatggaaattttttcctttgtgtttttatcttttctgtataaaggaaagtggaattttttggagttcagatcccagttctgtcactttaagatactgggataaactttgccctccagatcttctatttataatttaggagtgacagccagaaactcaggcagcaatacatgt

SEQ ID NO: 37147 - DNA, 681 bp, Bovine  19866881874390
tttgtacttgccaaaataagggtaaacccaggaccccatccccagcaattcaggttcacgaagttctctgtgctctgtccatagggaaactttctaagaattttgtggttttcaacaaggtctctgactgtaatatcacaagggcattctttctcccattgatctttttctctcacgcatactcagttacacattacgttagtaagagtccatcttggtggcttttctattttaagctactgtatgaatgacatacaggatagaattaaaatttaaaaaaaaaattttactgagggggggaatatattcccagaacagatttttttttaaattttagtttataatagttttagatatacagaaaaattgagacagtagtaaagagagtgtccatatagccataccctcttttcactattaatagcatcatacattattagggacatttatcacaatgaactaacaatgattattattattaactaaagtctatattttattcatatttccttagcttttaactaacgtcttttttgttgcaggattctatccagaatgccaattatatttagttgttatattcacttaaattcattgtgactgatatttcttaagttttcctattttttcatgactttgacacttttgaggagtacaggtcagatattttgtaaaacgtct

SEQ ID NO: 37148 - DNA, 2175 bp, Bovine  19866880413483
acggaggagcctggtaggctgcagtccatggggtcatgaagagtcggacatgactgaacgacttcactttcacttttcactttcatgcattggagaaggcaatggcaacccactccagtgttcttgcctggagaatcccagggatgggggagcctggtgggctgctgtctatggggtcgcacagggtcagacacgactgaagcgacttagcagcagcagcagcgggcatcaaggatcccttccttttccaggtcttttgcctaatgactttgcattagtttgtatctgcctcttccatttttgctgaggttggttacaactcagacttccctagcgattttagggttcagctagctcaccatagaactttcagaattatactcagtgctgagaagttagctgtgacttgtccccacagccttcccctggttgagcactccttttcaatgaccctggggagagagagaagtgtggcaaaatcatacaggagatttgctaaaagtctctctactgtgttcttagcagattcctttcaagtaggaactaaacctgggtttgaagttcctcttctgtgttgtagaagagttgcttgggtgtgttccttccttggggcttcccaggtggctcagtggtaaagaatctgcttgccaatgcaggagacacaggttcgatccctgagtcaggaagatcccctggggaaggaaatgacaacccactctagtattcttgcctggagaattccatgcatagaggagactggtggaatacagtccctggggtcacaaagaatcagacacgactgggcaactgagcacacgctctttcctcgtgtacgtgctttcattccctgcaaactttgttttggaaaagtaacttctgaaaggttttgtcaccaataagaattttatttcatgagattttttttccccaaaacaaccacaaaagatcatgtcttaaagatgtatacttaccatctttaatcatgaatggatttgcctgatcttcgtggctctgcaaaagaggcattctttctatcctgttttgcaaagctttcctgcattcagcttaagctttctaataagaaaaagttgaattcagtgtgtgtctctgaggcaaatcaatttagtgccagagctgagacggtggagatgtaaacgtgtgataacgtggagagcaggagtttgcttcagtgggatttgttaatgaaaataaatccagaaaatttggctttctgaagtgaacaaggagggcaaacggctggcacggctgtgatggagtgtgccaaatagattccaagagaaagctagtgcattcttttccctggaggcaaaatccaggaggctttcaaggctcaattcttgccctgctggcctcggaggggaatctgctagataatcctcctccagcctaccaaagcaaggtctgtgagggcttcatacaagttaccctgcagctcctcccctcccccgcgtagaggacttgggcctgttgaggaacgtgtgaattatacccttaagcctctggggtgaagtttgctgtaagttacatcttccagtctccctgggtgcgtcccgccctggattgctgttttccagaagctattctgagagagtggccaggaagctagacgcccctccttctgtatcccgtggctccaagcggacggcaagcccgtggaaggagctgtggatgagacccgagtttctgagtcactccttgccagcccagtcgggggcctgtgcaggcccaccccaccctccctatcctccccatcgtcgggagaccaagcgttgtcagggatcccttccaagtttacaattatggaattctaaggcaaatgatacgcccaggtcattgagggggaaaaaaggaaaactgggtcctggagttagaggagcaatgtgccagagaggggccctggagagacccactgtccccatttgctgggcggggcaccccgagggcacggaactttttgtttaaaaaccaggaaagttgtgaaccaaactgtgaccctgagtgcacttactgtgccctctgtcacactttaaaatagacgtcgatgggaaagtccagcctaaagggggtttctgagtccatcgggccctgatggagcctgtggaggcaatgagcgggtaggtgccaacctcattcctcaaaagataacaccttcaa

SEQ ID NO: 37149 - DNA, 3574 bp, Bovine  19866880436557
aatgaatgtttaattgattgaatacaaccctcattgagtacccagttctccttcctcccccaggccccaaacatctacctacaaatataccgtaccctctccatacagctcacagttcatgggcttcacatactcttcaccccaccacacacctgctttctacatgcaccacacaagcacccatgtgactcacactactgaattctgcaagggcttgaattacaattatcttaaaaacagctgaacatctggagaaagtccaaccttgttgctatgcaaaggaatgcaaatgaaacacaatgaagtaacagtttaaacctgtgatgaatgtatcagaagtaaagaagtgaaattagtcatatactgatcgaggtatgaggaaaacagtaccctcattgcttgtagtaatgcagattgactccatcttttagaaatattatccaactaggaagagttaccagaagcctcacaagtgtccacaacctttcacttggcgatcctacatttggaaatgtgactccaggaaagtatcacaggagaatagagcaatatgcttaaagactctccctcaagtgttattttttataacaaacaaatggaaagaacccaaaggtcagttgttttatgtgtcataatgtattgatgcatctgtttgatacattaaaaatggcaaatatgaagactatgtagcatctctcaaatattcatgacatagtgtgaaaagaaaacagaaaacacaatttgatcactgattaaaaccatctaatcccggagaaggcaatggcaccccactccagtactcttgcctggaaaatcccatggatggaggagcctggtggctgcagtccatggggtcgtgaagagtcggacacgactgagcgacttcactttcacttttcactttcatgcattggagaaggaaatggcaacccactccagtgttcttgcctggagagtcccagggatgggggagcctggtgggctgccatccctggggtcgcacagagtcggacacgactgaagcgacttagcagcagcaatcatgatagataaaatcaatgcaagaacacgaagctacaatcattgtaaatttgagaaataaatgcccacaaattaacaaataaatatttaataaataaatgagtactctctttatgccaacagctccatttcaaatgcctacttcagcccagttctcttttccaaacaccagattcctacattaaactgaccaacatctcctctcagatggataacaggcatggaagatgtgacccatcccagtaaacccttgttcttccttcctaaacacatcactcctcttacagctttctccatccaatggatggcaattccatcctgtcacctgctcagagaggctcacttattcctttttcttccacaccacacatgtaatctatcaggaagctttgttggctttatcttgaaaacacctccagcctcaggccacttttcaccacctccgccactacagccttggtccgggccagtgtcctttgtcacctggactactgcaacattctttcacaggtttccctatgtctgtccttgttccatggtctactctcaggaaagcagccaatgaccctttttaagacataaaacagatcacaccactcatctgtttaaaattctccatgctaagttgcttcagtcatgagcgaatcttggtgaccctatggactgtagcccactaggctcctctgtccatgggattctccaggcaaagatactggagtgggttgccatttcctcctctgggggatcttcaatggctcccatcacgtggaataaaagcttgagcccttcagatggatcactgccccatccaggccctgctaccacctggcctgatgccctcctccctacttccttacaaattctgctaaatgcatacctgcctccttgtcaccccttgagaagtaaaatgtgatcacatattggcattttcgctcggtcaaccctctctgcttgaaacactctccccacctccttcaagtcttagctcagagagcattttctcaacactgcccctcccctgccacccacaaatgcacacagcacacctcagccccacgctctgcttcccacttttctcataaccctgataatttaaaaatacactacataattggcttacttattctgtttatcctctgctgcttctgccaaaatgaaagctctatgaaggcaagggtcattgccgtcttgcactctcatgtaccccatgctcccagtacagtgcctagaacattgtagggggtcgataaatatttgctgaatgaatgaatgcttgatggtggatttaatttgttgttcaattctattatctctatgacagtaatttcaggggctttccctggtggttcagtggtaaagaatctgcctgccagtgcaggggacacaggcttggttcctggtccaggaagatcccacgtgccatggagcaactaagcccatgtgccataactactgagcctgtgctctagaccccaggagctgcaactaccgaagcctgtaaacctagagcctgtgctccgcacaagagaagccgcctcaacgagaagcccgtttaccacaaccagagagtagcccctgctcaccacaattagagaaaagcccctgcagcagtgaagacccagcacagccacaaataaatacatcaaattcgtaaacaaaaccaaaccataattgcagtcactcacagaggattggtctgagtccacagctctgaatgagtgggccttgtgcataccaccatttgtatcactggctccatcctctagaagtggtaccctccatccaatgagagcacctttcagccaaaagaaaccctgcagcctgactgctggcagaactaccagagagaattcttccttttgtggttttcatttactcaccttcctatacacaccctcgtttctgctaccatcccctcaagaatatactctaccattgcatgacacgccttccatctctccaacgactcccagaagcaccagaaaatcccactcctgccatcagatttcaatgagggggattcactcagcaatgagagacaggaaaggactagtgcaggttcctgtacaccagtgtttaacccaatatactgtgcagccctccaagcattagcctccttccccatacacactcaattaggcacattttacgtctcattatccaatatgcaatcatgagtgctaataaaaaccgttgctaccctcaacaatgcaatcagtgccattagctgtctctcagaaactctcctctgctttggtgccaagtctgctcactcacccatttatttagccatgcattcatgcacgtgtaaccttttctaggtagcaaaggtcaagtgcacacctactatgtgccttgccaggcaaaaaaatctggggaacctgccctgacaggtaaatggttatactacagaatgtgaggggcacagcagagatttgaccaggtgctacagaaacccagagaaggaagtggatggagaagcccaacttcactcccagggacgagttcaaatcccagccctgccatgctttgg

SEQ ID NO: 37150 - DNA, 919 bp, Bovine  19866880449404
actgtttttcactttcagtacacccttcaataaattatatgagatattcaacactttattataaaataggtgttatgttacatgattttgcccaaccataggctagtgtaagtgttctgagcacatttaaggtaggtttggctaagctattaattgtgatatgaggtaggttgaaagaaagtgaaagtgaaagtcactcatttgtgtccaattctttgcaaccccatggactatacagtctgtggaattctccagatcagaatactggagtaggtagtcttttccttctccaggggatcatccccaacccagggatcgatcccaggtctcctgcattgctggtggattctttaccagctgagccacaagggaagcccaagaacactggagtgggtagcctatcccttctccaggagatcttcccgacccaggaatcaaaccagggtctcctgcattttaggcagattctttaccaactgagctatcagggaaaccctgataattatgttgttcagtaggtcagacgtattaaatgtattttcaacttacaatattttcaacttaacaatcagtctattaggacataaccccatcctaagtcaaggaaaatctctctctttgtgtgcttacgtgtgtgtgtgtgtagagagaaagagagagagcaggcaaccagatatacatatacttgggcaaactgatcgcaaagagttggtcacgacttaaattgattttaaagagaatgccaataagcctcatggatatggtaatttagagactaagacctaactcacaaaccctccaaaatgaaggtgttcaggctattgagaaaccaagttcctctgttagctacccagacactgcactgaacagagaaggaatgtaaaaggaaaatctagttcagagccagacttgatccaga

SEQ ID NO: 37151 - DNA, 1894 bp, Bovine  19866880639156
tttggttctccgggcagtagccaatatctttgaaaatgtgcccactcattgtgacactccatacataaatctctgcagtggctgccactttgagtcaattccaagccccactcttctggtcctgctcgtggggtcagccagcctcatctctttgcgagtccccaaacaagccagcacacttgtcgcttcgtattgtctagacaaccctgttcatgtgacagcagtgtcctccctctccaccttgctgaaaaccgagcttcagtgctacctccaaggagtggaactccttaccccccagtgggataagacccctccttgtccctctttcctgcagcagacagatctttccttcgtggctcttactgtgactcagaactgcttattgatatgttgctacatgaaggcagaggtggaatcatcccgtatttttctcagactagaatgtctcagcacagaagtaagtgcatagtggctgctcaacaaatattgctgagttaactaaccgagtaggaaaggcacataggtggcttcccctctgaggacagggtaagttttcactgcctacatggagagcaggccaggacaaagtgcctgcaaggatctggggactgatcaaggccacctgccactgtattatcctgacgctgctgtctgcacctcacagctactatattggaaaggagaaactgccagtggttcccagctgctttttaagggaaggagtattctaagttaactctcaagtgctatgcccagtgagagttgcctggtggctcagatggtaaagaatatgccagcaacacaggatacctgggttcgatccttaagttgggaagatcccccggagaagggaatggctaccaactcacatattcttgcccagaaaatcgcatggacagaggagcctagcgggctatagtccattgggtcgcaaagagttagacacagttgaatgactaacactttcatggtttttactttgcacaatacccaaagccctgcctctctgtgacttccccagaagttcctgaggcagcacataggaaccctagggctctcaggaacacaaattcaaaaccacacatccagtagataaacacagccccagaaatcgaaaatcagcattctcttcccatcgatgctactttctacttctgagtcagtaagttgcttttattgaccaaactttgtttttcttaccattaaaataggtataatattactcatcctacttaattcattgggctattttgtagacaggataagattaatgcaaacattttgaataggtagaagcgttttacattattatttgagccccagttacacatatatgacatcttcttctccttaagggcttttaaatgaaggaagataccctgatgttcatagatacaaagacattccaaagacataaacagagtgaaagaatgactgtataattcattagctttatggatttaggtgggtggtcagaaagacacagtgttctatagcaggaagatcttcatctgcagatcaggagacctgggtttgaacctaccttgtcatccagttactaactgtgggagtttgatgggtcatgtaacccttggaaacctcagtggcccccatctgtaaactgcagggagtgggtgtgggtggggaagtggagaatggtaatgacattatggtggtttgcaggatcaaatgaaacagccacagggtaaggcctttggaaacagccaaatgccttagtgaaggcatttatatgatccaggcacttgcctaatttaaccaaagggcagtcaggagttctcagggagggctgcccgaaacagcaagactgacttgaatgatggcaggaactgggcaggtttagccggagcatgtgtgctccaggcagaggtgcatc

SEQ ID NO: 37152 - DNA, 1609 bp, Bovine  19866880771175
ctgtgtttgactcttcgtgatccctgtgatctctggactggtactgccaggcttccctgtctttcattatctcctggagtttgctcaaactcatgtccgttgagtcgatgatgccatccaaccatctcatcctctgtcgcccctttctcctcctgctctcaacctttcccagcatcagggtcttttccaatgagttggctcttcacatcagatggccaaagtaatggagcttcagcttcagcatcagttcttccaacgaatatagttgctttgtgatgcgaccatagtttgagagatggagagagaagaaaaaacacaaaacccttgcagaaagctttcaagtcaaaggaaaggaaatttctcagactagcagggtgttctaatcagagccttatcggaatgtctccagtctaacaaggagaaagccaatctactgagggcggaatgctacattagatccaatcagaatctgctttctaattgctcaacaccaggtcagagcccagtgacagctacagttgctggttctttctggaaagtgaggaacttgagttgtgtcaactcttggtctcaagggaagggaaaagctttgtcttcactcccagatattcagctccatcagctcaaaataatgagacacaaccagagttttttcctggcccatgcaaagctctagtcatcttacgactgctgtcagctgggagctggaatctatttccttttttaaaaaacatgcattcaggacttccttgatggtccagtggttaagaatctgctttccaatgcaggggacgggggtttgatccatgatcagggaactaagaccccacatgctgtggggcaaccaagctcaggcgccacgaccagagagaagcctacacactgcaacgaaactccttagtgctgcacccaagagctgacacagccggataaaacagcagatacataaacagagcgaacggcaagaaacacggcccccgagcgtgcgtttatgatactgttgctgtatgccctgcaccgtgctaggcactttgatgcgtgctatgtttctccctaatgcctacaagggcatatagcattcaacaatcaaaacatgactgttacaggatatctaccccagcccagtgaaacacaacacctccgaatctccctctaggccatcctattgttgtcttctggcaggggattaataggtacagtcaactggccttctggtggcagttataccttacattttctttgctccaagcaaagaataccatctgtgaaaccccccagctcactgcagagccctgacatgtccttctaacaaatagccacaaaggcccaccgagggctgcgacccttgaacactgataggtacacagagccacacagagagagacagacacggagacagaggtgtgcagggctggacaaagaggaagcagagaaaaagacactgaattttctttctctggctttcctcttcactgaaacaagccttcccggtgctgtgatggatgtcctgtctgaaaactagctggccacctcatccaggcgtgattcatgtgctgctactgtgtgaggagactctgtccagggctgagtcttacagggcacagaaagg

SEQ ID NO: 37153 - DNA, 797 bp, Bovine  19866880783734
actgccatgctgtcctccaggggatcttcctggcccggggatggagcctgtgtctctaagtctacctgccgtggcaggcgggttccttaccactactgccactcgccacagtggagtaaactggccctgctgtcttagagttgtcgggggctgtaagggggcagagctcggagacagctgagcttagcctggcacacagtacacactcaatgggcacaaccctcggggctgtaactactgctgttgtgactgacgaggaagtctgcagctccgccctcctctcctcaggtctagaaacagagccctgggtagcatcagcagctgacaactgcagctcagttcacatgagaagctgagctccagatctggaaagtctcaaatcaggagtcccctagaggcctgacccacccagcacagcccctggtcctgtttcctggtgccacatgccatgagcgatgtgccttctggtcaataacttgtgggcttttgggtccaggaaagatgtaacatcttctgtcagaggataaatgatgaaatccacagggagcctgcaaagcctcctggaatctcccaggctgagcatggctctgcctccctcgctgcaaatgccatctcctgcccggactgctgacagccagcctgggcctgatgccctccatgcccatggcagggacagcctggaaaaccctcgctaattgtgtcactggtgtcgcccatgattcgccaggaagaaacacaggcatcagttaaattccccagagcaagtcagagcagcagctgaaaaggtgccccctgaa

SEQ ID NO: 37154 - DNA, 1433 bp, Bovine  19866880788086
ctgggaaggctgctgggcacttaatcaataaaaataatgcatttgggttgtagaaatattccccaagatcaatttcccctgaagaaatatttgtttcttttaccaggttgccacaagtgtgtaagggaacataaaaccttgataaacaccgcctggaaaatatgaatgcatccctctcccactcccaccccacatgcctctgctccccacttacagtgacgtgagcgacttcagaccctggaaggcatctggagcaatgtctgagatctgattcttgctgatgtctctgaaaaattaacagggaagtctgagaacacaggtcaaaggtatgatatggccatatctgaggggtggaccaagcattgcaggtatgcaaaatggtgaggatgaattcatctatttatttatttatagtgcgagagcaggtcttaaagatcattcaattcaaatgcctcatgatacaatgcgctatatatgtgtatccctcttcttggctttcaaagcacgcttactcgtggcatcttgactttgacatacggccatgcacatggcagccttcgctctgcaggtgggaaatggcacccagttcgatgagggccttatcgtaggttgcagaaccaggcaattatagcataaaggaagcaaaagccagcttcgcccaaacatagcccaggggttcctgtgagcctcaccttcttgtgtaatgtcttggcaaatgcttatttttctcccccaaagtcctgagtcattttgcctccccagtgacttctccctgacctatggaggttttgagcagtgactgcagtctctgtctggttcagtgcatcttcagccgtgtggtataaagacatcatgagagcctcacggtgactttcagacatgtgattgccactggcagtactccttggacggaagcaagcccagggtggtgaagaccagaaacaatgtgagtgagaaggatgctgtgtgttagaagcagctaacccagccttggggcattgggatctccccgatcgggaggttgctcactccgcagtaccccaagtgacttctgaacacccacatctagttctcactaacgacatttccctgagtgcagagatgtctcttaggagtcattagctcagagacagcctctgggctcctgtccctggatgtggagatgctccaatttccagctacaatgaactctggtgcctcttctttaacaaaataaatcaacgggtctttgcttttgtgaaaaagaggggaagttgggggccttggagggtcaacaaggaggagacgggaatattgagaagaaagcatgtctaagcaactgcttccagcgaggtcagacgcccggctctcctagcctcttaagtgcattccttgagcctgtttctctacgccttctgcatgtgtgtgctaagacacttcggttgtgtccgact

SEQ ID NO: 37155 - DNA, 1464 bp, Bovine  19866880811805
ctgaaaagatctggtgtcctttctcgctggggagactcacatgcgcttcagtttcttgtactgggtgaaggctccagcagggatggatttgatggagttctgttccaggcgtctgggaaacacgagcagagaagagtcgatcaaccatttattaatcaaccagtggttgccgggggccttgagaacaggatggtttctcccatcaacggcacacattcttggacaagagagactcggtaaacgctgtccaaaagccagagactcatgttctggtgtttgggagtgcccagcccagggtctaactcccctgggagaaagctaggaaagatgacttctccttgagcacatttggttcttgctgatgacaagctgtctttgggaagcagttgtcatcttcaggaaaggttgtaggaagtaaccagagggctgaaaaagccaaagcgataaagagaaggatgagcagagagagatggacagatagcattgcctgtctatgcctgaagcaagtcaccattcagttaaaacctcaagtaccctactgctggcatgctgcacaggcagacatgaccaaggctgacttcagttctgggcttttcttttcttattggaggtataattgacatagaacttaatattaatttcaggtgtacacctaatgattcaatatttgtttctgggtttttaactggctgttctaatatgatggagtctaccagtctttaagctcccagcctgacattccccaaactggctcctggacatctggagggccccaggggcccagaatggaccattcccctggggcggctgctgctgcagtctgtggctttactgtcttacagactttgctgaaatgcttcctcctctattactctagaaagaacaagagaagctgcaggctcagggtccacaggttccttggaagagaaggagcatagggagtgagcatgcttctccgtcctttattctttcatctctcaaatgacttcccatcaccaagaacaggtgtggtgggaaacgggcatgagcgggaggcagggccctctattagaggtgatgaatgagggcctggcccaggctgaggactcagcatctcctcctcatccatctcccgtctctccgaggtgcggatcttttcatcacctcctcatttggcatggatgagcccccaacccttcgctgggaagacacacaaaaagatatgtgtgtgtgtggaggggaaggctgggggaagcagaaggaagagacaggaggagctggctcccttggaggctacatctagaggaagcacatttctggctgggatgaacccattcatcttgaagagtaatccccactgcagaaaaggggagacagtcatattaatttgtgcccctgcaatctcatcttcattgggggaaagagagtatttgttactggaaccactaatggagcagtttgccagcaattttcccatttcaaaca

SEQ ID NO: 37156 - DNA, 902 bp, Bovine  19866880833202
cagaactttgagatgtgcattctcttttctttgaccagattaaaacagggatccccaactgccagggctcatggcgtgttaggaaccagggagcacagccgtgtgggggcgagcaagcggcgcttcatctgtattgacagcttctccccatcactcacgttaccagctgagctccacctccgtcagatcagcggcagcatctgattctcataggagcgtgacccctactgtgaactgtgcatgcgagggatctaggttgcaaactccttaggagaatctaatacctgatgatctgaggtggagctgaggcggtgatgctagtgctggggagcagctgcaaatacagattaccattagcacaataagtgtagcaggcgtgactcatcctgaaactgtccccctgccactcagtgtgaaaactgtctcccacgaaactggtccctagcactaaaaagggtggggaccactgcttaaaaatactttgatatttccctagttctgtgacattcagagcgtgtctcagaagccccaccatcagtgttactgggaaacttgccagaaacacaagcttgggggacctccttaggcccagcgaatcagagactcaggcttggacccagagacatgtttgcacagggtctgcagggaattcttaggcacatccgactttgagaactgctaattttagtcgccggtatgatagagaaacctagcaaggaaagagggcttgcaaaaaccttcagaaacctgagtccctggaatacttttccttcggtatgaaataaattggaactagcttagtaatctggtttctcttgtgttttgcaaacaagagctcttggagggaagtggaaaataaatttcaaggcctttcatctcagttacaatgacatgttcatttt

SEQ ID NO: 37157 - DNA, 856 bp, Bovine  19866880839990
atagacatttttaaaaaatattcttttccattatggtttattccaggagattggatatagtttcctgtgctatacagtaggaccttattatttatccattctacatgaataatttgtatctaccaacctgatcctcacttttgtcatctgtaaaatgagattaataatggtctgtacctaacagtgttatccagaggatttgattagttaaaacctataaagcttttaccacactgctggtaaacactccagaaaggtcaggtaatgttgctgtgttcttccgaaaccttattctgcctctgttgtcagcctgtggtttgggctgaagtgggttaggccaacccctgtggtctttctgttcctctgcccataaacctctgctgggcagggcctgaggttgacctgattcctatctgcctgtgtccctggggaatgtgtcctctagcggccctagcgtgtttgctgatctactcaggagaggaattcagggcccattccaatatttatgttggcttggggcctaatcttgtctgtcgtgaactgtaagtccaagaagatgggcctgatctagttcaagtgctctgcagggtgagtgataaatacatgcatctggggagggtggctggcttgtggggaggttcatcttagctttcccaattcattcctcagagaacatcttgttacctaaagaatggccgattggatcgtcattctgccttctgtcttgggtgctgggtttttaataacctggcattaattgggcactaaccagttataagctctgtgctaaccacttccatatgtgtattcttgggtcagcctcagaaccacttgatgagtcagcttgattgttttt

SEQ ID NO: 37158 - DNA, 1375 bp, Bovine  19866880878013
cctgtgataggaaatcgcggaggcaggatgttgaccccagagtctgcctccagagcctggttctaaaccactggggttattggaagcctctctatcagtaacagctcccttccccccactcccacccttttctccccttcttgtctttttggctctgcttcctttcatccagggtggccacctcctccgcccctgcccagaccaccatccgccctgaggacactcccctccctgagaaggatgctcttgggtccccgaggccagcagtgggcctccaggtaggtctgtctggaaccctcctctacatccacagctgcacaaagcctggtgagagttacacccagacagccaatgctcccatccaggcaaaagtcctgaaatctggcccaccacagcctgcagtaaggagggtattgagtgtgctcaaagctcaaaaccagagttgaagctaaaaataaaaccagcttggctctgaggctccaggaagggaaggaatcattttcagttctttgctggtatttgcagccggacaaaaataaaaacacaaccaaatttagccaattgtgtgctgcctgctgcttcgtaaaccctgaatgaggattccagggcggttgggctgggctctccttcctttaaaagcctcagggtctttctgctttggcttgggcgggccgcacgccgtttctctgttatcgaggggcgcttgatacatttctagttcatcccatcctgggatttattcattcttatttagagatccgagttggtccgaaaggtcttacttgaagagctgatgaagcctccaggctgcataaggtgcacttctcacgtggctgctttaagagcagctcctgaacaggaaaatgaacagagggaaacaggtctttctcctgccagagggacagataagcgctgggctgcagacagcggctattggcctccgtgccctccatcactcacgccatctgctgctctgtcacctggatccagaggtagaaatctgccacagttcaaattggaaataaacctgtgatgcctgcatggaaaaaaggaccgaatgggacccacatgagggcaggcctgaggaggtcaacagacaagacatgggcctggccagtgataagtcaagtccacctggatgtcttctcttcctgtaagatcaactctcctttttagctttcctgctggaacagtcggagcatcagggtcaagaagtccacgggctgccagctgcaaggtcattctgtttttcagcctgaactgtgaagccccaagagacagagtcttggctttgtggtatcactgatggccttcttggaggaacctgggcgtaagatctaattagagattttttccaccttattaattctttcat

SEQ ID NO: 37159 - DNA, 1484 bp, Bovine  19866880934767
aatgactccaacagcgcctgctcaaccttcaaatgtcaccagggacagtgccatgtctcagatcgaggggagccctactgcctgtgccggcctggctttagtggggagcactgtgaacaaggtgggtccagtgtgcgcaggggaggggcctcagagggatgcaggggtcagggtcagactccaccttcatcccgcggcctgagttccaggtctagctgcgccacttagaggctgcgcgaccctcactgggtcacctactgagcctcagattccttcactttgaatatgggagcaacgctgtaccttcctgtatgagctatccattgctgcataataaattagcaccagaacatagcagttcagaactgcactaaacgtgctctatcccacatggttcctgtaggtcaaagattcagaaacagcttggcaaccttgagggacccaaactgaaactgtctaacaaacagccaggactaggtgagctgtctggtcaccctttctcccctctcccctccctttatcctgttccagttgccagcccttgagctgccagcgtagccctctaagcagcaccactggctcaccggggacttattagcaatgcagacgcccaggtcctgcccagacctttcgaatcagaacctgcattttaataagagcccgtggtgactcttacacacactaatatttcagctgttgctctgcagtgtcctttcaatcctcctgccattattgggtcaacagaagacagctccttggtctgatcccattttgaaaacatcaaattacttacctcccttagtggcccctttagtgcgttaatcaaaaaagcaaagttgaaattatgttacagttgaaatgggttctgtctcctcttggaggtttttctctggcacggaacctgagtctgtttccctccctgtcaccagaatcccaggcaggtcacccccccactagaggactctttcacattttataccttgttaaaataccattcttaactaactgtgttaaataatgtattttgaaataatttcagatctaccagaaaagttgccagaacaatacaaacagcacccctgttcccttcaactcgacggcccagtgtgcggagtttgcgttccacccctccccacatcacacacacctgtgatcatgagtctcttttctatccttttaacaatctcataattttgaaaaactacatcaagcttagcaaaattcacatgacatcacattaaccacctaaagctttaaaatgcactcacaatccctctgatgctcataagagcccatgaagaagcgggaaggaccaggaaatgtgtcactattttgcagacaaggaaactgagggtcgggatggcaagggactggtccaaggccgagaggccgaagaccccgtgtggccaaggtgcattactccctttttcactgccttgctccacatgccctcccagtggattgaggacagcagcagggtcaag

SEQ ID NO: 37160 - DNA, 1640 bp, Bovine  19866880935024
ggcatatagctagctgtaggaggctattgcctggtgacggatccacttctgttctatcaggcttcgtgtccctcagggcaaggacactgcctctaccccccttccctgctgagccaggattggcatgtggtaggcatcgcgtgtgtttgttagataaaaatctgttcttgagaccacacgctgatcaaaaggaatccagtcagggtcaaagaggatgctctgagagtggcagtgctcctcgaaccatgtaaccttggcaacacagtctgtcccgctgctcctgggttgccgctgagcacaccggtcagtgctcaccctcttggcccacaggattgccaacctgaagatccagctcgccaagctggacagcgaggcctggcctggagtgctcgactctgagagggaccggctgatcctcatcaacgagaaggaggagctactgaaggagatgcgcttcatcagcccccggaagtggacccaaggggaggtggagcagctggagatggcccgcaagcggctggagaaggacctgcaggcggcccgggacacccagagcaaggcgctgaccgagaggtggggctgggctgggggcacggggcccttgcctgctgctggtcatccctccaagcccctcagcgagagggacaacctgggacgcccgggctccactctgagagcacagtttagagaactcatcactttccagaatagcaaatgtagggaagtgactcaccaaccaaccatcccaaaattttaccagagggaatcgcattactaaaacgtctgctcacatgcagattttcagaaatgctcttctgagataagctctatgtaatttacagcagttgttctccagctttgtgacagtgactcacgcattattaccgaatagacaaaagtttcatgaaacagtgcgtagtctttctgtgcgagagtcctccgatactttcttttatattgcgtctctcttcacaccggtcgtggcccactaaattggttttgccccgtgctaaggaattgcaatttgcagtttgaaaaacactggtttagatggggcttgcaaactgagatgcttataggggtcaagcaggtgatataaatgccagaggccacttggccatgggccatgttagactgcggtgcacagaccccaggtgttgtctgcagcctccaggaggtgagtacaggccccaggctgctagaggccccatttttcaagaaaagagtttttttgattttttttcaatattggcaactaatccaaaacaatttttaataccctagaggctaaattagcttcatctgtgggcttgatttaacatgaaagccactggtttacattctccggtttagactgtatagtgaaagtcgctcagtcgtgtccgactctttgcaaccccatagacagtccatgaaattctccaggccagaatactggagtgggtagcctttcccttttccgggagatcttcccaatccagggatcaaacccaggcctcctgcattgcaggcagattctttaccagctgagccacaacagactttaatcttttagtgtctcaccagcctccacacccatactacacagagcacatctctgtgttcacagtcctgcaggtgggtccttcaatccccagctt

SEQ ID NO: 37161 - DNA, 754 bp, Bovine  19866880945111
agttccctctaaaaattaaaagggattccactgtttgctaacattttaagccactctggctacctaagacttattctgatttaaacttactgatcaaagagaggccaacttttgtgcagagggaagaagggcatatgctcatcctgtgggaaggaggaaaatcaactgtttggcagtgaacttccacagcacaccaaggggagatctccacgtgtggcttttgagcttatgagccaggctgttctatagagctggggtggggtgggggaggtgggggagagagaaagagagagcgagcttagacactagtcctctgggctcttgtccttttcaagctgttgtcccctaagcaacctacagaatccaccatctgtgacccgggtcttcccagagggtggcgcaaagaaaacctcacaggagcagaaggggcgaaggcacaccaacagcaccttccactgaccggacatcctcaggcctcttcagaaagacgcctccctgccagacactgtctgcgcagaaatgcatgtgcatttttatgcctccttcaaaacttgaaagggaattcacgtccccccaccagcacccctccctccccctgtgcacgcgcgcgcacagacacacacacacacacacacacacacacacacgccacccatttgcttaaagacaaagaagggctccttcacccacatggcaacatgaaaagaaaatgaaattctgtcccagggcttgtgagtttttttttttttccttc

SEQ ID NO: 37162 - DNA, 2242 bp, Bovine  19866881089851
tgttccactcaaagcaattacagttattgctaataactcacacctgtgggtgtcctggtattgatgaaagcagaacagatgctgttctctggcttatttatgtaaaaatggatgcagttcaatagatttacaccaagtttgaagttaacactaatatttaatcccagacctgcttctggctatttagcttgaaaggcaccagatgagggatgcaagtgcggggagagcccagcgaagcacaaagatgaaattaatttgtgccgagcgtgagactgccgccactagtctcgtgccagatgcaacaacctcccctgtcccaggcgaagaggacaggatctccatggtaagaggtggggcagagagaagggagagaggggacacatctccctggcccctctgagactgtgcattgattgcagcctgagttatacttttccggacaatcaactccgttcccagcatatctgagcccagaagtcctgcatacagtcaaggccccaggagacagtgaagtactatatcaaacacatggctcaggagcctggaagaccctggagtgaataccagctttgcctctggctagctctgtgactttgtatgagtaattaccttgtctgagcctcagtctcctcatctataaaatggggatgatgaaaacacttgtgtcaggggattattacaaaatggataatgagttcagagcatcatgttatgtggctcatcataagcacttaagtattcatcattatgagtgctgcctacatctgttcaagtcttcaatcaaacactctgaatagaagacaagaaaatccctgcctctctgtcccacagaatatcacatagaaactctaaaattgtaaaacagcaactcaaggtcaagtttaatatcaaaggaagcaaaattgggttccactcagcctgctgtgtctcaaagcttccgcaggtcctgcagggagacttgacctcttggaatctcccaggctcccctgatgatggagagggtgggtggggtatagagagagacacataagttaaagctgcacaactctctaacccctgcggaagctggctggacatggtctgcagtcactgccgtgccggggggaaggcagcaggagacttctattaagaaggagaagaagggcagccagaaggcagctggtgctccagcagggaagagcagggagatcacagccccggcagccttcagactgggaagcagcctcaacatgacaccgttctgggctgagagcagactgctgatccagccacatgtacgcggactcagaacaagccaaagtagttctccgtcttcccgaggaagctgggggcttgtgtgagcttccaaagggtccagagccatgtggggaatggccctcagaggaaagcctgagatggggcaaggtggggagtccagctgactttgctactaaagcaaatttctggctgtggttagtctccagagaacagactccttgccgtcccggggcttacatttcaatgaagggtcaccattagtaggatgactacgatgttctcagggagtcaggtgctgcaggtcagagctaagtaaatgaggagacacggtccctggaagacgccatggcacagcaagtatgatgtcacctcttaggaaagctcggtcccctgaggagacagagccggctgctccaggaaagactgctttcctatcccaaagtggaggaggctgcttgaggattgaggggtggaaccagagaggcagcctctgttatgctggtgtggaaactgttagaggctctacctcagtgaatgaaagaccacctttagagtcaatggttgggcaggagaacccacgcatagcgagatagagacagatgtacgtatttatgtgtggatggatgggtggataaattgtgagccagagacacaggacagagggaaagagagagagactggcaggcagagagacaaaaaccaagagggacagaggaagagagcgacacagtgagacagagtaaaactagagaaaacaaaaggaaaagaaagccagagagaaacacataagcacagagacagtcatcgcatggaagagaccctgagaggcagagacgcacagaggaagagggctgcatgggtgtgaggccaagagacgcaggatgcagacaggtccacacacaaaaggagagacacagaaagacgggcttgggagagctagagacgacagaacgagaaggaagaggctcagtggaggcccccatag

SEQ ID NO: 37163 - DNA, 1114 bp, Bovine  19866881155613
atagagacataagagtcgtcataagacacccagcacatttgcctgtcgcttgtgaaaatgtttctcttagaggaaaggactaagctcattctctgtcatcagatggtgctgataaaagacttcacacatggaggtgtgtttgaggggtggggggagctgctacatgtctgacttagtcaagttaaagacaccttccctgaactctggagtcactgcgcaaaggctgaagatgaggcagagtgagagggtgggagaggcaggtagtctgtgtagaaggaccctagggcaagccgcagaggcgtgctgacccgcagacccccagacgcctagcctctgatgagtcaaggtctgtgtgcttgtaactcagtctgaaacctacggaaaaagctggggccaggtggtgcttgccatcacccagcctctcccctggatgtcactgttgtgctatgtgaacaaggctggggagacttccaggaccataaggaaccctcctggaagcagctgctcctggtggggaggcccagtaggaagagggaggaccagacctatgagcaggcgtttgggaagcgaggtgctcagagtcccagcagaccttgctgccccacgatagcgcctgcggtgacaccaaggccctctggtcccaccaggcctgaggtggaatggttctctagtgcagagaggctggggtagctgagagaactgggctcagccaagcccccgcccctcttcctcgaggctctcagggcagagctcgccaagtcagaagccaagggagaggcttccaggccagcatgtgcatgggtcaaacccaaacctggcctccctctaaacagccaggcgtatttggccaaactgtctcacgtctccaagcttctggttcatcacctgctttgaatgggactcctctcagctctgtaagaattaaatgggcgtagtgtacataaaacttaatatatatagtgcagctatcattataacaagaagtttagcaaagaatctcccaaggccttagcctgggaggaaaatcttgtctccaatccaatcgaatactagtgcagagattagcggggcttcccctggggctcagcaggtaaagaatctgcctgccaatgca

SEQ ID NO: 37164 - DNA, 795 bp, Bovine  19866881163263
tgaatcataaaagttgtttgatttttctacccaagaatgtgcatctatgtatctgtttaaagaagaacaacagaatccactttcctggcaccaagcagaatggaaaggtgttcatctgtaatggactggtttcgtgcttaaacctttcccttatgaaaataatttaccctgctaattacatcacattaagcagctactcccggtatagattaaaggacagccttttcaaatcattccataaattaaaagcagtcctccctgatacatgatttcatggataaatactgcatttgtgttgtcaggatttatattgagaggaaatggaggaaatgtatccttaaagaaatattttgcagtagttgttaacacctttctctctctctgcttgctgcttctagtaccataatataaatgtgcaagctgttagcgtgagatgaacattctttaggcaggggccacctgcgtgcgtggctggcttgttatttaaattgcctttgcatttcacagatttaaatactgccagggccctgatttatggtgtctacatcacacacataaaacttccactcggatcactctctttctcacgcatgggaaggaagtcacttgtggccacaggtggagtggactggggagctcgtcatcaccagcagtgggtaaaaaccaggagagagcatccagaagccagtggcacgtggaggtgtttgggagcccttggtcctgacaaggtctgtccctactccttccgtcagccaccaaagaattaagagagcgtggggaggacggaaggaacag

SEQ ID NO: 37165 - DNA, 1606 bp, Bovine  19866881184851
taaacccttgcttgttgctccccacccccgtcagtgactcataaagcctgctgtgacttggagctctatgctgcttctcacatctgtttgacaccttgggtggggtggagaggaagagtaattcagaacaacactggaaagaatgaaacagtaatgttctagggcagaccactgtccttatcttggcacgtgtacatccatccttcttttgattaaccctgtggcattcttgcagcactttctttttgtcatttgggggatgaagaaaggagcaaaacccaaccccagcacaggggtggagaaacagggcttcagctgtaaattcaggagaggagcgtttgagtcctcgctttctcacttccgggctatgtgactttgagaaagtcacttgaccttactgggcctcagttgttggtactgttgttgagacgtttataaagtatgacccaaagtgccagctctacagggttactatgagattcaagagacaaagtatgtgaggaagtgctttctacacagtatttggagtggttaagttttcatccacaccatcgatgggtcggagaggatgcagaggtataggttaggactggcttcaccaaagatgttcatctgtgatggtgaaacatacagaatcagagaatacaccatcagttcagaccagactttaagactaccagccctctgtatgggcttcccaggtggctcaggggtaacgaacttgcctgacaatgcaggcgatgttgttcaatccctgggttggaaagatcccctggaggaaaaaatggcaacccactccgggattcttgcccaggaaatcccgtggacagagaagcttggcaggctacagttcacggggtcacaaaaggctagacaccgctgagggacagagcacgcacacaggcgagcatgccatctgcgtgatcaggacacgcacagtgccgccttctgcgtgccaggagagaaaataaggcctcaacacagggcaagcgttgtaagtgccaccctacaacagagtggctccccatcacaggggcacacaagtgggagatcagctgttgactcgtgttggaaatgatgcccagagggtatctgtgatgggtaggaagcaagactcaagatctagaataccctgacaatttggagacctataattctatttgggggtccagaaccaagtgggcttaaaagttatgccttggtccttgtctttagagagcttgcagtctagcttaggagacggactaagacttatgagatacatagagaatgatgtaagaatatgaaaaactaaatgttgagagatgtaatctattaatagattctgtggagagtgggcaatcagagatctgaaagaactgttagagcaggaactcagagagaagacccctggagcagacggtgatggagtgtattgggggttgggcacatggtgacagcaggggccatgacgggggccacagagaagtggaaggtctgaggccagagagggcccataggctcacgagccttcagaggggtgatgcgctcacattgagacccatggcccagacttccctggggtccagggttaaaatccacctgctagctagggacaagggttcca

SEQ ID NO: 37166 - DNA, 1492 bp, Bovine  19866881195588
tgggcttttggcaaagatgtcatgagacacgggagtgcaccacttggggtttggaagaacttacaaaatgtggggacagacaggaagagcatcacgcaggaggggctggggtgatctgagacgagtggaagaggagttacatgatgggcaggaggatggctggggccagctggcttgcggggggccttgaacatcaagccattgtcaccacaccagagccaggggaaatgaagtgatgaaagccctgcagctggtggaatcctgacacacaccaggctccctccggccctagatccccttgtcctaaagatggaaactgcccttagttagcaggatcatgggccatacactgcatcgttgttaactttcaatgccaccaccagcctgcgctcaagaaggaataggttttttatgttttatttttttcttactagccatttattttccaagaaggagcatgtttgcagtcctagctggaagtgtgggttctggctctgccatctagccttgtgcctttggaagagtgcctggttgctctgcgcatgagcttctctgcgctgtaaagctgagggacagtgcattgctggcacagttggcataagagccgaagggcctggcgtgcagtaggtcctcggcgtgtgttaggtgattctgtggttgtcactgtcatcttcaactttgagacatgagcattattccagagcctagagaatgccagagacgcaccatctcagagcatgcaggtttaaacctctcagcttctcaactgtctaatctaaggacattagctcttctaaagggtgataggaaacgcaaccaacgtggcctggccgtttggttacaaagagtttctttgcggctgcccgggtcaccaggctgagaaggcatgtgtgcttccttttatgtggagaaactcagctcagcctgcgctgtgggcccttccagcgtctgcacatccctgccttaggagccatgtgacgggccagagggaagtccacttatcctcagcggacctcagggggcatcgagaggtaataaattgtatttcctcttgagtacaggagacaggaagctccaaattggactctaattaactctgaaggaacaatgggtttctccagagcctggcagttccaatggtgtctaaggaggtgtcacgcagccttggaaaataattacaaacgtaatgacgatgcctccgaagtcggtctcctgacgatacacctcgaacaaatgtgtttctccttcctcacaaggttcgctgcctttaattgctaccctgctttattaaggggcaattaattttgccactgggtttaaaaaggcagtaattataaggcgaggacaaaagccccgtggttaaacataatcagctggatgtaaaaggtgctccctggccgatttcagaaggaggggaggggagggggcttgtgttccaggcaggcagcgttttcccttctcgggtgtttcttgcccccgttcacgactgcct

SEQ ID NO: 37167 - DNA, 2133 bp, Bovine  19866881232197
cagaagcagttcagttaacctgcacattcagtggttcaatgcttgtgtgtgaggatgcacacatgtgcagaagcagcagctcaggctatgtttcccccctgagcagggctcaggggagtggaaggaaacatccccttttaactcaaccaagggaccctaatgagagaatgtacttaaaagttctttgtaaagtataaactaaagactttaaatgtaagatgctactgttattattactgttgttgttgctattaatgacatgccaaaaggccctttagacaagatggctttgccttttcaatttcattgaaaagaaactgagtctcccacttcagaaagatgacagagaggaggaaaagtgggaaagaggcaaggaaagggagggagatcccagagggccagggaaagaggcgaaaatccccaggacaaccctcaggaacatagaggtggccagaatgggaactgagccaaccttgcccttcaccagatacaaagctatcaacagactaaaaacccttaggctgagcagccagccactgcctttgctaggagagaagcccctggcataagtggatctgcccccaaaaacaaaggatcccagatatcagagtgagaggaacccataggggcccttggtggctagaacaccgataatcagagcaatggcacttctagaccagagaccaaggtcatccaggaaatcaacaccaggagcaggtagagactacccaggctaaagttcttcctgcgactccccaggggcatccaggcagcgcaaagcctgaaacactctccaattagtggccaggaaagtgtctgcactttccctcacagccgtctcccggtgtcctcaggtggtccgcaagctggggcgtggtctggtttggtaacgcttaaccacacttcccagtctgggttagacagtgccataggaaacacttggggaaagttgacgagagatgccagctagcagggccagcaaagacagaatggggcatttggcaaagcttatttctctaactcaataagtttctaaaaagaaaacttttaagatttttttttttaaaaacaatgtaatagggccacttcaccagtacgggataaataatgtgcttttttttcaacagactgtcatatgctgatatcattaaaataaatggataagagagccatcagatgctcttgtgaataccagaagcttagccctcctctgtgatgtgtgttttatttttactcctgaccttcgcactccctggggcaaagatgactgcattcatggttggggcaagtctggtgtggaataagtgaaaaaaattggcttcttgcaccatgacgtgggaaaaatagatccagagttccccagagatacggaagagaaaaccgaacacatggccacatggcatagggtctgcagggcgtgtgctcacatactggatgccaagggtcacagaagaggaagccactccagcacagagaacatgatatgaaggaagatttcctcccgggcactccaattaattaaatcccctcctttcatcatttcttccataagcagttactgaagatctgctttgtgccaggttctgatctaggcagtaaggactacaaagatgaccaagataaattcctccctctcctggagcttaactttcaactgagtgtcaaccaacaatcaaaaagggacttccctggtggtccagtggctaagatgctgagctcccaacgcatggagtccaggttcagtccctggtcagggaacgagatcccacatcccacaactaaaagtttgcaagccacaactaaagatcaaagatcccacatgctacaactaagactcagtgcaaacaaacaagtaaataaataaacatataaaacaagaaatcaaccaaaggaaacatcagataatatttaaaaagtagagatgggctggcacattagctggtgggtactttacacagcgaatttgaggaaggcctctctgaagaatgtgaacccagggtggggtaaagaagaaacagaagaagcctagccctgcagccctccctacctgtctgccctcacacaggtctcatttgagggaggtggatagcccaagatccttaggaggccagagctgatgccatgagcaagaga

SEQ ID NO: 37168 - DNA, 848 bp, Bovine  19866881296072
tgaactgaactgaactgaaagtgccattaatgttaggatttgcctaaccactgacctctttgaactggaaactgtgcagcctataatattaatagcattttttctcagctacataaccgtgctcatattgagtttgatgccaactgtagtgcttagattttctctctcactaggaggaatacacagagtgaagcggatgccactggatcacagtcagatcacatccaccacttctagaagttttcatgtacctgacacataatagacagaaatacacgttgaatgaatctgttggttttatttcttttatgtttcattttagagtcagcatcgttccagccctctactatttttatgaagcctggtttgttatctgacataacttttctcttacttgctttaaaaaaaaaaaaatctgaaaagaccacaaggaagccatcaagatctgcattcaaatcattgggaaaaaatatggaaaagtgaaatctggctataccagaaagttcatgtcaacttttgaacttgtcagaactaatcaagagtagactttgtgggtcctttagaacaggaaaggaaagggaaaccaaacattcatggggtcaatttagattcatgaaaaaatagaaaggaataaaaatgaaagccaacagaattaacgttagtttgatgcaaaaataaatcaccactaaaaaaaaagatctctagcccattttcccccctctacaagacactgtgaggctgtatgtgtgccgtgctaagtcatatataaaaaagtaaatcagagctgtggttgccatgtctcaatctctatttaagtttcctcctgcccaggaggactccaagaagga

SEQ ID NO: 37169 - DNA, 1053 bp, Bovine  19866881427297
tgccccaggtatgaggctgtgtgacagctgatggagacggcagacagagctaagaacctgtgctcactcagacatcatctgtccaagggcagggccgcttcctaggaactgtgctcagggctttgaaacacgtgattttagctgagcttcaagacagtcctacggagttaacacttttactttcctccctgttatttggcttcccaggtagctctagtagtaaagaattgccttgcaatgcaggagatacaagagacctgggtttgatccatgggttgggaagatctcctggagtaggaaatggcaacctactccaggattcttgcctggaaaatcccatggacagaggagcatggtgggctacagtccatggggtcgcaaaaagtcggacacgattgagtaactaacactttgttttttgttatatggaggcaactgaagctcagagagtgtcagtcctgaacacaggttacccggcagagcgagggttatgaccaaggccagtccttctccacagtccaaggtcttgtctctccatgttcacttgtccaatatgacaaggcttcaggaaggccccagaattgtccatgccctttgatccagtgcttacaaggctacagacttcacttaagaaaataatcatgaaggcagacaaaatgtatttgcaaggatgttcagtaacactatttcaggagaaactggggtgtggggaaatatgctgtgtgctgtgcttagtcgctcagctgtgtctgactctgcaactccatggactgtagccatgggattctccaggcagaaaaaactggagtgggttgccatggcctcctccaggggatcttcccaacccagggatcaaacccaggtctcccgaattgcaggcagattctttaccagctgagccaccaggaagcccagggggaaatatggtattggttaaataaagtattaggttggccaaaaagtttatttgggtttttctgtaccattttatggaaaacccaaacattttggccaactcaatactttatttattactttatttatccatacgag

SEQ ID NO: 37170 - DNA, 672 bp, Bovine  19866881474423
aatgtatttagagggtccatagatggtgggcatcatggactaagacacccctaaattgtacaccaaattcccgatgtggaaaaaggtctgtgtgacccacggaagcttaagaactcatagagcttgtgctgttagacctgaaagtgttgaatcacaaagaccaaagggaagcaagcagcctggaggctgacgggcgggaggcacggccgggcgcccataacctgagggcagcgctgcctctggctctggacaacccacccccatccatgtcccccatccccacagccctgccccggcccgggctggtgatgctgacgcccctctttggccccccaggctcggaggattaccgcagcaggttcagcagcgagtgcttcatggacctcgtgtgcccggacaggtgccgctgcgagggcaccatcgtggactgctccaaccagaagctggcccgcatccccagccacctccccgaatacgtcactgacctgtgagtgctacgggggcaggacccccgcacgtccccacacccatctccctgagccagccagggcaagggggtgggcttctagaagcgaccccctcagctcagtcaccccgggtgctccttgctgtctgctacttcccatctgagtgcagaccctcacgcctccactggggactgtttacttgcaa

SEQ ID NO: 37171 - DNA, 1200 bp, Bovine  19866881532532
cttgaggccactggcatcttcaagaagttgcccaacctgcggaaaatgtaagtcagcctcaggaccttggtagactggagcagagcatcggggcagcggtgccttcatctccctctgctctggcccatctcagtttcccctgtcacacccaggaagcaggacactgagacagggccacgcagagccagagcatgcgttctccacaagccctgagcctcagcccctctgccctctgctcatccctgccccctactccgcactcatcctctacgcccaagggctggtgggaggcactctactgagcaccagcagtgagataaggggacctaggctgcatgtgttagtcgctgtcatgtcggactttttgcaaccccatgggctgtagtaatttttatgagatgacagttggaaggtctgcttttagatagactctaaaggcctccatgtgggtgtgacccattggagcagaaacaccagctgcctcacctcctccatctgtaatcacactggtacacagctggacgcactccccccgccttcccttccccaggtgccccagtagacgtgccggcatggatagggaccccttcaccatctaattcccttctccttgaccccgctccccacctgcaccacatcctccacatctcccagcccgagtttgggtctgcctctggaagaaaagaaatacggtcatagcctcattattcacagaccctgtatttgctaacatttatttgtaatctcaaaatccatactcaggtgttttcatggtcttcctaaacacagagcagcaaaaaatttgagtcacctacatgcatgccctcagctgaaacagaacaaggccacgctctgagttcttgtttcagctcccagactgtaaacaagtgtccaatccacaatgtatttcgtgccacatttttttgcatatttgtgcttttgtaggtgatttgactgtttaaaatggacctaaagcatagtccagaagggctgtgtgctttacggacaaaatacttgttacataagctttgttcaggcgagacttatagtactattggttgtgagtacagtgtaaacaaatcaacaatatatatccaacaagatgtctttaaacagaaacacgcatcaagcaaggttatgtattgattgactaacaaaaatatcatgaccaggggctcacagggacctaaccctcaattt

SEQ ID NO: 37172 - DNA, 2391 bp, Bovine  19866881628714
cattttgttatgcacagccctcttgttgggtacatatacacataaattacactttaaatggaatggcacttatttggaacctgatgttttgctaacagtaagtcattgcctttttcctacaccagcagccgtagagcgctggctgtttgtgtgtcatagtcttgcacagtgttctactgtgtggttgcatcaggagtcacccatccacagcagtgggcaggtagctcctgatgcttgcttgtctctacaaagacgcgaccaacattcatgcacttacagcttggtgctcagtccccttcttggccttgcttcttgaagacttcacactggcttggattacagttctcctagaaatggcagagcatatatattgtctgtttcagggttcctttgagacttagcacaattcagcttttaagatgaaaattgggctgctcattccccttagaacagaaggaaatcacgaatgcccattcctgggtcagtccatcaggatgttctagactcctcccctgtgagcactgtctccctggagtcaccacaacatgggtcttggagccatttctgtcaatgtcctgtctgtgaagttactttggacaacccagtaaacccagagtcaaaggctaatgaatgctagcaagggcacagagaaaggtggcaggctggggatttggggattcagggcgtgaccctctccccttgaagtaaatgggctcaagtacatcctggcgagtcccaggtggcagtagctgtgctggtaaccaggcaggtatgaaggtggagccggggggaagtgaggggcaatactgaattaatacagagtgcaggccccgggagccctatttattattaaagcagccaaattaaggcagcttttagattcagattttttttttttttatgagctgtcaccatagtgatggtattggaaattctatttctgacagcattcctattaaaccatttgttgaattatttgcatcccttgattctgggaggccccaagagctgtgtgcttccctcactatgaagaagagagttgatatcaccatctcttggattctttaccacaaagacgttaagtccaggattcctgtatgcctggtctctacccaatatgggatgagtctcctggattctctacaatccctcctgcaaaaggaacttatgagaaaagaaagactataaaacagaagagaagagagaagaatgtactgtctatgccaaggacatggttttgagtctctctgcttcctgttttgaccacttggattggtctcttgcccatcaaatctacaaaacccacccggggcagagatgttggaggaccttccgtaatgagccaggaactcaggggtccaagttgctgcttccgttactaggttggaaccatttctgaattcacccttttttcttccttgagtgatcatttaagattccaggtggattcatggacatttttttttcaaactttaaaatttttattttgtattggggtataaccaattagggcttccctggtagctcaactggtaaagaatctgcctgcaatgcagaagaaacccccccctcccccgatcgattcctgggtcaagaagatcccctggaggagggcatggcaacccactccagtattcttgcctggagaatccccacggacagaggagtctggcaggctacagtccatggggttgcagagagtcggacgtgacaagccactgagcacatggccgattaacagtgttgtgagggttccaggtgaacagtgaaaggactcggccgtacagatgcatgcgttcattctctctgaatacctccccgccccccgacacccccgactgaagctgccgcaggacactgaatcgagttaccatgtgttatataggaggtccttgttggtcttccattttgaatatagcagccaaattccttatatatcccttcgccccagctatgtaagtccattttctaagtccacgagtctctgtttcataagtaagtttttttgtacctttttctttttggattccacatgtgagagacatgtggaatctaaacatctaaacataaacatcatatgatatttcttcaaggacatttttttaattccctctgttaactctccacctgactccagaatcatatccaaacctccttctctgatcttggtccagcagaagacactgcattgaattttcttttttttttttttttttccccaattttattttatttttaaactttacataattgtattagttttagaaaattgatttgccgcatgcgagatcttctgttgcagcgcacaggcttctctagttgggcacgttcccttagttcccgaccagggatcaaacccacatcctctgcatcagaaggcgattctagcca

SEQ ID NO: 37173 - DNA, 1385 bp, Bovine  19866881812694
ttccctctctccagcattcatttttccccatcttatcacattctttcttagagggaatgaagttggtgggagtgtgatcctctgccaactacaagctccagcttctcaccagggatacatatccagagcagcggttttcagcatcagctgtacattagcatcacctggggagttttatgtcctccgagacctgagtttcatggccagatattctgatttaattagtccagggtgggcttgagcatcagtatttaaaacaaaacctaaagtgttgtgatgattcctataatctgctgaggtccagggccattgctccagggctccctgcccccttagcacatggggcatctttcaactaccacttgcccaaggatcccgcttgccctcctggcaaggcagtgaggctgttgagagacaaagctcatggaccagccagcttcccgagcctcactcatgcctagcagccctgctcctcactcaggggttttcctgggttttggcagacgtggagacagtggcaactcccacctgaaggagtctcaatttgaactatctccctgggtcgagaagatgccctggagaaggaaatggcaacccattccagtattcttgcctggaaaatcccatggacagaggagcctgaagggctacagtccatgaagtcacaaaagagatagacatgatttagcgactatacaacaaacaccttagaacattcactgagtaactaaataagtaggaagaagaaaaggcaaatttatgcttttggccatcctgagtgcagccactgcttgcaagaaactgaagactaagggatctcaggaatttaattgggagcctggaaggtcagaggctccgaaggcaaggagggaggtgatgcaggtggctaccgaggctgggctctgggtgcttctgtgcgcagtcctcactgggtgaggcccagcctatctggttggcctgttcttcctagctgtctcctgctgctccaaccaggggtagaagggcaggaatgccccaacggctgcagtgccatcctccccttcctccacacccgtttcttaagctcccctaggagagaaaactaaacatcccactgatgtcccactgatgcggggctccttacatgagtgtcagatgtcggaagctggatagctccttgggcacggctgttaagtggtttccttccaggtacctgaaagagaggtgcagagtcatgctgggcaaagagatgcctgctgtgatttcccaggctggactgggtctctgttttgctctctcatagttatttcccacccacttcaaagcacagactacatttgtcatctaatatttatttgcatgattgttcaactaaggatgcttttccactgggctgctaacctcca

SEQ ID NO: 37174 - DNA, 1312 bp, Bovine  19866881977400
gaagtcatctaaaaatcagctatgagaatccaacaggaagagaaagctaaaacagacatttgaccgaccagctttagaaaagacttggttaaagcccctccaacaagcagctgcagttttggtggcctagcgtccgtggctggagtttgagctgatcagacctgtgtctgtgagtcagataacgaccagtttacagagtgtatccacatatttgccctgacaaaaggacaatgcgctcaaatcttccctatcaacacagtcagctttcgacattcctgctcagacaaagcgagactgttccaagcagtgtcaacacctcggtgtctgcgacagatagcatcagagccatttctcctggctcaagtcacgtttatgtgatgcaacatcacgaacaatttggatctgaaattaatgtactgaaaactccaatgccccataagctgctacaagtacaaaccttctttctgtccttggaaaaatcaagtgactggagcaaacggcccctcagtgagcaaggatctcaattctaatgtggatccagggctacaactgagagaaggtgagaagaggatatacaccttggtgggcacatcagtgaaatgagcctgcatccccatgtaacgtgggggccttgactctttggaagaaacctaaggcagagttctgggattttccttttcctttaaggatttacaggggacatggatccaagataacactccccaacttcttaagtgacagaggcaagttgtggctgccttttctgaaaacacagagctggacacagataggggagagagtttgcttgtgcactttggttagaggaacattttctctacaaagttatgaaatgctgaatcttgtctcagacagtacttcctacaagacgtctccccaggacactagtctctagcaatgttccatcataaaatggatccatcacatgtatatgtatggctgagtccctttgccgtccacctgaaactatcacattgttaatcagctatacttcagtataaaataaaaagttaaaaatataaaataaattggaagaagaaaaaaaaaaaatagaagcctttttaaaacagttacgatgtgccaggacctatgctgttactttcattaatcccagtcataatgtttttatataaaatgagattctatatactttctgttgaagcaaaatatgctttgagctcaatgaattttcacaaactaagcacacacatgtcaccagcaccgacgtcaagaaaccaagcatggccagtgccccaagtccttcttggggggtcctttccagttactgcactac

SEQ ID NO: 37175 - DNA, 1440 bp, Bovine  19866881993058
tcatgggaccccactggcccaggaagcagccttccctggaaaggcttcactggttaaacagacttcttttgcccttggctcttgatgaatatgttatcttactcttagaataccctctaacattttgcatcttgtgtgttaccacagtccatacatggttcagattgagtcacatataccctagttgtgtggtctcgggcagattatcaccatcacttagccatagattcttcactggcagaagagggcaggcaatggtatctacctcacaggctggtgaaaggcttagcagacagtatgtgcttggtaggtggaggctaccatttaactgactttggtggagagaacctagccctctcctggtcattcctgttcccctcacccaaccccagatcccaagggaatataaacagagctttatcctgtacacagaggcccctgtgcccaccccacccaagggtctgcacagatgccttctcccctggggaccctagtccacagcaggattccagggaccacatccccttcgacccaggctatttctcaaggcctttggccaataagacctggaagaaatctatttacacaaaggcacagaacctaatacgtttttctccctcccctcatatttcttctgcacctactggcattcttctggcattcttttaggcatatggtattatgataaagtggaatcaacccaatttacattgccagcttcagcccactcagggaattcattaatgcatcaattctgacacctagcattttatgatcttgaacctattctgttgcctgtggcttatcttttctatagatgtgtgtgtgtgttgggggggtctgaatccatcctatcttcatacacccaggaggtgttcagaatacgtcatcagagggcgcaagaacttgtcacttccatcagaccaggctgtcctgccttgacagggagcttccccggagtgagggtcatgctcccctaccccaccctttctccagcagattaggaatgcctccggggtggaagcaatgccttcatctttcttctatccatcccagagttccaggctccacacctgggggagacctaattagaatcgttgactcactaatcagacaaaaatccgtgtcccccttatctctcaaaagcaaagagctcaagaagcctttgcagaaaagaggctgccttccaaacatgcccagccactcgacatcagactgagttcacagccagccctaatttagctgaatatacagtgcagttatacacaggacttggattgtaactgcatccggcaggcgtccggcagtgatgacttattaatgtattactacactgatatttaaatgtgagccgtaatgagggcaataaaacatttatgataatagcaattattccagaactaaaatgactaaacacagtattcagacttccatgatttg

SEQ ID NO: 37176 - DNA, 780 bp, Bovine  19866882061637
tgcctggagaatcccaggacaggggagcctggtgagatgccgtctatggggtcgcacagagttggacacaactaaagcgacttagcagcagcagcagcatccagcttttttcttgagtcattcaactcacagccttgggccaggtcaaaagtttctttggagatcccctgtgttaacaagctggaagccaagcagcacagtgtggtatagcttttttctgagtagttaattaacgaggggataagctaccttgacaatcactggagcaaacagcctcgctgtgcatttgtcaagagggatgggattagtttccagggagacaatagggaaatgacaaggggggaggctggatgaggccctggcttgcttggcgctgctcccgaccggctctccacctgcccacagtgcagagcggactgtgcacagccttgcgctgataattatatgattaattatatgataattagttgtcactcagtgctatggacggcgtcagagtctgctcaacggcggcctgagacaggtgaagggctttctggaaagcacactgcctgaagctgacagcccaaggaggtgacgtgttccagggaaatcactgagtgacccgggggagtgactcagaggtgggcagggctggtcaggtcatgggttctggctaacccaaagggagaggaggtgaggtgtggcggttgctaagggccaaggaagaggaagagggaccacagtggacctgtgctattttaagttattttcttctactccatttctctctacttcgtt

SEQ ID NO: 37177 - DNA, 2315 bp, Bovine  19866880717547
acagaggaggctaaggcccaggcaacagcctgactgttctctgtgcaggctttcagggacgaggggtccaccagcgccgtgggcacacagggtccaggctgagtggccagaggtcaagtctcagctcttctcagggtagctgagtgacgcagggcactgcccatcaccgtctgtgtcctcatctgtcgaatggggacaacacgttgctggtgctgtgggtttgttttgagggttaaagaaatgaacatttttaagcgcttaaaagtcaataaagcagagccctcatgccctcttccaagggtaaacttctgctctacagctctgtactggtggcaaagcttggccacaatggacccagagttgggatacttggctcaattaatacaggtgaggagcaaagaacccaatacctaaccctaagtgtgcctttaaaaatctgggatatgttgcctcaaaaagtgcattttctccacccaaggtagaaggcctcatttaattgttagttgctcagttgtacccgactctgtgaccctgccaggttcttctgtccatcggattctccaggcaagaatactggaatgagttgccattcccgtcttcaggggatcttcccgacccagggatcgaactcagatctcccacactgcaggcagattctttaccatctgagccaccagggaagcccttgtttgactaaaacaaatcctttaagccacgatgtgacttaagatcctggcctgaaacagacatggggtgtggagagcttttgtcatgcccatagggcccagacaacctgtgctttactactcagcgggcagacctggtcagaaaagcctcatgactacaaagttctatctggcagaatcccctggatcgtgacaggctgggatgggggctgttggtacattttctgcagactctcagcccactggggaatggaggaagaagacatactataaagcggaccatggtgagtggctcaaacctaatcatcagggacaacagacagggagtgaggccttgggaagggagagggggagcacggagaagccaggccagctcttccctcctacctgagtaagtgctcccggccgggtgtccgggcacctgcagactcccagatgtcagaggtggtggaggaggcaaagcagtgggaggggcaaacatattggggtgatgtgagtgtgcggggggctggagggtgggtgtgaagctgtgcagggggctgtggttgggcagtgacagggggaacggggaggccgaggggtggtgggagatgtgcgggggggccggctgagtcttcgctggagtgctgcttctgctactgctgttggaaccccaaaaaaaaaaaaaaaagaaagaaagggaaaaaaggggtcagtaatcaactttcttgaaaacaaaacaaagccaaacagagccatgtaacacttttgctctcgcttctttgtcttcgcaggtccccaccctgtgcacagagcctctgctgaaatcgcagttcctctaaaccggccccacagctgtgggcacagtgaacagcaactcctgcttcaagctgccccccatcgccctgtccagagagctgcccctcataccctgtgccagccactcttcctacaggggccacgccaatggaaacgaacaagctggtgacctgggctcgccaggtctgtctgctccgtcttctgtgaagaagcacagggaagggggaaccagggaactcgggtgccccgtcacctccacggactggaggccacaaaagatgggcctggccctgcggaggcagcttccttccgctgtcacagacaggaaagagcagggccctcaaaccccagtcaccaggctgtcacaaggaaaacactaccgaagccatgaagcgtgagcacttagaacgactagcccccgggacaggtgcgggtgggcgacgccgggccctgtgcccgggtctccacctcccttttctttgcagggctccttgtgctgcttgtcaaccttccctctataatctgacaaagacaagacacaagaggcctggctccccatggaggaacgcctcccttttcctcaacccagcatctttctcctgtatctctgtgacccacctggcggaagtcaccacggaaactccttgaaccagatcactccttggtctgcatgctcccgccccgccaggagttgcagggagatgttgacagggagggaaatggcttcccttctaagactcccttaacattccgggaatctcccctggtttcccttccctgcctccaacccgggaaccagtggtgggtcccaggcacagcgcctcggactct

SEQ ID NO: 37178 - DNA, 845 bp, Bovine  19866881399721
aagcaacaagccccccccaccctttttttctttacataactatgtacatggccttcccttctcaccccaaagagctctctgcacggtggatggtgtggactcttgtcggcttccccaccccccagttatcaccgcgtgggtgttgtgttgtcatcttcactgttttggttcaaatcaaaaaaagttttatatgacaaaccaagagtggggagacatgagaacgtatgaatcggctaaaagatctgaaaaatttcaacagagaatatacaaaaaacatttcaaaatctgcaccgagtctatacataaatttttttttatacacagggaagcgctgggggctccccaaccgcactggagacgcgggcctggccagcgcgcgcggagggcaggcccgcaagtccggcgccgcgcggcccgcgggcctgtgtgtcccgccgggcgtcctgtccgctccttaccgggcttcgatgtccttcagcgtgtgggagggaggccgctccctgatctcggcggacaggggcgtagtcctgcggggggacacggggcggccccccagcgtggagatgagcgggggaggcgcactcagcgccgccgtcgggggcgtcttgttgagcagtccgttctggtggcccgctgtggggctgatgcgcgggtagtgcatgctcggcagccctggcgtgagcagcccggggtgcggcaggtggccgtccagggaggccgggtgcacggggtgcagccgcgggtgctcgtagtcctcgcggagcacgtgcaggcgctcgcgctcgtccaggtgcgccccacgctcgtgctcccgccgcgggtccaccgtcagcgggtggtggtga

SEQ ID NO: 37179 - DNA, 1620 bp, Bovine  19866881408415
ggtgggggtttaagaatacagggcacacaatgcaaagtgacagaggagagggagaacacggagagccgagaccagggtgttcgagggacagcccgagacagaaagtggtgggggcggagcaggaggcctggggggcccagagggtgaggggtgccccgcagagagaattaaggctgcccctacaaggttctgtttctagacaatgtgcagaggctaagaagaagagcatctttaagaggtaagataaagaaaagtgtatttgaatttcctttcatccaaaaggccactgtgagtccatctagagaaacagagaaaggtgagctgccaagtcctgctcttccttcactgacaggccgtctagagaaggggttccctctcccccagcctggagctggcacccctctgctgtggcctgtcaggaacggggcggcagagccggaggtgagtagcagacaaaactgagaccctctctgcctgcttgccaccgggtccacagagaaacggtcttccacaaaatcggtccctcgtgccaaaatggttggggactgctcatctagagagctcctggtctaggggtggcccctccaggggcacctgctctggcagctcagagctgtatgtcatgatgtcctaaatggccctcccattggctgagagatttttaccatgctctcccaaggaaaaaacttgtctttttataagaaagaaatcacttagcatgatggcctatgatgcaacagctacttaagctgctgcatttagagcctctaaagttaaattcttttagatcgctacaaaacacatacacacacatgcacacaacattcaagaaaaacaaaaacaaaagatttggatcgtactggaaacttcagttcccaaagggaagtgttgttgagtatcttgcgacaggtgtatcttgtgtgagtgaagtcgctcagtcgggtccgactctttgcaaaccccatggactgtagcctaaccaggttcctctgtccatgggattttccaggtaagaatactggagtgggttgccatttccttctccaggagatcttcccgacccagcgattgacccaggtctcccgcactgtaggcagacgctttaccgtctgagccaccagggaagatcctgtagtccgatgtatctcatgtagtccttgctatttcactcaaattgaaaataccctcaagaaagggaggcaagcaggaggaaggccttgtcaagaatgcttatgacattcttcagaaaaaaaactcagatgtttttcctctttaaggctacttctttttgaggcatggactaccacgtaaggaggtaaaatcggttagtaaaataaattatccactggtgacacgaaacccaaattgcttggtgaggtttctttgaatatgggttagcaaaatcttagcggtcatctgtgagcccaggatttgagtttgaacagaatttgagaaaaatatgatgagacgatgcaaaacatggctttctaacagaaaacaaaaagaaaagggggagagagagcgaaaaacctatggatgagtcaatggactgcacgaactcgaaagcaaatatggtctgattcatgccgtgtgtgtctggtccaggctccagctcactac

SEQ ID NO: 37180 - DNA, 685 bp, Bovine  19866881481046
accttctctgtttctgtccaaaactcttacacagccctgtctcagggcccagatggcatggtaaccaacctttgaacctatccctcgacagaaatgacagaaacctaagaccttagcaaattccatctgccctcaagggtggggtccccttgccttggggacaaggcccattagaatgatggtctcttgcagtgtgtgggtatttctttcttcctgaacagaagagccttgggtccaccaaaaatgagtcttggataaaaagcctaggaaggcggcaggcaggatggatgtgaaacttattcgctcaggactagaaacagggagctgcttgaatatgcatgtccagagaaagacattcaggaggggacggggtcaaccattaggatgcgctcagcactggcacttatgagcatgacccaggggagccctgggtcaggcaccgtgcgctgaaggcagttttaggaaagactttggtagcagtacggtggctctcgtttacccattactcctgatggctgctgccttcgtctgcatgttcctggagcaggactgggcagggacccgatgcagggatgatcagggacccactctggcacacctaagaggcacctgggagcgggtactctcagagcttaataaatgctgtcccctaaatctcctgcatcattacaaccaaccaggcaag

SEQ ID NO: 37181 - DNA, 1399 bp, Bovine  19866880106560
gaaatagatggggaaacagtggaaacagtgtcagactgtatttttgggggctccccaaatcactgcagatggtgattgcagccatgaaattaaaagacacttactccttggaaggaaagttatgaccaacctagatagcatattaaaaagcagagacattactttgccaacaaaggtccatctagtcaaggctatggtttttccagtggtcatgtatggatgtgagagttggactgtgaagaaagctgagtgtcaaggaattgatgcttttgaactgtggtgttggagaagactcttgagagtcccttggactgcaaggagatccaaccagtccatcctaaaggagaccagtcctgggtgttcattggaaggactgatgctgaggctgaaactccaatactttggccacctcatgcgaagagctgacacattggaaaagaccctgatgctgggagggattgggggctggggagaaggggacgacagaggatgagatggctggatggcgtcaccaagtcgatgcacatgagtttgggtgaactctgggagttggtgatggacagggaggcctggcatgctgtgattcatggggtcacaaagagtcgaacacaactgagcgactgaaatgaactgaaggaatatttgataggaatgattaaagatatcatctaaattgagaattgtgatcactgttgtttatgtctaccttttcccatctcttcctcaccctgggaaaccaggagtcaaccatctgattagtgaaatgtcctgtctttagaattagcccttcttttacttaggccagttttgctcagagaggagcagaaacctctcttttgtgcaaagagaccagggaactttcttcatacaaagttaattcatcttcccttttctgtttcctccttcagtttatttctggcattttggcagctctgagtgctatgatctctctagaaattcctcaagttaacatcatgacgaaaatggatctgctgagtaagaaagctaaaaaggaaattgagaagtgagttcatttccgttatcatcacatctctgttgctgagatgaaccctctaagcttcatttaaatgtgaagctataaaactagtttcctgatttattcttattttatttatctgtcttctttctcacttttaaaggtttctagatccagacatgtattctttattagatgactctacaagtgacttaagaagcaaaaaattcaaaaaattgactaacgctatatgtggactggtaagcttttgaagttgttgagttttgtttttaatggccttgtcaggtgtttatcagcatccattcagtggccactgttttggaaagcacaggccaaccctattcccttgcaaaggtgggagggggggaagtctgtggactg

SEQ ID NO: 37182 - DNA, 1361 bp, Bovine  19866880460338
tttaaggtgccttataaacgtgaccttcgtggtctgtggttctttagttctttgtatactgttagagactctaatctcacgactttttgcttctaaacagactccagattagagtagtccagttagcattaattttgagacatcttatcgcagggagaagatgaaatttcctgacatgatttaagtattcatgtttctgaggtttttttaggtagattttcagggtagttgtactgaagtatcacttttcatgtgaaatagaactgggcaaggtttagagcattgatggattcttttacaattaaaagcattttatttggtaaagagactaaaaatgtttaatattcagcagtatccagagtctgtgggtgacaaatttaggtgtggggaaaagtccagttttagctggaggagggtgtttgcttctatcatccagtatctggtgacttgatgatgtattcatagtgctgtgttagatcttctgtacaaaataatgacctagctgcagcataattttcaactactagaattttaaacatgagaattaaaatcaatgtatttaaagaataattaagcctaaagaatccagaaaatgttagctttcatttaagcttatcgttggtgaattttccaaattgttttgtaaaattctaaacagagcaacaaaacaaaagggataggcatcaaagtggagagtgagattaagaaaattagaaaagattgtaaatgtgtgtgtgtgtgtggtatttaatagtacagcaaatggttcttttggtattgttttgagcaaagctgatttttaacattttctttcataacactcagaaatcattaacaattgtttgcttattcatttgatgagttttttgttcttttttggtttcttttcgttgctttcttttaacattggtcatgtttcaccctttttttttttcattcccctgtctgcaatcaacttcttcattccactaaggctgggcacagagtaagtttcttctcttagctcctactaacagtggtggtggggtggctgattactgggatttcacccttttacagtctatcaaatagcaagtaaccaaattttctgtgctttgattagattggttctttatttgagtttaacaagactgccatttccagaatcttttgccatcttaaaagactctatgtaatctatgtctaacctgcactgtcaaagtgtggaatttgggcaaagacgctgctcaaagtatgacatttgttatgtgatacttttccccatataacttcattagctgcaggaaaccagagtcctagtaaggatccttattaatctgagataatttctttgggcctttcattgttacatctttaaactg

SEQ ID NO: 37183 - DNA, 1060 bp, Bovine  19866880499536
tgcagtgggaaacagaatttctcccttcctgaatgtgcaagcttaaattccaccatttactctgcttggggtcatggactgatcatggaattgatccctcaggccagggccctgagattatgcagattggccagggttctggcactatgatcggcccatccagagtcacaggttccaatccggaaatgaccaggagtgagggagggtgtggcttcctactggaaattccaggtattgctacaggagacagaggaatgctggatgccccataagcccacataactattttttatgctgaactgtcatcatatgaaaagacccatatcacaccatatcataacaggtatcatttactgcgttcttactttgtgcctggtttagtgccttacatgctgaacaacctgaaatggcttctagaatttctcctgtttcccagatgaggaaaccaaggcccagaaaactgaaatgacttgtccaaattaacaagtggccacggaggaatttttgctgagatttgatggttgatacagcaatgctttaaagcactgcactgtaggaaccttcagtgggtggcagagctcagagtttctagtttcggaatttagttcctgaagtctggaagttggggtgcagtggatcttacagccctatgggctcgtagtattagcattgttcccgcctctgaatacctaatgcctctccgtaccactggctcctgcttttaaaagcaagggatggttgtcctcacggctgaagctgggtgaatttcgatgtaaccccatcagaggacacactgccttgatgccatttcgcccctcttctttgggaacacagggagcaagggggtaaccaacatgccagaaccatctgcctggctcctaataataaattgtgagaggaacaggtttcaggaaaacattgctttaaaaaaaaaaaaaaaaaaggcctcttctcacacccgggcagccatctgtcgtgtcctcctctggtgccaaactgtgggaggagggagagggtgctgctgggtccagcaccaccagcaggggggctcacaagtttt

SEQ ID NO: 37184 - DNA, 1824 bp, Bovine  19866880551046
ttaacccttcgggtgctctcgtccctcgaccggacagtgttgaggggaaggaaggcagagatgaagaggaggtcacaaacgcactcctcccgatctggaaggggaaaaagagacacactcgggaaaacacaaaacaagcatgaaaccccaccacccaccctggcttcacctgggttcccagttaaaagactcctaaggagcaactcactacgtgggatcagtgctgaaacgcccacgctagccaacgacagatccccagagatgtttaatccctcagtgaaataaatgcctctcggaaattacttggaatctgtaaggctacttttccatgagggaaaagacagtacctagcataatctgtcaattgtgccaatggtttctttttttttttttttaatagtcttaaacaagtatttgctttttaatcaggacagatgatatgaaatgaaaatctatacaaatgatttaaagttggtttatgtatatcagatacagtacagatatggaacttttaaaataagacatttttacattttaaatgtttttaaaatcaaaaagtacactgtgaaaatgaacaaagtggcttttcctaaattttgttctcagttatacaaaaataagattcttagttcaatggcattcccattacaccaaatgtgttgaatcaattgttttagaatgtttagcccaaacaactttaaaagctgaagcagcagattcccaattacaatataacaacactgtaattttatcacactaaaccttgacaaaattgaatagggtataatttccaaggccatattctttactattgactctgagaacttttttggaaattcctataaaagtggactgaagagcaactgacgttcaaaaagaaagtattactctctgaaaaaataaaatcatgtaggttcaaaatgcagacaacattttgtcaaaacataggtttttaaaataaattaatccaaaagatataaaatttgaaaacctcacaacacaatacttcttccatgggaaaagcaagagtgttagcagcctgttacagaataccatctttggaacataaagcaggtaaagttgatacaggagtttttacatctcgttctcatgaaatgaaaaaacaacactttttccccacaagggaggaggaggaggcagcagctaagccggcacactgaccacaggtgcagggctgccgaggcccacatgcttccgaccaggcctgcacccccaggccacagacgccgcccgctccactcggagaagtggagaaggcactctgaattccaagggctctgctgcataagtgggcatgtgcccgcctacctggaagaagatggtactttcttccagtggtaaccttcataaatttttggttttggatatggggaaggaagttcataaccaaaaaagttccaacagtggccacccgggaaatatactatggatatggggcagaaaaagggggagagggggccgagcaagagccagaatccccagacctgctgggacaccttcggccacgggccctgacggcttgtgggaacaccacaagcacctgtcgacatcctaatacagcaaacacaaggacggttctcgtagcccaatttggcaaagcggagactggggatctgcaagctgagaagagggaaggcaggggtcaggctggacagagagtaaagagtggaagcgctggtggtgttacttacgtgcgccgggaaaggctggagtctcgtcctgctctcttcgggatggttcacttctcccattgggagatagggtttctgacccgatcctgtctcgtacatggacatgggccta

SEQ ID NO: 37185 - DNA, 686 bp, Bovine  19866880647422
taaatttcgaggtgtgaaccttgaaacatttaggcagcaggtgcttaagagagatttgttaaaacttaagagtcatttctggaaaaagaaagctagtttatttcctcaagatgcaggtgaatcttggtgtattttttggagacaaatacagatttgttccttggtgcttgaaaatgttgctgttaaatgtttaatggaatattgaatggtggtggatgtgtggctgggaaagctgaatggaccactcatcttttagatgttattcatgagtgggaattgtcttttgattgaaatcatagtccagtgtttgtcaaacttgcagccgacactgaccaaagaactcttttttcttctgatggctgcagagtctatatacagagtctataacttggcctttttaaagagaggcataacactcatttactgcgtattggccatgagctgagcactgtaatgaggcaatctttacaccattatccctgttccctcacaccaggacttgatgttcatgagttgattcccatttataggtgaagataatgaggctcaaagtgctacccagggtgcccttagtacacctcatctggaatttgaacccagatctgactctgaagcctgtgcccttgcccagtgtgtttataatgactttgaagccagaaatgatcacttaaaactttaagggattc

SEQ ID NO: 37186 - DNA, 1596 bp, Bovine  19866880772773
tagcggatgaactgcttcatgttgttgtatatggcccgtccttcctccacggcagccacaatggtggagaagttgtcatcagccaggaccatctcagaggctgttttagctacggcggtgccagagcccatagcaatgccgatctcagatttcttcagagcaggagcatcatttacaccgtctccagtctgaaaggccaagaaacccaccactgatttgcacacctgttacctaatacacacattgccaacaatcacttggccatcccgaagccagggaatgaatggagctgttgggcctctgggcagctaagttttctgggagagtttttgtttttgtaagctggtgtcacagaacacattttaacctgggaaatgtgaaactgccaaatgaacttacaggtgacacttcagaggaagtagaacaaaggggtcttcaaactgttattacttattttaccaaacaaaacaacaaaatacgtgtatccatatggataaatctcaaatagagcaaatgcagacaaatacataaactataatatgccatttatggccaaaaatacttaaatattgtctacagatagaaaactatcattcccgtgtatgttttctatactttcactgaacacccagtactgaatccagaatggtgctttccttggagaaagaatggaaggggaggaaagaggaagacaactagaacagctggtttttagcaacaaaattgttttaaaaactgaaaagtttcatagacaagcagcaaacgcaagcatgacacaatgttaacatcttggtgaaaaatcagatgcaaggaagactatgggagatgcttcatcaacaagctgttctcagagaacacatcaccagtaccatctcacttcaggcgaggttttccaagtgtgtgatagagtacggcgtagttaggtcctaaatcggcttttagaaatgtgagatacaacacatacattttaaccatggcaaatacgtcccctgtgactgacgcaggcttctaggtcttaaacttccccagaatcttgcatgccaatagaatccttgagaaacagcccagatcatgacaaaaaaagaatttccaaatatgggacctattactaaaaatttaatgatcagaattagaatctgctgtgttcgtgcagtttgttacctgtacatgtctacagacactcaccatagctgtaatctcatcaaacgactgaagaaattctacaattttagacttgtgggaaggttcaactcgagcaaaacagcgagcattcaagcaggcttctctctgggctgaaggactgagctcatcaaactcgcgacctgtgaaggccttggctgtcacgtcctcgtcctgcctgaagatgccaatgcggcggcagatggccacagcagtgcccttgttgtcacccgtgatcatgatgactctgatgcctgcctgccggcacagcttcacagaggaggccacttcaattctcggagggtccagcatgcccacacagccaacgaaagtcagattggtctatggtgaaataatcaccttatgtcaatacaggaaattctgtttttccccccttagtgcggagagcaaaggttt

SEQ ID NO: 37187 - DNA, 1568 bp, Bovine  19866880790177
cactcggtggcctgcgagctgaaactcacgccggccctgctctggacacgacgcatttcttgtccagccacccagttttacctttcatatagaatacagtcctgcctcaaattacctttctagttttacctgttttgcagttatcccaaacttgtttttcattattgccagccaatgggctctttagaatggcacccggaacctgccagaagagagggagcgggcttgggtggctttctagtttatcgtctcacatccagagtaaaaggaagccatctcaaaaacaagagaaaaaatcaagtacattccccccatcttacttcataaagggtcacagattctaaacacagtcaagccttaccttggtcaccgggaacacgtggaaaatggtcccttctctttagatttttcctaagcatgccactcggagaaggcgatggcaccccactccagtactcttgcctggagaatcccagggacaggggagcctggtgggctgccgtctctggggttgcacagagtcggacacaactgaagcgacttagcaggagcagcagcagcaagcatcccactcaacccaaaaggcataacaaaaaggccaataaatctgattacaaacccaaaaaccttctatatgggattgggtgggcatgggaggaaatcccatcaccaatcaaagccaaacagcaaactgattgggagaaagggggtgaccccatgtaacaaatgtcatagaccaaagactattatccctaatatgtaaagagctctaacaaattaataagaaataacctccttatagaaaaatggacaattaaaagacatttaatctcaataatggaaaaaaaagcagtgaaatattttccatctaccaaatttgatgaatgtaccaactttctctctagttcagctatcctggatggaacttatccaaacatatgacaaatgtccctgcatttgtacagcaagccatttgcagtgtactaaacagggccatcatcaaaaataggaattatgataaagatgtgacccagtgatatcagaggccccctcaactgttccctaaatgggtctacatggtatgcttccagggttttaggacagcgttatgtaggttttttttttttttttttgctgtgccctgtggcatgtgaaatcttagttccctaaccagggatggaacccatgcccgctgcagtggcagtggagagtcctagccacagggctgccaggaaagtccccagctttgtgtagtttttaaaaaattcctcttgctttctcggcagtgctttgattctgtgagatactgggagaacaagcagccaactctgtcagcatcactgacagaataagaggaagcagacacccagcaacactgtgacctctgtgacagttctgcccgggtctctgccatggttcagacggttgaggttgtccggagagcagaactccccataagccagcagtccccatgtgccgcacagaatcacattcatttcctgtttttctggcctccatgtagttggaaagcacctgctgttatgctccgagcaagcccccagcacata

SEQ ID NO: 37188 - DNA, 1230 bp, Bovine  19866880798219
ccccctccaccccactcctcatgctgcatagagctctgtgctcagatgcctccactgaagtcggggttgccaggtaggcctgtgaccatggacactcttgggctgggaggctctgggggcggccgaagtatagcaattggcccatctcaaacacgttgacttccttgtcctgcagttaagtctttccagcctgtggcctggaagtcagggcagcttttctgattctcacaggcgctcttttctgccctgggtgggcagggcgtggggcgcggcagatgtgtgcattcactgtcaaggccaaggggcacgtatttgtgtgtttacacaatttaatttcagctttgaaaatgctgctattcatttgcactgttggtgaactggaacatccccccgtggaaatgatactttcattcttaacagtatttattttaagggtgctaggcttatcttactaaattaaaatgcttatcttgttttgtgctccattctagcacagcactgatttttttttttttttaaacaacctgaactaaatgtgaaataactgaagtgggatactgtaactgacctaacgattttgtgtgtaaccctggactgagccgctgacatgtccactgttctgtgcttctgtgcaaaatgtccattaaaactaaagtaacatcttatgtgatgttttatcctagtcattatttcacaagcatttaaaatgcaggtgtgtgtgtgtgttggaatctgatttaatctcttaaggaggcactgtgaagtagacctctaagctactcagaaaactgagccctaagtaatctctcaagctgggccaggggccagaagacctggattcctgttccggctccagttacaaacaggcttaacttctcttagagcctcagttttcttatctataaaccagtgatatacacactttatctttctttattctagtgaggatcaggtgatgtgaaaactaacacaaatggaagtgggatcaccaccgctggcctgtgactggagggcggagtggtggggactctgaggggcagggacagtcacatcacaggagcccacatccttgcctcatctgggatgccctgttgtgttatctgcctaaacatttattgccatttttagcattttaaaaggaaagagtaaaaacttatcagacccataaaccttgtgcccggccttttgccctgtaatcgccagccaagtaaaccaatcatgtttggtttt

SEQ ID NO: 37189 - DNA, 1189 bp, Bovine  19866880820894
agcccaagttttgataaagcatcatgttttagacatctgatcttgtgactcgtgggaacgacaggatagtgggttgaggccagatggacactcactagccctgctggcggccaataagaggggttcatctggggctgagaacacacttgcgaatctgatttagcgttttctctgggcagggcatagatctgcagttttataaacggctctagaactgaaagtccactctcattctttaagaatgacttcttgtatcataagcatgggatccaggcccagttctgtatgaccgttggcatctcacctctcctgtcctttcagtaaagtcagggtcctgatttgcggggcctaactgttctgccgggccctcaggcttttctcagtagtgcacatctcttctccagtgcccttggtttcccgaatatgcccgaatgacgtctgtcgcatttggaaaagcggtgccaaactgcgtgtggatatcacgctgctgggctttgagaacatgagctggataagagggaggcggagtttcatctttaaaggagaaggtgagtggtttcccttgtagtcgtcactgctgttgctaagtttagagtgatttttcaccatcgaaatgtgttcgtgtgtgtgtgtgtgtgtgtgtgtgtgtgtgtgtgtgaaagatgatgcagttcaatatacgaagcttctttggtttcacatcttccttgcactgtgcttagttacgcccttgtttccgttaacagacaactgggcaggagttgatggaagtcaaccacgatgaccaaagtggtcaccactgaacactttgacctttcccaggaaatggaacggctcactctggacctgatgaaacctaaaagcagggaggttgagaggcggctcacaagccctgtcattaacaccagccttgatactaaaaacattgcttttgaaaggtacggatttaagttctgcattttcatgtctaatcccattactgccatctttatagcatgtatacattaattggaaactatgggtggattagaattttttttctactatggcataagaaacactagtgggctttaaagttgatctctgctccaaccaaatggaaaccacagctgacatcctccaccatatggcatttttatcacacgttggtgaagtcttggagaaatgtcttcatattcttttatgggcc

SEQ ID NO: 37190 - DNA, 1957 bp, Bovine  19866880840087
gacccctgctgtgccgtatgtgcccggtctacccctcccttcagaacttgacccacatccttcttctcgtctgaaataccttagctcctcttcacacacccaaatccaatccattcttcaaagaccaactaaagacatgacttaatgatctgggccacagtgaagaaatactatgtatgtatccactatggtaatgagttctacattatcttgcctcatttaactcttccacgcatttatgaatcctctcctccatgagagagtaaagtctaggggggcagagttttgtcatttcacttgtcattttcaggttgtcaactgtcattttaccctgtgcagagcatcgttctttgcagttaatcaagttaatttggaaaaagaaggaaagatgatccatcttctgtcatttaaatgatattaaagactaatctacagatttacttttttattttccactacttcacagccaaaattttcaaacgaagaaaaatttaaagaattttatagggagccccgagatgtccactacctaaattctgcaattaatattttactatacttgttgaaccacatatctatccatacaggggcttcccaggcagtgccagtggtaaagaatctgcctgccaatgcaggaaacgtacgttcaattcctgggtcaggaagatcccctggataaggaaatggcaatctactccaggatttttgcctggaaaattccatggagagaggagtctggtgggctgcagtctgccgagttgcaaagagtcagacacgactgagcacacatgcacatccatacagatttgtttctaagttcaagcaatgactaaaagtattcaaaaaaaactgaggagtgggttctgcaactctttatacttgatgtggattccaactatggctcaaataccactatgttacaaaggataaaaaaaaatgaaagattggaagctaaagcacagtggttaatggttctaccttccccaactttgactggctgtaagattatacgcacttgaaatatcttcatctgcaaaataacagaattcatatctttgaaggagctaaatgctacccatgcacaatttagccacttttaacaatgaaaagtggctaaatgattaacaatgaatcatacacaaggtaaataatcccaaacagagaaaggtaaaagagttgagtctctcacctggcatagtcgacaggagttttcccactggagtcctgggtgcctgggtctgctccgtatactgccaacaattctgcctgtagaatctgccctgctttggaggccacatggaggggggtgtttcctttctcctaagaatcattaatacaaaatacacaaaaagaaacaaattaaataacccaaaggctaagcaaatgcaacccatttagtttcaacttaatatctgaaccaatttgggctttcttacagggtgaaaaaagttggcttgtgctcctaaagataacagcctcaaacaggtttcaagattccctgttctcacgcttgaatggagttgctgaaaaatacataaacaagaaaagaatgtttgttaaaagtgtaaagaatgagggagcaaagcagctggcagaccactgcaatctacattatcgcagcactacatcatctttatcttgcttagcaaggtgaatgaagccgtctctcccttgctggtaacagctacccctgggctctaaggcagagtcaggcctacgttactgataagggaactagggctgggaaggctgatgcgcccaaaggcatgatctgtctaagtggcacaaccagtctctgagtgtgagggagtgtgaggaggggttaagcatggctctaaagtctgacagacctgaatttcaaaccatatacccctcaagctgtatgaacttgagaaagtgtttaaagcaacctgaacctgtttccttatctctaaaaggtataaaaatgccacctatt

SEQ ID NO: 37191 - DNA, 1492 bp, Bovine  19866880860574
cacacggcagggcagaatctgggatgatgaaggggaggcgggagccgacacctaggcgagtcagtctgtatactcagccactattgagagaaggacggtgatgtcatctggctttccacctacaatgaaaatgaaaatgtattcatacattctaaaaggaaaaatcaagaaaaaatataagcctaaataagtaagtactaggaaaaaaataggtttgtcaatatactctagtagaaaaaaagggggaaaaatcgataaaatagttaaaacacaccaagaaattacatctaatttaattgaacctttaaaaaaaaatcctctctgctcctttacaataggagctttgttaaaatggccaccaccacatgctctgtatagcaatcacaataaagacaaaatgttactaagattgattctgcctgacaggaaagatctatgttccaccccctgtaatcctaatttggacaaacagatccaatgttttgaaactagttgatagtcttgtagtctaatctggcaaacagctatggcatgtgcttttttcctatttaatatttcccagacagctaagaaatgctttacgtgtcctaatattatacctgcaagaaactgaccaactctacaagtgctaatatgattgcaccaacatgttatccaagctcaaagctgagctattggcccgctcccaaagttacacattgctcagtaggtaggaagactctaggcaaggagagtcttcccttttcaaaacatcctatagaggcaggtgggatgaattgggagactaggactgacatatacacactgctatgcataaaacagataactaatgagaacctactgcacagcacaggggaactctactcagcgctctgtggtgacctaaataggaaggaaatccaaaaaaggggacatacggctgattcactttcctgtacgacagaaactaacacaacactgtaaagcaattaattacaattaataaaaattaataaaaaacaaaaaactcgctatagcaatttggtaggcaaatactgtgaatgagtcccacaaagccagaggaagggagaagtgaaatgtcagacttgtgaagggcagaatgtttaaaccattagcaatgtccaggccctccaggcagaactcggaggttttctgggctcgggtccaagcagagcattggcggcgataaagggcttcaggttccacctgcccctgcagccaatgaagtgcagttctgaagggcacctctgtagggaacacatgcacttgctgtcctccagtgatcgggcctgctgaccttgttcagagtcaccagctcacagctgggggaggacccctgagcagtctcaccccagtacagcagccggcctcacacacagcccagaatgctcccatcccctaagtccccaattagtccttacgaaggtcccaaagaatgcttacctctcacattcaatccgttgtcacatgcaaactgtgcaaaaggtgacat

SEQ ID NO: 37192 - DNA, 606 bp, Bovine  19866880899597
cttattaagtgcatgcctggtacgacatttttgtcacatggttttttaaaatgggttttgtgagattaatggggaatgcagagaagccaaaataatatgcaattcatattagttccttggttataattatggcttgaaatatagaatgcacctaacattcttactgggctcaaataataagtatagcatcacttattgagtgcttactgtatgttaggaactttgttaaataattcatgtatgtgtcagaatttattaaaatattaatttatgtgtgtactccttctgtttcccctcctcttgaaacaatctgcatcaccttgagttttacaggccaaaattagaagttgcccttacatctttcataaaggtctgaagtctttaggggagcttatactggttgtcctcagggtgagtgcagacagggaagttcagagtaagaatagagaagtgagatgctgagaagattgggaaagcagcacaggtggtaggtttggggtagctcttaagaaggtggaaatacccgcaaggaggccacttcatccatctggggcttccagtgtacctaagcttacctgtcccaggtcttacaggaagcatcaattc

SEQ ID NO: 37193 - DNA, 1887 bp, Bovine  19866880976516
gcggcctatggggcaagaaaaatgtttgtaggcctgcccagtctgaagacagatcttgacctggcagcctcaggctaagcttgactcatagacgcagatgattttcctcccggttcggaggactctgagtttgtttatttgccagaagctccttgagcactgtcacagccaggcactgtgtagaccctgcacctggggcagcttttggaccgggagtggttgaggggaggtgtcggagagactggttctgctttcgagtctccggccgtgtccccagatcgcccccttgacccgtgcaaattggttcttccctctgggtagtagtttccccatctgtaggaggagggatctccctccatgctcatccagaacattaccaggtgtgacacctggagatggcaacccactccagtatccttgcctggagaataccatggacagaggagcctggtgggctacagtccatggggttgcaaagagtgggacacgagtttcatttcagcaagcgactttgatttcacctcacagccagggcatgttggtgtactgtaccaacaggtactgtcttgcagtttacagagcttgggcctcatcccagcctaacatgaattagactcccagctcttgtttaaatttcctctgcttccttgctttgtgatcttcagcaagtcattttacctctttgaacttgtttcctcagctgccaaaaaaacagggcgatagtaacaatgaaaaaggtcatataagtcaagggcttggcccacatccatatgccttcagttatcctctctgttaccttaggcagagcacagaaaccccccgtgtgctagtccagtgtctagtccagtgtcgtcaggactggctccctgcctctgcactgcccttaatgatgtcaggctcacagctgggtgcagtccaggcttcttcagctagatgatttgcggtcctggtagcaagtcatttttaaaatgctgatgcctgggagcctgcactgagatttttttttacttaattggtctgccttagggcccaggcgattccagtgtgcagcccaggggtgaggaccgggcctcaaagggatgaggggctgcagcaggctcctgttcttagtgcccctaagaacatgttctcctcagatggcacttcccacgctgccctcctcctggtgcagccggcgactcccagatcagcaggctgcccgacagcgccgccgggagcaggaggcacatcttcggcagcagtgggaccagaacagccgctacttccaggtgtccgacatctgcagctccaaacaggcagagtggagctccagggcctcctaccagcggaggtaactgtgcggtgagcaccttcccttagggctggagggcctcctgctgccaggagatgtgactgactcaaggacctgggggagggtggctggccggcatggatactctcatggaaatgtgatgatttccatggatactcgcatggtgatgtctttccaactggaaacggaaaaaaaggttatcagtgaagtaacacatttgactgaagaagataagatgatgagacatgtatgtagaatccggaagtcccctggtagccccatttccccaggagagaaccaccgtgaactgtctggtccatagcctcctgtacatttcttcatctgtgtttgtgtgtaaatatagatacaagcatacaaccatttttatagagagagatacatacgaaacgacggaagttaaaagcatgggctttggagtcagacagacctagatagcaattctgactatgggctttggagtcggacagatctagatagcaattctgactgtgtcacttgctgtatgaatgagcctcagtttcctcatcagtgaagtagggctcaaacagaaccta

SEQ ID NO: 37194 - DNA, 1109 bp, Bovine  19866881099881
agatggggctccaacggtaggtgctcggcgccggggctgcagggaccccgcgcggctcggcgcgggcccgagagccaggaaagatggctgaccgggctccacctcgtgggtctcggctccgcgcccgccgagggttgcaggcgacgggttgagcccgcgcgccggccccgcgggagaggggttgcaggcggggggcactgaggtcgggtctgcgcctcatctcgacacccgcgtggctccagcccttgaccttctaccgctcgcagctagctcggcggctcttcaccagcagcagctggccccggcagagggagggatgagcctcctgcatctgggttgagccctgcgagacattttctcgtccctagccggtttatgaggcgtcgctgtagttgagaatgcctctgaccgttctactacccaaagttacacatctggcagaagtgatgacagggctgaaatgactccttgtttcagaaaccctgcttaggtattgataagattccacgtttcagagtagatcagtacagcaagtactgcatatttttttggggtagcattttggtatggtttctattaaatactgttgaatgttcatatatctaggtgcatctttcaaagccagtgataatttagtaattctttttggaaagagtgctaattttttttttcttttccttctcttgacacgttgcctgatgaatttctacagagttaccggctgaagaaggtaagtaagctcaacattttttttctgcccccccccccgtatggtgatcttaagatgacatttacaacaaatatgtttctttctaacaggaaaaaccttgctggaacttgtgattgagcagtttgaagacttactagttagaattttattgttggcagcatgtatatcttttgtaagtataaagcaatttcttctatttccccaaagttgagactataccttagatgaaaaagcaggaagcagctgtctattgagtgagaacattttatttggatatttaagctgcattttcgtgtttctggttttgtgtttttgtgtttttgtgtttttgtttttttttttaatactctaggtattgaaaattataaatagaacacgc

SEQ ID NO: 37195 - DNA, 1778 bp, Bovine  19866881124566
gtttgatgtaagtcgttaaataaggaaactataccgtatctgcaaaattcagcacgtgtggggcccacggtccctcggagacattccactttattataacccttgagattgcccccagaccagcacacttcctctcctctcacttccctcctcttgtctcccttctggaatgtcattctacttggtctgacattagaagggggcatcgtctggtcttagccagttccagtaccctcaacacataggtcatatgtggaaactaagttgcacttttgagaagacacgaggacaggccttcaggtagtgcaggcattgagggtttatccagtttattcatcccctgctttaaaagtgagttatttaaaaaaaaaaaaaaatgaattattttaaaaatattatttttagttcggattttcttccttttcaggtcctgctgaaatgagtataaaaatagcaaattgtttaaaatcatgcgagtagaggacaaggcctcacaaggggatcttcccccaaatgtcatgttaattacagtggagtcttggctctaattgccacttctgcgccaggcaccggagctagcttgctctccagttagtgggctggtctgggatgccaccaagtgattccaagcagttgaagcgggaaaggatctagtaggaaggccctagggaaggagagagtttattttatacattaattgtacagtaactgaggaaaatgttgtcaggtggcagaactaggtggagccagctaaaagctggaggatgcagaggagggggctgggtacttgagaatggcctcctagggggaaattgtggttagctatttagaacagcttggacatgtaaaagacttctagaatgtgttgatagctaaaatagctttcttttttgtttttcagagtgctcatatgaaaggatgtactgatccctcaatatacatgtgaaaagtgaaaactgtacatttgatgagattaaattttatatatggctagtaattgtccagcttgttcattttcaagcaagagtaaagtgttcaacgtgaggaaaatatagtttatgatacatttgttacacagtgtggggtgggacattctcagtcacaccaaggaagaaatagagcctctaaaaggctgtgtcccccagaatccgagccggcagcagtgaggcaaagccatcaaaccaaatctctccccgacatggccccagaggggcggctgtcttccttgtcacaagcccatgaggcaggtcttccctttgagctggagaaggcgtgcatctagttcacttccccgagaagtccatgctgtctcaatagcttgttaagtctctcaatttcttgttcctgttattacaaaagcagacaaataaccgaatttaccttctgagcctccccaggcacgtggcagtcatgcagtgagccccaggcacatactgggccccagagctgaatgaaaaccacgcttctaatggaaatcactcagtcggggcccagcagtgacagcggaagaggagacactggaagagggggttcctggcggagctgcagggcggagcagtgcctgggctgaatctggaaggacaaggaaggcctgtcccaggggagtggggctctgggctaacggccccacgagagcagaggcctggctgggagggaacaatctgtaaacggggtgttttcccaagcgccttcttaccttctcagagcagctgaattcaaggtgctggatcttggtggccagttgtatgtttatctgttttaaccttaacagttgccgt

SEQ ID NO: 37196 - DNA, 1522 bp, Bovine  19866881133677
catgttcttttggagaagcaataggtttataatcatacatgatgcattatcaggttctactcaagaaatactaggctttagtgacatatttcaaatgtcaaattaagtagtaaactgttaaccaaagttaatattttgctgatgcaaaaagtagggaacagcattaatgttttacacttgtgacctgtagggataaagtttaattaacttgtccctttgggttggaagaagtgagctgtgtgtctctgttgcatatgaagtaacattagaaattccttgacattcagtaccttcttttcctttcactttttctttccatcccccttgctcaccaactttgcccttcatataacacatcatgattgcttaattggactgcctgttcttttctcccttcactgctttgttaggaattgagcatcttaggtacatagcatgaacactggggatacagcttggaaggaaatacggtatcctacgtggagctgacattctaatggggacagattaaaaaattaaaatatttaataatctgttggattggagagagtgctgtggagaaaaagtgggtgaggaagggtggtggcggaataaggggccatgtggaaagagtgcagttttcaaattgggaagtcaggaaaggtgtctaaggtgatggtacctgagggaagtgagcgtgaggactatttgtctcatctgtctgactcatgtcctctgtggtaacccaatttgcataattttttctatctttcacccctattaccccatctcggctacttagattgaccctaaaatgctaattaagctttcttagactaagacacttctcaaattttggtttatatttgaataatttgtcttttcctactgaaacctttgaagggactattaattccttttagagcctaggttagtgcttttgttaaaagaaatacctggatgagtttatgttggtagcattttcagaatacatgaaattgatttactttgcttttctcaataagatgtattcaagaagtatttggtaatgtagtgattttaaatttttcctgtggtttaattattttgaaggataaaatgggcagtttactgattgattcaaataatttattttgagcctgtgtttaaaagatggtttgaaaggtgaatgtctgggggttttgttttgtttttaaaaagattatattctcaaatctgaaaatattgagtgttttcacatgaactttggattggaagataatatatagtctaatccataccattcttttttttaaaaattatttattttgagtgtatcgcgttgctcttcagggacttgggggtggggcgctttctctggttgtggtgatccggggttactctctagttgccgtgcaagggcttctcattgcagttatttctcttgttgcggctcccaggctctagagcacagacttagttgctctgtggcgtgtggactcatcccggatcaggattcaaacctccgtctcctgcgttggtaggctgattcttcaccactgag

SEQ ID NO: 37197 - DNA, 1079 bp, Bovine  19866881199354
ttgattagctcatgccctgattgtctggctgtatcacttaagaaacaaagcttcttgatcctctcactcttagaatagatctaaattttcaaagcaaacacagaatatacctaggctttcaaactcacaatagcataagtcttccaaaccagcagactggacatccacagacctcctcaggccagcttgagtttctgaaattagaccaaactatagcgctacaattcacactatcgtatactagactttgccttaccaagtgctgtggaatatgatgctcaaagttgtaactttccctctcctgtaccacctcctccttttaagaagagtgaaatctgtgacaagtattttttgtgcattacaactatccataaaataaatctgtagtacatgacagtaacattaaaaataaattacaaagtcagttgtattcataaagttaaaggtttcaaacacatatggttatgcagcaaattaaatttaatatttttgatacagacaatgctcgcatcctgtctttggttctttaaatagcttttataggttgttaggattttttagaaagaaattattccaataatataagaaaagttacagttaagtagtaccttaatcttaaaatcatgttcaatactcttaaaactcttgatctgacttactacttttgttttagtttatgaggataaaaatatttgttgtaagatactttatttgtaacatagacttaaatagatgtatttgcatgccaggcattgtgtcaaaaatttgctatttatatttaaattatattttcttcattctgttttgttttgctatctgctgttaactttgcttttcttagccataggtgggaagggcagtctttaataagcattttgaatctggcctcagtttagtttagcctcttatttgggcaagtaccgacctctggccttctcacttgtgtccttagatcaactgttagatcaaccctgcatactaaaagaggaaaagatggggatgttcccatgtaatctgtttgtgtctttgcttgtttttctgcgcttcttgggattactgttactctgtgcttccttatg

SEQ ID NO: 37198 - DNA, 1740 bp, Bovine  19866881201580
atatgaatttagtatctttaaggaaaaattaaagacatcttcgataccttgtccagatgaagcagagattggaggcactctgacagtttcttatatttaaaataatgcccagaacctactgtgttagatttttggtgaaaataagcaataatcttaaatttagtacagtactatacatgaatacttactttaaaaagattaaaatttacactatataaattttaaatagccatgatatgtgcaccaagttttatttgcctggaaaacaatacaaatagaacaaatatgtgattcaaaatattaaatgttcttgaattgtacagaagaaaaagaaactgaagtgaaactgtaggaattgctgaacttcagataaatgtttcttcaaaacaagagatattagttcctaaaagatttctctaaagttaaaaaaagattaagaaaaacattaagccactgggttattatgttcaaacaaaaacttacatgtttcttaatggacatgtgtttacatttacagatagtaaactcagtctcttgtcttataaaacagaagacaccactgatgtataaactaagcgaaataataaaagcctctttttcatattagaaccttttaaaacctaaatctaccttagcattattttccatgaaaacttaatagggaatggctaatctgaaagcaaaatgttgaacaaatcactttcaaaaaaaaaagaaacacatcattgggattttacttatagctagcagcatcaactaacgccccaaacaatggcacatgaactcagagtatcagccggtcctctcctccctcctgaattacctgaccaatggaagtttgggtttgttgtttcagaaagcactgtttcttacattccatcaattgttcaaaatcatgccacatttttgcttgtttcatatttggaccatgactttctcgtacagctttttgtttttcccggagtttctagaataaaaaaaataagagtaattaaatatcatatagggatttacttctactgctctaatcagaagaatatggtatgctttgtatatctgataaataatagctaaaccacatgatatatgaaagctaagatgataaaagttaattaaatttacgatagatctaagacaacctgaagctaaaaaggacagaaaaatagaaaagaaggggaaaataaaggaaatcaggaaagtggagcagtatcatggtatataaaaagtgcagattttggaagtcagaagacttgagttccagccttggctttgtcactagccataaggaagacaatttctctggactgtagtttgttcaattgtcaattaaggttaataacaggagtaattataaaagtaactgctttataatactatttttttcacatgacaatagatatagaaataattacaaactatcttgtgttatatatgttattattattaaacattatattctttcctgaatcagtatactctaagggtatgctctatgcccaaataaatcaaattgtatgcaaatattcttcaaggagaaggtccagtgatattttaaaaaggttcagatccttatcataattatttttgttactaatagcccacatatatagttccaccttccaatattgttctacttactggctaaaaccataaacaggaataggaacatttttaagtaaactgtgaactgttctttggctctgtgttatggcaaatcaaggaagagtgacaaagaaaaag

SEQ ID NO: 37199 - DNA, 1885 bp, Bovine  19866881298868
aacgcagtatcagggatggggaggaagtgtgttctcaagcaccgagacaggaccctgagccactgaacaagacttgaagggcaccttggaaatatgtgcgaggtgctctcttcccacctttaaacaccaaaaattctcagtgcagatatcctttaacaagatctaagtcatacctgaattaatttcagaatgcaactttataaggaaggcaggtgactgaggggtaaaaactcatatataagataaatgtgaatcacagttaataatgttgagatattcaaccaggactgagagagagaaacttgtcatcacaacatagtaccaataaaacttaacagggctttacgctgtggtatcgatgactgctttaattatttttataactttaacatgtgtgtgaagttcagaaggccaaagaagcaaacatttagaggtctgaaacagttaccttttgaactagagagagggctgccttgctgtctcctcttggcatcactgagaatgtcgataaccagagtggcaaactcatgggcgttaaaccgagctagtttctgtctgccctgagggtgagaaaataattggaaatattcccagatataaaaatacacacatgttcacataaaattagtcagactattgttagagttcagcaaaggccttccagcatgctcaaagtaccatcaatcacagccataactcaatcaaactttgtttctgtgtatagtttaaaaccatttacataatagaatgatgtaacatttctcacaaggcatatttctttttgtgaactgaaacgaaatggttctacttaatgctttatcaattctgttttgaaataggcctactagttaaaaatcaacttgaagggatagatttttaaatttcaagacagtttagatgctgggactctatcactatatataaacattaatcaataaaaatgaaaagaatttcatcatttattcaacttctctccttttgatggatgcttaggcttggtttctgtgctttatcattacatacaatgcttcaatgaaagtatgcataaagctttgtacttttattttattaggacatattcccaaataaggtatttggatggaagttatttggtatcctgggtgaaaggatgcagttaattttgagacctctgtaaccagttaacaaactgcctttctgcagtctgtagcaatttaaactcttatctgtagcataagaatgccacatccttaccagtgtggagtctcctttatcatatactttattaatttgatggatgaaacactcattaatgacttcaggctgctttctttgattactaatgaggtgaaatatttctttaaaaggtgtttgaaagccatttgtaattcttctgtgaactgtcttatgttctttctcagtcacttattaacttctgttgcttttcttatcaatttgtgatgtgtgtgttggtacataaaggatattaccattttaatcagtcaaaaacattttaaatacctgtcctgggaaaataaaataccacaatatcagtcattcctcaaagatcactactagtgtgtttttggactcggccacttgcctggttccgtgtcgatgagtactcgggattgactggaaggaaggggacgacggttgtctcggtcaccagggtgctgtggttctgcgtggcaagccagactagccagaggaaagagccagagatacaatctcatcaccacaggcgctgctgctcctctgagagccgcggctcccgtgttactagggagacttggggtagtgcactccaaagccaacatacacaagagtcaaagtcgacacacgtgttatcaggacagcaggagttgggcaaggagaaacactgaggcggcagcttgctgctgcc

SEQ ID NO: 37200 - DNA, 1111 bp, Bovine  19866881358902
cttgaagtcatttaaccaagctcaagctatagcttcctcttctgagattaagtgcctaccccatagagatattgagaggatcagagataatgtctgtgcaacgaatactgtagttgtgggtacagtggatgatagctatcactgctccacactcctctcatcctctcagggaaagaacatacagattcaatgctcaggttttatgttcaaaggtcccatccagaaataccagccttggttgaaaaattctgaaagagagtcatagatatatgattggtagtgggccattaccattttacacacaatttaagaagttacccatatttcaaaagaatgtgggaactctgctgcctgtttggagggtgtgacgtgttacatggtgtccactagggagcgataaacacattcatttaggattagtgtttcttgtaacctatgtgcacctgctagatagtaaatattactttaattttatcattgtaatctgaacttaaaagtgtaaaagtgtttaaaaattttgattttgcacttaaaattattaatggattgctttattatttttaaggtattaaaaagattcataatgtgtgttttcaagaaagtcggcctttgcaagttatttttcaaaagaatatgtgtgctaatacactagtgattcagccaaggtaatgagttctctgttgtttttttcctgaatatagtatggtcacagagtaaagaattaatgccctagaacttttaaatcaagtacattttttaaagctaacattagacttggagaaatcaccttataggatcaagaggaaacctgaagaaagataatagtagataataactgcctaatggtagaaataatcatttattggccaagaaagttctagaactatcccatcagtggcttgctacatcaagtggtattaagagaaaaatattttattagataacactttgcattcatatgatgctttctataagacactgtatgtctcaaaacaggcagcatgaggaaattgtaacagattttatgtgattgattttatccctgtttgttgtttttttcctagaaaatgagtgagatatattgtcagtgagggggaattcaatttttcaa

SEQ ID NO: 37201 - DNA, 894 bp, Bovine  19866881415343
cctaagcgttttacagatagcttgtaaattctcaacccgttgagagtgggtgggtactgttagtgtcctggttttgtaggcagtaaaccttgtctgtcatgtcacttatccacaggcaacatagcttttgagtggaaaagcctgggctgagcctgggcagtccagacccagaccatcagctttcatgggagacaagattgatttaatggtgtgagtgtgtgaggttaaaggtgagggccatgttgcatggtgtgcttagggacagcaggttctaataattgcttttctccattgattttatccttattcttagggtgcttagttttttcatttttaatataaaatcaaaagggcctagtgtttattatcttaagatgtgaatcatttactattaatgttattaatgtgtgtctcttgtgggttttttttttttaatttatattttaggttagaatgctaaaatttgattcctagggctagaaacatttagcagtggcaggctgtgtttactaatttcttttgttttcttttttacaggaaagaaatgctgaaaatgcaatcgaagcccttaaggaatatgagcctgaaatgggcaaagtgtatcgacaagataggaagagtgtacagcggattaaagctaaagacatagttcctggtgatattgtagaaattgctggtgagttgagttggtcattttttaaggttgtatatttgaatgcagtcctttcctcagggttcatacttagaggttttagaaattaggctcacgtgtatcaattagattaacagatttttagtgctatccaaacaaattacggtttttttgtaaaatttcaaagtgttttaggacctcccttcatgtgagaagatttttctgttttaaaaaaacaaagg

SEQ ID NO: 37202 - DNA, 1295 bp, Bovine  19866881481495
cctctgaaactcctttcccgtttttgtgtccgttatatatatccagttacataaatgccagtgtttatttacagaacgtggaggccctggatcctcgaggtcgcaccctgttgcatcttgctgtttctttgggacacttggaatctgccagagtcctgctccgacataaagcagatgtgacaaaggaaaaccgtgagggttggacaggcaagtgtacttgcgaaataacgtaaagccttccattttgttttctctctctgaataaagggtagcctcagtcctcattgtcttcagagtcatctttatcttgagctctgtctctcttgggactcggggccggggaaggagctgagagcctcggaggccactggcttgtctgcagcacaatggtcccaattgtgccctgggtcaggcgcccagggtagggggtgactcttcatccagaaagcagctctcagcgcaccagacacgaaggcgagcgcccggtttcccctgaggagcgtggcggtaactccagcaaatccatcatgatggacaatcagaaagaaatgataggcagtttgaatcaccatgtgaagaaggagtaggcggcgggctctcactgggtgtctgactggtcctttttctgccttgcttgtttgaaatggctgacggtaaggctgggaaggactcaggaaaagccaacacaaaggcgctttctcacttgcagagagccagtctgcagttcctgggggaccgtattcatccatacctaaaatctaggaccaccagccatggatgtgtggacgtgactgccgctgtgtgtagcacagccatcctggaggacctcacccgcagaggtacttgaattggcaggaaatgcgtcagaagacttgaaggtaaagtgtattacgcctcgtcacttgcaacttgctattcgtggagatgaagaattggactctctgatcaaggctacagttgctggtggtgatgtgagtccacacatccacaaatctctgggaagagaggacacagaagactgtctaaaagaagcctggattccttcttatctcaggactctaaatacccctacagctatccagtgttggtgattccagtggaccatatctccgggaataagacagatttgccttttttgtaattctgtttgagcaagttggaagcttaattaactttccaacaagccaaatttctgcattcgagtcttaaccatgtttaagtgttactgtggcttcaaagaagctattgattctgaagtagtgggttttgattgagctgactgtttttaaaaactg

SEQ ID NO: 37203 - DNA, 1133 bp, Bovine  19866881740259
aaattcggcctctgtgcctttacattgttcaattgctgtgcagttgcccgagccttcttttcttttcaagtctgcatttgcccatgtcctcgaccccctttcttctccggagtagacaagggagagaaagaagactcatgtcagccaatttcgtaaatcattaggccccgagtagaggagctggtgggggttagaggttcctgtgcagctctgtgttgatgcacagtcgaaagatcctgtctgatgggtttgcctgtcattaccagagataattggctggaaagctggaaaagaaggtctgcaacatcagacagatgccactgagctgctggcaaaagaaaacttgggggctcccaccatgtctaggtaatgggttctgacaggcacagctgcaaattgttctgaggaggaaaaaaaaggtatcactcagagaagggcgcagaacagtggaagttgcagtgaactgggtcagaggtgatgtaagttcaggacctggactacagaccttgtgtgagttccttccaactctctgggttgggaagtacctctctgagtgtcctttcagggtcaaggggcctggagtgtccaatccaggcaaagccaggggttcagagttaatcatgtgctgctttcccaacagcaaggaaatcaagaccctgcaggaggagcaggatgagatcaccctgcttttgaatctcatcaagtcctccaggaacctggatctcaatgagaaaaactacttggaactgcgtttcctgctgcaaactaaggaggactacgaggccctgattaaatcaatgaaactgctgttggctgaactggatgagaaggtgtggtctttctcttaaagggttaaccagaacactgaacaaggggaaggtgtgctccccaccacacgctgcactgctggcctttctaaacctgtctctaccaccattgtaacccctaatctctcagttctgttgatccatttccccactgtggtctccagtgcctccctattacacttagaataaactcccaaatccttactgtatcagtcaggagaggttaggtatgctgcagtaacaaacactccctctccccaactcagtggtttaaaacaacaaaggcttctttttcgtacatgattt

SEQ ID NO: 37204 - DNA, 1099 bp, Bovine  19866882096251
atctatcttcttccttagaaaaacagtttaaaagaatcacattgaactacataaggaaatgagtaactgaattatgataaatctacttactaaagattttagcccctttaaagtgacattttaaaaaacgaataatatggataaatgtcagccacaggtaacaaaaggaggagacaaaattgtctatatattctattgacgaatgcttgggagaaaaagtcccatgcgtgtgggatacgattcgaaggaacacacctacaacagtaagcacctgtgcttaagtaggactgtgggcgactgtcactctcatgtatgcctttcctagatttaaaaaataaatatataacttccataaaagaaaaataagcctatattcaagctaaatgaatttcaagctcacagccactcaccccagctggtgaattcccatttcatctgcacgtaaaaatccggagcctgaaggacaaaggtttaaaagaaatcactcctgctatcagaaactaacacaacattgtaaatttgactatactccgataaaaattaatttaaaaaataaaagaaaataaattacccttggtaccattagcgaaacacacacagtaagggctgatagggttgttcaaaaggcagagggagaaagaacagagaaaataagaagaaacataaattgcaaacccatcagactaaatgcctatttttatattcaggctgttattttatctcactataaaatacgtctagacagttaataaagttaactgcaggcgacaaggttggagggagataaaagtcaaatctgatttaagggttcagttgggttcctagcagtgagggtcacaggctggtctaagcaaggagaaggagtgtggaccccacctgtcctacagggagcttgactgcaaaaggctctgtgtgctgggaaagggtggggtgtttatcagaccactctgaaaccaggagggtgtgagacatcactgtccccaggaagttattttccttcagacttttgcccctcattttcttcttaaacttctagaatttggctttttgaggtttcacaccaccacagcaagcctgtttagaatcattttctgaccca

SEQ ID NO: 37205 - DNA, 2050 bp, Bovine  19866880646640
attgtaaaaaatccacaaatatctttagaatggtcccattaaaaaaaaaatcttaaaaagatactttagtcgagatttaatggagatactgcatttcttttcagggagcaaatttcaatatgttagagtttaagtagattctgataatggtcacatgatgatccagaaatgcagtaattttagacagaccaaaaacttgaaatttaataaaaatatttttcaataaactaggcagaaatgctataaaaatagttaaattttaacttattggttaaatctttatgactatatgcagatgtgttagaaaaacatggattttttttcataaaaatattctgttttaaagccctgtagacattttcagacacatctttgttccctgttctgattaagctcatagtactccacagtgctggggagtgtttttcattaatttgctattaatcttaccattctgtcattctttcctcaacagaagtctaataaaaatcatttaccattataagataatgttctaacttgcctatttgctttgaaactggatatctttctggtttgaaactagtcagtctttaagttctctggcacaaaggaatcaagtgaggttagtctgtggaaagaagacagcagatcacaccctggcatcatatatgggctttgggagtgagagctttgtcttattctttggggtatgagacagtatcttctactgatgaagcaagaagcagggagaaattttgagaattggtaggagactaggaaagaagatacctgggaaagcctctgtaatttgctactaattagggcttccctgctggctcagatggtaaagaatctacctgcaatgtggtagacctgggtttgatccctgggttgggaagatcccctggaggagggcatggcaacccactccagtattcttgcctggagaatccccatggacagaggagcctggtggactgccgtgcatagtgtcgcaaagagtatttggcaatttacctggaaagtatgtgtgaaaacactgttgctgtgatttcataattcctgctttatcagaccttcaataatgtctctagtagaaggggaaaagcttttctcttagtggaatactcattggtgaacaggaatcttagtgctttgttattcctcagttacatatgcaagtcttgttcacttcactttatatataaatctttctgattctaaatcattatttatttattgcctattaatatgttattacatttatctcctgttccttccttatccttcattagttgtttaacatataattttactatagtatgctagggtatgactttgattagtttgaattttagcatttcaatccaattttgagtgaaccataaattgtacagcaaagctgtaccgtataattgacaaaaagcacttggcaatagttttttgaggacttatgaacttggaaatggctttaagagttcattaatcgtatttccattggtttcaaggcttcaggaactctgaactatattcaaaggagtcctgaggagaaagtgtgtagaaccctgaaaagaaatgtgaagcatcacagattatagtgtgtcatgtttagccagattcaaaatccaaatacagatttcttactattaaagtaagaaattactattaaattaaataaaactattaaattactatttaaacataatttaaaactatatatctagccttaattttgtagaaaatgactatgatgtttatcttttatgcttccccacattagatttctagaaggttatatatattattgcttcccaggtggtgcagtggtaaagaatctacctgccagtgcaggagatgccagagatgcaggtttgattcctaggttgggaagattccctggagtaggaaatggcaactcactccagtattcttgcctgggaaatttcatggacagaggagcctggtggactacagtctgtggggtcgcaaagagtcagacacgactgagcacagaacaacgtcaacagtatatattattattttaaaatttctgtttcttagaatgttt

SEQ ID NO: 37206 - DNA, 1140 bp, Bovine  19866880702643
ggaatcttcccttgtggctcagctggtaaagaatctgcctgcagtgtgagagacctgggttcaattctggggttgggaagatcccctggagaagggaaaggctacccactccagtattcatgcctggagaattccatggacagtatagtccatgggatcacaaagagtcagacaggactgagcaactttcagtttgactttcatgaaggaatcttaagatgaataaaatacatcctgccttcaggcagctcagagtcaaatagataatacagttattatgggacagaatccatttgtttcttgtgttgttataaaaatgtgaaactccatgagaaaagcaaataaaaaatgcaataccaacatgattatttttaaatctgtcatctacaaaatattgtaaacttttcttagaatatctaggaaataaaaaatttataaaaagaaaataaaaatcactctactcagacatgacagcactttggtacatattttttatgtgtatttggaattgtaatattgtatattcatttttttctatcttgcatttttaaactctacattatgattattacaccattaattgaaaattatttacataattatcacatcacagggtataaaagtttatgtaatcattttcccatttgaggacatttgtgttcctttcaaagtttcccctcttataaataattcattgaatatatttatgtgtaagtctcctcatatttctaattttcttaaaatgaacttctagaaatggagttctaggtcaagggccatgcatattttaaagttcttgaaacattttgccagatagctttccacaagcttgtgccatttggaagtcaaaccagcagggcataggagtttttgtctcatgcctgccagccatgagaattactgtattttttaagtataacttttgctattttgataaattaaaaaggcatgtatatttttttcagtttagtagctttaaaatgtagtttttaagtataatatacatacagaaatgcacacatatattaaatgtgcaattttgtgaatttttgtagaaccgacacaccagtgtatttattcagtaccagagaagactaggagcacaaccagctgccctgcagcctccttcatctccctttt

SEQ ID NO: 37207 - DNA, 1648 bp, Bovine  19866880981688
taatgagaaagctggggcatgcttggttgtcaactgcagatgcagtaaaacgattccaaacgttatttctaaaaaacactgttttatgataatacgttttcccccaaagtgaatttattgctgaatttataaaaatccaaattctcgattactcactaggaggatgacatggaccgcaatctgtacagaacaagacacaagcttaaggctttacctgacccagtaaaagtgtcaagcgctccatctccagtcgtggctgtggtttcactgctgttcaaaggctctgttttgactgcaaggagagacactacgtagaagaataagtacatgtgagttatatttctaactttacatcaaagatgctgactgttcaactagtagcttttctagctaccatgggcatgcaagagaaaatctgagaagtcgatgaggagttttgttaatttagcttctaaatggacatgcatttatagaggatttaatctaaaaatcttctgtctaagctgcttctctagaatctggcttttcaaggcagttaacctgacacagtgaaacagcagtatacatgtatttgcatttttaactcccctaagcatactctgatattatagtcaaacggcagaagaaaggaatcatcagtcagcctttagcacgctgaatccaaatcacaacagagatttactgcttatgttttattcttcccaaggagacattaaaagaaaagactgcttaagaacaacggtggcatatgcatatacagaaacctgggtgtgtattcatatagtgggtggaaaatcaggcactcaaaaaatttctgctcaacaaaagacaaaagagccataaggtattgttttttttttattctaatagtataatgatctttaatacattatagagacaagcataggagatggtttttacagcaggaagtacagcttttgaaaactctttaatatattatttctcctttgaggtggtatatcttggcaaaatcctctttggcaatgatgtcgccactgaggtacacaatattgccattaatagatgcaacgagtgtggcgggggctacgcaaaagcctccacccattttgtcacaccatattttccctttgtgggcaaagctccatatatcacagcagccagggaatacactaaattattttctacttgacacctcttatgtttcctagtcataaaaggaatgatacagttaaaaacctcagaggcaagcagagaactataaagaaagctgaagactagccaactatggacaaatacagccgaaagaacagtgggctcagagcacacccaccaaccaagcaagtcagcaacgttactctgttagaaaagcaattaatgatggagaaacatgcagtaatgactacgttccctttccacatgaacggaattggctgcaccctccctcagtgagctctggtgttaatttagcatccgtgatttaactatgtcatgaagatttgctggaagattcaaactgcaaaggttggaaagaatccaaactctaaaccatactgcctcacaggcagcactaactaaccaagaattcctttcatctgtatagagatgatccagagcagggtttagaaaggtgtaacagctactctcaatgatgcaatgtcctcatctg

SEQ ID NO: 37208 - DNA, 1392 bp, Bovine  19866881101652
atctgtgggacatgcagaacccaaacataaagtcgaaacataggatttgacccagtatgatgtatgcatctttgagtagaaagtgactaacctatgagagggttagattgcccacatggtgtggagtggggaaaatgaccaaaagatagaactactaaatcccagcatgtgaggactggtaggaagaaaaggagtccgtgtctcctagacagagaaggactcatggaaaaaattctagaagattctagcagagtatcagctactaagtggttctgaagaggtggtgtttaagaggattgatcatgtgtagcacagagatccaggaaggtaaagactgggtctatctattattgtgtgtgtcatttaagtggcttttggagactgtggctaagaatagttttgttcgagttttggtaaactaaagctggattatgacaaatgagatgtcagaaagtagagacaaatgtgagaattcagttctgtagccagcaacttcagtctgtactaactccattgcaggggcctagtaggcacatgtagctactccagatccaagtccgctctaagtggatttcgaagacttagtgtgcaaaacaaattatgtaaaacataccatattcatgtttagtataggttgaaatgataatgttttgaatgtattagagcaattaacatgtaagaaaaaaaataattttacatgttgctttttacatttttttaaatgcagcttctagaacatttaaaattttttgtgtggttacattcatggctcacattatatttctattggacaggactagaatgccctgttcttttaagagacgatcctttaaaaagaaaagatagccagtaaatagtttctatagatgcaaggttaaagggaaggactttttaattttgtctgtgcctgaaccgccccctcaccccaggaaagggagaggttgaagggaagataagagagtttgagcagtggaacatggtttcccagtaggtgaggctcagaagtcatacttgaatgtggaggaatgggatcttctcttctgacataaggagttgcgaacagatctaaatttagataaacatgtaggtggggatagagacacgcaagttgagagcatctggagtacaaaaggtgttcaggtttaatagctcacatatatcgaatctaggagaaagtgatgtgacctgcaaaatttttttactaaattaggatttttgtgtatttgggattatatcttttctttctttcttttttggtcataaggagctttttgttaagataattcataatgaagacttatacctgatctaaaaataaagtgctattcttgaacaatttatgttatttacaggagagtttgatactgttcaaagcccctccacacccatcaa

SEQ ID NO: 37209 - DNA, 1347 bp, Bovine  19866881249936
tggtaaagaacccgcccgccactgcggttagacgttaaaagacgctggtttgatctctgcgtcgggaagatcccctggaggaagacatggcaacccactccagtattcttgcctgagaatcccatggacatagagggctacagtatatggggtcgcacagagttggacataactgaaatgacttagcacacacacactggtactcagagctcaatgactgtgtcacccagcagactgtgctctgtgaacttctatacggataggtcattatcatctttctgcttctaaagtcccccacattctctcacccaaagtgcacactgaccaaaactctggtgcatgaatgaatgtatcagtgataaccaatacagaaagtataacatggtggataagaacatgaattctgaagaccaatccaaatctcagctccaccacctcctggcttttatattattattatttttaactgaagtatggttgatttacaatatagtttcaggtgtacaacaaaatgattcagttacatacacacatatgcacgtactgaactggccaaaagttcgttcagtttttctggaagctgttatgggaaaatctgcatgaactttctggccaacccaatgcacacagacacatgtgcacacacacacatacacagacataatctttttcagattcttttcattatgggttattacaagatactgagtatagctccctgtgatatatagtaggtccttgttattaaatatccctgagttccagttttcctcatatataaaatcaagataaaaaacagcatctactttataaggttgtatgaagattatgaaaattaaataatacacattaacacattaacattttttaattgaaccatacttgatttacaatattgtgtgcatttcaggagaatatacagaatacttagcacagtgactcacatgagtaagatggctattattatcctatgtacggctattttcatttactttgtattaggatactacctttttctgaaattttttagaaataacctcaaaaggtattcagaaatccactaaaatcctgataatcataaaaggcatatggtgaaccaagggaaaacctggaaattcagaaaacacacaaaggaaaaaagttatcagccaaagacaatggtggttagaattctcatcatgtgttattaatagaatagtataacatttacaagataaacacacccattagtcatgttttccttatggaatttctctttaaagggttttctaatgaatagtttacatatttcatatttaaagtttcttatcaagatggtttaatagacttatgattttaataatcgca

SEQ ID NO: 37210 - DNA, 1230 bp, Bovine  19866881260128
cagaattggatagcatatactaaaagcaaaggtttttgtttttttttcctcatcctttaccttgtgtgtgttaaaagccacaaagttgaaatatagtctgcaaagtatacttcaaaatatatatgagaagtgtgtgagcaatgctgaaacttaattgatatgctgagaaatatataaaacatacagccactggattgggaaaatgaaaattaatatgtgaatggtttagcgaacactatgctttgcccccagaacctggtgtttattattgtgcactttagtaggagacagaagcagtatcaattggaaaaacatttcttagtgaattgagaactgtatggctttccaattcctaagtgggaaacctggttctttggtttctttgtttcgacttaagcaagtcccaagctatttcagctgaacattttacatactaatggagtctagggaagtgactttggcagctgttcatgggataataatgaaatacactatttaatactgcatgctgctgctgtaaaatgtggggagtattttatagagatcctggtgagtagagctgtatccactttaagtttagcaattgtgtgaaactgaatgaggaagttcttttttcatatgagactaactagtactcttttcttacaggtaaagaaaacgtgcacagaatcagatgttcccgaagcccagaattccaggtacagtaaaacagaggccaagacttcactaagaaaaattgcagctttggagaactaatatgacgttatactccagatacaactgtgatgtaaaacatggggtttaagaacctatctgtatggaaatcatacattagactggctgggatgtcattactcgtgatatttaataaaaggacactgatggaagttaactttaaagaacaatagtggaaacatctctaggaatacttgaaaatatattcccatactatttattaagttcatcctcaattttctttctattctcttcttataatgtattcacatctgaaatttttccagaaacttaataccttttaaatctgtttattgaagatctgcctttttttttcaatcaaatgttgctagattttgagaatttcatcaagttggaacaaccaaaactaactgggcattctctttgtgcttagttacttcattcatgtctgactccttgcgaccctgtgtactgtagcccaccagattcctctgtccattggaattctccagg

SEQ ID NO: 37211 - DNA, 729 bp, Bovine  19866882155752
atgggaagaacaacaagggatgcatgaaaaagaaagtaggttacagaatatgtaggtgtaataaaagttgccaagctcaaaattcttcgagatgtttctgtgagactagctggtttcaattatatgcgtgttttctaagttgactagccaaccatcaacaattagcaaacacaaacaaaacataaccttggctggcccttactgtcaaaaatcaagtgatggtaatttataattccaggaagatggctactatcaaatgaatctgtatatcactaaggacccaaacgcatgtgtgcgtgctcagtcgcttcagtcgtgtctgactctgtgtatccctaagaactgtagcctgctagcctcctctgtccacgggattctccagccaagaatattgaagtgggttagtatgccctcctccagggtatcttcctgacccagggatttaacccgtgtctcttgcgtctcctgcattggcagtcgagttctttaccactagtgccagctgggaaaccataattatcatgaaattcagcttgttatcattttttagcatgagaaattaacctcattatttttaaacattttgtgttaaatggaccattttgcaaaatccatgccctgtcttgtaaacagttcaaaaatagctcagcatctactttttagcttgacttcatttaagggagattgaagccagacattactggtcaccctcgatctgtttattggaca

SEQ ID NO: 37212 - DNA, 1362 bp, Bovine  19866880441661
agacagagcagagtttcaaagtcccaagtcgctgtttgttgtctgtggctaagtgaaactgaggttaaatttaagtggcttcaaaattagaaagaaatgttgtcttcttcttaaactgatagaaactagtgagagactctggaaatgtgagaataaagtcaataggaacctaagaaaagcaaagcagatgctctagtgaggagaaggagcttttgacagattttcagatgacaaaaagccaatttttatctggaaattgttttttttttttttcaaataaatttgtgtagataagaccttgctggagttaaagaaaaaagaaaaaacccaaacaattagaaaagccaaacaaaactgcttacagcagaactccagatatctgctgcaaaacaattagtattagcattgctggagcattcccgaaatagatgagcttcactattagccttctgtgaattcaagcaaagaggcatcattatccaaattatatgcctggagaagggggcttctgcaccaagatgaacttgtgaaaagaacgtttaaactcaaggcaattttgcctatctgtaatttgtgctattccccttgctatcgttgaagatatttatgcttgagcaaatttctcactctcaatctgatttctcctttttcttaatccaaccatgaagtcataaaatcccctgtttgggacaatatgatttgctgccatggaaacaattacaatatcataaatttatcttgccctgtgatatcaaagaggaaaagcaatgatactaatattttgctgttaaatagtgccattcattccgcagtcactggctggtaaatatcatcgatttgcagatggggaaaactgaagctgggagctctcaggctgggatctaaaactcctgaattttagactgtggcaagaatgtccagctctttttgattcccacccagagcagcagttaaggggccagacttttggtctccatgtctctttttggatgagggtggaaaactgcctcctctcccagtgcctgtactttaccaactgttcccaattatgaaagtattggatggaacctagtttgataaaatatataaacgaaaagcctttggcaattgccacaatagtgaaaacatttatgtacataggaataagaaagaggttctgaaaagtgcattaaaaggtaagcactcataaccagcccagccttggcctgacattccccgagtcttatctatatgctcattctcttggttccttgccatccgtggatttacctagaagctaatggcacttgaacttcagggctcctcacatgtatagactcttctcaaggctctaggaaggggtcctagcattgtgttcactgg

SEQ ID NO: 37213 - DNA, 1382 bp, Bovine  19866880472866
atgggggcttcttgaaggcacacccaagttgacccccatcttatatcaaggaaaagttgtgaggcagagagaaggttatatgtgaactttgtccccaaaaggaaaacagagagtaagcaattctcaagcctagaggagacgtccactgggagaataccaactccacatgccagctggaagggagcggctctcaaatctgcaagtcaagggctgagtttctacagagttatgagatttaaggggagggtgttcctcaccagaaatgaacacaggtcgccatgaagttagggacgaaagagatattctataaaaagtgctaaagaaagaagggcggggcaggaggggaaaaggaaatggggaggaagggagtaatagtcctacagttgtaattcacacgcagctcaggatctggcagcgtttatggtaacagcctgtccaataacacacacaatacacaatgctctaaggacctgtaggatgttgaaatgttttcttgaacgagattcacaaagggaattcttgttgtttgacgttccttcaggtttgttaggccacagtgacctgtgcgaattgctgtgtgccacggggtagtgattagtgtatattcccactggctgtatttattcaagcccaagacttgtctctccagtttggatgctgctatgtatgcctcctacttaattcactcatttacttgggccaggaaaggaggaggggaaagagaatatcatttgtggagatttcgcctaaaattttcttttcaataactctaaggaaattttccaacttgtggttcttttcaaaagcatctcgtcttttaacaaaatctctttaaagttgcatcaaaagaggagagcctgcacttgggaattcatcaagataaagtctgggcttctccacctttagacagcagctccagggaccaaaactattagctgttgaccctgtgaatgtttcctggccgagtggacaaagccagaccgagggtccacagagagagtaaaaggcccccaaggtgttggcccctccgccttatttccgggactacatcctgttgccatgggaatgaaaacccttcaactattgtttccagcggctggctacatgcagggaaacgctagtattattactattattttgcaaatagcatctataatttccaccaacaaattctaaaaacctataaccacttcagagtagaagggaacaaataaattgcttttcagtttcttttccttgcagttgtcctttttgagggaaattagaaattataaagcaggagaatgggcaatgagttctcatcagttgtgagttgcaagctaaacatctatgctgtatccctgctatcaggtactcgaaggtcttcgttgggctgaccgagt

SEQ ID NO: 37214 - DNA, 1995 bp, Bovine  19866880553164
tggaagaggtaggagaaaagtaaatgctgtctgaaagcacacttaagacatcccagggcctcttgaacaggcagtgatcatgatttcatgaatgggactcctagcctagatcctagttacttttctctacactgtgctccccaagtctgccatggaaggtcggcatctcggagacctaatagtaaaagtaggtgccctcgtatgatctgggtcatggggaaaaacagaggaagggaagggcagcttatgtgataccaaacaggaagcagtcaggaccacaggagaacagtctaccaggaaagaactgcctttctcttgatgagctgagatcttttcagccctgaggacccctcccacaataggactgtacaccaacatccaatctgtgctcagttaggaaaacagaaaagaaaatgtggaggatttataatctcagctgggtaaaggtttgcaataaatgcctctgataaaaactgtgttttggggacttccctggcagtccagtggttaagactctgttcttccagagcaggggatacggttttgatccctggtcagggaactaaaatcccacatgctgcacagcgtggctaaaaaaaaaccaaactgcacttcccatgagaaaattatcaagctatcagtcatttacactataagctaaattactcaatcagctacttcccttctgatgtttacatgaggagggagaaatgtccagtttatatgagaattggggagtttgggtggtgaaggggtaagtggggaaggagaaggaaaggttgtgtagagctttgcacacttcagaagaagtcaggtgtggcaggatgtcacagtggggccctgaagccagaggaagtagtgtgacattcaatatgtgtgtgtgggatgttcacagatgacaaagggaccagacggtcctatttacaaaagtatttcctaggccagagatcctgcatctttaactagtattggctagagtgtttaatctgtgagttgggagtatttgttcagcactgacctgcgtacctgaaaaatgaacactttatttgcaggcagttaggaaaagaaatcttaagaataaaaccgagaaacctccaagatctgagctttatccataaggacagcagcatttttttcctgaaagtgaaatagattatctgcttggggatgtgaactcttttcagtctccaacccaactgctatgaaatctacatggaaaccagagaagctgagtttgtgtccttggagaaccctgatgatatgtagctgagctttcggttaaatgttttgagacctggtaagaactgcaaactcctctttctcctagttcctctgctataaaatggagtaaaataaaaacaagggtcggagggttatttcacttggagaagatcccaggaaggagcaagtcattcatcaggtgcaacagatgtggtccagaaaaaagatgagccagagcaaatccatctgaagggcctgatccttgttgatagctggcctgaacgacatgccaggattcctccaccctctgaaagtgatctatcaccactgcaccatcaccttcttatggtaacaatttctttacttaccaaatacatataaaggacagaaaatttttacattaaaaataacatttattgaactcacctttaatatagagaagtatgaagggataaataaaagataggctataatctctcttttgataaaataaatcaatgaccaaacctatccatggtcacaaaatacagatatatggaaaggcctaattcatgatttatttattcatttcctgattgctggacacattctgtttatccccctaccccaacctcttactttttttttttggtatggcaagaatacacagaagaactgtacaaaaaagatcttcacgacccagataatcatgatggtgtgatcactgacctagagccagacatcctggaatgtgaagtcaagtgggccttagaaagcatcactataacaaagcta

SEQ ID NO: 37215 - DNA, 1012 bp, Bovine  19866880570611
taggtgtaataattatcctcaatttcagatgaggggaatgaaaactaaagaggttaaataatttactcaaggtcacaaagctagtaagtgtcagagctgggagttgaatctaggcattctggtgtcaaaatttatgctcttaccccactaccgctaatttgactaacaaaataaaaaagtatgctggaattagttctattaccctttcagctgattatcattgttttaaaaagtatctgttggttgtgatagaagcctattatttagagagggaaaaaacatctcttaaaagcactgttacagtttttgactactgtctgcctttaacttgcttatcagatttacccactagaccaaggaagagaaacagtgcacatgagcatgcttgtgtatttgagtgtgtgtgtgagtatggaaaaatgagcaaaaatgtttgtcagtgagatggaatggtaagggcagaagaaagagggaggaaagaaaggaaaaatggagaacaagagtgtatgagttttcagagaaacccatgaaaacatagcaaactgaagttaaggtaatagtatgtttgctatgttgacttaagtaaccaatgtacagcttaagaaaataagtgtttctcctctatcaatagctttgtacgtagatactagtttttcagtcatttcattttccgctaacctttttcatagatgacagctcctggtttaggatggagcgcatgactctaatcaacttttcataatttccgaggtctagcaatctgtaatataactactggactcagataacaaaagggtaggaggtactaggagtgaccctgtgaaaccagagtgaaaatacacagaaagtaaaccattcctgcatactttgaggaggtagatggtggagttgatttcgttcacgtgcctatgagctgcggcaccagatgacacactcagcaggccggatttgctttcttcaattgagagcgctgctaacccgaaggtcatcagtcagatcccagatgcattta

SEQ ID NO: 37216 - DNA, 799 bp, Bovine  19866880587278
gaatgaagtactaagccatctatgaatgttatgccaagtagccagtcagaaaagccacatactgtgcagaagaggcaaatccatagagacataaagtagattggtgttgccaagggctaggctgagaacgggatgggaaataattgcttaatgggtacacgtttctttttggggtgatgaaaatgttggaattagatagtggtgatggttcctttgcaaatatattaaaaaccactaaactgtacactttaagagggtgattttatggcatatgaaatatatctcaataaaaataagacaaaattttaaagtgctaaccacaaggaatttttccatggtccaagaagtgatgggggaaggtctgaagaacaatcagtgccctgtttctttctgaaccctttgtttggcatagacagtttaaatctacctttatttttatcaccattcactcttgtcctaaccgtgacatccaaaagtgaagtgagtgtaagaagaaagtgttcttcactccttttggagcttttccacggtttgctattaaaacctcatttgtgcatttgggtttgggaatggttccagcagttagttgactgcagtgttaaatctcaccattggggtctaatgcttccatttctttttattaagtgcttttgggtccctgggcgtcagggaatggaaggttgcacagagggaaagagaatgtgttgccagggtattagctgccgcctagcagcctgagggtcatttgaacaggacaagccagaaagaggaagccagcagatgttctaggtgccaggaa

SEQ ID NO: 37217 - DNA, 2071 bp, Bovine  19866880723604
gagggggaggacccaagaaaggacacgtcaaggacagggaggaatccccagtttggactatggctctttcaggggaaatagaagcaagcagggcggggactttcagtggttaagattccacgcttccactgctggtggtggtggggggggtggtgtgggggggggccaccggggccatccctggttgaggaaccaagaccccatgtgccacacagcacaggtgaaatgtggtatgagggagggagcagcaggtgtagctcaaatgccgcagacaggtaacctgcacgagccaagtgagccgggaacaagcaaaattaggctgcccccaccctcctgtcttctccatgttgccaaataggttcagaaaaatactcatccattttgtaaaaatcaacactacaaatgtgatcatgaatggcaaccagcactggaggccatagacttcaggtgtatgaacccacaaaaagggcccaggaactgcctacagggggtaggtgttggggtggctaggcagctccagccctagcattgactgtcaagggatgatgctggcccactgtggccagagcatgctatttttaaagagaagtcataagtttgggtttttttaaagtgtgaagtatcctgactttaaaaatgctggcccagacttttacaatacactggactcgggaaaacaggcctgtagtccatctctatagcattgtgactctttgtaagcctggtgttgagggggaaatgtcaactaaaatttctctgtttctcctgaaagagccctttgtctctaggctaagagcatagacctggtagataaaaaaaccattctctatttttacttttaaaaatatccagtatttgaactaaaaactctactttcctataagagtttacatcctcagatactctgctggtaaacatttaatgcaaactcttaatatcatgtccacataaccgacctcagctaactgttacaggtgttaaaatgtgtgtctggatgggaagcacgaattaactggcacaaatttttaaaaggacaaaaaatgaggagggaccaaaaattctcacagaaaatatatgagcatgcaagctgactctcagtttatcaatttcctcaggaaagaacttcccatttgcagatgacttatagtacaacacacccaacagtttcattagaatgctatttgtaatcagttcatcataccactatgcttcaggaagtgaaagcaagaagtatataaaaccaacaactatgcatatagaacattcagaagtcaaatagcgtttctaactgggaaaataactggggaagtgtagcactgccatagaagaaacatagtgaccattgtgactctcaagtgagtgcataagctttgaaaaatcttcattatacacttctgaaaactgaaaaccatgtatcgcaagaggtgaagaatctattccgtaatgactcgtatacgataacatcattgggtggatcactgtcatagaatctatttcaagttcatttcactttgctctgattctcatgtttactaagaactgatgtggataatgataaatattagtgtctctactttcaaatgattttcctcctgatggaacaaatataatctcaggcaggtagaaagagaactcacatgaaagccctctgcacgctaggcttaagtttctactgaaacctaggagaaagccttaacaccgtatgttggagagcatcttgttaacactgggtgacgttcttgcctacggctccctgtgtcttggtctttccttcttgcgttcggtgtcttcagttcacatactcccgcacttgcttgtctgttcatcctgcctcatctactttgcctcatcttctctcactcattactctggattttctctttgtaattgttgagtgtgactgttttgcttctctggtctcctgtccttgcaggtaccctttcccttccttgcctaaattaacgctagctttcaaccaaggtataaactgcgagctagtgttaggtcaccacaaaatgcatccttggataccttacccttgaggtgcttatatcgagttcacagattcaca

SEQ ID NO: 37218 - DNA, 863 bp, Bovine  19866880741740
aatacacagttcttcccgtccgtgactagtgtgaaacgtggaaacagctgcagaccataagttctgttgttcctacatagtgacattccctgcgagaggttcccagctgcagttctgtaaacatcatcagtaacatcaatgctgtcatctgccaagaatggtggatagtcccagatggtgatggggcacttatggaccccccacaattacttttagcctctaaagcagggaccatgaccttttgttgaaagtgtttatttcacacacttcattcagtagggaaacctgaatgataaaggtagcatgagggaaaaaccaagcttttacaactggcatttggtgaggatttaaaggaaaaacttaacatagtttttccttgcatcctaactatactattttagactgacccatgtaaaggcaaataatgctttaaccaacagagtgagaaagattaagcatccagtcttgggtactcacaaaatagtagcaactaagcagtcctctgctttgtaatgtggatttttcaaaatgccagtatagacagtaacaactcactgatacaataggagaccctcagaaagcagtctttctgcttgacttctattatccactcctgtctccattccttagtcctctcctcctgctccaggcttcagttctgaaatactggcaaagaccacattgcacttcatgcaggtacagtgaggaagacgggtgctgtcagtccttccatttctgcacgttgctttcttcctggagatcacaacatagtttacaatattgcaggttcccagaggcctacaggatcaaagtcagcctacatgcaagggcctgattatctctcccaactttgcccccttgct

SEQ ID NO: 37219 - DNA, 1172 bp, Bovine  19866880773323
cagtaaaatatttccccccaacgtgtcgtttttatagtctcccgtgattctgcttactattacttttggggcattcctccaaattctgtttgtcttaaaaacagcagactgataatgtaacgcccctaaatctctggacttggccatctaaatgagatctttcatccttttcttctccagcttcccagaatgcattttcatagcattcttgcaagaggaaagattatcaggaaaagaaaaatgaaggggagtaaagtcgaaggaaagtaccaaataccaaagctttgggtaagaaaatatttaggcaacaagcacacaaccacaccctttctgggaagatattactggccttgaagttgggttagtggatcccaaaatacacctcacaaaaagcacagttaccctcccaaaataggccctataattaaagtcttttcaagtggattgtcctatatcacaacttgacatatgttgctttaatctccctgcttcggcaaatgtagccatatcgggctacacaagctcacaacgactcccagttaaaccagattgtactgtcactaggaaattgatgcaaataaacagccctgagtaccaaaatacccaatctcaatcatctgtaatgagatctctctcctccctaagcacattctcatcacaccagaatcacacccttgattcaaaaggatgggctaacccagattgaaatactgcctcatctcagaggtcatctgaagacaaacacatctgaagaagccgggctgaaatttaaaacacgagccaatctcttttgtgtgaatgccggaaccaagttgtgtgagtctcgttttcagctttagctgacagtcctcagtatatgtcttcagacacccatctgtctgaattcatttagatctttctggcttggagtctgtggtgatgtagcctcttaggagcactttcagatttgtgattttttgaacaaacttctttatgttttctagttatatatttacatttaattaagtgtcaaaacattaaaaaatttaaaccttcaaaataatgagtaccttagacattgattttttaaaaaatattattatttccatattggtttcacagcctcagaactactaacgtcttgggcaggattgtgtgtgtgtgtatgtgtgtgtgtgtgtgtgtatgtgtgt

SEQ ID NO: 37220 - DNA, 1620 bp, Bovine  19866880878635
tggttacctgaaggggctctcacctttcacagtcagccatgtcctatcaaagtcattctgtaaacagccatctgctatagttgttgttgttcagtcgctcagtcatgttcgactctttgaaccccatggactgcagcatgccaggctttcctgtccatcaccaactcctggagtttgctcaaactcatgtccattgattcagtgatgccacgcaaccatctcattctctgtcgcccccttctcctcctgcattcaatctttcccagccatcagggtcttttccattgagtcagttctttccatcaggtggccaaagtattggagcttcagcttcagtatcagtccttccaataaatattcaggactgatttcctttaggattgattggattgatctctttgcagtccaaggaactctcaagagtcttctccaacaacacagttctactacagagatcaatcctattccttaaatgacaaaaggagaccatcattttatctgtaaggattcttttctttctgctacatgagaaattaggggaatattaaaaaaaaaattagggaatagtttggtgattcctcaaaaaattaaataaagaattaccaagtgatccagatattccacttctgagtatatactccgaagaactgaaagcagggacttgaacatatatttattcacgaatgttcattgcagtgctattcacagcaatcaaaagatgaaaagagcccacatgtcctcgatggatggatacacaaaacgtgccatagcataagacagagtattattcagccttaagcaggaatgaagtactgatacacgttacaacccaaatgaaccttggaaacatactaagtgaaataagccagacacaaaagaacaaatattacattattccactgatatgagatgcctagacactcaatttcatacagacagacagtagaatagcggttaccaggggttggggagtggggagaatgaggaaatatcatttaatgcgtaccgagtttctgtttgggatgatgaaaaaattctggaaattggcagtggtgacgattgtagaacattgtgaatgtacttaatgccaccaaactggaaatggttaaaatgacacattttatgttatgtatattttagtacaattaaaaaaaaaagcaaattaggagtcttggctctttcatcttccacagcctcaggccaggcatttctcatacaagtcccggaagagccccggaggggacaggtgagggccgagggcagggtgggcttggttgttgcagcacagctgtgcctgtgaagtaggtggggctgtttcacagactctgcttctctttgggattcagcatcgatgcctggctcacaggtaagccttcctcctagagatcccaaatgtttttctgtttgcagttttcacctgtcttttgattgggttgaagccagctccctccctgggattaatattcacaacaagcagcaagcgattaatttaaccagttgaaatttattgtgcactcgccttaactccaagccagcttctgctgggtgtttatttttcatcattgatgcattgcacatgacagcccctaagcatctgaatttaaagcacaccgttgtgca

SEQ ID NO: 37221 - DNA, 1203 bp, Bovine  19866880904235
cctatgaaaaagaggaaggaaaaaagtcgttatcacttatagattatttggaggatttttcccttttcttctctctctctttaaagaaaaagtcttagactgtagcagtggtaaggggaaattgtctaaatgccaagctaaacaccagtcaggtgagaaagttgacaatggacagggactcaagggagtcacaaaagctgcagagagcctggcctgagatgggacggagccccgctggccacgccccacgggaggcccctctactccagggacacagaatgtaaagctgtcgcctttgctccaggaaccagctgcaggttccttgttattcctttctttttgacagaatcaggttctcagacatttaggcaggaaattatttatgtgtcaatatttcaaaggcattttattgtgtgagggagagaaagaggcaaggggagaagccaatataaaaacaaatctgtctcgagatgcatttttttttttttgagattaaaaagtgtctattgctcctcacatcccttctttccttccagctttatgatgttattaaggtgccctttccaacacaatattttcaaatgatccaagccctggggatccagctgatgtctggctgtaatgaaatatatttaggcatttgagagatccttacaacatgcgggcattttgagcacatcatttaatctcagggagatattttgcttcatttctcctaagtatttcattagaatccacaccaaccaaagtgaccccctcccctaatcaacaagcttgccaagtgttgttaatgctttttcatttgctctttagtgcccaggatcaatagacagatatttcttagtgccattttcaaaaaactgccttttttggtgctaaaaaattatacacacatatttttaaatgaatgagcatagagcaatagtggaagtcaagccatgtagtattttgaagtcttgtcattatcctaaagaataacagaaaatgtacatatgggtcacataaaaacaattgggatatagacctctatctggacatgcatatgtccatccattggtgtgtatatattgacatagtggggttgacttgctaatctaggaaagaaagcaatcattttaacaactacatgtacaatcactctttttaataaaatgtacaaatcacacacctaaacacctaataattatatgtttctaggaacaa

SEQ ID NO: 37222 - DNA, 1019 bp, Bovine  19866880993310
ccagagaaatctaattaggggcacagactgagcaaagctgtgatatacaatcgactcagaggaccatggagatggcgagtggcagaatctgggctaacagaaccaggaatggggtggctggctgaatgggttctcgagaatctctaggtcccaagttcctaggtggctggggaaacccagtaaactcaggatgatgatacttaagtcacccttgaaacccaaccaaggggctctggttatggaggatctgtaggacctctctgtgagcacaggcctgaagaccccacatgggcatggatccaagagggtggaggatgaagcaaagtactgctgttcttgggatgcttgttacaggcaaagggactcgcttggggcaccacacagaaaagttccgaattttgctctcacttgtcctcttgttgccttcaccctttcctgttgggatgttcagccttctgagaccttgacttctgagccacaagccctagcatctggggcaatccaagcagcacatggaataaccaacagaggtttatttgacctgaaggttttcagaaacataaaagttccaacagagatgtttcttcctaatgtaaatctttggggtcaagcctctttccactctccttggccctgttatcgaaaaacaatcacaggaaaacaaaaataaaaacaaaaaagtaggcttctatttgtgaatcagcaaagagagacaggaaagtcagtgtcacatctggggcatggtggcagacactggctttctgggctgaactggccgagggcccgagggtcaggctgtcacctggcagagccacaagaaaacacactagcacaaagcagctgcttgaacaggcgtcatcaacgtcccctccctgccaacccggagaatgaaagccaagggggttcgctctccactgctggacaaaaactagctctgccaatctttccagggtctattagaggttccttgccagatgattctgcaaatggggcctcctcctttcaaaaaacagtgaatt

SEQ ID NO: 37223 - DNA, 1000 bp, Bovine  19866881015132
aaaatgtaatactttttttttttttttttttgtgcatcctcatgaaatgtaaagtagtgcatagttatttcactggaggactcctggacatagagaaagtcatttcattagcagtacagaacattcaaacacttattttacaatgggaaatgtacaacccctccctcaccttcccgtaaggtttagttgtatgagaaaatttagcatgttgccatgactacaatgctatggattttagaccatttaaatgtggttacaaggtttattaaattaaaaaagttggaaacatttcagcattcatgtttttatacaagaagtttgtgtggtatccatcctctagtttccctggtggtactggccacttgcttgctttaaagaggctcacttttaagtttcaagaacaaatcatagtaagttgaagcaaatactggaaaaagaaattgtgaattcagcttgggccctgatgaaaagagtcaaagtaacagccatctacaggcacagtcatgaaccaaaaaagtacaatccaaaaaacaaacaaacaaacaaacacgttttgcaaaagccaaaaagcgaggccactggttttcagaattacaccagtgcttttatgttgattttccagtcaaatcctcattctgggtcctgaagctttgtggccaacgttggccacggtctccatgttagcacccacatggtgtatgcacagggatatatagattatatatattcatatttataaaaaaagaaaaaaaacaaacacctgtcctgattggtttttgttaaaacatgaaaaaaaattttattgttttagacaaagaggccacttttggaaaataatacttttttttttagttgaatcaggtgaagacagagttaaaatcacataggatttgcattttaaaaaaaggaaagcactaggatcgttggcactggagtaactatttacactgaacagaggtttggccttttacataacatcgatacaatgcatttccaaagt

SEQ ID NO: 37224 - DNA, 1985 bp, Bovine  19866881056432
tgagggctcaaaacctgtgtgtttttttgtgtgtgtgtgttttttttttttttttttttgaagctcctcagtgattcttaatgggtagccaagattcagaggtatacatttagcctagtcaacatagctcatagagcaaaaggaaccaaagaaggccaaccccaattaaagactcaattttactattgctattcattatcctaacagctatatttatgtaattactaaatgcaatattcttgcccatctgccttttcaaagaattctctggcacagcacagatgatacgaaacttttactgacctctccacaggtgtaacacatagcagctaaactgaacaatttcaacaaagctcccattctgacatgctacacagaagcaatacaacaccgtaactagtgccagcagtgataggaaatatcctaacacaacaatcaacattttcactgtggcacaacagggcttgttcttggccccttttctaatttgttttttattcatttatagaccaccatgatttttttaacaaccaaattgtatggttttattttctcaattgcgagttaacctgaacagactattggccctaattatggacagaattaagaactggaaatcaactgttttgtaatgaaggaaattattactgctaaatatacccaactttttaataatatatggtaattagccctacgccacaaatcaccttttagataccttggagaacatttcaaaaaagatttaatgtcagtaaatggcatttccaaagctaggtttctgtgaatgccttctggtactttttatttctatggagtagaatttaggagccttaatcacctaaaaccattttctgaagaaagtcctggcaatgccttggggaacccacacagctccccaaagggagatgctttctaatacagatagatatcttttcaaactctcaatttttacagactttaaccccatatattacttgattatttactaagatgtattgtattcttctcaactggccacataggacagctgcactttaggcacttggaaatataatcgtgaactcactggccatcaatattaactaaattaatattagtcaattgatgtaatatatctaattattcataaatatttgcataatggcatgaatatacacagtccttacacttctgaatattctgaaaatcaccttgaatcagaccaggtcggcatgtcatattgggcctcttagaaatgcattttctgaattgtgcttcattgtgatgcctttctaaggattattataaggaatgtcttaatgaagtcatcattacagttattatgatagagccagacactggaaaacactttatagttaccttgtttcatcctcttaacaaatcttttgtcctcatttaatgatgaggaaactgcaggtttaagtgatttgctcatggttccacagctagtaagtggtagagccagatttcaagacctcatataagacttagaagctgagtctagacccctcccaactgtctaaacatggtctaggatactgctcacagcctcaccagcgctcctcttttgaagaccctagggagaaggtcctagctgtattagaacccaagattagttattattctcctgatcagttagttgttaaatttatgggccttgtgaattgtataacaaagtatcctttcaagctctttagttcactttaaccaaataggtagttcattgtggaattcatatttaccctcattcttagacctactttgttgcctttttgttttgcctttttctttcacctagctttaaatttaagctgtattatcttctttatatcctttctccaacaagataaggacataagtaaacaaaggcttaggaggtcatgagtaaagctcagagaccgcctaagaaatgagggaagcccactgagaaccatgggaaagcactatgcccatttctgtactgctgcgctttaatgaaataattt

SEQ ID NO: 37225 - DNA, 795 bp, Bovine  19866881269257
cattttcccttttttcccccaggaaaatgattgtcccctgttcttaattagaagccagccctccacatcttccaaaattctcagttaagaatagagaaaataatatgttttcctgtggccttgtccactaattgaagaatggccccataaaaccagataagtacatttcccctgatctcctgcatgctgtcttctttagattttggcctggtgtccatttttcttattcacagaccccctgaaatctgtcatttaaaacactttaggtgtaaggttgcatttagaatcagaacaataagttgcaagggctgtttcttctcattcgactactctcctgtagtgatgctcactttgactcccaaatcacagtcctcttattccctctgatttgaaagtatttctatgtgtttgagtggatagctcatgttcatttcagaatgtcatttagtagctacatttctgctaaataaccagaaattatagttgaccctagccaagaagctgagtacctagattttgcttccaagtatggtgctgagtagaaatgttttcgtttcatcttcaatattaatagtagactgagagtgatggatgggcctggatatgagaaaaagaaaggaaatgtagattgcaatggcagaccatcatctacggaagggtttcttgacctggggtttttatcagaaccacctgagaagctgttaaaaatcctggtgtccaggccttgctgtcagagcccctgaggacatgacccaggcaagtgtacaaggaccatctgctcttcctcagctgcat

SEQ ID NO: 37226 - DNA, 1165 bp, Bovine  19866881276163
gtcttggctctggccgtgtttcgctacaatggcaaagttgaacagttgcaacagagactctatgacccacagagctgaaaatatttaccacctagcctttcatagaaaaagttagccaactcctgcattaaacaaataaacctccaagtcaggctcctgttgtacccacatccaatcaatcactctgtcagttctgcaggcacacacgccaagctcaactctgagcactccatgagaaccatcttacttaattctcacaacagcctttggaacatactgttaaaatcggaaagcgtggggagaggctggggttggggtgtctgagtagttggtaaagctttaatggagatgaaaatcccaggaggaggagctaagagtaggcagaagctggtggactcggtgtagactcgggtgggtgaggcccccacggacacctgtgagaggctagttttcggtgtagtgtggtggggaagcatgatttcaagtctggcctgatttcagggtcaaatcacaactcttccactattaactgtgtggctttagttacttcacatctctaagcctcttagcttccgtctcctcacaagtcaagtgggctcttgtcaaactcaagtaagggaatatgcatgcagcctcgagcatagggctgggtctgtgggaagatgtcggatccatgtgggcccctccccttcatctttggtctgtcctgtatgtgatggaaaactaccctaaaatctcagctgacattgtggttattctcctcattagaaaacatgatggcttccaccggcccctgctagtgcaaggagacactagtttggaaaggctgcccagcacacgcctccttaaactcctccccgcccctcgcattgcattttctattgaaagtcaagttttcaccatgtaaccctcctgattaccaaaacagctgatgatactggggacagacgcctgataggggaaccagtccattgactggccactagctaatggaaacgtgtccaagaatcaagaggctctggtaatggatgctgggcctacaggttaggttgagtcaggatcagagatggccccatggagagcagagcaaagcagtggctagagaccaccgaccaccaaggagtgagtggctgggaacagctgccgctcagctcctccatcagca

SEQ ID NO: 37227 - DNA, 1338 bp, Bovine  19866881353325
tcgctggatttcctctctacttccctagatcgatgactgtttttgtttggtcgcctcccctctcttatctctgcggccacaggcggaggggactgagccagaaagaggccaccaagcttgggccccggcggagatttgctgggactgagtgagaagagggataataaaatcacccttcttgcccctcctcccaccaataaatcacacagactcgctgggtgtgtgtgtgtgtatgtgtgtgtgtgacacaaagagccctttcagtgcacagagaggagacgcacaaagtgcccaaggatgggcgcgatgcttcttgtttctgttccctggggcttcccttttgctcagataaagcagttgatcttctctctgagagtctttcctgccacatttaccaaaaaataaaaggccccagatgcagggtggcaggtgctggtgttttgctgtattcatggaccggtagtgttgactggcggctgcagtacttcttagattgaagggggaattgatttcagctgtctgaagagttgctttactctcagggtagcaccctcccttgcccagttttaactccctttcatggtagggggtaggatacatgggtgtgggagagggagaattttgtttccaaaagagagttatattgatgtttgctaggagtgaggcagcctaacttgcttctctcaagtctaaggaagactgaagtcatttgaaatgaagtcttgtccacccagtgatggttgtttcacccttgtatttaaataagctcctggggacattgctaacacagcagtaagtcgggatttggaagaccactggggactgtgtctctcttccctgcttcagggtagccttcagacgcccacttccttcctctcaccgccaagccactgccgtactttccaccctttgtgctctttcttccaagtccctgcccctctgtccctcgggtcctgtgctttcagacgaagggactcacagatttttggaggaagtggttttgttaactgtctcaggtgttggaggcacttagctatgagcgaaagatgtggagagtcttttgcctgatctcttaaaccatctgcttgatgttcctcttgaaaaggaaatgtaaatgtaagtctgggggcttaatgttccattctgtaagccagtgactgttacgtgcttaatcaataatgtcaaaacttaggtcgaacccattgattcctaagagcatggctctttgactattataatagaactgtctcaagttcttcaagaattttattagagaagaattgttaggttcattaaacatttactcctgcactttctaaggacattcatctggaacat

SEQ ID NO: 37228 - DNA, 1889 bp, Bovine  19866881497596
actttcttaattatgaccaatagtgataagacattttggaggttttaaaataggtccattatttcaaatgttttcaatattttgatagttgctttgctgtctatattatggaggaaattcagaatttaagtttttacttctttttaggggttcttatatcacctctcatttttgccctaggttgatcccttggggatttttgaaatttacgtttgaaagggtctttttttaaatgaatgcagtaatttttattttaaaatttttcaaacattttaattttattgcgaaaaatgtcagacatatgcaaaactaaagcaagttatgtctgagctttaagtgagatgtcaatacagggactatgtttgttaatgcggcaatattcagggactcaggaaatgtttgtgacttaccgcatgcttgaaagaatttgtataaatcaaattttttaaattgttcagtcatttccccatctttaacaggttgtatttcaaatgtttgttggttgttagccaatttggggacctacagatgtgtttctcatagaaacaatcttaaaatggctattagcttttcagcctagctctcagtaattatctaattcatagttaagggaagcccacacatcacttttaacatcgtttcagtgagaaaatacttttacagtcgaagtcctggggaacaccaccccccgcccccatcttcccttcctctaagtatggatgtacagaaggagagtcaggtcctccttaatgaagattcatatccataatgggtcttcaccaaaaggagcaggaactcagaggaccctaggagtatgaggtgggggatgggagtgcacactgtacattccattctgaaattatttactgtttccgttgctaagtggagtttgtttttgtgctttttttttctaaggactttttatttaaaaaaaaagtttcacaaatactctattgtatctaaagttttcattttacaggcttttttaaaggaaggcttctggttattttcttctttaagtttgtggcatagagggaaattatttttactggctgagatatgcctaagacaacaggaaaagattcctgactgctgctgctaagtcgcttcagtcgtgtacgactctgtgcgaccccatagatggtagcccaccaggctcccttgtccctgggattctccaggcaagaacactggagtgggttgccatttccttctccagtgcatgaaagtgaaaagtgaaagtgaagtcgctcagtcgtgtcggactcttagcgaccccatggactgcagcccaccaggctcctccatccatgggattttccaggcaagagtactggagtggggtgccattgccttctccgaagatcctggtacagccaagtaatattttttaaaggacaaataaataaaagaaacctgctgctgcgaggcacagccaaaataaatcaataaagaaaccttctggtggtctagcaggagtcagcacagcacgttctatcaccctagctatgttgcgtgcctttagaggtggaccccccactaggtctttccaaacaaaaagcggttaatcccaccagttggacacgtgtgtccagaagccagcctactgcactccacatagcacagcctgggggctcatgggcatcagttacacagtaaggcttaccaacgggattccttccgatgtattggcgtgaagcacaggaagacaggggagagtctttcccctccgtggggaaaaaaaaaatatatatatataatatatatttcagtaatatataaataatatatgttatattatataatatatgttgtatattatatatgttaatatatataacaatatatgttatatatactatatatattatataatatttataatatgt

SEQ ID NO: 37229 - DNA, 923 bp, Bovine  19866881747530
tgtccccagagcaatttcagaaaaaacaactggttctcaaactggccaaccaacaaacagacaaacaaacaacacaaacccaaccctaaaaacaaactattaacactgtatcccagcaaccctgtcatgtgaaagtgaacaaaaataagttactcagtctggagatatctgcattcttacaaccagggtgttacctgctcaactcatcagcctcttgctgaaggttccgtgcatggtcaacagcttcctgaactaaatcatgactgaggttgctcaggttggatagttttctttgaagttcatttttggctccatctatttcggcataaatccctgatgcattctaaagaaaatattgaaaaaaaattgaatttagagggacttaaagtatttttcctagggagcaccaaagataatctctattcctccttactgtgaagttcagtaagcttcaggccagatccagaagagtctaaaaggctatatgtgcatgtttagtcgatttaattgtgtccaactctttgtgaccctatggactgtagtccacgaggctcctctgtgcatgggagtctccaggcaagaatactggagtgggttgccatgccctccttcagggtatcttcctcacccaaggatcaaacctgcgtcgtgtgcactgcaggtggattctttacagcttagccaccaggaagtctaaaagactatatacatagatatttacctatttgcatcttcaactcctctactgattcagacatgctctgccatctctcatctaaaaagaaaactaaatagaaacgccccactgtcctcacttctccctaattttaatcctttcatagcaaaatagaccccctctgcaaataaagtgtttatacatgctatctctatttcatcagtttaaaattcacactttgacttat

SEQ ID NO: 37230 - DNA, 652 bp, Bovine  19866881869781
tgcccgggaactctctgccactcggtggccccacccatcgccgccccgcccccgctccaatcaccaatggtcgccacccgctgctcccgaggggctcgttgattggacagtggagcctgccactctagcggggcctcccgccctccctcactccccgctggggctggaggggctggagcatcagcgcgagtagctcggagcagccgcggcagcagcggcgcgtcgttgcagttgcgccatctgtcaggagcggagccggcggggagggggctgccgcgggagaggaggaggggtcgccgcgagccgaaggccgccgagacccgcccgcccaccggccgtgggagtagaggagaggctgccctcggagccgcgcgtccatcaccgccccggcgcgcggcgcttcaccccgcgcaccgagggctccccaggcgcacacaaagccgccgcccgcgcctgggagggatccggtcgccgggccggggacacccggcgccgccccctgggcactctcagaaggcccaccgactcccgggcccgccgagcaaccaccggagccgcttcggccgcgccggaggaggcggggagtggaccatgtgaatgggctccggagcctgagcgcagcgcaggtaagcggccggggatgcgccgcggg

SEQ ID NO: 37231 - DNA, 724 bp, Bovine  19866882201607
tggaaaaactgaggcccccctccagtaagtgactgaggccctctccagaagtgactcctagcagagtcagttgatgaagaaggcaaaagcagaaatgtgtcgctccaaatccagccatcctccacctcagcacatttccccagtcttcatttcaatcttacagatgttgctgtctctaatgaggggttatatcacctgtcagatgtggttttacctaaatctatttcctcgggtatcagaataataaaaaggattacctagcaatggtaagcaaaaaaaggatgggaactgcccctgcactgctagaaaactgcacaggaaaagtgttacagaaagccacatgtagggattaaactgcccatttcccagagccagacggccagggccatatccagctaattctactggtgaggatcaaatccctttcctctgctggctagggggccagggctggacagaggagcgggggtgaagggaaacagcggttctaccccagaaagggcactgacctctggtttataatcggcatccatgctagtggttttctgcaacacatggtagaaagattgcttttcacatctgatcctcatttccagaaaaggaacttctattttaggtattcagttatggctcaggaaaataaatcgaaggtgaatctggggacccagagacaaacccaaaagaactggttggcactttcataacttgtagtgaaaaggagcaa

SEQ ID NO: 37232 - DNA, 1923 bp, Bovine  19866880494929
gaggactcctgggaaagaaaaaaccaaacatctgagatgttgtttcttggcaaatccaaagttcaatatacaaataatgttggaagcaagcagaaacctctcaggcagctagttgaaaggttgggaaagtatatttggttgaataattctgctgtttctattgtttttcaaaggatatttttacaaaattacaccttaagatgtcagttcttcctgctactttctctgctggccacttcacagttatcaattataacataacaaaatggaaaacaggccgtgtgtgtgcgtgtgtgtgcacactcctcatgtagaagtattcttaaaagatcttcaggaactagactatgatgaccaatcaataatacttctactactggaggaattttcatattgaaatagaaaatcatttggtttgaagatggccaaaagaaagccagggccttttacctgtataagtttcgagccacgtcatcctcatctatcgcatatccgtggacgtggtcagtaaaactgaaacctgtgcccacctgaaggtgaaataaataagcaggtataaacagagagaaatgcacatcttgctgagagacaccacatgggaaggaaatcaacattattcccaaggtcatgcctttggcctcagctttttgacatcacccatgcgcactcatccatgctcacagaaggatgctgcatgtcaccatgtcccccttccctctgctgagcccaaataaactggcagtgcaaagctcttctttgatcctgcagtggggaccctgccagatgattatttaaggatgagaaactcacctttcctggcctctgctacagtagcaaaagagtcaaagttgcctcctctctgaaacctggaaggtgcactgctctgtcctgctaagaaggaactctattggctgaagataaaagctagctgtgtgtgtgtgtgcagtttttttccccatttctttacttgtgataaatgtggccactaaaccctttcaccttcagcagataaggggttttaaaataaagtttaactttaaactaatagttccttattcctggaagttcatagacaactgagtaaatcaatagaaaaagctactacttattttgggtcaacaatatgtacaaggaatgcacccccaccatatacatcagttgtaaatatttttgattttttgtttttttccaaacagccaagggaacagaacatttaattagactttaatgtaaacatggaattctagactaggaaagaagatggctgacaaaacatgacggaggtgaggggggagcaagaatgttggattttttccttcctatttttctgttttctctttgaaccgtctgggaagtgaaagaagttagattagaggacagatactcccaatctgcaggagttgaccctaaagttactctcctatattgtagtttatttgatttgatttcataaaaatgtcccaaggagaattctaccttttgctctccctgagatgaggcattcagctcactgtgataagtgaaaggggctagttttgactttttatatcagagctgtatttgaaagattaggtgttcccccgctacaaaaaaacccaagttatagagaaacccatattatcagtagagagaaagtcatcccttcctggatggtataactcagtgaagagaacatttcataagaccagaaatgagggaaggagagaaagcagcaaggaaaattcccaaacttggatataatggtacatattagaaaaattaaatctcaatttaaaaaaatgtttaattggaggataattgctttattgtgttggcttctgccatacaacactatgaatcagccataggtatacatatgtccccccccggacctccccctcatcctgtatcttgtctcacccctctaggggtcacagagcacca

SEQ ID NO: 37233 - DNA, 1664 bp, Bovine  19866880548318
ttggtaaatcaaaaataaaagctagaatactataaatgaattgggattttacattgaagaaacagaggccaggccttgttctagtcttccagtcactagaaggacagaaaaacaaaattacccttgcttatgtctgaggtttatttctgtttctagattttaaaacattcacagacatgtgcatgcaaacacattctacagagcaatgccatatttatctggagatcagacatcctacaatattaactctttgaaacataacccatatttgcagaatcctacccccaaagccctccatgcagcacataccagatataatgcctttggggagaagtgtcaggctcccacccagatgattgtatagaaccaaaaacagaagaacagcaagaaaagtaagagtgacaacagagaaggaagcaggaaaatagctaatgcccatgtaagcctggctggaggctggcaccctgagtaacctttgagcctgcaacattcagaaaaggttgaatttcattccatttactctgcttaggaaaatgggagtatgtgcagaatatttttaaattgcatgcaaaatgatagatgtttaatgcttaaagaggtagaatctgttacttgaaattgttgttatggaatgaagtgttgctatttatgtattaacatgttctattatattgagacataaatagctaaatttttatcagttttgttacataattctctctaaaatctggctatttctttcagtctccagcagtagacacaatgcctgcctcacagtgggtattctgtatttattgaaagaagaatgaatgaatagcaagtgaatcaaactacccataaaatccatatgtctgtgtgacgtgtgcatgaataaaggcatccaagtttaaaactctcccttttctcctttccagagcagagaccattctcttgggaccattcataagcaagagacacccacgccgtgacatatgccagtgccaccacctccgcctcctcctcctctgcctccacctcccccaccactgggggctcctcccccacccccaccgtctgcaccgccggtaagacctgtttgggtttttttctgtctgttttactggaatatgctggaacaggttttaaatattcaaaatcagccatcacctggctcctctagggcaggtagcatcttagggagctagctctatggtgccagggtctaactccaaaccagtctggccacgtatttccctcccagttctttggcagcccccaccctctaccctagcgtcctctacagatgtctacatgatttttaattcatgctgctcaatataggcttcccaagtctccctaatcaactcttccatctcatgggaaacctcagttgggaggctgcaatgagtcaaggaggcatgctcacatcaagttccaggttgatgttatctggatattgataacagtagcttgggcttcagccacccggttctgggaccaagtgagaggagtggcatatgcaatgccacagcaaaacgtgctaagtcatttcagttgtgtctaactctttgcaaccccatggactttgcccaccaggctcctctgtccatgggattctccaggcaaggacactggagtgggttgccatgcccttctccagaggatcttcctgaaccaggaatcga

SEQ ID NO: 37234 - DNA, 2024 bp, Bovine  19866880588991
ccctgtccatcaccaattcccagagcttgctcaaactcatgtccattgagtcagtgatgtcatctaactacctcatcctctgtcatccccttctcctcctgccctcaatctttcccagcatcaggatcttttccaatgagtcagttcttcacatcaggtggccaaaatattggggtttcagcttcatcatcagtccttccaatgaacacccaggactgatctcctttaggattgactggttggatctccttgcagtccaagggactctcaagagtcttctccagcaccacagttcaaaagcatcaattcttcggtgctctgctttccccatcctactggccttgagcttcagcttcctcatccatcttactcagtagatcccatagacagaaacgaggctatgtaacaaggtgattaagagccttggttctgatatatacgtatcaaattgtcttactccactcaagtcttaatgcctccattgctacatttataaaatgggggaaataacaactacctgttaagtttattttaagggttcattgaggtaacccactgaaaaggatgtaatccactgaagcactgaatgcttgacgtggaattagcgttcatttaatgatgatgattattatcattgcatattatccaacagtacagaaatggagcagctctcccaaaatgaaccaggcttgggatgttttccattcagtggcactaggtaaagtgactgaggaaggtctgatgttttagcccagccataagtgaggagttaaggatgccttcttttaaaacccacccttaccccgcccctgaaactgcacaggatgttaactttataacccttcaaagagacattctaagagatactttgcatcttaataagagtcacttaaagactaaaagtagcattttaaagaatttggtgaggctcagaaccaaggagatcaaagaaggcctgaggcaactgcctggcatccaaggtgtgatgctgatgcatgtcaaaaagaggcacaatccctcttcccagttgccactggcttccttgccagggagaccttggactgcaaatgctatggaagccctgataacagagacctttggaagaagacctatgagaatgggaccagagcaaagaattaggcaaatgccttgattattttaaagagagagaaggaaaattctctaagatataggtggtggggctggaaatggatcccagaaattaaaaatgggatggattggaaaagaagttggtaacagtggtgccataaaagccaatccagtctcactaagaacaagtcaagtcacagtgatgccaatcatttcttttcagaaagattggcatatcagagcaaatgaagcagacaagaaggttgtttgcaaagcgttttggacaaggttacaaaacacaggacagggaccagtacaactaggcagattaataatttgatgattgaaatgtagaaagggaacaaattagttgatataagaatatttcttggccttaccctaggcaatattttcatgaatattttaaccaaaaatgagagcagttttaatcaaaattatctatgtaggagatctaattaaaggtcgctatatttgaaaaaaagcataaagtatgttctctaccctttctggaataaagactcagaagcttggattgctacctgtaagggatagataacatgtcagatggtaaaatggggatttttaaaaaatctgaataggctggcaccagattcactaaaatttcatttaagagggataaatgtaacttttggccaagaattttaaaaaatcattgctaatattggggagacacagcctagcaggggtatgtacaatgtatagatgtaaagattgtaattggtgtaacatcagtagctattgtagagtaactaagcaaactctgatctcagactgtgctaaacaggatgacaaagtagccgtctgcttcggtcagactctctggagtgtcacatgggttctgggggccacactatgttagggacggactaaaa

SEQ ID NO: 37235 - DNA, 1199 bp, Bovine  19866880592052
ctgctaacagttttatttgtataagattctcaggcttagtattaatatagattgaaataccatccttcactgcaattattctttaccgagcatgaatgcatgtgattatcatcttatttagtaaattatctttgatatttcttcacacccacttcttggttattccgtgtgcttctggtgcctgattcctcccacccctcctgacacccaaccctcctgctgtggcctttacaattgaacaatgctcacagctctgtgaatttctcatccagccagtgctatcatttgccaagaacaatttgggaatattggaacacagcctcctttcacagtctgtgcacatttctatgcttgaagttagagatatagttttataaagtgaatgtttaactccagcctaatctcagttttccttagacatactgcgtagtgcactaaagttcatgcgagttattttcctgggtggaacctgatatttgggccactaagtgcttccacgtgtttaatccaagtggccaaagggaggacagatttgcatgcaagatcatttctaagaaatttatgcctgaggcactcactaatttttttcagtgtcataaaccctgctgatctccaacagttggagcttgcagaacaaaatggaagtttcttttgttttgtctctacatagaattacatgagtgggctttccctctgtggcagacacaacttactctctactcaatattcctttccttcttccactccccactcctttcctgaatgcagaaccctgattttgctccaggaaataccgagcaagtgggtctattccagggagggcaaccgcatcccctcagccccggcctatgattggtctagagatggccgtgtgacccaattctgccaatgagatgtaaggaaacacctggtagatggagcttctagagaagtggctgccttcctgataaaacggttatagggcttgtttctcctagctctctgcccctttgcttttactgtcttcatccctcctttctcctgcctataacacaaaacgtcagtagaatggcagtagccacctgtggtcaaaagaaaatggccaagagaaatgcagacatcggccttaatattgttgaactgttgaatcagcatcaggcaacagcccacctccagcttctttttatctgagaaaaataaacctctaacagtttaagcct

SEQ ID NO: 37236 - DNA, 2008 bp, Bovine  19866880626600
ggattctccgaaaagaaaggattgcattttgtttctccaggggatcttcccgactcaggggttgaagccacatctcctgcattggcaggcagattctttaccactgagccccttgagcccttctaagcactttgtataaattggcttaagttttataaccctctgaggtaggtactgttataattacctccactttacagatgagaacatgggaactgagcatttaagtgatttgctcaaggtcacacagttgataagtggtaaagctgagattagaaccccaggcacaatgcctaggtctattttttggttgtttttgttccccaaaatcagtttattttttattgagataaaatcagcataacagcaaaatcattttaacaatttaaaagtatagttcagcaatccagtggcattacatacattcacaatgtcctgcaagcattaccgctctctagttccagaacatttccatcattcaaaatgaaaccttttacccaattaagcagtcactcaccattcccttctccctccagcctctggcaaccactaatctgctttctctatggatctgcctattctgaatactttatataaatgaaatatgcaatctctggccttttgtgtctgacttcttactttttattgctcaatagtaatccattgtatggattactatggatggtccacatattatttatccattctccaggggatgtgcatgtgggctgttttcaccttttggctactgtgactactgctgctaaggatattcttgaacaggttttttgtttgaatacctgtgccagttcttctgggtgtaacactaaatgtatgcttttaaccaccctctaaaactgcctctcatccaaatattgttcacattttgaaatattcagaggctaaaatgcaagaattactcttccccatagttaacttgttaacaactcccaggactggtgtggcctggtttggtttcactgcggagacttttgttctcactggggcctctgccgaagcagacacgacttaagatacttctgttagtaggtggggctataaataaacggtgaaataagctcaccacttcccttttccttttttataaataagggctgggattctattttctgtgtatggcctctcactgctctttgtctccgtgatgaggatcttgcacccaaggaggcgtcaggtagccagaaggcagtggaagtctgtcagatgaagacaaggaagaagaacggggcactgggcaggaagacaaggggaacgaggcgcactggggtgcgtgtgcacggaacacgctcagggacggtgggagaaacaggaagcctttccctctgctcgggctttagtaatcgagcatcttaaaaacgtggggatcccagaagctcatgtaatcaaaggtcccttctccacctggcttcaggcagacctgcatcttggcctctggggaccacaacattctgcctttttagtaccaatttctagaaaagttgatttacatcaatctgtagttcttccataggcactgagtaaatttctatggtacattttaaggagggctttttgaaaatgtgatcatcagtcccaagacagtctctccccacctattccaatcccagtcctactcctcctggggccccactcacttccatctcgggtctgagtcccccgaaggggctgaaagcctgagctacacccctgttacagacactaccctgtagatgcgggcatctgctgcctcatggcaatatatgaaatgaagatcagtattactgatgctggcgaggatatcatggggacagctcactaacagaatgcttctgtttgtaataagtggcccattgctggggaaaacactgtcagtgtatcaaatgcctcatgtacattgatccaatgattctatttctaggattctcttaaggaggtcttcaaacaaagaattaatagatagacacgtatcataataataaccagaaatgagagaaggcttaaacattga

SEQ ID NO: 37237 - DNA, 1085 bp, Bovine  19866880654777
tatttaagtgactgcagaacttttgtgcagtaaacaaggagagggacttttttctctttgaagtgacagagggaaaaaagggtaagaagtggcaagtagggtgaaagggtgtgcaaagagtgaggaggccccaaccagggagcaccctccacccgagtcttccatgacatccaccgaacacaaatgcctactatgagcaagctgttgctgttggcattggatttaaagaggcattggatttcaagttggggttgatgtggtgaaggatctacagggtaagaaagccaggagatcaggagacagcaagctgcttagaaatgggcaaaagcccttgggaaagggatctttgagtttccagagggtatggaactgggaggttcaaggtcattggacctggatccccaaggcagggagtattcccactgactttccaatcacctagtatattcagggaatcttgaatctcctttcaaatcagaaacaaagtccatgttgacaaaatgctggagtgaggaaaacctccctcatcaggagcttctggttggtacacccacagatgcggctgactggcctggagaataacagggtagggtgagggtggccttgagaggaggaagggtgaaggaggtcagggcagccctaatcctggtcagagggtggaggtggggtgcaacaggaagctggtgccacagccacatctggcagctccaggtgggcttgtctcaccggcggccagtgtgtttcttcaggtaagggccttgggctggcccccttgcgtgccagctgctccacctgcagcctccagtggccgtgcgggaagagaatgaccaccatgaggttcactgaggtcgtgctggacagagcccctcgctagggcgcacaccccgcgctgagctaacccagaattctctcactttcaggtggcaagaccagccagggccctggctcccgggcgccttctccacggcttcccaccaagactatcagcggcccattcaatccccctgcgtctcccaggctaggcaacgcctctgaggggcatggcgcggccagggcggtaccccctcgccccagcgtgcccgccc

SEQ ID NO: 37238 - DNA, 1513 bp, Bovine  19866880662948
ataacattgttctaaatactttttcttaaattatatgacactactagaattttaatttttctcaagtaacaaatcatcttaaaagattctaaagtaaattgtttaataaagtggatcactaagaatttgagttcattgaggtcaatttaaactatattctacatattccaatcaattcatttaatgcatattcacattgttaaagttgccaatttctctcttttggccctccatgaaggcaaaaaggaaaaactaagattataagttttgatggtgaaaatgtgaaagtaataagttttcatatgccaccaccccaacccccacaaagctttctatatcaacttttataattgaacaaaaattttgaagtattggttccatgatgagacctgagcctccataaaccttcgtctatttcgatttacgtgttttgcacatggcagggcttggtaaatatggattaaatgaattaattggaatattgtagaatttagtagaacaatttcctttgtatgagaagcacctccaaagtgttcgacttcagggttgtacccaaatgggcatttttgtactgtttattatgtaatttctgatctcattggtggccctagagcttcttgaaagtataaagaccacaacacttattcatcctgccagtacaaaaggcctgaacaaaagagcagaagcttttaaaaagattttgccttgttttctatagaccaactctctcaactttacttcctatcccattatctctttagccactcatatagtatttgatagagaaatttcaatttctaagagccttacatggtgagctctctagtgtagtgctcctgcctggaaaatcccatggatggaggagcctggtaggctgcaatccatggggtcgctaagagttggacacgactgaacgacttcactttcacctttcactttcatgcattggagaaggaaatggcaacccgctcctgtgttcttgcctggagaatcccagggacgggggagcctggtgggctgccgtctttggagtcgcacagagtcggacacgactgaagcaacttagcagcagcagcagcagcagtgggtaggaaaatgttggcatttgcaggtaaactcagcagtcaagcccagtgggtgatattaatgaggactttgactttttttactccaagggaaatggaaaacccttgcaggttttgagcagagtcacctgatctggcaggagcactgctaagggtaagcatgtttgttctaggaacaaaacagagctctttatctggccttccaggatcaggaggcttcctggaaaatagccaagagacaagtgtgaaaagagcagagagattagctcaagctaaggtccagaggtgagctccagcatggaaggaaagattggggctggtcacttggttgggccttgtacaatgtgaagggatttgaacttgatcctgagggcagtgaggagccagcaaaggtttttatggacatggtaagtgacatgtcccttata

SEQ ID NO: 37239 - DNA, 919 bp, Bovine  19866880673531
aacatatgacattttagccaagatctcaaaatacagaccccaagctgatacacatggtcactgctgcattgtaaataaacaggataaagttctttgaagtttccaaggagaaacaaatatagtagttgtcttcacatcaggaaatattgtctatttttcttttttaaaacatcacaccaaatgtgttgcttttctagctgactataaaaatcagtgactcatgtttgcattttatgccaccatgctttgtgggctgaactatttcagatttacctaagcttacatcatggaaatttcccaaaagtctaaacactttaggactttagttcatttttccccactcataataatagtagatttctgaaagatcattttaagatgttaaattacccttcatttttcaaagcatttggaacactaggcaatcaactgagaaaagacagctcattgttctatgttttttccccacagagaatttatgtctcaaaagatattttttaaaaaaggaaagttatttaatatgtctccctggtcaacccaggatctgctataaattcaaaattcattcttgtacaatgttcttaattataagataagtaatctttctgttagtttaattctgtcctatttatcttctcaagtggaatgacacattgcaaataccatttggggagttttattaataaaggcctaatcccatggcttgtaggacatgtctcagaataatgttttaactacacaaaagctcaatgactgtaacacccactcagtaattataactgttccccatgttaggtaagtcgcctttcccagtgtgattaatggtgatttctcaaaacgggtctcaaagagctcacagcaagtgatcagtttcagtctcctgccttattaggtagtaaggattaccatctttgctgga

SEQ ID NO: 37240 - DNA, 1487 bp, Bovine  19866880677040
ggagtgacgatgcaagatgcagccctctgtctggggagggctgactctggaactaagatttgccctaaatgacctttcctcctagcgtggtggaggagtggagaggatagaggatgggtgtccctgagctgagggagccagtgagcagtttctgtcccttcctattaacacagactgtgtgcttgtttcctggggctgccataacaatgccataacaaagaaccacagcccaggtgacttaacaatagaaatttactttctcacagtcctggaggctagaacttcaaggtcaaggtgtgggcaggcttgatttcttctgcttgcaaatgagcatgtcctcctgtatcttcacgtgttaacctttcgtgcatgcatgctaagttgcttcagtcatgtccgactctttgtgaatgtatggactgtagccctccaggctcccctgtccatgggagtctccaggcaagaatactggaagaatccctcctccaggagatcttcccagggatccaactcgagtctcctgcattggtaggcgggttctttaccactagcgccacctgggaagcccaccctatcagtcacatgtgagtttggagggggacacaattcagcccataagatgttgggtatgacttaatgtcgaggctatttaaccatcaaccacttcccgctactgaatgtctctgacacttaccaaaaagaactttgttaagtgtgaacaagcaatacagtttagttgcttcatctgctttgaggtcttctgcacgtcttagagggcctgagcttgtttgtaaaacaggacaccagatttgaccttgactcatgataacagtgtgtcaaggtcaaacaggtattaaaattagcccacttgttgtcacatagtattatccataatgaaacattaatactgataattactggtaaatgttaatacctgcacatgggaatgccacgctgcatattttagcttccaatttcatctcactgaggaccaaagaactgagccacagctgagaattcttttgagggcctcagaatagtgttctataaatacagagaaatttctgggaaaagcacatcgctggtgcaacctttaaaattctcatggtgatgtcaccatcagcaggtggcctggctgtttaatatgagctttgatgtcaccagcaagcaccagagagggtgcactctcattcactgaatgtgaatttctgaagcagtgcccaagcccaggcaccacacaggcactgcttattccacgagggaataagcagggcaaggctggcatgttttcttgccaggaggcagcctgatttcccacacactctccacagctttctttcttccactatctcacttcctaactcccttaccagagtttccaggaatcaccttctaaataaactacttgagaaccaaacctttgtctccgagtctgcttttagggaaacctcaaattagaccatgatcttctctttctcacagtgtgt

SEQ ID NO: 37241 - DNA, 1345 bp, Bovine  19866880702250
cctgagattttagggcaggtgatgagagaatagagtggttctgatcaccgaggtgaagatttgctgtgctctatggtgcaaatagtgcagggctaatgaaggttgacctgggaagcacatgccaggggcctgacactcatggattcactgatctattcctcatagaggtcctgtgagggaggaggtatgctaaaaagtcccagttttatggatacggaggcggagtacagagcagtgaactgatttgcccaaagtcacacctctcttgaatggtagagatggggtttgaacctaggcagtctggtttcagaaactgtgctcatatcctctcttctatacttcttgacacagggagaaggaagactttgtcgttgttcagttgctaagttgcgtcagactctgcaaccccgtggactacagcatgccaggctttccttcattttctcctggagtttgctcatattcatgtctgtcaagtcagtgatgccatccaactgtctcatcctctgctgccctcttctcctaacattccctttacagatcttatggattcattgaaaacatttgccaatctaatttaagacatactgtgttaaataccacacagaaacacagactagggtgctcttaagtcctggatattttcatgtggtgtaaaaagctattttgggaactgccttccatcccagagaattgtcagcccctcagataattgaggaaaatgaagtaaaatgagaagaagggtcctatccaagccatttttccttgtcattcaccactaatcagggtcaaatggcttttctcacactgattcctaacagctctgcctctctcccccagtgggttcctgcttttcctgcaaccaaatgttgttccctgattactgttgcttctaaatgcattgtaacagagacagtgtccttcagaaaaatagaatgcagctctgcctttaaaaaggtattgctaaaaaacaagatcccaaataccaggttcccatcaagacagaataaccttcctcaagtctcctcacacttctctggctacaaaatgggcaaaatcaaacttgcttcctcttggtccttacctggtgggactattgtgaagataaaagacagtaattggtatgaaaatgccctgagctccatagatgaaaagctctatataatcccagtatattattagactggctttattgggatttggatacagttctttggctcatagaagtcagtctttcagccagtagtagggagtccccaaggttttattccagaaagagagtgtttatggcaaatacagtcaggttagcattatccaggttacagacagcctagagttagagaag

SEQ ID NO: 37242 - DNA, 1179 bp, Bovine  19866880706536
ataaaaaaattttcaaaggaaataaaatgaggcttattttaatattaaggaattgataacagtattacaaggcttcatcctgaaggagagaataagtacttctagcatgaataaaacataaatatttatttcaatcttcctctaattgtttcaatatttggttgtaataaaaatggggtgtacaccaggattaaaaaaataagcttaatttggtctctttacagataaaacctacatcctaacattttttcaacaaatggctaatgggctaaaattcatttgacatcagaggtataaactttggaggataagatttatgagttgactgaaaagcataaaattccagaaaagatttttcaatcatatcttgagccttggggtaatcacactggatttctaccacatatatgtgataatctacttttgtatgaactttgttttcttaggttaaaggtgttggagttggtgagaaattaacatgaattcccatgttccacttttattcttcctagtctgattccagggacactgaggatatgtagagctacaagaagttatagattttcattgatgcttataaacagcaagttcatgtttatttgctaaagtagaatatgagctgggcggctatttcatttacagtcatttctgtatatagtcaaatgggcagttttctcagcaggacagagtggtggtatctgaaggcagtttcctagcttacctctacccttcaaatgatgcaggggacctgatgtgaagagctggctcatttgaaaagaccttgatgctgggaaagattgaaggtgggaggagaagggaacaacagaggatgagatgattggatggcatcacggactcaatggacatgagtttgggtaaactctgggagttggtgatggacaggggggcctggcatgctgcagtccaggaggtcacaaagagttggaaatgactgagtgactgaactaaactgaaatgggcagtagggagctatgcactagaggaagtttcaaaagggagagccaaggggaccatcttgacaagcctgccttgggcaagcctagctggcataaaactaatcatctagacatgtctaaatatgtgttcactcttctgtgcattttacacttggaaacgcactgaaccaagagagggcattcatcactcttaatcttaagg

SEQ ID NO: 37243 - DNA, 1503 bp, Bovine  19866880769478
aattgaagaaaaactaccctgatgaaggattcctcattccagagagaaggttatggtttgatacccttaagaactagataagctcattaggagaccacctgaagccagattaaaggactataggccctgaacacacccctgatccttatttgcaacccctccccttgaaccattgttagaaaactcttcactaaatcctcctgggttgggacacagaattttgagggacaggactccactgtgttctcctttgcttggaaaagcaataaaactatccttcactacttcatggaaaactcttgtctctcagatttggtttggtaccagtgcacagaggctgagttttcagcatcaaaaccattagagactacaatttgggaggtactctagctcccaagagtgcatagtatatttcaggcactgtgatacagatatggagaaagcattttggactggccctcctttcattggtactccttaaattatatgtgaaaagattatcactccattatgtctgtatctgaaaaactaaaatttaaaaaaacccttaactaacactggaaacgattctagctaggttttttactctgcactgtttgtagaacctccttgttttcctatttgtcacactacataccctagagacaaaggcgatgtaagagaaggaaccatgtttatattttccaaatcaaggaatgaagtaaagtgaagtgaagtgaattgaagtcactcagtcatgtccgactctttacgaccccatgaactgtagcctaccaggcttctccatccatgggattttccaggcagcggtactggagtgggttgccatttctgtctccaggggatcttcctaacccaggaatcaaaccctggtctcctgccttgcaggcagacgctttaccctctgagccaccaggaatggctacttttaaacaccaacattagcattttaagttggtaacggcttgagattaggcccattcctttttggcatatgcttatatggaaaaacaaatctgcattgtttggagacacactggtagttttcttaattatgtcacatgcctggatttggctgcatcaagttctatgttctgaattgtttgtctcttggcagatacttagtttgtggaatctgattaaatagatcttagagcttatcttccctgctcacagataaaagaaatattaaaagtctctgaccttatactctgtatacagaagacttctgataaaaaactcaggatcgaattgaagagaattctgggtaaattcatttcagggcgtggtgctctttctggcaagctcagcctgaggactctgaactggctaatgctgtaagttattccattacctacatattatgttgggatgatattcccacagaataaccaagcccaattaacaggttgtttttcttacagtgaatcccctgggtgctcctaagggctttttcatttctgggagtgtggcagagagaatgtgatgggaagcttatgaggt

SEQ ID NO: 37244 - DNA, 1896 bp, Bovine  19866880774205
cttttcccttttttatataactttttaaaattaattaatttggtttcatcgggtcttagtggcggcagacacaggctttggtgcatcaggcaggacatttcactgcggcacagactctagctgtggcatactggctcacttgcttaggatcttagttccctaaccagggagagaacccatgtccctgcattgcaagatggattcttcactactggaccaccagggaagtcctcaaatcaggctattcttaataataaccaattaaaactttatttcactgccacttttaaaacacttctttttacaagtcagtcatattataaccaagaaagcattcctatttatgcattggatggtcacacatttaacaatattaaaaattattattgtcaggcagatggcaagtcctaaagactcatagtaacctgttctagtactccccaggtggcgctagtagcaaagaacccacctgctaatatgggagatgtaagagacatgagtccgatccctgggttggaaagatcccctggaggaggacacagcaatccactccagtaatccttgcctggagaatcccttggacaagggagcccaatgggctacagtccatggggtcacaaggacacaaatgaagcaacttagcacacacgcatgccaagtgctcatggagaggcatagcacagtgctaagtcagtctctggacactgaagccagttttcctggggtcagatgctgactctagtacttactagctgtgtgaccttgggcaagcaacttaagttcttagtctctcagttacctcatctataataataatagtgcctgtttcataagggcttttaggaagattaaataacttagtatttataaagcaattagaaatatacctagcacctagaaagtgttctgtaaatgatcagtaaatacactggaactcattttctagtgagggagtcagacaataaataaatatgaaaattacagtcgagtcatggggacaaacaccaagcaaacaatttacgataaaatgaaaacacacccagtcctgtgagtggcatgccaggttatttggcttaattctcctgttggaaacaattgggcaccaaaccaatggttttggtttcctcctgaaggaaaaggaacagaattttaagtgagtgtagggctcatccaaaaaagagcaattaatagaacatccttcccttgataagcattggcccgcaaagggtttgggcaatccagaagtaaactatgctcatccccccaccaacagatctttatggaaagttaagctaatttggagcagaaaagatctggggagggtagggaggcttgtcccagatgtgactataggctaacagtctctttttctggttatcccaaaacatgacttatactaagccatgaactttagtatacagtggcccctaagatcttgaaaagaatttctagaaaaagtgacttttgattaggtcttaaattttcctacaaataattttttaaggaaaatgaggagcatacaataatatccaagaatactaaggaaccagattcagaaaagaggaggcttggagagttgggaagagtcagctggtgatggctgcatttcagagagagggtgaattgtacaaactagccttacttaggtcaagtgtgaaactgacatgattagtaatattttgggactataatttttatgcttctagatatgcattcatgttaacctgacggcacaggatgagatgctatgagcagtggattccaccatcaggcatgggtacaatgtcctctctttaaaagtttacacactaaatccaacaagactgatgtgaatacacaaaaacaagaaaagaaatattaaattaccagtacaggataactataaaggaaaaggcc

SEQ ID NO: 37245 - DNA, 1297 bp, Bovine  19866880797368
catgttaaattgattaagcttcatatgttgaatcatccttgaattctagaaatagatcccacttggtcatagtgtacagtccttttaaaatgctactgaattctgtctgctggtattttgttgaggagttttgcatcaatgttcctaagagttactggtctatagttttcttttcttgtagagtctttttctggctttggtatgggttatattgacctcacagaatgaattgagagaattcaattcaattcattcaattctgtgagaagtgatccctccttttaagttttttggaaaagtttgagaaggattggcattagttcttctttatatatttgatagaattcaccagcgaagctttcaggtacaggactttttctttgttgggaaattcttgattactatttactgatttgtttcagaacaaactttttggcttacccaatagaaagcaaacaaaaagtatagttacaaaccactgttacaataatactagattttataattgcctgtatggttacctttattgagatctctatttctccgcatgactctaagttactgtctagcgtcctttcgtttcaccttgtgggactcttttaagcatttcttgcaggttgggtctagtggtcatgaactccctcaacttttatttatttaggaatgtcttaatttctccctcactttttaaggacagttttggtggatcttggattcctggttgaagtgtttttattttagcatattgaatataccagtccactgcttctggcctccaaagtttcccatgagaagtctgctggaaattttattgaggatcccatgtatgtgatcctttgcttctcttttgatacttcagtgtttctctgtttgtcttttgaaagtttgattataatacgtctctgagttcatcttgttgttgttcagtcactgggttgggtccaactctttgcagccctgtggactgcagtatgtcaggcctccctgtccctcactatttccaggagtttgtccaagttgatgttcattgaatcagtgatggtctccagccatcttatcctctgctaccctcttctccctttgccttcagtctttcccagaattagggtcttttccaatgagttggctgttcaggtggccaaagtattagagcttcagcatcagttcttccaataagtattcagggttgatttcctttaggattgactgggtttgatctccttgcagtccaagggactctcaagagtcttctctagcaccacaatttgaaagcatcaattcttgagcactcagcttt

SEQ ID NO: 37246 - DNA, 1615 bp, Bovine  19866880849121
tttcaaaacctgaagagtgaaagagggcttctctggaatcattagaagctactttggcacgtgggacccctgggaatccctctgcaaccatcaccctgttcactgccatcatccttccctcgttacccgggtctgagaagcatgaagagaaaaactctgtaacatgcataaaacataactcaatattctctgtcatctatagagtacctggtttcttaccaccccccccccccccagggtggggccgggtttccaccatcaacattgtcatttaacttgaccaatttagcctcaaaattcaagtgctggtggctaggggaaagctggggggagggggaagcagagagctgcccgtgtaagacagtctttgaagaaacaccctcatgctcgcacaaggcaacctgaacacagcgtgtgttttctaacctgggcggagatgaagcttctcacggcacaggacagggtctcatctttaaaggccctttgtttctttgaaaacagggattctcgtcccctcctggcctccagtttcacagctatgtggcaaaagggcaggacccacaggttaggttggaacctgaaggaaagggatgtgagaaggaatgaactaggttcctggaagctgggggaggtgaaggttccttgaaggaggacaagcaccctcctccccttctcaccacagctgatccaattttgagaactgcagtaaacattctcagatgattgtaggtttaaaactgggtgggtgtatgattgtagttcagagaaggatatatacagagaaaaaaaaagatggaagaatatacacaaagttgttaacaggcattcactctgccagcttatgactgaatttgacttattagtgcatttatgcaatttctgaattttctgcaataaatgcattactcccgtgatcagaaagatatggtaataatcaaaataatagtccctacattacacaactttttatagtttagagaagttacatatgctatttcattggatcctttttagcaactctgtgatataagctggagagatttatctttaatgcctttttttcatatgagaaaaccaagctccgaggggttaaggaactcacctgaggtcacacatacagacctctgactccttgtccagtgccccttccactgcgcctcactgcttctttccctggcaggtcagaattgccaggacaggagtcacactcaccttcagacgttataagcatgatggaacattccatactgtccagtccctaacctcatggcaggcacacatctgaatcccctgagcccacaaagtctagtcaaggatggactgtagtctgtcttgggcatcccatagtcaagaaggtctttatgtctaggtggaaccatgttaattcatttttcacttcagtgaggcaaaaagcaattgcccagagaaatcacggggtttcagacatggtgaacagagccccaggggtgctcttcttttatgggccagagcccacgtgatccatgcaaggctgggagccctaaacaggaaatctgaaagcctggggccctttctctctttttcattgccttgtcttgagatcgccaccaaggtcttcacttttcttagcttccca

SEQ ID NO: 37247 - DNA, 893 bp, Bovine  19866880895991
gaagaaggccaagtccacctggctttctgctattgtctttgctcacaagctgaaaattaaagtcagaaccaaaagccaggttacaactcctcttttaaccgcggggaataacaaaagagcatttaccaatttagctccccgctcactatgtattatcctgattgcagatgaacacatactgattatcaccctgcttacttcaggtgtggggtgctgttcatttaagaggctcattcgctggaaagaatagccagcagtcatgaacagtcttccacttctttaaattttgagagcgatcgcttagggatgtgtgtggagaatgtacctatttttctgttttaaaagataatgtttattttttcccttgctatttcccttgctattctacacatgcatgtagaaaatgcagtaggatttcaggcttagccagagactgcctcgctctggaagggatgtctgagccctagagagcgtatggtgatgccaggggagaagagaacaggacagcagttagggacagtcaaccagccggctctctgtcaccctcaaacaataacagctgctcaacgctgttttcagagatttgatcattctgtgttacagaggaaggtgggagctgggttgcagggttaggtcggtaccaaggggccctgggctcttgggaaagggaccaacactctctttctaggattccccaatcttagagaatttggaagaataaattagagaaaaaaatttctggacaaataatcctcttttaccttcctggaagggagagggaagggagggaaatggctacacagttttttccccaggaatgcaaagattatttacaggacacatgtaccaggataatttttggaaaaaaaatatacctatcacaatgggtgcat

SEQ ID NO: 37248 - DNA, 1069 bp, Bovine  19866880926032
aataaatatgtaaagtctagaatctagtgaagcaaaaaccaaaaataaaaaataaagcacaaaacctatataaacaagaagtggataaaaatctcaacctgtccctctcaatagcatttcatttcaaaatcactgtacagacccagcaaaatgaaggacacctttcaatgtctgagactaaaccaaaataggacgttgagaatcagggttgaactagatgtcaggggaggcagggtatgtttctggcctggaaagtggaccggatggcaactgtgagagcctctgatcagtcaatcagcaggttttgtatggtagattctgtgacaaaggctagaacattcccactgaagttgtccagaccagtagtactatctggctcaaatataatattagccacatatgtagttttaaatatcctggcagctacattaaacattttcaataaacaggtagaattaattttttaaaataaattttctttaacctaatatccaaaaatgttatcatttcaacatataatcaatataacaaagttattcataagacattttaccttctctttgttttgtaaactgttcaattcttatgtgtactttactttgcagagcatctcagactagccacatttcaagggctaaatagcccaggaggctgccatattgggtcctgcaggtctaggtggagaatcagtcccttagaggtagcgttgcagccctcaccctctagtagatgcctcagatttaccctcaaaaccatgctccctgcttcctgcttatttgctgtcccctaattgatctcactcaggtttattcttgagaagcaaaattatttaagaaaaagcactttacatcattagagtggcattatgtgaaataactagaaagggctaggtttgcttttcttgaagaagaccgtgctcagccaggactgagggtagagagggcagtgatgggacatgatgaagtctaggtactgggcttctgatgagaaaagaactacataaggttattacccaagtgattctgtgattcataccgcccaaaatttgtgatctgagttatatcattaa

SEQ ID NO: 37249 - DNA, 962 bp, Bovine  19866880935326
aaacccttgtaacacttgacttcggcccctgggaagacacagaaagtttgtatctgaggcgggatgcttgattggttggtgagcacttaaagtctcccacatcctgcgcttttctgctagtggaggaactgagagactcatggaccattcactgcgctgcctctaaacatctatgaaccaggcactctgcctgttccttggatgtgctgctgaaggaagcagaaaggagctgctagtctggagtggaggagagacctgtactcagcgctgtgtcaacacttggatcaggtgcatgggaacacaggtgagacagcagttagtgctgggagggaggaggatctcacacagggatggcagcttgtctacaggttcagattctgtagcagctgctgtcaaagtatgttccccaagcagtccctaactggtttcttaattactagtgtttacaggctgacaatgtgtaggcttatgtttagagcaaggataaataattcacttctcatgccttccctgtgttgtcaagaacaactttcctgtgttgatttaggtaaagaagatgtagtgagtggaagccaataggtacttgcttcccacctgtttgtcttgtgtgactcctatctttcctgctttagaaccataataaataggcaagaagacatttccatgagcccagagttcctatgaggtcttctgctgagtggtccaggtagtagctagtcaaatgtaaaggctgttatcttaaaggataggtatggcttggatcaaataattattggaaaagtattggaaagggtggggaaattgtgagtgaggaaaatatttggaaagtggggacatttgggctgaaagcttcaggtacccactgtttcccatccatgtaaagtggctgtgccattggtgtcttgttttaatggacattagagaaagatccatttccccctgttccaccataagtacagtca

SEQ ID NO: 37250 - DNA, 754 bp, Bovine  19866880974100
gcctggttcctgcccgaaccgtgggctgacgaatgccctatctgcccaggccatacgacgcatcatggagagggatggcctgagtgaggctgcggctcagagcaggctgcagagccagatgagtgggcagcagcttgtggatcagagccacgtggtgctgagcaccatgtgggagccgcatgtcacccagcgccaggttggtgcccagggaaaggctgggttgtggggagggagtctcagtgaatacctgtctgaccttgtccctgttttcttcctgacattccggcccgtcccaaggtggagaaagcctgggccctcctgcagaagcgcatctccgaggcaccatcaggcccatgactgacagagttctctgtggggtcaaagtggcccctggagctgacgagatccagcggtgaggaggaatggaaccttgaagctcactctagcctgggcctagagggctctgagctaagctgggcagggcagtgctgggcccgctggacaaaggaagcctacccagcttgccagtgtgtggccaacactgaggatgcagctcacgcggtgcaggcccccggcgttgttctatccccgctcttatccacaggtcgttggtacccctgctgggctggggccagggcaaacactggaacttgtaacagaattaaaggtgaatgttgccattggtgtctgcttcctgcttcaatgactctgggtatctttgtgacccttgagcacccaagtgcaaggcccaggc

SEQ ID NO: 37251 - DNA, 1370 bp, Bovine  19866880995050
gagaaacaagagtcggagcagcccttcacagtctgcaagatgctcatttaaagtccagggttcaactcagcattcgcatgtctttatcacttggatgctgcacactcgaacaaatgtacgcaggaaggaaagccttcctgttactgtggcagggtggatgacagcattggcaggtctataattaaagggttaagaataagacaaacaacaggcgggcccaatgattgctggaagagaaagtatttacattacataacggagcaagaagaatagacacctcccccaacgtgcccccagcccccgccgttatttagtgtcgcctgtcttcaccacacttgggacagctgtccgcgtgccggcagcacagtcatatcctcttgctgtttgcacagtggcacatttgtcttcctaatcgcagtatgtgaaagttcctgcctccatgaccagaatcagaaaccaaatgttaaaacaaatctttccttaacattatcctgtctgaagatgtttgtacttgtgacttctgtttatctatgtttaatggcactggcataaggagaaatagtgtatttacacacctgtgctgttataaaagatcatttgtccagataaatatttacccatcattctgttcttgagctcatgttggtgctgcgcacacagaggaagaacattctttccttcaggcagttcccacttccagaaggaatatatttgaatggtgtctgtggcgggtgtgtgtgtgcaagtgtcacgcccctggcaggggtgagtgggaaagaagaggaaaccaacacagaggacactgctttggagctgggcactaaaggataagtaggagttcgcagggctctgcattatagagaagagaaggaagctgggggtgaaagggaggatggggacactggtttcccttgcagagttctgagaaggaaggagaccttcctgttcattcgttgagtgtttctgataaaggagtgttttctcacaaaaggtggctcatcatttccacggagtctgtgccctaacaaagccatctttccctgcctataatgaaggcataggcagatacaagatggaccagcagactataaatggaaggactgcttgcatcctgtcaaggggtaaggagagggtcacaggcaaattccttcagggtgacctgctgtctcaccttctcttctaagcatgtggcctattaacccttgctgctcagggcagagctccctctatgattactcccagcgggtgccctgtggcttctggtgaaatgcaagtgcagtgtgaatccagtggaaagccaccctagtgtccccccagaccccagtgctcccctgcagcttattctcttcagcacctcccaaagaagagct

SEQ ID NO: 37252 - DNA, 971 bp, Bovine  19866881046418
accctgtgacgacccatgaagatcaacctgaagggaattgctctcggagacgcgtattttgatcccaagtcggtaggtggctcttctttcctttccattttgttccttaaggagatgcaatcccctttaatcagacagaggctcctcttaaccctagagacctaacttcataaagggaaatactgttcctcaaatgctttctaatgatttcaatcttctaatttttaccaaatgttctatggtgtcaacttactgtgtcagcgtaggttggctgagtgcaagtgtcagtgtgtgagtgcctgtgcttggtgtgtttgtgtgtattttgtgtatgtatgtgatatatgggtgtgtatgtgtgttgtgtggttatgtggtatatatgtgtatgtgtgtttgtgtggtgtatttgcatatgttgtgtggtaggtgatgcctgtgacgtatgtttgtgtgtttgtaagttttatgtctgtgtgggtgtggtgtattgtgtatgcattatgtgtgttgtgtgtgtgtgttgtcccgctccactaattaacaagttacagagggttatttctcaagcagacgggctcccctcacatccctttctctccctgtcgtgtctgtgtttgcctcttttctcctcagatcatagagggctacccatcattcctgttccaaattggcttgttggatgagcaggagaaaaagtacttccagaagcagtgcaatgactgcgtgaaattcatccgccaggagaagtggcttcaagcctttgaagtgagttctaggtcccgcgctgccctggagcaataagcaccatctgagaaggtcctggaagcactggggtgcctggcctggtgttttattgttagagaagctgtatccggggtgctgtcacagtcaggaggcgagacgagtgggctcataaggaagaaaaggaccatctgggtttctttgaatttacttggcaatattttaaa

SEQ ID NO: 37253 - DNA, 1063 bp, Bovine  19866881052983
atgcaaatgaatatctgtaacagacatgcaagttacaaagcgcaacaatggtaactctcattaaaaaacaaaaaactaccacttgactctaggaacattttattcccttgcatcctcctggtgctcttctcccttccctcctctgtcttctttcgttccctccctccaaactaaccactactttgaatttcctgctttttattcccttggttttcttcctttaaattgtcttactccatatcactaaaatacatgctccgtgatggcagatattttttgtctgttctgttccatctgtccccagtgtctagaacagtgtctggcatgcagtaggctgagtgactgagtacacgtgcacatgcttaggcactccataagtagttattgagtaaatgaatatgtcagtgtcccaagtctatcaaagggatgctgctatagtccctcctttatctcttgtatgtaaatcagctctgtaagtgatgtaaatttcatcatagtttcatattagctgcatgcctttaatgatttttagaaaattagtattttttaaagtgttcatatagattatttgcatttagttgcaataggagatgcccagcaaaattacatggacttttatgagccaggacttctttttaaacttgatttgtatttcacaagcacttttcagggctgaatagtgagcactcaagaaacataagtagtgaagcttgagttcagcagggagacctacaaagaaatttttttaaagaataaaatatacatgctaccacaaaaatgaactttgataagattatatgaagtgaaagaattgagctacaaaagaccacatattggcttgcctggcagttcagcagtaaagaatctgcctgccaatataggagacataggttagatccctgatctgggaagatcccacatgctgaggagcagctaagctaagcccctgtgccacaactattgagtctgtgctccagagcctgggagctgcaaattactgagcccacatgccgtaactaccgaagcctgcacgtgagagtctgggctccataacaccaacaca

SEQ ID NO: 37254 - DNA, 2206 bp, Bovine  19866881054464
tgctgcccaagtatgcctcaagagagacacccaggagggggagtcttggattctcttccgattcagagcccagcagtctgtgggcgcctttgcctggtcagcatgcagcacagtgaaagcaactttcttggtggaactatgaccatgatataaatttaacagaccacttgaatcccagtgagctattcatatcatgctaagaatatagatcctatttctagggagcccagatagccttacaacagagtgataaagatatactatgtgtcctgttcagcaaaagaaactgtgcttggtctgcttcctagagaaacttgaagaggtaatggcgttttctagagccacacaccaggagaagacagcagctcccatcagttcaacaactgttgtgaccacatctttatttagtcttcgtgacccactgtcaagaatcaaatccaatcccgccaccaccaccccagactttttgaccatccagactggactattaaactggtaggttgtggacatttaatctttgtctgcgtttgcacttagatgaagagaaggattcctttataccttcctggtaattaattctacttcaatagcaccattcaggaagtgcagggagctcccaggaataaaaagaattgcaggggttccagcaaagcttaaaatgtggatgctcatctagagtcagtgccccttcgtggggctgatatttaagaatgtacattccaattaaggagtttgacaaagaaatctcaagtatagtcagatccaataggtcacacacacataaatggtgatgtagggtattcaactaaaagtcatatttgccccgaatcctgacagaggggttcatttaccatgacttaagccttgagatctttctaaagctattgagagatggggtttagacctattcttccttcagtctgaacaggactaaatctgtatacagggactccctcaagcttgaactcaacctcagaaggcagaagcagagtatctctgtctctgtattcactgtcatagtgtaaaaaaaaataataataccgctgccttttgaggcctcttatttctatattccattttaaaatgggacatacatttctgaaaaatattgctgtaacctttgttgaaagtgttagtgtcagtcgtgtctgactctttgcaaccccaatggactgtagcccgccaggctcctctgtccatgggattctccaggcaagaatactggagtgggtagccattcccttctccaagggatcttccaaacccagggatcgaacctgggtcttctgcatggcaggcagattatttaccatctgagccaccacggaagcccataacttttaggtacccctatgtcaaaggagtaaagataaggtcatcttgacattggcagagtcttcatcttcatccagagccaggacttgctttgagccgtggagttgggtcatggactttcctgtttatcctgcaggccacctgttcagggtacatcccacccgagcccgtgcccacggccaggaaggaggaggaagaagggaaactgtgcctgggacagtgagctggagagggtggggtgatgtgtagaacagatgcaagggctggttattattagtgcccatggtaaacgggagagcggcttacacagggatgaaatcagctgcttctgtactggggcaagttacaaagacacctctgctctcttcccaacctgatctgactctctgaaactgggaaaccatgtcccctgcttcccctgcttctcgtttctgtgccctcagtgaacttgctgaagccaggtacatcatcataacaataacaacaaatgggacttccctagctgtccaggggttgagcttttgccttccaatgcaggaggtgcaagtttaatccctgatcagggagctatgatcccacatgccccagggccaaaaaaccaaaacacaaaaaaccagaagcactattgtaacaaattcttaaaaaacaaaacaactatcatcaccaacttttcagaaacagttctcagactttacatatgtaaactcagttttccttacaagccctctctgatggaggtactgtggttggcactgttttacagatggcgatcttaaagctcgaaaagtttgtcattgaccaaagttcccctctggtgagtggcaggatggggatctgaaccatccctaaccattctgctgtactgcttcgt

SEQ ID NO: 37255 - DNA, 1364 bp, Bovine  19866881063197
ttaaaagctcactattacattgtccactttgactaaagtattaggagtttcactttttttagcaaacaaagtttgcataacaacataaaccattattaatacgttgttttgtgtgtgtgtctatgtggctgattatccatagagaggttcctgactaggtaagcctaactatccagatgtttttgtatgaaactgtcttaggaggtgtttagttgcctctgtgataggatgggccccagagagtaagtaattgtgaaagaatttcatttaagctacacaactgtgattgagtaagatttgggggaatttcaccactgcagtttctttttatgtatagtaagcatattggagaaggcaatggcaacccattccagtactcttgcctggaaactcccatggatggaggagcctggtaggctgcagtccatggggttgttaagagtcggacacgactgagcaacttcactttcacttttcactttcatgcattggagaaggcagtggcaacccactccagtgttcttgcctggagaatcccagggacgggggagcctggtgggctgccgtctatggggtcgcacagagtcgcacacaactgaagcgacttagcagcagcagcagcaagcatatttgttttttaggaggggaaaatttctcaaactgtcttattgcatgagattagaaagtttctattccttttcataaaattttagtatgtgacagcaacagaaggacaagggcacattaggctgggtgagtgatgccgtacacgtgcaaggtgacaaaaactgttccctcattgaaaagtgctgaactaaaagaactcttcagagttccccagctcaatattctgtgagtcggggaatggatttttccctctggctgtttaagctggagtatgttttaccaagaccttagctatgagctcaggaggactctaataactccatcagaattataaaatcagctgtcagccttgggattgttgagctgactgaacaagcagattttctcccattgtctgccttctagtttgatgaataacagtttcgtcctctccattttgttgcaactcttttcctctgacacttctgattgctgaaaggttttctggaaatttcctaagtcacacactggagtaaattcaaggacatgatgagattccaattgaatcatcagtgtctctgctgtcagacctagtgttttaggagttcagttggctgagtggtacaacttcccagatttaatattacatacttgccactgtgcatcttgccctcaagtctaaataaatgggctaaaggtctgattggaatctgtgagataaactatatgtttattatgccaagttaagtaaatactgt

SEQ ID NO: 37256 - DNA, 1947 bp, Bovine  19866881121875
cctcattcaggcctgacaaaaagggaagattgcatggaataagagaaaggctgatgttataaagaggaggagtggaattccattgtggctgagcaggaatgaatctgactagtatccctggggatgcaggttcaatccctggccttgctcagtgggttgaggatctggcgttgccatgagctgtggtgtcggctcgcagctgcagctccaattcaacctctagcctgggaatttccatatgctgcaaggtacaaccctaaaaagaaaaaaaaaaattaactttgaagtgttgtgaggatgaaatactatgcagaaaaaatgtttggagttcccttcatggctctgcagttaatgaaccagactaggatctatgaggatatgggttcgatctctggccttgttcagtgggttaaggatctggtgttgacatgagctgtggtgtaggtcacagatgcggcttagatcctgaattgctgtggctgtggctggcagctgcagctctaattcgacccctagcctgggaactgggaacttccaatataccttgggtgtggccctaaaaaggaaaacaaaaaaaactggaacagaaatcaattttatttctatataccagaaacaaacagaaaatgaaataaaagagggtaatgtttatttaaaaaaaaaaaaaagagttccctttgtggctcaatgcccctcctgggcatctatccagaaaaaaccatgactcaaaaagatacatgtactccagtgttcactgcagcactatgtacaatagccaagacatggaaacaaccttaaacgtccatcaacagatgaatggataaagaagatgtggtacatatacacaatggaacattattcagccataaaaaggaataaaactgtgccatttgcagagacgtggacggacctagagactgtcatacaaaatgaagtaagtcagaaagagaaaaataaatatcgcacattaacgcatgtatgtagaagctagaaaaatggtacaaatgaacgtgtttgcaaagcagaaatagagacacagatggagagaacaaatgtatggacaccaaaggggaaaagagggaatgcaatgaattgggagattgggactgacatatataaatatatatatatatttatgactatgtataaaataataactaatgagaacctactgtataacacagggaactcaatgctctgtggggacaaagagggaatatagtttcttgctatacagcagaaactaacacattgtaaagcaactaaacttcaataacaactaattaaaaaaagaaatttacattctgtggtcagatcacatagtatagaataagattgagtaaacttgaaatctccctttcttttctttagttatcctaatggaattactttaaactctccaggatttttatggggcactaatgaggtgctttacttcctgtcttgactagagtgtattattaaaaaatctaccagccagtctttctgtaataaacctccttaaaaggttaccaatggttttgctaagttatgtaagtaaccacaagtcaggctccttagaaacttgctataaaccttctgctaacttgtagatgcacacaataccaggttggatgctcaggatcaaagtagttcccattcatttggcttgttttctgtcttctttcctttttaccctatgttttcccagggattatgattttaaaatatgtgtgcgtgtgttcagttgctcaattgtgttagactctttgagactccatggactgtagcctgccaggctcctctgtccatgggatttcccaggtaagaatactggagtgaattgccattcccttatccaggggatcttcctgactcagggattgaacccacgtctcctgcattgacagattctctaccactgagctaccttttaaaataagggtaatattagaataaataaaaagt

SEQ ID NO: 37257 - DNA, 1311 bp, Bovine  19866881259208
gttatataaaaaaagttctgaccttttggaaagcttgcagaaccaataagacagatcagctatacgcacagctgatgacctgcaaaagcttctttgtcactgatttagctgttatagtttggcgtgatttattccccaggggagggaacttgacattgctcagtggcttctgtttggaatgagaagagtacacaatgatggtggacaccatctcagggtcagtctccattccagacaggaggtggtggatgcggtcacatgtttgccaaaaccccactaacagtctgccttctgcgcatggcgtattctgggcattacatcctcaagatgtgagggtatgagtgggctgtttcagaggaaacatttttcactgttttctttccacctctcccggatttcctttaatctgcagctattttgagcacagatgaagggtcagtctgcttttttctatttttctctccttcctcagtcacagcttttcctccaaggatgaggtcaggcagcaagcaaaaacacactttcattcccttgccagccccagaaaaagggcatgagaggagcagccacaggtcacagccagtcctgacccatccatattcagggctagctgaactcatatacttttcctgtctagaggggtgccaccacagggactgggggactctcagaccagctcagaaaggtgctaaggtttacctgatgggtggatccaggttccctaagcgtgggcgggggacatgatatttgaggcaggtatttcagaatatgttttagtctatactttttcatgtcatgctttccatgataaaccctgcactcaggggaggaaaaagaaaacatttctgagacagaattaatgatgacttatgtaggtttctaatttgcagggaacatactgaaatctccttcagctcacctcaccctggctgccaggatgggggctcagcgggacaggaaggaccattgcagaaacgtgggcacgaggggcagtgtaaacagtaagagcgttggctacctgcaggactgttcagttacacaaggggccctgtggtcagccttggagggactgaggccactcttggctttgatctgcgttatatttacatgaggcagcaaaagaatccttgtactgcaggatgggagcaggaggggccatgtggcagcatcttgggtgagggacacgctactctcggggagccgcgtcattcataaggcattacctggtttgattttgcagtttgtgtgatgagactagaaaaatcatgccaataagaaagctgttgtggatactatgactttgggaaacta

SEQ ID NO: 37258 - DNA, 1778 bp, Bovine  19866881334616
tgaatgaataatggaatgcactaatgtgagagattgtgaaattttcttcagtagagatctaaaaaattaattgctaaactacttcctgggctcttccttaaagagtgtccaagttcatgaattggccaccaggggtcaccagaagaattgaaagggcttctgaggcaaagccataatttcctgttcaggaagaagagggcaatttgtaattctattgttaaagagacttctcacttaaatatttaggattcttttgtcccttcttttatatttaaaatttccttgtcccttatttttgatcgtcagttcttgctgcactactctgacctatatgtcattggtagatatttttctttttaattaaatatataaatgcttttttgtaaggtattattcacatttcaaatattagcccatcaccaaaggctgcctttaagtattcagtctaacatcttcctgttgttcttttatattacccatttctttaattacttatttattacctgtcttcccactttaccagaaaagtagccagagctaacacttaagtagatactctaggcactgttcaagtgctgggcatatattaactctgaatctgcacaacagtcctgtacaatagacattattattaagttcaagcttattattatgttcaagcttattattatgttcaagcttatattattattatgttctgcttatgttcaagcagaagccaatgagacacagagaagttaagtaacttgcccaaggtcacacagctatataatagcataattagaactcagaccctgacagtctagtgccacagtccatgttcttcagtaactatccttcctgtccatgagtgggagctggcctgcatccccagccctagaataatgcctgttgatgttctatgttaaatgaattaatacttcatggcaaattcagggtgtcagactattcagccagatgatgatacatactgatatatgaagagatttccacagcatgctgttaagtgaatgcagcaaatatagaatattatatattactgtttttgttcagttgctaagtcatgtaagactagtttgggggggggggaaggtacttatgtacataacataagtaacatctatgagatatgtgcatatgtacatgtgaggaggtagggaagggtatagagaaaaatctgaaagactaaatactccagtgatcatctgtagggaataggattggtggggcaagagggattttttataccctctttgaaaaaaaagtaagaataagtattttctttatgatatgaaaaactttaagtaaaattttttaaatttttgacaaaaataaacacactctctagtttcatacattctttatagtttcagaataataagtactttaaaagtccttcatttcctaaatctataaatgaagtaaaacagttgcttctttcttcattcaagtctgagttttgcaattttattcagggtgtcttcatttctttttcagttcagttcagttcagtcactcaatcgtgtccgactctgcgaccccatgaactgcagcacgccaggcctccctgtccatcaccaactcctggagttcactcaagaggagagtgaaaaagttggcttaaagctcaacattcagaaaactaagatcacttacttttattctttcctaaattggggtagggagtggggagaagggcttcattcccacaattgagagctaaatatatcacctaaggagttagactgccagggtctgaattctaattatgctatttt

SEQ ID NO: 37259 - DNA, 898 bp, Bovine  19866881370955
ataaaaagctccatggtcaaaatcatatcaataaatgcatgtttaagtagagtttatagacagagaaaaaattcaaagattctttcctagatgacatttttaagaaatgtcttattctaaatgcctcagggcaaaatttcaacccaaatgaaataaaatgagaagtggccagttatttagcaagatcattgtcattacacagaattgaacttttttttcagttagagctttatacatattttggaggtggctgatacacctccactgatactgatacactacactgcactgatactgatacagtggcttacatttataattttctaattaaaatatatccttcatatcaattttagagaagtaacaagcttaatccatggcatttaatcgtttgggtttgttttgacatttttagaacatgaaacctaatacagagatgtgattactttgcaaaagatttgcgaggaaggtgacatgccacatgagattttacagagggaaatggactagtgtggtagggtaagggaaagaaaagatctcaatgtcaattctaagcacatgcatgattttcaaagcgcctctctctgaagtctaggaataaccttttatgtaaactttcctccattttatcacacttcactgttctaccctgtcccttcttagatttaagaggaaaaaacaaggttaaatgtacaagtaactttgctaaccaacaaccaaaggctgaatgcttgatccactcagtaggagcgcgtgtgggctcctctggacccatcacctcatggcttcttgcctgacgctcagaccctgacaggatgccctaatgctgtctcaacacaaacagagggtatttaagaaagtgtcctctccagccgctctgtaccttataagaaattta

SEQ ID NO: 37260 - DNA, 2389 bp, Bovine  19866881440339
ctggtgagtttcagcccatcgggagcggctgccccgctaggtctctcgccccctgcccgcgcccggcgctctgggatggagagagcctacctgtggccgttctgctcgctctcccggagtgagggcaggcggccgttgtgacacttgtttggctggccggcaccctttgggcgcccacagcaccttcggcgcctggagtctgacagcacagaggtgggagagcgggggcgcccttggtgtgcagaagtggggtgtttggggatttgtggagcattaggcaagaagcgaggcgagcagggcgggctcgcactttctagcgccgctgaaccagggctggcgggtcggggaaggtgagggtgccgctgggcgccccgaccctctggctgtgtgcggtgcccattccactggatgcccagattcaaggcaagggggagcaaaccctcgctcttcgcatacttcattttctttgtttgtttcagaaattagctccgtggagacgcacgcttggtgtatggacttgagatagggataatacagggattctgtcattctggttctgattgaagttagggaccggcggtcaagcccagcctctgaccatttgcccagtttcaggggtgtgtgcgtgtgtgtgtgtgtgtgtgtgtgtgtgattgtcctctgtggcctcttagaatacgtttggtaattttactttccaggcatacatttttttttttttttctttgaagtgtggctgagcgaaggaagggcttctttcagcttttctatggctgatcagcgggtctaattgaagagaaaaaatcgctaatgaatctgaaggagtaggaatcaatagcagcagaccctctggattctgagtatgacaggtttctaatcaggatgatgcattaggtagaatgcttctaccgctctggtcattgaaaactttaatgacaaaccctaaagggatagctgacaagacatttactgtagtttacagtattcaggggtccagaaggtctttgaagtcctaatggaaatgctcaatatatcaatattgtattaatttctattgtgtgtccgctttaaattattactccaaaaattaaactcagagaaagaaacgttctattggaggcattggacagcaagccaggcattaaggaaccctatctctagatgtgtgactaattaaatcataaatgcaaggtgatttgactaaggtgcagttgcgacatggaacaaggtgattacttgaaagtcatctattatcttttttggcaggttttagttccagtgaaatagcacttcctttcttgatcattaccaactgatgaaaagcacagtgttgttatgtgtatgaggtagtcgaagtttctggtagtagcagccaatggggcagaacagtcatatcttattaagagcagcaacaagttgaccgcctgtggttttaattctgagaactcagcaaatgctacagcttatttttagtatcctcaaaccactgatgctgcttttcaattcattttggttgactaacattgaatttaaaatacagtgatgttggcttatggttagcatatggttacccctctttgaaaatggcccacaagatgaactggtgggagagtggtaatgaagggaaagaagacaagagaaaggacaataaggcagtattatcatatgatttactggtgtataaattacaggtgctgtggcatccgaattttcagatcttgatgaaaaatctccttaagcttaaggacccttattgaaaaacctaactcagccttaggaagaatacatgggtttgaagcagcactgtataagctttagatgacgttgattgctttgtagataggatagagatgcatgtgaaggttctattatattttttgctttatttaccactgttttaaatcctaatgaaaacagagagataacaggaaagctgagattcaaaaagtgggcagggatatgtcatttaatatgaatcaacctagcccatgaggttatattggctaattcaccacttaatcaggcactttgtcttgaaaaatatgagaaccagaattctctttttaagcacacttaccatcatgtggatcatgaataattcagaaaacacaagcaattcacacctgtgaaaagtgttgggcaggaaagattagagcttgtttgtgatggcagctgggttctcaggcaaaggtcagagtctgagaaagagggcacttcatcagtctattaatcaccgttttttgcatagtaggtggacctactatgtgccaggcctcaggttggcctcagtctccgcttcaaggaggttaagtgaggaaaataatttaaggattctttagagcttccctggtggctcagatggtagagaatctgccttccatggaggaga

SEQ ID NO: 37261 - DNA, 1336 bp, Bovine  19866881512822
ccagtggccaagtcatgtgcctgcctaaaatgggtgccttttaaaaattcatcaaaggtgagggtaacccaggcatcagagaacaagatacatgaggttcttgctctcataagtaggtctgtctagcctggcctatacttttgtctccaaatacaaacaaacaaatacataagcacgtaatttttaaaaatctgataataaagaggctctgccaagagttaaaaaaaggcatccaagagacaactttgggttgaatggtatagaagatgtccctgaggagccagaacatctaaactgagatccaaataataatgaagccggccatgtgaaaatcagaggaaagagaatgtataacatcgctaagactggaatgatctggatggatattcaaggatcaaaagagaggctgaaccaataaggtccttctgtatagtacagggaactgttttcaatatcctatggtaaaccttattgaaaatgaatatttttttaaaaagtatatatatatatatatatatatgaaaagtatactttttaaaagtatatatatatgaaagcattagtcacaactgtgtctgactctttggaaccctatgaactgtagcccaccaggtttctctgtccatggaattctgcaggcacgaatactggagtgggtagccattctcttctccagggagtcttctggtcccagagatcaagcctgggtctcctgcactgtaggcagattctttaccatctgaggcaccagggaagcctatgtataactaaatcactttgctgtgcagcagtaactaacacagcacggtaaatcaactatactttgatagaaatgaaaaacaaaagaaaggctggagtagtgggcaagagaggagacagatgagatgaccagggcaagggccagggtccagatcatgcagagcatgaagccctacctgccttgttcacagaggcatgcccagggcttgtctcactgtgtatattcaataaatacctgttgaaaaggagtgtctcctcctgcctctgcatacgaaggggccctgaagctccgtgtggccccggtgccctctagtgaccacaaactccagcccatggccctcagtggatggcttcatcatcttcagaaaatctcagcttagccttggccttggggcccagcctgtgggcccatcaataatttccaggatatatcttattaaccattctctgcaagtagggctaaatcagttacaaaaatccctgaaacgagaggaacacatgcacaccaggccctcattccttaccacaggcagcatttttcaaagcaaatacatggatgtctgatttctctggggaa

SEQ ID NO: 37262 - DNA, 2423 bp, Bovine  19866880166605
cctctgtcgtccccttctcctcctgccctcaatctttcccagcatcagggtcttttcaatgagtcagctcttcccatcaggtggccaaagtattggagattcagcttcagcatcagtccttccaatgaatattcaggactgatttcctttaggatggactggttggatctccttgcagtccaaggaattcaagagtcctctccaacaccacagttcaaaagcagaagttctttttattaaagtatcattatatctgatacttggtgactgaatttggacctgaggacataattgaactcagtatcttaatagtttaattaacttcatttgaataaaaactgatgacatatcttaattggatgctaattatgaaaacagattaagacctatttatgtcatttaataattggtctttttaaaaaaagattcctagacctttaaaagtgcttctaaaaagacatttaaattttttgcttgttttcttgagtattatgctatttatgtgtatatatttgacccttaggaagttaaaaagatggcaaggcccatgaaaattgcatgtctacgaattgcctgtgccccataggtgctataagataaatcttttcttacacaatccagggtcagccagtaaagaagtgccatatttcagtatttgaaaaagcatagccacttgaaggataaaatcactggcacattcaacttggatataatggggaaagttaaagctgccattatcaacctatttgcgtctgagttaaagggacaggaagtcatacaattctagtgcctggacagtgcactaaagcattggtcagctgatttaaacttgtgacctctctatgctgttcattagatgtggttgttcatgtattctctttaattaaaatttggtttctagaatgtggatggcaacatatgatactatgagaaaatcagatattacagtagatgtggaaaaagttcctttcaattgctagcaatctgtctccatttctttctaacttgtgcaaagtccttaaacactttaaacgtcaaaaggcttctttgcattcccaaataaaaccagtgtcacttgtcttgctctcttgttccatttattgtaataaaggctgattaaaaattaaaccagagttcagaataaaagcaatgtcagacaatgattctaatgatgctaaagcggtgttgtactggagaccctttcaccaggaagccaaaccaatgccatcagcagtgtctgggagctaattaaaaatgcaggttctcagacccccaccccaggcctactgattcagaatccacattctctcacgaccttcagtgactcatatcaatttagaatttagcagtgctgagctaagccatcctgagccagaggatgccaagtttccttccggaggagttagccttgtgaatcagaacgaacacgacactgggctttgatagccctaaatgcgactgaacaacaacagcaaaactgaattgtttttctgccaccgcattatctattggagaaattccttgacgagtctttttccccatctgtcaaattacgtcggtcaatacatgtgctgttcataaattatgacgcacctaccacagtgtctggcatacgacagaaacggaacatcgtttaattcctggcccttgcccactctctccagcagcaccgataccctgtgattctatggatctcaattcctgtcacagacctcatctcctactgccactgcccccaactgaagaaaataaacataaatgatcaaatcctgcaaaagtaacatcatatactaagaactaaatagttatcagtggcagcaaatggagttactccaagctttgataggcagtatccctcagaaataaataaactggagtcctcctctactagagtcagttaggctagaaacaatcaagctaacatttctgtttttcaaattatcaaaatgttgctgttgcttgggggcaagacgtacagatccttggagtgttgtctcaaaacagggcgactgtcaacccaattacctattaagtgctttccgactttcaaagtaaccctgaagaaatctgtttattctaaagagttgttgggggagagaaatgtctcccaagatatcgttttaaatgctgttccattgtattttgaagtgatatgttttgtcttttactgaataggttattattcagaaatgctcacttatctttacacttcattttgaattcaactacactgtgacttttcggtaaatcttttatgaacaaggtctccggtgggtccactttaattggttaaggattatcagccgagaacactgtcaaaactctagacggtatttcttttaaaaaatcatgcacaaaacttttcctgggataagttgtctggatgcagataaaaacaaaccatgctcttgtgcccacaaata

SEQ ID NO: 37263 - DNA, 689 bp, Bovine  19866880261763
ccatggacagaggagcctggggactacagtccatggggttgcagagagttgggcattacttagtgactaaacaatagcagttatcataatactgttctcagaactagccacattttctaggccactgttagttgtgagaccaccactgttggttaactaaggctctaaggagcataaaggatttttgttccccattctgcttattttttaaaaatataaagatatggattagtaacgctatgatctatgttctgtcaggttataatcttacatgtatacaacttgttcagtcttaacaaattttttaaaaagttctcatatcttcactaatttattctaggtcattggaataaatttcatcccatcttccaaagtcttttacccctttaaacagctttggtgacatttcaaggtcagtaactgttgaggataaattgaaagaaaatccagttaagatgaggcctaaaggattaggttatttaaacagaagacatttcttgacaatgagggttattagatattaaaatagaaattaccctttttggtctgttggctataaacattctcatttatctgacaggaagtaaatgtaataatttcagaagtcttgggaacagaaaagatgaccttaaaaactcattccgtgaatataggtgtgacatgtatgatattgagcatgaagtaattaa

SEQ ID NO: 37264 - DNA, 1632 bp, Bovine  19866880389361
acgtaccttctgattccaccattgtgttttatgaagttggtgaatctgcatgtgcctgaaattctctaagcctctatttcctcgttccaggttaataatatctcctcccaaggtttgtgtaaggacttaataaaacaaccatgtgacatcaactagaaatctgccccgcaccaggacagtagcaatgaatgttcgtcacacatccgcaggtctctgaggatgtgagaagtgacctggaagtgaacagatggctctatcggatggattttaagagacagggaagccatcatctttacaaatggagattattttttatattaatacaacctaatcaagctcgcccttgtttaaatgtcatcgtatactggctcatagtcaattagctacattgtgccagtttcaggtgtgcagggaagtggttcactgatacatataagtgcgtccattctctcaaatgagacggttggatggcatcaccaattccaatggacatgatttggagcaaactccaggagatagtgaaggacagggaagcctggtgtgccgccatccatgggtttgcaaagagttggacatgactgagccactgaacaacaacgcagccaactaaattgatttcagatttcatagtcgaatgtaaagctattgctcgtggatgtgactgcagtgggcttaataccgtgaaggcaagatgatgttagctgctggtgaggggcctaaggaagactttggagggaaagggtagggtagatggacagcacgaaagaatgtgaaggaagtgcagccacaggcgtctccctgcccgtgaagaggcctctggtggacttcagcaaggcagccctccctacaaagttgctctcagtgttcatgttaaggagactatttaatttgtatttgcacaaaaaatgaatggtggatgagggaaacatgagccctggacagtgctatacgcccttgaaatacagcaatcttgacacattgtattgaaggaaacacttttcttagcaaaaatcccaaacaaaataaatgggaaatgaaagcgttttcaacagtaagtgtatacatttatttagattgaccttgtttccaaaagaatttgagaggacttcaaagggaatggaggatttgttttttcatattaatttggaattcagtgcattaataatgaaacactgagaaaggcagaagagttggttcaatcagaatactccgatatgcacaacaataatggattgtcgggctcaaggcccttagacacagacaagccagttcttgatgaacacaacctgtatgagagctattaaccattcaaaagaaagccacactcggggtgacctttgctgttgttggttgtttgcagcaaagactaatcccgttaaaataatacttgcagttagattcacatttcaatttagaaacagactggtgaaaacattaattgattcctgagtgtgcaggttagaagggaaaactgagactaaacaattcacatgtaaagtaagcaatctggaccatctcttgaaaggtaatgggtgctgcaagaaaaaacagaccagtgaaagggaagaggaggaagcagagttggggagaacacaggtagcagcggtgcacgggctcacaagaatgatgcag

SEQ ID NO: 37265 - DNA, 1109 bp, Bovine  19866880567738
ctcattctgcagggaaaggcggcatagcttgagtccacccgtgactctgacacctaccaacctcatcaattcacatgttctttctaagcttgggtttcaatatcagcaaactgggggaaatgataattcctatctcagagtaagactgtgaaaaagatctatacctgagacatcgtatatggtaaataatggtttacagatctatgactctttcctatgactttgaaataaggatgagaatcaaggaacaggaaaagtggcagagagggggaaaagggattataaaactggaaataagccaagatacttcaaataagacatctgtaacataagggaagtcaaacaaactaaacatcgaaatttctcagttaacactgaaagtagaggtgaaaaattaaattagtagaaatgactgaaacagatagtaactaaataatctgagaagataatgaatcattgggtaatactctgtaaggaagaaaagacaacaagatacaaaattatatgcagatgtaactttttccccccaagacaatggtactaggcactgtcgcagataaaagcgtagggaactcacactcaccctgtgtggagtcccatctcaggggtccagcaggacagagagcctgggaccacaatccaaggtaaatgtggtccgtgaagggagcataggatttcatattccttccctgtttcatacaagtttgatgtactgatagtttaaataaatagcttaaataatttatttgaaacagtgatcatttaaaagagagtgaaactaataataacaaataaaagaagagcgaatattgtaagtcagtgaaacctcaggcctgaccatttgctctttgtccacaagcatccagagagttaatttaggaaatgttaatggaaatgttactggcttcatggtcaataaggctgggaagctgttccctttggcagctctgaaagcaacggcggaaaactagcacagctcaagacgtttatttccagccatttcctttgcctgcctgaaagtcctctctatgtcatcaatctcctgatatactcttaaaaaatcattatcctcttcttcgaccggaggaattctctccctctcgttcgga

SEQ ID NO: 37266 - DNA, 1714 bp, Bovine  19866880861306
ttgtgaatgagtctgcaataatctgtgtttgggtgttttgcacacgtgtgataacagggtgtcatcttgacagcaggcaggatcctgaacccagtcttcaaaatgttcaacttcaaaatttcatttaaaaatcttttttcctagattctttccctttaagtgcttcagagtcaaagtagaaaacaaaataaagatacttgaacattaaaaaaattttcaacttctggactttgatgagccaattttagcatctagctacatccacccacttactcagccaggtcagaggcagttacagtaggtgggactaaccgaaagtgcccagcagctgatagccactgtggctttccgctgcctttcaagaagtgactgctagctggtggatatctggatattctcctccccataagaaaatactcttcagcttttgggacagcatgtcatgcatcttggtaaggtgggaagatgtgcctaagtcagagactcaatatccagaaagagacagacagaaggaggaagagaaaacttcttgtgagaactgtccttagaaaaataattataccttcaaagattcacttttttgatatgatataaacaggaacaatatattcatcgtcaaggttttttttttgtcttccactcagagaggtttctgtaatcagcacgcttgcttctgtgtgatgcttagggatctgtgtgccacaccaggaggacgagggtgtgtgaatattacggggttaagacctggactgcacccacgtggctccctgattagctctggccaagaaacacagctttcaactagatttatttggaagtcactgtcctttcttacacttgaaatcactttcctgaaacttttgctctattagaccggagtcctagatttatgctttaactcggctggatttattggacgccagacggtcgtgcagtgccttgcagccttccttggaggttggggcgaggggtctgtcacatcgctctttcctacgacttccattcaagttagctataaaagcatattatgccactgaacaccagctgtggcaggttcttacagctttgtgaatagatttgccatttttgtttgggctgctgagtcagggaattgacattccactgttgtgcttttaaaagtatttgctgtgacttcattttttttccctctctgacagctgaagcagaaaggtggattagctttcttgattccaattatcttccctgtagtatattgctgatacgctagtgtgtcagataagttatgagaagtagaagaaagtgtcacccggtaaatgtgacagtgtttgagggaggccttgaaagatatttcttatcattgatgggtctctaaaaacttttttttaagagaggtagaattcttctgaaataactaagttggatttttttctgccaaatttgctgaaagactaccatgcaaatgtcaatttttgtttttaaaagagacataaattgagaaagtcagtgtgatgtcctacccgatttcattccacacttgagttattggaaggtttgcttcatgacacttgatcccttctgttttttcttactatcaggcagtcgatcatgtctcagaaagaccagggtcttactgccacatggagagagatttgagataatgactggataatatctgcagaaaatgcatgtcttcatgttttgtttttttgtgttgtaaattactggatgaagt

SEQ ID NO: 37267 - DNA, 1596 bp, Bovine  19866880958607
ataccacaggctatggcttcaacaacagaaacttatttctcatagttttagaggctggaagtccaacatccaggtcctaacagggttgattcctggtgaagactctcttccctgcttgcagatggcacctacttactatgatggcatctactattcccatgatgggaaggaagagagagcaagctctctggagtttattcttataagagcactaatcccatcatgagggtcctacccttaagacttcatttaaacttaatcatctcccaaaagccccatctccaaatatcatttcactggggggttagggcttcaacatatgaattgaggcatggaggggaacacaattcaattcagtccatagtgttcactctcttcttatctatcaatcagatacatacagatatatatagcctctattctctcactaatacatctccctgctgctgctgctaagtcgcttcagtcgtgtcctactctgtgtaaccccatagacgacagcccactaggctcccccatccctgggattctccaggcaagaacactggagccggttgccgtttccttctccagtgcatgcaagtgaaaagtgaaagtgaagtcgctcagtcatgtccgactcttctcgaccccatggactgtagcccaccaggctcctccgtccatgggattttccaggcaagagtactggagtggggtgccattgccttctccaatacatctcgctagtacatcttattatccctggaacatctaagctccagaatagctccctccctctgacccagtcatatatctagatcacacactttctcactgtggcttcagctatccttcatttacatggagacttcccatccctgggtcactttattcttacaaaccgtcaactgcctcctagcttcatttcaattctcatctgagcactcaaacaaaaagaacatgtaaggattgcttatactacaggatgtatcttccatgaaggtcatgggtcttcattttatttcacggagcactcccatgcctagggcagtttatggttaatagtaagtagatgctttaataaaatctcattgaatgaataaaccctttcatgaagaaaaattctacacgagttgatgatgacagtcatagtcagtcataataatgggttattatccttaaagtaggaagtgggggaaatattgagttaatgaaaatacttctttttctcctgggtaagtggcagcaaagagttcatttagcccatactatacattccattctgtcctgcaattaagccaaagattcatgaactttgttatggaatgaatttgcagtaaaagtacaatctcaaattctttaaaatgcattctcaacgaacacagtatctaaagacacagcctggctcagtggaaagaacacctgacagggagtagcaggcctcagctgtagctctggttctggctaatatgctctgttttctaagagaagttagttaacttccttaaaattcaatgtcattatgagtgaagggattggattcgattatttctaaggtctctttgaggtgaaatttctcttctagtctaatagatttaaatttttaaaggtctt

SEQ ID NO: 37268 - DNA, 1579 bp, Bovine  19866881010194
tggaccacctgctttaatcctattatgttgtgagcttctgctcagcatcttgtccacaagatgaacactgtagctgtcagacaaggagaaaaatgaaataaatgacagtaatttgcaatttattccttgtaaagtagctgggtgcagaagggctgctgggtgaatgtatttcatcacttgacatttattctgctagttgatcttgattgattttagagtcgcattcctagggttcttatattcaacacattcgcatgcagcagtgtttctaagtaatgctgtgtgcgtgtgattaatcatatgaccctattactaatggcttatgaagaaatcatttaaatttaaggttacattaatgttttttaaatccctaattcattagttaaattgtctgagattttctacaaagcactaaggaaataaaaatatgccaagatacttcatctgagtataaaaacagccacaatatttttaaacaatcacatctgcttctttccacttatgggacacaacaaaaaaggctattcaaaaattattttctttcaggaaagcctcccaactcggaccctcttaactagctccttcatgaactttcatcatgaaatgttaattagcgttaagtgaagagatggtgtactgaatgagcagttaaaagtttcccctccctaacttaactcaaatgtctctattttatgagtattacagacaaaagtcaaacaagttataataagtggttaggaagaacaacaaaaaattagctaagaataatttatcaagatgaactggtggtaaatttagaaccagtatggggaactggagattaaagcatctattgagcaaaagtcatctcagaattctgttatgaaataagttacaaggactcccgcaggttactctaggtgtgtgcaccggtggtccttcgcctcactacccagaggaagaatctttccatcggcaaagacacagctaatcagaggagagggtggaaaccagaatccctcctgagattacttcagagcccacccacagcagctcttcccctgctcatctcccactggcaagaagaccagtgggagatgagcttcacttcatttaaaatactcttcccttcatgcaaagatgctggatacacaatgtctgctttctgaaggaaaagaaaattgtggagaaaagtctctccctgacggagttatggtcatcaggagccccagacaaaatattaaataaggctggagaagaacagtaggaggagctgccaataatcattaaggaacaaggatgacattgttaaagtcactgtatctctggtgacagcaattggtgtcttctcctgaatgtagagctagtagtctcttaaaaacatatgtggtctggtagtattcattaactggaattacaaccttttaatttcatgtccaaaagtagtacacatgctcttcaagcctttttggttgaaacaatgactgccactctccttggctgtttgaaatacagccactttctttagcagaaatgtcactaaaaatgtctcagagccctctcctttagaacagaggacatttactaaatgaacagtttc

SEQ ID NO: 37269 - DNA, 1186 bp, Bovine  19866881028111
aacttcccaaaactatattgaatagtagtggtgagagtaggcacacttgtcttgttcctgactttagaggaaatgctttcagtttttcgccactgaggataatgtttgctgtgggtttatcatatatggcttttattatgttaagtgcggttcctcctatgcctgctatctagagagtttttatcataaattggtgttgaattttgtcaacggctttttctgcatctattgagataatcatatggtttttatctttcaatttgttaatgtggtgtatcacattcattgatttgtgaatactgaagaatccttgcatccctgagataaagcccacttggtcatgatgtatgatctttttaatatgttgttggattctgtttgctaaaattttgttgaggatttttgcatcagtacacacttcttatttttaataggtaaattacaagataaatcacagtcacgtggatagcctgagtgtttataaaaccacttatatatgcaaacaaattttaaaatatgttaaagagcctcagctatctcaatagtgatacctacttatccactacaagaattccctaactaaggggttcttagtgatgatgactgtcattgtaaataacattataaattatctataaacagagaacttgagtacagtttgccaatgtccacttttactcatgaatgagatttatccagaatcccatattgtatcattctatgcaaatttaaaactactaatgaaattgttttctttgaatttgagatggagcacaatcctgtccaatgaccatacctgttggattgttaattaacttcacatccaccattattaaattattacccatgattgaatgtgctaatgaaaaataactacttgcaacaggcaaatattattgaaaaagcaataaagccatggaagccacaaaaccagaaatgtaatccatttttcatttcattgaagaattcaataatgttagagacatgcaaataaccttggtgtaaacaacccttggtttacatgtgagagaaacactcaggatgaacagaagtaatattttggctttatttttctttagattctcaaaatattttttgtaatatttaacatgtcaggagatatagaataatatttcccaggcatgggaaaattttagaaataaagctaaatttagggaaaaagtca

SEQ ID NO: 37270 - DNA, 1469 bp, Bovine  19866881080773
cgctggcacttaccgactgaacaagtgtctgagactcgtgtttctcccttttttgtctgtgagctccttgtggacagcagctatggtgtttccttatccctgggcgcttcacacgatgcctggagctcaggaaacatctgtgaaccagatccctccctcctgccctcttggtattcccccacccatcatccccatcttgctatacctttcccaaggtttcttggcaaaaacttctgttccaccaactgttttagctcctttgagaattattaaatcctagtctcttattttctaattatcttcaaagaaatgaggcttaaatataggagtaccaagttactaccaaaagctaggtggatgtaaaatattatagttaatcagaatttcccattaagtaaaaagaaatttacgggaaggtttaggatttcagcaagcagtcccagcctgccctggtttttacttaagatgtttacttagcatttaaatgactgctttgaaaacatctattctaataccttatttgggttctgagggagatgatacaaactgtctatcatgtgggcacttgacccaaatcatctgatccccagtacactatcatttctaaaataatctgctctagagaatatactccaggcaaaataaaaatttcaacttataactgaccatctcaagcacctgcatacatttttaactttttttttttcttttaaaacaccatttgagggataaattcttatgtaccagtgatggtttgttccatttattttgagagctcttatgtacaaatggggcaaggcttttgcaataaacctaagaattacaagagattcacttgccctactgtagaacctggggttatcacctcttcagacaacattcaacagcccatgcaaattcaaaaattaatccccacaagcctattatctttgctgtaactgtacacaattgtccaatatatacctgactttctcattttgaccgttataaacttgttactgtattatctgaacatttcattcttttttttccccctgaaataagagaagaaaatatcctttgccataattttaagtatgattgagaagggttcaccttcccattttcaagtggcttaataataggaatcatcaaaacaacatatatctttggagacagcacatgatttattgtgctgattaccatttatcctgcctatccatgggtgaacaaggaagatgaacttttcagaacagaataagacttttccacagataaatggttcaactctagcacagttacatatttcccctagagaggaaaaatatatcatatttataatcacagtctctcctttttgtcccccacatgctttttacccccaatacaacaatacttttagtaatcacaagccacttatctatccatttgaactatcaaaaaaacctaactttaaaatggtctctaagccccccaaaagaggtctttta

SEQ ID NO: 37271 - DNA, 545 bp, Bovine  19866881283722
tttaaaatcccatgttatccatgatccatcttttattaaaatcaaatccagagactaccataagcattgtcttatcacatcttattctcacctaagtatttaacagtacaaatcaaggtgctaggtgttcttttctgtgttactaggaaaaaataagtggtttttaaatgatttttaattgtaattataacagtatctatctttcttctcctgatgactttttttcccccaagtggtctatttttatcgtgacatttttgtccattctatgaatttcatcatagggaagaaacagcagtttgtcttagaacagctcaattttgatctccaggtgacaagctgatatttctttcctttgaagaagcttttaatatgatgggttaaatgtcaaggaaaaaactctcatcctatattgaaccttgataacctcatttttcttaatattaatgacatattgagatttgatttctttaaaataaggttttgtttttttaacagaggtaaagattttttttttcttcaaaagaatgcatttatttcgggat

SEQ ID NO: 37272 - DNA, 1003 bp, Bovine  19866881314671
ccaacccatcccatgaactacccattagcctaatgtgtccatgtctgatcactttggggtatttctctgccccactgatctcttatcattttttacaacttttagttgattctccaaaaagaagtgtatgaccctacgaaagaaactctctgattctctgatggcagcaatctggtcaactggtcaaccagggagccttggtttagagactgaccaggaaatcagagccaatggcgtttacttactgccatttgtaaaaataaatgtttcagagtcttaataaccatgaagaaaaaattctactatataaccactttcatttttacacattgaaaaactggtatgaaaaagaattatattttggcaaaagttacaggcttccaaggtccaaatgaaagttttatgttttggctaaagttgaaaatactacctttcctcaatggaaaatgtcttaacagaatccgaggattctctaatggaaatagaagcatttgctttttggtcctccaaacttttacatattctctacctcaaaaataagtctttaaaatattcagaaatgtgaattatgcctgagaggtagtgacttaagtaaaattgaaatatcacatatttacattttgtttcaaatctttaatatccctatacctcagttttccttactgaaaattatcaagcatggtcatcattaacattattactattagtaaacctccatgcccataaatagtaaagagaattggtttaaaacacacataccttcatttcatgtgagtgctactaacaaagaaaccatctgctgacttaaatgaatcagtcttaaaacactgataacaaagcaaactttcaacagcagtttgcttacccccaaactaacatacattcagtttaaagggcctcctatttaattcccaagtctcttttgtatgtaaaaaagaaacttcacttagactggtataaatgatatttagccaatttgctttacaaatgattcctttaagat

SEQ ID NO: 37273 - DNA, 752 bp, Bovine  19866881337197
agtaagtggtttttactttgttcagttttgctacacattaaaggtacttctgaggatactgaagtttttaagttttttctctaatacatcactacaaattagcttgtcttcaaataactagaaagatgaaagtaatttgatgttcctgttgaatcaggttggcttctgagaaaggtgtatgcgtttcattggtatgcaccctgaggactggtatcacccttctcatccttgtgagaagatacagtttctgttcttactccagaagaaaaacaatgtggatctttcatgcaaagcattctgaggattggctatttaactacttaagtcagcttttgaataataaattaataacacgattatgctaataagtaactctaatatttgcttaacaaaataaatttacctactttggaagcagatcaagtggttaaatagagcagtaaaggagtattctggaaaatgcatctaagttctattaatctaaactattttaggactggtagcaatgttttgttggccaaatatacatgacagagaccctgtcttagatactttcttggaaatagattgataatcatactgccttccattttattattttccagcctgtaaaatactttcattacataatttcatacaagtaggggaattactgccagtgtatgcatgcctagttgctcaatcatgtccaactcttggtgaccctgtggactgttgctgccaggctcctctatccatggggatttcccagg

SEQ ID NO: 37274 - DNA, 753 bp, Bovine  19866881506152
tttgctagttgggttcccacactcagatctgggaataagccagggcacttagctgtgtggttatgtatgagatatacattctgtctttttgttcaataaattttcatatcaattcctctgctacttgaaaagtgcgttagcacgaactttatactttcacatctctccctttccttacccatcactgatgcatcttgatttatttgcacttccttaacttcaccttgcatctttagctctcccaaatgcctctttctcaaacttgattacttcttgattttcttctttttccattttggtctattctattcagggtgttttccttcctcgggcaagtaaattgtctttttaacagtccccatttcctttggttttgtattgattattgatttcatatatttcattccacctactttgcagtctttcaaaaattattttatgtaaattattgacccatttaatgttactttgataataatttgttggagtcagtggtttagctctcttactatatattcctaatctgtcattcatattattaaatataaactgagtgatgctccattttttaccatttcatgtatagtaacaagcttttctccatactcacaacacactcataaaatttctattttgaaaaaatagacctagattgcctttgatattttggtttgtaggcatacaccaatatgcgcttaggaatgtcattaaaatattcttcattgcttattttttgtctttgtgtatatttga

SEQ ID NO: 37275 - DNA, 761 bp, Bovine  19866881686811
ctgcctggagaactgcatggacgaggagcccggtgggctacaatatcgccatggggtcactagcagtcggacacgactgaggattaacactttctttgctttcccattgatttacagacaaattatctttctagtaacaaacacctaatagtataaatcttcaaggtgaataagggtaaaatatagagtacactgcacatagataaactgttaagaaatactttagattaatggtttccaaactttgggtttttaacacacggaaacttttgctacaaaggaacagagagcagttgcagtgaggcagccccttaccccacagcagaaaccttttaagtccgaagccactgccaggggccaggagctccccaacggggatatggatcggatgcagctagggagctttcgagaccacctgtgcccagagccggcttcaattgctggttccaacgagcaaccaggggtgttaactcacgctgcaggcaacaggtagatgaccgaaagcggaaggactgtcactcaatattttcaaataacttaaaaaaatcatgcatacatactttccagtaatttggttggcaatttcgagcacgccagtctgaatgaagagcctgagaaacgttggtggataaatcctcattgataaagcccatgctttcggcaaacttagtggctggagattgggaacaaaaatgtacatgagttaagtgtcttcttttaaataaaatgtatgcacaggaagtgctggggtcagctgtctc

SEQ ID NO: 37276 - DNA, 679 bp, Bovine  19866881851250
cataaaaaaaatgcatcttctaacatgtactaaatagaaatttttaggttctatcaatcacctaccttggtgattaactgtgactctatatagactcattgagaaacatctctatgcaaagtcattttgatttaaatatctcatctgcattatggcaggtgaggaccaggcttacctggaaacaattctatgaaattatgtttccagagtgtggcttattacttcagaggacaacatataaaaagcaataataagtaataataatataaatgacagaaatccacttgtgctacattggtgcacagacttttagaagtaggattttatctggcatataatctcaacttgtgtgaacagaagtatccattacggtggcctgagggcaaatttaacttgaatactttttcactaactgaaaatttaccaaaagatttatagttccatgtttggtttcaacctcaaagtgccttttcctggaaagtttttcaacctttctcaactgtgtatgaattattattgtaagaaaaaaaaatgttgacatttgtaacatttgtcagtcttggtggcttgagaaatttccaaaaacagttgaaaccatttccagttagcttaagaaagtcaggggaaggctcaaaacgaagaagaaggtacttcatgcattgcacacagtagggattca

SEQ ID NO: 37277 - DNA, 1243 bp, Bovine  19866881942241
tgactaatggacgtgagtctgagcagactctgggagacagtgaaggccagggaagcctggtgtgctgcagtccgggggttgccaagagtcggacaccgctgaacaacaaaaggactcaaggtcagcagccaagcaaaggacacgctgcagataacatcgtgtttagttgtagagattttacaggcatataatcatgtaaactgctggaatgctaagtgatagaaaaccagtcttctataatagagcaaatgaaagtgctttaaaaaagaacctaatgatgaattggttatatatttgatgaagtggtccatgttctaagcacacccatatattagatcagatcagattagtcgcttagtcgtgtccgactctttgcgaccccatgaattgcagcacgccaggcctccctgtccatcaccaactcccggagttcactcagactcatgtccattgagtcagtgatgccatccagccatctcatcctctgtcgtccccttctcctcctgcccccaatccctcccagcatcagggtcttttccaatgaatcaactctttgcatgaggtggccaaagtactggagtttcagctttagcatcattccttccaaagaaatcccatgcccaataaatcctgtgttctccttctctctcctgctttcaaactcaacacttgcatgaaaaattccttatgtctttcccctcagactgtagtatttatgatatatatgatatcctagccccttttaatatagcacttatcaggaatgcttttgagaatcatggatataagcaatgaaagagactgtcctctgtgcttttaagcttataattggtgggctacttcaaatagtcctatttgcttatacaaaacaaatgaaaagattaggaccaaatatttacaatcaagataggttagtcatccaaattatttcatttttgaaagaatgatggaccgctttttgttgagaagtattttatatgtagtatacctggcagtcaaaacttactaaatttcccaatctaaagtgcaagatacaaactcatttgttctatctgtagacatgtatttaaccattttctagtgactagatacttccacagagctgcatggagcttaaggtaagttaagcattatgcaatttttaataaaccatcatctgtgacataatgttttggtatcacgaccatgaccatgtgaagctgctcagtcgtgtccaactctttgtgactccatggactgtaac

SEQ ID NO: 37278 - DNA, 743 bp, Bovine  19866882135175
tcttcttggagagcaacactttaaagaaatctatcacttgcttactcaactttaggcaacaaactatgataaaatacagatattataaagcagaatcaataatcagcaggaaatctgtacactacttaaaaacaccctggagcaaacccaagtgtaagctatgaatcaaaaaaaatgaaaaataaaaaaccatctcccccttctactcctgtctttcttcctcctacccctttgccgaactctcaatttctccagtcactacccacctttattatcttcttacacatacaaacacatagatagcatagttacctgacaaataataggccagtgttatcaaaactatatcttttaaaaaatagtagcttttccaaatgagaagcaaaatcccatatattgtggcaggttaggaacaagccagaaatctcaaaggccagaaataattcaaggtatattaatcttatcccagtctctccggataaacatcttggagggctttttcattcttttctccttcattatctctacctccttttttaacacaattgctcctaatctagattgtaataactacaacttttggagtacttcctttaagtctaaatgaatgtatttcctctaatattcaaaacgataaggaaaggtagtcattacagctttcctcttggaagtaaaaggattaagacccaaagaaccttcagtgtttgccaaggccacagagtgggcgaaagccaagaatgttc

SEQ ID NO: 37279 - DNA, 936 bp, Bovine  19866880386330
cccaggacccgaggcccaagacagtaccctcaggctccaaccgccggcagtccctgcggccgggaacgcagacattaaagttagagcccccgccactgccaggtccctgcctagtcggcgcggtgacggtggctctggcggcggcgggggccttcccctggctgccccgccatttaatcagggctattatcagactgggcttgcaggatggcgccggccgagctttacccccattagcgtagggcagggtgggggctgggtccccagaccgccgtctgtcccaacgcagctgcagcgcttctggggcgctttgagaaaggccgagccgcggggtctggtggcggctagcgctgtctcaaaccagttcttctcaagctgacagtttattagactattatttcctacctcccaactcgacctttactagctctttggcgttcgagcaaaccactgaacttttttgagactcagtttttcatctgtaaaatggatctgcttaggtacttaactcaaggttctcttgaagataaactcagatgatgcatctaagataaactaagaaggttcagaccacaaatggtgttaatacgattattacactagaattatatctgtttttttaaaaaagcatttcccaccccacccccgctgtttaattaaaaaaaaaaaaaaagtgtagagggaccaaagaagtccaaagattacttaaagacctgctggatttattcatgacttgctgggatctaatttctcctctgccacttgctctccgtgtgactttggggacttcacatctcttagtgcctctttgccttagctgtaaaatggatggaatactaccaccttccttattagactgttgggcacattaaataagatgatacatggggcttccctgaggcgcagaggtaaagagtccacctgcaatgcaggaga

SEQ ID NO: 37280 - DNA, 2617 bp, Bovine  19866880449479
ccatcctttcctcccccacgaatcccaggcaaccactgatcttttttgctgaatccatagttttgtttcttccacaatgtcatatatagttggaatcataaaatacatagcctttcagattgctttaattcatttagtgatattcatttaagtttccttcatgtcttttcatggtttgaaagctcatttctttttaatactgaataatacttcagtctctggatattccacaatttgtttatgaattcaattactgaaggatatcttggttgctttcaagttctggcagttgtgaataaagttgcactaaacatttacttgctgggtttgtgtgaatgggcttccttggtggctcagtggtaaagaatccacttgctaaagcaggagacacagatttgagccctgggttggaaagatcccccttgaagaaggaaatggcaacccactctaggattcttgcctggagaatcctatggacagaggagcctggcaggttatagtctatggggtagcaagtctgacccaacttagtaactaaacaatgacaacaatttttgtgtgaatataagttttcaacttatttgggtaaatgtcaaggagtgtaattgctagatcatatgggaagagactgtgtaattttgtcttcattttgtgttcccaccagcagtggatgagctttcctgttgctccacatcctcaccagcacctggtgcatttagcatgggttactttttaacttataggctctctcttttcagctttctctttatttattgaagaaaccaatcatttgtcccatagattttctcacagtctagagtctgctggttgtatcctcatggtgtttagcatgttttcctaattctgaattgctttcaaatcagtacttagatctagagtttgatcagattaaaatgtgatattttttgacaagaccactttatagatggtggtatgtacttttcattgagaggaataaaatgtttgattgtctctcttttaatgatattatgatcattattacataaataaattaattcattagtactgcaaaatggtaagagtctatcatcctttctgcatttattagctggaaatgctataaagaaaaaccttccttcatcaacaatttggtttccctgaattacagttcacattggagaggttattttatttgccattatttctatttaaaaataatgaattgattccctataacacatccatttcatccattgtagcagttattattctaattgattctctgaatacctcatctctggtcagtggaaactctttcagacagctcttgatccttttgccttgacctcagtggaatgtgagtttccttgctgtcttttatgacaaggagctccagacttatccacagcagaccaggaattagtcaaggaaccctgttacttgtagtgagttattgacactttctgcattatgttcttcaatgttgacagaaatggaagcttaggcagttagcttagcatagaagcttactgggtttgcagaatgttttgcatctggggcaacctaggatactttgtcataggcatcttgatattctgagaggtattctctgtcttggccacaaggacagccttctataaagacttgtttgctaatgtttattaagttctcatggtcatccaggtctcctttcatcataatgtgtgtctgtgtgttagttggtcagttgtgtccaactctttgtgaccccatggactgtagcctgctaggctcctctgtccttggaattctccaggcaagagtactggagtgggttgctactcccttctccagggaatcttcttgaccgagggatcgaacctgggtctcctgcattgcaggcacattctttatggtctgagccaccagggaggcctacatagtgttttaagtggttggaaatatttcatattctatgtaaaacacaaattgatgcatcttctttgtgatactaccaaaagataccaatttatggtagtgaagttttagtgactttcttctttatttagggagtgcaggtcattacgcatgcctgctcagttgctcagtcggtctgactctttgtagtcgcagggactgtggcccactaggctcctctctccatgggattctccagtccataatactggagtgagttgccatttcctcctatgggccattgtaaaaacaatttaaataagcacacttgaaatatatctaaggagtttcaagctgctacatcttttcattctgttttatgcaaggattgtttatgaaagtcaacattatcattatagcatatgaattctgggtaaaaatgagctgggatgcgtaacttagagagtaagccggaaattccctggtggtccagtggttaggactctgctcttccactgctgggagcctgggttcgatccctggagagggaactaagatcctctggtatagcccccccccccaaaattttatcagatcagatcagattagatcagtcgctcagtcatgtccaactgtttgcgaccccatgaatcgcagcatgccaggcctccctgtccatcaccaactcccagagttaacccagcctcatgtccatccagtcagtatgccacccagccat

SEQ ID NO: 37281 - DNA, 2961 bp, Bovine  19866880461546
cacccctggctgacctaggcttaatatttaatcacagagagttaagaacaaataattgtggaaagtcagcagtggatgatgcttcttcatttctaatgtgtcctttcatggagagatgtcacattttcaacttttatttgctcttcagttgttggaagaggaaggaatagccttatctgtgtcatgaatttggagagaataaactgggcatgctcagctcagccttcctcctctcctgggtgcaaactgcttgcaggatgctagtgttctcctcttcccctttatccataaatcttattagttcactaacatttatcagtacatactctatcccaggcagtgttctggtccaggggatatagcaatgaacaaaataggcaaagatccttgtctcatgggagatgttggcaataagcagtaaacataatcataatcacattatacagtgcattggaagatgatagatgctggtgcaaaaaaacaaatcacaaaacagtgcaggagatcaggattgctggattggcagccgcagtgtgaaagaaagtggtctgggtaggctgacttagcaagtccatttgaggatatgaagagagtcatttgtctgcttacattcagaaccctgtaaacgccatagttttagaggagaatattgaccattcttgggagaaggaaatgggcaacccactccagtattcttgcctggagaattccatggacagaggggcctggtaggcctgcagtccatggggttgcaaagagtcagacttgactgagtgactgagcatacatacatgcattgctcactctctttctcagtccagccaccacttgcccccagtcctggacatgccctgagtatctagtttgagtaggactatgggctgtggcccacagcacaggtaggtttaatcactaggtttaccttttgaggtgtcgtcttggaacaaagtccaaatcataattgcctataattagtgctttaccccgctttgcaaacagatacacatggtcagttagcctacccacctcatcctgcctccactttgcagccaggacagcagtattaaagcaatagctattgctgttggcaaacaaatgtgcacacagtttttctttaaggcagcaatccttaaagtgtggtccagatcctggtgaatggagaggacctttcagggagggtctgtgagatcaaaactattttcatagtagtactagaatgttttttgggcctttttcattttctttctctcttgtttacagtggaattttccagaggtcacatggcatggactagcacaacagattgagtgcagaagcagattaaaatactccttttttcccctaactacatatttgtgtgaagcctgattttctttacatatttctatcaaaacaacatattgccacagattgaatgcagaagatctgaaaatccagctgtcttctattaagccaaacttaaagagatttacaaaaagttaaaacaagttgatcttcctgctaaatatttttttgaagagggaaatagttactttccatatagaagatatttatgttactatgtattgagtttattattgttatttataaaggagttaataggtaaatattaaacagtttctcacatttaatttttaatgcagtaaatatctatgagtataatccacataaacaagcatgtgaaagtcagtcagttgtgtctaactctttgtgaccccatggactgtaacccgctaggctcctctgtccatggaattctccaggcaagaatactggagtgggttgccatttcctactccaggggaatcttctcaacccagagaatgaacccaagtctccttctttgcaggtggattctttaccatctaagcctccagggaagtccataaacaagcatccagggaagtccataaacaagcataaaggggtctgagtctgaagaggttacactcaagggcttcagtgtaaaaccctatctgcatgtttttacagcccccagacatcccttcagaggcatccttccttgttctcagacatcacataaactcagggcaatgcttccccacttgatttcatttgcgtatctacctgcatgtaaagcactctatactaaggtctgtcttcttgtggggaaagagcatttagtctagagtggatagaagaaacaaaatttagtcctgggtttacctaaccattatctggagagatgcaaggtgatgaagttggactcttagaagaacatttgtcctcaggttggactcagggcaactggacagaggtaagccaaggtggcccacacccttcctggccatgagaaacttgggctttaaagacctggcatgctgttaagcactggttcctaagtactggtgcctcaaagagctgcagaaacccctgcacaagaatcacctgagttgcttgctgtacgtacagacttctaggctgtactcagagaccaatgaatcagaatgcggttggagatctcaagatctgtacttctttcctaagcccgtgagtgattctgtgacgcagcaagatttgggaccctttgatcagccttcttaaaccctgtcaaatcatcatggagatgagtcaacatgcttttgacaccaaatatttgtcctggccacctcctgcaggctcaaagtatctactttttttggaagttagttctttggcaatagggcagcaatgcctcaaatgttccctctttacttgaaagcctctctggaggaatgctgatgtggctgtacttggggagtaacacagcaggtgtatgtacctgctatacatgagggatgagaaagggcagaaaggaggatgagactctttggaaggacatgggggttggagttatgagtaagaacttcaggactccaggacccctcaataggcaacaagagaacagaagctagatattatttccactggactacactcaagactctaggaggagccaag

SEQ ID NO: 37282 - DNA, 3386 bp, Bovine  19866880547250
tcaaaggctttggcatagttaataaagcagaagtatatgtttttctggaactctcttgcttttttgatgatccaacggatgttggccatttaatctctggttcttctgccttctctaaatccagcttgaacatctggtcaccttgggtgaccctacatggcatggctcatagttttgttgagttagacaaggctgtggtccatgtgatcagattggttagttttctgtgactgtggttttcagtctgtctgccctctgatggagaaggataagaggtttatggaagcttcctgatgggagagagggactgagggggaaactgggtcttgttctgataggcagggccaggctcagtaaacctttaatccgattttctcttgatgggcggggctgtgttccctccctgttatttgacctgaggccaaaccatggtggaggtaatgaagataatggtgacctcctttaaaagttcccatgcaagcactgctacaggcagtgcccccaaccctgcagcaggccactgccaacccacgcctccaccagatgctcatctagtaaaatataattattttacgttttcagatttttaaagtgctttcataaatgtcatcttacatggtcctcataataaagtgagcagtgttatgttctccattttctacatgaggaaacagactcagggtaacctctgagaatcacttagaagtgatcttacttaagatcttacttaagtgatctacttaacttaggtaacttctctaggatcactcagccagggaaaggcagagcagggactctaacccatggctttgtcttcatataccatgctcaacccctgacctgaaacagaagatatgaggcacactataaaaacacatcactactgccccactgaaccactgtcttcatttttgcctgatacctgattagaaagcagaaaaaattcacctattataatcccacctgcataaatccagtgtgaatcagtgcctttggcactctagaaacaggagatgagaaagatcacacctaaatggaagtagcctttttaaaacacctcctggtggctcagatggtaaagtatctgcctacaatgtgggagacccaggtttgatccctgggttgggaagattccccaggagaaggaaatggcaacccactccagtattcttgtctggataatcccatggacggaggagcctgataggctacagtccatggggtcacaaaaagtctttgtaaatgtggactcctttgtcacccacactgctgataccgctttctcactgctttggatcttgtggcctatttgcatgcctatgttctacctaatcgaagagttacctccttgccatccattttgcaaggcattttcaaccacaagctcaagttcctttccctgatctcagtacccccaatcacttgtcagactcttcaactaactaaccttttctactcaaatgcctgcccaattttcagtctctcctgctggattctttgcctcctcactgagcttctatatctctccccccaaaatcaaaaccacacctttatgctctggcattgggaaggatgatggaaggatcagacagatgttgctaaaacttataataatcctttaatttgagttgccaggacaggaaagagaagtgctgaggtcaggacatatgaccatgtggtaggtaacaaagagtgtgacagaaccatgtagcagttggtggggaaaccacctaaagatctggagataaaataaatcagagggctggtagttagggtactccacctgtctgtaaagattccaggacatataagagattaaatacacaggatgaataaatcttatgatttaattataaaatggtgacttttataatttaaatttgcaaagacagtagaatttaaatgtgttcacaaaaacaaaacaaaacagagtaagtacagaaagttgcatagtacacttaggggtacaaataatcagttaggttgaaaaaaatcttttctttgaaaaaaacttttttttccattcacattgggcaaatatgcatctcaatatagtcattactcatcacataaacagtctcacactgtgtgaaccatttcagttaaaattagggtaaattacaggcacatgattgtcacttgccttaaaggtccagatatccaatagccttcctattaaatacaagcattctacgctgtagataaaatatgcactttgatttaaactgcctctgtttgcttcagaattccaagctacctttatagtctttatgttagcaaatatatccacttcagaaggcaaaggctattaagattctattttctctgtggattgccacttaagacacaaagcttaatatcatcaagaggactgagtctttgataacaaacaagccctattttttgcagttgaattaatgtcctgttcaaagaaaccacttcactcagaaatgggagcatagaatagattcaactgcagcaactgtcagaacttcagcagttgcatatctgtagggtttataactggacgtgaaggtggggcagagaacgggagactgtacagagtactggagactatatacagtaaagttatgtctcttttggtgttgcaaggagtgtgctcttacaaactagtacttttctttatcttatcagggcaaaaaagtaaacagaaaattctcattacctctcaatgtccgtgagcctggaggagtcccggaatcctttggcaaaagggttactatctattttcagcttggttatctggaaagggaagatgagtaacaaaacagtgtcatgtctgtggtcaaggaaacaaaatcagaaacaaaaagtttgttcattttccatcatagcaccccaagaatgtctaagaatatcttagtgtctctcagtattgtgataaaggttgaaattgctaaagaaattcacaaatttgggtgaattggtcagagaaggcatcaaggaaaaggaagtatttgaggacagagtatctgttcctaaaacaggctggaagtcaataaatagagacagttagaaatgggggccttttatgaacagtgtgcctgatgtgagaagtatttaagagcagtgaaaggctagagctggactagggaatgaggaaactgtccagaattggacaatacccaccagcattggtgggtaaagggaataaaaacaagaatgttgcctcatgctgatttgacagcctcatttgttaataccatgggcacctatatataccacaatagacaccccaataatagcttcctgttcaaaactgtactgaaaaatatgacatagatacatgatataaacttttcagcatataaatttaccccattccccttaccatctgaccaaattagaatcaaattaatgggtct

SEQ ID NO: 37283 - DNA, 1357 bp, Bovine  19866880561100
tgcaagcataaattaatgggtgggaatcctaggaatgccagctaagaggacaggtggtggggcatgagcccctcttgtcctttccgctctctgcttttctgttgactggaatctgggaatgatggcaggagtcctagcagccatcttgaaccaacaactgaccatgagccatataccatgagctgaccttgaggttgaacattctttaatagagtagaaatatagagaagcctgagtttccagtgataaggaaatacaatatgagccctggactgcctacctccagaattctttacataagatgaaaataaatccttgtagacttaagccacctttatctggattttatagatattcagctgaatctaattccaactgattcaccaactaagtaaatcagagaccaagtggaaatcaaaaggttcctcagagaatcactgtaaataggaggcttttgtcaggagagtcatgatggacaatattatttaatgaagagtattaatattgctttcaggtcagttgctcagtcgtgtccaattctttgtgacaccatggactgcagcatgccaggcttccctgaccatcaccaacacccagagcctactcaaactcatgtccattaagttggtgatgccatccaaccttctcctcctctgtcatccccttctcctcctgccttcaatctttcccagaatcagggtcttttctaatgagtcagttctttacatcaggtggccaaagtatcggagtttcagcttcagcatcagtacccccagtgaatattcaggattgatttcccttaggatggactggttggatctccttgcagtccaagggaccttcaagagtcttctccaacaccacagttcaaaagcatcacttcttcggtgctcagctttctttaaaatccaactttcacatccatacatgactacaggaaaaaccatagctttgactagacagacctttgttggcaaagtaatgtccctgctttataatatgctgtctaggttggtcatagcttttcttccaaggagcaagtgtcttttaatttcatggctgcagtcatcatctgcagtgattttggagccccccaaaataaagtctgtcactgtttccattgtttccccatctatttgccatgaagtgatgggaccagatgccatgatcttcattttctgaatgttgagttttaagctgacttttccatcctcccctttcactttcatcaagaggttctttagttcttctctttctgccataaggggtggtgtcatctgcatatctgagggtattgatatttttcctggcaatcttgattccagcttgtggcttcctccagcccagcatttctcat

SEQ ID NO: 37284 - DNA, 2306 bp, Bovine  19866880574576
tccacacttgccaataactatttactttacagaggcaaagcacaaagccctgggcctggtcagggctgagtggctgagaaaggaccttaatgagccctgagaagcctgccttcccagcaaaataagtactcaaggttaatgtcgtcagaattgagggagaataccttgttttgactgagagatcaaagctaggggagtttttgatcagaattgcctggacaaatattttagcttccaatttattctgattatgcagaacaggcctgagagggtcacagccagttagagagacggtcactcagcccagccaggctggagggaggacaattcttgtttgggagtcctgacgtcggagagcctgtgggaagtcacagaggtaggcaaaatccctctggacctgctttctgtgcttttagcactccagtgaagacaggttcaaactggaaggggcctcggagacccgtcttggtttgggaccttgttccagtggcttgccacacagccagctgatagccaagctggaaggagaatcagaccaccctctcctaaccccaccacctgcactgctccccatgctccctgctgaaaatgtctgcagtgaaatatgaacttgaccacaaactgtaaactctggggaaacatctacaagaagccttggggctgcccccgacaagctggagtgagcccatccaactgcagtcacagctgtagctccaaggggctgtgaaacggccttgggaagccccagggaggaagggaaggcttggagttacaaacataccaggagcaatccccatcccatcccaaaccctgaaagaggcagatgtagttttccagagcaggctcagcgagcaagctgaagattcattgtcagaatgcattgtcagagatccgcatagggcccaatcctaggaccatcgtaggaggacttaactgtgattacagatacttgatgagcactactctgtagcaggcatggtgcctttacataagttaatttttaaaagattgtaataagtctgctatgccgtctcacttttataataacgaacttgaggcacagagaggtacaatgctttgcacaaggcaaattaactactacacagcatatgtaggattagtaccagactggtcttcaaagcctttgcagaatcaaacagttatcctgacttccctgcctcagctgtatcttggattaactgaatagttcggtgttttggaaaattctaactaataagtgaaagaggaatgataaatttagaaatttatttagaaaatcaccactctgcaaccattaatgcagaaatattgggttggccaaaaagttcatttgaatttttctataacatcttaccgaaaaaaaaaaaaaaaaaaaattgggcttccctggtggctcaaacggtaaagagtctgcccacaatgcgggagacctgggtttgattcctgggttgggaaaatcccctggagaaggaaatggcaacccactccagtattattgcctgagaaatcccatggacagtggagcttggtgggctacaatccatggggtcacaaaagagtcagctatgacttagcagctaagcaacaacaacacattgtctgtaagacaaaggatatacttgataattttcaaaacaaggccaggttaagacatctcccttggcccactcagtgattctcttcctttactattatgcttctactcatttggtaccaagccaacatagtaatttgatagataatgcacgcacacacacacacacacacacacacacatatatacatatacatatatatatatatatatatatatatatatatatatacatatgtgtatttttccttcactaatactggattgtgatacactaaatacattgatattccccactgtatttcaatattgaatctacaatagggtctatattactctggccaaataagatatattcctgcttgtctcttaaagggtttgctgaaattaaattatcaagcttattaaccttgcattttctactggaatttccctgccacatgtataaacgttccttgtcttcttttgcatcactctttttgcttgctttctttagaaagcagacttcactctgagaatgtcattcgccttgtagggtgtttgattgatgcctgttcctgttttctttttccccttcaaattcttgtgctttgttcttcttattctacattagcatttccagactatgagtaattcatttcatttttttttttttcagaacaaaagcattaaggattaaacatttctgctgtatcactctctctaacactgt

SEQ ID NO: 37285 - DNA, 1695 bp, Bovine  19866880626609
gtattttatttttatttaaattagtggaatttcttaggaaaagaaaaaaccgagtaggtgaaacttaataatgataatttttagaaaggctatcttgaaagttgttaaatggttaggcttatttaactaagtcatgttgatagagaaaagcaaacttctcctactaaaaataaaaacaaatgaacttatcagaattgtgtagagagagctttctattcctgacttgattctaccataatgcagaatgattaaccttctagcttaaaaggctgcagagtaaaagaaacctgaaaatgaaaatccccttagacctcttagaataaattatgtggatttgctaagtacacagactggccctcttaaaagggagataaccactttaactattgctttggaaacagaatccataagaccaattacgagtcttattttacattagtgattttacaccagtaaaaataaccaccttgggtccttcacaaggtgttgttttaaaacaaaacccaaatgaatttggaatctgtttacatttcaaagataaaacagcaaagtatagtaaagagcctgccagaccaggagtcagaaaactgtgttctctgcactccttctgaataaccccagcctgctgtgaacctcagtttttcatctatgaaaggtagagaaaaacatctgccctgcattcttcatggtatttttttttctattagttgattgtggtacttttgtgaggcacatttgaaattagaagaatatgaaatttccctttgaaaattatgaattttagcaaaagatattttggaaggttggaattgatttattgagatgtaaaagcatttacctaagataaaactatattccattttcctctttcctctcctaacctcagctttcttaaagtaaaaattatatataaaatatcaggaagggaaggaaactggtcttttaaaaaatttttttgttcttttttggctatgttgcatggcttgcaggatcttacttccctgacgcactctcttggcagtgaaagtgtggagtcctaaccactggacgccagggaattcccttggtttttctttatgctgatcacaggttctgtggtaggcagcctccatgatggccccctatgaatccacgttttggcatcacatccttgagtggtccactcctatattgttccaaggttagtctgtgtgagtggtggtgcatcacttccaagatgaggtcatagaatgctgaaggtttcctgtccctgtttctctatctgtctctctgagctgtctctgtgtgcagaacaagctgccatgttctgagcagcccaatacagagtcccatgtgcctaggaactgaagtctcctgccaacaaccaaggttagaagcagatcctccaacccacatcaagtttcttgatgattcagtcttgcccagcagcttgactgcagccccatgagaaatcttgacttagaatcacccaggcaatctgctcccatatcccctgcccttggacacagtctgaagtaataaacatttgttattttaagatgttaagtttgggggtaatttgttaggcagcaataaataactgatacaggttttaacaggaagagaaaatgtcagacatgcagctgatgaattcttttaactagagaatgtaaccaagaaagcctgttgggtacacatttccttactcatcagttt

SEQ ID NO: 37286 - DNA, 806 bp, Bovine  19866880755109
ctaaatgaaaagacgagattgagactgctcaatctcataattacatctgctttcatactctacccatcgactctatttttaggatctgacctatggaacatttctttcagctctgacagtttatttatttagttcccaggttaaaatccacatgctccctttggatgcaatgattgtacagccttgaaacaagccatccctaatcatgaacccaaacggtgtacaaatgtaccatagttcaccctggtcaacagccatcatatactactgtaactgtactatatatacgtttataatacatttcacataagataaagttcttccatagtaagttctactatctgcatttattccattttagttagctaccctataagagacttactcctttcttaagaaaaatcaaattgactttcacagggatttttaaataaagaggtggcgactgcagccatgaaattaaaagatgcttactccttggaaggaaagttatgaccaatctagatagcatattcaaaagcagagacattactttgccaacaaaggtccgtttagtcaaggctatggtttttcctgtggtcatgtatggatgtgagagttggactgtgaagaaggctgagcgccgaagattggtgcttttgaactgtggtgttggagaagactcttgagagtcccttggactacaaggagatccaaccagtccattctgaaggagatcagccctgggatttctttggagggaatgatacgaagctaaactccagtacttggccacctcatgcgaagagtgactcacggaaaagact

SEQ ID NO: 37287 - DNA, 1479 bp, Bovine  19866880777089
cacttcgtttatgtattgttagcttttagtctgatttgctttggatataatttatcccctttcctacggttcttgctcttttagacaataatgaattgaaactttggcaaatgttttctcatttgttaaatgaaaataattctagcttcctcatgtggctcgttgtgggaagtaagtgaggtgatgtaagtatgaacttggtgatacgtgaagaatagacagatgctaactgtcagtcaaaaggtgtgttttattccaaggtctgcctgttgtctgcttctttcaaaaagtcttttcagtctgcctttcagaaattctgaattatgtttgtttttctttactcaaaaacatgatgtccctttgtgattgctggatgttaccaagcccactggataccttgtagtgtatttcacaaggtttaataccttgagcagggaaaactcaagggtaaaagcctgtggaatgtggttgatggtgcgtggaaggcagggtgttgttggagctatcacttgtcagccaaagaacggagactgtgaaattggagggtccaaaaacagccgggtgttagaacagcaagttctgccatgcagtggaagctgtttttaggtactgttaagattgaaatgagttacagcaatgtatggcataatctaatggtgccaccctttattccttactaggctcatattggcaacttattaacatcaaaattcttcagttacaaggattttgacactttattgtatacatgtgcagcagagtttgactttatggagaaggaggtaagatgggatctatccttttctttccttaggttttggtccattcatttctcataaaggtgctcctgttactcagattcttaccgctgtgctcgtatctcagtttgaaggaaaaggaaaaccttgcagcttaaaccaagatgttcctgtttacattagcacagcctcatgaaatatatgatttcttctgattttgataatttagaaacatgcattcagtctagcaatagtttttaggatgagtaaacacagaagcatttcaagttgcttcctttcaagggtagtattgattcagtgaaactctcaagcttttcagtttccacttgctttgtgattatttgtttgaataatctcagtgatttgaaatatcattgaatacaggtttttcattccaacaacatttgtctttctaaaactgtactcgtgtgtttagaaggagatctgagagtagttgagtggattgtgagacagaagtctgcagtattacttatgttgttgagcaagtgactctcattctttgaactgtagcttactagtttctggtagtatgctacaaacagatattgtgagaaggaaaggagatacataggaaataccgttgatattttaagatgtttcacattaaatactattttgtaatactttatgagctagtttggttcaacagtatttatatatatgtgccttttgtgtgtgt

SEQ ID NO: 37288 - DNA, 1689 bp, Bovine  19866881077806
aactagcccatagtagtatgtttgaagtctttctgtgcagtccattttgaatcttcaagaagcagctttcctcaccatctgttctcgaaatgaactcccccctcctaccaccaccaccaccattcacaatctcagtatctccatctaccttgtatcttacagttatctttcccccaactttctgtatctaagggctcatagccttgagcagaaggtccaagaaagaggaggaggaagtgacaaatacaactggaaatcctatctggtggtagaaagtcagggaaaaggttttgaacttcatcctaaaaataatgaaagtgaagttgctcagttgtgtccgactcttttcgatcccatggactctagtctaccaggcttctctgtccatgggattttccaggcaagagtaccggagtgggttgccatttccaaatgatgaagaaaatgacaaaaggagagttttcatgtcaatataatgtctttttaaataagtaaagggatatttgcatgttttttatgattatcacttaagacttggttcacataatctcagagttgactgaacactcccctctgacctcttcctcctcagggatcaactcaggtttaatagaagcttttgtttctatctatgcctttgacagctgggagattagcagggacttggctaattagaatttaactgtttgctaatgttccagtaggtttgtcgatcacaatctagtttaaaatggattcgaagttttcaaaatcttgaaaaaaaaatgctgtgtcagaactgatttaatttcttgaaaggattcaaacaagaatcagatctatctttatgatcttttcagtcacattccctaacaaaaccatgttttgaattggaaataagccacaatcctctttagacacgaaggctatcgaatgagagtggagtgaattgaagagcctccatggaaacatgagctttcatgagcgcccatcgacagcagccccacaatgacatgctcccatgcttcccaggtggcctaggagacatatgaggagacaagtctcattatgtgatgtttagcacctgaagtttactaaaaggtaccatgcaacttgatgcctactttgattcacttgcgcagtcagtcagtcagtaaaaattttcttcttatgtgctaggcagtgaacaaatactgaggatatagaggtagaaaataatgacctctaaagaagttgacattttagaaggaagacaggcatgtagacaattaccatgctatatgccacatggtgtcttaataaggcacagcatggagcagtagggacacagaagaaggaagatctatgtcatgagacagctgcttaggaaagacttcagaggaggtagcactttgactgggtcttaaaggatgagtgcaatccctgcctacaatcccagagacctgggttcgatccctgggtcaggaagatcctggggagaaggaaatggcaacccagtcccttattcttgcctggaaaatcccatggacggagaagcctggtaggctgcagtccatggggtcactaagagtcggacacgactgagcgacttcactttcattttcactttaaaggatgagtaggggattctcagtggaaaattaggggcagataattctaggcagaggaaacagcattttcaaaagcataaaacaaatccaggcaagaaca

SEQ ID NO: 37289 - DNA, 1238 bp, Bovine  19866881113450
gaaaaaatgtgaaagcagttttcagagaatacaatagtggagccggtatgcttttcacttaatacccaaatcagcgtttcttaaatcatgtgcgccgggatagccaggtatcagaggccccaggaggaaggacgccacttccctgaaccttggaaactctgaaaaccactgcctgccactcccacatctgctgtaccaagatcttgaggcatggttcataattctcaaagttctttccaaataattcagtctcatttgattggcaaatgtagctttgctgctgctgctgctgctgagtcgcttcagtcgtgtccgactctgtgcgaccccatagacggcagcccaccaggctcccccgtccccgggattctccaggcaagaacactggagtgggttgccatttccttctccaaaatgtagctttattgccctttaattctttgagaattaatgggctctttggtgcaactgacataactcagccagctattggcataattagtgagtcacagagctctcctattttctctggaaaagtttggggctttttgcatgtgtaaaaaggaagatgatttattttttccttttccaaatttgctgagttactttcagtgagtgtcaaagatggccttcattttatttactagtcagttttaggctatttagacttttcctttctcctactgaagtgacttcagaatttaaagtaagtatttactttaaaaatctgtgtcctgagcaacccaaatgtccattgatagatgaatgaataagtagatttggtatttaaatgaaatggaatattatttgactattaaaaggagactctgacacatgctacatgtatgaaccttgagcccattatgcttagtgaagtaaaccacagaaaaagacaaaatattgtacagtgtcccttgtgagatacctagagcagtcaaatcaaatccatagaaacagacagtataatgctgattgctaggggccgaggggaggaggggggtgaagaattattacttcaggggtgcagggtttcagatgaaaagagttctggagatggatggggatgatggttgcacaataatgtggaagtatttaatgccactaaactgtcaaaaaaagagacatggttaaaaatattaaattttatgttttatatatatatatatatatgttgccacaagttaaatattttcatgtcctgcggatattgccatcccttggccatgatttggggggtt

SEQ ID NO: 37290 - DNA, 2126 bp, Bovine  19866881163259
cttagcagcagcagcagcaaacatctttaaaactcctcttctgtgacttagaaggtcaactctctgataatatttcttatcagtcattacaaaaatccttcctaagtggctgcatctgagtggcaacagactctaacaataaactgtaactcctaccttgccttacattttcctctattgaaagtgaaagtgaaagtcactcagtcgtgtctgactctttgggacgccatggactacagtctgtggaattctccaggccagaatactagagtgggtagcctttcccttctccagggtaccttcctgacccagggatcgaacccaggtcttccccattacaggcagattctttaccaactgagctatcagggaagccatttgccacctaataaatcaggaaaaacaaaaaaaaggctccaggaattcatttctactgtagcatagttgcaaatttgaaagagactgaaatcaaccacttttatgtgtttttgttagattctttcacaggactggttaacatcttgacagatatcatttggagattcactggagacttaatggcacctgacctggtctgccgcgtggtccgctatttgcaggtatgtagcaccttccaaatatgatgagacaaaccgacaccaaaattacctcttggattcttcataaggaaaatactgtaaaacgctgtactctgatgcaacaaattgctcacttcttcatagttgaaaggacaagcaaaatttatatttttcatgttttttgtttgctaaaaacaatacatatataaagaaaacccaagtaagcaataataagaacataagcattcctagttcaagcattaggtaaaatttctgggttattattctttttgacatattctggctgtcttagtccaaggatgctgatatatataaaaataccgttctgacctggagaattccatggactatatagtcaatggggtcacaaagagtcagacacgactgagcaactttcacagaataggtggcttttaaacaacaatttatttctcacagttctggaggctggaagtcgaaaattagtgtaccagcctggtcaggttacagcctttctccagactgcagacatctcattatttcctcacacaccatgacaaaatgggatttattctgggtatgcaaggctggttcaacattcaaaactcaattgacgtaattcataacataaaaaggtaagaaaagattatatgatcctatcagtagatacagaaaaagcatttaagaaaatcttatactcactcatgataaaaactctcagtaaactatgtatagagagaaacttcctcaacttgataacaaaaatctacaaaaaacctacaactaacctcagacttaatggtgagaagctagaagctttcctcttgagactggaaataacacaaagatgtctcctctcacactcgtattcagcatcatgctggaagttccaactaattcaaaatgacaagaaaaaaaataaaaggttacacagattggtacagaaagatgaaattaaaaacacctgtgtttacaaataactttgtctctgtagacaataaagtgaaaaccagtaaggtcacagaatacaaggttaggggacgacagaggatgagctggctggatggcatcatcaactcaatagatatgactttgagtaagctccaggagttggtgatggacagggaagcctggcgtgctacagtccatggggttgcaaagagtaggacatgactaagtgactgaactgaacatccaaaagttcagatgttttttcatataccagcaatcaacaatttgaagttaaaatttacaacacagtaccatttatgttagcacccaaaatatgaaatctttaggtataaatctaacaaaatatgtgcaagatcaatatgaataaaactggaaaaactctgaaaaaaaaatcaaacaatatcttgaaatgtatagatattccatgttcatagataggaagactcactattgtcaagatgataattctgccagtacaacttataaatccaatgtaattccaatcaaaatcccaccaggttattctatagatatggacaagctctaaagtttaagtaaaaaacacagaacagtcaa

SEQ ID NO: 37291 - DNA, 496 bp, Bovine  19866881355929
cgcaggctgttggcgaacgcgtgcaggtgcttcagcagcagccgtacgaccagcacgtgctcctccgtgggcatgaaggactcctgggggccgggcgggggcgtcagccaacgccctgcaggtgtgccgccgacgcccaggtggctcctgcacttggatacccagcgcagcctgtgactgggctgcaggcccacaagtgcgggcgggtctgagaccaagcggctgctcccccgcccacccccagccacgggcttgcccgcggtgagcagcgccgagaggggcccagaagacccaggcccacggcctggtcccacaggccgccgcggcatggcaacagccgcgcaggccccagcgacccccagggcggtatcccttctgcctcgtctacctttgggtctctatgtgctggacctgcaacatgccagacagaagggcatgccgtaatgggaaggaaaagcacagggcccctccgtgccgagcctgctccaggagcccc

SEQ ID NO: 37292 - DNA, 1586 bp, Bovine  19866881414839
cttgatagctcccgtggtctgtctgcataacatgtagtccgccaatcaagacattcctagctgagtcccagactttatggagtccacactgtggaccttgttttgtcatgcttgattttttgactgtcagaaacatgagggatgttttcagtcactatcatttggtattatttgccacctaggaatcaatgacagaacagaggacccttgtttatgtgagtaatgtcctttggagtgtccagtgggtttggtgcctgctgtgtggtgcacagtgggtttgagatcccatttcccgaggctctcttatctggagggacattgaagaaggcctgggagagagggttggcttcccagccagtggggaaacttttcatttcccagtcacagatgctgcagtctccccagttcccagagtcattcagggagcccagttctgtgctctagtcctgaagccttgacctcctcagagatgtgaaaacatagcacctaaacttttgcatctttgttctccctgtattctgcagtgcttcccaggtggctcagtggtaaagaatccccctgccaatgcgggagacctgggtttgatccctgggttaggaagatctcctgaagaaggaaacgacaacccactctagtattcttgcctgggaaatcccatggacagaggagcatggtgggctatagtccacgccattgaaaagaatcagacatgactgagcgactataaaacaacaataataacagacattctacaggacttcggctcccatagccttccagtctaaggattttccctttatttctggcacctcagagtttcaccttctgcctttaagataagttagtaattttttaaaatacatgtttttcttccataagttttaatttggagtgggggtaaaggtgggttacaaaggaggaattccagaggttgctccatctgatgttttaatctcacttccttatcttctctctagaatatttttgggcatttgctccctacatcacaggactgtgttagcaaaactgtgaatgtgctagctcttttaaaagatgtaaattcattcagaaaagtgaaactatatccttggtttctagatgattaaattcatagttgtattctattgatccactaggatggttctgacaattgaaattcggtttcctgtggggaccagtgatggtagttactgatcagggaggtacctttcttgcccagtctggtcttcttttgaacagccactgaagagccgtgtccttaagataatgaccacgcataatccgtctccgctgcagataacagctaatggagtcaggctgctcatatggatatgctcctagataatgcagaggtttttttccccccctcatttatattttaataaaactagcagataggacttcaagctgtaacattcagtaaaataattaatatactgaaatgtggctctttgacagatactcaaatgagtataaggctatcaagaagaaaaaataattatcaatcagtcagttcagtcgctcagttgtgtctgactctttgcgaccccatgaatcgcagcatgccaggcctccctgtccatcac

SEQ ID NO: 37293 - DNA, 1682 bp, Bovine  19866881441728
ataaatgttatgatgagtccactttgtagatgaggaaatgatttagagaagttaatcacgttttccaagtttgcacagctatttagtgagatcaaaatctgaagccagaatgtctgactctcaagccctagctcttaatcctatgctattaaagttccctgttttaggaagatttccaaatctgagcaaaaggctcagaagcctagacttttgatgctcattcttatgctgttctccagcccaagccttaaaccctttgagggcttcagcaggttgaaaatggctcagcagagaacaggaaatccttgtaaatgtcttctcgggtactacccatacctcgctatgtcctcagaccgccgagtgacaccagcactgtttatttgcatggttccttaaggattgtccattgttgtttcccagaacaagttacgctgctcttcctacaatgagtggtgggggtggggatggggaagggctgcgtctctgcagacacttcagaaatcccaccactttgagacagtctcgagaaaatccagtcccagccttggaacaatgtgtagccctgtggcattttgacattgggcgtctcttcactgttgaagtaactcagcacgtggcaatgtgtttatccccttgggtcaggtcaatgctaaagtaagttcatcgcctctgcttcttcaataactgatgtctgatgcatcagctgaatgcatttcaggcttataagcagttccctggatccacaggcaaaaagctttcaccatctccccctcccccactaggtgaccatatcttagcattaatgcatctgatggcaccaagcctttgtggcccgagcaaggacagtcgccaagcaaggattgaaatcacatttttatttacattattacttttccacagtttggtttccttcaggcttttgatctattaggccacaccatttagtctggactgaatccttgaattactttactttttcttccaagactctcaaagaacttgataaacttgtacttattaaaatattcatcaatagtgttaacataccagggataaaagtgaaacactgcttaatgtgggagacaaaatacaatctcaagtgtagattttgactcttttgtgaataacaatcattgttttaggaaaacactgagtttatccagcctttgttagaatctccctatcatataatggaaatgttaaatctaagccttcttgtgaagtaaactcatattatcatttacatatgtccagtcatggcattaataaaagcagattgtcttggataaaacacacagttaacctttaaaatagatctgaaaataagattatgaataattgttcttctttactgtgactattgggctgtatttagtgccaaacttttttgacagctcctaaggagtaaattgtaagtatattgaaattgttatccaagtacaagctgccacttctgtgtaatggcatttttctcccacaaactgtgaaagaaatggagccataaggaatcaaagtaaaatcagagggatttgttagaatagaaattctgattccttcattctacttctcatttattgtcagacaataagtgaagaaatgcccactaaaaaaatcaaaaagatccctttatcttttgataaataaaatgtgcaacattctcaacacaacagcttagttttgga

SEQ ID NO: 37294 - DNA, 1119 bp, Bovine  19866881510828
tttgtttttagccctttcactcattcccctggttttcagctctgcttcttatttatgctcttgtgtgtgttccctctgagtccagaggttctgtggttctgctgcttttggatttgggcagcttcctcaaggtcactgtttcctagctgtgcttcaaaccaatgatgcctctacatttactttctatcatctggaaatttgttataatctcttatctgttgatgagtatccttctattgacttgctattgcaggtttataccattctgttgctttaccatcatttttctagggaccaggtgatagagagtcttatcatggggatttagtctgtcatcctgaagtagaatcctttaatctatttaagaagaatcccttaaattccatggaagatgtttgatttcagccaagtgttgaaaaataagtagaatttacatggaaacagagaattgtaaaagatagaccaaacagaggacaagtttgtgcagtagtgtggagatgggtattggccatgttaggtttgaagaataatgagtatgttagccaagcagaatcccagagttccagcaggagagtcatgggaaataagacttaaaaaatagtctgcgtctagagtttttagttctagatgggaaaatttggctgttttgagcagagcagaaaggcaatgaaatcagtacttagaaagatttatttggcatgatgtgaaatatactttggagggagatagactagaggcagagagccaattaagaaacaggtataatcatccatttatgaaatgagggatggtggcagcagggaagaaaattgggaagagatggcaacttagaaataagaatctatagtacttagtgactgattagctatggaggataagatgactataagttttcaggtctggataactatggagaattactggcattgatgtagttctaaaagtcccaggtacctatcctaattccacctcctctctctgctaagagtaggtcacacagagtacgatctttgtttccagcctaggttttcacaggcagtaatagtggtggtggttgtagtgatgatgggtgggagatcgtgctggtgaaagaggcagtggcagaaaatagtgacaatg

SEQ ID NO: 37295 - DNA, 658 bp, Bovine  19866881776454
atttactctgaatatctcaaaggttagggcgggagacggggggttcctcctgggcataggtgaggaggatctaggtggtcccatgacaactgtgggtctaacctacaatgttcctattggcagtagcaggacttcactttatggttcgctttttgcatctgcagatggaaagctgtgcaccagttacaaccgagggctcatctcaaaggcaaagatcaaggccatcaagtatagtattgtcatcattcttggtaagcaacatccctcctcgtgttgtaaaactgtggacattccaataacaaatttgtacctgggacctggtgacacaaagaaaaaatctgtctatgagaacttctgccttttcccaattagaaaggaatatgtgtgtggagcttatcagtgtcactgcagctccctcacgggccaatatttggtttcctatatctatctttatgaatattgttgtccaacacagccatgggatgcataatgtggaggaaaaacctaattaagacattactagctgaagctgatgctcaccatcatctagttgacccagttgcttttctgaaggcatacactccccagagctgaagttcaacaaccaaggaagacagaagcagcattccatttctttggatatttaatttcaaggtca

SEQ ID NO: 37296 - DNA, 1849 bp, Bovine  19866881999140
attgcatggaatgagaagagtttaccttgtagccatctagatgtcagtttttatgtctttttcacttaatagcgtgttcagattcctttttctctctccttatcaaaccagcttgtttggagaaggaaatggcaacccactccagattcttgcctgggaaatcccatgagcagaggagcctggcaggctacagtccatggagctgcaaaagagtcggacacgacttattgattaaacaacaaactcattagctactccaaaccagcttggtcgaaatgatgaaactcactctgaggcatcagagattaataccaattttgtgtggtagttcattttcaattggcatcaaagactttgtccagaagcatctacaaggaaaaggtctgtgaccaaaatcccatgtgtgtgagggcaagtacatattgaaatggacaggatggtaggtttggagcagaggttctgaaccaaggatgattttcctcttcttctccccactcaaagaaatgtctggagacattcttggttgtcttaacctggggagggatgctctactggcatctaatgggtagaagtgagggatcctacagttcacaagacagcccccagaacaaagaattttccagccctatatgtcaatagtactaaagatgaaaaattcagattgagagggtttcctactgcagctgtaacaaattttcctgaacacagtggcttaaaacagcacaaatttattacagttctggaggtcagaagtctgaatggatttcactgggctaaaaatcacggtgtcagcaggaccgtgttccttctggagtttctaagggagaatacatgtccatgctttttccagcttctagaggccactcagatttgttgacttgttcctcctgcgcttcttcaaagccaacaatgtcaggccaagttctttggggccatgccttgacctttttccactttcacttaaggacctgtttcacctaagacccctgattatgctgggtctatccatataagctgggataatttccctgttttcaggtcctgtgattagcaaccctaattgcacctttgaccttaattcccttttgctctatcatctaacatactcctaaatttggagattaggatgtgggcatttttggaggccgttattctgcctaccgcagaggtctgtccttatcctacaagtgttggtacaacacaatcctaaatcaaatgcatttactggctttatcaaaactagtttgcaagtcatttaagtaatgcccaaatacgatgatatgattttaaaataattaagtgttgactgatcaagatatataattgatctcattccccttcaattgtggttacttactgaccaaggcctgcaaaatgacctcctatggctttgtttcctgaactataggacttgttatgggctctggactcaaccacactggcctcccagtgtccttacctgataagaggtttatacacgaggatcaatagccaaatggaaatcaatatgccttttcattaagtgccagaggcaacaactagtataaaaagacgaatccaagcgacttcactcatcttccctgaaaatgtaagatatcagcctaaatctcctacccagttataggcagagtgcaggtggatgagaaagaacccgaggtgggcctgcccagaggtagaggtcctgttgaagggagcaaggtagtgtgcatgaggaccaatcattgtctgctcccacaagtcaacctgaaaaatgaggttaaagaaaaagctaacatgagtttaggtggactattggacagttgcactacccttaggaggtatattggaatccggggggctttagcaaaaa

SEQ ID NO: 37297 - DNA, 2023 bp, Bovine  19866880350464
agattttcctctatctgtggaaactataatattaaaagaaaaaagtatttagaaatctgtttcaccttatgttgatgtgacattctgtttttcactgactacctggtgatttttgtgatcggtaatgctaccttgattaaagacaatttttgtaaaaattacattctttaccatttaagcattgtgactaatattttaatcaagcacacacctgtaaggtctttgaagttttattgcagatttttaaagatcctttcactgttatttcccttaagaaaatggaagcactctctgcaatttccattcgtattctgagatgtcattttacggcaggaggaaaaggtaaagcactttatatgatgtgctcgtaggtgcatctttatgagggtggggcgtgactgcattcaccggggttcctttcccagccccctaagtcacatcctagcgagatggataaagtcgtaatcccagacagtggaccctggcccttatcatcatgtcactcatttccacaagcctttccgggaacccaattacgaaaagattgctgatcggagtgatgtgggggagagactgatctgtggccagtctgtaaaatgcataatttttttccccctgctccttgaaaaggatctacccccattgtggaataaattaagtgtgaaacatgtcgggtgagatttatggtgttgcccagacttctgagaagcggagatctttatctcacggaggctgccatacattacattctgggtgatacgcggatgacagccaacctctttgccctcagacgtatttacataacatgtgtgcggaggagggggggatgccttggtcccttcaatctccccaggccacctgtgtcaggagcgtcttctgtagcttgttggctggccttcacccccagagatttgtgggagaccccatgtgcccaagacagctctgaaagtgaacctttaaatcagcagaaaaaggagacacacaatcaataaggaagcttccttttatttctctccttcttttctccaggcagaatccccagacataacaatgaaatctgtctggtctaggccaaactgttactattaaaggttacttgacaaggatattttgacccatacagaaagagcttgatctacatctgtgtttgttcacctcttgggcagacttttaggaaaataagaacgagctccgccaggctcctggtgccccgtttcttgtgtcaggaccacttgtggtgtagatttttgtagatttgataaatgtttccttatccagggttttattaggaagaaaaaaaacacaggcttttatttagggaatctcactgttttcttttttttccccaaagatttaactggttccttcatcttcgtgaatgacagacatttataaataggaaactttagaatttccttgaatattgatatcttattgttagttgactggtattttttttcttctcaaaaggaaccaaagaagcgtgttcataaatttcagatatggtaatttcaattcaatgcccatatccagattctagatatttatattaaaaacacttaacagtaacactatctgcttctagtaacttattttgttgattagtatctatcgacttaaagtgaatcagaatgagagcaagcaaaactgctggatggaatcagttaatggaaaaataaaaaacagaaacctctgcttacaaatattgatgctatagagagatcaatttaccactacacgtgaaatccagacttcttagcaaacctccggtagaaagctgaagccaggcatgaagaattatcagacccatttacctttgctgaaaaacaatcttatttctttgggtaaaatccaactttacagacattctgatgtggtctagagaattcgagaatgtatgtcaaaagtctgatttttatcagctgttaatcccatctctttctcatggattatattttgcatcatgtaaatatcgtggtggagatgggggattgactgacgagtgaaattacttccattctgt

SEQ ID NO: 37298 - DNA, 1922 bp, Bovine  19866880356999
gacctataaagctttagaaaccagtaaatattataatgcacaaaagatttaaattaatgtagtacctcattcttaatttaaaggtgttaagtctttgcagaaaaaggcaataaaattatgtagttaggcagtgtagaatagtggtgctcaaactttttttgtttcagagcaccttcacattttaaaaaattattgaggtctctaaagagttttcctatatgtagactatgtagaaagatatttattattttagaaattaagagtgggagcttataaaatgcataattttatcacttaaaaataacagtaaaaaaatccatcatattttagcataataacatttttatgcaaaagagccatctttgccaaaaaattagcaaggagtttagtgctgttttacatttttgtaaatatctttaatgtctgtttaatagaagacaggcatattatcatgtttctacattcattgtcatatggtaggttgttttcggtgaagtttataaagaaagtcaggctcacacagatttatggttttaaaggggttattttaatagtcttttcagataattgtggatatactcaacagatggtagtttcttaaagatcagttacattgtggaatctgaaatccatatcaaagaactttttgtctccgttatggtaaaatccattggtttatctttcaatgaatttttttttatctgtgcttgattttggtgacaccagtcattggtcattgaaaatattagtttactgtgctgggcagattcttccaaatattcgcacatttaatgtgttgtcaaaaatcacacttgtttgtgtcattaccatcacagtgccatcagaagagcctcttaagtcgaggaagctattagcaccttcactcatttttcagaaaaaatgtctgccgaacacagaaatctgaacaaccacagtttatcagttgtctttttaggtaaaaatggtgtcacttaaataaagcagctagttcctcccacacctcagatgtgttttcagtacagtccatagggtcgcaaagcttcagatgggactgggcgcagccacactcagcagtagtgcctcatgcgccccccttgcttggtcactcgttgtcacaaaatgttgcaaagtggactcactgatagagatatgataaagaggacagtggcacctacattttggtgcccctgtcttgaatcttgctaaggcactggcagcttcacccatctttcgttttgtaccactagtgcgcacgtcagacagcgaaacggcaagcagccttctagtctgcttccgttgatcctgttgatctgaaacaccctttgaacgggccttggggaccccaggagtctgcagccacactttgagaaccacgggcatagcgaggtctcaggtttcatcgggaccttatagttcacccagttcaactgctctacttcacactgccctcgccaagtatttatttagattttgtttgaatgcttccagttcctgtgaataactgtgctaaatgaataaaaataagagacatagacagctgcttgatggaaagtaagagattcgtaaccctggaattgtgctttgtcctgttattttaaaaaagtgcatacttataaattttgaatcgcctgtagtgtctgtgattgagatagcagatgggtgcaggtgttgatggcattgcctttcatctttaaatcggatgatagcctgcattggaatctgacgaggcttggaaagcagccgtggggggtgttctgtggtctaggctgggcttgagaaagcccttgagaactcatataatattgagggtgggcacacacttgctattaatctcatttttaagcctcagcttatagaaacagttatttaaatatttccccttaggaatgggaaccatttcccgtcttctgagtccacgtgtg

SEQ ID NO: 37299 - DNA, 1128 bp, Bovine  19866880410144
ttgggaagatcccctagaggagggcatggcaatccactccagtattcttgcctggagaatcccatggacagaggagcctggtgggctacaatccatagcgtcatagagttggacacaactgaagcgacttaacgctacaaaaattaagctccagtaaatacacacacactcctcttttgaatatagccattaagaaatagaaatcactggcatccatttttgtataagaagtaactaaagttgtctatgtttaaaaacataccattacttcctggttcaattagagcgattagcacttggccttccaaatcaagtttcactgtaatgacaataacaactgactgaatctatatatttccaccagaaagcaaaatgatttttttctgaactgtagtaattatttgtatccagccatttgccatattctaagtacttgaggaagctggttttacctggatctatttttccgtacatctgcctttctggaaggactcttgtttccattcttggatcatccagatctttatgaaagacacttttttcccttaaagaaatgggtacagaagagagttcccaaaccagctaattcctcatagaattgttaagccagcagttagttaagctttctgaatatctttgaggttgtcaatataagaagcaagtggtcctagagcagatgtctgttttatgctgtgattcatcagtgagataaactcctgactttagttctgttcaaatatcctctctgctgttcctctctgccctctgctgagtagatgggtcaggggacagaggactcactttgtttattcagtgtgtcttagctctgttgcacgagaatgctggacactccagttgagaaaaagaagtgggtgaaaagaaactgaatcacggcagagaagtcttggctcagctccagccctaaataaacatgaatgtgaccgagtcaatgactaaggactacgatttgttgaacagattttcagttaaattactgtcacaccctttcctctgcaggaaacagatcctagattgatggagtaataacttccttttgctcctctagtaagaaatttgagagcacacgaacgccaacttcattttctacctgttttctgaatcatatca

SEQ ID NO: 37300 - DNA, 3076 bp, Bovine  19866880420683
agaagggggcctggagggcggaccgggccagggactgggtcaggccgtccactgctgcggggactgagatggagctacagtggagacgcctcggtctgctcttgtcttcagctctgtggggagagaatgaacacacagagccccagcggagggacccagagccatcgttcagatggtagcagtgaagcggctcaagcacacgtcatctcggctcttgggtaaatcagccttcccgcgaggctggaggatgcctgcggggctccggtacccagggcctctagaggcagccactccatccttccagccccgcttcccgacagataagcacgtgcgaatctcatcatgattacttcagaaaaacatctcacccaaacccaagacgtctcaaggagtgccacatttgccatcaggcattcgctgagtcaatttttcacactccgattattaagcaaatcaaaaaaccagaatttcaatctgaatgataatttctgggaagttcatcttaatagagagttactgatgcatcagttgctgggagttcatcactgctcatccttgcaaaagagtatatacttacaatgatcaaagattttcattttccctctctctctctctctttcccttgccatttaaattccatcagcaattatttaattatgtgcagaattgttatttttcttctgtggctccatctggttgcccaatgccaagtgaactgctggtattcaataaataaatagacaactacttcttcacttaattttatagcacgcaaatgaatacatgatgaaattgagaaattggggtggctgtttagctccagcagagaaaataataaatattattctggaagtcatataaaattaatagttatctggttaaaaaaaaatttccttctggcttcacatgtcaatgtaatcgtgtgcgagggagatgccaacgcgttcatttcacaaggagtctcggagcatttgtttttataattatatctttgtgtggcagagaaccaacagggctgggatccactgccgggcagatcagacgcccgtgtaggaaatgaacgagctgaagatgaaagtgtggcactcggaggataatttgttttccctgtaatgtttaattacagttttccgtacaaaagggaattttttcagcatttaatcactgagatagttgaagctaattagtgagggacacaccaccatttccactttaataaaaaatcatttgacattgcagtcaaggccaaggggggcggtcatctgcagtgaggagcaactagatattgctgtgttcctatgggaaagtacctccctgagactttgggaaggtcatgtacacactgctatattcaaagtggagagcaacaaggacccactgtagagcacgtggagctcagtgtcacgtggcagcctggatgggagggggctgcggagaatggatacatgtatatgtatggctgagtcccttcactgctgttcgcctgaaactaccatacactgataatcgtctatgtcccaaatacaaaataaaacagttaaaagtctggggaaaaacaatcttcctgacagcaaattaggatggaaaggaccagggagggctatcaggcatgagtatcgtcatttgtcacagggagacaagagcggtgacgtggagaaggacctggatttcttcacttgtttatttccagctcagcatccaccgtgaactctgaaagctttccctgaagctttccttactggcaaagaagatgagcgagcttcctaagggaaatataatacaggccaccaccgatcaagctcactgcttttgtgtttttagagtggcttctccattttgggggtcaaactttcagacgtttctgtgagtcagccttatttatatatatgacacttgcgtaaagatgtcgagattccagctatacgtttttgctaagatggaaatattagatgacttaaaactcggttggtgagggacttccctggtggcccagtggtaaagaattcatctgccaatgcacagggcacgggttcggtccccagtcccagattatcccacatgctgtgggacaacatggcctgggctccataactactgagccagagccctagatcctgtgcttcccaacaagaggacccaccacgatgagaagcccactcactgcaccttgagggtagctctcaatacccactcacggaaaccagagaaaaccagtgcagcagcaaagacccagcacggctgataaagaacgaaataaaaaattaaaaaaaaaaaatcttggtgctggaggtggcaaatgatacaggcattagtgtagcaattatttcacgtggcctgaactaacacacagagcatccgttttctagaagggaagcccaggcaatgtatcctttcagatgtcaggaggtttcactttacacagtgggcatgcgtatatgagtgttcttctccctacggtcacgtgtgattgaactttacattaagagctatcagcactgggacttccttggggtccggtggttaagacctcgccttcccaagccacggggtgtgggtctgatccctggtgagggagctgaaatcccacgggcttcgtggccaaaataccaaaatatgaaacagaagcaatattgcaacaaactcagtgaggactctaaaaatggtccatataaaaaaaccatattttgaagagcactatgggcattttcttgctccccccaccctgatgaaccacgtgggtgatgggagctggacaccgcccgcctttaccttttggagccttcctcctgcttgcccctggcctccaacttctctctgtggaaagcagcgttcatctcgttccgaagccggtcattctcgcgggcgatgtccgaggcgttctgaacaaccagggcgtcataggtcttcagccccaggtcctctgtgacctgcagcaagctgttgatggatgtgacctcctgctgccgtatgctccttttctgatgcaagtgctggcgggctaaaaatcctctgaccacttcagtgaaagaacacaacggtggggtcagaaatccagacgtacaccaacaagccacag

SEQ ID NO: 37301 - DNA, 701 bp, Bovine  19866880461056
aattattactagtcctgctggttgataagtgatcaggatcgcttctcttgagtgtggaaatactgacgtcgtctggattgtgtttcattttggaactgttagaaaattattattcagtttaaagtatgtaaacagctgtagctgtgagataattgattatgcttttggttaaaattctggaaatcaccctctttttttcatactagtggtagaacaaagaagcttacatttaaaaggaatagacaaaaaatcaaattcaagtgtaatacattcagatataattaacaataaatgcaatttacgagttctgacatactaaacacattttatgactctccacgattatttaatgcagctttttaaaaatttcttataaaattgtatttctgttgagcaatcagacttggtaataaaacaatttgagagtcagagagtgtttatattttgagtagcaggaaagcacaagaagagcagttgcagatttccaatagaggactaaacataatggagtttcatttttcttgagacttcacacatacgcagttttctaatgctttccccccttatggacagattctcagcactaagactgttgagtggaagtgtctgtgttttcgccgttacaagatattgccagatcagtttccaaaaaaattttactaatttacgttttgaaagagtaccctttcctcacattctaa

SEQ ID NO: 37302 - DNA, 2836 bp, Bovine  19866880469911
ccttggagatctttcttttgcttacctcttgctgctgtattaggaactatttcactttctttgacacttaaaaataaaatcttagatataattagagaaacacgtggatatggtaaaatgcacaaatcttacagttcagtaaatctttatatacccttgtatctctatatatttgtacttatataatcctgatcaacttggaaacattttcatcattctagaaagttcccttatgctccttttccatcaatacttcactttaaagacttctatcatcataaattagttttaacctgctattgaacttcttctaaaccaagagctgtaatttgacaccctcaaaatatcccccatcagcttcatgtgagacttttattttggtgatatttcttcacactgttacctaccttaaaccacttaattaacacctccatattggggtctagagatgtgtatcaacatctttggcgctctggaaattattctatactattaacagcttacatatgattgccagcatatatctattaaattgaaaaacgattctattaaaggtgctccagcttagatgctttataagcatctaaaaagtccattcttctctacccacttaattcccacatataaagcaataccccctctcccttctataatgtcctactctatctgtaaatcttttctaaacccttttgtgcgtttatggatgactgaccccacattgcagtgtctgccatgatggatactctaggtgtaagagtaaacatcatttgattagcatcatattagcgttttgagagaaagcccacagtggacataaataaacctgaataggatgcagaggcggggggcgttgcagcgatgaagcagtcaggcacagctaagctgaggacaaaggcgtggggcacagggaggggccgtgggtcagattcttgtcctcctgtgtccccacctcactttacccgccttcgcctcttctccaccttcacctctctaggtcactcactgcaggagccttggtgctgcaaaggaggcaccatcctcctagcatttcatcagcttcacccaaggttggcagaatggccatgtctttattgcttaactctgagaaggttctccaatcatccaaagacatgaaaaggagggagagggagaaaggggatgaagggagaagatggggagaaagaggaaaagaaaaaagaaggcagagcagagacagattccgcgagaaatgtgaggtcatggattacggatcagagagcagactgtgttctcacacagcatcccagtgctggtttcctgagccccagtccccaccaaaaaatgcagtggaagccccttattacagtgggtttggagagaattagaaaacaaagcttatgtagactttgggcacttctccccatctacacacacacacacacacacacacacacacacacacacacacaggatgcagacctctagagagggaggaggatgtctccatctccatcaccttcaaatataaccagatgagtctggagagatgattctccaaatctccccagagctaccccatccctagcctcccaggagtgtttttaggcaattatccttaaaccaaagtggctgatgccctttgccctgcagagcagattgtgtagacgtgcaaacagttatggagatctgttcccaaacaatgagttctattgcaatttctcaaaaaaaattaagtttctaagtttgggaaataatattatttatggatttggatatttcaccatacagtttttttttccaaatcactttaaaatactgttaacattttgtccgcatgcctcccacccccttgcccagtttagagaccatacattatcctttgaaagctaaagtgaaatctgtgtaacaggctccagttcatccacctcacaactgactcaaatttgtttcctttcgatggctgagtgatattccatcgtatatacataccacatcttctttatctagaaaaagtgtactgatgaacctattatttacagggaatgagatgcagacttagagagaggacttgtggacacagcaggggcagaagagggtgggacgaattgagagagcagcgttaacatgtatacactctcacgtgttaaacacacagctagtgggaagctgccgtgtaaccagggagcccggccggtgctctgtgatgacctagaggggtgagtgtataatcatggctgattctcgttgttatatggcagaaaccagcacaacatggtaaagcaattatcctccagttaaaacataactaaaaaacaaacaagaaaggtaaaatctgaaaccagggaatttatttggaagaaggaagtcatcagtgtttaaacttgccctcaaatcatcttataaggccttttaaagaagccttcgtagggaactgaaaaggcaaatgaataaatttattgtatctttacactcacatgaagaaggcttatcttccactccacctctcacctcttctcctttctcaagtatagtaatgttttcccagttgtttgataatcctgcattgaataaaatattcctctgaggttacgtgtagtgccccagaagatgcattagagtatttctaattctctgtttcttcatttgatgacccttgagtgttcattgatgttttagccttcatagggaataagaaaattagaaagtctatacctcaaataagtaattatttactaaaagaggctttttctgtgatacaagtaaagaatatattaaagcattgtattatcagaggctagatggactgtcccatggaaaagggagcagagggttcaaggtaaggccaggacttatttag

SEQ ID NO: 37303 - DNA, 1892 bp, Bovine  19866880547283
ctcctctgtcctgggattctccgacaagagtactggagtgggttgtcatgccctcctccagaggatcttcccgatccagggatcgaacctgcatctcttatgtttcctgcattggcaggccagttctttgcccctgggaagctcctcccatctcattaggcttagccttttagatgctattcttcctttcctaacatatccccccggccccagttttgtttcaaccacagtgatctgctctataatccactgtagaaatctacaagtaatactggggaagtgggcctgatctaccttctcagggagcatatttacaacttgcggagactataagacccttctagtttgtcttgtacactgagaagaagaggagaagggcttgctcctttggaaggccttctctttctatttattttcacatctaaatccacctgaaggctctcctccagacggtttctctcatgtttttgctatgtcccatattatcatgatgctgaaaacacacatttgtcctcttctcccaaagtaatgaatttctccttcatctccatctaagcattactgtaacgtgactcatacatgacaacagcaattaaaaaaaaattctcctgaagatctattctttctaaagtaacggatgaagagcgtctttgaagattactagggtcaagtccttgctgtgaaagatctcacagaccagatttctggtccatggtctgcccatctctttggtgtcaaagatgaacttatggctttgctgagcttttgcatttttggctcatttatttaccaaagaatttgtgttccctcctctgttcatgtaatattttccaatgaaacctatgcagccatctcatctagaatctcacctggcatcaccacctctttctctatttccctatgcagccgtggtcttctaaaatactctgtgtatttatctgtctcttgtgttttccatctgtctcccccactagagtgcaggccccaggagggaaggtatcttggtttgcttcatatattgtgcatcctcctgggcctagaatggggcctcactttccaagggtgatagctaaaatctgtgaatttgttaaacttttctgcaaagaaggaccgcctctgcatttcataattctaaaaattagtaattaggcaataacgccacatgaactaacctatgatgagtttacttgagaataaactgtggttttgcctaaatatgtctagaccaccaacgcagaaacttttgttgtctggtctccaaaatttcactcattgagttctgccgagtcatgtttctcccctgcgtgaattggttcagttactgtgtgcagataaagcaggcttaatttttaattaggttgtgataacagggaagccggatgaatctctttagctttctaattcgcagaagtttacatggactagcgaccgactttctgaactgttctgtttgaggctcctcattggatgtggaagttgggataggagtgaaggaaagtgatatataagtagcttttccctaagaggcttagagatttgaattaatattctttatctttaatgattaaggggcccctggcaagccaaggatggatttaattctattaaaaatataccagggcggcagtgctgcacggggcacccaaaggccggaagtcaagcatccatgacccagcggggcagccccttccctccccagggctaaccttcattcgccgagtccctcgctgcagcccataggcaggcgctcacagcctcgtaggaggcgctcagccgcgtggctgggtccctctttggcttgggcggaggctgtttccgtggcgacgggaggccgctgccgtcatccaggctgaacaccgagtgcagagaagggggcctggagggcggaccgg

SEQ ID NO: 37304 - DNA, 1946 bp, Bovine  19866880587435
tcccagcatcagggtcttttcaaatgagtcagttcttcgcatcaggtggccaaaggattggagtttcagcttcaacatcattccttccaatgaatattcaggactgatttcctttaggatggactggttggatctccttgcagtccaagagactctcaagagtcttctccaacgccacagttcaaaagcaccaattcttcagtgctcagctttttttgtagtccaactctcacatccaaacatgactagtagaaaaaccacagccttggctagacggacctttggtggcaaagtgatgtcactgctttttattatgctgtctaggttggtcacagcttttcttccaaggagcaagtgtcttttaatttcatggctgcagttcctatctgcagtgattttggagtccaaaaaaattaagtctgtcatggtttccattgcatccacatctatttgccatgaagtgatgggaccagatgtcatgatctttgagttttaagccaaacttttcactctcctcttacactttcatcaagaggctctttagttcttcttcgctttctgtcataagagtgatgtcatctgcatatctgaggttattgatatgtattgaggttattgttacaacataaatgaatatttaaaaactaaatgagagaagccagacacagtaagctatatagtgtgtgatttcacttatatgaaatatccagaggaaggaaattcataaagatagaaagcagtctggtggttgtcagtggctgagcgagggtgaaatggagattgagtgtctaagggattcagtatttccatttggggtgatgacatgcatgtcctaaaattaaatagtggtgatagatgcagaacatcgtaaatgtgctaaatggtacattttaaaacaatgaaaatgggcagttgtattttagatggattatatcacaataaaaagctataatcctcctgctgtgatgctcttattgaactttataaccttcttaaaccacatatgctttattatatcttattaaattatgtatgaaagtgaaagtcagagtcagtcttgtctgactctccgtgaccccacggactatatggtccatggaattctccagaccagaagactggagtccaggggctcttcccaacccaagggttcaaacacatgtctcctgcattgcaggtggattctttaccagctgagccaccagggaagcccaagagtactggagtgggtagcctatcccttctccagtggattttccttacccaagaatagaaccagggtctcctgccctgcaggcggattctttcccaactgagctaccagggaacctatgtaaaaactgtatacagaatgaaaaacagaaatcgttctttttgcataaatcctatttgtgtttctcagtaactctgaagcagcatgggaataattttcagtgataataaagtcttcttatctgtaaaatatcattttggaaaattttcctccaatgtgctgaaataggtatgtttagccaaaaggatgtaggtagagagcagttctgaattcagaagtatagtttctggtcacttaagaatgactcagcaggggtgttcaagtctagccccctagacactactttttacagttttcaactcagcatcaaataaaccacatgttagtcgttacttgactccgatatttcccaggttactatttcaatgtctaccttttttctgagtctcattcatcagtacatttttcttttttatgctctgacctgtatgccattaagcatttataactgttgtccccagagatgctcatgtggaaaaatatgtaccatgtgacacatttaggaaagagataaacactgcccctaagaaatgatcaattccaatttcaatacttgccagaggcttccacactcaacaaaaccgagtgagcccgcccttggcttggtgctcat

SEQ ID NO: 37305 - DNA, 1524 bp, Bovine  19866880711802
atgcacttatttttctttatatgggatagcaatacagctccggcaaatactcagtgttctcgtggaacaaaatcttcttgtgagttggaaaaacatagaagcaaagctaattattttataaataaagatacttaattttagtttccaaacagaaagagctacaactgtagctattaggaaaacagatcagtgagaagaacaggaaactatgctagaaaagtgaaagtgaaagtcgctcagtcgtgtacgactctttgtgaccccatggactatgcggtccatggaattctccaggccagaacactgggctgggtagcccttcccttctccaggggatcttctcaacccagggatggaacccaggtctcccacgttgcaggcagattctttaccagttgagccataggggaagcccaagaatactggagtgggtagcctatcccttctccaggagatcttcccgacccaggaatcgaactggggtctcctgcattacaggtggattctttaccaactgagctatgagggaagcccatgctacaaaagtggcccagctaattaagacagccccagacagccctgttcttcactctgaggcaccccaagttttgcaaagatccaaataatagacctcccaacagtggaatgtgcatagctttcagcttgttccctttggaagccgtggagtctgactccgacaactcacagctgacaagatgtgagaaagttcaaggtcccttctgcaggaaggagcaggtaccagggagtgactccacgttaccgcctgtcaccccagggatgtgactcgtgacttggtgaccttcagacccacagctcagctcacactgtctccagggaagataacatcctttaccttgctttcagaattaatgagacaatttttttaagaacccatggctgcgaagcactaattattattattctaagccatcctcagaataaaccttttgagaggcgcgatctggaggaggtgcgggacccagagaacaaagaggcagctgtgcaggcttttctgggaggcgagaagtgcacagtctcagcacggcatgcccctcggacacgctacaccgtttctctgacaaaagatcacacttgaagggattggagtttctttggtgttatttatacctgaaccgcagaaagaaaaaaaaaaaaaaaaactaaagacagggcatacttctcagtttaagaccacatggaactcagggttccgaatgcctcccccttggccaaggctggacttactcatgaaattacacgctggggctgtgcaattaagcattctctgtcagggaacacatctgggtccccagcctcagcttttcaggatggcaccgggaccgaccgtggctttcttctgacaagggttgagcttccaagtgtccccaggaatggatgcagagttgctgggcagactgcccttgacttgagcccttgctcacctgcatgagatgcttaggaggctggacgtgttctcccaagagaagagactgcatgcgacct

SEQ ID NO: 37306 - DNA, 1252 bp, Bovine  19866880777097
cgtgataccctctgttaactgtagatttggtaaaatgtggatccacttcggtaataaaccaggaacatcatcacttcgggatgacaatcttcagttttattgtcaccctggaacaaatcctggaaagaattatcactgtggatctatttccactgaaaagttgtttatcataatcaaatcactcattactggagaaatgtggtaacacaaagattataagtaaaaagaaaagtatagattgatgtgtaaaaaataaatgtactcaagagtgtgcagtcatttttatgtcatatgtatttgcttcattcccattttcatttaaagagaaaacatttttttttttttacattctctcattagaaaagtatgccctagtaatgggatggaaacccaagaaatcagttcttggtacataaatttgcaaatattgttgattttcttgagaagaattattttatttaagcttatttcttcatttttcagagcagtgtttcagtgcagggttacatgagacaggcattgtcgacctaaatcctgagatatttttgggcttggcatatcttccccaaatataatttctttttactattttttgctctgcaaatagggatatggacctacagcttgattactaggatgctaaaatctagcacttttaaaaggctttaaaggggtgttttttaatactctgggggagtatgttgaaattgattatactcgcctttgaaaatcctcactgttcctttgtttcattgtcattgtatatgcagtaaaaatatctctggaagcatgttgtaacaactgattctgaggatgaaatttatgcttggagagttgttgggtgcatagataaaatgtgtgtgtgtgtgtgtgtacatgtaacacccatgtgtaagcatgttaattttgttcccagaaaactaccttcctggagtccatagaaaacattagtataaagtggaataaagaatacgcttgcaactacatttttcaaaaaacacttagtctatgtatgttttaaaatctcctgtgatccagccctttgtgtcatctcattctcttttttctgcttcttttattatgattaaatatataaaatagaatttactatctttgttgttattcagtcactcagctgtgtctgactctttgcaacctcatgagctgcagcacaccaggcttccttgtccttctccatctcctggagtttgctcaaactcatgtccactgagctgatgatttactcccttaa

SEQ ID NO: 37307 - DNA, 930 bp, Bovine  19866880817531
tcccccgtggcttagcggtaaagaatctgcctgaaatgtaggagtcccaggagagagatgtgggtccagtattcttgcctggagaatcccatggacagaggagcctggcgggccacagtctatagggttgcaaagagtcagacacgacagaagcaactaagccctcaacatgcatcaattatccacctttaacatgtatggaattattcttctccaacttcacagttactgggcatttctaacagaggtcttccagaaatctcacttagactcagatactcagtgaataaatggagttaaataaatgaaactggaaaagcttagcaacttccacagctttttcctgatgccctgcacaagcatgcgatgtctttttctcaaagatgttgatctaagaatatataattagcacgttggtgctgataaagcatcaggactcataatgcaggatacccaagaggtggggcgaacacagagctgctcacgcttgacattttcaagggcgaaattgcctttttcggtacctaaggcattttgaaaccctgtaattttgtctctctggcaacctgcaattttttatttgtttttatttactcagtaacccccggaaaaggaggttcggtgctgagcccacgttcctgcagccgtcaggaggttttcttacatgtattccagcttcaaagcctcttcatcttagcctgacaaccaaagtctaacagtacaaagatgcagagcatttgcactggattcagagctaaatgagtgcttcctgttcacctcatcaccttcatcttctcatttcttctttcttccaactctaccatttctgaatctttttactctgttccctgggccgtctcattaggcaaagatccctatattcttagagttcatccatccatccacccatcccttcatccgcccatttat

SEQ ID NO: 37308 - DNA, 1158 bp, Bovine  19866880830898
ctatcgagttgtcagtcagtcagtttgaagttttcctacaactcactgatactccattcatttatttagtcatttttctctctgttttatgtcatatcgtttttactgcctttaagtcactaatcttgtcttctataatacctagtctgtttttcctttctactgtccatagatgcggttttcctttcttatataagcttctttccttgtaagttagtacaaaaggggagcaaattcctcaccagttgagctccacctccagcttccataattggcactaaagttttctgtatgtataaaagaaatttggaataggagtaagcctatcatggtttattgcaatagtatattttcttttctttctttcttttttttagtgcgctcggtatgataatgtcttcatcgcagagatcctgattgacagaggggccaatgtcaaccaccaggatgaagacttctggacaccgatgcacattgcctgtgcgtgtgacaaccctgacgttgtcctgctgcttatattagtaagtaaagcgatccagtttattaccatttgaagagatttgatggcatagagaagtctagatacttacctaagtatccagacgtagaaaagtctacatacttaactaatactctttgatagtatgtgatacttcagttgagaaaaaatacgtgtgtttatgtcagcacttatttgcctggaattacaagataattaggagactgaggttgtgggtcactgtatagttaggaaagccattttgtagatataccaaactgaattcctctcacctttttcttggaaattgtatgccttgatacctcacaagtcagagctaactagtttgatgattattgtcttctctctcaattcattttcctaatgttcagccaaaccgggcatatgatagtaaggatatacggcttatattgaatcttcttctcatgttaaaatctagcaaaaaggtgcctacaacatttgtgtttccaggaaagtgaaaactttaagtataaaatcactggaattattttgctgtcattgtcttcagttatagctcagatgtagacatggatccttacacatactgtaattactttagaattggaatcctttctgattggtttatctctaacaaagattttaagaaattatgcagg

SEQ ID NO: 37309 - DNA, 1418 bp, Bovine  19866880862051
tgttgcggttgtctgccgaggaaaacggtgcatttctccctctggagagtttcggcttggctctcccagaaactaatgtataagtctgctattgcacttcccccttctggccctttgggaatatgattctttatttaaagatcccaaggtgcatttatttggctacatctcaaagactctgaaattctgtgaccgccacagaagaaagaatacctctgtgctttggcaactggttgaaaacagaattcaaagtccttgtcaagttcagctttcccttagatagcgctctgagagccattgtactcaaagtcagaggagtcatgcgtgccttgagcctctccgtggtgactctaagcgctctctccactgagcaaggcgcttacatcctaggtgatgtacacacttattcaaaactacctcgtgtcaaagaagacacattgctggaaggatctgacatatttttaactttgcttgacattcaggaaataggggagtaaaaatgccctgtgattaggtcttcacaattgaagcgtcactgagtcgaggcccgaacagaaagaaagacaggaagatgaatgcaacctttctcttcatcgatgtgatattgacaaggtaactaacagtatagctcctggatggaaaatggctaagcagggttgacagagatgctggtgagctctgctcggttgcttcgttctaatggatttaccttgggggcgcattggctttactaaaaacattcagtgggaagctgcaatccaatagtttattctaagagcttcacatgtctctttccaccaacaatcacttttgagtacacatgagacagatgtcagaagcgcagagttcaagatggaaaagacatggacgctcttctcaaggcaggctcagtcactctttgggaatgctattctccaattctgcagaatggaacttctgcacttgttcggttttaatctagtgagtgatcagcaactagggggtgattcctgcagtgctgtttgactcccacatgttcctattaaatttttgttcttctgctacaggaagcaatcatcagaagggaatcctcatcctggaagggtaggaggggccccagggtgggcaatcaacaccctttattagattttactcatctcctgagtgacagagtgcattgctcataggaacgcccccaaacactttcctcagccctttgaggagcagttagagcctacgtctcgggccgggaggaacgccatcctcctctttatttcagatttatttcagaaatcacagagctgtctccatgtgtgtctatgttctgtctccatctcatggaaggggggtgttctggcttctttggcgaacaaagtaattttttaagaaatgctcattgatgaaaaaggtgattctaaagttgcaggagatggatgcat

SEQ ID NO: 37310 - DNA, 1652 bp, Bovine  19866880866648
aactgaagcgacttagtatgcatgcatgccgaaactaaaaagatcctgcacgccccggtgaaggtcctgtatgctgcaactaatacccaacacagggaaataagtatattaaaaaataaaaatatcaaaaaataaaggagaagaaatggactcagaggtggcaataaacagggtaaaattcacagagatatgaaaggctggatcttgggcttattttacatttagccaagtgtcacatcttagttttgcaattttggatagtaattttaactcttttcactattttaatatgtctctaatctatttcagaaaaccaagctccccaaaccactcccaggatattttgagtcattctgactagctttttgtttcactggcatacaagtgaaaacatgggactcagctcacagtgatctattctaatttctcagctcactgactattctaattatccaaaacttagcactagctattcaatacccttcactgagttgcatgtaacatggtgtgaatttgtgtgtgttacatagagtatgcacatttaataagtaagttctgctaaacagaatatcagggaatcttgtcagccagccatctttcaaaagaatgtgtatgccaatgtcttaaaaagaagttagttttttcaaataagcctcacagtaattttagtagtctgcataaaactgctcttacataaacaccaaacagaacaaattgcttttcactcagatatactcttaaagaattatgcattaaaactgtaagttttttaaagttaatgttacatgtaaattcattttcaatgattataataagccaacaaatgagttttatgatgtatgggtttaaattatatgttcaaaacgtatataaggatttccccccattaatttaaataaagccatttttctacataaacacatttgaattgaattgccttcctaaaagccaaactattcagttgtaaaatatctatttaatgcatgatataattcattattaatatccaagtttaaaagaagaaaaaaaacaaccactgcaaactaatatcttgtggaatgtggagagatggtaatgagttaaaatgatggggaaattttgatttaattttggttgctcaattttactttcattattttgattgctcaataaaaactctgcagtaatctgctcattagagttgtttcctttaaaagaaaagttttgtgggagaaactgggcttcacgagtgacagattcttcggtcactccaccagggaaggatcactagagcgaaactcacagtgtaagcagccagttccgggtctggtgctcgtttttgcaggtcgggggagttgatggccgacacataagaggctaacatgtcccagcatgctgacgtcactgaaactcacacttacataaagtgtgcatttatgttacatctactgggtatatgggggctgtccaggtggctcagtggtgaagaagactcctgccaatgcaggagacccaggaaatggaggtttgatgcctggtcgggaagctcttctagagaaggaaaatggcagcccactccagtattcttgcctgggaaatcccatggacagaggagcaggaaagctacagtccaggggtcgcaaagaatcagacggactgagcgcacaggcaca

SEQ ID NO: 37311 - DNA, 3636 bp, Bovine  19866880955885
atcatataattcataaggaatgaaacaagtgacttaggtaattatttaagagtggtttggccctgcaagcaaggccattttgcaattatgttttacctgacataacttataattaaaaatattaagttgtatcggtggaggctggaaatgggggagcccagttaaatcaaataatcaataagattcagaattctgggatggaattttttggatgtactcccaaaattttattaaaaataaagtatagctctcaatatactgaattcaccctttgaaaataacttctggtctatttccctgattttggttgtttcatattgaatgctttcttgttgctgtttagttgctaagtcctgtctgtatcttctgagactccgagtactacatcccaccaggctcctctgtcgatggggttctccaggcaagaatacggaagtgcattgccatttccttctccaggggatcttcctaacccagggatcgaacttctgtctcctgcactggcagtctgattcttcaccactgagccacctgggaagccttgactaagtggaatcatatcttggttttgaatcatttagactggtcagttttgcgtatcatctccaatgttgtttgaaagtgaagtctttttgatttcaattttcatatgatttttaaggaaaacattctccattttcaagcgccatttttctcactcttcttgagctgattttcggaggtcgtcacctgctgctgtgtcagcaccacacagatttgtggtgcgtgtgatctctagtgaacacggcagtaacttctgtccaggaaactccacagaattaaccggactgttcatcaggaaaccgagcaaaggccatccagggtcaagagtctagtgctgggtttctttgcccccactaacgtcatagagctgtttgggcatccctgtggtctggcctgtggctgcgaaaggcagtcacgcctaaagagactgcacacatcgtggaaaaagtagaaggagcaggtccttgaggacatggccactatcagcaccaaggcgtgacggaggagcagttaaaaatccgcagggctgaggtgtgtgaggctttggaccaccagcacgctccttgggatctcagttttctcaactctaaagcgggcagggactgataatgcagctcgtggggacgccgcgaggatttgatgagacaacgctttcggtcagtcctgatcaatctcacccaaggcaaaagtcccgcaattattagttatatcgtactaacaggtgtgtagtgagagcagtcaccccaaaaaaggttattctgaggaacagagtcacgtataacatgcagatctggagcttcatccacggcgggaattcaacaacacccatcagtgacgccccaggcactcctgacgggaacttcccgaggcgtaagggcactctgagtcagtaaaacgcctgaataaattaagctgttaagtagcttcagtcgtgtctgactctgtgcgacccaagagaccgcagcccaccaggctcccccgtccctaggattctccaggcaagaacactggagtgggttgccatttccttctccaagaataaattaagagtgaatggaataatgacaaagaagtgagtggtgaaggaatgagtaaattaatgctttcatgggagaccatctagcttattagagtagaaattaggatcaaggccagatactggggataaaagagcaaacatcaaagtcacgtttcacaacctgtccctttttcgatggaaaaacatgccccaaattctatcagaaagaagacaagactagataaagggttaggcacccatgggtcaaaaccacccaccttctgttaatgccgacagtttagcctgcggtcttggctggcagacttggaaaggtcgtgcacgtgataaataaactctcctcacttgttcactgacaggctgtctacgagtcaatggctacctcatggctaccttctgccacgaggcagagctgagtagctatgtcagtgatcttgtggcctgtaaacctcttatagaaaaaatttgcagatctccagtagattagaggggaattttatgattcttaatccattgagcagtagaaaaaattcccaataaagataaacctaattgtatttaaactgaaatggcctcgagaatctattatacttctcattcctatttttatatttcattgaaaaataacaggtcctcattcctccccaacctcattaaactttagacaatcagccaaccctgcagaagggttttagcagaaagaatacgctgagacttggcaaaattatccctgaagaaactatatcccttgccagttacattagaatatttaacagctcctaaacatgttaattctcatttctattaaagatgtattgacagtaactgacatcacttccaaggaacaaggaagacgttcagacgatgccagcctggacctggagctggtgagtgctgcacggcggggcggccttggccctttcattcaacccaatcagctgacgagcatctcctttcatctgtctccacgcacccaatttaacgtcatggctgtgtgccttcacggcctgacctttcagcaacaactgtgtcatttaaacaagctaaatgactctatttctacgagggatctcatccaggaacaatctcaaaacagagatcacaggtcctcaccttgccaagcataataccagtccctgcagtgcttttactggacaagcccttctgtcttctgcaaataaggcacctcattaaagggtcaacctctccccatgttggggatactgtcctgctctcccctccagccacagagaagtccatacacaaatgacgtgcatgacccttccaagtctgccacccaagacccacagcaagatcctcaaagatgtgccttttacatctggaaaaagattaccattcaaaaggctagcaccctgagaagagtggagatacacaggactaaaatctggtatgcccctgcatgaccattaaaaagccacgttacctataatgtcataagcatcattgttccctgttcagttgccaagtcgtgcccgactctttgcaaccccatggcctgcagcacgctaggcttccctgtccttcactgtctcccggagtttgctcaaactcatgttcattcaatcagtgatgccatccaaccatctcatcccctgttgcccccttctcctcctgccttcaatctttcctagcatcagggtcttttccaatgagtcagctctttgcatcaggtggccaatgggtcagctctttctttgcatcagagaccacttgaggccagattcaaggaatgcaggccctgcatacatccagacccttatcagcatccctgcccttgcaccactggataaaactcccctcctaatcccctgggtggttgggatacactggataaaactcccctcctaatcccctgggtggttgggatacactggataaaactcccctcctaatcccctgggtggttgggatacactggataaaactcccccactaatcccccgggtggttgggatacactggataaaactcccccactaatccccgggtggttgggatccacagttttttgagaagtacaatgtgcccactgtatc

SEQ ID NO: 37312 - DNA, 2078 bp, Bovine  19866880966268
ctttccccagcactgtggtttgtgtattactaattgttctgtaccctgcccacagtgttcttgggtctagtcttcattaactggaatatactcgtgcacactttttagcaggaaattactccagcttctgtcccgacttcagttcctatggatactattacaataaacacatttaacatggaagcaaacccagtgtaaaaactaaattgagctgaaacccatgcaagagagcatatttgaattttgtttgaacaaaacacaatgaatgtagctactcttttctcttgctctttaattctgatgaatttttagtatttctaatatgaacttatgtagacacacaattacaacattcaggtgcagacctgtatttacaccgatactagcctggtgttcagcctcagatacaagtttattctggtcttcattatacatgaacttgattttaagccatttcaataaaacagtgaaaaccatacacacactagaagtgtaccatttgggcttttatccttgggtgtgaaagaggccggacagttacaactgtgcctctctcctgaaaattcatatgttgaagccctaaacacgaatgtgaacatcttcggcgataattaatgctaaatgaagtcataagggtggggatctaatttgatagaattgatgtccttataagaagagaaagaaacaccaagactctcgctctctctgtcatatatggacacaagcagaaagaaagtgaacatctgcaagacaagaaagaatttctcaccggaaattgaaatttctaatatcttgatcctggacttccaacttctaggactgtgagaaaatccctttctattttttaagccacccaacatgggctatttcgagatggcagcctaataccatgacataaacctgctgagaaaaataagttgtaatttaactgcgacccctgctgtataaccatggtgagggtggatggcatgttcagctttcctcgggaatcccctcggtgggcatctgcagcaggtgtggggtgaaagggttaagtaatgtttaaccaggatgtatacttagttccctttatctcccggagacttattagcactctgagtatcaattccctaggaatgactaataccttgaatgacatcagcttccgccgacatgtagaggttactatggcaatggagaaagtttgtcagagcacaaaacaaggaccgtgcttgatatattagtcagccagggagagcagtcacatataagctccagcattcattcgatgaatagtcatttatgcagcatgcatgtcagcaattccgctgtgtttttccgaacatcaaaactttggcagttgaattgagaatcttggcggatttacaaaagtgggagcactcattttctgggcctagtttgttgggttttgtcttttttttttttttcattctttatttcttgaaacccatattttctaaaggttcacagggtttcaaatccaagcaccaaagtgaatgttttctgctggggttcacaccactgtccacggcaaaatcagccctgcttttgcttccagtcattcagaacttactttcattttattaattatatgtggccttgttttttagtacaatgttttattacactgcgtctggttctatcaatcattgttaaattcctcctaattggtcttttcaaaaaggctatagagaaagaatgaatgaccaaagtacaacatactataaataaaatattagtaggtaactagtaaagacctgctgtgtagttcagggaactctcgtcagtgctctgtaaaggccgttatgggaaaagaatctaaaacaaagcggatatgtgtgtatgtgtaactgattcgctctgctgtacacctgaaactaacacagtataaataataaagcaacagtactccaataaaatttttaaaataaaataaaaaaattaatggccaatctatcctcatcaggtagggtgtagatctgacttcagtatgtgggtaagaaccagttccttccccgtgaacagattgcttgagagagaaagtaatcattaaacccagaaccaaagcaagttctcta

SEQ ID NO: 37313 - DNA, 1174 bp, Bovine  19866881275483
cagaggggacaacatggttggaaggcatcactgactcaggagacatgagtttgagcaaactccagaagatggtgaaggacctgtccgtgctgcggttcatggggtcgcagagagacgggcacgactgagcgactgaacaacagcaacaactgttttgagggtaagtaacctcaggtgtccagctggatttcgaaaatatcccgaagttcacagcagaccttctgcattaaatccagctctcttttgctcatattgttacaaatctggcatgcaagctcagtcactcactcatgtcccattctttgcgaccccatggactgtagaaagtcaatctatatagtcggtcctgtgtccatgggatttcccaggcaagaatacttgcctgggaaagtatgtagtttagaattttcaacagcagaaaagttgcattttttctttctggtacatagacctatacatgtgcctgactgctaagtcacttcagtcgtgtctgactcttttcagctccatggagtgggttgccatttcttcctccaggggatcttcccagtccagggatcaaatttgagtctcctgcatctcctgatgcaggtggattctttaccactgtgccccctgggacgtcccaagtaacaaatctggcaacattatgaaaagaattctactgcacgcttcatcacccatgttctgaagatgcctactccttatcaggcagaaaggaaacagctcagggaagaaagagcttgtgggttgttcgcccagtatcagtgaccaaaactctacaatgtcaagatcttaaagggttgcccttaaggccttcggtccacgagtgctcagtcctgtgaactcacccggcccgcgtagtgcatgacagtgaaagctgcgccttggtctcggagggcgaggttcccatttccatccttcacgggggagtagactgcatttgtgtttgaggattctagcagaccgtggagctttttgggaagacttggttccactgaccaaatcatttgactttcttcgtccaatagagagagaaatccagaaggcttctgaaagttaaaaagacagctgtttttcccttccattcctcagtctgctattttcgttactgttcacacataccatttgcagcctcatcatgttaatacgatcactcagaacatgagtttgc

SEQ ID NO: 37314 - DNA, 1119 bp, Bovine  19866881334748
aagagctgactcattgggaaagcccctgatgctgggttagggttaggagaaggggacgacagaggatgagatggttggatggcatcaccgactcaatggacatgagtttgagcaggctacagaagttggtgacgggcaaggaagcctggcgtgctgcagtccatggggtcatataaagttggacacaactgagcgactgaactgaactgagctggagatgcagacatagagaacagactcgtgatcatggtgtgggaaggagagggctggagagatagtgggagcagtgtggagtcacatacattaccacatgtaaagcaggcagccagtgggaatttgctgtatttctcagggagttcaaaccagtgctgtgacacagcagaggggagatttggggtgggaagtgggagggacgtgccagagggaggggatgtatatgtacctattgctgattcatgctgatgtatggcagaaaccaacacaacactgtaaagtgattatccttcaattaaaaataaatttaaaaaaagaagggataatgtacctaaatattttattttgtatttgaaagtattcagactacagtagtagaaaggagcactggagagggaaacaattacatgaaaaaatgcatgttgtcagagtcagaaaataatatttaacccattagcttttttccccaaagaataatgatgtccacttgtacaaatacaattatatataacttcttttttaaaggtctttgtattttagctccaatactttattaaatgcatctctttaaaccaccagatgaagtacatcgctgtcactgctctttcacgttcaatgactaaggctgtttttgttgcagttgcacatggcctgcgccagtggctacaaggaagtagtgtctctccttctggaacatggcggggacctcaacgctgcagataatcagcactggaccccgcttcacttggcagcaaagtatggccaggtaaaatatgccctgaattcagttttaaaaattatcatatgatcattgcatcatttcatatttaatttttttcaaaatgtgtgctgacatgatgtgacttgacttttaatgggattgttttactgagaaaatatgttttt

SEQ ID NO: 37315 - DNA, 1214 bp, Bovine  19866881380157
tttctgcttaatttttctgaacttaaaaaatttctctgaaaacaaagtctattattttgtttttttaagtctgtttgaaaggaagctgcattcttttctcttctgataatacgtgtaaatgtacggagctgaaactaataatgccatttaacagaattcctcttcttttctttaaccagccagaatcttcacgtatatgctagagaaatccagactcgtttcacagccccctggccagagcaattttctcatcttctacctgctgatggacggattatctgctgaagagaagtatggactgcaccttaataatttacatgcccatcggtaagtgattatgtgttttcagtttgatagttctgccctcaaattgtggttgtgttttagcagtcttaaagtttcttcttatttttcagagaagaaatggtgacttcttttaggagcataattggatgtactgttaggtttgaactatctgtgtattaccatttattgagtgttcaggtgaagtctggtgtgtgtgtattatctttttctagttttcagatcagaataatgggttagcacatttctaagcgtttgtgttcccttggatattttggatgtaacagttatgaattcctaatttggggttgtcttttgaaataatgggacatggtatttgagcaattatggtgcattaggaacagatgaggttacataatggcttcagatgaaccatgcccacaggctgggggcactgactttctgcaggggaggcagaggagggggccttggtcacaggatggccgtgcaaggggtgactcggcgacgtatgcgtttttgccgaccacctgaccctgtgtgtctcccttcatggacgggtccacacttggagaggatgagaatgagccagcaaggagtgggaaccccactcagacgaggagtgggggagccggggggagagggtggcgggtgggcatgtccaaacccagtggtgaattcctggccgagcagcgaggaggggccgcgctctgataaagctgtgcgttaacttcaaacattcgctgacccctgacaactggctgttgccggctttaagaagaatgatgtacttgtgattttatgagaatttttgtgagagaaaataaaggatgcatgagggggaggaggagggcctcccaggtggggatggtggtcaagaacccgcctgccaacgcaggagagtcaagaga

SEQ ID NO: 37316 - DNA, 1440 bp, Bovine  19866881404528
ggtataatgttatctataacacagcctttatccaaaattttccgttttcccactaaatcctttttttattccattccttttagaagcaactattttaaagagaaaatcatagggaacagaaagcatgtctttaaagtcatttcgattcagtccaggtactttaaaatactttgggcagtctctgctgatgatttatacgaacacagaaatccacggagagatccccatggctaaggcattctgtcatattttgggatataaaaggaaaattattcaagactatcttctgactggaagtaagactgcatgccaggagaaacagttatagctgctttgaatgagaattcaaagcggaagaggggcttcaaagaggaacacactgaaatatacaagatgacatttttacccccagcagctgagaagcagctctacgttgtgtctgaaaggctctccccctctccctccaggagtggatctcacctcactgcggcagatgaagcttcagagaccggtgagcatgttaacggacgtcaaacacttcctgtcctgtggaggaaacgttaatgagagaaacgacgatggcgtaacactggtgagtcacaaggttctctaggagacactgcttacaacgcaaatgtgcatggatttcgaaaacagagaattgggtaccattaactcctaaataaggttttttatttttctgattatatcagtaatacgtatttattgcagaaattttgcaaaacagaaatgcaaaaaaaagtgcaaataacataccatcacccaatatttatctgttgatatattctctttaagtcctatgcatgtttttcctacaaatttagagtaatttttatattatttttgttagtgtgagacttctgagctgcaacttacaggagactgttttcattttaagcaaaagaacctgtgttactctgatgaatgaatttctaaattcaaacaaacgcctgccattgctttttaatgctctcaggcatagttgcattaaattgaacacataacaattaaatgtggactcacttggatgtaagcacaatgtcttatcatcacaggaagaacatttggtcctattgacccataaaaattacttggatcgggcatgctggggttagaattaattattatggagatgaatgtgttgtctcaagaaagtaagctacagaagcaaaagggaaaagctctgaagcaaggggtgcacagaagcagttgcaaccaattttagaaaatgattccatttctactatgggaaaatacggtgtgaggttgaacacagtagatgaggaaagcagtgtaactgagtgaataagacttgtgtgagacctgatacctttgtagatttattaagtgcaaattaagtgctttgagacttctcaatagagttatcttcccggacattgatgttcatctttggaatat

SEQ ID NO: 37317 - DNA, 1067 bp, Bovine  19866881636499
agttttcatgcctatatgtattccccacaaaggtgactattgtcccttccatattatcgtgattgttttaggtcccctttcaatatccattccaaacacatgttccctgaatgatgttacttaaatttaacattattatgtcttctgccaaccttcatcttaggaaggaaccattttctacaaatatcactcatcactttcagacaatgacatatatgtacagaactttacagaagtgctacaggagaaaaaaaatgcatgtctagcaagctatttttaccaaaaatgtctccctcttcattataaaccagaaaaggcttagatgcagcgtttatctagctcagaaaatcctgttaaaaattcagaaactaaagaaacccttcatgaacccatgagaaaagccagtgccaaactatttttcaccaaactagcatcagtgtggagcgtctggtcacagatgttacctgagtccctgagtacggcaaggtgaacggtacaaggacaaaagtttacagtcaaggataaacccaaggtgaagctcacaagttaagcatgaaatgtagacacaagcagcacaacctgagaataaaataagcaaatggagtcagccacgtattaacaagctaagtttctatgcccacattttattcatatatgcgtatacctagaaataaaccttataaaattctttttcaataactgcttttttaaaaaaattgctgtatcttgttcttcaaaagctagagttctaaagatttcaatactatcagcatttggatcacactggaattatttcagaatccggtaggaagaggacattcatttagcatgtgaaacacctttcaaagtcaccattctctgtcactcaggcacatgtggcatgccagcagaccggctggcatctgcataaaatagtatttcaagaccacgaataatccgatgagccaaagagcaaggttacttacagcacttgataaaatgagagtgaaacatctttccatctcagacagaaatcttgctacgggttccagcattctcttcggctacaactgtcgtccccaggaaat

SEQ ID NO: 37318 - DNA, 1312 bp, Bovine  19866881765806
ctatttgtggacaaacgtgaatggctcttcatgaaaatgatgatactgctgttaacagtgggaactggaatagtgtcttggggaatggatgggcctcttggagcccacagagtgtcacagaagatacattaacaacacagcctatctcccaaggcctgttgcattccatgccctatccggcccacctctgctgttcaaatggaaacacgggtcactttccagctgtgctgttatcctgatgagtggcatctattttgagctgtctgacattgctaatttagctacaaatggctttgggagaatgatggaagtggggccgaggggtaattgcacgaaggaaagcttaatgtgcaaagtgtcagcttttattgttttaagccaatgagtcctaatgagtttaaaaaaataagagtgagctaaagcatacatgagctgagtgaagtgattcccttctttttgcttatttctccttgatctatgatagaagcttaagccaggcattttgaaataataaattgtaagagtgtggtcccctttgggaatagtttgtggggctgaaataggtgatgatgttggcaaaccaagaaatggatttcaatgtgaagagaaatgctgccaaggttaaatccccaaaataatgttggacggtgattcgtgcatcttctttggctttcatggctgtttgggatttagacacaaatgaaacgctgccccttctggttcacagtgtggaacaaagacgtgctgtaactcccctctctcattcttccagtgctgcgactcctgaaggagggggccgacccccacatgcctgtgtcctccggagggtccctgctccatctggtaagagctgtgatgcccgggtgggagtgggtgacatgctgtggaaggggaaccaactgtggactccaaactccgcagcggaatgcacttgtaacagacgacgaccagtgcagtgatgtgcttcagaggaacaggcctgaatagtgacacgctgatgcttgttaattactcgtaatatagtttgtaaattgttgttgtttagctgcttagtcatgtctgattcttttgcaacccagggacagaggagccgggtgggctgcagtccatgcgattactcaggcaagaatagtggagtgagttgccgtttgttcctccaggagatcttcctgatccagggatcgaacctatgtcttctgttgtctactgaattggctggaggattctttactcctgaaccaccaaggaagctcatctttctctctttctctccctctctctgtcaattaattctatacaaaattatcaggag

SEQ ID NO: 37319 - DNA, 1062 bp, Bovine  19866881869568
atgtaacagagggaatgaatatttctgaagatgatcttgaggcattatagaagccaaaatcatttctaaataaattgactttgatttagtactaattttgctttatcacatgctaattatttaaaatttcttagtattatgtcctaaaggtaattctctctgttaggttattataggagcctacatatttattccccaattattttaaatgaatctattatcttaaatctgattataagaagttttgaggcagatcattgatttgaggtggagttcaaatacagttttggggcatgaaattacaggtaattggactgaactgaatcctaagtgggaaagtccctgtgatgctggattaccttttcgtatagtgggcgtgtcactgtctgcaatcagctgcaagcagtcttgagtgactgaaaagcaaaaatatatcatttagttacatgaatagaaatagggaacgaagacgaccaagaatacaaagctacaaacccactcttccaatggcccctgatcaatcatatcaatactttctcactgcctacgtgctgttcttaaaatccctttaggaaatatgcccacagatctcaatataacttctactttaaatgcaatatgtatatacttgaaattcaagttttagaaaaactctatgctattgaaatatagtagttttaaaattattttgccaacaagtgaagtcctgtctcactctttttgaccccatggactgtagcccaccaggctcctccatccatggaattttctaggcaaaagtactggagtgggttgccatttccttctccaggggatcttcccaactcagggatcgaacctgggtctcccgcattgcaggcagatgctttaccctctgagccaccagggaataccatctaaacagtttagctgaacttcttctaaaacatacgcctgtatagaaagaaagtttagctactgtcattttggttctccagttccctcaaatatacgagccaaatgatcagattcctctaaaatgattttttggtttttttttttaaatctaacattaaatcataa

SEQ ID NO: 37320 - DNA, 1267 bp, Bovine  19866880370314
attgaggacactcaactttgaggaaattgccccttgttgtccaaactgtcagtgtgagaacagaatcactgacctcttgaatacagagcttggctggcagggccagccccccatcctgagaggaggaagcactgatccagggtcacacagcagaagtggcagccagaccctggctctccccatgtcccatctgctccctccccactagcaccagggccgctctatatgccgttttccaaagagggttcccggctccctcgtccctgtgagagcaggcaggcagacgcttcttccctgtcccctctctccagttgtgttttcctcatttactttcctggtgacagtcacgtggcttttctcttctctgaggtttctctttttccttcctacagttctgagccaagaagaacactcagggtagggcagtgagtggacgggaaggcactgcccggacgccacccctggacgccaccaggcccacagctgctccacggggcacttgtccctgccctccttgtctgggctgcaagcagggcaccctgtgcaacacgtcccaagccttggagagcccctggatgtgaactggagcttctgggctgggagggatctaatggagagggtcaggatggcctgtcagctgtgtgcaagtgacccatccccgttgttgaagtgccacaggcaaggtgtgcttaaccagggcctgttcttaaccagggcctgaaagagatgggtggcatttcagggggttctgaggagctccagtaccatagtcttttatgtctcagcacagaaagaattcaacgagatgcatagtgatagataaggagtgatatattgaaataggacgtttgtgaggcttacaataggccaggtgagagagtgccatgctcgagcttactgggctacagttttataatcaaaagaaaagtagggacagggagaagaccttctttgtctttcttgagtagacatcctgcttccatcatcagcttctccaagttgagcaggggagttttcttgtccttccatggtcaagctagggccacaaattattgttttttatgtgtgcagagaactgtcctaacttactgagctcactgggcaggatgtggtctcaggccaccattgttttattacctgggggcgtgtctagtgcttctagtgcatgggttggttgctaagcaagccggcttgcttttgtggttaagcaaaccttctttttcaagtaatcattaactgacaagggtctgctatatttttctattta

SEQ ID NO: 37321 - DNA, 1704 bp, Bovine  19866880532386
tgtgtctcctctgatttagagtctgtgctgtgtgcgctaagtcacttcagtcgtgtccgactctctgcaaccctatggaccatagccctccagggtcctctgtccatggggattctctaggcaagaatactagagtgggttgccatgccctcctccaggggatcttcctaagggatcgaacccacatctcttacatctcctgcattagcaggcaggttctttacccctagcaccacctgggaagcctccatttagagcctacacacacacacacacacacgcacacacgcacgcatgcacatccataaatcagagtcctgtccttggctgactgctggcctaatgggctgaaaggcagcaatggcctctggattataaatatccctgtcctgacagggcttttagcagcctggtcaatagcccatcagactggctaatgtctattaatgtgggtcctcccacagaaaccctcttaggcacagggccgaccagcctctggggaccgcctgccatcctttgttcactaagaaggaagagaagctgtgtggggctggggcctctgctcttggaggcctgggaggagtgcccaccagagccaggcctggctctcaggtacctccgagtctgaggctcacagagctggagtctggagtctgaacggggctcctgggcacattgcctccagtcagccaaggccagggacaatcagctccctcgagaaacctttctcagggcagaaactggggcttggcctgggccagagtgcagagatcaaggccttgagagcacctgggtaggccacagccaaagacagtgctgctgacttctttggccctttggcccaggaaatgatccaagagaagggaaaggctgtgtgcaggaagcgggtcaggacactgactcagacagggctggtgctccctcagaccacagtgagtatgccacaggctcgccctgggctccagcccaactctgcccttcaccttccccatgaccctgggcaagttcctcctccagcctgggcgtgggcgtgggggtggggatggtcagtgatccattagtaatgcctgccacaggtgcatgccagttgagctttgctgtgttttttaccattcctgatcgcagagcccctcagacactgcagttttatcagaaatttttagctaatcctgcaaggacctgatcttttcagaaagtctgtagtcttgtcttaaatatctttttttaaaaaaattatttatttttaattgaaggataattgctttacaatgttgtgttggtttctgccatagatcaacatgaatcagccataggtatacacgtcccctccctcttgaacctccctcttaaatacctttttattgcaaaattttacacagtttttatagtttagaaaaaaaaattttaagatacagaggatgatttttaaaaagccacacccatttagctcaccatatagagataaccatgaataacagtttgatgcatttccttccagtctttttttctcaactttagtgttcatgtgtgggacttccctggctgtccaatggttaggactctgtgcttccaatgcaggggatgtgggttccatctctagtcagggaggaactaagatccctcattccaagaggcacaaccaaaaacttttataaaaaaaaaaaaaaaatatatatatatatatatacatgtatatatacacat

SEQ ID NO: 37322 - DNA, 867 bp, Bovine  19866880727847
cccttgggccctgatgagagaggttaaagtgcacaatctttctttatcgtgtttgctgggaacggacattctatgattagctcgggtgctccccttattatggggagcacctaataggaacacaaagacatggccgactgtgggtgaatgctgcagagcgtgtctgcagtgacgtgccctaaatccccacggtcccggaatgggtgttattgtgttaatgtgtgagtcagcctactccggtaccccagccctcggcccgcagagctgtgcccggccccacttcccacaagactccctgttccaggaaggctgcagttggccggactggccgctggaggcctggctgccctgcctgcctccttccccagaggggagaagggctggcctggggggccacagccagtggcatgtgtggagaggcagaggtggtttctccagaagccttcgcctcttttcaaggctgctcagggccactcagtgacttctagctggagttctagcaactttctccttgtctaggatttttttttttgcaaagtttcaaatatcctagctcctcttcctttgcagacatgaaggacgaggtcattttcattcctcttctttgtgaaagaataaaaacttcacaaataaggcgcgaggtcaggtgccaagtgccccccatcctgtgcactgcatgccatctgagcagtcccacaaggccagccgtggcgccagcttctccacagccagagctgacagtgttcctgcagcagctgcctctgctctgtgtggttctgtcatgggggaggccccagccccaggcctcccacccttacaggcccgagaccataactcggaaagagggtggcacgtgtctgtgacggg

SEQ ID NO: 37323 - DNA, 1371 bp, Bovine  19866880747401
cccaaaggttaccctcctgaagacatctttagcctggtaggcaagaaggtcctggtcactgtggaagaagacgaccccatcatggaagaattggtagagaatcatgggaaaaaaatcagatcttaaaataaagtgccattctctgaattctgaatcgccttgctggtaccatcaggtgcatttggctgaggtggggcaggactgctggtctctggggatccccaggcagcagacattttggggccaggccctgggttaagcccattggagggatacaaagagcaaatataggcagcctctgcctcaggttggctggcccagaaggggcagtgggctcagaagcttctcctcattgcccattgcagtgcagaggggtgaatgctagctgtatgggcccttcctttcagcctgccttcttccagcctgcaaagccaaccctaatgaccccaaatgtcccttccttccggctctctccccttatctcctgcctgccctggtttttttttttttttttaatatatttatttaattggaggctaattactttacaatattgtattggttttgccatacatcaacatgaatccaccacgggtgtacatgtgttccccatcctgaacccctctcccacctccctctgccctggggttcaatccaattaactatatagtgatcacttggcattagagaagaaggggttggtcagggtcttacaggcagaagaatgagcaaagagagggaaacggcatatattccttctttcaacaagtgtggagggcttgccacgtgccaggccctgctctgtggcctgaggatgcaggacttccgttctgatggggatgaatgcttcacaaaccaggagcacaggaagtaaaccacagcgtgttagaaggtgacatgtgcagtgaggtgtgtgagggagatggggagcgtggggctttgtgtgtttgcagcttctggtgacttgtacgtatgccagtgatgctaaaatcagcctttctaggatctgcagtgaaattacacccagctaacaaaatagcctcactgctggacttccttgaactacagcatgaacctttcacagacattccgtatcatattcctctttgttcttttgaaccaatactgagattattttcagattcttaatctttgtttgtatttatttgacctggttactgtaactcgtgtttcagagtgtgtcttggagtctctcttcaaatgtgtgaatttgccttctgaagattctttacttgtgaagatagggcctccctctcctgtgggtcccaagacagtttctggaaaggcatctacctgcatttgtatgtgtgggtggggtggggtggggctctggggtcatacgagaatcca

SEQ ID NO: 37324 - DNA, 2563 bp, Bovine  19866880819128
gaacttggagtggagctgctgtgggtgcaagggggaccaggaccgttttcaagcttccacttagcaaagccatacttaacacaggaagggtatttaataaaaggtactgtccagatagaaaacaagacagccccccactgtggtgggcatgtcccctcagtcagctttccagttgagcttccagagtcgttggctttcattttgggggacatggttttctgttgtccattttggacatgccccagaagcaccttcccccaggcaaactggcccctcactctttttgttcccccgtacctcagaccagtccctgtcacagtgtctgtaaagctttggggtccctttcaagctggtgagctaaaggcaagggcacccagcctgccccgtccctcgccccctaatgcagagcggacctcagtgcacaccgcagggagggagagaagaaccaacagccccccagcactgggggtggggggtccgctcctggggacagggtctgggctggcagcaggtgtcagggccaggtggggcctatgctcgctggctggtttgttcctgggcgtgatggtggagactggaccatggccccaagttaccctgagccccacgtgccctcgcaggagtacacagccactgagcagcagatacagcagcagatgagccttgggggagctgtgccaccccgtgccccactcatttgagcccgtcaagagcttctttaaggacctcgtggaagccatgcagagcctgctgcagacgccactggatgtccgccttaaggaaagtaagtcactgtgtgaccaaccttgggtccttcactccctggtcctgtcattagagatggtgcagtcatgtctgaatcatgtctctcccgcacagaggcccaaggctgggcccaaccctccctgccaacctcacctcctactcattctgagataggtcctgtctctcacagccgctctgctctattcctgcccctcagtcgctcccggggtcctgcctcacctcagctctgcctgcactcagctcccagctggacggaccaactccccccacctcctctacctggtcaaggcacttacttgggaagcccttccttgggctcccttgctgtctcagccatctgcccctctgctctgggcctgctccatctcctgcctgggggtgtttgtgagctggatatatggcccttctctgcctctcttaaatgcctggagggcaagaaccactttgggtccatctctgaggtcaccatagggcctgacacaaagcaggtgctcagaagtatccattccttcatctctgttattcgttcaaaacagttattgagcccctgttatgtgctgggcacagcagggtacaaaacagtgatcctgtctttgtggtgctcagtcttttaaggggaagacagtcaactaatgaatacgtatcagcaataagaagtgccttgaaaaaataatactgagtaaggagaatagagggtgaccaggagaaagagctattttctatggggaagtggggaaggcctctttgagaaggggatgtgggaggtgacttgaagcatgagccagagagcttagtggtcacaggcatggactctggagccacactgcctgggcttctatcccaggtccaccacttcctaaccctgccatctggaacagggcacctaacttttccatgcctctgttcctgcatccatagaatgaagataatatagtcccatctcatagagttgttgtaaggattaagtgggttcttacatgtaaagtgctcagaatggtgctcaggcgtaataagctcccgtgagcactagctagtattgttactgctgctgttacgtcttggggaaaatgtcttctaggtagaggggaaagaaagtgcaaaggtcctgaggcacaaggcaattgtgagtttgacttgctggaggaagagcaaagggcggggggcggaagcagtcaattggagtagatgtgggcacaagagggaagaagagagagagataccaaggaaactccaaagattttgaactgaacaactagaaagaagttgtcatattctgagatgaaaaagagcacttagaattggaaggaacagcccttttggctgtctgagtagcatatagggatttgcaagagcaagtgcttgacaaaaggcagcaaaaaggaaccaagaagaaagtgagtggttgacccgttttctaagaaaggttatgaaagcagcagctatgttccaaataagaaattttggaaaaaccctaatcacaagaactgtagcaacccaaattgcatctgatggccttgaaggtcacctcttgaagtgagtcttgctgatctgtaaaatgatgaagctgcgtttagagaattaaagctaattcccgaagatgttaagggcaaaaactgcctttcatggtatggatcttatccatgtcaaaatacgctccatgatcaaaaaatggcaaaccgtgattgaagctcacgttgatggcaagattaccaacggtcatttgcttcatgtattctctgtgctttgctaaaaagcacagcaagcagcaccaccccat

SEQ ID NO: 37325 - DNA, 1401 bp, Bovine  19866880907953
taggtgtcctgtaaatgtttgctccaactcctggcccttcataatagatgtgattgctaaacacctataatctgttctgaaggaggcaacataaaacaatacatggagaatcttggtgaattattttctgatcctcctggaaaatctctgtcctctaaaataatccaggttctggacattttgcggtaacaaagctctaaggctgagggaaaccccttccctagaagaaaaatgctagctagttgtttgcctctaagaggatttatttaatgatggggtcatggggtagggaggctggaacattctttggttatccttgtgttccctgctcctcctaataaaggcttctgctacggagatttgctcagtctagaacgtgagttgtccagagctcaaggaaattcagcaatcactgaatctaccccacttcacaggtaggggaagtgaggtgcagaagagggcaggaattgacctgagctcacaggatggggtgaggaagaaccttcgctgaatgtacgctgacttgagtcttggggcttttcctctggaccacactgctcctgtgttagccagactctggtattggaaacttcagtatcattattttaaaagctgtactttttaaatgaaatgcttattcagccgtagtaaaacaccaagcgcttctttaccataagataacttcttgtaaataacagcactacactcatctctcctataattacttccttagggcaaagtcctcaaagtagaagactaggggcaaacggaagttaggaccattttcatggacttttggaacaagctgccagattgccctgcaaaattaaacgctactggagaatccctatagctttaccagcatagagttttatccttttacatttatttctgctaattttataggaataaatagagtgctttcatttactatatggtatgtgttttcagacacacacacactcaagtcctggaatcaagatccctgggcttggttgcttgtctgctgtgtgatctttgacaagtcacatcccctccagggacagaggatatctatctgtaaaatgatggggttgaatgagatgattttttaagattcctttcagcttagatatttcataattccatggtgcattttaaaattattgacctaggatgactgtttaatacccaggatctgccatagctctaaatcaaggtccaaacagcttggactagtggaacaggaaaacagaacccgaattatatgcaggtagagatgacaggagacataggtagcacttaagcctgttcgagggagctgcacttgagtgacagtacagatacttagtctgcttttacgagggaataataacactcatctatggtctagccctcaagtcccgtgcagctccaccatgg

SEQ ID NO: 37326 - DNA, 819 bp, Bovine  19866880438057
attattattttttttttaaatcctgttgctcatcctgttgtatctacatatttagttatcctcagtaatgtctgagacgttactgagaggacttaaacagtcagaaacgctttctcattagtaacacgtgtagagtatattaaagtaccagttgttaatgggcaataagagaaaatgtcagcaattttactaatagtttttatctaaagttttctctttgtttgcctgtaagattttaaagaaacacttgtgactttaaccttcttcagtgggtttcttatctctcaaggattccaggatgtaatttatcttaaataagagcaaaatgaataaatttcttagtacaagggttaatagacaaatgtcatctttagttactttccctttaatttgaccctttttgccttttgccagactttcgaagataacataagaaaaaacaggactgtgattagtaactggataaaatatgcacaatgggaagagagtctaaaggagattcagaggtaaagtcactgagcatgtaactctgtaaatagaaattcttaagttaccagatacaaaaacatagaagttaaagcacgtgtaaaactgtgtgcctctgataataataaaataaaaattttcagagtttgttcccttgggaccctaggcttcctttgaggggcctcaggaatgctgtggtgggctggtccaagggaggaacagtggaggaggctctccaggtgattctcgtcaccagcacacactctgcagccagagaaatgcagttctatccattttctccatattgggaaatttttttttttttttttaaga

SEQ ID NO: 37327 - DNA, 1161 bp, Bovine  19866880444518
ccgtgtggcacgactgccgagcttgtgctctagagcccaggagccgcacctattgaggcctgtgtgccgagagccagtgctctgcaatgaaagaagcctgcacatctcaactagagtagcccccacccgctacaatgagagaaaagcctgcagagccaaaaaataagtaaataattgaaaaaataaagaggacacctaggctccaaggagtgatctgacgcattgagatcacatggctagtaaacagtaaacctctggaccaactccagtaccagtgcccatgaccaacatataccccagagcaaacagggtcttacggtattaacttccacaaagaaccagtgttaatgagccaaagtataaacaaacccaagtctccttggaaaagacacaattatccagaccacaaacttttgttctgaatactatgtccctagaaaatataaacgcaacttatgaagcagaagttgacttctgggccaacatcagtgactacatggcccagccagaccacagccccccggcagtgcagcaggcagacccatctgaaggatatagcgctcatagatggtgcgggcccggtccacctccttgtatctcagctcgaagttgatgtacgaatgccaggcctgctcctctggccgccactccatccagcgctcgaacacctgccgggcaccagcgatgttcccgagcatctcctccatgtacgtgtacttgtaccttcaatagaaccatctggaacttatcagtcacggtcaaaatgacttcagaaaaaaacggtctttggcaatctctggctctaactttgttaacacatgagagtcagggctttatcttcccaaaaggtgaagtcaaacatgttttcctattaaaatagaaatctgaaaaggatcagacattctgaaaaggatcagacattggaaaaaaaggatttttctcctcaaatgttgcttagttcaacaaaaagattcttttgtataaaagactgtaaccaaaacttcagttttgattacacagctattatatattgggattatgacttaatagaccagaggacattaaacagtaatgagtgtacgtttaaagaaaaagtaggatgcaagacttaatacatatgattacaactataaataaaataattacacagggattccctta

SEQ ID NO: 37328 - DNA, 2491 bp, Bovine  19866880537155
ttgggggttactcttgatgctgcctgccttcaacatgactggtagaagcatagggcggtgacagcaaatggctgaggccggcacatgatacagtctctagctgatcaatttccatccaggcctaggatgacataaagatctgcccacaggtgaccaaagcccagtgtttcccacagagctcggtcatttctacataggcctacagattctgagcaacgtgtctaacaggacatggacaaagctgaaccccaaaccccaagtgaccccccattctgcctgcctggtgattgctgctccctcctcccatgacaccagcatccctgctgacaccctactgctgcctgcacagacaccatggagatgcatccaccccaggcctcctcctctttctgccgtgcagcagatgttaacctccttctcagagctgtgcagctcatgtttaacctcccctgttcagagatgctcatgaagcacctctgcgtgtgccccacccaccccattttgctgcagcaacataaagaaccaaactttgtcctggagtgactacgggagcattcccagttgtctctgactggtgtgctatcatgctgagaatcctattttattgatagagaaaagttgagactcacctcttgtggggtcatggagaagtggattctaaggtggttttgctcttgtataatctcaattagctggccctccatgtcctgacaccccaaacaaacatgccatctaggtccaaaaccctttttctttgttccacacacagattcaacaagaatgccagccctgttctcccaatcaaatcacctctccaaagaccctcctgcctagaaatgtggagcctccactttctggagcttgtttctccttggctgaggatccaagggagctgcttggtgaattgcctttaccaacgggatatggcagagatgataccatgccaatgcggagcttagggcagcttctgattatctcatgggacatttctagctgccatgtgaagaaacctaagctagttccctggaggatgatacaacatgtgaccccagctgatagccagtcatctgcccaaagacaggcacctggctgctgacaactgatgagagacacatagggaagcctagccaagactggaagaaccacctgggtaagccctgcccaaattgttgacccacagaaccatagctaaataagtggttgcttatataagctactaaaacagaggttcctctgttacacagcagaagcttactgatgcaatatcattcatttagagctaagatcattaatgggccctgacggtggttagtcatcattactcaaagtaggactttagcaaactgtaaagtacttgtgaaagaagaattctgtgatcagctttgaaagccatgctattacacttcccatatggagattcatagcccaaatttgcatattaaaagtttgtgagaaaccctgcatttagcacatagtcagacaataacttagcatttctgttcccgatcaataaaggagccttgatttccaacctgaagaccacagatcctctgagaagcccaaatgattgtactggggtcaggtgttaacctggagatggtggcaggtggttgcgacacctctccaatgggaaccaggtgtccctatgctatggaatagatggtgtctctgctcttggctcctgaccacctggaggcttccttgtacctgctgaggctgcaggacaggccaccaagagggcacatgaagcagcttccagaaagaactgaaataagacaagtgctgcctccagaaggtggatgagctgcctggaagtcgttgccaaaatcctctatttacagaaaatggcactttgtaaataccaagctgtgctatttatgtagctgtttctcatcaatatatgtgggaattctgcaattatcacgagtgctcttcaaaggcttccggaattgcagacaaatgagggtcacagatagagtcagctgagccccgcaaaccctatgcccccggctcctgctctttcacatggcttggctgctggtgaaagagcaaagggcagggcagggccaggccagagccatgaccagggtctagccagatggcccctctccttggggcatggatgggggagtaatgtgggcggaaacaaggcactcaggaatctggacatggagggatcagtccaacaatgaccagcccaccctggtgctggacacaaggctggtgacactgccctgcagcatggccacagtccctgtgtccaccctacaacccctgggtcctctggcagcttaaagaactgggaggtttctagagctgtgcccagaaataaggctttggaaactatcaaacactgtgcctactgaccatgcctggagtcacttccaatgtcatcactcacatcattgccatggaaggagacttccctccccatcgcccaccaactcaggagccctgcaccggccccaaccccagccgtcaatcctgcact

SEQ ID NO: 37329 - DNA, 1786 bp, Bovine  19866880558660
tttctattttctgcctaaacatatatagatgtgtctccttcctcctggcttttcttagctgctcatcaacccagatttttctcaaagatttcctcctcttgtgagtcttgaatccttgtgggaagatttttttttttttaccctggagggttggcaaagcccaaagaattgcaaaaccagccatttgcggaggattccaaggtctggtggaagttggctgataggataggcttttggcaactctctttttccttcagaagatttctgtttcttgagcagaatagttttggaggggggaataaaaggacacagacgtttatcctggaggaaccggggtctgcgagggttcagaaaatgtccctgaagtcgcagggcaaatgggtagtcctgccaggaagggaattcgagtttttctggcctcttccagcgttcagtttctgtagagcttatttggcaatggttttattttctcattttcaggggtgttacacgtggtcccattttgtgccatctgagaattaagtattgaggattcagtggaaggagattttctatgcatgaagcggtgatgggcaccattcgggcagttcgaatcatggagttgtgatgtttcagatttggatggcatctcccagtctccctcctgctgtgaggtccctgtctgtctacacctgttctctcttcatcctcacccctgggctgggtgatgcttttcattgttgcaagtcctagggacttcactcacctccctggtcttcccaaccttgctcccacctctgtaaatggtcccttatgaaactcccttcaacagtatcccttgagtgagtttctgcctggacccaactggtgtaaaacatagggatcttcgttgcttctttctggaaatgtgtggcaggtttttgctcattgttgcgctgatagccgtgtctgagatggatacccacgatatcctcatgatgctctgacttttgtgggaagagacacattgaacaactgattttcaagaattttgagagacaaatgagaaatacagcatgatgtggaggaggttttggtccagggtgggagatgctggaacctggaaaataaaggcgttagggctggtgaagaaaggacaaaaccacaaatgtacagaaaatgggtaaaagaagctggaaggcagttcctaaaacaaacaagcaagcaaaaacatttgcaaatggcctgttgacacaagtaaaaatcctcagccttgatagtaacaggagaagctaaattgtaaaatgacgagttaccattttatagtatcagaccagcaaaaatgaaaacaaagtgttgccaaagatgcaggggagactgcttctcttgtttatggcaagtgaggatgtgccacggtgcccaggatggggggagactgcagcagactgacagggtgctaggcatagacctcctgtgatgcctctgccttttaatgagatcgatgtgcggaaagtggggaggtaggatgagaatggcaatacaaagtatttgagacgtggatagaaatgcaacttgtctggacccatctgtgaccacggaacaggttggtcctgaccctgggaactccagagtgcagggattaggtgagagttcaggggaacaggggagaggcccctgtcccttctggagcatgcccaaacccatccaggttgctaattgaaatttattttacttatttatttttggttgtgctggttcttcgtcactctgcacgcttttctctagttgcggcggttgggggctactctctaattgcagtgcacaggct

SEQ ID NO: 37330 - DNA, 1256 bp, Bovine  19866880603173
aaatgcgcctcactgattggtttgttttgcctttgttgttctcccagctggcaaactggaaacagtgaagtgggcattcacctggcccctgagcttcgtcttgtacttcaccgtccccaactgcaacaagccccgctgggagaagtggtttatggtgaccttcgcttcgtccacgctgtggatcgcagccttctcctacatgatggtgtggatggtgagtccaggaccccagggtgctgggtcccttcagagagaaactcaaggatgcagaggattctcaggatacaaatggggtgcagggaagagtgtggggtctgggtggaggcagggaaggggcggtaaagaccaccagccctctctcagtccttctccccatggacaggcagctacgtcttcccagagtctaaggtgggggtcaggagacagcgccacctagtggaatttctcaacatcgtccttcaatttgcggaaactcccctctccagaggggagccagggcagaggttttagcccagtaactgtatcagtcagctgttgctgccatacactgtgtaacaaccagccctagattccgtggcttagaatcaaaagaacttatcctcctgctcatgtgtcggcagggagactgtgggtgactggtcttaccgggcaccagctaatcagtctgctttcagctccattgcggttgcctttggttcaggcagcaggtggggttcgtgtctcctctgtgtttgcccattttctttggacctgtggctacctggggaatgtcttttcacagtgggtcacaggaatgcaggagggaaaaggcaaatatgggggccttctggggccttggcttgagatttccacccagcctccatctgccaagtatttgtggagtgggggacatacacctgacctgctctggtgggaaggcctgcagggtcacaggcagccagcctggaggcaaggtgggaggtatgagaagtgacactccatccatcatagtcactccccatctcagctcagtttcttcaaccagaaaatgaagtcactgaaccaagtgaatgctcaagggtcccttatgaagctaaaacaatgattcaagagttggcattgattgagggaccttcgctcaaaagtgtttctgccctaaagccatcctaggaaacccagagtgcactcattgcccatgcatgatgctcgtttttaactggggagtggccctaattcattataatggaatgggaagaaattaaaaaccatacatacgt

SEQ ID NO: 37331 - DNA, 1540 bp, Bovine  19866880628173
cctgggtgttcttggaaggactgatgttgaagctgaaactccatactttggcccctgatgcgaagagctgactcatttgaaaagaccctgatgctgggagggattgggggcaggaggagaaggggacgacagagaatgagatggtcagatggcatcatcgactcgatggacatgggtttgggtggactccgggagttggtgatggacagggaggcctagtgtgctgcggttcatggggttgcaaagagttggacacgactgagcgactgaactgaactgaactgaagtgtgtatatgtcaatctaactggtatagccactatggagaactgaatggaggttccttaaaaaactaaaaatagacctaccatatgatctagcaatcccactcctgggcatatatccaaagaaaaccaaaattcaaaaagataaatggaccccaatgttcacagcagcactaattacaatagccagaacatggaagcaacctaagtgcctatcaacagaggaacagatacacaaaatgtggaacactttctagccagcactgttctaatgcctgcttagcctgacacacgccacatttctgggttgtcctggaccacacagttccctttctgggtgttgccttccttcctaacaccatacctaaaactagctcactgctcatctcctccaaaaggacagagcaatatcctacaagctttcatctatcaaaaaaactaacttctctgatcctttagtctaccccacagtttttaaatactcagttgatttttttcatgattttcacagtttttgctaacaacttccttcagatgttggccctctcaatgctgccccctcacattgctggactgctcctggaggtcctggcttcattccctgggactcctaactctggagtctgggcaaagccctgggttggttcctaatcatttctgtccttctgacactatggctcatttgctccttttttttttttttgaatttttatttatttattttgactgtgctgggttttcactgctgtgtgggctaccctctagttgcgatgcgcaggcttctcactgcagtggcttctcttactgtggacatgggcacagggcgtacagggttcagtagctgtaggcacgtgggcttagtatttgtggctcccatgctctggagctcaggttcagtagttgtggtccacagacttagttgctctgaggcatgtgagatctttcctgatcagggatcaaacccatgtcttctgcattggcagatggattctttttttttcttttaatcactgagacaccagggaggttcctggctcatttgtttctaaagaaaactttagactgttgaatcacagctccaatatctgcattcatttctcacttttcatacaaggcttgagaaaaaaattgctatagagaaaacctaagcaaatctgctttcctgaaatggactctcttaactttgggcttattgctactgagttcatcatggatttgattattttgtgatcatttcctccaaggcttctgtctaat

SEQ ID NO: 37332 - DNA, 924 bp, Bovine  19866880633427
ttctccgggatggtgtttggtccaggagccgcatgagtgccggagcctctgataagtgcttcctgtgtacaggctgttggggagcccgaggtccttgtgtcatgctggcaaccgctatacatccagctgaagtttcccccaaataccttcaaaatcctcaaagtctctttctgctcctctccttctccccctaattttctttccggtacatcttgccagcctggggcaggcagccggcagaggcaagcagtgctgttcccatggaaacaacagagcctggagggagcggattccccttaccaaggcaacggcaatcagcggcctgcttctctctcctggctgctttcctgggcctgagtttgatgagtctaaatggaagtctgaaggggatggagagcttttttttttaaaatgcaacagggactttcatagcatctttagacatactaattgcatactgatcaaatgaagcggctcaagatgaaaatcaacacacctaaaaaggcccagctccctgaaaatacctgagtgaaaggaatctgggcctctgtgaccaaaacaacaccctgctctcatccaggtttgtttgttttttaatcatgaaatactcagagcatcttgattgcctggccccttggggattgcaccaagaactgaggtcctgacactgcccagctcctctctgtagcaatgggtgacttcaagcttctgttttagacgttcatgatacatcttgctgctccctgggcccctggcagacaccctgggaagccgagtctgccaggtgtggtgacagcccccacagagccctcctgatgctctgttggtggtcccattatgctgtgctgacatgtaaccttccaatacactgcagtcatgccttggcctaaataaccctatagctcccgggagtcaagacctctc

SEQ ID NO: 37333 - DNA, 2418 bp, Bovine  19866880688121
attatgagtgagctggcaccccactccagtactcttgcctggaaaatcccacggacggaggagcctggaaggctgaagtccatggggtcgctgagggtcggacacgactgaacgacttcactttcacttttcacgttcatgcattggagaaggaaatggcgacccactccagtgttcttgcctggagaatcccagggacaggggagcctggtgggctcccatctatggggtcgcacagagtcggacacgactgaagtgacttagcagcagcagcagcagcagagacagatgaggctacagaaacaagttaaggttagttgggggagttcttatactctagacttagagatttgggttcacaggtgcagaccatctatgatgatcaggaatcattgttgactttactgggaaaaccttatgatgatggtgatgatgaaagtggttttgatggtatgatgatggttgtaataatgctggtgctgacagtgattggatgatgatggggacagtgatggagatgaagatggtgatgatggtggtttggtggtgatggagaagatggtgatgatggtgatgataatggtgatgacgatggggacaatggtgaagatggtgatggtgatgatgagaaagataatgctggtgatgatgatgacaggtcacactttttgaatactgaccattgagcacatgaccactgagcacactggccatatgactaagcatagaaatgctttacaacttaatcctttcaactaccccatgagatactattgttatccccacttttcagacaaggaaattgaggcagacagaatataagtcctaagtcacagcaccagcacaaaacagaaactggacttcaaccccatttgaatgattacagcccaagccagtcatggttctaaccttactttcagcagcaagagaagagatgtggtctgaatgctcaggatgcccactggcttgagggtttctcaagacccctcatctttccttgagtcatttcttccctttctgcctttcctctacttcgccatgatgctccccctctcccattgccactaaaaccgtgtgacatactctgggagctctgaaaaccccatgtgagatggtctggcagcaggtttgttagctagcactggcctctccttcaggctcattgagaaagtgacaatgacttctactttgaggatatattgtaaataatagaaaatttaactttttctgggggactttgaaattccagcatatactcaactatctgcaagaggacggaactcttcaaggttggtgagaaacctgcttcttgccttaaagtttttaatagcaaccagagctgagtctttctgaggcaatccacagtgaagtaggaatttccatgccagattcagagctaagcttattaaacaacatggagcctttgaaagacgccagtctggttaaagttatcaagacatttatactcttgcctttctgtcgttttcttgttattctctgtccaaacagtcttgggagctggtgggtactgcagctgccagataacatcaaacagtggacggcggccgaaccccgggcaggtaaccaaaacttccaaaaacagagctggcctgagacgtgggcacttcaagcaggctcatcattggcgcctcttcaaactcatgctctttaaatatttattcaacatttatttactggaagatggaggcgaaaactcatcctctattaattaaaaagtgtatatagaaattaagcctcttactaatgcatttccagcaatgcaggcatagtcaatattctgaaaaatagactgcaaaatctcccctatttttctgtaattgttatcctctttcatctttcttttgcaaaagggattactcttaagtaagcaatgtcttgttggtgaattcaaagttttaatatctaatatttaggtagtgaaacactttatgcactattcattctaattttaaaatttcaactggtgacattattcacaatagtcaagacagagaaacaacctaaacgtccatcaacagatgactggctaaagaagatgtgatgtgtatatatatgtatatatatatatatcttgttttatatatacatatgttatatattatatacatataatatatacaatggaatattactaagccataaaaaagaatgaaataatgacatttgcagctagacatagatatcatctagaaatgatcataccaagcaaagtaagtcagaaagagaaagacagaccccatatggtatcacctatgtgtggaatctgaaatatgatacaaatgaacctatgtacaaaacagcaacagactcacagacacaggcaacagacctgtggttgccaaggcgggggtagaaaaggagtgggagacttgggattagcagagacaaacatgtata

SEQ ID NO: 37334 - DNA, 1638 bp, Bovine  19866880739063
ggtcccaacagagccccacacctgatcttccccctgatagaccctgttgttcctggcccggactcctttaaggtcacccacacagctctctgctgctccacctcaatggcctctgcatcctcatcccagctctctattctcactttagctttggctcatagcacgtgttcctggattgttctacgtccttgaaatgatccctggaaatcagaacccacatctagattaggtaagaggtttttggtttcaggaaacaaaaagccccagctctaacttggtctcttagaggatgggaatatattaatgtctgaaaaatacagaagaaaactggacttcaggcatggtttgatcaagcctccagccacgttttctgtgattctcttatcactaatctcttttgttcccttccacataactatttttcttgggggctgtagcagtttcaggcttcatatacacatttcacactgactaggaagaagaagaatatctccccacccttcatcctcatggcatcatcaaacaaaaatctgattggactcaggtcacctgaccatccctgaacccatcactgtggcacaggaactagaattacccagttggtttagattactcagaaaccaaccacgctttcctccgtctccccagagataagactatgatccgttccactccacgtacatagccattggtccctggttatcatagaaagcagataaatgcctacagaacaaagcctatgcagtaccctagggctagtgtgacacagacaaacgtgtttagatccattacaggtccttgtgtggacactgatttcatttctttggggtaaataaggcaggagtgggattgctgggtcatatggtgagtatgtttataagaaaccaccaacagactttcaaagtggctgaaacccttttgtattcccaccagcaagctgtgtattccagccgctctgcatcttctccagcacttggtactttcagattgttgttttgttttgcttttagccattctagtgagcacgcgtggcacctcactatagttttaacttgcgtttccctgataagtcatgatgtcgagcatcttttcatgtgcttcttccctgccaaacatatcttgtttggcaagagtctgttcaaatctttgtccatttaaaaaagaattattggagtatagttgatttacaatgttatattagtttcaggtatacagcaaagtgaatcagttatacacatacatatatccactcttttttttagattctttttcccatcttggccagtacagaatattgagtagagctctctgtgctatacggcagtttattattagtaatctattttatatatagtgtgtgtgtatatatatatatatatatgtatgttccaatctcccatttatccctcccccaccccttatcccttggtttgttttctgtatccatggctctacttcagttttataaataagttcatatgtatcccctttttttaagattttccattttaagtggggttttcaccctcttactctaaagttcagcggtctgtgtaccatgatgcttgaccatccttctgagacattctgtcccgtttattttatcttcagataagtaaagactagggccgttagaaa

SEQ ID NO: 37335 - DNA, 1115 bp, Bovine  19866880739248
cggactgcagctgtgctaaggcccagggcttcactcggaacagagacagaaccactggtccaactctgagctgcggtgatttggagggatcaaaagaggcacagctcgctctggttcatccctgagcacacaggccctctcacctctcccctctccccaggatgtggattttatgtttcagtgacaggcctcattccctcggcaagttgagagcaaaagccaactcaaggggctgtcttgggttgggtccctgagatagtgatttattgatggacagttctcatgcagaggggagagaaacaggcttagcaagatgagtgagccaagctgtgttctcagctgcaggccagcctcagcctgatcctgcagggaccagagagcatgcatggccctgaaaagttgtcccaccttgaggcaggggttgaccacacgctgctctggaagtaagcacttaatcttccaggcatttcgggtgaagtgttgtgcatcagtcacttctcaggagaagggctattctcaaggagaaggatgcactcaatggacaacattcatggcagcaggaggtgggtacccatcccacagaaggggatctaagttgccagcaacagtgtctactacaaagatgttccctgttgtccttcttgacttcacctgggactggttataacaaaactccaagttcttgtcaccttgaaaagaaagcaccgggcatctgtctgtgagaggtttcctttcctttcataccttaacaggttatagatgtgttttgaaaagggaggaggcagtaggtggatacataagagaatgtagctggtcaaatattacagccttggacccaggaccgccagcccctgatgtaagcactcagctagctattcatccgggcttgttaaacatgagggcataaaaagagctgatttcattcattttatagcaccgcatagtttcccccaggagaggcaaggctggccaagatgtgtgtggtccataccttttgtgtgaaagatgttttcaagacttttcccccttgtatatgcctagtcctgcccctgaccaacacctacttattgatactatagagcgtgagcgtatttggggctgtttctagcacttgc

SEQ ID NO: 37336 - DNA, 2618 bp, Bovine  19866880773354
gcaggtttgggaccctgtaagaaggttcttccctctaactcatcccaacctctcccagataaatcccaggacagggaaaacagctgcatcagcagttgtgcactgctggacagccgtcagaagcatgttctcagtcagcagtttaaggcacaatgtgcatggctgagacctggcagaaagacgcccggggctcatttcagaaaggaaccctgcccagttcctaggtcagcaatcatggtgcatgaaacatggaaacaaccagtcccagaatttcctctctgagacatttagcctggaactatggtttctcaagatttcacagcaaatgtgtaaaaaaacaaaaacaaaacaggctttggatcaaatgtctttgcttaagactaagactaaaactaatcaagactagtatgacagagtatttaacataaaagcatttgatgcttcgtaagcaccaatccacattatggtaatatcctgtccatgtctgtcatgtatttataaaaagcaccaatataggaataaaacacttttagatgtaaacactcaagacaaagctaagttcctagtattttcccaccacctgggaagagatttttaaaaaataaatttggaactgtgaattaccagctatttttcttctgattcctataaaacaattctattgaggttcaggtggaaacttggcttgtttgctcctctcgggctacttttagatccttgtaatgatttttggtttgtttggctgcacctcacggcatgcgggatcttagttccccaaccagggatggaacccccagccccagcagtagaagcatgggagtcttaaccactggattgccggggaagtcccctgataatgatttcttgagagtcatgcagaatatggcttattatgtattactttctttccttcttaaggaaccaccttggggaagtcttaattttcacaactgaaatctactaaaatcagacaggagggtgacttgagccctgctggacatcactgtcaactctggaatgctctccctgttatgtccagctgcaagaattcctaacacaccatcgcacgtatcctaagaatgacaggcctagcagagaaccttcaagattcagaggggacccaagatttgtcacttcatacctgcaatctgccagacactgaccagattcccagaggcgtcaaccaagaaacagtaaacattcgatgacaccatcttttcaccttccctgtgtcctcctcactccagggagaaagcaaagaggaaactgctcaaggaaagatacagaacagagaagtttattttacactatccgtccaagaaaacaatctccataaaaccagtgcaaaatgtgtaacagaatccgtaagtatgtctcagctcagaaagcccaaagtggtgattccctctcccgctccgctggccagcaggtacccctcggccaaggccggcctcggtgggcaccggcgacagaaacattcaacccatttgtagcaggttatttttacaattcataccagagtgtgtacaggggaaggggaaaaccataccgaatgaataggtgatcagtgcttaaagtaaatacatggggcagcacggggcgagaatccacagtttcaataaatacaagtgaacaagcatgggtgggtctcaactcggtggagttgtctgcggagtaattcagcatcggacagaacctggcggagctgctgagcagcgattgacagcaacatccacagtaacacgcccttgagtgagtctgcatccaacacattctgcgtttccaaggttgtcagttctgttcctccttcctgtgtcccctccccaccccccggggaagggagcggggcgctggggcagctgggcgtggcgactgggaggagacgctggccctcgagccagcagtcagggtccagtgtactcagtacgaggggcggtgtctgtgcaaagtgcgcttctccacttcccgagaaaccagtgtctgcaactcctgcctccgggtcacactccctgccccgccaaacaccaaaccaagagcagtctcagagtctcaggcgggaggcactgccgtgccggctgcctggtgctcaggatggagaggttaacccgggcaggcaggcttcaactattgcttgagaggctagaaagaactggggagagagtgatggtcagaacggacaggcggtcagctgtcctcttcctagaaaacccagggcctcagggcagagccccgggtgtgacgagaaggcgcttgtccaggggcctctccagccgctcctcagatgggcgctaaatccacacaagctccgacgcacctgggcctcgaccccagaggacgcagctgggatgcccagtgggtcagtgaggatccagagcccggggagagaagatgcgaggcaaaaagccaacatctctggaagggaaagaagaaaagaggggagcccccaacccaaacccccagactcaggaacctagaaaccagccccaaacataaggagaatcccaaacgctccctgtcacgcgtggaccctctcctctctcttctccacagtctcggctcatacattaggccggtcttccatccaataacttaaaaaaggaggagggatatatactaag

SEQ ID NO: 37337 - DNA, 1690 bp, Bovine  19866880779105
ctggatggctgtgggtagcagtccagcctggggctgtgtgtctgagtaaaaccaacaggcttgtgtggggcttaaactctcaccttcattttattgcttaagatctagtgcagttaatgaacccagaccaaagctttgtattatagtacttccaacttcacacttcaatgacaatccactaaaatcactcccagatgaataccatggacttttaactaggaggttcaaaacctctcttgccagacaattagcttagctgggcatagaacgtccctcccctgggctgacattcagggtattccaaggaatcctttgtacccagacaacagcatgaatgactgctggtcttgggtgtccttcgtgcattctattcacattgtgtgcccttagaaagcaacagggctccagatagagatgctctcagacgttctactaaacatctttctgttgctggagggacaatgcctctgatgagaaggggaccgacttctgctgcagtctgtagatgatgacaccaacatgaggaactggggctttaaggcagaagctaaaatttaatcatgcttacactcacctcccccagggctaagaaaaagcaagctgcagagctgcaactaaaaacccaagagatcgtctaaaggcataagggtaaagcacactgaagtatgtgcatgcatgctaagttgcttcagtcgtgtccgactctgtgtgaccctatagattgtagcctgccaggctcctttgtccaggggattctccaggcaagaatactggagtgggttgccacatcctcctccaggagatccccccgacccagggattgagtctatctcttacgtctaacctgcattggcaggtgggttctttatcactagcaccacctgggaagcccacattgaagtacaagagagatgatttcctggagatgataaagaaactggacaacagtggcatctttgagttacttcagttctttcctggaatgaataaacaggaatggaagaaatctgcctggctggttactcctgtgaaagtgttagttgctcattcgtgtctgactctttgtaaccccatggactgtggcctgccaggctcctctgttcatggaactctccaggcaagagtactgaagtggggttgtgatttccttctccggggggatcttcccaaccccagggattgaacccacatctcctacattgcagacagattttttactagttgagccataaggggagccgtggttactcctgctctccctgtcagtgtaaggaagttggtggaggcagcgatgaaccatggttatgaagcaggaaccaatcgatttattgttgcttagttgctaagttgtgtctgactctttgtgaccccacagactgcagcatgccaggcttccctgtacttcactatctcctggagtttgctcaaactcatgtccattgagttggtgatgccatccaaccatctcatcctctgtcgccctcttctcttcttgccctcagtcattcccagcatcagggtctttcccaatgagttggctcttcgcatcaggtggccaaagtactggagcttcaacatcagtccttaaatgaatattcagggttgatctcttttaggattgactgatttgatctccttgcaatcgaagggactctcaagagtcttttccagcaccacaatgcaaaatcat

SEQ ID NO: 37338 - DNA, 1534 bp, Bovine  19866880982625
tgctccactgttcagggaaaccaggaaaggagcaagcttccaccgtgtaagtctggaggaatctgacagcctctctaactaccgttccttttctgtttgttggttcagtctgtttgtgtactggggtggttttaggatgagattgttggtgtaactccagggtaggtgagggatcaggtgagaaccacaagtggaaagaaagtctccttatcaattgtattagatttctgtccatgttgagttggggtgtcagaggctatggtttgggaaggaaactactgctccaataggaaagacctgacacccaaacttcttcccgacccatgagagctttatttaagaattcgaataatgtggatttcattctctgcaaaggacctgctgtggcccttggcagcctgtctttgtcacctgctctcatagccttttgaagaagcagagatggaatctgcatcctttggaagaaatgtgatgcatctgccaattccacacagaatccaggctggccgtttccttgagaaccacttgaggtagacgtgttcacgttcagttttcaggaagctaagtaagctagtaaacttgaggaatccagacttctcagtggttataggcagtatcccctgcctgtcctggctcatcagaaagggtttgtatacggaaaacttctgaacagaacaaagagacttaggtctggatgaggaatgaagtcttggctctcaacgtgccattccttcactgctgtgcaatgtcaaatttcttgccgagaaagcatctggaaggaaaagaattacaggcattaggcttggattcaagtgtactttttaatttgtgtgcttcttggttgaaacagttaatcatttgcccctcaaggttccactgtggttgtggttctgctccgtgctctgaagacagcactgtgttttccttttgggagcactccagcccctggactttgctaattaagtgatgaacttcaaagggcctggaactggggctccgtgcagcagctgagcttgtgaacgtgaatctcagagtcaacagaattgccatggaaaactcaccagtcttctcaggaggcttttggaaggttgaccttcatcccattgggattccgagtggaaagaatcggagggaagacagctctgaacctttaaagggacggagccacagagacataactgaaataggtgacagctccagaaggaagggcgggtccatgttgtgttctcattttctgagatggaaaccaccggtcattgcagccccctgcggatgtgaaggagtggcaggtcttagggcggaaacgtgcctgtctccagaggtcatcgcttcctaacgcgagcaattctctactactcttccgtttgttgacatgtttgtgggctgctgctgcctctgtccccccaagttcatgatgaaagagcctcagcaaactggcagcagctcatgtgtctttggggccttcccaccccacccctgccgctgaaccctctaagatcccccggacacgttttcatttaattttcctttacag

SEQ ID NO: 37339 - DNA, 1191 bp, Bovine  19866881019832
attattaatggtagaccttttagagcagttttaggttccagcataactgcacagaaggtacagagtcccttcatccccctgccccccgacacacacagcaccccatcgatatcttgttctgttttcccagtgggaacctgacttctagtgggtaacatagcaaagagctagaagagagtttcttgtaagtaaagtggcaggctgccctcagatgccaggaggtgctctgagctggaaagaagcccgtggcctggcaggcccctaggtgtccagaggagccttgtcacagagcatctgtgggtgggtgtcctacctcacgctgccttgggcatgaaactaacttggttttcagtaggcttcacctttgagagcacagagagcctggcaaatctgctcatttctcatcctaatccaagtgttggcactgctgtgcattagacgaagcttcttactcgaggaagatcaatacataatattggaacatggtcttggagagagagtttatggacttgtaagaggcgttgaggcttttagcctgttgtatataaaacagatcaagaaaaacaaagcagaatacgggggatgggagggccttttgcttagactgacattaacccagaggtcctaagtacatggagggctgaggcaaggtgatctggagggaacgtgttccgggcagtgggaacagcaagtgcaaaggcccgggagcagcatccatggcacacttggggatctaagaggtggacaaggtgagcatgtgataggtgacaggcattgcaaagacttggtgtacagtataagctgctgaattaatgaagacaggatgttcttgaagcagagggtggcctgaccctcaccccaggggctctgccctgactctgactttaaccccttctctcctctcttccaggccatgtacatgttctacgcgctggccattgtgtgtgatgacttcttcgtcccctccttggaaaagatctgtgaggtacatgtttgagcactggaactgttccagcctcctccactgaggtcctgaggagccctgcatgctgctgggtgggaaggccaggcaccagcatgcttcagagctgtgggcaatggtagcccagaaactcactggtctgcttagagtttcattgtgctcatccatgctgtgttgggtagtggttagtcgctcagtagtgtccaact

SEQ ID NO: 37340 - DNA, 1105 bp, Bovine  19866881188895
tccatttactagttgatatatatctgggtttttccagtttggggccattatgaataaaactgctatgaacattcacatgcatgtcattttgtgaccatatattttcatttctttgggagaaacaccaagagtacaatggctgggcaatatggcaagtgtatgtttaacttataagatactccacactgttctccaatgtggctgtacattttacatttctgtcaaccacagattagagttccagttgttccacatctttgctaacacttggcattgtcaggttttaaatgtgagccatcctagtgagtgtacagtgttatctcattgaagtttgaattttcaattccctgatgactaatggtgttgcatatcctttcgtgagcttatcagctgatatatgcattagttgggttaatgtgataaaggaccttgctcaggggagacacttgctcgtttcttgtttcctctttaagcaatttttaaagcacatattcttcttggagaaggaccacgtctcaataatccttgtgtctctagcacagtatatgacacatgataggtactaaataaattaactcgaaaaaaaaataaacaaatgaattccagttaattctgggatataataaaatgacgttcttaaggccaagtagagtgttcatctataggtttttctacactgaatggcccaagatgtaatttttttgattgctgttattatactatctctcctttcatatcagaccttcagcctccccctgcctctaaataacccaccttcaaaactagtgatctgaatctatcatgggcttgtttgggatgcaaacaggtttgttttgacttctaaatgtgcaaccatataaataaaagcaaataggtctgaaggagagccttcaacactttaaaagattaccttggggaaaagtcctcaggagattcataggtaatgattttccccaccaaaggctgaaaacatgttgaaactgaggtctctggtacagcagaattcagcagtgaggtccagagcagggaactgggcttggggagagaaacccagaaagacgaatctagttcaaaccccagctcctccagtcctgatttcccagac

SEQ ID NO: 37341 - DNA, 1250 bp, Bovine  19866881205934
tacagtttcgctctctggttggggaactaagatcccacatgcctcatggccaaaaaacataaaatagaaacaatattgtaacaaattcaataaggactttaaagatggcccacatcaaaaaaattctttaaaaaggttcaccttcacaagtacctggcaccttgacgacggagcctttccagggttctttctggctggcccctcctgttcccatcctgcagggacggagttgccaacttaatctgctatgtcaattattgctcattcttccacccaacagatggcagaaccgtgctgaccagtctctgcttccactctcttagaatttgtggatccatgcctttctttttttattgaggtatatttgacatataaccttatattatcctcaatcaatgccttttaaaatttatgttattatcgacatctaaggattttgtgaagaaatggagtaaaatacatatgcagtgtgccatatttagccaaatgtcatctccgctgtaagaggggtggggagaaactagattagtcaagactattatcttttggggtcacaaattaaatttgatcttagttttttgataggaaaggctgaaaggacagtgttattatataatttatgggttagttgtccacagatggaagatgtgctctaagatacataaaaggggtgactattattttctttcttttttatttttggccataccatgtgccttgcaggattttagtttcctgatcagggatcaaacctgggccatgccagtgatagcacataatcctaatcattgtacccagggaattcccagctattttcaattgtaaaaggaacagacatcttttctggaaaacctaggggaggcactttaaaagaatataatagttccctgtcatgtcactacctcaagaaaactgatgtgagcatttggtatttacttccagtctctttccattttaaaaaatgtaggtgaaatcatatgtggacataatttcctattttttttccagtcacgttctatcttaagagttttcccatactgggaaaaacttttcaccagcatcgtgtttaaggctgtatttttcatggaacagataagccatattttttgagccattctcataatttggtgcatttcaactctttcataattagtgttctaataaaccacgtgtctgttatgaatgtctttgcacaccaaggagggctcacatatctgaggccctcttcaagatacattggggtcaaaggg

SEQ ID NO: 37342 - DNA, 2159 bp, Bovine  19866881233419
ctttccgatgtctggaaagaaactaaaaatagattacctttccctgccaaaaaacagcctacaacctgacataaactatattccttaagctggagaattcaagggtccctgtggctgttattcagcactctgaaagagtacccttcactgaagcacgtgggggctgcgtgagctacaagtgaaagccgggttgaaggtttacgtgtcattaccacgtggacagaactgcatgtctcctgggaggtgggcttctgtgggggcctggcccaaggggcatggcagggatgcttcgggtcaccgctgtgctggtaaccctgtttgccaatcgggtcttacagtcgaagatatgtcaccatctttttgcaatgagaatgcgggcggtgactgggatgtcaggagacaggagattcagttctaggagcccagccttgccgtgggcacacctttggatgcaaaagaatggcgtcagacaaagtacagagcccagctctgggactggggtccagctctgtgcagggccaagcgatggaagcttctgttccctggagttgggaccatgtgtcaggggagatggtgctggctcgctgtgagtggcattgctgactgtttcaaagaatgcatttctcagagtgacaggtgtaaaagaataaggcgcgtgaaatgccatcgcgagacaggaatgactcagctcacaggcagaacagaagatgtccagctaagaagagctgaagccagcacctgttggtgttggcaagaaagtgggggcgcagggcaaggaggagaggagagactccagggggcaacagtggtgggggggtggcaacaaacaagagctccccatcctgcagctccagtgcaggctgggaagcagccttctggactggcctccttcctgttcacgatggtgtcacagggcagggcactcacggctccccgggatggtgtcagggctcccttggtgcccagtgctgagtgtccacatggggatctgagtgtgtgggggccggtgtggccaagggaagcacagtatcagggtcacaggtgggagttaacttgactcttattgtgaagtgtgcctggtgccctctgatgtcacagggattctcaggctgtgtcctcggaacccctggctggagacgccatcggaatgaaattgactgggaggctggtgatgggttgacatgttctggttgtggaaacagttgggggatggggctggcttgcttcctcacttgggaagcagacctagtttaaccctctgccccttccattgcatgagtgcagaataggaactcacaaactcttccacccctaagacaccaggtccagttccccttagtaagtccctgctttgtgttcccagaattccgtgtcctactgccctccctgtccttttatctctctgccatccatgttcctccctccccctctcccttccccgctccctctctttgataaccaggaggccagagcacggtccaggggacagccaggatccccggcccattggacagtggctgtgctatctttgtgggtgtggcgagcttgatatggctcacttttcataggacagctgccactttaaagacgtgtaaaggacttccctggtggcatagtgggtaagattccacctgctgatgcgggggacccaggtttgatccttggtcagggaagatcccacatgccatggagcaacctgtgagctgctactactgagcccacccgcctagagcctgtgttctgcaacagaagaagcccccacaatgagtagcccgagcgtggcagcaaagagtagcccctgctcgctgcaactagagaaagcccgtgaggcaatgaagactcagtgcagtcataagtaaataaataacattaaaaagacatctaagatttaaaaaaaaatttttcttttaaatggcattcttccctgcccccttgaagacctgtttttggtgaaaatttgtaattttttcctccagatctgtatgaaaaagactgaggtccaggctctaatttttctgtcatcgttccagccctctgagaatttttaaggttgttttcttagcctgacattgccaatctcatctcgagcccggaaacattgtcttttggcaaataacacttgaaactgtttactcagataattattatgagaaatttaa

SEQ ID NO: 37343 - DNA, 1573 bp, Bovine  19866881298147
tttgttgctgttgttgagttgtatgagctgttcgcatattttgaaaattaagccgctgtcggtcacattgtttgcaaacattttctcccattctgtaggttgtcttttctttttgtttattgtgtcctttgctatgcagaagcttataagtttgattaggtcccacttgtttattattgtttttatttctatcgctcaggagagtgcccaggttctgactgaacatctccatggcgtctgcttcccatgcccccctctcctgtgctgccttcaccatgtgtgcagcccctcccttccttatacaggacactggttcgcactcacccatctcctgagcctgctccccctccacgtgacttgcacccactgatagaacaatgagggcacccaaaacagatacccaggagagggctttgggggatggagagtgttctcaggctgccttaaaaaaaaaaaaaaaaaaagactaaaaacagaccgaaagacttcatttattgcaagcatttgggcaaaagatcaccaacatcacagacagagccattttctattttacaaactgctatctccacattttagtgaatattccttgcagaaatctggccagcttggtgacgtgaccatttcatagttcaaaaggtggagatgctgggggttaggagatatactcaaagccagggacttagagacagatctgatgtaattgaatacagtatttatgggacccaaggtttggggagaggctgggcaactggcccttctcatttcccgaacatttaaggagccagttgttgtcaggccagtgaggggagacaggtttgcgttgtgtgtctccaacctgtaacaccctgaccctcgatggatgtaaggttcattgaaggcgtcttttgcacttgttgtttatttcctgttttgtgataggctttccaggccagtaattcaaagctatgaagtagttcggtggagtcttgatttcaacacgagatttgcagaatctgctatgatttcattggaggctagacggataactgggcatggcgtatagctagtatgttagcagctggttgacaagattgcttcaaaactgtgattaatgaccttgggtgggagaagggttctctctcatggccctcttaacctcagaagttcatcatttttatagatgatagtgaacgagaaatgtcagttcataaagaatttcactgaagacatcaaaggcctgattatcacatttgcaagagacccaaggattgtagtcataaccacagagcattagggagaaccaaggtttgagactgtctccccatcctggagatggaggagatgaaatttaacccagaaacgtgcaaagtcccacaccaactctgttcctaaaaccagctatgtgagtgctgggtggggaacgggggctaaggagtagttgctgtagagggctgtgtcgcctggttttgttcatgttgctgtgatcagatgtggctgaggatgtgtgtcattgggaacaaagggtgcatggtagcatcatatgcagacttcctgctcttcttccttccctccccaccctgctgtgtctctcatt

SEQ ID NO: 37344 - DNA, 1169 bp, Bovine  19866881390432
ttggttgattgacatcagctttgctctcctgatgggaggataagataagttcccatttgacccagctccctcttgattccagggccacatatcctgtttcccttttgacaagctctctacccttcacactgcaaaagtggtacgtggagggacaagcaactgctttaacaaaagcatgtataccatttggcatcctcctcaaaagcccaggatcggtaacttcatggacacagtgaagtgtactcactcctgagtgccccgtccagtaagatatagaccctgtgacatcatttgttatcccaacacatgctccttattggtgggttttcacatcataccacttccgcctcagtctctttcaaccaacgagagaatagtcccaaagtgggttacagcactgaaatacctcctccaacttccttaatttcaggatggaattctgtagatctaggctttacattcccacctcctcattcagcactctctcccccagaagctgtgggaaaggaggacaggactagatttttttgaagaagaagagaaacccagctggtgttctcaactggtattctcttagtcccaactttctggtagtgaaatctacactttgcagaacttgttgcatttttgtggatactgttttgattttcttaaagcaaaagaatttttacttctgatttgatattaatcttaaggaaatccttctgttttcaagtcttgtttcaagaaaaacaaaattttccaactcccaaaatgttagtaatcctcaactttctacttcattcaaattgcacacaaacactcaacaaagatacagataagccaactgtatttataaaagtcagtaataaaaaacaagatacggttttgccttctttagtggctgtcaaaatgtgtattttttctgaagagtattaccattatttgaagaaaaagtagccttaaaattcaattcccacatatttcaaagagaacatcaatttacttacatgagtgttttattttctttatagagaaatgatactgaaatgtggttaaacaccagagagcatagtgtgcgtaagaaagaagtctgaagtcattccttgggttttaaacaattaaaactgccttgcttcatgtcatttttttttaagaacattcaaacctggggattccccagtggtaca

SEQ ID NO: 37345 - DNA, 1529 bp, Bovine  19866881600076
ctgggtatgttcgcaaattgccatgtagcagacattcattacatcgaattcatcaaaaccctaattgagacaggaactcaagccttatggccgaatcactttaatttcagatggggagcagactcggtcactaatagcctttcacgccaggacaccgttagagaagcccacgggcgctcactggtaattctccccgcaaatacaagtgcggagcaacgtaaatgacactgccaagtgagccccatgactggactgatgaatcagctcaattcccaaagtctgtcctgtgctgccacatgcctctgtcccagctccactgcctaggagggcttctcggaagataaggcagcatctgtgtctcaccgaagttggttttcctcccagcgatcagaaggcacagggaccaggaccagtcctctgaggtctttctactaacacctcctcaacttttttttttttggctgtgtcaggtcttagctgtagcacatgggatcagcagtatgtcgtgcaggatcctttggtgtggtgcacggactctcgagttgtgacacactggcatagttgctctacagcgtgtgggatcttagcttcccaactagggattgaaccctcatcccctgcatcggaaggcggattcttaaccactgggctggcagggaattcccaacacctcatcttgcttctcattttctccccagccttcccattcctccccactggcatcccatggttgttcaactattttttttttaactttttttaattggaggataattgctttacaaagttgtggtggtttctgccatacatcagcatgaatcagccataagtatatatatatatccgtccctcttgagcctgtctcccactcccacctcatcccatccctctaggttgtcaaagactactgccttgagttccctgtgtcatacagcaacttcccattagctatctattttacatatggtcatgtgtttatttaggctcagctggtaaagaatccacctgcaactcaggagaccccagtttgattcctgggttgggaagatctcctggagaagggcatggcaacccactccagtatttttgcctggagaacccccacgaatagaggagcctggtgagctacagtccatggggtagcgaagagttggacatgactgagtgattaagcacacagcacatgtttcagtgctactctctcaattcgccccaccctctccttcctctgttggatccataagtctgttctctatgttgagtctctattgctaccctgcaagtgggttcatcagcaccattttcctagattccatatgtaagcgttaatatacgatatttgtttttctctttctgacttacttcactctgtataacaggctctaggttcatccacctcactagaactgactcagattcattcctttttatggctgagtaatagtccatcatacatatgtaccgcatctttctccattcacctgtcaatggacatctaggttgcttccatgtcctggctattataaata

SEQ ID NO: 37346 - DNA, 2783 bp, Bovine  19866881604233
ctggcctcgtcccctcgcaagttagtccctgcatcggcatccttgtcacagagtcggcctcctgagagcctgaactgagacccagattcttgggcaccaaatcccagctcctcccatctaggcagcagtgttttcccctttaccttctgaggggaaagtctccccaggctccttagagagaagccaggctgtcttccaagactaagcagtcttcataataccaggggtggagaacatgcagttaaggttggggtattttcttcttttatcctgaagagaaaggaaactgaccacactccctggcacacaccccccccatccacctccccggttggctctgcttcttgtccagaaagggaagtgagggtcaggcagagacccaggagaaaaccccactgtctgagcttctggcctttggaagacagattgggcccagagaggtgacagagtccccaagtcaccgcatttactgtgcgcgggacctcatgttctgtgagggggaagaagggcggcaggcatcgtaaatcacggggagtgtgccgtggccacctctgggtcggggcttggagatgcagccatctgtcaagcagaaggccaggcccgtggacccccctcagctgagccttggcgaagagggggggcccctgaagtgagagggttctgctcttccttcagacacccttgagaatcagagaagttggaaaaaacacttcaaaatctcctgaaaaatgtttttctgaatttggcaaagatgaactaggattggccatgtgagtggggagggccttttgcttttattttttaccttttttttatatatatataagagtataattgctttacaacgttgcgttagttgcagctgtgaaatgaagtgaatcagctatatgtatacctatatgtatacatatatcctcttcgtcttcaacctcccttctacaccccctccatcccactcttctgggtcatcactcctgggcatataccctgataaaaccataattctaaagatagatatacccttgtgttcatagcagcactaatcacaatagccaagacgtggaagcagcctaaatgcccatcaacagatgaatggataaagaagacatggtccatatgtgcagtactcaggctgtttatggctgaggaatattactcagacatagaaaggaatgaaattgggtcgtttgtagagatgtggatgaacctagagcctatcatgcagagtgaagtaagtcagaaagagaaaaacaaatattgtatattaatgcatatatgcggagggcctttttgttaataaataaaacaaagtctccaaaattcttatggctgttagaagcttctcgtgtgtgtcttgaaacagactgaaataaagagatgttgaggacagcccagctttcttatttaaagctgattattaaaatggaggggcttcccaggcggcattagtggtaaagaacctgcctgacaaggcagaagacctaagagatgcaggttcaatcccagggttgggaagatcccctggtggagctcatggcaacccactgcagtgttcttgcctggagaatcccatggacgaggagcctggcaggctgcagtccatagagttgcaaagggtcagacacaactgaagtgacttagcgagcatgcattagaataaaaacattctaacccagtacaagaggtaggatgtgtatgggtatgtgtgagcccaaagacagacgctggaagaaaatacatgaaggtgagggcaagtgggcagataaggtgctctcgtggaatccattgtgcaccccaatttatatttcccgtaatgctattttgtttgtagttttatttgttgctcatgaactgccagggtaggaacaacgttttggttgctaagcgcgtgtccaacaagaaaccaaaaagaaacatggaggcctccctgtgtttgagatcactgcttgctggttttctggtgaccagtagtcatagaagggctgggagggagaataaactggcaccattgtacaggaggggccagcatcaccccaagcttgcttgtgaccctgttctgtgtgtgcgtcctcacgtggataactgtgagcagcctgtcgtcctagccttactgggagcctgttcccaattcattatttcactctcctacaggagtaagccaagggaaagaatatgcccagaagcagattgttccaggttttctgaaaggtcacggccagttttttactggttgctcccatctcagcagaaatgctccagtgtccctccctgtccctcgaaccagggcttcttgctgactccgtttctttgagataaaacttccctccgggtccagtaatattgacggccgacttggccacaagacagagggccctgtgttcttaattatttctggatgagaagtcccgcaggcaagtggagattcagggccaagctggctaggtggggcaggccccagtgtgcagtggattgtacaagtggagagataattaaattaaaagcaccaggtgcaggcattgaaagataaccatgggtgttaattatgcagcccagcttcacagtccagcgttaggggaagaagtgccaggggcctgtctgtcacgtggtagctcgaaggacttgggggagagacattcatggtttctagagaatttgccaagggctgcctacttgggattctggtggaggtgggattatgtatgagttggaagtgtgtgcctttttttttttttttttcctatttcacactgagccaaggaggtcctttggtatataggatgggg

SEQ ID NO: 37347 - DNA, 1118 bp, Bovine  19866881726997
tcgctcagtcatgtctgactctttgcgaccccatggacagtccatggaattctccaggccagaatattggagtgagtagccttttccttctccaggggatcttcccaacgaagggatcaaagccaggtctcccgcagtgcagggagattctttaccagccgagccacaagcgaagccctatacccctgtgtggagggcatcaaacactcgattgtttaattcagtgaatattggttgagtccatactgtgccccagccaccgtgccaggcactggagcttcagcaatgaacatctgcctgaggaggctgagtgagtccctgcaaactaagggaaaccctaggggggtacacccagggatgtctgtgctgatctgtctcaaccaggagcgggcaggagaggaagtccttttgcagagcctggaccaccctgagacattgcctagagtctcagagaccaggctctgcagaccacctaagactaagagggaggcagtgatgggaatagcactccttgtgattatttcttagccataagcttgggcatgggttttattctttccttcttgccaaggcattctgaaaattggaaaatcacttggtcatgctaattgtgacagcgtgagacctccatcaaattactgcagagcttgcgctctgggaaaccctgcctttaaaatggaaaaatgccttcttagattagtaaagtgatgaacatcatttgttaggataaaaaagccccagggggctcctaagaaaacagctctttactgtgggtgcttttctgctgcttctccatccccactcccattcaccttggtcaagagtaattatgatatgattgaattttccctgggtcgtggggatgatgggggaaatctgctcaatgtacaagccagagcttcaggtcgtaccagcttctctgtccttgggcagttgtagtggacgagctcatcatactctgggttttgagaaacagtcacattccttaatctcatgctcaattttctcaaccttttacatttattaacttctaagcatggttgtgtattgaataggaaactctcgaatctctgttttcccttgtttgttgctgtaagttattcccattagtggtggtg

SEQ ID NO: 37348 - DNA, 1120 bp, Bovine  19866881787470
cgctcacccagctgactccttccagatgggacacagggcggctggagtgacggcccagagtgtctgtcctcagaggcagcctgctttggagccttggtcccgtgatgggtgacccgtggctgtcgggacccatgcgactgcctgggctcaccaggcggcccggggaagccagggcagggcagagcaccggaaagctccgctttttatagcacctctctaagtacccaggcatgagcatttcaggggtgaaaagcagggctgactttttccctggtgttcttctatcccatcgaggaaattgtctaattaaatacacattttctcaaatggaatcgaatcaagcactttcattttgagttaaaaaaggtaggccataaataacttttatttcagtctgagtgtgtatcgtgaaaaacaatgctgcttgaaaaagccccagtttaatgccttcatctgaaagttcaagtgcaaggtggtaaactgacgtgcccccaggtcacccagcaaatgaagcctcagaggccagtcctcccgtgcagcatttctccaccatgaccaaagactcagctcgtaaaatgtgaggctccaggaagatctgggatcctgccactagggtttccctttacatcccaagccacatgtcggtaagtactgcattattcattttctcttgagttcagacgtttttctggatgccctttgcagtgtttctttttatagcatcagagagcttgcagaggagccatatctggcacatgcctccccttatattaatcccaagagaaagctcgggatctaatatttaagcttccaagacattaacggggggctctgcccagatttgcagtttcatctcttgtctctgcagacacagtgtctctcctcccaccctgagtgaatactgggaagtgctttatgcccaggtcaaaggccccctgatggctgaggtcactacccacagccccctcttcctcgctcctgctagcctgccttgcccgaagactggggtttgggattcatgggggtgataggatttctgagccactgtgaactgcagactggcagtttgtgagagaaatgtcactgaaatgccggccattctcaagacaaagtggcagga

SEQ ID NO: 37349 - DNA, 1562 bp, Bovine  19866880291025
ttggtggtgccatccagccatctcatcctttgtcgtccctttctcctcctgcccccaatccctcccagcatcagggtcttttccagtgagtcaactcttcgcatcaggtggccaaaatattggagtttcagcttcagcatcagtctttccaatgaacactcaggactgatctcctttaggatggactggttggatctccttgcagtccaagggactctcaagagtcttctccaacaccacagttcaaaagcgtcgattcttcggcactcagctttcttcacagtccaactctcacacccatacatgaccactggaagaaccatagccttgactagacggacctttgttggcaaagtaatgtttctgcttttgaatatgctatctaggttggtcataacttcccttccaaggagtaagcgtcttttaatttcatggctgcaatcaccatctgcagtgattttggagccccccaaaataaagtctgacactgttttcccatctatttgccatgaagtgatgggaccagatgccatgatcttagttttctgacctttatacttgaaggtaaatttttctggatataaaatccttggcttgcagcatttccttgagtatttaaatatcttattttggcataaagtgttgctataaaaaaccagatgatggtgtaattttcttttccttatagatatgttatttttgcctagatgttcataagatttttgtgttttttttcttaaaatgtagtaaatttcgctagaatatttttggttattctgagttggtgtttctgagtatgtgatgtgctgtttcagtgtagcttcaggtcttcttctttttttttccctaccctccaggaaagttttcttgacttagaagtcttcaaagtttgttcttttgctttggttttttccttcagggactcctgttatccaagtgctttatcgtctttctttgatgtttgatattatctatctagctttgatatttatcagtttctctccaaacctttcttcttcttctttttttagcgtttacaaagatgtttaatagcactcctgtctattaaagaaaatacaaagttcaaatgcccaacagtaattatgtttaacacttggtatatacatttggataaagagaaacgctgctgagtagacattggatttaaataaaggtgttgtaggtataattcattacaatttatattatgaataaattagaaaaaagggctgaaaaagacaggagaggtttatttttcattattctttcatttggacccagcacaccacgcccccgccccgccaagaacttattacttcccaccattgaaccatcatgatgactctccaccaggcagtcacagcacagagccagcccctggttcagtggaaacatgtttggctctacagttcatatcctaactccgccccagcttcaggagtgcaagctcatgcctttggtcacttgagactttttaacaagcaccaactggatggtgttagctgatttggacccgaaatgccactgtgcaccagagaagaggctctcactggattccgaat

SEQ ID NO: 37350 - DNA, 1752 bp, Bovine  19866880501591
ttggtatatttgtccaaatctgtaccagaaatatgtgcaaatgctaagtcacttcagttgtgtctagctccttgtgaccctatggactgtagggtccatgggctcctctgtccatgggattctccaggcaagaatattgcagtgggttccatttccttctccaggggatcttcctgacccagggatcgaatccacctctcttatgtttcctgcaggtgtgttctttaccactagtgctacctgggattgctcgtattactatggttttcttaagtcaaattgtcctgatgcctacctctgtttttcagttccaagatcaatttagctattcaaggatctttatttcttaatataaattttagaattagtatattgaaagcattaaaaaaaatccacctgaatatccattaggatcactttgaatatacaggttaatttaggaataattggtgcatctattatactaagctcattaattggtatagttactatattgggtttactgtgttatacaaatttataccaggaatatggcataaatctccatttattcagattattagacctattagtaatttttaaaatttcaggtatcatgtattcgtgcaagctaatttttttaaagcacaggatttattgcaacaaaatttaattggagatgcatccttgtgaggagcttctgtcatattccatcacaaatgtctgtagaaatgtgtccctctgggccagagctagcctgttcaatgtccatctccaacctgcctcttagttggagctcttcagaaaattttaaaagcctcaatcaattaaaatgaattaactgcaccctggggatatgatttaagacgtgcactttgcttgagtagaaaaatttcagcatgtttctagcccaacaagccttcaacagcattcacacaccagggaactctgaaacctttgtttttcttatcaaaataacatgcattaagcaatgaggaagctgttaatgagtgctctttcagagaaagactcagggttcctcaaacttctctactagcataatttgcaacagggaaaggaaaattcataccactaatatgtctaagaatccagtgtggcatggtctgggttttgatttgaagtgctgtgttttaatagtaaaatgttattcagaattataattcttcttcaaaatatgttgattactagctttttccctagacagagtgtaaagtaaaatggactctaaaaagtcatgctacattgaacttctaactttgtgctcccaatcttgctgcccatggggtcagctggaagagaatgacactgtaaaatttcattatagtttgcctagggctggctcagagtaaaagaatctgcctgccagtgcaggagacacaagagacatgatttcaacccctgaatctggaagaccccctgaaggaggccatggaaatccacaccaatattcttgcttgcagaatcccatagtcagaggagcttggcgggctacggtctatagagtcacgaagagtcgggcatgactgaggcgacttagcatgcactcacagtgtccttatacaaagagacttccctggtggtctagtagctaagactctagtctcccaatgcagggggcctgggttccatccctggtcggggaactagatcccacatgctgcaattaaaggtcccactgctgctgctgctgctaagtcgcttcagtcgtgtccgactctgtgcgaccccagagacggcagcccacgaggctcc

SEQ ID NO: 37351 - DNA, 2082 bp, Bovine  19866880587104
cgcttatgtctcctgcattggcaggcaggttctttaccactagcgccacctgggaagagaaaaagccatggatccgtgttaacagaatccacacctgtagtaagaaaaagcaacctctttgcaaattattcacatttgtcttttccctcactttagaccatacctttaaaggctgtgattccattattgttttgactttttcttccctcagtaaaaaaagatcttactgggcaggccttaggatcttgaggctttacctataggaaaattaaatgcttagcagtcagtttaaatgggtttaaatgagtcagtttaaatgaggcctttttctttttccaagtaaaacttgggatgccaagtaaattctatacttggaaaggagcagatcagtctagtacagacaaatgaaatactagtgatccccaaacctgctttaggaagtccttctccagggagaatgcttttcaggaatcagtttgcaaagtaatgggtagaattgtagctgttttggttttttttttttttttccttgttaccaactatgtcctaaatccactggtatactcatttaacactctttttattttatttttttcacctcaaggcatgtgggatcttagttccctgagtagggattgaacccactccccctgcaatggaagtgcaaagtcttaaccactgaaccaccagggaagtccctcatttacctctgttgattctgggcactgtgtacactggagatgtgtacaagtctaagtgtggggcaagtgtggggtggggaaaagtctcctgggccaggctgaccccgctggtcttggaacccgttaggagtgtgggtcaggctgatgtaggcatgttacctactatggaatcgaccacggagcaggaactcagggtgactccacagggtaaatccccatgattctggcaggtgcagctgagttttctgttctagatgctttttactcttccttgcccatctccactgagggcacacagccacgcgactcaccagcgggctctgagtggtacatgctcacctgcctggtgctccgttctgtcgtgaaggacctgatgcttcagtgtccttccacacattgctctctgccatgtgggttcagcacctgcagaccttgagacacactgtcactccagcaagaaggggactggaccctctgaaggcacacggccaccgagacctccctggtgtgcgctcagactctggggcctttggaacatgagagccaatgtgacttgactgtggctgataaagcaaacggttgtctcttgtgtcatgtgatagagatgactgctcgtttcatagctgtggcttttcccccttctgtctcctcagaaatcgcaggtgctccggtgtctgaaatttctgggcctttctcaacagaggacatagccagcaactgcgtccctgccctgccgttgaacgagcctgttttgtggattgtctcctatactctcatgagcgtgtgtggagtcatccttctcgttttaatcaccctgctgctacttccggtccggtgtaggcatcacccccgagatcccgaggtggtcaacgatgagtcctcgctcgtacggcatcgctggaaatgaagagaaaagcctagtgaccgtgaactcgacaattaagacgattcagtgcagcaggcaggggttataaggcaaggcttcttcctgtgcgcactagtcttaaatctctgttttgcttccagatgccttccagattcactgtattttgattcttgactttatagcttcctctttctcccctacttccaaggaaaatgataataaaaaagcacctcattcttaatcaaaacagagtgaattgggcttcaggctttatgtagctggttatgccaaactattttgggtgtggccgccccccacccccccccccaaaaaaaaaactacacaagccttggcttgttctcttttcccttctatgtctggagaaataagtgcatatactttataactcttcttagctaatgggaagctttttgtattgatcacatttaagggtattttgtaccaggatccatctgcgtcaaagtgatacaaaaa

SEQ ID NO: 37352 - DNA, 795 bp, Bovine  19866880725075
ccactcaccagcccaggggcttctgctcacaccagagggtcatcaacatactcaacgatggcaaatgcttcagggccccaatatggcaagacccctcctggacaaacttaagaaattatctaaataatcaagaaaaatgtgtgtcatcatcagatggaaagatgtagcatgagatctcaagggcctgggtcagcctccttaaggaaacaacctgcataattttctaatatctcaactctactcataagcatcagttgaagacaagaaattgttcttttgccagaactactctgtgagctgcaccccagatggaatataggagggggagacattttagtgaaaatatagttaatttctgagtagattagtataaggtcagggggatgagtatactgaatctctcatcaagccacttggatggagactattttactggctaaaaaagaagtacacctaaaaaaatacatgattgcctttttgctgtatagtaattcattggaacattcaccaccaggaaaagagtgcttctgatgggacaaagctgcatagatgactgatggcagcctgatgtctgattccataaatcaaagagatcttgtcaaagaaccccaagtcaaatctccaattactgggacatgtttcaggaagcgttaaacctgaatatccagagactgggggacttgaatcagaggctgacaaacccaaccagaaaccttattataactaagagagatcagagggacaagcagatacagaaacatcacaaggcagcaagctgcatctcaaaaaagaaac

SEQ ID NO: 37353 - DNA, 1830 bp, Bovine  19866880779663
tggcccaaggataatcttttggaacaaataatcattaccacctgggaatgtgtgtcttgatgttttgagtggaagagaattttttcagctatagcaacctactccagtattcttgagtgggaaatcccttgtacagaactgagtgactcaacaacaaaaattaatctgggcaatgtgggtcctgacacccaaagttcagttcagttcagtcgatcagtaatatctcttttcgaccccatggactgcagcacaccaggcctccctgtccatcaccaactcccagagtttactcaaactcatgtccattgagtcggtgatgccatccaaccatctcaacctctgttgtccccttctcctcatgccttcaatcattcccagcatcagggtctttttaaatgagtcagttcttcgcattaggtggccaaagtattggagtttcagtatcagtgcttccaaagaatattcaagactgatatcctttaggatggactggctggatcttcttgctgtccaagggactctcaaataatagtttgtctttattaattagtccaatcacctttactctaaaatgacgaagtttattgaattaagaagaatgcattgagtatcttatgctgctgtctttactgaggccaaggaagtagttcattcaaggttacttctcagttatacattctcatgtttccagggaaggctctttttaacaatccagatttaatttttacatttgacgggaaatgaaatattctgtgccttttccttggcctgatttagtaataagctgctttatagcagaattcatgtgtgctcattccaaatgcctactgtaaactcttaggtgttaatgacaagtaaatcagaattcattctgtctgcctcctcctgaaacatctcagaccactaactgcgggtctataacaggcaagagggggcagctgtaggtgacttctgaacttaatggaagtttttctgctctgttaattgccaagagtcctgcatatgtgctctgctgattttctgaagcctaaaataaaacttgcttaggtggagagaaaaatggagttgtagattcaagagaatcttttgaaaatgaagggatagtcatggatcatgtggagggctccccttgtgttacatgccttacaggtgccttccccaggaatcctcaaaagggccccaagttcttacccccatctagtagacagcacagctgaagcttggagttgagtggctttcccacggcagtgggacaaggcaaaagcaaagctctagaaagcagcacaagttgaacccaggccattggactccagaacccaagttctcaatgacctggcaaacactgggtcccttcacttcctcccttctgacttattttctttggttttgggccacttgtttttctcatcaaccagagatccccgaactgtgcaccctcagatattaggaacttaacatatgacccagactggactctcccagacccagccacctctccgtgcatccccttccttcagggtgatgctcaagcctcggcatcctgaataattggatccaggtgtgcgtgggagagaacgtacaagaagattcaacaggaaccagagccccatgctccttgctctctcttgggaaaggctgggaatgtgctcagtccctgggtgcgttaatcaagagttggggtccctctttcagcctgacacccttccaagacatcacaggcgtccacccggaagcacgtgtgtgagcagccccacgttggcatggagatgagagctggggctcatgataccattacatgacttccttctaacaggagagaaccagcagctg

SEQ ID NO: 37354 - DNA, 1795 bp, Bovine  19866880883436
tgtttcctccttgagtttcaaatacaagactgctgtagtcacatgacaatattgagaggtggaatcttgtttgttactgtcattcccatcccttttcgtttagaatcagaataaagttgtatttcaaatatctaaaataaataaataaagagatttaagtaataaaaaagtatagtagtcaccatttctggtgtaaattccttggtgtagattaaaatgtgcattcaatatcattttcctttggcttgaagggcatcctaaacatttcctgtaatgcaggtctgctagtgatgaattcattcatttttgtacatccagaaaagtccttactcactttcttattttaaaagattttttttccgagtagaaaattttaggttgatgatttttctcagtactttaacaaagttgctacactgtcttctcatttgcatagtttctcctgagaaataggctataaatctcgtgtttattcttctgtacataacatgtcatcttctggctggcattctgtcattatcactgattttgaccaatttgactatagtgtgccttgatatagttactttatgtttcctttgctctgggctcattgagctttggggatctttgggttaatagttttcaccaagtttgaggacatttatttcttcaaatatttatttctgttttaccctcattctgttgattggggagctttaatcacctgtatacattaggatgattgaagttgtccatctttgatggaacgtgacctgcaggttatgatagagatctcccattctgcctcttccaggagtccaagagcaacctgtacagccaatatgaagagaaggtgcggccctgcattgatctcatcgactccctgcggtccctgggcgtggagcaggacctggccctgcccgccatcgctgttatcggggaccagagctcaggcaagagctctgtgctggaggccctgtctggggtcgccctccccaggggcagtggtaagcaattggcttctgtgttggttagctcaggctgcagaaacagaggacctcagacttgggcttaaacaatagaagtttacttctcaaaatttgggaggctagaaggccaagatcaaggtattaccagggttggtatctcctgaggcctgtgtcctctgctcacagatgactgtcttctcctgtgtcttctgggggatggtggaggatgtttgcagaagtctggggtttcccaatgcagtgtaccacctgggctgatggaaaacaccggggtgaagcaaaagatctaaagtaggggatttcaagtcaaactccatctgaaatgtacattctagatgcacattcgtgagtcaccccagatagcatgcctcagagagtcaaagggtgagaacagggagtttgcagttttaggagcctcccggatgattatacaaatttaagaaccactggtctaagaccaccatataggactgtatagacctgatgagtagtggtttcctaggtattgttacaagatgtcctcttgtgctgaggctgaaaaaacttgggaatgaagacgagtggaaaggcaaagtcagcttcctggacaaagagatggagattccagatgcttcacaggtggaaaaggaaatcagtgaaggtaagtgtcccatgtttgttcttcatgcctatttgcatatctggtcaacgaggtgaaatagatggggtatgcctgtcactgttcccactctcccctttctaggcctgttctggtccctcaggaaccttcccttccctccatcaggcccccagctctcttggatttt

SEQ ID NO: 37355 - DNA, 1477 bp, Bovine  19866880896930
tgcggtttcccagctctgcctcctcttagcaccatcagccacccacatctttagatcataatgtttctctgagtgagaactgtgtcctgggggggaaatggggaattagatgtggatggaggataaagctgatgatgaatttctggtttcattttgcttatttttagtccccttttactctgataaaaacgttgcttactttactctcttgaacagagttcagggaccatcaagccaggatgatgtggttctatataacttttttcactcatcattttatgctaattcctccttttcaagagaaggaattgaagggaagcaattagagggagggtcattgatataaaattatctacaataaagccctgtaacttttattgtcatgagcttttgatttatcttgcaatgtaacgcacagtctgatttcatattcaggtactagctgaattaaatatgcaaatttaatggcccaggcacacgcagacaaggagacacaaagagataagagtggaaatacctctctgcagtccagattaaggctctggcctccaatttccaattttagaatttctatctgataataccactcctccttaataggggtgtaccagatgtctcctttgtacaaagttggttcaattccacctaggacctgggaaggaaaacatttacatctttaagagaaagaaaatataggcatattacaaagtcacacagagaagcgtgcttttttgctttttaaatttattttttaattggaggaaaactgttctgccaatgtggtgttggtttctgctgtacaacaaggcaaatcagccatagttatacatatatcacctccctcttgagcctcccacccctcaccctactccatccctccaggtcatcacagaacaccaggctgggcccccagcgttatacagtaacttcccaccagctatctgttttacacacaatagtgtatacatgttgatgctacttttcccattcattccaccctttccttccctcactgtgtccacaagtccatgcactacatctgtgtcttcactccttccccgcaaataggttcatcaatactattttttagattccatatatatgtgttaacatacaatacttgtttttctgatgagaagcatgctcttataaggcaaaacttcactggaatcagtacttccaatttaacaggatgttataaacaaatgcataggcctggaaattaaacaaggaacattctggggccatgtgttggaagatcagagtcccactctaatcaggatgctttgataatttctcttatgtagaggaaatgcatacagttccagctttctgatactgagatcctcccccaccccatcccagtcgtgggcaaagaaatgcaataaaatggttaaccacacagactgacaaaaatttagttcctcggaagatgaaggatggcttcctgccccacatatttgcatggaaagaggaa

SEQ ID NO: 37356 - DNA, 2994 bp, Bovine  19866880989097
ttggttttctgtttattgagaactgtattgttaacatctgaattcacctcttccctttgctagagcaacgtcagtaatgattgtgagtctaagaggtcaagctgattcaatctattaaaatgttagcttgcttgccaatttcagtgccaacagattttaaatcactcatataaaaagggttaaatgtgacaagaaaaatagaaaacccaggtacattgtgcccatcaatgaccttgggaacctgttatgaaatcttttcaattttgaaaggataaaataaatggttggaaagagacatttaaaaattatatgcagttctaacaatacagtcagccaactaattggggcctgtttgtggtaatgatctaaagtgacatccatctccaaggcatccgtcagctttaacaatggtgacattgtgtgctcacgggacccgcaaggttgtgatgcgaaaattatccttcatttggctccttcagccccgattccaaaatgaacccttcgagaaatatttgcttaagactgagctttcaaaataaagcaaatgtgcttttaaaaaaatcaaaagaagttagagacgatggttttgccagagcaaatgaattaggtagagttaggtgtaattttagacaaaacaaggttagtttcaggagagtcaccaacaggagttttaaaaagttaaacaaagctcactaatgccatggaattccacactggctgcccagggatgaaatgaaggtacaggctcagagaggaccagctcagaacggtgaaaaatgacttattaaggccaagggaaatgaaaagactcagagtacacttacagtttttaaagcaatttcatgggttttgaccaaaattgcttaatatcactagaaaaagctaaattttcataaggtcttctaaaggaaggaaatcaagaactggaaaatataggtcaaggggaacacctctctgaagtaaaaacaaaagttttacctgtggagaaatgtctatttggatcttctgcccgttttttgatccctggtggctcagatggtaaataatctgcctgcaatgcaggagaccaggttcaattctgggtggggaatatcccctggagaagggaatggcaacccactccagtattctggtctggagaattccatggacagaggagcctggtgggctatagttcatggggtcacaaagagttggagtccactgagtgactaacactttcactttaatattgaatcttatacattgtttgtacattttgaagattaatccattgctggtcccgttgtttaagattttgctgtaatttatgtcaaagagtgttctgcctgtgttttcccctaggaattttagagtgtttggtcttacatttaggtctttaatccaatccactttgagtttatttttgtgtatgatgttagagtgttctaatttcattcttttacacatagctatccagtttttccagcaccaattattgaggagactgtcttttctccattgcatgttcttacctcttttgtcatagattaattgaccataggtttatttctgggctttccaacctattccattgatctatgtttttgtttttgtgccagtattattttgatttctctaactttaatatcaaagcaaaaacagaaattggtttgcccaaggtatcgggattaaccagtatcactgggtgttggcctcatcacacacaacagctggctggatcttcatggcagtactatttttgcaagttcagtctgagcatgtagtattttcttaatagccacacaaaagccatgctcttcaaccaggaattcaaagactcctcagtctagcctcatgttacctgtgatcctgtattcttctagcatctacactactgattgatgagtcctttcctctttcctttccttcctttttgctgtcctgtcttttctcacgaccccccaacccccacagtcattaagaccatgagcccttggcttatattaagcctgtaatcccttctagcttcccttttgttaaaggcctctactggtttccccatggcttaaattcatggcttaaaagagcaaaaaataggaacatatatacaatggaatattactaagtcattaaaaagaatgaaataatgccatctgcaggaacatggatggatctagagactgtcataatgagtgaagtaagtcagacagaaaaggagaaatatcatatgacaccccttatatgtggaatctaaaaagaaactatgcaaatgaacttatttacaaaacataaacagactcacagacttagagaacaaacttatggttgccaggttggggggctgagaagagatagttagggagtttgggatggacgtgtacacacctctacatttaagcaacataatcaacaaggacctcctgtatagcacagggaagtctgctcaactttatgtggccgtctgcaagaaaggccagtttgagggagaatggatacatgtatatgtatggctgagtccctttactttcacctgaaaccatcacaacattgctgatcgtctatcccccattgcaaaataaaaagctaaaaataaatttcaaaaatataaaatatatccaggtctttaaaaaaaagcacaaaatacattctcctgtgactctggaggtcagaagtccgaagtgggtctcacagagctaaactcaagggctggttcattttggagatgcctgggaagaatctgttcatttgctgttatggattgaatgcttgtgtcccccccaaaattcatatgctgaaatcagtccccggtgtgacagttgtttggaggtagggctttggaggtaattagtttatgcagatggagccctcatgaattggatcagtggccttacaaaagggaccacagagagctctctagttctttctgccagctgagaactcctggaagtccaccatctgcagcttgaaactgaccaaactggcagactggtttcaaacttcctgcttccggga

SEQ ID NO: 37357 - DNA, 1752 bp, Bovine  19866881006467
gcagcagcaaggaccggaaatatgttgtttgggggtgaggataattggaccattgcccagggcttttcagaattgagaattaaaactctgtgcccagattgaatctaaaacggtcctttgttgttgctgttcagtcattcagtcacatctgactctttgtgatcttccctgtccactgtctcccagttttctcaaactcatgtccattgagttttgagttttttattcatcatctaaccatctcatcctctgttgcccccttctcctcctgccctccatcttttccagcattagggtcttttccaaagagtcctggatgtggctttatgggtaactagaggcttcccggatggctcaagcagtaacaaacctgcctgccaatgcaggagacacaggttcgatccctgggtcaggactatcccatgcagaaagagatggcaacccactcaagtcttcttgcctgggaaaccccatggacagaggagcccggcaggctacagcccatggggttgcaaagagtcggacacgactgagcacacatgcacacaaagatgtgacacactcagccagtattcacgtctctctcctgccctgtgccccaggatagcagatgctgctttagaaacctgtcctaggaccagactgtgttctagggtacacacccaagtctgcaggtgagacattcataggcttcccccctttgcatccctccaggctgaaggaagatgccaagaaggccatagaagccctgggaagtacagagatcaggaacatgcgattcaggtcaagctgggtgtttgtggcagcaaaaggctttgaacttcctgcaggaattcagagagaaaaggtgagtggttgttaaacatcccttcttctcagacagttaccgtatgtcctagcaattccattcacagatgcacagccaagagaacaaaaacacatattcgcacaaaatcttgcgcaggaatgtgctattactcctaacagcaaaaaagcagaaacaacccaaagattggatgaatggacttaaaaatgtataaataaaatagatataagtgcccactggaacattattcaggcacataaagaaatgaagtattgatatatgctgtgacatgagtgaaccttgaaaacacactgagtgaggaaaaccaaaaccaaaaggccgtataccgtatgattccacgcgtatgaaagttccataacagtcaaaacccagagagagaaagtagattaggagctcactgggctatggggcatggtgagtggatatgggctttcttatttcaggggtgaaaatgttttcgtttgtgttttgccaggatgtggcttgcagggtcttagttccctgaccagggtttgaatccaggctctagcagtgaaagcaccaattccttaccactagactgccagggaattcccagaatatgttttaaaattgagtgtaatgatggttgcatgtctctgaatatactgaaaaccactgagtaaccactttaccattaaaaccagtaaaaaccactttaaatagatgaattttatagatatgcaacaagcaacacaggtttactatatagtacagggaactatagtcaatattttgtaataatctataacagaaaataatctgaaaaataatatatgtgtacatgtataactgaatcaccttgcagtgtacctgaaacataagtcagttatcagttcagtagctcggttggtctgactctgtgcaagcccatggactgcaacacg

SEQ ID NO: 37358 - DNA, 2404 bp, Bovine  19866881140176
gggcatcttatggagacacatattaatttggtgtttgctctagcgaccatatgctggtcaggttctaggccctatttctggctacagtgaaaagcaaacaaagctattcctaagataatcgcctttactttatgctaatttcttgttagcatttaaaatcaattccttattttgacttgttaataactattggatatcctctctttcctccaaaaggcaggcacataaaacagcttatttggacacatgatgggctcatccccaaatttattgtgaaaaatgagtggtagtaaatgagctttttgaacaatttatagtcaaaatttgaaaaacgccagagatttgcctcagacagatgacttaagcatatttaccctttatgcatttgaatggctacctctatacttgattttggaaaatgctccttactgcagccctcaacctctgcatctggtgtaaactcccaggagataaatgaatgaatgactgaatgaaatcagtttattcattcagtaaatgttaagcatctattgtgtaccaggctgtgttatagacacaacacaattccctaccacatgaagtctaaattctagtggttctgttttcatcatagcaaggaggtgctcagccactctttggtaagggcagaatatttactgccacatctgctttgggtcatggttgccttgggtctttcaacaccatccccatcactgttaccttgaataccatcactgttactgccatcttgaacctcacgcaacagtggaccggttcaaatttgagaaaggagtatgtcaagtctgtatattgtcaccctgcttatttaacttctatgtagagtatgtcatgagaaatgccaggctggatgaagcacaagctggaatcaaggttgctgggagaaataacaataacctcagatatgcatatgacaccacccttatggcagaaagtgaagaggaactaaagagcctcttgatgaaggtgaaagaggggagtgaaatagctggcttaaagctcaacattcaaaaaactgaatggcgttttttttgttttttttttaaagatcatggcatctggtcccatcacttcatggcaaatagatagggaaacaatggaaacagtgacagattttattttcttgggcttcaaaatcactgcagatggtgactgcagccatgaaattaaaggatgcttgttgcttggaagaaaagctatgatcaacagagacagcatattaaaaagtagaaacatactttgcttacaaaggtccatctagtcaaagctatggtttttctagtagtcatgtatggatgtgagagttgaaccataaagaaagcttaaaactgaagaattgatgcttttgaactgtgtgttggagtagactctagagaatcccttggactgcaaggggatgaaaccagtcaatcctaaaagaaatcagtcctgaataatcattggaaggactgatgcttaagctgaagctccaatagtttggccaccgatgcgaagaaccaattccttagaaaagaccctgatgctgggaaagattgaaggcaggaggagaaggggatgacagaggatgagaaggttggatggcatcactgattgaatggacactagtttgagcaagctctgggagaccatgaaggataggggaagcctggagcactgcagtccatggggtcaaaaagagttggacatgactgagtgattgagcaacaacaacaacaaccctgttttatagatgagaaaaggtatatgcatattatgactattgaatccattatatatggttatattttatttgaatattcatttcaaaagcttgaaccatgttgctctatttccttacggattcttaggttttctgggcggaaatttgcttgttgctcaattgtgggtcctgctcaaaccaggatctatggaaatagatgagttgtgcccttaaggatgccccctgtgctcccgagggcacacagttacgcatccttctttctttctttccaccttagttctctgtcttcctgcgggaaccactgtctcaggggtaatctgtgcccttctgctcctttgacagaaatctccattaagtttcttttctcctaagaagagctccacaattcaaaccctcgctcatcttccctctcatctcttcccatcacatctcgtatctaatcaattaccaccactcagacagctgtcacggggagtgctgaagcctgtgagccttctgctgcagcctgttagagggtgagataccttaatgtgttacttagtcccagaggcatcagggaacagaaaggtaattttctacagtgatggctttggcatcaaccacaggcagacaggagagaaattcgtgggtcagggtaaggcggtttaccctttcatgtatccttca

SEQ ID NO: 37359 - DNA, 1140 bp, Bovine  19866881265433
tgatctagggcttctggtgtgtgtcattccaatgctggaaatatgtgactaatgctagagtgtctgcttgcacatatgtgtgacccatgatgtaagggagacctggcacaggagtcacccacattgtgggctcttacctgtcctccgagctctcacagaattatgtttttagatgaattttagggaggaaggtataaaagagctttaaaggagtggtaaattatccatgttgagggcggtcacgtgaatttgtgatttttctcttagacgcactttcaggtccaacagcgattcttttgaaagaccagcacattctcggtggcagggaatgttctgtcccgtatcaacaggatacaatttctcttctcgtacctttaaatgttccaatctggatttaaaaagaaaactatttttattttaaccaatgtagatgtcattttccattagttcctggggatgtacatttttcagtagcacttggctctgatagagtttctgccactgtgtgcctttcagtatctaaacaaaacaataacctctactctgaattttcaataatgagatgctaagtttcttcaatgagtaaattttcagaaaatgttttatttcgaattgaatttgtcatttgcaaccgaaaacagggaagttggagagagtgtttgaaggctgagaggggctttggccaggccctggcctgcttgctgaatctaagtggagtgtcctggagtgatgggtgtgctcgactccccgggggtagctggtttgtgctaaacctggttgccctgtctcgcacatagctgagactcaggctggtagggtcactccagctctgtttcccatgcttctggatctaggaactcaatttcatcagaacctgtggggatcctcaggcccttaattttactcactcgataaacctgcacaagctgaatgtataaaccctcaggcgaagatgccggtttcagtgattccagcactctggctcttccaagacaaatcagttatggtatcctgtctcatcatccatatactccagcctggctaccctgtctccgcaaccagcatcatcatctccagcctgtctggcccgccttcccccctcccccaacaaaaccagcagcagcatctccagcctgtctg

SEQ ID NO: 37360 - DNA, 795 bp, Bovine  19866881335963
cacagagaggttaagtgccttgcccaaggtcacacagcttggattttaaccctccagtttgacttggtgtccactctttactactgtcccctatgtatgtcggtttactttctctattcatgtcttcaattgcaaactcttctatatctgaagaggcagggagtgagaacattggaagaaaatatttatttctaattatttcgagaatcaagtgtctttactgttacagtgagcagaattttcccctcttcttttgcagcgatgtttgttcttcaaaaacagtggtttctttacgctgtataggtaagtgttcttggttttctgtttctaaaatgggatgcattttggtatcccatttgataccaaaatcaaatggtatcaaatttgataccttattgaaatgtatcccagtgtgtctttgggggacttggagatagaaggtggagtaacgcgtcaggacacacccagcaccctgcccaagggttcccattcttgaatctggatacactttagatacctattgctttggtccaagaaacagctgtcccaaggacagacaaactgcagagacagacaatgtggccctctctgtggtgtccacattgtggggctggagacccatgggtatccccattccagcgtttggactacttgtagtttccaaccttttgggcttccctggtggctcagacagaaaagaatctgcctgcactgcagaagacctgagttcaatccctctgtcagggaagatcccttggagaaggaaatggcaacccactccagtattcttgcctg

SEQ ID NO: 37361 - DNA, 1519 bp, Bovine  19866881504685
cttattttgctcacagctggcacattaaacattgttgattagatgaatggatacattaaatccttttctttcctttgcacagatcaaccactcagatgatgtgaagaacaggtattctggctggccagccgagatccaggtagaaggctgcataccaaaagggcccagctaacactgccccgcctcgataaatgggcttcttatagacaaatgcatcctgaatggactacgggcccttttccaatggtcaatatttgatgaatatttcaggtttgtcaaccaaccaatcaaaatatttgccagttgtataaaatcttgtcccacagactttttatgccagtgtttatagagtgaagatgttgagctgaaatacacgggagtgttcaagaggattcagtgacatcacctgggaagcagcccctgcctgtccaggtgtggagctattttatcatcagatccaagtttgacccatgtggtccagatagctctgcagagagaaaacctttattctccgaccacggagcacacccttgttatggacggtcatctcatagggacaatgagcagcagccatagggcttagctaccttcttgggtcaaccttcttgagctctccctgcaggtccctgaacttattcattcatcccacaaatgtgggtgcgcctaactcaggcacaagcaatatgatggtgaagagattcagtgtctgcctccatgcaggggtgttgctccagtggcaccttgtttaacaggatggggagggagggatctctgatgggctgggtgggcaggggctgctctcaggaggaccactgtacaacccagacttcctaggagacacacagtagatccacataccaagatgcccagtgccttggggttaagaaaaccaagtcattgccaaatgctctttctgacctccctcccaaatctggctcccagaaacgataggagactttgatgccagcttgatagtgcttatctagcctccagtttctcatctatccatagaggggttggaacagatgaacggttttcaagtacgtttatcagcaggcctccttttaaaaacatggcagtatgtgtcaccctgaatttcagcatccttgcaggacccgactccccaagtctcagtggctgacagcagtgctgagtcctccatggttgtagacgggctgcagggcagtggaggctcaattctgagcgtgggggccaggctaaaggagggtccctatggggcatggaagccagagagagcacaagtgcagatgtttgccagagctcctgccaggacacatgtgagccctcatcattgcatcccgctgccaaccagggtgaacggcagcctcctggcagtggcggggggtgaccgtcggcccctcagggagcctgcgtctctttctgcagaggagtctgcaaaccactcggtgggatcttggctggggccctgttacaggctagactctgttcctccctgactcgtgagttgagtcataactaaccggcagcaccacagaat

SEQ ID NO: 37362 - DNA, 1044 bp, Bovine  19866881708683
tgatttatttctaatgacataggtgacaccaggactagaacttggcactaaaccatgcctggcaactcccccagtggggatctggtaagaggaatctgacaaatttctatttgagaggagaccctattaaatgaagaaatagtccttctgcttctcttgaaggagataatggaatccccaaagcaaaactgctttgcagaatctacggcccaaagctctgtgaagttgttaatacctcattgctgggagttactttcacagttttgaactgtaaccgaccccaaatttatttcggaccaaaaagtctgcatttcacagaagcaggtaagaaaaatccttacaaaagtctgggagagggctgtgttcagggagaccgtccctgttgtcacacaccaggaatctatttctttaacaccaggtccctgtgttttggctcataagaaacacaaaatagttcaccatggtgatcacacaccagtcggttgcagttcttctaaattccagaggaaaaaataaaatcaatccccatctcattgctatttttgataaacagtttcaggttctgaagacagggtttcatttcaggcttctgaataactcatcaagaatataaagcatcagcctatttaaaaaaatacattgttcacgtaaaaacatcctttttctatcagatagttgacaaggttttgacaaaaacctgatgctaatttgcatctttcaggagaggaccatcttccagccccttccacagtgtgctgcctaataaaaatgatacccccaaagggctgctatctcctttcctgttcaaagcaagcctgcttgaaggtttgccaagcgaaggatcaatttacataactggaggaggtgcgtgtcactaacagggttttgactcaaagtccaaatttcagcagcaaggcatgccaggaaaacgtcccaatttcaattgtctatttcattcttgttgctaagttatgcttttgtaatttcagtatttccattaaaatgtcacatccactgacatctcagatgaaaaggtagaggaaa

SEQ ID NO: 37363 - DNA, 741 bp, Bovine  19866881725408
tgggtgagaaagatcccctagaaaaggaaatggcaccccactccagtattcttgcctggagaaaccaatggacagaggaacctggtggggcacacacagtccaaagaatcggacatgcttgggcgactaacacatacccacacacacatacactccctctcaccaccatcctgcctctgtccccacatctcacccctgccccctgctccatcctgatcaaagcaggaagaacctcatcacccacacacccccagcaactgcacaactgccacgcggctccctgcaccccactcctgctcacccttgaaccctggatgccttcacagcatcccagggggctcaggcatccagcaagcagctctgacagtgctgaccagcacatactgctgctggaaagagcagaaggaacccaggacagggcaaggccagggaggtaatgattaaccacttactgagtttaaagccatcctgatgttatcagcagcatcgggtaaagggaggtatttggaacgttcaagttgacctagaggaaagaacaacaggactgttttgcttctgtgccggtgagtttacgggagatgagacgggaaagaaccagaagaggtcctgggtgatagtcagctctcaccacaaccacggcgggtctgcctgctcaccttcaccttcacctcatcacctgcacccacagctgcccatcctgaaggagctggggacctgctcgcttgtaacttacattcaggg

SEQ ID NO: 37364 - DNA, 961 bp, Bovine  19866881809513
ttttagatatacacatgccctttagttcttaatgtagtttattattaagagactgaaagtcttttaagacatgaaatacaggtttcttaaattttttttccagtaaatattatacttgatgcatttggtatgtgaaagatacagtgtgtatattcggatgagatactctcagaatgagcctgtgtgtgttaccagggtcctgttcttaccttccagttttacgggagccctatacagtccgtgtggaggaccagaaaaccatgagaggcaatgtcgcggtcttcaagtgcattatcccctcctcggtggaggcttacgtcaccgtggtctcgtgggagaaagacaccgtgtcactcatctcaggtagggcgtgggcttcctcggggcaggcagggcgccaggctctcctgcgcacagctcggtctggataaccaatcgggtctccatctcttcgcgcactgtaatgaagaatttgtatgctttaagttgacgctgctttagattaaacgtgatttcggtgttttcttttggtttatatggctggattcatagtgtccaatgaattgactgatggatagaaatttgttccttgcattatgtgtatagtcattgagttacttttggtttccaagttaccaaggaaacattttggttttatttctgctcccgggaatagaaatataggattgttgttatctgtgagaaacctcagaactgatattcttatattctctgtaatctggaaaatggaaatcctgattttatgctattctcagcctttcaagtgtcttcagagtcatgtggtatctctggcctcataaagattttttttgagatatgtagtcagtggctgaaatacacacatacagataggtaggtagataggtatgtatataaatagcttactggtttacttttggtatctagaaaagatatcactgaaatctagcttctaagaaat

SEQ ID NO: 37365 - DNA, 4975 bp, Bovine  19866879992949
tggagagtgaaaaagttggcttaaagctcaacattcagaaaacgaagatcatggcatctggtcccatcacttcatgggaaatagatggggaaacagtggaaacagtgtcagactttatttttctgggctccaaaatcactgcagatggtgactgcagccatgaaatgaaaagacgcttactccttggaaggaaagttatgaccaacctggatagcatattcaaaagcagagacattactttgccaacaaaggtccgttgagtcaaggctatggtttttcctgtggtcatgtatggatgtgagagttggactgtgaagaaggctgagcgccgaagaattgatgcttttgaactgtggtgttggagaagactcttgggagtcccttggactgcaaggagatccaatcagtccattctgaaggagatcagccctgggatttctttggagggaatgatgctaaagctgaaactccagtactttggccacctcatgcgaagagttgattcattggaaaagaccatgatgctgggagggattgggggcaggaggagaaggggacgacagaggatgagatgactggatggcatcactgactcgatggacgtgagtctgagtgaactccgggagttggtgatggacagggaggcctggcgtgcctcgattcatggggtcgcaaagagtcggacacgactgagcaactgatctgatctgaacagatgcaaactactacgaataaaacaggtaagtaacaaggatttactctatagcaatagggacctatatttaatatcttgaaataacttttactggaaaatgatctgaaaaatatataaaactgaatcactttaccgtacacctgaaaataacacagtactgtaaattaactctacttcaatctgtaaaaacacacagaaagaaaaagataaatagcagaacagagtgttaatcaactagaaggtaacagttgaaaattcagactgaagtgcagagaaaagcacattaataaagaaagtgcagaaaaagtacaaaagacatggacagagacaaaaagtctaatagcaaagaagtcctaacagggaggtaaatggaattatgttattaaaacatttttatgttgtttaagaggtgacaaaatactaattcacaatagacttaaagtttgaagagcagtaaaagtatcaattcatggtaatttacagtacgtcaaaaaagcacattgcaatctctaaagtaattactaaaagaataacaaaattataaaattaaaaagctaatagtgaaggaaattttgataataaaatgtgtaagattgctcaatgtcattaatcaccagggaaactacaaatcaaaaccacaatgagatatcacctcatacctgttaggatgcttattaccaaaaaaacaaatgacaacaagtattggcaaggttggggggaaattggaacccttgtgcactgttggtgagaatgcaaagtggtgcagctctttatggaaaagagtatagtgattcctcaaaaaattaaaactacaactaccacacattatccagcaatccaacttctaggtatttatccaaaagaagtgaaatcaggatctcaaagaatattagtattcccatgtttactgcagcactattcacaaaagtcaaaatatggaaataaccaaaatgtggataaatgcatgaatgtattaaaaaatatggtatatacatacagtagaatattattcagccttaaaaaagaaagatatcccatgcatgcatccatgcaacaacatggttgaaactagaggacattatgccaagtgaaataagccagtcacagaagaacaaatactgcatgattccacttacatgaaatacataaaataatcaaacataaaaaaattcagttatacaaaatgaataagttttagagattgtctgcacaacattgtgcttatagataacaatactgtattgtacacttcaaaaatctgttaacagggtagatctcatgttaagtgttctcatcacactaaaagaaaaaagaaaaatacaagattaatccaaaaggaggctaaagaaaaaagaaagtatgaagaaagggttggagtacagaaggaaaaatagatgatttttgatcctatgtggagtcaatttgttgtaaagtttgggaagtacaatggagaagtcaatatttgtggccatgtgctgcttttcttgctccattgggaatccatctcaatttttgtttggagaatcatcttttcccgtttttaatccatgtagtttgcatgaggactgtaacctctgtaactcaagataagtcaatgagcctcaattctgataattttgttagaactttggggaaagtggaaaatgtggacttgctagctctgatatttgtaaatccggcaagttaggggcggcacaatgtggggagagttgctatgccatggagagttgctgaagaatgaagccactggggaaagtagagctaatggatgggaagaaacatgaattctaatgccatcatttgagctcctggatccactcctgtctggattccatccatgctgaaatttttagttatacattctcttcttggtttaaagtcagtttgaagtaagtttctgtcatctgcaatttcagagtcctgataggtatgctcaatatatggtgtgtgtgtaactcgcttcagttgttgttcaactctttgtgacctatgaagagcctgccgggctcctctgtccgtggtattctccaggcaagaacactggagtgggttgccatcacctcctcgaatgctcaaaatatatttagtgttcaacaactgcttagataaaacataaacaccattattactggctataatataagttaattcacagataagtggacttgtcaaacctcattaaacattctttgcccaggtatgttaagtgaaattcagatcatagaagagcacaaattggttaactctttcaaaatattctgatattaagaaatgcagaacttccaataattcaattagatttggtgaatgcactggctatttgaaacatcatatttcctcccagttaggagggagctggatcagttctctacctctgtctcccactctctctctgtgtgcgctgacggatacacacacacacacaaaacattttttcttccaatcgaaagctttgtttggtcagtggtcatgtaccgttttgaaagagaattttgagcagaggcattattatagaaatatgttaaaacccattgatactatgtaaatgcttgaaagagatatatttattaataacattgattttgtgctactaaaatcatctttggcaaacatggaagattagtttatttagtttttgtttgtaaaaattagtgaaaatccaaaggacaattagaatcaaaacaatggcttgtgaaatattatttctttaaataattactttaataatttttaaagtattaatacttccattataggcatcatgataatctctaattttataactatttcctaagaggatataattcaattacctactttcaatcacaagcttttaataaaaatcatactattctatgaattttaaaattctgtataatcatttaaaaacttttatgtagtccatataattaaaccttagagtaacccaaatttggtaataacttcacttcactttcacttttcactatatgtggttaagatgtgtcaatttcctttaaattatgcaaaatggatcaaactgaaactaagattttctcaagacttagtgggattaataacattgtaattgttttaacatacaccaacctaagtaggtcttcttccttgagttaaattgaaaagtgctatttgtaagaaatgtttactgagctttcagattcaaatcacactcacctttgtcaattaataaaatacagtagccagagggaacatgttgaaatcagacaatctatgttaaaatcagaaacatttggaccatagagaaaaactcaaagtgtaaaatgcaattgaacataatcttgcagattataaatgtagtaatgagatattaaaggaaaagaacaaatagaaacaatacccgttttagttgctgttcttttaggcttctcactgtccttgcaggctcagaaatgaagtttttatagttttcacatatattgatccgagactgggctacctgcattgttccctcgagaaaagatttccaaacaggatacatgctcctaaattcaaagaagaacagaaaagtattaggcagagaaaaggaagaataagttgcctaaccttttgctctctggctagcaccgacaaacagaattaatactttctttatagtttaaagtgtatttatattggttcataggtagtaatgtttttagcatacttaacaagtagaaacatgggaatacgctctatttctctatagcctgacaatgggctgttttgattcattagctattcttgatactggagtaaagtgatacaaggcttacaattctagacaaagctaacactataaaaaattagtgaataattcagacttttcaggcctttcactgtttcaggactgtcattatgaataccaaatttcattattccattaaggtattttcctgattttagagatgaggtaactgaggctcagatttagaagatcaccctagcttacacaagaatgtggcagtactgagatacagacaaatacctctaaagtaccttttctttcaactatattatattgctctcttacataaatggatgtgactggaaaaaaaaaatcatgaacaattgcttgtgttcttgagaagtctatttgttagacaaaagaagtctatggtattattgctctacatctgtttctctgttgtaataacacttagccagcatctcattgcagcttggagtcattccaaccaagttccatcacctttgcttgagtaaagtgtgctctcatcaattttttgagtagggtcaaagaag

SEQ ID NO: 37366 - DNA, 1824 bp, Bovine  19866880171555
ccagcaatcgaactgggttcctgcaggcggcagtgcctaacagacattagcaggaggaggaccgagcctgcagagtgggtgctagccatctgggtctggggccctcccaaagaggaagtccccatggttctactctgggccccaccgactgtgggcaaggcctggcacctttctggtctgttttcctgctgaggtgcttaagatgcctctctcctggcctggggcagctgggtgggctctgtaaactgtggagtcctgcatggtggggggtgcatgcagtagagctcttctttcctccaagcctaggagcaccctgggcatcaagaccctgcaaggcccagagagaagctcccagttcctggaggactgggagggaaggacaggagaggaggcagcacagatggggtaaaataccctgctcagcagtctagcataatggctaagagcctgagctagggagctaggccgtctaggttagaacctcttactgtgtgatctagaataagttacttaacctctctgtcttggtactcccacacctatgaacaagtaggctaatagaacttagatcattgcctccaggatgaagtgagttcatgcacgtggagagcttagcacagtgcctggcaagcaacaagcgctcaataaacgccactgctgctgctgctaagtcacttcagtcgtgtccgactctgtgtgaccccatagacggcagcccaccaggctcccctgtccctgggattctccaggcaagagcactggagtgggttgccatttccttctccaacgcatgaaagtgaaaagtgaaagtgaagtcgctcagttgtgtccgaccctcagcgaccccatggactacagccttccaggctcctccgtccatgggattttccaggcaggagtactggagtggggtgccattgccttctccgcaataaacgccacagctactatcaattcttgtctcctaagctcccttaccccaggtctggcagctgtccccaaggcatagcctcttttctaagtctctgctccttgacctggaggcagtgcctccctcttctgacctggagaaaaagaaacaatctaagttcacctggaacctggagggctgagaataaagcagaagtggccattataacatcttgcccccctccctcaccccaattcccaacagagctacaaaggcctggatgggtcccctttgggaggccttcactcaacgacatgagctccttgcatccacacagcccccttctcagtgtctgacaacagggcaccaggacagcagcaggccccagggagcctggctgtgcccagccagcaggcaggacagtactgagatgtccacgcccccggggctggtttctaggaccctttgaagggctcatgtggggaaggcttgctaggagctctgtcagtgagtggggctgaagactgggtctgggttcattttgaggtccaaaattcgtacctggggcaggcctagaagaagcccagctttcctgggcattgctgtgttggggactcctgccaaccactgccctctgccctcaggcactggtacccctgcttagtgggcatctccagggtgcttccccgggggcggctgcctccttcagcaccttctaaatttagggcttgggctctgtgactcattactgaatctgctttgctaccctcctccaggagtgtgctcccacggtatttttatctcctgctgcctcagactgattaataaggccctagaatcctgcagcagccacacacacaccactgagagctccccagtccacccaccccagcttggctctggactgctctctg

SEQ ID NO: 37367 - DNA, 1097 bp, Bovine  19866880440698
actgtcaagtagtagctgggctggactcaccttgaagtcatgctcattcacaagtctggcagtttctgctggtatttgagtaggacctcatcggtctgtcagctggggtagcctgcacatggcctctgcttgtgacctgggcttccttacaacgtggtgctgggctgtaagaatgagtgactcaagagcaaggtagaagagcatggcatgggtgtggcctagctttgtttttgctttttttaaagagcatggcatgggtatggcctagctttgtttttgcctttttttaagattcttttttaatgagcattttttaaaagtctttattgaatttgtttcagtatttctgttttatgttttggttttttggctatgaggcatatgtggggtcttagttccccgaccagggattgaactggcattccctgcgttggaaggcaacgtcttaatcactggaccacctcgctttggatgtcacatagtatcgcttctgctggactctattggttggggcagtcacaaaggtccacccagtttcaagggtagggaacataaacctcatcactctgtaggaagagtgtcagtaccacactgtaagaagaccatgtgtcatggaagatactgtgatagctatctgaaaaatgcaagctgccacactcccctggactgcttatgaggataaaatgagacagtgatgtaaagtacttctcccatgcctggcacatggtgaatgctcagctatagctgtttttggtttttactgatgtggccccttcactttccacctctgccaagaaccacagggatcaccacccacagaggtgctgtgcagtcgcatggccacagaagaccactgacagggatgcacagacacgtgcatgagcctgcacagctgaaacacgtattgtctctcataatcccacctccaagtgcgcactgtctgacctgagtggggcagtgaccctgtggcaggaaggacctgaggctccttaggcccttgatctctccccttcctgttctcaaagcacattccccagaattctggggcccatccagagcagccagtcccaagggagtcctgtggcttggagactgcc

SEQ ID NO: 37368 - DNA, 1597 bp, Bovine  19866880468803
aggtgcctcgggctgcagttggtcacggaccccagtgccccatgcacatgggcacacaacaacacacacacacaccaggactgctcaagagctgagcccatgaggggtgccaaggcacaagaaattctaagcaacagggacccaaagccccatgctctgaaaactctctgcctgttcagacacagtcatagagggagacccagtttgcggcttccaggttccaagaactcccagagctttgtgatctaagaaaatcagagtttccattgtaaatccctttattagaaaaatctgtgctttttacagcctatgaatgtgagagcttggagccctgaaaatgtcggagcccaagatcctaacactctattatcctaactgcctataacaccgagactctaggactccagctccagggtttctacagccctcagagcttgctggtctgtgggctgcatctcatgtttctgtgaatactggtgaggagagggcccctgtgagcccccacacttgccttccagcctccaccttttgttcacaccactatccatgcctaaagttccatcgccctcatctctgctaattaaatctgagacaactttgaaggggcaggaacgacaatgctgtcagggactacctactaagtgccaggcccacacatcttatttaatcatcattatattattagtccaactttacagttgataaaaccgcagtcccaggacaggaggtcatttgtctaaagtcacacagctagaaatagtagaacagtgacccaaacccagccccttgcaaacgcatgcctctgagaagagcccagaggggagagggctccctctttgacttcaggaccacactggagcaggtcctctcacgccagtggctccccaagttccagaaggcagagactgtggtctcctcttctcgcctcttcaagctggaggcagcccagagatggccacgtttcctgtcctgattgatcgaaaggagctggatccgccaagactccatgtgggaccggcagacatggcattttgtttctaggcacccgtcgctatggaagccaggtgctgccagcccaaggcctagcaacgaggccctgagtggtgcagggcggagggcaattgtcaggggcctcaaaggcaaccagcaagagagagagggagggtggaccactccgctttccaggctggagggctgtacccgctgctctggctgggctttgcgaggggaggaagggaggcagagaagacaggaccaggcaggtcctaagagacagagacccagagacaaagccaaagaaagacttacagagacagactaagggggatcagagacagcaaaagacagagacaccgtcagagagagggagattcaggaaagcggaggaagacaagagctgagactcagagaccactgagtcacgcaagtggtagagaggaacagactctcagacaagcccaactcctgcggtggggaaagggtgtgccagggagcaggaggcagccacaggggaatgacagagatggatggaagtgcgaaagaaggagataagcccaaggcaggaggcaatacagagacataataaaggaagagagga

SEQ ID NO: 37369 - DNA, 2786 bp, Bovine  19866880551913
taaggccctggaggaattcaggggcttggctaaggtcagcaagaaattagacttagaaattgaatcaagcttgggtctctgggctcccagccccacacagtgccacgtccccttactttacaccttcagggatcttcgactgagttgggcactgatataagaggtaaaggcctctctgagcccctcattctcccctaagggttcttcctggtcctggcgtctgctgaggctggaactcatctaggctgagaggagacatttagctccattgttctgatgaagacactgaggtcccaaggtaacagtgactcactcagtaacaggtcagaaccagactgggcctgactgcctggcccttagcttgtccacacttcccccacccaaagctgtcccttgcttctcttcatcccgctgtgcagccttgctgggcctgccagctttgatggatggccccacatctcagcctcccttccattcctttccgggtgctgggctgttagcctcctaatcaccagtcctgcctgtggttcgccaagccatccatctctccaaaaaacctcacccagcgcaggtgggttttttggggttcagcaggtcccccttctctaaggccaagctgaaagtgtggctgcaggccctactccaggggagtcaggggtcaggaagctgtttacaccccgttgctagagggccagaaatccccacgagaacttccaagggaagtcatacatgcatacatgtgcatacacacatgtgagcacaaacacttgctcacaaaaacagtattaaaaactttcatgtatcaaaaaaattactgtatgccaagcattgtgccagagctctgcaagtatgatctcattcagctagttgattactgttgataaccccaatgtacagataaggaaactgaggctcagagaggttaagtaacttgcacagagtcacatatccagaagatggaggaactgggatttgaactcaggtcatattggctcacttttgtatttgccacttctctgttctactgacttacgcatgcacacaagtgcacacacacacatgagcacatgcacacatgcatgcacaaacaccagcctccgtgtggacccctgccccgcctgtctccctggacctggttcctaaggagtagagagagtgctgggctgaggaagagacgaggggtcactacttattgtcccccaggctgcccccagactctcaccctgacagtgacactgatcagccatggaggctgcatggaggaggcagcctccagttagtaggaagaggaggctgagaggcagtcaatcgattgattacccctgcagcactgccttccaggaacctgggcccaggggagtgtggcgccatgggtcgatcatctgggatgcagcccaggttccacatgctgggggtgtgtatgtggagtgaggctggcataggtcccctgcctgcccccttccccctactttgctgaccctacaccttccccctgctcttcccgctgccccccaccatgggcactgcagctgggaatcaagctacctgttcccagacaccatgtgcacccactcctgtgggattactgtgctccagaggctgatcctagggttgctgcttcaaggtgaggagaggtcaggcagggaggccaggggccaggagttgcagggggtgggagtgagccttcatagacctttgtggccaatttaataagataatgaatgtaaagtgcttcgtaccaccagggcatgcaataggagcttagtctttgctggttcctccctcaggagtctgcagagagtgaggctgatgggggtggatgggggtgcctctgagggcacctgagctcccagagggactgttgggtgccactgacagtgttaacaatggcaggaacgatttagctctgaaaaagaaagagggagagagattagtacctgacaagtgtcagagtctagccaagaattatcatctttctgacacagggaggggaacagctggtgctgggaggagtggctgggaaccttccccgccctcctactgggaagggcccctgaacaggtctgtgttgcccccttcctggatctgcttccattctggcagagggacctccaaaaaggccctccaacttgcactggtccccaagagacctgggttcaagtcctggttcaggcacctgctggctggtgctggttagggcaagtcactttccacctgtcttctctgtggcagtcctctctgagggcctctgtcttctcatctgtggcaagtccccaagaggattaaatgagatgtcacgtgtccagtgcctgccatttccctgcccacaaagggccgtgccccctgggttccccagagcctgccttccctgttcacagccccaagagtgacagctgtggtccatctctaccctggacgccatccgctccaccttgggtccccactgtcctgactcagagcctgttgttgaggaagaagtaggcaggggatcgcatcacaggctccgtcatcttctctctcactgtggggagaagagtgggaggacagtggacctctctgtactgacggtgactccatgggtcaccaaggcccggtctgactccgatgggtgttggcaccgggctcaggactgggattcccagggcctgacttcctactgttctggacactgccttactgtacgagcttgggcaagacctgtcctagggggtggggtaagagagacacggaacctctctgaccagcctctcttctgagggtgtgtacctggatgattctgtgttctg

SEQ ID NO: 37370 - DNA, 1540 bp, Bovine  19866880590884
atgggctcttagtcgctagcccctctgcatctatccagccctggtgctcagggcacaggacctggtcaggcaccaggaagctcaggctgcagcaccagcgctgccagccctggcttcctgactctggccgagacctcagccctctgccctttgccttctgcagtcaagatgctgagctagagggtgttcgaggtcctgattctctgatctccgtgactcccagatttccctgggtttggtttgtctgcagagtgtgtgccaggctgagaacaggatcagttcccatcctgccctgctggtcagccctgagggggccctccaggcagtgggaatggttgccagggtcaggggttacagattctagttttatctgttgcagccaaagctggggctggcctggcccactccccagctgacccccactgaccccaaaactgagtggctgggaattgacccaggttgagctgaggcagctgtcaaggcagccctaaaattagcttcaacagggatagggagagagctctggcccgggcttcaggctccaacgtccccgagggactgagcccacactccactgaaggctggagaggtcagccagggttctgccagcggccctaccatgatgttggctggagagtcacagatgagcataggcacatttcaggaggggatttgaagggcaggcaccctctgccaattgcttgggccctgatgtagctcccgtctcccagcccatcagaacctgggagggtccagggaaggaccttgctatttatattcttctagaacaggttgaggcagcctgtctgtcttcccaaggctgaattggatggcctcacacctaacatcagctcccaaccacagaggaggagccagaggtctaccagcctgctgtgggggtaggttgcagatccccagtactaggtctaaagtcagctcctcctgcttaggaacagcagctggatccacttccctcctctctgccttgtgttctgaggaacttgcagattctaattccaaaggtctggggtggcacgtgaaattattcaagattctaacaaggtcccaggttggtctgcagactactctgatcacagatcttactttcccagccagtctgggtggaccccaaggccagacttcctttctttggtttcataggtattcctcaaccaaccccagtagagcctggctcaggtacgtgggcacatgatgcagcaggtagctgactgttttattttgtgttcctatgtgggtatgtagatgctcatggcagtcctggtgcctctgtgtatccagcttgtgactttttacacttatagagtgtacaaagatgcaggtgtacaataatagcacacatcgctaacattttaaaaaacagtcaacttttagtcaggtactaacaagattacatataatgtcctaagtctcataacaactcttatgagttatggtcctattctcagatgagaaaattgaggctcacagaggttagatgactgctcaaggtcacagactgttaagaggcagccggctgctg

SEQ ID NO: 37371 - DNA, 1381 bp, Bovine  19866880596457
tttttggagcatctcggtgcccaaccaaccccagcctgagggggaagtaggggctccaggctgcagagggaggtggctgagcctggggaagtcagattctgagaattgtttctggggagctggtcaggaaggggtgtggcagttcaagccaggatgagcaagtgtgcatctgtgtgtgcacctctggttatctgagattgtatgtctgaggttcaaagtctaaccacagtccctccagctccaacactggtcctaatcttggctgctgcttaaccatctcccccagcctcacaactgaacttattgctcttgtcctgggacacttctttgcaaccttccaagctgttgatcctctctggggatgtgaggccagccctctacctgtaggcagcctcacttctccactgctctaatggacaatggaaccctccaatatgagagaggagtcacccccaccgacccactgggagctgcaaatctgtgggagtggagtgatcctggagggctgaactcagagacattgcaggtccagtcttctttgtggtcttggacaaatcttaaccctaaacctcagatttctcactcataaagtgggcaaaatggcatcctctttagatttgctaggggggccagaacagtgccctggggcttggggtgggggttttgttgtgagaacaaggccggcaacttaggtgatccagcaacctaggtgattgacctaggtgaccagtagggaacagggagagggaaaggggctgaggagtcaggcctgggcctcaccctctaccccaccctgaaactgatgagaaaagaggaaatgaccagggatggggtggaggggctgtattccagggtctgtaacagaaactaccaaactcaagaactttctgttctggcctgaggggaaacttacaacaacccaggggaagtcaggactgttttttagtactgctacagaaagttagagctcctggaagggaagtatcttgccaaaggccacaggctagtggagcttagtttgtttcatcactctagggccaggccctgtcttgggggaggttgaatcaatccctggccccttccttcccttgagaccctcagcaggcgttggccagctatctcctttcccctaatgggtgtccttctctgtccctgggagagcaggtcttctcctgggagggtctgggggttatgctcttaggaggctgtgcaagggctggaggtcctgatggagctacactcatcccctgcaggcaaggcagagcccagcctgccagtggctcccccttctgcatcactggactcctgcagccctcccagccagagaggtagcttgtctgcctggggtctgcggaaaggtccatcttgctccaggctcacc

SEQ ID NO: 37372 - DNA, 1675 bp, Bovine  19866880617692
tgttttctttgtaggggaacttctagtccccggttccagttctggagttaaacagtggcgtttcacacgcactcaataggccagatggggatatgctttttggtcaagttctgaccattaaccagacgtcctatagagcagggatccccaacctctggaccacacagcaggaggtgagtccagccagcgagtgaaacttcatctgtatttagagcccctccccattcctggcattaccatcctccccactcccaccccctcccttggtccgtggaaaaactgtctttcttgagactggtccctggtgccaaaggggactgccactatagagggtccggacctgtctctgctaccagctccatgtgaggctttggtcaaatcccttcccagttcagcttccccatctgaaaatgaggctgcttaacatgttgcctggaggtcatactagctctctgtgtgaggaggcccgacctgaccgtgtgggaagggtgagcagccaccagagcccagagaaatgaccagggatggtggaggcgagcagtccctctgtcctccgaaccacagcaagctgcacctggaaccctgcccaagagtctgggaacattcagctgctacagagaggagacagggaaggagttgtggaggccaaaggagagatttagatcggctttttatggagcttggagaaccacaggttcaggaaaacaaaggactcttagaatcacaggcttttaaaactcctggcatctcagatgggtcctcagaatcttagcattttaatccctgagctcaagcacctcagagacagacaatcttgttgaacctctgatagggaagccggagaactgagtccagagaagtcctgtacctcatcctaggcggcacagcacaagacttcagtaagctgggtgagctgtggtgacccaggggcagggacataggccccacccactgagatgcctaaggtggggtggggatcctgggctgcaggatcagagaaaaggggctgtttgcgggggatctgagcagatagctgcctctggggttatgagggctacctaggtggcgctagtggtaaagaacttgcttgccatgcaggagacatgagacccgggttcgatccctgggtcaggaagatcccctggaggagggcacggcaacccactcgagtattcttgcctggagaatcctagggacagaagagcctgacaagttacggcaagagtcagacagacaggactgaagcgatgtagcacgcacagggttacggaccagaaatggtggcgccctctgtggatacccttaagttccaatgtgactgtccaaagcaagaggaaatgtcatggctcagacttaaatttcaagactctgcacttggctaaccccctaactggtcaggttctatccctcagaaggtggactgtcctcctgtatctgttcctagcctccagtgggaggcttggtttaaagccattgtcaggctgtgtggccttaagctagtgactttacctgagtgcaaattcactctcagggcattgtgaggatctgctgagaccccacatgggaggcatcaacttattctacgctgcggggctcagaacctgctcctttagtccccacgccctgtgtcctctccacagcccagtgtctgggctctgccctctctctccagtaa

SEQ ID NO: 37373 - DNA, 1376 bp, Bovine  19866880637093
tcgtgtccgactctttgcgaccccatggactatacagtccatggaattctccaggccagaatattggagtgggtagcctttcccttctccaggggatcttcccaacccagggatcaaacccaggtctcccacattacaggaggattctttagcagctgagccacaagagaagcccaaatcagtggtgggaactggctttttccacacctaccaaataactaggacttgctccttggaaacaagtatgcccctcctgtatttatattttttgaaggtcaagagtaacgagaataaatggccacaaataagtttttctcccttgtacctcaaagacttcagtagtgatcaagtttcctgggattctgaggtgtacattttaactgctttatagatgttaatacaatctaatcccttttactgttactaggattaggactgaagaaatataaagctatttttgattaatatggaaattagaaattactttcaagagaaattatttctgaaatgacttgatctttaggtagtaaaaatagcagtgtatcaaaaagctagtagaagactaactccttgggtcaggaagacaaagaggatgttgtcgctgtgagcaggggggacgcttatgcaatgaagacactcccaggtctgaagctcacaaataaaattaaaaaactgtccctccaacccttatgggtaaccaaaaaaccaaataagcaaaacaactgaacaataaaaacaaacaaaaacttcaaacactttaattctctcaaaatgagaaagaagagggcaaaaagaagaatatattttgaatttgtaatatgttctgagctatcaggtacttctttatctaccctaactttatgaaatatattatcagtctcattttatagatgaggatattgaagcttagatttatcttacaccactagtaaaaagagaatggcaacagaactgggatggctgaatgagacaaagtccactctaccaacctccctcaaaacatgagtctgctttgggtaaacctctggatttggctgctattttcttcgccaacattcttatttcagattcgaaacctgagaaaacaggaaattactcaggagaattgctttgatcaaagatggttcaggttttttttttttaaagctattctgttcacactcagtgtcctaatatagaccatgctcacattactgaaaagcatcacacaagcactgaattacagagttagaagagatattagagatgattgagtccaatttgccatccagcactggaatatcttcaataatggcccgcatagctggtcacacagcctatgccagcacactttctaatgctggtgtattcagaacctcttcaggcactcaaagctt

SEQ ID NO: 37374 - DNA, 975 bp, Bovine  19866880646449
ctcaccacctgctcccttccgctggaagagctttcctgagccgggaaattccctctcatagcaagtgacagaagctcccagcattctgatgccacgtgcactgcccacagcaacatggcaggaattagatcccatcgtggggccaaggctggacagggaagacaggtgggtttagggattggagctgtccgtttaggagggctgaaaatcagagagggagtacaggtcctggggaagcttctctccacacactgggccaactttggttgaaagcggtgctcagctcacccatgccacagtacgctggtgtgtggatggatgtgttgcagacaggcaaagggtgggtgcccagagagaaggcaggatgctcagggcctctgccagccctccaggacactcattttggcctacaggccccccagcagggagcaggcaagcatgttctgttttggcattaactaggcaagctgtgggaaagtaagcagcaggcttcctaagctgaatagggtctgctccctccacaggccagtgcactgtggttatagagcggtccctccccggcaacaattctctcccctgctccctgcctaaccccccaacccccagctcagcctggagggtcttctccgtggaagaggctcccagatgggtagcatcccatgccttccaggctgggaagccccagtgtcccagaagaggaaacgaaggctgagggagggcagggacttcccgggtcctcagagtgagtcaggacaaaaccaagactgtagctgggctcaacctcctcccaagggaattcctctttttgtgttttattatttttttaaacttgcaaacaaaaccagaatgaaaatgcagggaagctgaaggaaaacacatgcacacacagaggaaactcatatttgtaggccagtatgttgtaggcattttatataaacattcccatttaatttccccgtcacaacccctgcaaaa

SEQ ID NO: 37375 - DNA, 1256 bp, Bovine  19866880657880
tggctcggtggtaaagaatctacctgccaagcaggaaatgcaggtttgatccctgggtcagaaagattctctggagaagcaaacagcaacctgctccagtattcttgcctggataatctcatagaagaggagcctggcaggctacagtccatggagttgcaaagagttggacacgactgagcaactaaatggcagcagcaaatagtctttactatcaatatacaccagacaactaaagcactttttattaacttgtttaattctcatagcaaccctaggaggtacatacttcacaatttaagatgaagcaactgaggcacagagaggttaagtaacttgcccaaagtcacacagctgggaaggggtaatttaaatatagtctagacctgcaatacaataacttctagaagccacatacaggtactgaaactccagatgcgaccatatagtgaagtgtgctctatacaacacacactggattctgaagacttagtaaaaaaaataagaacatgaaatatctcaataactttgtattacataatgaaattatagcattttggatatttggattaactatggtattaaaattaatttcacctgttcatttttaatgtggctactagaaaactttaaattgcatttgtggcttgcatcacattgctaccggacagtgcagctccagactcttaaccactctacacactgcctttcaaaaacgacaagctctgactgagcagctgctgcaggccaggcactgttctcaggattcaacatggattgatgcatgacagcccaaccaggctactggaatgaccagggctgggaaacaggaaactacctctcctccctgagaagggcccagccccctccagggcctctctctagttcctattcctgcactaagggcttcaggccaagatcagactcagggactccgcactgacactcctctaggacagcctcattcaaggcattgaaagcatgagccagaccaacctcaacccacccttcaggaatctcaggcttgacggcatcagataccacccagccagcgaaaaacagcccacagggccctcaccaggctgggggtcggggaaggcttcctgaaggaagcagtcctttgaaaaaagaagtatggagcagtgcgctgctgaaccatgctagggcctaaaaagacaaaaaaatctgcagtactaaacctctttatttaaattttggatattttgcttatctggatttttttcattattttcatt

SEQ ID NO: 37376 - DNA, 2161 bp, Bovine  19866880767540
taatgggcccaaaatagtacttccccctgctctttcctgcaatctggcctgtggcttcaggtctgtgaggacagaagagagacttggtgtttggcaggcatgcaaaagatgtgacgagctctcggaggtcacctgggtcattttttttttttacttttctgaccataggaaaccttcctgcccggttctcctccacacccaccctcagcctcagtgctgccttgctgtgtgacgtcaggtaaatctctgtccttttctgtacctcatcttccttttgaggcagatgtatagctaaaccctgctgtttgtatctagcccaaggaaacacctggagaacccccctgggagaaaaggtggcttttggccctgactgtctcctctgaagtcaggatgtccttcccaggctgggtatgaggaacatgagccagatacgtcatgagtggctggatgtgtctttggctgcttggactgtctcgtgtcctccagccaccccatgtcactgcccttactctcctccatgaggcagagacctgagcagacagatcacatgcacatcccggctctactgcttagtaggaaggcaaccttgaggaaggcgtttgacctctctgaacctcagtttcctcatctgaaaaaaaggataatggtaccaacctcccaggaccactgaggatgaaactggatggtccaagctcctggcttgcaataaataaatgggagctggggctattatttagcaacattcaagacctacagggaaaccgcaactgaattctctagatttaactaaacaaatatttattgagcacctactttgtgtcaggcactgcaggtggcctggggatggggcagtgagcaaacatcccccttgcagagctcacattctggcttccctgccttttcatttttccccactgctccagctgggcctacacctcagacctcttgctcccggtttcctgacccttctttgcattgactcaagctgttccttcactcctcacatcaaacccgagtcccattacctccaccccagtggcatggcttgtgggatcttagttccccacccagggatcaaacctgggcccacggcagtggcagtacagagtcccaaccactagactgctagggaagtccctggctgtgccctttaaaacagtggttctccgcctcactagcagaactaaaccacggtgtcagaagccagcatggtagttaccctagaaggggagagtaggtgggggtacgtgggagctttcaagtggtggaatgttcggtttcttaatctgggtgtgtttattaataaacttatctagcagtccactaatgacttgagtaccattctatacaaatgttatacttcacttagaagttttcctacaaatatgactgacacttgggtcagtcccaccctcagaattctgatctaattggtctggaatgtgacctggaccccccaggtgattacaatgtgcaggcaagatttgagaaccactgctttggaggagctgatccttctaggctctcccctaggccgggtgcctagcgatcgatcgtgcatcccaggaccgccctgcccacagctgacctgctcagggctgctcatctctccacaggctgcccggtgtcctgggatgtggccttctaaggagcagcgggctgggccgggcccattcctaccgaggcatattagggaaaatgctgaggatctggccttggataaccagtgctgaaagttaagtctgtccagaggcagaagagggcctcaggcagcagaagttgtgaagcagaaaatggcagctggctggtggtgaggcaggaatcagagactcaaggtggagagtccaggggtcttaaggtggggcagcagtacatgggccactgtgctaacagctatttgattctagttcgtttccactagtcagcgccccctttatttctgggcagaacaaatctcttccttgcaatccaaagatctgtgcacaccaaccaacagtcctgtgggggaaaggattatcaaccccaatttacagatgacgagatggaggctcagagggaatacaactcatccaaagctgcatagccaattagtggcaaagtctaagtttctgttcagcttcaaaacctgtgctccttctatgccatttcatcaaattccacg

SEQ ID NO: 37377 - DNA, 1326 bp, Bovine  19866880779780
tcatgtccgactccctgtgaccctatggactgtagcccgccaggctcttctgtccgtgggatttcccaggcaggaatactggagtgggtagccatttcctcctccagatgatcttcctgacccaggcatcaaactcccatctcatgcgttggcaggtggattctttaccactgcaccacctgaggttgcctctatgagaagtgttcaaaggaattgggagagttcacccagggaaaaaagcagatttgggagggtacaatccatatgttccagactccacagggatagagaaagagatttctatataatgtaagcctgactaaaatgtcccctttgaaccaggctggggacttccagagccttgctcctgcgatgcaggcaagcactcttttacagtcagacctcttgagattctttgggggaaatgccataatacattcctgtggccctggagaccgaactggtacaggtctcagctgcgtctcaagaaggaggttttccaggcagagtggcccctggagggagtgagctcctccatccctgtgactgtgcaaccaggtgctggctcccttccatcgaggaggccacagatgggattcttaccctgggaaggaattaataatagccaccatttatttcacctcttccatgtttcaagctctgaactaagcatattattttcattgcttctaaccctcaccacaaaccctagcagtacatatgacccatttcacagatttcacaatctgaggcccagaagtaaaatgacctacccaaggtcacacagttaggacaggagagcgaagcctagcccctgactacctctggctctgaagctgtgctctcccttcagcatgcctgcagctatatagtctcctggaaggaatgtgattctaagtttaagtcagagccaggactgaacgttgacctggtacagatgtaagagtgggcattgaaagacaagctattctcatattccacaggactcccaggagaaacctcaggtaaagtatgcaccagcacttgagcatggctaacatggaacagcaccccacctcacccactccagcaccccagaatggacacccacgacaggttagtactccattcaaagctttctccagagaaggtggccagcatcccatctgcccattgtgcaccaaggcaccccttgctgtagtggggattcaaaacctcctctactcccttccttgctttgtcattatctcccactcacactgttgcagactgctcgggactacctgtctccccatccagatgccagctatctcctgcctgagccccgcaccccacccctgcaagcca

SEQ ID NO: 37378 - DNA, 1444 bp, Bovine  19866880820796
atctgatgcaaggttgattcaaccatttgaaaatcaattaatgtaatccatcacatcaacaggccaaaaataagaaagtcacattatcatattaacagatgcagaaaagcatctgacaaaaccctaacacccacttaggataaaactctcagtaaactaggaatcaggcttcccaggtggctcagtgggtaaagaatccacttgcagtgcaggagatacaggagacatgggtttgatccctgggtcaagaagatcccctggaggagggcaaggcaaccctctccagtattcttgtctggagaatcccattgacagaggagcctggcagactacagttcatagggtttaagagttagacacaactaaagtgactgagcatacatgcatgcaaaccaggaataaagaggaactctctcaacttgataaatactagtattatacttagtggtgggtgatttgaagctttcctgataagataacaaggcaagggtgtcccttctcactactcctttttgacatcatactggaaatactagctaatgtaataagacaaggagaagaaataaaagatatacagattggaaaggaagaaataaaattgccttttgtttgcagatgacatgatcgtctatgcagaaaatcctaaagtatcaacaacaaaaaaaccctccagaactaatgacataattgcagtaaggttgcaggatacaaagttaatacacaagagtcacttactgtcttacaaacgagcagtgaaaagtggaacttaaaatcataataccatttacataatcatttaaaaaatgaaatactcagttatatatgtaatgaaatatacacaagatttctattaggtataggacaaaactctttgcatcatagattaaatcattaaaagcctctattaagtagtgaatgcaaatattattagctttcatagacaaatatttatcactctccacctacttttctgggcaacctgccaagaatttaaaatatatcacttaaaatttctatttctttaattgttccttcctatttgggttaccagacccattgaccatttgtgtaactaaaggaattaatcaattaaattacatacaattattattgttctcttaaaacctgactcagcagtatacagtatagataaaatagtattttcagaataaaaaaatatttctgaattttaaaatcaaacatatagcagagactgctagctttactggtatccatgttttcccctccttcaaggcatacacacagatgagatttttccagcctcctcttaaattagatttgaccgtgtgactaagtttcagcaaatggaaagtgggaagaaataatgcaagccacattcaggtctggcctatcaatacttcccctgtgcaaggaaaagactcatgccaaacaaaaggaggtgaatttgaaaagaaactaaaga

SEQ ID NO: 37379 - DNA, 1314 bp, Bovine  19866880868394
cagaaaaatcctgaggctgagtggaaacctgaccctgctgaggggcatgggggtgcacagtagtggggggtggacaggaatgactgggcttgtgcaggaggcctgcccaggctgagtgctacagagggcagttgtctgtggcttaggaagtgttaggaaagaaaatgtgagggagtttttgcttcacattgtggcctcagaaggtggaattttagatctctgaaagctgtgggcaaactgcgtcctcagccaggcccatccctagggccttgctcctccacacctgccagccaggaaggcattctatgggctcagaaagccaaggccctggactatgtccagtcctggcctctcacagctctccttcacgccctgaggatcctggcgggaagaagctgagtcagaggagttcaaaggagggtgcctcccggaggggtgcaggtgcactgaggcctcacttggccctcagccttctttctgttctcttgctctggaaacgatgggtggagtcctcatcctcaaaagtctcctgggattatgctcgcgcaggtcaggtggcaggggagggtctcctccccatcccactaccacaccagcctccacagctgtcccacaagtaagggagtctgtagtaatgaggtgcaagattcaggaccatgggccctccaaggcttagagccaggcaggcgggaattcaaaccccagcactgccatgtgccctgggcaagttcacctctctgaatttcactttagttttctcatctgaatgatgagtgactcaaagagttatgaggtttggggagtgtccatcgagtttccggtacatagttccctccgcttccctctcctaaagaggttgaattgatggggccaagggagtaacagcagcaaatgttggggtaggggttgctgcaaggcagtgttgggagcggggaagtgaggaaaagggagaagccctgagactgtccgggcctgcacttctctcctccacctagaaccggctttctagaccagccagggcaggaaccaatgacccagcgcaattacggcgaagccccgccccacagcaggccccgcccccgcctttctccatggtgctgatcggcgcgtgtcgcgttcacaggctctggcccgtagtgtgccagcatacaccattttggggggcttgttgcggggctggagaaaggtgaggggaagcaggacgctcctgagaggcggggggccgcccaaagcgatgggaggatacagcctctgggattcggcctccgccccgcgcccaccgcctcggaaggactgcaggctccaaaggctcca

SEQ ID NO: 37380 - DNA, 1702 bp, Bovine  19866880935067
atggggctgggtaggcagggtgggcaaagtctggaggcatgtggggatgcagggggctcagtggtccccacctagtggagccgcagggtccagataggaaagttctttctagagtctacccacagtctcttctgttccagcagtcactgtggggccccagagcctgacaggctaaacgggtttaccgcccatttccacccaggacctcctgaagcatacgcctgaggaccacccggactaccctctcctgctggacgcgcagcggaacatcaagcaggtggccgagcgcatcaacaagggtgtgcgaagtgctgaggaggcagagcggcacgcccgcgtgctgcaggagattgaagcccacatcgagggcatggaggatgtgagtgccgtctcgcctggccccacccatgcctgtgtccacatctgcggccacctggaactgtgctcatggctgcagtgtgtttgcgtccatcgcggttcgcatctgtgtcctcccccatgtctgtttctggccatatgtcccatggcctgatgacacagcattgagagggtggacaacgtgttgctcctactgacttggcccatgagtggggccaagggtcactagggtctggggaggggaaagaattcataatgagccttcaggacgccttgtccctcctgccccacagctccaggcccctctgcggcggttcctgaggcaggagatggtcattgaagtggtaagaagtgtcccattgtctgcccgcctgtcccccacctccctgcttggttaccttctctgctcacagctgctgccttctggcctcctgctcttccaccccagcaggagcccagggtcaaggcccagtttgcttctgggcatcgggaaggccctcccctccctcgtcctggctgtccgccttgggcacggtgggcaggagggagggcctctgggcctgaatcctgtctcgggccccacagaaggcagtcggtggcaagaaggaccggtccctcttcctgttcacggacctcattcgtctgcaccaccctgaagcggaagtcgggctccctgcggcgcagctccatgagcctgtgagtggccagggtgcttgaggccattgtccttccctgggcccactcccccgccttggccagagcacccctgttgctccccacaggtacacggcagccagcgtcatcgacacggccagcaagtacaagctgctgtggaagctgccgctggacgacgcggacatcatcaaaggtgggggtgctgggtattagggggtcttcctcggagaagcccacctggaggatttgagccgtgaccaggctggctggctgtgcacctgctcttctgcttttgggcctcgctttctcatcctgtccaagggtgctggcatgcaggatccagtttgtgtcccacggagccagaccgaccaccttctgattgggcaggggcctgccgcgggctggcgggggactggggctgcagtgctgcagggagcgcagacacgcccgtagcggttgattcactgcacaggtgcctgtatgcacctcatcttagatgatggcgcactgttctggtccagcagtttggtgcctggggaacaggcacactcaactcaggccaatcagaaagctggctagaatgatcctttggtctggggctgagactgtcgggagctgaggcagcttcaaagcgctgttcctcctgcgg

SEQ ID NO: 37381 - DNA, 838 bp, Bovine  19866880979426
tctctcctagcacagcacaaatcctagtgggccctagaagcagagaagggggacagtcctcttgcctaccagggacccatttttgtatgagactcaagaccaggcctcgttcagggcacagtcacagagatgctgatcatatgcactcgtacagtatattactgtggccacgaggacgtggcaaagatgctcatctttcttcaagtggctttggcttatctgattgagtttaatcagatcatgttggctacataaggaaagcagcaggagggatttcaggagaggctggctcctccccgcagttggtccccaaactgagaaactgaaaccttattggaaaaaagtagactgccctgagtttagcaccgattgcaataatgcacatctcttccacagctaacagatttaaaacaattaacagtgtcctttgtattaatatttatgccattcatttagtattagcagagctaacatgaaggggctgaactagtagccgaatctcatccatcacatagactaatagaaagggggctgcggctaaagcagaaatggagcttccagatctgcaatgagccgacttagtgttctttttatatttggggtatttttcatcttaatttttgcagcatatactatgatgaccagtatccttagaatttgaatgtcttgataaaactggggacacatacttgccttgtcaagcttctctactggagaggcacctagcattattttattcccaagctagtccactggcccaggcagccaagttgtggctggcccagaccagcagccacccaccacatgaaatgcagcttcccaggtcccactgacctga

SEQ ID NO: 37382 - DNA, 1372 bp, Bovine  19866881020728
aacagaggttagagaggcaaagccccttgcctaagacccccagctggtagatggtagtgcagaaactcaagcctgagtttgtttacttccaaagcttgttttcttgtccctaggtttgggatccagggctgacaatgcaaggaagtagggggaggaggaagccaagggccaactccaaacaccgccgaggctcctagctacccggttgtgacagcgacaaagatcaacagaaacgaccttgggacagcaggatcttgcctcctgttggcattttttttaaaggtatattggtccacaccctgcaacaaagccacacaaagcaaacagaggtgatggcatggcttctggtgttgctgagatacccactcccagtggtttcgggccaaggcgccattggcttcagaagctcagattcttagcacgatccaggagcttagactctctcaaagctctagcatggacagggtctcctaagctttcagtccaccccaccagaagagggctccgcttcacagactccccagctgggttcatccaaaccccactctcacaccctcactgcttatccctagaagaagctccttctgctgaaggactgcctttctcactctgagctgagaccagcctcctaggatctccccaagtctcctttggggcacaaagtcagctgccctatggccccaagtggccctatcaagctgggaggacagtgactctgcatcttctctgctcctgatctaaaaccacctgggcaggggcatcagtgccaaagtcattcctgagacatgggcacaaaactacccagaagagctggttggccacctcccacattctaggctttaagcctctgctaatgcatccagatagcaaatccacctttgtgctggtcacgttccactgttttcctctcatcttagaccccaaggctttataaatttgatctaagtacaaggtcttcttaaaatttccgtcttgtaaatattagcaattcatagaggtatatacagtttatgtacagcttcttctgcatcatctcctttcatgcttagtgcagtttactggacctcacagagatggctgatgtgaagtgctccctggtgagcctgatcatgtcagggggcccagcaacagctgctgagatgaccatgagcattaggtggacaggatcctctgctccaagcagtgatggatataagaccatgggagccccccaaaatgagaccgtgtagcctacatgagggtccagaggggttcctgagggctgcctcaaaggcagggttctaagggtgagtctgattgggagcccgcagaaggggagaatgagggagactgtcggtttaggggagtccttcctaggcagagagggagccag

SEQ ID NO: 37383 - DNA, 1374 bp, Bovine  19866881042104
gtccacagctgggaactggaaagagtccatagcagaactaggatctcccacctgtccgagaaagcaagatgttctaccttagtcttttcagtgaaggcatctccttaggagaagcctgggtgagaccctaggtgaagaactctttcaccttgtcactagactcccgactaccagccggctggcccgtgtcagcctgagattcctgggcaaggtgcactgggaaaatcgtggtccaaggcctttcccggtgtcccctccccttgccctattcccgtggttcccccatctctgccttctccactttccccacacttgcatgggcttccagcttgggggcctggcttcagctgtctgagaccctggtcccgcattgcagggaagtgaacctgggagaaagaggaatgttctctttctctgagatgggtctgaggttctggtggacactggggcctgcccacacagaggcattcctccaccagtcaccatcccctcaccgaagcaccgtgcctgctctgtgggaggagtcccaggcaagacacacaaccagggccagaatcttgacctgggtgctggtcctggctctgtctctggctcattgtgagcccttgggccctagtttcctcctctgtcaaatgggagtttggcagaggtgatttctaaaggctgtccaggccctggctctctaacactctatgtgtgtatgtctgaatatgactgcctgtgtgtgcccatgtgtgtttaccacacctctggaggaatgattagcagtgggatgatggaggaagggtattccagatagagacccagcttgaggtgaactgtgttggccacagtaccattgagtgcatactgggaagccagggtattgagtgtttcctgttgtggggctgaagcacagacagggactgagggagggggcactggaagctcagctcagctctctaggatatgggggagaccctccccggcagagccatcctccagtgaaagggggtgcctgggaacacctgtacaacatgtgagctaaaagggaatagttaggggcaagagtgggcagaggacactcctgcctaccggaacaagcactcctggtcactttctgcctctttcagaccagggctggcgcagaggaggcagcctggggaaggctcatcctagctgacttcctgtgacccagagccccagctgtccccacctccctgtctctggagcccacagcattgcctgccctgagaaatgctggaagctgggcgaggtcccaggctggaggacctgtttttcctgtttcccacagagctccctgcagctcggtccaggcctgtgcattcatgagtgaggaacctgagctggagctgagcatcctgacagcaagag

SEQ ID NO: 37384 - DNA, 1196 bp, Bovine  19866881103317
acttcttcatactttcaatctgttccacttctaaccaaggagtgttgcccctttgttatttttgaaaaacaagttctttgcttcagcttgaaaaccagctctttgtgtctggtggcaagtctctcactctcttccaggtccacatccaggacatctgctgtgtaagcgagtgttcggtgtgtgtgagtgtgcacatgtcaacggcagcctcaggggaaaggagcaaacactgggcgtggacattaggagagcaggaggttctgtgagggacacatgtctcagatactctagcagaagttacactgtaagtcactgaaagttacaaagagaacagaggaaattctgttcccgtcccaacctggaggctgaactgccccagttcccagaggggactccctggacaatcaatcatggacaagctgagcccagagcaattacggacatggaaaggccagcaggtgttttgagtttattttttcccaagtagagcctcaccttccatcccactcatcactactgtctccactttctccttacctggagcataactggggctattggtggggtacaggctggggttgtaggcaggggccgcagctggataggctgtggggtaacctatgaaaagacagaaaaaaaacaaaccctatttagttgggcaagaagaaagatttctgagaaaatggaatccaagtcccaggcttggccttcagcctcttcatgagccatttcagaccatatatgtgactggttttagccttctgagaaaaatagaaaatatatacatatttttctattttttaaaagcagtataagatatatatgcctatatgctcactgtaaaaaaacacaaaaaactgaaacactatataagtatatatggtaaaaggtgtaactactttcacattcctgccacactgctctcctccgcagagacagtaaaagtttggcatttaagtctctggatagttttctatgcatttttatacacatatattcagtggtgtgctggtaaatatttaacaactggcccaaggaaactgcagtgaagcctatttggtagcccttgctgagttccatgctgtaaatactcccaccatggctggtttcaagccagcaacgtcatccaatgaatagttgagaagagatgctcacaagggccctagagagcccatacaagcctatccagtccacca

SEQ ID NO: 37385 - DNA, 949 bp, Bovine  19866881112627
atgagttagggtccaaggacttagagatgtgggcataatgtggctgcatatgtcagagagaaatgccaagaaaataacctcctgtgtaacctgggtttgtgcctcttggctgcaaatgtcaagaggatcgatccacagtgaagaacttaggactcttgttttgtgtagatagttacaatcagaaggactttcatcctctttatcagaacttccagattcaaagctttccttgtgcccatatagtttattccagttccgtttgactgtcaatcctctataatcacaataccaatcactacctgtattaaagaatgaaatgcattttcataaccaagagagggcgatgtcacagccccattttgccatcagcatcttttgggtgatgaggtcactggaggactgggagcagtggataggaaggaactttgccctctgtgctgtgctgccccgtctggtgaggataccctctctgtttctcctccaggagcagcagatgataaaaaccttcccccaccttctcaacgtcaatgaagacccgcagctcacgggggttctcaagcacttcattcaggctggtacttacttacccctctcaactcgcaccgagggaaggcagagggaagagggtcaagaggcacttgcctgctggctttggttcgtaaggtctctggccaaattgtctgggaccttctaatttgcagagtgatgttaactgacctggcacttcctcagcagttgattttggttctgttcatgcctcttgcccctgagcatatttctttttcttttaaaaaatttttaatggtaaaatacacattacagaaaactcaccatgttaaccatttttaagtgtacagtgcagtggcattaagtgcttttgcattgttgtgcaaccattttgtgtgtgtgtgcacacacatgtgtgcaagcattcagttgctcagttgtg

SEQ ID NO: 37386 - DNA, 1871 bp, Bovine  19866881116379
gcctacttagtgctggagaaaggcggggatcaaagatgtgggcatagggctcatctttgaagtgagagagaagatcctggctgaaaattccactgcggctttccaggccccttttaatgctaattcttccacatttcaaccaatagaggttctaaatctcccggatttctcttccccttcaaagctaagaagtgcatatggaaggcagaggagagagaatagagacatccaagagcttccttgaagagactggggtgcctgcacaggggggagaggcttctgcctctggatactctctctgagctagaaccctgaaggctcatgctggtgctgctgcctgaataaagtgtagggagaaagccgggctgtgggcagggaggacccaggctgtgttcccatgagacaggggttgtttgtgaacacagatagtggattagagcattctggagataagctcatggaagggcctatgtcagcaagcttgtcaaaaccaggatatggtggaggaaaatagggccacccctcccagttcctcatacttcccatggctccttatgaaagagtgtgagggtcagaggaggtacaggaaccagatggccaatcagcaggcacaaggccaagcagtaggacccctgatccaagggacaggctggggactagccaatggtagggacaaagggaggccaggtggcccctatctgtggggatccttggcaaagagggggccaatgtagagctaaacagcacccaagaaaccacacacatcccctctgtggagaccaccatatcacagaggccaaggccagaaggacccagagcaagaccagggaaccctctctactgcaggttgaagttgggctggcaggagatcttgtcaagcttcctccccagccccaggagttagtgaccagcaaagagcagagtgtgtcacttggcacatcatggtccattcccatgctaagcccctctagtcacaattctaggctggatagcgtaaaagaatcgctatgaattggataggagactgaagttttaaactttgctggtctgagtttaaataactgaatgagaccagaaagttataaaaactctatccatgatgttaaaaaaaaaaaaaaaaaaaaagaggaaagaggaaagggagtaattaggaagaaaaaaagacccagaattgcttcatgttgtccacctcaacaggttgaatgaaactccttgacaatcacttgcgataacaaaatggccactgacctctcacctccaaaggatgcatccccaaccccccacccccaccccaccccaagcaaaacagacaacttgtgaaacagggtgcctgcaaaagtcccaagtttcactctggctggtcacctcgggtgacaagcctctcctgaaccaatcactgtggccaagagatggaatgtactgactggtctaccttaggtcttatttccacccctcgagctgccttccctgggaccacagggttccctaaagggaagtgtgaactgcagaaaagaagaaagggaggatgaactgggggggggaattttgtgttggtgattctccccattcattcctctgagagcaaaacgcttctgccccaagaagagagtcgaagtagaactaaaatttcagctgtttcgtaattcccattataaaggccattggcattcttaaagacgatgtggcatggtgggttgcagcagcagggcagaattaaatatccctgcagtaagaaaaaggagggaaagggagaatgatatgggcatgagctctttggggcatccaggggcctgaaagctgggaggggcatcacagtgaaggagtggactgctcctgtgagaagagtcacggatcacggggattttctaaag

SEQ ID NO: 37387 - DNA, 937 bp, Bovine  19866881136948
tcttggttcttagcctctccttgagcctctttgccttagtgtttaaatacgtctccttcctccaatacaaaacaccaaaagaacctggaattaactaaaaaccccctctccctgaagcctgtacctatggttggactgcagctcttccttacccaagggcagataaggccagatgacctgcgaggccacctctggccccacttcatctggtgccccacctgccaaacagcagacactgccaggggagggatggcatgtcccacacacagggcctgacacagaactatgcagtgaatgggcaacctgggaagaggcacaaggacaagcagctcctcctgacactactttcccacatttttattattcaacaatggatgagtatggagacacaaggatggacaacagccaagtttcaataaataagagaaacggggacagccgtgggcccgtgcctgcacagccccacataaataacgagactgctgagccagtgtggaaacggaggtggagcagtcgcctgcactgcccaggccaggggacaaacaccaacaccgcagggacacacaccaccgaggccagaggccccttcccagccccgtcgcacacgccacttccctccgaagcgcctgagatcgtgggggtggctggggctctgcaccacagtcctgcccaggtcaagtctgtttcttcagtttcaataaaaacagcaggggcagaggcaggcacatgcattaggccccttatgtatgcagagccacattcaggcagccctgggggagacttgaaggcggagggcctgaagcagcaaaaacggggtcagataaagctactagtgggaggggcagtgtggagtcgagctctccacccccacgacccagcccagagcctgcgaggcgggaaggtccctgtgcgccgcggtgccgctacccccacttca

SEQ ID NO: 37388 - DNA, 1473 bp, Bovine  19866881211612
tctgccgctaggttggcaaaccctcagaacatctgtcttatactgggccccgggccagagagatgtgggaacctggcctccatctctgctttactattccctggctgggtggggtgacccacgctggtgacctcctgcagcctcagtttccttagggatgaaagaggcgtgctcacctctcctgtgaggagtggaggcaaccccggatgagggcctggcctgagggaatgagggtctgtccccttccctgtgagggcggaggatgaaaaggagacagcgcctagctgtgggcactgccctacttcagccccagttgccagggaaccactgggttccttgctaacctggatttctctatcgatgggaagcctttgtcttcctgcttgggcgcagccattgctgagagaggcctgtgtccggctgtgtttccaggcaaccctagcctctggaggctgcaggaggtcacaggccataaagccactgtcgaggaaacaaatacctgtctcccaccccctgctccaggtgggaacctgcctcccacctccgtctgtccagccctgcttcacttggccggcagcccagcaagccctccgagacttgagttgttccatgcctttcgctcccctgctcacccttcaaggctccggtaggccccgagggcgggggtagggggtggaaacaaaggcttctcagctcctacctagacttggtgtgacctgggctccgcccaccaacctttcttctcccttcctgcaccccccacctccccagatggtcagtgtgtctaatggagcacctcctgtgtaccaggctccgtgccaagccttgtacatgagtgtaagagaatctcatttgtaactcgcacatcaggtgtgtgccatagccccctccacagtgtacaccagaaacggaggcatggtgaatgcttaccgagagcttgttctgtgtcaggctctgtgctgagtatttttttttaagaggattgattgatttattagtttttggctgtgctgggtcttcgttgctgcatgcgggctttctctagttgtggcgagcgggggctgctcttcgctgtgggcgcggacttgttgcgatggcttgttacctgtcccgttgtggagcacgggcttcggtagctgtggtgctgggctcagtagttgcggatagctggctctcaggccccagcacacggacttggctgcttcgaggcatgtggcgtcttcccggaccaggatcgaacccgtgtcccctgcaagagtctgttggcgcgcagactcttaactactggcacccctgggaagccctgtgccgagtgtttaacgtgaattctctcttgtcctcacaacggccctctgagagatggggagcgggggtggggtccacagccgcagagccagtgaagagcagagccaggaaggctggttctccccgagttaggcaggggcttcaaatctggttcagtgccccccaccc

SEQ ID NO: 37389 - DNA, 741 bp, Bovine  19866881246016
tcttcttttgttctatttttaggaaaaaggtaagtataaagatgagaaaattgaaacttaattgaaatgcttttcatttcaccaaactatgtgaccagccatagaaacaaactacccctggtatatcacagggaacacagctgtccacctccagagctctgatgactcagtctgacatctcaatttcccatctttcctctgttgcagcatttattgcatttctgaatccaaggagccaaactcatataccagaaaatagtacaacacattcaatttggagcagacagataaatacaggcttgaaaaattaatgcacatactctggtgctattccatactagtaattttcaagacaagacttcagggtttgttttttttttcttcttcttctttttaaataacaccatggcacaaatcacttaaatgggaaaaatttgtttcacaaagaaatacccaattattgttatccatacaaacatgaacctagacaaaacagtatttattcgtaacacgtacagtgggtatcagaatttgaatagagaagaagatttcattggcaagagaggttaaattactcagagtatagaacatactacttttagaaggaaacatatgtggtcccctaatattgtaacagggcccaatgtaatggatcagaaatcgttaagtttggggtattcatctccatacatgcaactttaaaaagaacaaatcaagtgctagcataagaacaatcacatt

SEQ ID NO: 37390 - DNA, 1015 bp, Bovine  19866881308550
ccttttacatcttttattgaatcctaggggtaaaaatataagaatacaaaaatatgacaagatttcaaagcaccagactagtgatatttgtatttccacgagaacttagcatttaaaatttttttctaaaaatagaattggagctatggtacactgaaaataataaatacacatggaggcaattcaggaaaagaaaagggacatagactgcgcccttttctttcctgtctttggcctctgtcttgtaatatggataccctgattcctttccaaacaactttctaaggtattggccagttcccactcctctggccaaaaatgagaattgaactggatcctttaaaataatagtcataaaatgaatgtattttaataaatgcattcagtcaggaaacatttactatgcacttaatttatcagaaagaaaataagattaattaaccacaggaacaatttatcttccaaaggatactttctctactgtaaaaaattttaatctgtcagatcctaaagaaaaacaatttgatttattttctatgtaaacagtgtgacatgctagcaaacttgaatgaaaagataactatcaaagaatgacagcatatagaaggcaaggttaattgtttaaagcaagttaattataacattaatttgtttatcaattataaaattttaattttcctttttgtgtccctttattattcttcgcatcgacacatgactctgttgttttatgaactgaatgcattcaaaattaatttgagtggaaaataaagttcttaaaactattcttttcaaaagcaacagacatgctaataatgactgctgtcctgagacagcctgtatcatcacctccctttttgaccttcatcaagaagaacgaaacacctttcaactttgttagaaggaatactgttttcaaaaaatttgtcctttaaagcattctaatgtcattggtacattcattttgtttgtatctaaagacattttgattctaaaggatatatcgcatacttca

SEQ ID NO: 37391 - DNA, 1037 bp, Bovine  19866881536851
gggggtttaggaagccaaggaggtcccctgagcccaaggcatcagacagaatgactatggcttccgaaagatcacctcctcccaccccttgttctctaggtggtgggcacctgagtctaagaagaggcagtgacttgcacaatgacacacggtgtgtgggagacacagttagcctggggcacgcctgtgtgctctgtgcccagagggtacaggtgagcagaaggacatctacgggtatagctgagaagggtgtgaaccagaagagccatctggggggccttacaggatgcaggtaacagaggccgagtgctggagcttcaagctgttcctgcgatcgcggatgctgtcagaggactggtacacgtggacactgtggatcagtggtgtggacctgtgacaagtgcttgggcacaccaatccctccacctagctgcctccaccaccatctcctccacggcaggtgccaccccaaggtaccaaaatcccactgccttcctgtgggtttcagaccctctggcagccctggttgacagtatccttgagatctgacccaaggccctcctgcttctgctttaggatgtgatatttcttaaacagggactgcaggttctggcaccaagactccagcctctcctgtgtccctaccagccatcctcggtgcccagccacacggaactctggtaggcctcagggtcaacgctcagcaggtcctccaggctgccgcgggtgaaggagccacgactggaccgacgaagggctctcccatccatgggactggtgccgcagggaccaccaggcccgaaggagccagacagtggcaggaagccaggctcctgttcctcctctgaactggtggtctctgctgtggcctccttggagctcggggtctcctcatctgatggagacaaaaggctctttctcccactctgccaggcccaagatgtggtatctttctaggccctactctcccctcaatgcacccttctgggtcaaggtcttccactgctgttctccccgccctccagactccgccatca

SEQ ID NO: 37392 - DNA, 727 bp, Bovine  19866881691365
gtgagcccctccgctctgaggggagacacggacccacaagctagggctctggggtccaggctgggggctcctgagacccccaaagctgacccaagaagggtggcctccatccccctgcctggcccaggtacctccaggaacttgagaaaggcaggcctcgcctccttagccacacgcacggcatccttcgcattgagaaagttatcgatgtaggcagagtagatgttgaccaggacgtccttggagaactgtggatgaagaggcaggttgggaccctcaaggtgtcccctccccacctcaccctgtccaggtttccactgattcacgagccaacatctaactcttccctccatctgaaaatgacacggtctctaagggatagggcatgtgctaccactgtgatgtctgtacatgtcatatgtatgactgtgtgattaggcgtgtgcatgtgcgtgcagacacacaggtgcactcagaccaggctctctccctcccaatggggcatttcatcccctggtctccaaccaggcaggtctccctcctcgctgtcagctgagtgacacaaacttgttcctgctgcttggcttttgctcacgtaattccctccagcaggaaggcccctcccccatccaaatctcacccaccctggcaaggcggagctccagttctgctgcctccaggaagcactactaccctgaagaaggctcagcttggaactatacctggc

SEQ ID NO: 37393 - DNA, 1423 bp, Bovine  19866880340657
tgaggctgcagctgagtgagctgggcaaagagtaataggccaggtgtcccaaagatagcaaggaggtcagatcatgcagaccttgagtactatcagaccgactttagattccactctgagtctctgggtttctagaaacactattacaacaacatggcagacccggaaatccctcagcaatacccacagaaaaatctggagatgtgccactgctgccttgccttggcctgtgatgactgccaagaaaccagatgctattgcttgaaaaatattctacaactgtctagcttccatgcccttcgatttccagccataatgaagcctccaaaacaacacagaatgaagacaaatatgggtaagtatgcaatgaaaaaagtttttaacttgttaaaaatatatctttggggaaaaatgcatgaaaagaaggtataatattttctaaatgctattttttccctttaatgagtggatagaacaaatattgctagttggcaataaatgtgtttattacatgaaaatattttactttttaaaactgtaaactcttttaagctggtttttaaaatctcaggagattttggaagattgaacacaagaattatgctaatgaacaaaatttcatatctatgatgaaatgtacaaacttactttttaaaaatctcatattaataataacatgaaatgtacatttgcaatcaatattgagagataaggatgcattttgaattcacttttaagtgatccggtaaactggcaagaaataatgcaaaatatactcttcttcccttactcttatattttcttctgtatttttgaaattcaaataaatattttacactgtttaagaaccacgtctactttcatttttaaactgcaaattattagtattgccaattggagaacttcagcatattttgcagtatgtaaatatgccatctgtatcctacagtaatacccatggcttactccctaattagcagaaaggaatgataccttatacatagcagccatagtaaaaattatttaaatagtctatcataaacatataacgtgctgtattgtcactagacatgatactgatacatatctcaataatccaccttgagaaatcattacagcagatgaagcaggtaatggttaatacaaaggactgaagaagaagcttagaaaaataaggtttatatgttgctatgagcaggataatacagtgattaagagtgcacactcttcagtcagaacctactaattgtgcgatctcgggaaagttatgtaattgcccagtgccttaaatttccacatctttaaaatgggaaactaatagcacttactccaaaagatttgtagaatggaataaatgaattaatgcacataaatacttaaaacaggggctcaccataaagactactactacgccataaagact

SEQ ID NO: 37394 - DNA, 2119 bp, Bovine  19866880406668
ctccctggggcggggggaggggagaaggcagaaacaatgagaacagttttgctttatctgggtaaagattactatatgatatatatgaaaataaccatttatgtatcactcttcttattttacacaggagacctttagaaaggtttcatggtaaccatgaccaagtagcatccctatgtcttccaggacaaagaatcacatgaagtaggtttcaattatggtatataatgtttttagttttggacagtggcaaactctttgaaatcacacttccatacagtgacttttagtgtgatgcatcttcctttcctttctccttctacatccctttcctctcttcctttctttccctccatcctttctatcctttctttcaattagagatagtttcttttcaattagtatgtacgctgcttgcccacctgtaaaataatacataacatgtgttccttaagctgtatgcaaggtcacctttttgattgaggactaaagaatcctcagtggatttcttatatgaactaagagcactctcatttattgtatacaattaaagaaactgaggaactgttggaattagttttactattgtgaagtgatgatcattcaaaagaaattataatcttttattgactcagcagtttactaaaccctgaagtgaaatttgtcagattttaaggcatgttgagtgtttgcttactaagaacaagataaaggaatatcacggtctaaaaggagaacttttaagttttcagaaagtcttcctgcagcgagatactctgtgcaattgtgtacttacaacctgaagggaagtccttagttgtgtttttctggcgagtctttcacataagatgcattcgtctcagttcttgctatgggttgtttcttgagaatagtttgatttaaggttagagggggttaattatcccatgcaaccgaaaggaaacatttacaaattatctcaaggatactaaacaggagatgaaatccagatattcctggaagaaagttgtggatcgaccgaagtgatgattatagagagcactgacagagtaacacgccgtgcattagtctgtagtgtctggagtgagcagactgacaccgtcccccagcagcacctgccagtgctctaacatttcccagtttctctgtcaagagaggaaggggaaggaatcaagtgtctatatttggtagagtttccctggtggctcagaggttaaagtgtctgcctgcaaagtgggagatctgggttcgatccctgggttgggaagatccccgggaggaggaaatggcaacccactccaatattcttgccttgagaatcccatggacagagaggagcctggtaggctacagtccacggggtcgcaagagtcgagcacgactgagcgacttcactttcactttctttcactaggttaaaaacggctgtgtgttgttgaacacctgtgttttctaggcattgggcaaggcacttctacctgttatctttaatccttttaacaaatccctcaaacccctggtacttttctctaaattctgatgtatttttttaccttcatagtagttatcttgtttttgtatgtttattaatgtttatagttttcttcactaaactatgagccctgtcagggcagataccatgactattttgttcaaacctgtacactcagtttctagcacaatgtgtgacacatactaagttcctagtagatatttgttgaataaataaacaaatgagcgacaacaacaaaagataagggaaagatggaaggaatgaaaggcagaaaaaggcagagctgggattcaaacacagctcgtttgatttcagattacatctcctcccactgtagaacatcagcatggttttactttatctggaatattattcttgattatatccttaactgataaaattttcctaagttcttagagcacttcaaacctgtttacatcttattctgagacctcttacatcttaccctgagactgaatgccatgaaaaaggctgtcccattttttttatcattctgttggaatatcgcaaccgttctatgctaacaattctctccagaaatataggtttcatagtctagattttttggtttctgttcctcctata

SEQ ID NO: 37395 - DNA, 2275 bp, Bovine  19866880421243
ccttggctgtgttgggtcttagttgcagcacttggcatcttttgttggggagctcaggctctctggtttcacatgcaggcttagttgccccaaggcttgtgcaatctttgttccccaaccaaggatggaacctgtatccctggcaatggaaagcatattcttaatcactagaccaccagggaagtccccctgatatttaaactggggattgtgatagaagttatcagatatggttgttgggaagatcaagttggaagataatgtgtatagaagtgcctagaaccgttctagacaagtgtgttaggataaatcgacaatagttataagtaatcagtagtagaaccatggcatgaaaagggcccttaattctcatatgttttatagaactcagttttcaaagtgctttcatattcattgcctcattcagtaaaaggtatacagggtagataaccttaccaatcatactgtctaacttcctacttgataggaataaatgtttcaattgagctttgcttcaggatattattcactataaacaaagcttgtgtgtcataaattagggttggcatttttgaccttcttttttcccccaatctcttttatataatgtcagtgctcatttattttatcttcatacttacttccagagccaaaccagtactgcatttccatatactgaatgtagctgaacaataccatgttgatcagaagcattaaatgtcagtttacatgtctttatagagattgtatatgttagacattatatatgtctagacgttataatgtcatatatattagacattctatatgtctttaaaaaattagggaataatttgattataatagaataaatatggcaagtttgaaagatgacactgtttcaatcaccctctgtgtatttttggtcttttaaccttcctgaggctttcaatggctaagtcaaaatatgggttttatgaaggaggattaataaaaggatacttgatggtgaaaagatgagaaccacttgattacatgatttcaaagatgaaaatgcacgattgatcctagtgaagagttatgaatatatgtaattctatgcagtgtactagttgctgtaatggagatatgtataagagcagaagtacctatgtcaaggaaagcttctagtaggagttggcctttgagctgtgtcataaaggttaattaggaataacctatttgaagtagcatcctgaagagcattggacataaatgaaacatttgatggtattattgactattttgtaaggcatttgataccaaaatgtttcatgtttgtgtctttgtgattctagaaaggccttgtctatcataaatgtgaagtggccataagccagcagcttaacctgtgctgatttaacctcttaacttctctttcttagcttagttttgtggtcagggatattgtgagtatattttaaggtacagagaagtttttcaaattattgattcctttgaatatgttgactaagtattaaaattaaaataaatggcttattaatatttaagctgatgatctggaccataacttaataaaatcttgtatcttacactgtaatttttttttttaattggccattatcttagagaaagggaaatacctggaaatttttagatctggttatttctgagttttccaactatcaagttggcatattccataaatttttttttattgaaagatgatgagacggctggatggcatcaccgactcgatggatgttagtctgagtgaactgcgggagatggtgatggacagggaggcctggcgtgctgcgattcatggggtcgcaaagagtcgaacatgactgagtgactgaactgaactgaactgaactgaatgtaaaaataaatgaatcctcagagtgattcaaagttttgggaaaaaatacaaattattattatacagtgatgatggtgaaccagtatcagtaccagaaatagtagtagcagagcaaccactctctactcttgataactttcaaatagggatgctaaatgtaccctttatagttttgtaatctggggtctcacgttttctaataattttctgaatgccttttctctgagctacaagccttctttgctgtttttggtttgggaagttttctggaatttagtagcttgtttctccaaattaggtacacctattgagatttttgcagtttatatgaccttgtaacataatcactttctgaaaagggccttatggccacataggctggggagaagttatggccctctttacaatggc

SEQ ID NO: 37396 - DNA, 1596 bp, Bovine  19866880454740
tgcccttctctaataatggtctcattattgttattctaagactgggcctcaggaggaggaatatttgctggaggtacgtcattattttgcaaatttcgattagctcatcatgttgtctgtagtgtgaaaatcgtagctaattagggcagccagttagactaccagcttttgagcttatgagttaaaaggtagcatacttgataggccagtgatgtgaaaaaggtggtaaaaaggaggattagagcagttgccttagtaactccaacttccatctgtgagggaacaatggacttgtgtttctcccccaccttggtgtaaaaattggttttgttttgaaaggacagggttctttttatgacaatctggaattcagcccaaccgagtgtagttttagttgttaggagagaccattggggataggaaagatgaaaggtcatggtgagcttcaaggacatgaaaggttgttgtctcatgtaacaatggtagattgttttttttttttccctaatatttctagccagcccctaagtcaggtgatggaacaaatacctacagtttagtcaggtgaaacaggaaagggagggggaaggaaaggagaaaaatggggtaagaaagagttcgtactttgtttttaaaagggggggaggggtaacttcaatttgcttttattaaacgaagtgatatttctctgtcactgtctctgagattccagtgtgctttggatgatttgcctctgtgggccatcacatctctgggaagctctccaatgtgttagaaaatgtgatttaagctttcttcctgaactcccaagaggactagtgatgcgatacttaacaataaatttagttgttgtagctttctcacattattggtgttcttaaaaggttttccttcaaaatgcacactgaataaaatgaatgataaatatgaaagaatttgtttcaccactctatagggttttatcataaattctatgactttcatcacagaaagtttacaggaaactgtttagatgttgctgcaatagcagcacaattttttctctctgttcataagaaaatgccacaattttaagagctatttgaggttttgtattaagaggaggtgataaggattgaatatggtgctatttctttaaaagcctgaaaaccaaatcactctctctggatttaaaatgcctttattacagcaaaataagtgtcttctgtttctctttcatatcagtattaaaacatttgatatgtgtgcttatatgggagctcctgtttgtgtatgtgtgtgtgtgtgtgtgtgtgtgtgtgtgtgtgtagaatcagaaagagtatgggaatattaagtttttaagcagaaagatcatcttttgatgatcagaggaaccttcatatttctccctctctattgtccccaaacaacccttgtgtaattgaagctggacttggtccagggggctagggagattttcggattctttgaatcccaggtctttgtttttttactttttctagccaactgtctttatgctgtagcttttctttttctgagaagctgcgttcatttaatttattgtaaatacttcatagactgaaataatagcat

SEQ ID NO: 37397 - DNA, 1315 bp, Bovine  19866880512010
tctgaagcctccctcctaagcggggctcttctactctctcggcccgtccaacaccagtgcacatccttagggctgatgtgcaaatagcaggcttaatgctcagcttccccttaaggtacaagggtcctaagacagacacgttactgagctaaggggattatctctagagctgaggcccccaagcagagggctggtaaaggaggggtgtggggttaaggtcatcgctctctctcctcccctggcagtctacctggcgtagttccccctgtcagttcacaatcctgcccccattttccctgtcaccccaatatgtaagagaagagcagagaaaagcaaagcccagagaacttgtatctttctccaaggacgatggaatttcagaactgaacaacaaggtaaaggaagcttttgggggagcagcagagtggggtttcattcctgtgtccttgcatcacaatggactggaaggctcctatggacttcgctcagcaaaggtctgaactcactgtccggaagtagggacacctacaggtagcctcacctatcactgactctcacagtcacttgcacgttcttttatcctctggtttgtctactcaggtggccgtgaggatcttcctaaagccacttatctttgctgaaaaggctgtgggctttctcacagccaatgctggctaaagagaggtgagtttccaagcctcattactgagaatttgcatatggggctgcaagcctatctccagtgtcaatgatttatttaggacgctcacagcttgcctggcctagaattacaccaaagaagttaacactgagcctgctcaaaggaaggctttgtgagctccccagggcactgtggcactcagggaaagcatgagcaatgccactaggctaggtagaaatcaagctgcagggccctggcttcagactggcctatctcctagtaacttacaggactaagttctctacaaagcctgtgacaagacccacatgttgtacccatctgtttgggggaggggaaaaaaggattccaggcctgctgcgtgttaagtcaccaagaactcaggcacagtagaaacacaaatagccaataatcacatgagaagatgtttaacctactagtaattagataaaaggaaatagaagccctgatgtccttttttagcaggcagactggcaaaaactaaggaggttgataacatcaagtgttggcgaggatttgggcaaaccagttcagtactctcaggcactgtgagtgggagggcaaatgaatgcagccttttagaggggggggttttgagttacctgctaatattta

SEQ ID NO: 37398 - DNA, 2572 bp, Bovine  19866880548108
cttgcctggaaaattgcatggacagaggaacctggtggactacagtccatggggtcacagagtcagacacgactgagcacatacacacacacactaaaaccggaaatgagccaaggaactcttaagtagggcacctaagttttcaatgtcttaaaaatcttaccttgaattcatgaggatatacttaaaatttttttttgaatagcatgttttgtttgagaaagtgatgaaaggtgtagataatttccccaggaaaatacacatgcttatatataactttgaggtggtcatggaacctttgaaatctttccatggaacctctagaggtttattgatctcaggttaaaattttctggttattgcctttttttttttttttttttaatttggatctatagaccatcaggaactaatattatagtatgatgtgagggagggagtcaagttttatttttccatatggacatttaattgacccaggattatttatcaaaacaagtaagcaaacaagatcaaccccatcctttctccacagcttagtagtgccaacttataactttgctgtaaatcaagaacttaaacttgcttaatttcttctttttcttcttcagggctcttgaatctgttcctttgtggtgttttctccccaaccagggccaattattttctgttttattactagtattttatataataagttttggtatctggtagaccaaatctggagaaggcaatggcaccccactccagtactcttgcctggaaaatcccatggacagaggagtctagtaggctgcagtccatggggttgcgaagagttggatatgactgagcgacttcactttcacttttcactgtcctgcattggagaaggaaatggcaacccactccagtgttcttgcctggagaatcccagggacgggggaacctggtgggctgccttctatggggtcgcacagagtcggacacaactgaagcgacttagcagcagcagcagaccaaatctatcctttgtgttcttcaggattttcttagcttttcttggatttcatgaaatttcaattcattttcattgcatttatagattaatttgtggagatagaccttcaattaaaattttgaatcttcccaatccatgaacacagattacaaacttggcaaactcacttgttaattattattattctgtagattcttttgaattttctatctatataatcatatcacctgcatttaaggaccatttgatttcttctttttcaattcttatgtcttgtgtatttccttttcttgcctttttgtactgttgtgatggtgggtgcctttattgtattttctatctgaaagataaaactttcaacattttaccattaagtaaatggcagaccactcccagcactcttgcctggaaaatcccatggacagaggagcctggtaggctacaatctatggggtcacaaagagtcggatacgactgagcaacttcactttccacatatgatagaatgatatttgctttaaaataatatttattgtacagttattgtaatcatttggttcacccttctaaatatgtcgattttgtcaaatttactgattgcattatttaaacacttttttatttttcctgtttttaaagttcacttatgtcaagagaggtctttaagtctccactctgattatgaattggtctattttgctttttatttatgccaaatttagctaaatattgtaagattataccattgtacatgctaagttgcttcagttgtgtctgactcattagaccccctggactgtagcccactgggctcctccgtccatgagattctcgtgaaagaatactagagtgggttgcccattccccctccaggggatctttctgacctagggatcaaacttgcatctcttatgtctcctgcattggcaggtaggctctttaccactagtgccacctgggagctcaactattccattaagttcatacaaatttagaatcattatatcttaacaaaatatgcttgatatgctaaattaatgaattgacttttttattgttaactatgttctttatctctagtaatgcactttgcctgtaagtcattcttgtttatatgattaaaattttcttttggttagtgtttacatgttttatttaaatatccagttattctttttttgtgatttggaagtatctctgataagctacatataataaggattaaaaatttaatttccgaatgtcctgtgcatcataactctaggatgccctgtcctccaacggctttacttttctctgtatcatttaccaccatttaaaatactgcttgtactacttgagattttttaattgtttgcttctccatttaaatgtaagctgaatgaagcagggacttttatccattttatttatttatatatccatatccctaggtgaataggcattcaaaaatttttgccaaaataatgactctcaatgagttgtactctgcatgctctttttggagatttctaaaaacactaatgtataaagaagttctacaggtacaaaatttgtttaaccaagaatttt

SEQ ID NO: 37399 - DNA, 1752 bp, Bovine  19866880553129
tatggaagctttttttgctggttccttttttcagtttatgaaactacttctgtttttatgaaggagagatattttctggcagtggttttacgaatcatttgagatagcctagagatgagaaacagatgatataggcagctactgatgacctctgctggcctgggcagatcctcaggatctgatctactttttttctaagttgatttgatcaaacctcaaaatgtaatttagacaagatctcctacatagagttaggccaccttctaagagcattctatagggtcatctgccttccttaatatgtagttaggtcaccccagtacgtcttattaaattgtctacttttaaacaactctggcagttgttagttctttgctatggcaaagtttcacgttcaattaaactagtagttttgaggtgaagtaacttgtgtttgcaggttgattagtcagtgtgatttagacttgatagtatttttattatagctgcatacaaatttgctgttaattaaaacaaaaatccagcaccacagattttaaatacttgagtttaaaccactacatatgaacaaatacaatgggtatagaacagaaaaatgactacacgcatatgtatgtgtagtcctgtgtgtgtgtgtgtgtgtgtgtgtgtgtgtgtgtgtgtgtgtcctgccactcagtcatgtccaactcttttcaaccccatggactgtagcctgtcaggctcctctgtccatggaatgctccaggcgagaatactggagtgggttgccatttccttctccaggggatctttctgacctagagatcaaattggcagctcctgttcctcctgcattggcaggtggattcttttactactgagccacaaaactagaaatcagtttacattatataagagcttatattgtctaaatgtataggctaaaatgtgtgtgtgtgtgtacatatatatccacacgtatatttcccatttcaggagcgattttaggtttgttatactactatatttcattcacactgcatttgtcatgccactcacacctattcaaaagatatacgtgcttctcaaatttagggataaaataacaatagccttatatgtgcacctaacttttcgatttaaacataccgataacggcttgttttcttcttaaacatgtatcttttttaaggtcagtgaaagacttatttagatatcgttgaatttttacaattaaacaacttgagtagcatgctgatttgtaaaaagattcggttaaatggtgtttctctattaattcaggtatacatgtctgttagttttggaagcgtctatttatttatggacctgttagcttcaccttgaacagaagaggttaagaagccacttatatgttatcttcagcttttctgtttcctatgcagggaagaaagagaaatatattaaaggtttttgaaaagatgtagtttaacctaggagagaagagaaaattttccagtctttactggggaatctaactgccagatccaactcttatattggtccttgccccaaacttcctgtgaacgctcttctttattaacaaagaattatggcacagtaactttaccactgtccagtaagtgttctcttaactcatctcatatacgttcagttcagttcagtcattcagtcgtgtctgactctttgcgaccccatgaaccgcaacacaccaggcctccctgtccatcaccaatacctggagttcacccaaagccatgtccattgagt

SEQ ID NO: 37400 - DNA, 1112 bp, Bovine  19866880576666
ttcttttttttcttctgatcaatggacaaaaaacatcaacacactgttgcccagaaatacctgaccaagaacacttacagaactcaaaattccttctgctttacacagaatcacataatctccatccccaaagctgtcttcctgtcctctcagttcagttcagttgctaagtcatgtctgattctttgcgaccccatggaccactgcacaccaggcctccctgtccatcaccaattcctggagtttacccaaattcatgtccattgagtcagtgatgccatccaaccatcttatcctctgttgtccccttctcctcccgcattcaatctttcccagcatcagggtcttttcaaatgagtcagttctttgcatccggtggccaaagtattggagtttcagcttcagcgtcagtccttccaatgaacactcaggactgatctcctttaggatagactggttggatctccttgcaatccaagggactctcaagagtcttctccaacaccacagttcaaaagcatcaattcttcaatgctcagctttctttgtagtccaactctcatatccatacatgaccactggaaaaaccatagccttgactagacagacttttgttagcaaaggcattactttgcctatcctctcaacaactcatattttatagatttggaatctcataaattctagcttgtctagatcttttatcaaacattataaaactaggtaaacattccaatttgattttctgaccataattgcagagaggattttcatcacttttatttccgtcataaaattcaaaaggtctagcctattttcatgaaatactttcaacaaactctgaaaaaaccccaagattagacaaatgtccagtggcctctgggcaggagcagatctagatgtgaaaactagcttggttcccccaggtgaccttgggttagttacttaaactctctgaggtttagtttcctcacctggaggatggaagtagcaatatctactcaggagcactgtgagaagtaatgacgacggtaacatgccagcactctgcttggtacatagtgagatatcaataaatggcagcacatgttattatttttctgccttatttt

SEQ ID NO: 37401 - DNA, 1044 bp, Bovine  19866880604000
aaccatggagaggaagttgcattctcttaacaaaatgccaaggaacaccttcttgcttcccaggtcaggaagaagaaaaatcagaagcaactgaccgcatctgttcttaacattcatagagaaaaaaatttaagaaaagaatttttaagtctgaggagatagaaatgggccaagaaatttgaagtatcttttcaaggcagagacacacaaaatgaagttgagaaaagaattcaaccaactaggatactgccaatattgaaagtgggagttgaaaaacaacagcaaattgaaacaaatatttgcccagaatgtctgggttcacaggattcaggctaattacatacttcataaagatatgtgaggatgaccagtttttgaagaattagaaagcaaatacacttaacacaaaaacacaagaagcattattcttttccacaattcaatatgaaacagtggtttcagttcctcattttgatccctaattgtacaatacttgcagaaatgtatatttaaattatttggtactagattagtatttgctatgcatacaatacaaaatctttaaaataggatcgaggacccaaacattataagagagtaaagctacactttaaagagaagaaaaagtgaatgaaaatgaagttatatcagcattgctctgaatatctgattgcttcttcacccagagtaggagtgatcttgggtaacttcagcacttaaatgacctgtaatttccaacttacttaaaataataattctggggacttcataataaatacttaatgtgtttttatgcaaaagtccaaaaccttctcccataaatgaaaaatataaagaaaggtttggatcttggtattctaaatatttcaccaatataaccttcaattagaacagtggcaaaaacctaaaggagatcagtcctgggtgttcattggaaggactgatgttgaagctgaaactccaatactttggccacctgatggaagagctgactcatggaaaagaccctgatgcgggaaagatgaaggcaggaggagaagggga

SEQ ID NO: 37402 - DNA, 2480 bp, Bovine  19866880611335
ttgagtattttctatgtagaagacattgtcctagctgattgacttgtgttacttctttaatccttgcgatatgggaggtatcattatccccatttcatagctgaggagactgagtttcagaggacattagctcttgttaacatcattcttttaactgaagagtctatggaactgattttttgaaacctccaagccatttactattgtatagacaggatgtcacggaacaagctagctgctaaataaagagtgagcatgctgttcaaacacagagtagcatgccatcacctgatgacatgtgtcattttcctttttcacaatgaggtataatggtatgtggtgttaagagtttcacagtcaggaaatgtggcagaggtggatctaaaatcaggaataatatggttggatatagatgaattatatacggttactttattctgcaaatcagcaatgcctctttattaaaaccattgataaatggatggaaaggtatgggaaggtggaggatttcagcccaaattggtcagatctaggcctctactttctcagaaaactcctcattcttgctctcactctgctgtactatgtctaagccaatgatatagctatgcattgattattcagggactacccctcgggccctggaacaaacacttcctaggatgtgaggaaggtgttctgagcaggtgagcaccttatagaggtgtatctttttctatgtggtttaaggatcccctaaactctggagggcaatctcagtgcactgaggactagttagggcacatgctccactccatttagtgacagtgactgtttctctttctttttaaaaaaaatgattcgcttttttatttttaagcagatcaagcaataatccattgagaatgtgatgctaaaccacttttcctatagagtgtttaaactggacctctgagaaggagcttgatacaattcaatgactgaagtaatacctttgtccatttgagcattaaatggcccgttgaaatacagcttagttagaaggaatttcagaaaatagtactttctaatttttttttttctttcccagctgactagagcagagcttggaaaatgcagttcaatcactttctacagcctctcaggtcagcctctcaccagtgttaattaaatataacccccttagaatacgagaggttaagtgagagcaacatagcattcttctccaatatattactgtgaacacaaatggccataatctgtttataagaaggcttctttcagcacagaggtctcgctaatgaaaaattataagaggaaaagcaacataatgtgacaactgttcatcgcaaaatacattttaaactacccatttccacatccattgtgcttaaataacacatatcataaaggaaattggtgtaacagatggtttcagctctgggtagcaaatgcagacgagttttcagtgtgataaagtgaaactggaaaagccagtgcataattcagtcaatctctaacctgaagtctctcttcccctcaagccagagaacttttccccagcagctaaaggcattaatatactttctctttttagccgatgctgtatcttcagtggcacaacttggcctgacttactgaaactagaaaattgctgaaagaatggttttatactagccattagaaattagaaaagtctctttaaaactacagggttgatggttctaaaaaagttgcatacactgtacaaggctatttgtaaattacatcattttaaaataaagctctttaatactctataattagtcttgtctctctgaacatgactttactgtaaatgctccttcctgactcttctattgtcccaagattcctgagaagaaagcagccaagcgataattcaacattattgctgcttcagtgcactaatcgcttaaagagcagcaaagactctgtgctctctgccccacagctcccgcagcctcctggcctgaggctggcatcccgacccaacaacgtccagatgtcaagaggaatccccagctcctgatgcagcaggcgctccattccagtatggtcaaacatctgcttcatctgctggcatgcaacctgctgaacacgctcagagggcagcacaggcgagggatgggcagggacacactccccagctactccgggagactcatcaaaactttgaaattataagacaggcctagaaactctcaaaagaaaagaactcagcattcagcaaaaaacataagcattttcctccaaagaaagctatggaataagatatatttcatgatagctatttttattaattctagtaggcttgaaatttcttctggacagttaactacaaatttggaaaatacctgaactctttgagatcccaaaaatgtgatgttggctttgaaatttttccttttataatttaattacattacttttattcacttagatattataataagaggagaataagttgtgcaggaaaactt

SEQ ID NO: 37403 - DNA, 957 bp, Bovine  19866880617344
ttagttctggctgaagaggtaacagatgcaactcaaaacacacagagctagccttgtaaaaagttttaactagcacaatgactcactttatgcctctaaatatctatggtttcctctctccagaaccccccatgcattagaaggtagtttggtagtttatttttattgtttggtctaaatacagcacatttttggttcaacgaaaacaaagaaactttgttgcaaaagctgtattctttccaaaatgtgaggatggctatgagtagtgttcaactgaaaataataatggaacttgggttcctaatttaggatagaaactttcctagactctggaaattggtttgattcaatccacatattttaaattcagccagtaaacatctaggttagttaactaacctagatttaaatctagttagctaactaggtttaaataaaattcatttagaaaaaaagtaaagaaaaaaatggatctcgttcaacatcatttataggaactactacttccaacattgcatttataccacaaatggccataatagattattgttgttgttgctgttgttcttcagtcactcagtcatgtctgactctttgcaatcccatggattgcagcatgccaggcttccctgtccttcactatctccctgagtttgctcaaactcatgtccattgagtcgatgatggggtccaaccatctcatcctctgttgccccattctcctcccaccctcagtcatgatagattaggtactgggatctggaattaagttgagacatgaaataaatatacaattcagcccttccccagctcctataacatggttttgcctaagtgatgcatatactttattcaattttctagtcaggattgataagtaataaagtcctgggcatttagttagctttaatatccatgagtaagacattcgattaggtttcctcaccagacctcctc

SEQ ID NO: 37404 - DNA, 1084 bp, Bovine  19866880652173
tggatataatatgcagaaagactttgattaatagattcaggtttaaatgcttctaagataaaaatccttcagttggggttaaatgatgaattttagttatccttgtatcacccatcttgttgccaatgtagctgggctctaacataagcgacagttgtcagaaaatgaatactttaaaaaggacttctaaatctaaatacatatatttaatcagagagtcctttggcttctgaaaataagttgtctaatgagaatttcatttgagcagctgtgactgaggaggtcaacaggcattgcctaggagaatatggcccagctggttaaatctggttgttgtcgtgatttaaatggtcaagtgctgcttgtaatccaggaccgtctgtttgtaaagggaagagtgagtgcttcagcataatgtacagctgttttaatctctctttaataatagtgcttcagccactatcatgtctcatgcatcatactactaagtatatgatcctagactggatgaactggtttgggacaggtcctggagtcatgtgagattgcagagaaagggatataaacagctctcacaaaataagagtttctttctttttcctcctttaagagacttatattttaggtggtaattattgtgatcaagagggagtgatgaaacttgcagttaaaaatattagaataaatgtgctatatttgatagaggccataagcttaaagggaaatatgcagggtttaggtacaatgtcatagaatgtatgctggtcagaaattagagtatttgtccagtggaattgtgcttcaagatatgataataatgaaagtatgtggattcatttgactgtttatgtggagaaagggcaggagcatttgagctttggattcctggtgggataggctttccaatggattatgcagctgttgcccagcacaagaatgaacacgtgtttatgtatctgatggattattatcattattcacatctctaaacaataatttggatttctacatatattttcactgaattatatttagtaagcatatatgttggtatgtattgcttatctgatgtcaatagcttttg

SEQ ID NO: 37405 - DNA, 2884 bp, Bovine  19866880780128
gtcctttatttaaaaataacaatagtaactttttaaatcatgttcctggcaaaagaaatgtatctgtctttctaaaaacctctctctacttcttgaattcaattaatgaacataagccattatctttcaaaagctagacaggaaagtaaagtcatcattgaaggcaaaaattattcacatctaagcagacctcccctttacacttatatcactaatgaaattcttgttgcatctttctccttccttttttttttttttttttttgaggggggtgcacaccactcgatttgcagaatctgactagtgaccaatgcaccctgaactggaagcatggagtcctaaccacaggactgccaaggaattcctgtacctttcttctgaaggaaaagtgttttcagatctactagtacatattccagtaagaaaaggaggggaagattattgattccctctgctgaattttgagaaaatgaggatgaaagaaaagaaatcacataaaaaagctttcattttcactgagttggatgaaaatatctaacttataattagtcatgtcttccacattctattcaataggctacacttcttaaagaaaacctctcttccaaatttcatgctatgaaactaaattttaaatgtactaatttatctgaatgtttaacattttgtaagcccatggactgtatagtccatggaattctccaggccagaatatgaaatggggtagcctttcccttctccgggggatcttcccaacccagggattgaacccagttctcccatattacaggcagattctttaccagctgagccacaagggaagcccaagaatactggagtgggcagcctatcctttctccagcagagcttccctaccctatgcttttccagtagtcatgtatggatgtgagagctggaccgtgaagaaaactgagcactgaagaattaatgcttttgaactgtggtcttggagaagaatcttgagagtcccttggactgcaaggagatcaaaccagtccatcctaaagaaaatcagtcctgaagattcattggaaggaatgatgctgaagctgaaaccccaatactttggccatcgatgagaactgacccactggaaagattgaaggtgggaggagaaggggatgacagaggatgagatagttggatggcttcaccaactcaatggacatgagtttgagttagttccaggagttggtgatagacagacagggaagcctggcatgctgcagtccatgtggtggcaaagtgttggacacaactgaatgactgaactgaactgatctgaatgttaattcatcttctcctatgtccagttccttaaaataagactcagatactaagtgacaagaaaatagagacatagaacacagaagagaaattaaggtcatggaatgaatttaaatatggcattaagttcaaatttaccccagccaccttctaggacactctgacccccccatagacatgcataaatgtagggaaagaaaagtccggcaggttatataatagataaaaacacttttttaatgagctttcattcccaagtacagtggatgccaatccaaagaagaagctccaatggccaaagggacttttcacttaggggcaacaactaaaatacagatatcacctgttcattgcaaatatcctgactggcatctcagttactttaaagagactcataaaaattcctagagcactgcagagggtaaaaaaatcaacctaggcaattagtcaaaaaaaaggggtcactactatggccatttcattttagaatcctggaaacacaacagcatcataaaattacatttccaagatccccagtgctttctgggaatcatattcaatctgcatggatccaacacacttcccgatacttaactgttttcggtattcttttttgttgccgttgtaccttcagctgaaatttgctccaacagttccaccctgattgaaattaatctattacctctcccatacgtattacattttatacctgttcagcaatcctgggatgaaaagagaaatactgaagacagaagaaatccaacatttggaaaccctacagtggatggttatattatgttcccaactatctatttccactttttgacatatgacttccagtgcctcccagtagatggagtgtatttccctgccccgttgtcaggattggacaagcgacttggccaatacaataagagaagatgtgacatatgctatatccttatggaaactttatttgcacctacatagttttgttcggtcttttgtactcttggcctctgcaatgagaatagcatgtcccagatagaggctgttccttcaacctggatcacaaattgaaatgacatgtggccaaacagagacaagaacagccacagccaatctgaagaccatgactgaaaaaccaacgctcattattgtaagcaactgtgactttggaattctttgtaactacagcaaagctgaaaaatacagaaattggtaacaaatgatattacagttgatcctttgtatctgtgggttctgcatcagtggatttaacaaagaattacatttttttttaatttcagaaagttccaaaaagaaaaacttgaattttccacctgccagcacctatctacatagcatttatattgtattaggcattataagcattccagagattaaagtatatgggagtatgagaattgattatatacacactatgccattttcataagggatgtgaatatccatggattttggcatctgtgataggacctggaaccaaccctccacagataacaatagttggctgtatactgcacaacaacctcgagaccatagtgatttaataacaaaaaagctttatttttct

SEQ ID NO: 37406 - DNA, 1440 bp, Bovine  19866880914842
ggtctcctgcattgtagacagacgctttgccatctaagccaccagggaagtccacaggcttgctaatgggtggggcctggacccagggaattctggggctggtacctattcactggtggctgcacccgggtcctggggtctctatgaggctatggggatctggctctagtgcacaggtaccggtatgtggaggcaggtcctcggccatctgatgggcaggcatgtgtccagggccagctgtgggctcacggggtcttaaggcaacctttctcttggtgggttggggctggatcccagaacatgttagattttgtgtgtaccttgtaagagtggagcctgtttccacaaccctctgagtcttgtggaagtaagccctactggcctttaaactcaagtattctcagggtttttcttcccagtgcaggactcttgtgctgggaagccaatgtaggattcagaaccctctttctttgtagagaacctctgcaactgtaattattctcctgtttatgagtcactcacccaggggtatgggtcctgactataacatgactctgttcctcctatccatcttgttgtggatccttctacacaaatttagctgtagaagaacttttcaggtaggttccaatcatgttattaataataaaaaataattctgtaaatagttgtaattttggtgtacctgtgataggaggtgaggctaaggtctctctactctgccatctttggcaaaagaacctctgtggaattatctgtcttgatctaaatctacataagagagaggggagcaatacagtaaaggatacaagatgaaacaaaaatagtggtaaggttcataacccatttgtatgtatgcttttttgagttgtaccaaaagagtaaggatgccaggacatttatgatgatgaaacatttctaaatgcaaaggtggcttactaaatgatgtctagatcattagaattcaccctgcttctatgcatggatctagccttctgtggtttatataggagaatcttagccagtctccttcttttacacacattcccccctatactctggctggcatctcctccttggtgtgaaggcgcctccctgggcagtgtgccagagaagcagtaatgttggttgtttgagttagcacaaactgtttgtcaaacacacagatgatagagagaaaaaaaataattatgtgatatgaatcaaataaggaaaatagtgttttccttccttccttggtcatttatgattaatcatttaaatatttacatttaggggttaaggtagataggcttataggtacactctcctgatgcttagaaaaaaatgacagtgtctttctgctagggaaaaaaagtgattaaacaaatgcttttaaatgaaaaattctacaaaggattcccaatgtttttaaggttattttttaaacacaattactta

SEQ ID NO: 37407 - DNA, 3012 bp, Bovine  19866880944975
tagggaagtttaatgcaaagaagaattttctaataataagctattcaataatcactgtgattaaagaggttctttgtgccattttcctatgcgtgtgtgtgctaagatgattcagtcgtgtctgactccttgccaccctatggactgtagcccaccaggctcctctgtccatgggattctccaggcaggaatactggagtgggttgccatgcccttctccagggaagtggtcaagtaacggctgtatactcatatgccacagatacttaaaggatagacataacttaaactctaattagataatgacctatggtgcattttcaactttataattctacgtttgtttaaaagtcggtgttaggaagataatgtcacatagtcattcctccattcattcaacacatttattcagaatctactatgtctacaaaggctttgttgtcaaatgaatctgaagcttaaatctatacagtgtcatttacttggcagtgtgatcttgaacagttactcagccttcctgagtctattttctcatgtaaaaaccaaagctaatgtgtactaacgtagctggtagttagcagcgtggttattgtgaggattaaataaacaagaaaagtaatgcttggggcatggtgactagcgtttaatagacactcagtaaatattagatccttagtttttcttatccagtttgctattcagtactagaaatttatcaaactactaaagaactaatacaagaaacagtggatcttaacccataactctacttcaaataagaaaacatgagtcaaataaataattcagtttggcaggcagaggcttgtttgtttttagcagacccatgtctcacagagcattatcttctcctaaatatccagaacatgaaggaaaaaaaaaaaaggtgggattaaaaggctcatttgaagatgtaatttgggatccttagtgttattcattaaacagcatctgaaaacataattttatttttacattggagcccaagctcttcagatcttcggcataagggcatcaatggcaatcaggtatcagactttaatgattaaaacttggtgtctgaagatatttcctttgtagctagctatgtaactgagagactaaagttaactaattaaggtcatttttaacattaaagagctgtaggtgtttcatactaacgtaagctgtaagaacttagggaagttcttttctgtccaccatcctctacataacaggatattttagaaagtttcaatgctgtgaggtaagaggcagtttcaataaactgagaaacaaagtaaataaggagggggacagaaggtattgtgaaaacaatgacaatgatggaatcacagacttgaagtggagcttggagtttatctaacctagtagttctcgaagtgtgggacccaaccagcagcatcagcaatacctgagagtttttaaaaaagcaaattatcagactccagcccagacctatgaaacagaaactctgggggttggggccaacagtctagaatgtagactaaaatttaatccagagaggagattctcaaacttttgtggactttggaatcatctggagggcttgttcaaacaaaaattatttgaacccattctcagaaatcagtagatctgaggtgggaacctgagtttactgttctaacaagttcctaggtgaagctagttagtgctgttggttcaaggaccattctttgagagtcactaatccaattcaaatctcacaatttacactagggaaccaggtagcttgagaaggtaaaactgaggtcacactgtccgcgacagacctggatctagagtccagaacttctgcaccctgttcagtgctttttccattatatcgcatggacttcagtaaaagaaaagcaagaaatcatacatgtacattctctgcatagagaaaatctgaagtgctgcaactgaaaataattgtatatttcagagatgtgtctctgaatatagatactagggagtatagatactgtgatgttcagtttcagtctgtttcttctcttattttgtacctacacattgatctcaaatttgtcatcaattccaattaatgcgttagcaataatcatttagatccaaatgataaagttgaccttattttaagtaaaataatgatgtgcaaattcaaaatgccttcattaaatataagccaaaatatccactagccagttagaacccaggctgagaaacgatgaaaagctcctcttatatctctaattacagaaatcatcatcatcatcacagcaactaatattttccagtatttcctctatgtcaagcatatgggaaagtgatttaaatgctccatctcatttaattctcaaaattttatcaggtacctactgttactgtcctcatttatttaatgagaaagagaaaccaatgagaaattaggtaacaaggtcacttaaaaagtgatggagccaagattcaaggccaggtatgtcaggctcaaatcctatacttttaagtactatattaagcataaagtcatcttttgctaaatataattgtgaatttacatgcggttataataaataatacaaaagatcccatgtatacctgactcagtttctcccaatgatgaaacttgaaaaattatagaacaatgtcacaaccaggacactgacattgacacaatccaacagccttactcagatttcgccaatgggataccatttctaaaaaattatgtgtcataaaaggtagcacaggtaattaaagttctgtggatacttccaactaccacctttcatacaaagttcaccagtatgacctagtgcaaataaagtgagtggaaatcatgaattaaagcaataatttcccctttcagaactttccatttattttacttactagaagattattggttgaaggtgggacaaaaatggaaagcaagaacaaggtgggtgggggaggtaaggaaagaggatttggtggccatacaagcatcacataagcatctaaaatattttt

SEQ ID NO: 37408 - DNA, 2380 bp, Bovine  19866880957604
agccctatgttgaaaagcagagacatcactctgctgacaaaggtccacatagtcaaggctatggtcttcccagtggtcacatacgatttgtgagagctggaccgtaaagaaggcagaatgccagagaattgatgcctttgaactgtgtgctggagaagactcctgaaagtcccttggacagcaaggagatcaaaccagtcaatcttaagggagatcaaccctgaatattcacggaaaggactgatgctgaagctgaagctccagtattttagtcacctgatgcacacagacaactcattagaaaagtccctgatgctgggaaagatcaagggcagaaggagaagagggcgtcagaggataagacggctggatggcatcatcgatgcaatgaacatgaatttgggcaaactccaggagatggtgagggacagggaggcctggtgtgctacagtccatgggatcacaaagagacatgactgagtgactgaaacaacacatggatatttggtatcatgtaaaaatgaagaaggaaatggcaacccactccaatattcttgcctgggaaatcctgtggacagaggagcctggcgggctaccgtccattgtgttgcaaagtccgacacaactgagcgattaatagtttcactttcaaaaataacttaagggagaggtctatattgtcatttctaactcaactatgttataaaaagtcttgaaacataaatgtttggtgtgacttttaaataagcaaagagtgttttagtcgcttcttagtagtaagtttagccatttccacttggactattaattctctgaaataccagagaccttcttcagtgtgtgacttacaggcttcaggggagaattgagccatatgcattggttgacattaaagtgtaatttatttttattttctaaatggagattggcatgtttagaagaataaggtggcattcttagctcttaataaaaataaatctctgttggtagtgaggtttgctgcacggataggtcccaaccttgtcacttctggggaacagcagtgaaactgtttgttcctgacagcagacagccccactgcagagccctggtttcatgttacattaagtattagtgctgttctttcaggagctattatgctgtgacatcaaagattttctgacagggcagtggtaggttagcactgaagttgtctgctgaaattttaaagaatgaaattaaatatatatgatcagactttaatataggagatagagacagaatgagaatggtttaaagaaagttgaagaaatggtgaatctatatgctggcctctttgtctctgcttgtttaagccaaattgtattagcttttattcctatagaaagtacaaatggccattttgttaatgctaggatagttgatcattttcagaaagactttataaataaggaaatgtaagcttttttgaaataaaaatggttaggttgacttgtaaaatatttgatataagtggacatgtggacagtaattgcagtggcctgatttgcttcttgctgatccactaattaaaagaatcaaactacatattgtattaaagttacaggagtacaattacatggtaagtaaagatataaaagccttgtaactaaaaaggcttacgatttcatagcagttgtataaatagaggtaacttaaaaattaatctgattacaatgttgtcattttaaaagcctaacttttgttaaatgctgggaagtattattagtcatttttgtctctgtaggctttctatttaagagaagcattgctataactataacattactatgatattttcatgaaataatcttggtaatatgaaatgtcaatttgataagcacaattcagtgtctagacattttagacaatataacagttttttttaaggttatgcaaataaatcatatgttaaagtgaatatgtttgcagtattgtagttttatttttgttaaagtaatagttaatagaacattttttttcaattatattcagattcagtctgctatacataaaataggtaagcagcaaggatttactgtgtaacacaggaaactattttcattaccttgtaataacctataatgaaaaataaactgaaaaaaataactaaatcactttgctgtacttctgaaactagcacagaagtgtaaaccaactatatacttcaataaaaacaccatgatatacttgttttaaataatataatactaatagtgtcagttgagaagtaattggaacaaaaaagaaatttcttcacaggtacttgtgtatttgaccgtgtttcaagatagtttccattcggttgatcgtattctgtcagaagaaagttatttaaaaaaaactaatttaaagatctttg

SEQ ID NO: 37409 - DNA, 1675 bp, Bovine  19866880996693
gaggaaaattggcctattttaaaaattcttttttttttacatttgtttccatttaatcaacttctgaattttgaatttacaagtaaaatataaaatgatgctagtagtggctttgagtttggttccttttttgtttttattgaagtatagttgatttataatgtgccaatttctgctgtacagcaaagtgactcagttatacaaatatatacattctgttttaaaatattgttttctattatggtttatttcaggagattggatatagtttattttaaaatttcttaagtgtagttctctcccactataaagatacatactgaaaataggtatattgaggtttaaaaaagaattttaatcttggaaccaactaaaattgcatcctatatttaatttttattttaatataatactttaagacattattagaagacattttcagcttttttgaggttagaccctttaaacttttacagacaacagttcagagaatacctctatttatactctttgtatagatttgtgtgatttacaggtatgctaaggtagggttatgtaccccaaatgctaatgtgttttaaattatgtagtaatttgtaacaggcttattttctccaaggaaaatgtatatagcaacctacattggggtgggactagtgaacttggcaactcttaattcttatgtatggcatggcagggaaagaatgaaaaatacctcagcttttaattatgactctttgggaccttttccaaagtactcatcataattagtcatgtcttagttgtgaaattttgtgtctaatttcttcaattatgtccacacagaaaactcattaatgttatcaagagctgtgcaagtaaattatatgtgaaaatatataccccttcatattgtatgctgattttttttcttttaaattttgttagcaccccctttcacatctttggatttttcattttccctttttgatctatgcctacactgacttctattaaaatctcagtaaaataggacatttgtatcaatgtccttttacttttatgaggctgtgattatatagtttttacttttggttatttcacaaatttgtatctgaggtaatttaaaaacaaatataattttattatatttagtaggaggggcattaaattatttggtcatcctaaattgtttcaaaggaagcttctatttaagtatattgctgctgcatcttaaaagcaagtaactttgactattgataaaaagtttgtttgaatgttatcacatagcatagttggtgtcctctctgcttgattgggggtgaatgtagcagtttcagtagctgaggtgaaaagatcataatttaagatatataaggagagaaggaaatacatatcttaagtggctgggacagccttagggccactggacagtactgttggtaaaagtaaggctggttgaattcctcttgacaagatgaaaattttacagcttatttggaagaacttctgatctgaatagtgatcttcaaactttttggatagagcatatcaccagtgaagtatttatgagcatgtgccctaatacatgtccatatttatttaaacttatacacatgtactattgtgctagtatatgctgtaaaacatttacaatagatattaaaagaaagatgtattgatagaataaataata

SEQ ID NO: 37410 - DNA, 889 bp, Bovine  19866881038338
acaatgtacttactcttcttcttgaagaataaattcctattttctggagaaaactgcccactcacaggatgcctgaaggctgtggtctgctggttatggctaaaaagaaaaagagagagataatgaatgagaagtcatgtgagtggaaaggctcacagacacaacaggtcagtgatgtctgaagacccctgctcatcgcagactcctcccagggtgagcccgccggccttgccttggagagacactctgtcagaatccagctgcatttaaaaaccaaaaacctccagctcaggtgccaaagcccactaaagacatacaggggtttcaactgtaggcaagtcttgcccccaagacaacactggatcttagagagacagtccatgaagtgcttactcctacagactgactccactcctacaaagtgactcgctcagcaaaaagttactttaagacggcacgagctgagaacaagaatgaaggaaagcagacggcactttcaacagcttccgaaacccacgaagcagggcaagaattctaagaattaacacccacccagaaaaatctatcttcttaaaattcttctccctactacagaatgtcttcacttcagtgatgggatataaatgtatgggcatgtctctgcaacatgacctgtacaatttcaacactgtgcagtttctatcacccttttgatgtgaggagggatcagcttccacgccgagttgacagacacaaccagagtgtgtaggtgttttgtgtattcataaaggctgcctgcttctttgaaagaagagggagttggctttagaggctgctgttctgctccatgaataggctagggtaacctctttttttctttaaagaatatgatttatgttaaaatgttttt

SEQ ID NO: 37411 - DNA, 1423 bp, Bovine  19866881068042
gtgaggatgataatcctttttttttctttctaataacaacaaatgaaaagtgctactccaaatatactttaaatacaaaatattttgtttgtgccaattaaggtcagctgtgaagagcatctgattgttgttgttgctgctgttttgtggacacagtggaaggaataataagcccctgcacccgtcctccctgtttgctggctctttgatgacaaacggcagatatgtggcgagcacatacctcatttacatcacatgcataatgtactctatctgggatattagcttctcagggttggcagtgtcgcctaacacacacggtgatcagcacatttcttgaggctgcaataatcagaggaatacagcagtgatgtgggaactagaggaaataacatggcataatgatgtacccatcactgttctgttgtcatccttcctaaccagtttgctctcctttagagcctaacaaaagggtcatgaatttaatagagtaagacatggaactgggtgcgagaataatatgtctatttctgagctccactttcagaggaaaggggaaaatattgactacacaggggacaaactgccctgaaagcttttgtggtctacgcatgtgcctatgtaatcttcaaacaagacgtgcagtttttcacaaatgtgtcaggcctcatttaatctcaactaagcatatgaaaaccaaaagtcagatataggaaattaactaaattttcaaaaatctgcaaaacatacgtttctaataaaatatcatctgttatattaatagcatgctgtttacaacatttattcttagcatgttaacctcttcatggttttcacacatttaataaaagataacaatctcatagcagttttcacccatttgttcaagactttagcaagagttcattcctgcaagtattttacaaagcagtttgcatgttcctgttctatagccacttgcagtattcccaaataactcttacacatgggttcaataaataattggaagcccagatgtttgaaacggatatagcagatacactgtattttcagtacagctactttccttttgtcctctcatcaactacatagcactgcaccctgccatttttcagttctcttctaattaaacctagatgagcatttggcatgtatgtgttctcactcatgcccctctcaaatgcatcatgtggaggcatcctgtgctactgctgctgacttgagacattccaaggaggaattctacttcttcagactgaactgcagcattctttgtctcttcagttcacctcctgataagaaacatgatatgagacatgatttgccacttcacatagcaaatgactagaaatctgtgtacaatcccttcttagtccgagcctcactcatttctggggtctttttctagcaccattaagctaaa

SEQ ID NO: 37412 - DNA, 767 bp, Bovine  19866881219889
ctgctcttgcttgttctctttccctctctctctacttccctcttagtttctccccttccgccttctctatttctttttctaccaatcccccctcacattcctaattttctctgtctctctttccactgttgtgcttgtttcagggttttctcattagaaaaaacttagtcatcaccatacagcagtgatccgctttcagaggacagatattaagagagtgacctgtttaagatttttatattttaaaagtcctagataggggaatgttgtaaaagaggtgaggcacatccatttattaaagtgctatctgcaaggtgcctcccatatccagatgtggaatctttagggacttcccaatgcccagtcttatttctagcaccactgattgtaattatgtatatttcacatgggcaaaattaactagcagattgtgatactaacttttaggagctgatgttttaaaaaaaaaaatttcaaacttgatttttaattttttattctatatcaagaaagggatttgtcctaattgtcttattattttacctaaattctcatctgttttgaatttctctattggctttgtacctcgggacaggtagttatactttgtaaagtttaaaataaatagtctatttctagttaatttttttcccaacttcttctgattatgaccaaaaaaggatagagggctgattttgaaactgttatggtgaaagatggtatttgaaaacttttgatgagggaaattgctgctgtatttacatttt

SEQ ID NO: 37413 - DNA, 1058 bp, Bovine  19866881270211
gggactgacctcttcagtgacgatcgagacagcacctgagcagcctggttcatggcccggacccaagcattcatgtcctcctgggtgtcggcgctgaagtagtaggtcctcatgccggactgctcggcctgagagctattatagatgagagcccgcatcccggtgtgcacagcctggagacagaagatggagacccaggtcagagaggttagtgtgcgtttcatttccaggagcaaaaaccaagagatgccccaggccagttctccccactttcagactgaaagcccacgcaccacccagctgatttccacagatggaaaaaaaaggctgggttcccgttccttgacacagacaggcccagcaacagctgtgtctgctccccgcagcgaaagccctgcagctgtacctgtttcctgcttatcttactcccacttatggaagggtacacagtcaattcaaggcttatgtgagaaagatttttaaaatttaaaaaaaaaaaacagcaacaacaacaacaaaacacctcattccaaagaagcagactcttgggaatccctgtctcagttcttctgaagcacctgatgactggaattgattcaaaacatctgctcaatagcagatagcttggtgcagatatttactgcacttccctgcttggcatgaaatgtgatatgtgcccatcaaggaagctgctcttctggctctccaaagaggtacgacaaagtctgaccaagcagtctaacacctgactgaggaccctggcatacctactatgtgtcaggaagcctccaggtgctctcatatgttctataggtaccaggaacgacccctgaaatgcaactgggatggaccatgaagaggtaacactagttttcccctttgggctctgataagcagggtcttttaaatttgcaaggaaaaagctcaccaaatccacagaccaagatgatgcggaaagagaaagatttacggagcgccttctatatatcttctgggtacctccgtgcctttatctcattttaatcccaatagccttgaaatgtaggaacattcagaat

SEQ ID NO: 37414 - DNA, 1385 bp, Bovine  19866881325003
aaaacttttatcctgtccccctgcttagaaaccatatggagcttccatttattcagctgataaagtccaatgttctagatctccctcttctcctttcaggcttgtatctatccttctatcctacactcaccaagtactgcagggctttgtgaagttcaaggatacagcgatacatatgacagaaagaggcgtaatccttgaagaactctcaggttgttggagaaggcagacagcagtcgagtagagacaagtttggtgagctgtgggataacagaggaggaacacctgtgtaaaagtgagctgaatctgtgaatggtcccccagtgtttgtaaggtcagaacacaccaaatactgggaagaagcctagcgagttttcatattaggaggaataatgataatgaagcttttgcattatacagacctaaactaagcttgattaaaagtattaatgcttctgagcctcaacttcctcatccataaattgagtaaggcataatagcagcaccagtctcacaggattgttgttaaagtttaaatgagataatgtgtgtttgttggaacgtagtaactgttcaataaatattggctgttgtgattattattcagcgtcagaaaatgcaaggaaaaacatctccaacaatttgcttcagcatgaatccagcaagtcttataaacctatcttgttgtaacacacttcagcacaagtgaaaggagtaactctaacaattcagttcatcagtaaaagaaatctgtgtaaagagtgacaccttgttttctcaagtatgggttttgcacactgggtttttttttgtttttttttaagagaggtattttaatacttgtatggtgatttgatagagtcatacccaaagataggcaacagaatcgcctgggaaaggtttctaaaataccgattctgggattctgcctttctcccctaccctagactgttccagtatatctggacagggcctggacatctgcgttttaaataagtgcctccaggcgcttctgatctggggctcagttagggaacccaagacagaaccaggactctgaggccagccctgggcttagcttctcttggtgctacctctgtctacctgggtgacttcctgtccctccggctctgggagtcccagggttgtccggcatgggcacctgatgagatgatgagtggcagtacttttctgtgggctcagaaaaagtaagggattgtcattcctatttattcattataacaatccccttttctctaatgattgaatcagagttactgctacaacatagcttttaagcctgcagttgattttgataggatttaatggaaagtaacaagaacctgtgctctggcctgagaacacattctttgctattaaaaagc

SEQ ID NO: 37415 - DNA, 1064 bp, Bovine  19866881379609
tcctttctgtatattgaagaaactgagttccgagcagtcatcctttgtttagggtcctaaacttatttttagaaggaccaggaacagaataatggctcccatagcactgctctttctttctgttatactatttattctttttatattcttctttaaaaatagtgaaagagaaatttcaaagcgttcagagaaatagttatctaacaatacggtaagttttttcggaagctctgtttcagctgcatttaaagagatgatttttgtcttccctgttttgcagcagctctatgccgctcagctggccagcatgcaggtgtcacctggagcaaagatgccatcaactccacagccaccaaacgcagcaggggcagtctcacctactgggataaaaaatgaaaagagagggaccagccctgtaactcaagttaaggtatttgctttgcaggattatggaaacagtttggaaaatagcttcacaaggaaggtagtgaaccaggctgtgctgggcataaacagcaggaagcaaagcaacataaaggaaccccaaaatgttcctctttatggtaaatttcatgattgagcactgagaaacaggtgtttcccttttgataacaatagtgccatattgtgagatctttacctgaatctgcaaacttacttctcaacagtttttcccctttggattctggcttttattttttaatgttcattggcatgtatggccatggttttatttccagtctttgtcatagtcgtgtgacacttctctctaactttaaacaggtggggagccaactgatagtgctagaggaggaggatctcaaaactttagattgacaagaaaaaaagagaacccgatgctgggcctttatatggtttgatggtaaaggtctctctccctcaaacaatagttataaatgtgggctttgaggaatgaatggtgtcataatctaattatgcttcaatgccatgtatagttgtgataggataaataggatcgcccaagttatgactgaaacattaatagatcctttcctcactgattttcagtgtcttaaaatgga

SEQ ID NO: 37416 - DNA, 1217 bp, Bovine  19866881416931
catgggcttagttgcccccaggcatgtggaatcttcccggccagggatagaacccacgtcccctgcattggcaggtggactctcaaccaccagggaagttccatatggcacttactaaattttaaaattgttttatgtatttgtctttttgttgtctaccaaaaaaaggacataagctccataaagatagagactaatcagttaatttgtttatatcgcttattagtatttccagtccttggcacaatacttctatcaataaatacttgctgaatgaatgaaaaccagatgcatctgattctaaacacaatattattttcattatatcatgctgccaccttaaaggatcttagaaattatctagttcaaatttctctttttactcatataaaaactgagatccagaaagataagttatttacccaagatcacaccataataagtgtcagaaccacaatgattccaggctttcttacttctgattcaggctttgtcttttagactacattgctttgtgctaatagccccatccaaaaatatgcctaagaagttttccacaacatgggcaaaaatacaggcaaaaatttttgcaaccatttacaacctcagattatacaagaaaggaatataaatacagatgtatgaatatgaacatatacatatttttatatataaaaatggtatacaaagcactgtcaaaatttttgacatatttgcttttgtttttaaagaaaaatttgaaaatatagacaaatgattctctattttacactatataattcacttcacaatataaaaaaaaagttttatttcatatggctaatacatttataataaactttcttagggaatcatactttgtccctaaaatttactctaagttttcccaacaacaagtaagtctctaaaattcacacaatataaaatataaagatcatgtaatcttgaaactaaaaaagaaactaagcaaaaacagttaataataaccacggatcaaaaaacaaatacttgaacccaggaatcctatatcatattcctcttagaatctaatttctggcctgtaaagcatttagccatatgtctgtctattcagttcatgaatcaatgcaatctacattatcataactgcatactatccttcagttccttccacttctttagaacccaaatcaaatagctattacaccatctcaagctggactgtcacctggtgactg

SEQ ID NO: 37417 - DNA, 2005 bp, Bovine  19866881621008
gagcatccaacattttttaaagctcagagaatttgggtactgaaatcatctctactgctgaaagggtcagaaaatgaaaagagtgcaagaagggtatagcttttgtaggcccattttatattttctcctttgatcatagctagtaaggaaaagtacacatttttcacagaaatgattcaatatcattaaaatggttttgtcaggaatagaataaggcagaagaacacaagtattaaatgggaaggaggaactccatatcctttttgttcagtaggcatcatctggtgttccctttcaagttagtatgcaactattcgttatacatgctttaataatattcttaaatatccctctagggctgtggaagagatgagatttaaagtgaaatctattccaagactttaaaaaaatgtttcttcatataatagtaaggagagacctgtatttttatgcttaaagtgaagcgttacattcctattaacatttgtttaactaggcttctatcacaacaggtgcacaattatttttatgagtaaaatattatcagccttcaaaattagccagggcaaaatgcaagttgtctgattaaagtaatcagagctgaaccttaaaaatacatttgatttccacaggaattttaaaatgcaaagtcccagcctcttattctgatatgttgaaggagttgcaattgtttgtggtatgtaagtagcagcttgtattgcaaataagttgatatatttcacataattcaattgaccttatgagacagtctactaaaaacataatagaagtttattaccctagtctagcattttaatctgtcagtgaagtagtattgtttcacgtgcatagagcagaaaaagtgactcttttgttttgtagactattctgaattcagttaaagggcacatcagtttagaaagttaaaatccagtgtattttttaaatttaatttatggagggtaaaaaaataagaatataaatttcagttcatagaatgtataaatcgtgtgtacaccaaagttactgaatatcttggtgaaaaataaagacccctaaatggttaaaatcaaacaatcaaaataaataaaagcaaacaataacatacacacatactcttctgagcacaacaggaggcttctctaggaggcactttctaaaccatggttagaagtactacaacagtgcagctgttagaaaccaattatagccaggtaactgtttgttttcacatctaaatctgtttgtcaatcaggggaatgccgtgaatcaggaaagggtatcttgtacaaaccacagtaaggcagactatctggaatgggtccaagccacaggaattagggcaggagtatagatggaatcaaaaccatacatatgcacatggctgctgtctttgaccaacttttcaaatagactcagaagtagagactattggagaaaaacattagttttctattgagagtagtctgattttaagatttcttagaaacgtgttgttatttatagaaaagtgattgtagaagacatcttttatggatcttcaaatgtaagacatttctaaaactggctcataattatcatttcaaaatgaagtttaagcttatctttgaaattaaaaaataaccattatatatatatacatatatatatgtatcatgagagatatatatatctaatatatatatatcatcagatatatatatatatcatcagatatatatatatatcatcatatatatatatatatatatatatatctgaccatagttataaacaggtaagcttttactactttgaaattcatttatggcagtttctagcttatctagctacttatgaagaaactttagttttatctggacccaagaatacactgttactcaagttagtgaaaccacctctactgtttaaatatgcagctgttgtgctatggttgcaaaatttcaggagacagtgaattatacaaagaatgacttacataagtctatatagcctagatgttttt

SEQ ID NO: 37418 - DNA, 1356 bp, Bovine  19866881637491
cttttcttagatctaagattcttctcatagttggcccaatcagacatcctaacaagcaaataaacttaagcttctacccatgatactatcagacggtaaaatacagagcaagtaattttgtggcaataaaactagcacgagtatgccaccttggaaaccattatgttttcactaggttgtattagtcaaatggcagatggtaaaaaaggtaaggtttatcctgcttatgcatcacatcagaaaagaatgcttaggcttccaccaagtcaatatttcctacatccacttatacaactgtatacaacatccttgaataaaagccctattggtgctgtttatagagaagggtgcatttgcagcattttaaattccattttcaaggaggaaagtatctaagtatgagagtaataaatacacagacctggatctgttgttgcaggagattaattttgtgctgctgttgcagaagttgctgctgttgtcttgcaatctatcagaaataaaatttcattaagttaaaatgaaatgcttacacctttgccattacctgaggtacatctcctggtattacaagaaagttttactgtacttctaatacgaaagaattcccataaaatgagagaggcagaatcagaaagttggagagaagggaaatatttcaaacaggtgccatctctctgcttacccctaaatcttgacctgtacatgaaaactacccaccttgtattacatttgtgagcagttcatctatatctgcactggtcatctggaaagaatgggagtttcaaaatctgatccttggagaataaagacaggaaaactctggctacatgtttctgaggagcttaatttggatttaaaaattaaaatccataagcaaggacatgaaagaactttctattacttataatatggcctactttggtgagaccttttctactgtaaagatttttagaactgataatgcttacaaatattgtcaagggaatgtcaaaagaaaaaaaaaaacagcaaaaagcaaaaacttttctttttttttgctgatgtaatgtgtaacatacaaagcattttttttaaacaaacaaaatttcatatttattcacatctttttttactgtaatgtgttagttttatagtacacaatgcacatatagttttgtattcccttgcttcatccaacaaattcaacaacttaacatgtcatctggtctataaaaaaaaacattaactacttaatgcaagccccattgaagactgaatcttcccctcaggagagcaaagaacttctttaggataatagtgtttactataaaacatgagttaggtgtcaggctgcttattacctcaaaatctgag

SEQ ID NO: 37419 - DNA, 1276 bp, Bovine  19866881667647
aaaaatagtgtatttgaatttatatctaatatgataacagtggttattttaatgatccagaggttggttacttaactacttgtttttctagttattttaaatattttataatatctttcttattgtgtccctttggcttgttcagtaataacagaagctgaaaattaatagatcttgaactagtgtgatgactgaattattttattgaggtgggagggaagagaacaataacaaatgttttagaagatttttttctgatgaggggtgggatggactcactgacaagtaaaaggctaacaaaaatgctgattatctcaccttttcaacaccaaatttcttcatctttaaaatgaaggtgttgaaaaagatttcctgtttggtttcttctagctctaaaattctgtgcttctacaactaatagactgtattattatgtagttcatatttttaaacaaaaacttgcatacaggtttaatgctttgactgttagcatacaagttggtgttttatgtatatattattacaggaagacaatttaaagataatttgaaatttgcaaactctataaaagcaagcaattaaagtggtaaagtgttttttctaagtttaacttctcagtttttaaaaccataaccctcttcagaagaaattaaatttgactgcatttaaaatcatgtgattttaacagaaataaatatttatgcaaattatttgtactactgcacgattattggtattcatgtctttgaaaaagtgtgagttgttcagttgtgcctgactctttgtgaccccatggactgtagccccccaggctcctctgtccatgggattttccaggcaagaatactggagtggggtgccattgccttctctggggatcttctcaacccagggattgaacctgggtctctggcattgcaagcagactcttcactgtctgagccaccagggactccccaagtccatatgtctttatttttcatcagtttttttttttcctatcacaatagaacactgaagaatatttgtaatttcattagctgtgcagatgaattcttaattaataactttgtttcaactatgataaatatattatttatcttatatattggaaggtgaagctgtatagtagttatacacttatgacaggtggttaaaaatgtaagttagactgttatggtctaatgtttaatacaatttctaatgtaacctgaacactaaaaagcacccaggtaaggtgtaaatataactttaaatatttggactaccacttttc

SEQ ID NO: 37420 - DNA, 797 bp, Bovine  19866881776405
atctttactccaaggaaaacttgtctctggcacagattttattcttagcaatattcccctctgttcttatgtgtttgctactattaatattttttttaccaaatactatgtaagcagtctcatttgcctccaaattgtttcttcttccctaggagccttctgaaagttacttcgttggataaagctttctggcaggcagctccttctcaaaaacgcccctttctcaaagttaactactatgtttccttgctgtcagtgcatgaacagcaaatgaaactccaaatcatttcagctccaatatattttaatatacaaatctcactagaaggttaatgttttcgtgttttattataatttcaaccacattattttacgttaacagaaaaggtaagttattcattgattttcctagatggatacactgcactttgacaggtcaactgtacactctacagtaatttccttggcagctgaacctgcaggaaaaaatatccaataaacagatttcccaaacagtgagcttttgcccaggatcttcaatcctgaaacttttcagtacattccaggaagaagagtctgggagaagatgagcttcactacaaagtggagaaacaggaggctgatagagtgttaaagaccataaattcccattccatcttcctttccagagctcagctctttactcttgtattcccacccagcaaccactgacttcagagcctgtagataaactagatacaacaatggaaaagtgaaaaatacttcttcggtgctttacaaaatttagtcatagaaca

SEQ ID NO: 37421 - DNA, 1971 bp, Bovine  19866881865276
catcgatagctttattgtttaaattgcgtatgactttatttaacgtcagcgtttcttctagctcctgacaagaagtcacattttataactaattaaattgatccctgggaagcaaaagccactaaacggaattattcctacccaagtgtcaatatattaaatcaaagggctaatgagttgggtcactgcttcttttattgggaggctacagcagaataggactcatattatcctctattttctgccttaacaatcaattttatttaaaccaaaggcagctaattaatagttttggatcttacagtaaataatatcttctttatgacacataaatgggaaatggaaaattttctttgatgacacatgcaatatattttttgcctatttttatgacatcggggtcacaaaaacatctaaagacgatctaaaaggtgttttgcaagcaaatgattttgagaatttctaggtttcaactattagcattatgggtttaaatcaagatgaaaatctgcctcttggagccgacaatagtgcctaacgaaagtgattaaggaatgactaaatttgtcctgtcagcctttcctatctctcctgcagctgctgagtaatactttgaatgatttcactatttacatctggacactacttttaaaattcatcacctaataaatcaagccactcactgtttttgacataacttagcttcttttggtaaaatctctgcagacagtggaaaacatcctgttttattattgccctcaattaatcgcatcaatacagtttattcagagatgcattttcatgcctaattatttatatctgtgaattttacattttattctggggacttccccccataatttatcatttcagtatttgtagagaaaatatattcataaaattggttttggaaaatcttagatcttcactaatctataaatcatgttataactatgtaaaaatctagcaagttgaaaaattcagttctataaaattagtcctagtgatgattacaacagtaaggagaccacctccaggaaacacagtggaaagaaagaaggaaaaatgaaggtgcaaagagtatatatacaagcaattgcaactgcaggacaacaaattcaacagtgtcttcagttttagggtgaggatttcattttgtacatctggcaattacccaaaataacactagtttaaaggtagtcctgagatcttttgggttgaattaacctatttatcacataataggttgtcaaaagtcagttttgtctgtaatacttaactttgttgatttaccaccaggatcaaatacatcatagggaacaccacagatgtttttgacaaaaacatgttctttcacccacacatagtttgctttttcaaacactgaattagggtttctttctttgtagacacagtggttcttttttgaagcaaccttaaatagtcacttttatccatttatagatgtgtgtgctttggaggtcaagcatgtgctgttgtttcttaccacaaatgttttccttcattttcaatggtcagaagtcacaggcgagtttgaccccacccacagacagctctgttcagtatctggagaacccaaggttggctggagatcactgaaatacacatgcttacttcacaaacaaataaaaaggtaccctaacacagactaatggaatttgacactgaaataaacaaacaaaaatactaactatatggaatgtgtatgtatttaaatgtaaagaacacccattttcattaatgcagactactactgcaaacagacatactaagatattcttgataaacacttgattttattgtgtaatagcaactgaattaacaatattacttttccttctacctcatagcttcaggttttaatttaaacacatttaaatttagaaacaaagctatcaggtttttatattagttactttttcaaggcaaagaaagtcaccgtctcaggaa

SEQ ID NO: 37422 - DNA, 1150 bp, Bovine  19866880444542
aactcaagggaccaatgaattatttaaatgcaacgttttatgcttgtgaggcctgcagcttccatattattctcaaagaaatctgaaagctaaaacacgttaaaatcttcagtttttgtagttactcttcctagaggaaaattaagatatttagccatgtttggtccccaaattcttagtttatgatgatgattttcagattaaatgataaaaagggatgtgagagtacttgccaatagtctaaacaatgttaccttcattacttcagcattcatgaatacctaagctttaatttctgaaaaaccttgttaaaaaataaaaatgcaaatagtttatttcatactaataagccgttcgaaaacagaaagcagagttatattttatctaatcccaaaataatcttatcacagttttcttaccagtcaatgactctttcgcatcatcttcttttaactcatctttggaatcatctgtttctgtgctatcataatcgaatgactgattaactggttcagaggagtgaactggctggtcatccatcactttaagtagcaagaggagaaatatgtttgaatcagcaaaaataagatccataaatattaacgtattcttggaaaattgaaatataaactcaaagaaatttcccattcaccaataagcactgattggcagtgaactctggggtcatgtgatatctgttaagtattaatactagagactataaaaggaaatattttaaaatctcaaaactatatttttagcagaagagaaaaatttaatctaagaacttcgaggatgaaagacaagtccaaccacaagttacaattcataaaggtttctgaatattattcaaagttaagttttagtcgactacctcaaattctaagtacacatattacaggaatacagaaaaactaaaatagaggtggaacttttataaaaacccttaaaaaaacaacataaacatttaagagataaatgttaagaaaatattttcaaagtagcttataggcttgattttcttttaagaatttaacagattccagttaaaaattttaatttcagaaatatggtttaaaagtaatttgtaattttattttaacatttttcagtgtactttatctctgaaattcttttaacatgtgtctag

SEQ ID NO: 37423 - DNA, 1933 bp, Bovine  19866880541313
ggaatgatgtgattgatgactattgcaatggagtggcccttttgaggaggaaacatttaagaagcggtttgcgtaacaggcatgcaaatatcagagaagaatttggggcgaaggaaactgctaattctaaggccctaaattgggtttgagggggaaggtatgagaaagtaaaaggaaagtaagcttggaaacactcttggagacgtaaacaagcacaggttacatcctgtagggttttgtaagccaatataggaattagtttattctgaatgcagtggaaagccctggagagttttaaatagggaagagacacctatgttttaataattttaagctctttgctgcagagcacggatcttaagaaggccacaaaggaagaagggagattaaaggattataatctatgtaagaaggagccccgaaatttttaatttccgatgacattgacattcctgttctaaaatctgttaggtcagagtcctggttctgtttgccatattttgttaaaaaaaaaaaaaaatctagatattcttcagttactgctgtttaattacaattggagaaataaatgggaaattttattacacgggaaaacaaatggcccccaaaaaatcattacctttgatttttttcccctccatttacaactcacagataaccacctcttctgtccaaaggtcagttctaagaatagccaacataaaatgatgttcaatgcagatatttattcctgagtataagatttgaaaagatagaggtctaaggctagaaaatggagatgtttcactaacaagaaacagagatcaggagaactgggttccaactagaagaactcattaactggtgactcagccaaatcaagcaaggtaccttatcatccgtaagtctcagcttcctcatgcataaaacaagacaatgaagtagcctgcacgcaaagtggttaagccttaattatattttggcatgcacacacccacaggagggaagctggaaagggaaatgaaatgaatttctataaaaacctaacagagtcagcagcacaagtcaaatgaaattggaagctcgtacgcgcgcgcgcacacacacacacacgtatgcacacacacacagcagctgagaaactatcaaactgattaatacagataccaggaatgcttccctaagaaaccttggccttctcagagtgtgaaaatggaaacattccacctgctcaacctcatattccctttctctgtagctattttgaacctatgtagtgtgtaataatgattcacatatccctaatcaaaatttaagaactagaaatgtttaaaagatatggagcaatattttaaagttaagccaacacctcgattttaatgaaaataagatttcaacactatagggttatttttttgaaaggaaaaacactgaatgagaaaaagtattattttaacatattaagagcattcatttaaaatgctgaaagaatcaagtactctttgaatgctgtttgcagtccttataatgattaactgaaacagctgctccatactgctaattttaatgcacaatgggctcaactctcccattctaacctaaactaatacagcaataaaccctcccaactcaagctagcaagacagtcactgttgtctcttgcggtctacaattatttctaggccaacaaatataaaatgagaagaaatcaggattgaaatccatttctacaggtgtccctagttctagataattttttattttcttttttaacagcttgattgatatataatccactgatcatacagtgttcaaatgtacaattcagtggtttgggtatactcccagagttgcccaatcattagcaaaatctaactttggaacaatttttttcccccaaaagaaaccccttatctgttagcagtcaatcctccaccctgtccccagccctaca

SEQ ID NO: 37424 - DNA, 1834 bp, Bovine  19866880578314
tgatgcatttatgctaatctgatgaacctttcaactatttatgtttataacctccaagctattgagttaaaccatatgacattaccatttttttttgttttgtttaaaggatggttgactattagaaactctatagcactcagtcttatttcacagataagaaagtagagttgcaaataatgactcatttggtaaaaataacagagctgctaacatctcaaaactgtttttttttttttttcaggggtttgtagataaaggacaattttacgaggttcatgaatattgtctattaaaatgccattgcccttgggatttctaatttttggagctttatcactaatcatatctgtatgtgagttgtttattccacttctttcccagagagtaaaatttagtgggtaagaggatgatgaaaggaaatgaacaccattgtccaagaggaaaagaaggggtgttgctgaggaagaagtaaaggcacgcatgggggtaatgttgggggagagagggagagaaagggggagagacatatgcagaactacagggaaaacagccagcagtttcatgagagctgagtggaattttcctgaaatatgttgtctctgtagatgtcccacttgttttatgtggattaatagtcatcagaatcaatatgctctaagtgatgtaagtgaattttaacattctttcgtttaacagattcctagtgtgaaccatatttaatgatcagcctaaaattggaaatagatatttattgcggggctctaagttatgagttcattttgtaattgagttgggacaaagatatgatttcagtttgttcattatatgcactatggcttaaataatgcttctgaaaatgcatgcatgtagatgaaactgcatctgtgcatctaaggaaaaaaaatcctgtcctttttgttccagagtattgagaaaatgggtttgcagattgattttggcagttaataaaagtaaagagttacaatattgtatggtactctaaaaattagagagcgtagagctgcttaattacaagtggccagtttttcagctttgtatttctatgcttgttatgaaatcagtaggaattatttttctgatttttctagttctaaatatgccaagaaaacaatagccctaccctatagtgctgacattaataaatcataattgtgttctcaatggtaaaagtatacagtatcctcaagtgttcccatgaaatgagtatgaatattgtccccatttctcaggtggggaagttgaagttcagtgaaactgacctgctgtgaaatggcagggatgagattagagtctgaatctaacgctgattcccatgtgttcccttttcacagatggagagagggaagagggaagaactttccacacttggacttttttgagcaccagtgaatttcatgctcttgtaacagggaagctcttgccaaagttcagagagagccctcagattctgactaccagagctctctaaccttgaaattgttgctgaagaatgactgttgtaccctgccttcatggcagattggaacttatattggcatgctgtccttctgcttaagtgggtcatggctctgtgcctttccttatctagggaaatatcacattatcaaccaggggcaccgagggatgtatatgagaactagtggtacagatgtatatagatggcatttcccagtggtctgctgtgagaacctatcccagtgtactgtggactttcaagctgcagtaacagagaaatgctgttccttctgtccacaaaggaggaaagcgtgtagggaaagaagttcaatttctctttctctgtagccataaa

SEQ ID NO: 37425 - DNA, 817 bp, Bovine  19866880636971
atttgacttatgaagtagtgctccagggtagcaggttttcaatagataactttaaacctgacctcagttatatttctgcttccttacataatcttgttgcagtcagtgaaccaattatatgtgaggtcagttgaggtttactggacacactgaactcttatctaagcaattaggcccataaagatttactgcaagaattacaatattgtgcttttaaaatggtgagtttgggcctcattaacaggataagattttttagtgtctatgtggggaaacctttgtctttagtttgcaagtaattttaagcggtttgagagactcaccagtgttacagaatagcatggggaacctatgtcacctttgtgtcaggatagatagtgcactaaattgcagctacttgtcagttttaatgacttagtgacagaggttacacgaaagcctccagggaagtgttacctaagattccctgacttagtaatcagtgcttgagaaacagtctgagaacctaagcctccaatccttatgatttgccttatttttactattgtcctaattgcttctcgttatatgagaatttactttgggaaaaggatttcgtttgagatttctttagatacatttttaagaatagcactctcaaaaggatgagccccctcaacttttaaagctcttaaacatgccctgaagtctcctctagagtctctgagtgctcaagaattgatgcttttgaactgtggtgttggagaagactcttgagagtcccttggactgcaaggagatccaaccagtccattcgaaggagatcagcccgggattt

SEQ ID NO: 37426 - DNA, 1272 bp, Bovine  19866880702878
atgccgcaactgagacctggtgtagccaaataaatacttttttttaaagtcaattaaaagtttatataaaattatatatatatgtatacataataattacataaaagtattgtataaataatgataatgctcaacactcatttgtttctttctgaggcagagattcagagtcatgtattttctaataatcaagaaggaaatggcaacacactacagtattcttgcctaaagcaatcctatggacagaggagcctgactgtctacagtccaaagggtagccaagagttgggcgcgattgaatgactgagcacgcgcctgttttctaattaatcatttaggctaatgctctaactctgctgtcgaagctactgattctccacccttaagtcagagaaactggctcctaggagttaagtacgataagcagttgattgcgaaatgcttacagctctacagaaggcatccctgttttgtgcccagtctgtcaacacccacggggccatgctgcggcttttgaggccgagtctccagcactcgtccagagttatcgagaggctagccatatttggctcttatctctattgggtgtttcatcactatgactctgcatgagaatgtgtgtacacgatacaacattagtctaggcttgaggcgcttgagaatgttctgttcactgaccgcaagttttaacgaagcatataatctgaacttgggttctgttcaattatttgactccttaaaattgtttacatttgtggaaaaccatcagcaaatacaagtcaatcgttttttcttttttttttcccccttggctataggcctaaactactgatctcagttcacattggtggccacaatatcatagtctagttttttttttcttcttctgatttggtcatgacatgctttttaaaatattctttctttaatatagtctattcaatatatactactaaatttaacttttttcattatattatttcctttccttaaatatgtacacatttgtattacttttttttttttttaagaaaccaaactgttctttatttcaaaagctctcccatgtattgagggcttccctagtggctcagaggtaaagaatctgtctgcaatgcaagagatacgggagacaggagtttgatctctgagtcaggaagatcccctggaggagggcatggcaacccactctagtattcttgccaagaaaatcccaagaacagaggagcctggtgggctacagtccgtggggtcacaaagagtcagacacaa

SEQ ID NO: 37427 - DNA, 2705 bp, Bovine  19866880745035
taagattagaagactttatgctgattattcggagaaggcaatggcaccccactccagtactcttgcctggaaaatcctatggatggaggagcctggtgggctgcagtccatgaagtcgctaagagtcagacacgactgagcgacttcactttcacttttcactttcatgcattggagaaggcaatggcaacccactccagtgttcttgcctggagaatcccaggggcgggggagcctggtgggctgacgtccatggggttgcatagagtcagacatgactgaagtgacttagtagtagcatgctgattattagcaaataatgttgctcctgtcttaagcctacttcagtggttcctgagaataactgaactctgccactgaattactttttcttttcagacatccttgctcaaaggtcctttccttctcagtaattcttacttatggattttgctaagctgcaataaaagtggaaagtgaagtgttagttgctcagtcatgtctgacttgtcaagaccccaagactgtatcccgccaggctcccctgtccatgggattctccaggcaagaatcctggagtgggttgccagctcctccaggggatcttccaacccagggatcgaacctgggtctgctgcatttcaggcagattctttattgtttgagcccagcttcaacttggatttggactctaatgacccagagcccaggagctgagcccaagacaaagaaaacacacagcagaggccaagagagaggctgtgggaagagtccagatccctgagccaggccagtggcttccaaagtttttaaagcaaacacagactagagagccttacaacggaggtataactgcaggaagacaacataaagaactttctggaactggggagtagggaggctcagcatatgctgctgaattcctaacatatgacagcacatgcaatgccatcctgggctatggaatatataattttcactaggaactcctaaaactgtcatttgctcatgcctcattttatatttgttaagtgacacactttcattacttattcctagtccttatgtttccttcagagaagagaacatcaaagtacagagagattaaatgagctggatatgatcacatagtataaagatacagaacatggacttccctggctgtccagcggttaagactatgccttccaatgcagggggtgcaggttcgatccctggttggggagctaaaatcccacatgcctcctggccgaaaaaccaaaacataaaacagaaccaacattgtaacaaattcaataaaaactttaaaaatggtcttctcagttcagttcagttgctcagtcatgtctgactctttgccaccccatggactatagcatgtcaggcttccctgtccatcaccaactcccaaagctcgctcaaattcatgtctattgagtcagtgatgccatccaaccatctcatcctctgtcgttcccttctcctcctgccttcaatcttttccagcatcagggtcttttccaatgagtcagctcttcgcatcaggtggccaaagtattggagtttcagcttcagcatcagtccttccaatgaatattcaggactgatttcctttaggatggactgcttggatctccttgcagtccaagggactctcaagagtcttcttcaacaccatagttcaaaagcatcagttcttcggcactaaggtttctttatggtccaactctcacatccatatatgactactggaaaaacccatagctttgactagatggacctttgttggcaaagtaatgtctctactttttaacatgcatagcttttcttccaaggagcaagtgtcttttaatttcatggctgcagtcaccatctgcagtgattttggagccccccaaaataaagtctctcactgtttccattgtttccccatctgtttgccatgaagtgatgggaccagatgcaatgatcttagttttctgaatgttgaattttaagccagctttatttatctgagatcccacagagtcaaagctgtacaagaacaatggcaaatctcgcttttgagttttaatagaaattaagccatctgtggatggcaagtgtgtgctgatgattcagttctgttctgtcctgagtttgatttttccctccctgcccatctaggtgtaaaggtctgcttgcatctgacacacaaatctctgaatctcctgggtaagtgaactgtatttaaatcctcaaggcactcctcctgtgaccttcaggaacacaggttaggacctgaatcagttggccatatttactcctaaaatttctagatgttgtatcctaaatactaggcttcacatggcactgtaaaagtggtgtttagtgcttacttgttttatgtaaaaaataaacccattttgtgcttttttattttctaagaaatggtgacacaaggaatgatgctcaaggtggtcttggaagaagcaacatcttaggcttgtttgttttatagggatgcttctgcaggatttcaagtcatgacgctggtataaagtgttgtaaatttccagaacattggatatagttgtataaaaaatggatgaataaaaactgactcaaaaataaatccaaatggggtgcttcaggttatgtggagtactatattttcttccctagcccggctctattgtgtaagtcctaccatctagaagagcctc

SEQ ID NO: 37428 - DNA, 2054 bp, Bovine  19866880765327
ctccaatgactcataaccatcaccgtcattttataccatccaaaactaagccatcatgtctcctcagcctgcaaatgcagagttaactttttcactcttgctatccacatactaactagaacagtctttgaaaaacactgctcataaccctccaatggcttctcatctcgctcatgataaaatacatactcctctgcatggcttacaggtgcctgcatgatttggcccctcactgagctttacttactcctttggtcataccagacccctttggagctcctcaaaaatgcagccctctggtctggactatgcttttccactcagatctctgtttctagatttctacttagatgtcacctagagaaatttgttgaatgagtaaagtgatataattctaaacattcattaggtcagttgtctgggaaataagatgacatttcaaaagtaaaaagagcgatgagacaaaagtagagacaaatggtttatttggtaacaaggagtaaaaaggaattcttgattcctcttctcgcttttggcagctgaagtgaaatgtgatagtcaaatagacagcaacacacacaggaattccctcacagtccctgattacagaaatgcaaaaatgcccgtcacacgactcgccattactcttttctagacagaagtgccaggagctgggctttccgggatatccttggtggctacattctccttcttgtcttcaggtttcatggcaggaaacaaaagcacctcctacaggagagagaatggattctgaagctaagaagcactttttcccgcccattgacccactcggccccccgccccgttactgttatcaccaaaacccggagatctgtgttgtttcatttcagtttagtccctgtcagttacaaacaatggaaaagaagaaatgcacaactaaaggatctcacgtgctgcaactgagaccagagccaaattaataaatattaaaaagaaaattgtacagcactgcctaggtcacgatatcaaaagacggaataaacagagaggttctctccaaatgatttcttcatctataaatatgggaatagcaatagtttctacatgtctcaggttgacttaagttaaatgaggtaatgcatgtagatggctcagtatgttccttggatcctgaagaaatgcaaacaattggtatttcttctgccttgggtagaaaccccccaatttgtacaatcagatgccctgtccgtcctcctgtgaagtcaccggtaacctctccaccttcccctcctcccagcccaacgcccttcccttgcgcctccaacactggcgcacacagcggtgctccttcggggctgccgcataccttgatgttattggagtctgtgagaaacatggtgacgcggtcgatgcccatgccccagccccctgtggggggcagtccgtactccagggcggtgcagaaggtttcatctatgaacatggcctcatcgtcgccagcggccttggcctagaggacagaaccacacagtgacactgttccaggctgcgcgctctggcgtctgagtgagcatgtgaaaactgccagaggcatttccatcccagcgctgctctgactcccagcacttgctggaaactggctttccaggaactccaggatggagccatttctttcgaagacctgaaggtcaggactgaggaaccctactccagaacatatgtgaacttctctgccaaatggaaatacctccactgcctggggctctgcgagtccagggaagttgattttcagagactggtaattcccaacagtgtctgtcccactgcctgaaccacccatcgtggcaacgctagtgtgggcagccctgtgggtgctttgtcttcccatccccaggccacctcaataaatgtaccatctaagaaaacgtaacatccttgtcgacacaagtgtcacactccccccacagatcatcacgcctgagctccatttatatagaaattctagggccaaaactgggtcaagttctccatcttgaaatctgacctcctcctgtgaggcctgtggctttcag

SEQ ID NO: 37429 - DNA, 1688 bp, Bovine  19866880780537
tgttcttgcctggagaatcccatgggcggaggagcctggtgggctgcagtccatggggttgctaagagtcggatacgactgagcaacttcactttcacttttcactttcatgcactggagaaggaaatggcaacccactccagtgttcttgcctggagaatcccagggatgggggagcctggtgggctgcaacccatctatggggttgcacagagttggacacgactgaagtgacttagagtagcagtagcatggcttagtttatgaaagatacctattcagtagatttaggactttaagaaaatttaaataactcagctaatgtttattgctaaaatttcaagctagaaaagggaaaggcactcagagaatggtgatgatagtacttccctggtgaaaggtggctagcaggcttctaagaaatctcatgggatggcattaatttggtaaatttgtcaaggtcctcagtctgctaggctcaaaatctgattttatccttacaacagagagcacacccgactcccaggagaatgttaaagacatatatttttatctatacataaattgatatataaagccagaactgcaatatattacattgcaatgaaaatggaaaatttcatatagactacatgatatatggtttctatatcagcattttaatcagaaggagacttgcatggaaagctaaatccttatcagaaagctgtttggtgaacctcctcctctgaacaggaggataaattacaggaattctctataagaaagaagatattaaagatgaatgggaccagataagtcaaaagtctcttagtttccttatctccttcctacacaaggcttagatgggaactgccagcactggcttattactgagattaaacaatctatcatttgaatgatgcaatcttttttctttttttttggatatgttgacggattcaatcaagtgctgttatgaatctccaagtcccagagttattcggtctctgagttgtctctgcgtttctgtagccagatccatcagtatgttgagtttatagttttactgtaaaaaaatcaccttatctccttaatataaagttctcgttccagtgtatcaactattaaaaacatctactgcaaagaaagtcacaataagtccctttaagagagtgatcacacattggatatttttataagacagttaacgacccttaaaaaacagagaacctgtctttgtgctctaaatgaagaacagggtacttttacagaaagatctaaacctctcccaaactcaaattatacttatggctatccaaaataaaagtagcacaaaagacaaccaggtagaaatgaaaggagtaagaaggcatgaagtgatactcagagtattatttcagtctacatcaacctagacagtttcccaaacgtgtcctgtagcacactggtggtccccaaaatgtaaatgtgcaaagagaacagaacgctaggtcctatggtgaaatacccttgaaataaaaggtaaaacaaagttacatgtttatttacagtaggaattctctgagcttttaatattcatgtcaattgtgacctcttgggggagaacctacatctggtatgcactgaaataaaggaaacatttttttaaataaaagattcttcaacacaatatgtaaacaaaatgggggagaacaaaaacattttta

SEQ ID NO: 37430 - DNA, 4253 bp, Bovine  19866880800122
atacgataaattttttatgttgaccttgtttcatgtgactgtggtaagctcacttgttagttctagtaatttatatactctaaagttcattgatttaaagtgtacagttcagtatttttagagtattgacagtcatgtaaccatcaccataatctaattttagaacatttttcatcacctcccaatccaggtagctctctttcctttggatttctagtctaactccattgattagagaccatattttatatgatttcagtgttttatatttattgaggttctttttatgatcaactttggttaatgttttatgtgcatttaaatattggagaaggaaatggcaacccactccagtactattgcctggaaaatcccatggacggaggagcctggtaggctacagtccatggggtcacaattagttaatgctttatgtgcgtatacagggatatcatttctctgttgtcgagtggagtgttttataaatgtcattatataccccagcaacgtacattgatagatgtgttggtgttggtcaggtctatatccttagtgattttctgtctacttattttattgattactgagagaggagtctccagatataactgaaggtttacctctttcttctttcacttatactagtttttgtatcatgtattttgtgcttcttttgtccgttgaatgcatatttagagttgttacgtgttgttgctgaattcatccctttgtaatgtaatgactctctttatccctgataaaacccttctgttctgaaacctactttgtctgataatatagccacttcagtgttcttttgtctagtgtttgcaagatatatcttttctgtctaatttttaaccttgctgtgtatttatatttaaaatgtgtttcttataatagacagtatattttttggtctttctattttatccagtctgagaatctttgtcttctatttggtgtttttggatcaactagattcaatgtggtgattgaataaaatctactctccttgccagttcttttctttgttttgctagttattttctatttgtttcattcgtccttccttatctttttatctctcatttatggtctgcttctggatgaattcagaatttactatgattctattttgtgtattattggagtgtgtgtatagtcactcagttgtgtccagctgtttgtgaccatatgggctgtagtgcagcaggctcctctgtccatggaattctccagatgagaatactggagtgggttgttatttccttctccaggggatgttcccaacccagggattgaacccctgtctcccgctctgcaggcagactctttaccatctgagccaccagggaagccaatacaatgtaaatgctatgtaaattgtaaatacagtataaatgcagtgtgaatagttgccacatgacaaattcacgttttgctttttggaacttctggaattttttgttgtcccagatattttcagttcgaggttgattgatgcagaaactgtgaatacagagggctgactgtaccatgctttactttctgcctagaatgtctctgatactttcattgagaaataacaaataatagtgaagaattgcatgttgattatatcccatggtatttctgattttggctacataaatatatggatacattgtctatgaagaaaaagtctaaattcaaaatgtagtaaaaatttcagatagatttttattatttttgctatagccctcattgctatatcattgattgatgatagtattacaaatataatatccacttcaataggcactgggatacctctgtttgtcagtatttgatattcaatttattatgtaaagttggaagtaaaaaatctccatttctgtttaaaatatatgttttgaaagacttttcactgtgaaaagttttttctttattatgtacaacttaatggctatatttaccatacaacttaatctgatgaaattgtcgttagagaaacatatgttttaaaaaacctaaaaatagcagttgaaaaaaatgttcggaacttctctgatctatgagtaacttacttaaggtcattaactctgtttattttaggttccttttaatggatttgtgatattaccatctaaataatcagtcacactcaatttagtttatggatgtcattccaacaaaattagttatgagtcattaaaaacatgatcttgataagtaaaaccatcaccaaacttgcatgaataaaacttattaccagtatacttttgaggatggccatcttatgttttaagatcagatctcataaaatgagcaagctaggcaattcatattttttgttaaaatcaagattgccctaagagtatgatttagataactttaaagattaatgcgtgtaatgacttttatggtacatatttcagaggagactacatgactcacatttgtgaagtgcatttatttacttcttttttcacaatgttatgataatttgacattaaattaacttcatatggcaatttctgtagctatatttcctccttggataaaagtacacttttgtattaaaattaaaatcagaattaccttaattttgaaatatgttaccagatttttttttttaatctgctacccttcatatatggagatgatggcacaggtccaatcattagcatgacctaagtacttgtttatttttctaatattggtgtccattgtaaatatagcgtgctcaggtccaccagggaagtcccagttttctcttctgtgagattttcccagtgtatgctcagcttattccagacttgactattctccgtcctactgaccagttttgaacttgtatctgtgccggtctttattcttccctctaaaacgcactctatttctcctagaatccttcaagatttggtccactgatagttctacatggaacttttctgatctgtcattctgggtgtaacttttccctcctctgaaactccataggactgaatttgtaccattgaggtagaaagaacatgggttttaaatacaaattatgtcgttaccattaactttttgtggtcttgaactccttgagtccttatttgcttgcctactaaattaaaataatacccttcaagatggttgtgaaaattaaggcagtatgaaaaggacaaaccataatatctgtacactttaggcacctaaatacttaggctaactcataaataatagtttcttgccatgtaccccactttctctcactccagatggcattgtagttaatttctgtatcttatttccatctcctcctttctgccagtcatgtctccctagctaaatagggaattttttaaaggcaggagtctggtttatttattatttattaattcatttcacctgatttttgtttattagattcctgttgtttcccaggggctgttagggcactgatgatgtacagacgttcttagtatctgtaggggatcggttccaggactcccttggacacccaaatccagggatgctcaggtaccttatatgtggcatagtatttgcaaatagcctacacatatcctcccatatacttgaaaccatctctgctgctgctgctgctgctaagttgcttcagtcgtgtccgactctgtgcaaccccatagatggcagcccaccaggctccaattacttataatacctaatgcagtgtaaatgctctataaatagttaaaaatgcaatataaatgctatatatatacagtgggtagatcacagcaaattcaagtttttgctttctggaattttgagtttcttttcccaaatgttttcaatccacagtcagttgagtcctcagatgtagaacctatgggtgtggagggctgactgtatagatgatgctattgatattgactagatgtccttgcttgcccgtcagtgggcaacagtacagcagcatttaagatacagtgttgtatacaagccaagaaagaaacatacataggttctgtgggaccctagaagagaggtacccaatcctctgagtatatgtgtgtgatttggtggaaggggtctggagaaggtgacattcaaactgagtcttcagggataagtagtagtcttctaagtgcagaacactgaacaagtcattatggttggtggcatatgccatatatatatggcacatattgaaaacaagctgtctaaaaataggaagtgagaggcagcttaggtagcgtggcacgtatgtgtgtagagagctgatgccaagaggaaga

SEQ ID NO: 37431 - DNA, 1325 bp, Bovine  19866880885847
aatttagaaagaaggtaacgataaccctgtatgcaagacagcaaaagagacactgatgtatagaacagtcttttggactctgtgggagagggcgagggtgggatggtttgggagaatggcattgaaacatgtataatattgtatgtgaaacgatcgccagtccaggttcgatgcatgatacagggtactcaggactggtgcactgggatgacccatagggatgggatggggagggaggtgggaggggagttcaggatggggaacacatgtatacccggggcggattcatgtcaatgcatggcaaaaccaatacaatattgtaaagtaattagcctccaattaaataaatttatattaaaaaagaagcagaaactaaaacaactaagaataaacataggtcaagattctcaagcttggtattattcatggaaatgcaaattaaagcaacaaatgcacatatttcagttatcaatttagaaaaataaaagtacaattgcatttaatgctggaaaaaaaaaaaaagatgtaatggaaaaacctgaacaagctttttggccaaccctatagctctgaaacccttggtccatcctactgttgttattctctttatataaacactttctaagatttccatatctcagagtagctggctttgtcactctgtgtttagtatccactgaggcagactgataaaaagattaaagtagtcttgatttcttcagtataaaaatttacctaatatgtagtagttttgtggtttctgcaaatctaccgtgatactttattgttttaattatcagatcagaccatctctttagaccatttattttatagagaaaatagcagatatatttagaaagccaacagtggtcattagaatttctaatctgtatttcttttgtatagtgagagccatactcagataaaggaagtgtgcagttgactcttacaggcaaaagttgcgtcccttgaattgattgtatatattagaaatatgtatatgcatgaaacatataagaaatatataaattctttattataaatccatataacaatctaccttagaaaaggcaaaatgtcaaataaatgcagttaaacacataaacaagacttgagtttcagcatagaccttagacccctgggaagtgagtcagctctgcaggagactgaggtatgagttggtttagagttcctttcttcctgacagtgaatgcaaatgtcatccaggatctacaaatgcaagacacgtaaatcgggcttccctgatagcccgctggttgagaatccgcctgccagtgtgggggacacaggttctgtccccagtc

SEQ ID NO: 37432 - DNA, 2091 bp, Bovine  19866880910927
cgcagaaggaggtctggaaggaccctcctcagctcctcgtgatgatctccgctgccacatgggaacgtggtccagaatattcacaagaaacctggactgttaccaaaaggccacccaaaccatctgtgcttggcctgtggcctcatcttgtgacaatctgattgttccaatggagaaaactgaggcccagagagggtagagagtcccagtacagggtccccagtgggtggttgccttgcccagagctgcctgacccatgcattagcagctgccccagggaagctggaggcctccctggtggctcagtggtaaagaatttgcctgccaagcaggagcggagaaggtgatggcaccccactccagttctcttgcctggaaaatcccatggacagaggagcctggtaggctgcagtccacggggtcgctaagagtcggatgagactgagcgacttcactttcacttttcactttcatgcactggagaaggaaatggcaacccactccagtgttcttgcctggagaatcccacggacgggggagcctggtgggctgccgtctatggggtcgcacagagtcgaacacgactgaagcgacttatcagcagcagcagcagccaaacaggagacatgagtttgatccctgggtcaaggaagatcctctagagaaaggaaatggcagcccactccagtattcttgcctgggaactcccatggacagaggagcctggcgggctacagtccacggggtcacaagagtcagacacaactaagcgactaaaccaccaccaccaaaacgggtacctgtactatcggctgtgctccgccataaattcttagctttgtctctaaatcacatagatgaaaagatacaggaagagtcatttcttttaatggagaatatttataaacctctcaccatcgttctacaccaaaggcatctccaatcttgaagacggagaacactgccgcacgttttgtcgcagacggcacacttggcgctcacgggcaagttaccctcgagccactggtgaggcatagccacctacacagcaggaagaaagggcagtcgagttaagaccatggaggacactgttcttagcccacggaagagagacaatgatttcttactctatggaatcagcagcatgtatcattcctggcatgcatgcatttcccccacttttaatgagcatctattatgcccaagcacgatagggatacaaaaataaaactaaacccctaccctgcaggatgtgtattctcgctgagcacagagagggattatcataaactgaccaggaaggggtatcagagatttgcatgcaaaggagataaggttttgaaggtgggggagcaggctccaaagtccgaggagtgaatgtctgggtatacagctgagctgagccttacagagtaccttagtcggccagataagggtctgcagcatcagcccagcccaacaacccctcctaagcccttacacaccaatcgtcttaaaatttaagagctgaaagaagctacgaaggattgaattgaaaataaaaagtcccaatctacccaaactttccatctaatcctaataatcaacacttcctcttaacttcctgttgtaatttaactaattagatggctcccactgaacttccacgggagcagagaacgaaggagtgggggtgtctgggaggagaggggagaggaagggagcctaccccgtcctcgttctcgatgatgtccttcccgatggaggccagggtcgtccacttgcagttgttcattgccctcactgcacagcgtttgtgagccttgaatttacacactaaaaaaaagccaaccattgctaagtgaacatatacttttggaccaacgatgaaaggaaatcacagcatgaaatttcaaagggctggggagggtgagtagaagaaagacaatattttttaaagtttctattactcttcaataaccgtcgatattctaaaaagcaaatatgattatgtgcttatgaagcattctgatcaagctacagattgctaaagagatttcatttactcctaaaagaagaaaggaaataaatactaaaagaattaattcttga

SEQ ID NO: 37433 - DNA, 1708 bp, Bovine  19866880956047
tttggctgtgtcatgcagcatgcaggatcttagtttcctggccggggatcaaacccaagccccttacagtggaagcacagagtcttaaccactggacctccagggaagtccctcttctagtcttctagtctataatttctcaaggggcatgttaaagttttattaaatggttaagtggagggattattacaaatataagcaccctaaaagcaccaagaatgtctgaaccatactgcaaaaagagtgtgaatacacattataaagaaagagaaagtggtgcataattatatttaatacccttggggacttttgttgtaacaggataaaagtcttagttacaaaccaccaaaagaaaaaaacacacatacacatattttaaaaatatataacattctactaacttctttctcaatgctgtgggatttggagctgtatctaattattttaaccagcaggtcttggttgcttctcttggatgaagcgtactgtcacatctgaataacacaggtcttaaaccaatattctgttgcttacgtattcttagaaaaagagccatgcgttacttatgataaaacaatcaaatccacaacattatacgtcaaaaccctacagtcacagaaaacagaaataaaattaaaatagtcaactgtagagaaaacatggttagcctgaatagcagtaaaatttctagaaaatgggcaataaaaaagattatagtgttttcttgaaaaacactcaactgagataaatattttgcctttcgccttccagctctatgctggaagttgatttttctcttctttcttcagctggtcattgtccaaaaatccagtgcagaaagttttccattatagataatagaaaataaataactatgtcagcacagattatacatccaactctaccaaacattgaattacttttgacatataataattgccttagtccatatggactgttataacaaaataccatagactaagtggcttataaacaatactaatttatctctcagacttccagaggctgggaagcccaagatcaaggagccagtagattcagtgtctggggaaggcccatgtcctggttcatggacagctggctttccagtgtccttatgcagcagaaggggcaaaggtgctctctggggtcgcaccatagaggcactaattccactcgtaagagcttcatgctcataacctagccacttccctcagtcccacctccaaatatccccactgaggattagctttcaacacaggaattctgtagggacacaaactttcagcagtactacttttattctctaggccaataaagaattgagctgtttcctttgaaacacagaagtctgtgacccagtctataaacaacatgattaacaatttttactagccaagtaattttttcagcttattttaaggaggcaagagtcctgtatgtttttttttttcaaaagtgaaagtgaagtcactcagtcgtgtccgactctttgcgaccccacggactgtagcctaccaggctcctccatccgtgggattctccaggcaagaaaactgcagtgggggttgccatttccttctccaaatcatagactaaattttgggaagtttattgatataaaccattagtacaatatttacaaacaccatctgcaattacaaaaaaaaaaggttttaagaggattatataccaatgatccaaaatg

SEQ ID NO: 37434 - DNA, 2448 bp, Bovine  19866880988864
cttaagatcccacccttgccatcctgtatccggctgatctccagcacagacgttttatttcctcacttataaaatcaggatgtgagtccttattttctgggtcactgtgaagagcaaatagagatgatgtaaagcctcttcctcctccttgtaacacaaggacactgggttcctgtacccaagtcaaaattaagaatcacggtggctcagatggtaaagatggagaagggaatggcaacccactccagtatccttgcctggagaagtccatggacagaggagcctggcgggccccaatccatggggtcacaaagagtcggacagactgacaccatgtctggtgagcccagagggagcgagtggggcagggagagagcaccaaacgaagggctgggaggggggcctaagcctcatcccttttggtggcaggctctcggcccctctttgcagctggcttcctccaggttaaacccaggcaggggactgacgttcgtgaggctcttcagcccttatagttgagtgggctctggtcccgaccttagacttgcagctcttctctgaaaagcagatggggtatttttggcttctcggtatgtgtttcttccacacccttctccaaaatgttttcctgtgctaatttatttggctaaggaggtttgtggtgagagacaccaaacaggaaatagctgtcatagctgctgtctgcaacgtttgtttttttaaggctttctcctgtctagctcaccttctctgtgttgttcagtattgattgaaggtcagggtaagtggaaggggaaagggaaacacatttttagaagagaacattctccttctagttcaaagtttactgaagggtaaggattgttatgcactatggcaggattaggtggctcctttctgccacagggcctttgcacatgcaactccctctgcctggaatgcctgctcttctggtttttggttagttctgcttctttgggatcagctcagaaggccttccgggcccctgtgctcaaaaggccttccgggcccccagtctaggtcagcgcttggtgctattctcatagtgccctcctcaagtccattcatcttggtttacaatgacatgttcacctgggtgatttctttttcataggttttttaagattcatttttttggccgcatctctcagccaggtgggttccctgaccagggatcgaacccatgaccctgcattggaagcatggagtcttaaccactgaactgccaagaaagtgcctgggtgattttttttaggttaatttctctcctctttcttacaagcgggccataagccccacgcacgcagggacgatccctagcttggcatgccatgcactccagtgcacagcacggcgccaggcacacagggagtgctcagactgcttctgttgactgagtgagtgaaacgtcaccgctcacaggcaggcaggcaggctgggcatgacacaatgtctggggtgcgtgttcacctagtcccctctgcctgatcgctgggccactgttctcttgcaggtcacttctgccttcccttctctagggcctcgctctcatcctcccaaagcatctgaaacattaacccaaggccaagactggtgctgggggcccattagaatcctttccccagctccttatggtttatcgggggagaagaggtgtctgaagacagagaactttgaggcaagaaggaatgactctaacgggggaacctcagccaccgtgtttggcagtgaggggaagaggagcacttcctagccactccagggagacagatgtctgctgctaggctgactctgatcctgatacaatatttaccttttcctagagctcggcttcttaagtcagagaagttttctgaaccctgttgcggccagaacgtggtgtcagcacaccgtgggtgtgtgtgaacatatgtagttcatgtgagcttgtgtgtacgtgcttttgggtttatgtgtgcatgtgtatgcatatgtgtgtgtgtgtgtgtgtgtttgaattaaaaggaaggtgacaaagacataggcttcccaggtgatgctagtggtaaagagcccgcctgccaatgcaggagacgccggttcaatccctgggtcaggaagatcccctggaggagggcttggaaacccactccagtgttcttgcctggaaaatctccatggacagaggagcctggtgggctacagtctacgggctctcaaagagtcagacacgactgaagtgacttagcacaagcatgcacgcacaaagacaggagtcctggtgtggaagacccggaggaggacacaggaccctcagagggtctgaggttgagttattaaccgcacggtctgtctcctgggcaggagtggcccttcctctgctgggcttgtctttgcttgtcaacatttcaaaacaggatacctttgtaattgcattttcatgagtca

SEQ ID NO: 37435 - DNA, 1276 bp, Bovine  19866881036600
aactctgcagcagctaacctccttgttaacctttgttctaaaaccaagagacaatgcaactaactgaagtgtaaagagatatgcagaatttacaaattatggatgtttagacaaaggataaaaagcggtgggtttgggattttttttttttttttaacaaaatgaccctctcttccctctgcttctcaggctttataaagctcctatcttaaaggccaacacagcaaattccagtcactcctgctccctctctgtatgaactggaacataataagacactgaatgcttattaggtacaacaagttgacaggcacaaaaaggaatacaaaaataaataagacatacatacagcctaggagagataaaaatagtatataatttatatctattgtttatgtaccgtgttgttctttttccaaactactaggaagcaatgtcaattactggcagagagatgagttaccagtcacatggctgagtgcagatgagcacatcttcccaatctaaactgtaattcattacggcacactgctatttgtggtttacagttgtccatgtgtgacgtctggttcaaaaggggacacttcaaccttgatggccagtgttacatcctagggaagcccagagcttgctgcctgtttttacttgagtccagatctctggtgagtctccaggtacatttatcctcagtcctcatatcttcaaccttaagagtctttgtggtagcaaggcaagtggggttaacataacttactctttgtgtcatgatgctaagtgactgagtctaagtagtgagtatgtcatgagtaatgtgtacatgagtctcacatttgcagcaaagcttgtactctgatttgctcaacataatacacattttgaggacatgtctaaatgtttttataatcaacatgaattattcatatacaaagaacaattattttttaaagttcacatgatttaaccctgctaaggtccccctggaggacgaaatgggaacccactccagtattcttgcctggaaaatcccatggacagaggagcctgctgggctacagtccatgggccaaaaagagtcagacacgacttagcaattcagcacacacacaggcaacagcctacctagatagttctcacagtttaaacctaaaagcaactgttttcacttcttctaaagccaagaaaacagaataaaatctcacatagctgaaaatatgctaaaaataataaagaagccaactttgaacattaatatatgtcaggggatcctaataactaa

SEQ ID NO: 37436 - DNA, 917 bp, Bovine  19866881149682
aatgtcaaaatctcattataaactctagctagcatgaatcaaaacaactctgataggattagccatctgtggaactcttcccgaaaataacaaaatctcatcagggagccaccaatccaaaatgtaattactctaaaataagctgtaatctaattaatggtaaccttgcctgccataaggtaatgttgcaatggctgattcttctgcagacaggatatttaaaaagaaagctaggttggtgagcatttatctgagttaatcccaaaccagtcatgagggggatccccatgtagtttgggagcataaagtggactcagtctccagtctttaaaagagtctggaggtggtttcccagaagactgcccaatttagcgcttaccaaacctcacaaggtattttaaatggctttttcttgtaaatttaaataccactctccccacaacctaggaaatactgtgaggcatttcctctgcactgggtgtgtgcttttccctcgtatgttataaaaattaatgtctccaggtggttagcagagaaacaacacccctgtggtaaaactccttaatacagacctgcaaaaaaaaaagtgaaagtgagtcactcagtcatgtccgactctgcgaccccatgggctatacagtccatggaattctccaggccagaatactggagtgaagccttccccttctccaggggatcttcccacagggaatcgaacccaggtctccctcattgcaggtggattctttaccagctgagccacaagggaggcccccaaagccaccccacccccccaaaaaaataaaggggatttaaaaagctaggactattgttagaaacataagacaattttgttcttgtgctttctttactaatttaagaattgttggttgttggttcagtcactaagtcatgtc

SEQ ID NO: 37437 - DNA, 673 bp, Bovine  19866881161022
ttgtcaaacttctggaataatcttaaactgaaagtaagaagtatttgattttaggataagtgaataaaaatcactctccccaattcttttgtcattctattgttacatattggtactcatgttcagattaaatataagaactcttacaggtgaatcatactataaaaattaatttgagtgcaatgtggaactcacaaaaatgtcttaatcataaagaggaaagaggattatatgcagaaatggagacaaaattaggaagaaaggggagtgagaaatgcaaaaacaaaaaagaagcagaacccaggaaagattattgaaggttaagtgatgggcgatggtaaaaatagtgattttttttctttctatcacaaggatatattatctccatgagtagcatattaagaccagggtggagaatccagggcactgatgctcttgagtggcatgggggcgattcctaaagagatccaccaaacatcactaatgtacccccaccacactgccagcagttttttaacttcctcttttccttttctcaggtcaatctttctacttctgccttccttcatctcaaattttgacacatctcaccctctgaatgtacctttgtatacctcaagtattgtggaaaattgaaaaaatatggagacaatctcaagaagtttcacaaagg

SEQ ID NO: 37438 - DNA, 695 bp, Bovine  19866881491063
atagaactattttgataatactatgtcttaaagaagtaccttagattcaagggagtatgtgccaattgcctcgttcattaatatctaccttgtggttatgctgaatcactcattcagctgttgcttttcatttccctcctccttcccctttcccctccttctcctcctctttgtcctccctgttcacatctagtaaccgtgactactgccctccagtacagaaaccaactgtttttgccaaatataatggtactagccaacttaaaatatcaaaaagtgcatttaacaaaacagactcaattgtcagtaataatagaaatggctaaaatattaactgactgactatacctctaatagcttcaacatttaaactgactcatttgtttcctggccttctcctgtccattaggctgatccatgatcgggagctaagcctctatgatggctccaggctgctgagagaagacaggtacttgcgcttgaaggaggagctgcaaatgtctgatgagcagctgcagcagaggtaacggggtatactactcttactcttattgtcaagtgcacgtctttaaaaattattcttctaaacctaggctcaaaccaagatcactttgaatggcttactaatttggtgtcctagacaagatcttatttgcacactttttaaggcttgagtttgctctccaagatgtact

SEQ ID NO: 37439 - DNA, 629 bp, Bovine  19866881776421
gccttatgtaatacggtttgtttacaaagaagtggtaagtatgctatccccaaaccagtgttgtaaatgggttcttccatatgtacaattaagtcataaaatagaaacactaaaaaaagtgaatgaatgtatgggaatataaattcttacaatgaaatgatagaaaaatgggtttcaaaaagagctttgctaatgggcagtttcaactacagaggggaaaaaatgcttataaaaaattaatttgttcaggttgcattttcttacagaataatgattttatttgatttgctgaaatgtaaaatctataaatcttatacactgtaatttcaccactgtgttaatagttatgttaaaccttaattttaaaatgttcttgtataaattaaatgtactgttctgcaattgaaatggaattattatatataaactgaccagaataaccaaccacagtgttatttatactagggaaatagtgtacatatcaacatttgatgaaccaggaatatacatacttctactaccgatacttaccatcagaatcagtgctgttgagtgcaattggaggtatgacagatactttacattggccaagtggacatacaggatgatataaatctttacaggcagtg

SEQ ID NO: 37440 - DNA, 988 bp, Bovine  19866882148577
ccttgcaatgcaggtgacatgggttcaatcccttgtctgggaactaagacccacatgtctctgggcaactaagcccatggaccataactagagaacgtgtgagccgcgactactgagccttcacactacaactagagaatccatgcactgcaatagaggatcacgcatgacacagcagagatcctgcatgctgcaagtaagactcaacccagccaaataaataaatactaaaacaaaacagaaggcagcctgacccctgcactaataggtcattgtccacagttctacagttttaaaaatgcagccctagttcaaaagtttccagtgctccactgacttcccaagaatcatctggaaagcaagttaaaaaatgtccaggacctatggaactagaatctttggggaagggatcagtgtgccattctgatcaccctccctgcataattcttaccttgaccaggcttaggaatcactgatctgatccaacctctctactcaccttagcccctagtttacagaaaataaactagagcttgaaaaggtaagttctgggcttcaagaaattgtcaacaagtttaaagaacccaactcatacaaactagagactcttaaccatagtgcagttaagttggaaattaataacaagaaatctgcaacagagcataaaacttacctctcataacttgttcaaaatatatccccacagtaaatcagcaaaactgataaccagttaaagctcagaagccaataaccgttagactgacaataagaatattaaacatctcaagactatgataaaagtttgttcagctcaatggcatgaatgtctaaaagctcattattcgatgatgacaattttttgaccatcaagaaacactgatatataacactctgattagcttaataatgatttgatgaaatatgcaatttcaactggaaatcaaattattaaagagcacttcagcttattgaaaatgattatagaatc

SEQ ID NO: 37441 - DNA, 2808 bp, Bovine  19866880752559
tctgtcgtctctgatctcttcctgtcttcagtcttttaccacatcagggttttttcaatgactctattctttgcatcaggtagccagaatactggggcttcagcttcagcatcagtcctttgatgaatattcaggacttattaccttcaggattgaatgggttgaccttcttaccattcaagggactctcaagagtcttctccaacaccacagttcaaaagcatcaatttttcggcactcagctttctttatagtccaactcctacattcatacatgactactggaaaaaccatagctttgactagacaaaccattgttggcaaagtaatgtttctgctttttaatatgttgtctagggttgtcatagattttcttccaaggagcaagcgtcttttaatttcagggctgccatcaccatctgcagtgattttggagtgcaaagatatagtcatttacccatctatttgccatgaagagatgggactggataccatgatcttagttttttgaatgttgagttttatgtcagctttttcactttcctctttcactttcatcaacaggctctttagttactcttcactttctgccataaaggtggtgccatctgcatatatgaggttattgatattgctccctgcaattttgattccagcttgtgctgcatccagtacagcattttgtatgatgtactctgcatttaagttaaataaacaaggtgacaatacacagccttgatgtactcctttcctaatttggaaccagtcctttgttctatgtccagcactgtttcttcttgacctgcatacatatttctcaggaggcaggtaaggtggtctgatattctcatctattgaagaattttccacagatttttatgatccacacagtcaaaggctttagtgtagtcaatgaagcaggtgtttttctgtaattctcttgctttttccctgatccaactgatgttggcaatttgatctctggttcctctgccttttctaaatctagattgaaacatattggagctttcagttcaaatactttgaagcctaacttgaagaacttttagcattactttgctagtgtgtgaaacaagtgcaattgtgtggtagtttgaacattctttggcattacctttctttgggattggaattaaagctgacttttttccagtcttatggccactgctgacttttccaaatttgttggcatattgagtgaagcaatttaatcatcttttaggatttgaaatagctcagctggaattccatcaccaccactagttttgttcatagtgatacttcttaaggccattttgactttgcattcaaaacctttaattataatatttggtgctacagtctctgtatcctctaggtattttctttgaagttggctattttatttgggtatattatttattattttattgatgttcaaaattactttttagtaaaaatctaccatcctagtgtcatctatactttgtgtgctaattaatatgcaaattttaatgtatgttcctttcttaaatctaaaattgtactaagctttgcagtgcataatgatatttatctcttgatttataattgaagcaagttgctcttattaatatacttcctctaggcaaggacagaagtatagctatattttttaaactgtaataaaatggtgaaggtttgattaatatttcattttttcatcttttaaaaatgataaaactatataagaatgcctttaggttgagtatttatattcttgaataaatagccagcatatttattcctttatcataaaatgaatgtttttatcattcagtgttattctataatataaaatacatgattttcaaataatgcatgtattttgcaaataatatgggggagtgatatgatactggagaaattaaatgcaatcaaagtattattagtgacctagctctgcctggtgttttattacaaatgcttcagtttggctcaaacaagactgctactgctgctgctaagtcacttcagtcgtgtccgactctgtgcgaccccatagacggcagcccaccaggcacccctgtccctgggattctccaggcaagaacactggagtgggttgccatttccttctccaaagcatgaaagtgaaaagtgaaagtgaagccgcccagtcgtgtccgactcttattgaccccatggactgcagcctaccaggctcctccatccatgggattttccaggcaagagtactggagtggggtgccattgccttctccgtcaaacaagacagaggagggaaaatccctttctggatgttagaggatatagaaaactggtcctccaattttattcccaaatctccatcttcttcctgatagatatgtgaaaaagaaaattagaattgagtcaatccttcattttatttgattctttcaaaagagtatacattttccaagttttattctcacagaatatttgaatttcataataaaaatgttaatatcattttttgcacttttttaaaatgtagagagcctgaattcagagcaaattctgatgctctaattatcctccagctcaaggtattgaatccttatgtagtgcatcccactcagatgtagtactgaatttctcttacaatgcacacttagcacatgcacacacctcaggtgactgacaattcttcccattccgaggaagtcagttccatccatccttggaaggcttttgttatgggactgtcatacagtcaatacaggtcagtcttggtcccatttatttatttatttattattttctcctcattcggactgcagagaa

SEQ ID NO: 37442 - DNA, 927 bp, Bovine  19866880782135
tgaaatgtattgtatttatattggtgactgcaattgccggtggatgcccataaataaactcaaattttaagcatatttcactggagcgattgatgttttatttaacctggacaagacagatatcttctttgttactgaacagccttgtggtatagccagggcaattttaatggtattgtctcttcctttgcactttcaaataccgtatccccacagctgcagtaccatataggcattttgtacaagtgatgtaagcatagttcttcttctttttttattttttaagcaacagtggggaaaatattttatactttcactgtatatgaggaaaatccttctaggttgacaacatattgagaaaccaagaataaaagaaagaagggaaggcaggtgttagataatatttgagacatttatagagttgatgactggctggttaatctgacttaccccttttcctaaaactcgctttgcatagatttgatgttgttcagttgctcaggctcagtctgtctgactctttgagaccccatggactgtagcatgccaggctttccctgtccttcaccatctcccagagcttgctcaaactcatgtccattgagttggtgatgccatccaaccatctcgtcatctattgtcctcttctcctcctaccttgggataggcttccctggtggctcagaggttaaagtgtctgcctccaatacgggagacccaggttctattcctgggttgagaagatccccaagagaaggaaatggcaacccactccagtattcttgtctggagaatcccatggatgcaggagcctggtaagccacagtccacggggtcgcagagttggacacaactgagcgactttactttcactttcctcctaatttcaatctttcccagcctcaggatattttctaagagtcagct

SEQ ID NO: 37443 - DNA, 856 bp, Bovine  19866881059116
cccttttgagaagtgaatttaagtccatagccttttgcaaatacatgcaaacatgtttatgactaatacatacagttgaatatagcatttgttggatctcagaacatgaatttatgtttacaaaattagcaataagaaacaatttttattcctcaaatcatatgtcctgccctgccctatgccttatttactctaattctgcattaaattgaacagaactaataatattgtgcctaatagggaacttaagggtctaggaacaattccagttaccaaacagtgccatgagttctgaaactcaaagttctaactcaaagtaaaaactgacatccacctaaaacctataccttttacaccttctccaatctatttgctaactttctagcacttgtaaacacttacactgctgagtatgaatacttttctctgcaagaaatctgagatttggaacggctgctgtcttgcaacatatatttctacaaagagaatgaatttgaggagaaagctaaatcctttctgaggaactgcattttgtaacatgcaatgatttattctgttaggaaaatagattatttgaagaattgtaagcccttttggcaagaaaattcatttagtcaaaaactttaatctatcccagtgacaaaattctctattttattgcttaaaaattgagctttatgacttcctacacttttgcagaaagattgccattttatgacgaacttatggcaatcctagatcacataaaaagtaattcatcaccatataggaactgagatttttcatattgaaaataaatgtctagatgtgatgcaaatatggatttttctctaaactatggaacagaagatattaa

SEQ ID NO: 37444 - DNA, 737 bp, Bovine  19866881211101
tccatagggctgcaaagaatcagacatgactgaagcaactgagcaagcaaaattaactaatcatcaaaagaaaaataatagtttctcatatctacaaaatttaattttattttagtagtaatgtgtgctaacttagtattaactatctacaggtcacatttttatctgttttacaatgtcttaatagatgttgtgtgtaccttccattagctctatctcagcttaaagtcagtctaaaagttgattgttatgattaatataaacactgcaatgtgtaatgttgataagaatactaaatagggcctagaataaaatctagcagaatacttcagaaagtgcctcagactgaagcttccttgcttagaaaaagaacgtgtgtgcttttaaaagatggctgatgtacatatttttttggatttcacttgatatataatttcagctataagttataaaactagagttagtattagatttaggcatgcaaaaggacctattattataaagcaggaaattatttactctatcctatctttgcaaagcagaagcagtgctctacaaaaaacaacaagaacttttatcatttgcataaagtgttccagaattgtattatagatgttttatcaacctaactagcttataagcaactggaagggaagagatatgcgtgttttctatgcccttcttaccttggaactactagttccaaatatctaacaaaataggcacatggaaaatat

SEQ ID NO: 37445 - DNA, 1389 bp, Bovine  19866881238621
ttgaatggatttgggttaatcgcttaatacccataagggcacacttttccaagcagaatatgagaatttggcagatataaacaacaaagttctttctgactgggactattattctgttcacttccttctaagcattttaagtatctttcccccaactctttgctctcagtttaaaacatactcttacaaggccagaaataagcaatgaaatcttttattctttttacaaattttaaaataaaaaaataaaataattggaacatggtagtgcttccctggtggctcagatggtaaagcgtctgtctacaatgtggaagacctgggtttgatccctgggtcgggaaagttccctggagaaggaaacggcaacccactccagtactcttgcctagaaaatcccatggatggaggagcttggtgcaggctactgtccatagggttgcaaagagtcagacacgactgagcgacttcatttcacttcacttcagtgccataaataatgttgaatcaagattataattagactattaattctcaatggataattgagagaagcttgtctcttttttctcatttttagtgtcagatctaatcctcttagctccttatactgctatgtacacattttactatctagatctttgctaattttccatttgttggccacttatttttaccaaatcacttggatgcagtttgttttgattcaactgttaaattaatcatttgtatattcgtggtctatttatggaattccttattttagtaaaagaagattaaggtgcagtttgtgtgtgtgtgcatgtgtgtaaaagaaagaattaacatgagagaaaggtacaagtattgcgaggcagaaaaaaaagtcctacttgtatgaaattgatctcatttatcttctttcccattctatcctagctccttcatcttcctcccactaaaatgcaatactagtacagtttaatgtttcccagtaggaagaaatacagttgcacattcaaattcctcaaaccaaaaagcaatcaatacactatggcaggtatgtagttcctgaagaaaattgtttttgtgcttctaaaaggaagaacaatgagcatcagtgagaagaaaaatccagccttggaagcaaccacatttatctttagtcaagaagaaaattaaacaaaaaagttaattttaaaacaattattaacttaaatctctttcatgagcattatatattgcctttctaaaggaaaaataatgccagttacctacaaagaaataaagaaaaatgttgtgtaaaatttaagaaatatgtgtatgttcagtgcattaaaattatatacacaaatcagtgttcagtttaagtagaaggctcagacagtaaagaatctaccgcaattcagg

SEQ ID NO: 37446 - DNA, 726 bp, Bovine  19866881333476
aattccttcttatttctgtgataccatcatttaaaaaaaagtgagaaacggagtatggaatgaacagttactccagccacatacaccaccagtctgaaaaggaatttttgggctaaagaatagttaattggaaatcattactgtatacatggcatttgtagctaagcaataaactcaaaatatccttacttctattggccattttacctcaaatacattaaataaagttcaggattcggaacatgtgtacacccgtggcggattcatgttgatgtatggcaaaaccaatacaatattgtaaagtaaaaaaaaaataataataataataaaataaaaaaaagccaaaaaaataaaatccaccatgattttttatttcctttgattttgactttgcatttcattgtgaagtggctatgtgctaatattactttgcaagctaatataatgccatcttttaagggagcaaatataaaaacatattaatgcctaatttagtaaaaagttctgtttatgttggaagcattagattaattttatttaaactgtgatatatttcagtttccatggaaacttggatgctaaccaagttcactgaggcatcatggagtttatttctgattcagcatggcttgtcaagttcttttcctaaagtgtttgctaaatataattatgtgagtttggaggagatacaaaattggtctgtggagcaggctttttttttttaaa

SEQ ID NO: 37447 - DNA, 1792 bp, Bovine  19866880611864
tttggatccaactcagacagagctaccagggagcaaagtctgagcaagaatcaacccatccccacccaactggattccaaatcacaacgttcccaatcatttattcacagaaccccaactgcagtcaaggtcttataaagctaccagcccatacccaccagtaccaggtacccacctgtaccaggagagatcactgtgttcccctctctagccaagaatccccttctttgtgcctggactaacaggaatggaaaaaataaccagttacctataacctggagaccagactcaagactttctgcatatgcctcaaaatgtgaaccaaaccaggtttccaacttcacctgagctgttaaatttacagggagatccataaggctttttacaagacagaaaagaccatcagagaagggcaagttatctctgaaaagggtgtaataaaaattaagctcaaaggaaaaaaaaaaaaaacaaccagcactggtctgagcagggttgttaaatggcatttatgactgctctacattccaggaagcagcagggtgtgtttatgctacaggatccagggacacccactgggttcaaaattctgcctccacgacctaaaacatgtgatcacaggcaagttacttaaatcttggaaccccacttccttgtgagaaagtagggataccccagagacgatccgctgccaagttgggcccataggccagttatctgttccaaggagtctgtgccttgtcttgttggtctgaagtgttaaaactctgatccttgggaatggctgctgggagtcatgttaagtggctgtgcgtgctgcgctctcaccccaccagcaggtactctcccccgtcacaggggagggtctggaattaggtagttacaaagccccgtgtcaccacctcctaactacatccaatctttcccagctaggctagaagatggtcatcatggaagaagcaacgcagtagaacaaaaactgaggagcggcctctctgctcttctgaagacttctctcctgcgcagggaggtcctgcaggcacagacagaaccctgctccaacacatctactcccctctgaagaagccatcacccacaaaggaggcagcacagggaagggttcaatgttcagtttcctttaatgacccccattctccccgaagggcaggtgcaggcagctgggcgatggcaagaggtattcacttgaagatcttgccctgattgaaggctttgcccacatgctggaaggccccttcccagcagaagtattctcgaaccaacgtctgggtctcctcgctgccgggatccagtttccgccatgtgtatgactcgtagtccacctgccaatctggactcagctggggagaaaaagtcaggtaagaagcatgtggtcaggttatcagacactgtcccatacctgttacttccagctcagacacccatcatcagagcccgggacgcctgtgaacatgactgctctttcatggacacattccttgaactctccagggcgccctctgactcaggaatatgagtgcatttcccaaatccttgccccaccttccctgcaccttcctcaccggaaaagcaagctcctggcctcgaaagacccagaccccagaaatggagctgctattgttggttccaaagagaatgacactggcaaaggcattcttcctcagtttgtccaatcgctggaacattcctaaaggggaataagaacattcagcctttgaaatcacatcgcccactaccgtggcctcccttcctccccccagagccatcttctcac

SEQ ID NO: 37448 - DNA, 1134 bp, Bovine  19866880675403
catcttcacccaaaggcaaattctccttattcaaaagcaagaagccaagccaccgctcaaattccttcagtgacgaaagggagcactctgcccctaccacccccacggggactttggagttcgagggtggggaggtggcgctggaaggcgggaaagtcaaagggaaacacggcaagctgaaatttggcacctttggtggattggggtcaaagagcaaaggtcattatgaggtgactgggagcgatgatgaggcaggcaagttacaggggagtggagtgtcctcatcctctaagaagtcccgactgtcgtcttcttctagcaacgacagtgggactaaggttggcatccagcttcccgaggtggagctgacagtttccacaaagaaagagtagccggcctctgtgtgtgtatatatctgtatagaactccatcagccttggttgtgtttgtatataaactccaaagagaaacacgccagcagcctcagcgacaatgcaaagatctggcctctgccaggggcaagtgctgaaaagccagctgcctttaggctcctcccggagctttacagataggttccaagttcttcgtccagcccatgtgcaaaatcagcagtatttgccttcagatttcagttttttgttttgttttcttttttgcattgaatgctgagagctcctgtttactaagccagcttttgtgtttattatcttcatttttactgaacattgttagtgttgggatcatggaaacccacttttttcattgtaatgacttttgggggcttttgttagtaagggtggggtggggtagaaggcagtagaggggagccagacctttttctcctacaattgggtctactcaagcagcaaacacccaaagagggctgagaggagctagccggtggggtgtgtgggtgtttctagaactgtgtatcattgctttttgtttccccaggggtggcggtcggtcccagcctgttcggtgctcacgggggagagggaattagaatctttttgtaaattaggccacccacttgctccacacgagggcctttcattctgtgtgttgtaagagaaatgttttcttcgtgatcgccacgttcctgatattagttctgatttcctttaacaaatg

SEQ ID NO: 37449 - DNA, 2638 bp, Bovine  19866880965004
tcggagccccctccaaagcccgggaaccgaatggcatcttaaatcaactcggtctgcctagaaccctttcatttcttgtcacgcattccatctcttcggtcctgtcccgcagtgagttctccgggttgccttctcctcttctattaacctggccagagaggtccaattggcctgacttccctgtccggagactcttctcgctcccaaacctcccgggcggaccacccttaaccgtggccagccgtacctgcccataaagaccctcctcttcgccctgtccctcctgttgccccacaaaacggtcgcaaaagttttgccaacctgcccggatcccacgtctcgaggcggcaatgaacccgaactgctttatcaagctccagactgccagaatctggcatccgttttctcctttaccccagaccctttcacctcttcggcctcccagagccctagcctcagttcccctctggggcctggaggccctactctcgaacagtacgatctctaaaccccggatcagttcccgactcagctgcagaacccctctgacgccggctgagcccgctcgggcagaggatggcgtcggataggatgagctggatcgccggagccggcaaacttaccccagccgccatggtgattccgcagagaaagggggtggggccctccgcgctgccgcaaagtaagccgtcagggagagaagggaggagggaaggggagagccgtggagaaacagcagccggaaagcgaggacggcatagaaggcttacgcacgacagttcggtatcccgcagcagctgaacggaaaaagaagtgggtggggcctgctggccagcgcggaaaaaactcgcgccggcgcagtgggggatgaccaatccgagtcaggacgcggaggtagaccgcgcggagacgctgagtcctggctggaaagccgccccttgctgctacgtggcagagctgtcagctcggcatctcgcggggcaccagaggcgtttccctccgggtcgcctgccccatggtgatttggtagaggtcgtgccagacccacatcttggtcgtgtgacgatcattggggtggcaactgcgtggagatgaaggagtcccacgctccttttgttccagctttctagaggagagattgtacatctaacccaagcccaggtctgaaaccctccgtaaaagtgaggcttttttcattaaaccactttgcagctcagagatgctgttaataagagaagaggcactcttccgggacccgcaacagaggagggactgaggaagaacacagccaagtcctgtcaccctggaggggctgacagttcaaatgaggggttgtcctttacctgtgctcagatctgaacattttttacccaatatgaagagaatggacttataaccctgaacccaaatttcaagccccatcaccattcataatctgggtagtaatgtaaatgaggaaggaaacggttcttcccaggtgcagctcaagccaccacccagcactccatctttccagaactcagtactgagggggtccaggtgccaatcacttgccctgggcatgaaaggaaacagcctgggagacagatctgttttagggtgacaagacaaggtacctctgaggctgcactaagcacttagtggggaaggagaatcatcaccaggtggaaatagaggaaactagtgttcattaaactagcagctttattgcctttcagggttcccatcttcacttaagcaggtttcgaagtgcttgagggaggaaaacctgtaagaaatgatggagatcagggaacaggccttgagaatcctggagtggggtcacagtgagactctggtcagcctgggaggtggatgccacgaaggtcaggagtggctcagcctctggcctctgttcagtactgctcagtccccgcagctcccgggtgacctgagcctcagttgccagccactctgctcccgagcgagcaccagatccacctccttccttgatttgttgctgcaggcgtctccgggcacgcctccgcccctgccacacacggtgccacaaggcgcagcgccagctcactgtgagcgacacccgcttctcggcctcggcctgagacccttcgcaggctgcctcaggtcctctgggcccctgcttggccagcgctgcggtgcctgactgcccctcttctctggtggctagatgctttccggtcatcaggggcagctcccccagctgcccagggctccgcatcacccagtcctgcaccgactctccaacctctatgaccatctcttccacgccatcttcaccatgctcccctgcacatccctgctgctcctctggcccctcctcacagctttttttctgtccatctagttttgctctcttgcttgtccctccctgggggggctccccagggccacctccctctgaccgcagtctcttggttccctgttctatatggcaccctaaggcttcccttaacacctgggccagcacagcagtgagctgggtgaaggaagcagggggtaaggggataaggtgttgcagagaggatggagctgggggagctgggctgcagaaggggaagcaggccccagtcccgaccccgggaagaccgccgctggtactggaggcttcgacagtaat

SEQ ID NO: 37450 - DNA, 1762 bp, Bovine  19866881010428
ctggcatgcttctttccgtcttggcatgtcacctttgatgtcctgcctttggagggcatatgcagaaactcaagggtccctctgctgtgtatcttgacttcaaggtgtggtgcgtggaggcactgaggcgtacggacctgactctcagggtgtgtgtgtgtgtatcagttcctgtcgtcttgacactgaccctggctgcgacgttgtctttggctgctgcagcagttaggctgcgccccctccctggctgtgttcacactggctctcgggcagaagggatttcctgggaccagtgggagaacatgcccttctagggggtcacagctggcggggaccatcttccccgggcaaagggtctgcttcctggtcttctcctgggtctgcctgggtgttgcccacccagggcagagatctgcagagatggcatgggcagaaccctgctgcatgcacatcctctttgtggttttgaatcatcagggcagcttcgttcttctctagctgcttctggcctgaatttcttgcactctgtccctgcagcctcagatgtgcgtcctctgccttgaagcgggagtgtccctgccacgtcactccttttttgccctccaggcagccctctgccttagagggtctccactctagcccttcccaccatgaaggttgctgtgagctggtgtcaggtgccaggggcagctggcagacctgggcgttctagggccccagcattcccccattctcagggctccagaccccactctccccatctgtcaatagcaggcagtgccgtcccacagaactttctgcagtggtggcagtgttctgtatttgggcttgtaatatggtagccatgcgtggctgttgagctcgtgaaatgtagttcctacaacctatgggctaaatgtttaattgaatttaagttagggcttccctggtggctcagatgataaagaacctgcctgcaatgcaggaggacccaggttcaatccttgggtggggaggagcccctggagaagggaatggcaacccactccattattcttgcctggagaatcccactgatagaggagccacatgtggcctaagggttcttccagctccaagggctttgagagcttctgacccctgaggaatgtgtagaattccccaaggctccaaagactctgctttgggcagcagcagggtggagcccctagccccccgggaaagttggcttcacctgacatgtgggagaagaaggaatgaccccctgggtttgctacaggccccaggggtgggggagaccaccggctgggatccaagtgcagaaaataggcccttgccactgtggcctcgaatcccctgtcagcacccctgtgtaccgccaggtcagatgtaaggggaggggaggggagtcttgcctggctgtgccaggaggtgaggcctgagccagggcaggcagggtggttggcagccccacctgactgggaagccagcgggtgccccgccaggatcaacctgcagcctctaatccagcacctcccgttctcacaagctgtggtcccttctccactcatgatgtccttctcattagcccctggggtggaggcatgtggctgatccccgcttctgagtttcccacttgggcttccgggggctccgggccgggggctctgggccaagcagctggcagggaagcccattgcttcttcctggagccccagcccctccggcacccagggccctggcccatgaagcgggttttaggtgtgacccttggcgtgtctgg

SEQ ID NO: 37451 - DNA, 747 bp, Bovine  19866881383498
tctggcagcctctcctgaggccttcaaatcatccctccgaggccccaggttgccccacctgaacccggcccagccagcttcctgcgataggaattcacacgggtcctgggagagggaggtcgtgtgattggcctggagagtcacgtgtgctaatgaagaccggctctgctaacgatcagggataggtctgaacctgttcttcccaaacctacgtgctgtccctcagagagccggacagggagacgcacagggcgggttgagcagctttgcggagttctgaagatcctagtgggtttaaaactgccatgcccagttgaccagactggatctcaagttaacaaccacctccacttcatttcttttccactttgaactcagaataaaccgggagtttcctgacccaccacttcacatagcaaataatcctttcagtagagaatggataaacaacaaagtcctactgtatagcacagggcactatactcaatatcctatgataaaccattaggagaaacaatgtatcggaatcattttgctatacagcagaaattaacacaacattcttaatcaactaaatttgaacaaatttcttttttaatttttaaagtaataatcttttcttcccaccctcagctgagaagtccttcccagctcacaaccctgctctgtggaccaaggatcagcacagggcacctgggtcaacgggccgtttgcacagatctgcacgggggctgacacagggtctct

SEQ ID NO: 37452 - DNA, 864 bp, Bovine  19866881516375
gggaggtgtgccggtgagtctgccgtgcctgtatggctggggttagagttggtggtccaggaggactggaggggaggaggtggctttttgcttcccttcctctattctaacacttccgtattccaaaagttacttgtttcttgaatagtatctaagagacgaatgcttttagctaagggctttaaaattttattgcttcttttaattaaaaaaaaaaaattgtgctgcaatcctcttatggaggagaaccagtccctctaaatactgtttttgggaactgccctttgtttgaagtaattattgtccctaaaaatgggaaattacacatactgtttatcaaaaggaaataaacaccttggactaacagagttctcgccactggatggtgattccaaaccttgccagcaacccggggaaatggccctcactgcacgttggacccacacacgcttttggtgttttccattttttaaaggggaaaccgttggattctgtgtgttcctcaaaggctgcttgccctgttcttgttatgtgatcacggagaacctttgatagggcttttctggaggccaaaataagtccaggaaaaaccatggggagtggggcgtgtctcccattcgctttgctccgactcgaattggccctttggttgctttgtgttcacgggtgtttggtgagggatgctttattgagacagcatgtgggttcacacagggaagaaaaggtcttggagggggctccgggtgtggctcagcctttcctgctccacccaaggccccagggagtgctccagtgctccccgatttttgactctggtcattgtcagccgaggcagcctcggccggcctctccagccacacccag

SEQ ID NO: 37453 - DNA, 1624 bp, Bovine  19866881848912
caacaggcctcagctggcctgcattcccacagctggggggcaacccttcccactggagagggtggtggaaggggcctccagggctgcctggactgtggtcagggacagtgggtggggccagttacaatgcaaacactttgattgtggactctcccttgtttattatcatccagaagagtgaatactctgaatactccaaaggggaaaagacctagggtaatagtgggtgggaggggttggcagctgctgaggaggctgaacccagaccaagagttcactttttttgaagcctggagcctccccttactccctagatgaataacagccttttctgggctggaccagaaaccaaccaagctgcccggagttctccagtttctgccactcactagctgtgtgaccctgaaaataattgcttaaactctctgagccttagtttcgatgtgaggaaaacaatacccaccttagagggatgttgcagaaatcaaaagagataaagcatatacagtacatatacagtgcctaacacaaagtaagtattccatagaaatggctgacacttccagtatttactatatgccaagcaccttatatgtgtcaacttacatcatcctcacaagaaagctataagagagataacatattattgccattttatagataagagaactgaggcacagagagttgtagtaatttgcccaagatcacacagctaggaagcagcagaactgagagctatcattatcatcattattattcctctactagactgcaggttcctttgaggaaaagggctttgcacacagtatttaggtgactcagagataaagaacccacctgcagtgcaggagctgcaggagaccagggttcagcccctgggtcaggaatatcccttggaagagaacatgccaaccactctagtattcttgcctgggaaatcccatggacagaggtgcctcgcgggctgcagtccatggggtcgcaaagagtaatgactggagcgactaagcacagggagaagccagcatgaaatctcaggagaggggcaccttgtggaccagcaggtcccctgtccctagagaaggtcttttcatccttaactctttctgatacttggcctcactgctggcaagtttttccatgaaggacaggcctcaagtttgtggtggaaaacaacagagggttttaaagggaactgaaatcaccgtgctcagcagaatgttccccacacatgtcctgcggcccatgcagggcagagcctctgctgggatcggtcagccctgggaatcaaatgcctgacacccggccattcagaggctggtaaacactctggcattcccaccccatggcaagcattcatgcaccgaattctttgtccttgggaggacggacagagagctgctctgtgctgcggagcccgaagccagaactccggtttccaaaccccagccagagagcccgccaaggccgaggcgtgcaggccaccagctctttcaagcacgcttgcaaaataaacttgcccaaacttggacttctttcttgaaaacttgggtttacttgttaattccaaagggggaaaaatgcatggtactgttacaaggagaaactaggcaatttcctcctt

SEQ ID NO: 37454 - DNA, 2389 bp, Bovine  19866880164109
agtgtcttttaatttatggctgcagtcccatctgcagtgattctggagcccaaaaaaataaacactgtttccattgtttccccatctatttcccatgaagtgatgggaccagatgtcatgatcttcattttctgaatgttgagctttaagccaactttttcactctcctttttcaccttcatcaagaggctttttagttcttcttcactttctgccataagggtggtgtcatctgcatatctgaggttattgatatttctcccggcaatcttgattctagcttgtgtttcttccagtccagcgtttctcatgatgtactctgcatataagttaaataagcagggtgacaatatacagccttgacatactccttttcctatttgggaccagtctgttgtttcatgtccagttctaactgttgcttcctgatctgcatataggtttctcaagaggcaggtcaggtggtctggtattcccatctcttttagaattttccacagtttattgtgatccacacagtcaaaggctttggcatagtcaataaagcagaaatagatgtttttctggaactctcttgctttttccatgatccagcggatgttggcaatttggtctctggttcctccgccttttctaaaatcagcttaaacatctggaagttcacggttcatgtattgctgaagcctggcttggagaattttgagcattactttactaccgtatgctgctgctgctgctaagccacttcagtcgtgtccgactccgtgcgaccccatagacggcagcccaccaggctcctccgtccctgggattctccaggcaagaacactggagtaggttaccatttccttctccagtgcatgaaagtgaaaagtaaaagtgaagttgctcagtcgtgtccgactcttagcgaccccatggactgcagcctaccaggctcctccatccatgggattttccaggcaagagcactggagtggggtgccattgccttctcctactagcgtgtgagatgagtgcaaataagttcatttatatactttatgcaaattacctaaattgccttatcaattggcttatgaacctgaatggaatcagtccttaagtccatttaacaaatagaacagttttttgaacttgcattaacaaaaagactgctgctctctgaggaccttctccacaaccacccagaaacctccttcttcaacactgtttaaccttacaaactctacagctaaaggttagaggcaaagaaaggtagcccattgaccagtttataaagattaactttaaaattctattttcttttccccctctccttccatcaagagtgcccttgcccgtaaataaactctctaagccagataaactgataaaaatgcaaaataaaaagattctgattcaagaaagacccctaaagaatctattcctcatttcagttcacagaatttgacagtacaaataaaaaattagattcagggagttctctggtggtcaagtggttaggactcggtgctcttgctgctatgggcccattaatccctgttcgggaaactaagatctcgaacgcctcacagctcagcagccaaaaaaactggattcagacatttaaaccatgttttctactttttttacaagtgagaacagaaaattcttcctaagatcaacaggttctgtctatcacttttcttgaagggccacactgctgtcttctaagagaaaagaacaatgtaattttaaaaagggactttactaagtctacactgtagtgattcagcaggatacagggcactttccccatcttcagacaccttccttatcctccaaaaacatttccaaactgggatgtaactatcccaaagtctgttccaaagcttcctgctattcctaagtcccatgggcagggctccaaaacttagacactgctggtatattaactgtctccaacttttcacaaatgctatcacttccaggacttgttctgcctctctccactcctgtatgttcttgtttgcttttctggttcacagtgggtttctttttttcagggaatattgaggttaaaaagcctgtgactctgttatcaatttcccctcttcatctaataatagttaggactttctttttatgcctcttttcaactcaaaaaatactgagccatatttccctactgccaattatgtgggtaggtggctataattcttttcctgcttttgttttttctctctttggcccttgagagtctctactttttttttctattatttttatactactactggtagagtagatagcttcaatttgtggatttcccttattagatgcaggcttaaaataataatgaagaaatagaactagaaagcaaaacagttctaaacagatgatcata

SEQ ID NO: 37455 - DNA, 1596 bp, Bovine  19866880446074
ctgggaggaggagatggcaacccactccagtattcccatatggaaaatcccatggacagaggagcctgatgggctacagcccagggggtcacagagtcaaatatgactcagggaccgagcacatgaaaacaaaactttttttcaactccttacaggtcattttaatttcttttttcacatggtgtgttagacccctctatgcattcaatccttgttgcaaagatgcctcctgtgtatttaactgacagactacatgacattcatttgttaaaagctaaaaagtaaacaattcaaaagaggttcatggctctgatttcatggatgataacagagtgacattttatccatggacagaatcatttcacaccagggtgtcagacactcactatgaagacacagtgcttacattctgcttctgtccttggctagctggcttatgttgggcagggtcatcctctctaaaccttgatttcctcatagtgcctctgagctgcttggtatcctgaaatgagactacggagtgtgggtcaatctgtaggcatgaaacacattcccacctgcctgtcaccctatctttgcttatctttttctttttctctttacagtcaaagagtcaaaaggatgtaaaaatggatgctccctggaatggaattgggcagagcccaagaatgaaaggaacctggctgagttgacagcttcacttatcccttgttgagggctcaaagcttatctgatttgtgtctcattggacttgtccaattagtgaagttgattcatattgcatcatagtttgctttgttaagcatcatgttatattctattttatgttatgttatttatatgtgtgttttgtgtgtgtgttttgctatttaatactagttttccataagctatttgatttagaatgaggtataaacttatgcttgaaggaataagatacatggattttcttgagcagaaggctattttaaaaagacatttaacactctagtttgtatatctttgtttcctaaattgctgtaattactttgcaaaagacaaaaatgatgagaagaataaaagttgaaaataaaagaactaaacatgtttgttgattgagttaaataacattgagaggtatattaaaaatatttaaaggtttagtaaatatgaaaatgctctgcggtgtttttcttttaattaaataaaaaatttaaaatttactttcggctgtgatgcggcctccttgctgcacgaggggttttctctagttgtggtgtgtggggccgactctctagttgtggtgttcttctcattgtggtggcttctcttgctttagagcatgggctctagagtgcagattcagtagttgtggaacaccagcttaggtgccccatggcatgtaggatcttcctggaccagagagtgaacccatgtcctctgcattggcagctggattcttaaccactggaccaccagggaagtcctgctctgaaacttgtattccccatttacttctttgcctatttgttctatttttggaggaggaaatgacaacccattccagtattcttgcctgggaaatcccatggacagaggagcctggagggctacagt

SEQ ID NO: 37456 - DNA, 1037 bp, Bovine  19866880468665
ctgcagctgcaactcgtgtggctgcggcggtgggaagggctgttgccagcagaaatgctgctgccagcagaagtgcagctgccagaagcaatgctgccactaggctgccagtctggcctctgggaaggtgctgctggtaactgtctcgttggtaagattttctttctttctgccagtcctccctgatttgaatgtcatataggtgacttgagatgaattctcaggctgaggaatttaattcatatcctctggtcactgagattctgcctccaaatgaaaaacacccacacagtctttctccatccgtcaccaaagtatgagccccacaaaatggagtgatgatttttaatgctatgctttctcgaaattttactgttgaaatgtttgttttatctctttctccttctctctgtggtttctgcattctctgtctctgctactattttctgattctgtaaactgtagacagttcttttcctaataaaccataaaactggcattcaaaaatgtgtcaatatctcctcttttttcattgtttgaatgtgtctcatgcaaagatgcaactaaacccactgaagtgagtaagaccccctgacgttttctgagatggatttaaagtaattaatgaataatctgtccctaataggttttcacatgatggtaaaaatttggtggttgtggttcatatatacagtggaatgttactcagccataaaaaggagtgaatttgaatccattgtaatgaggtggatgaacctagagcctgttataaagagggaggtaagttagaaagagaaaaatatcgtatattagcacatatatatggaatctggaaaaatggttttgataaacccatttgcagggcaaaaacagagacgccgatgtagagaacggatatgtgaacacagtgggggaaggagagagtgggacgagttgagagagtagccctgacatatatacacgaccatgtgtaaaatagagagctggtgagaagctgctgttagcacagagagctcaatttggtgctctgtgaccac

SEQ ID NO: 37457 - DNA, 1411 bp, Bovine  19866880629810
cctcgttgtaatgcctttgaccttagttgcttcctttcctctccacagagaggtaaagggctggtcagggatctaacccatgccttggtgacatcgccttgtatcaccagcagcgtgcataacagaaagcactcattaaatactggctggataactaaatgcatcatctttctccaccaaagagaagctactggcattttaaagggtttttctactggggtatttcaatctccacttaggactggtaaaaaaaaaaaaaagttatttacaaagttagaagctataaaaatgggacccaacaggctaaatacacttctttaaatagtgagatctttttatataagttactactactactactactactaagtcacttcagttgtgtccgactctgtgtgaccccatagacagcagttcaccaggctcccccgtccctgggattctccaggcaagaacactggagtgggttgccatttccttctccgatgcatgaaagtgaagtcgctcagtagtgtccaaccctcagcgaccccatggactgcagccttccaggctcttccacccatgggattttccaggcaagagtactggagtggggtgccactgccttctctggtagagtagcaaatgtgatcataaaggagaaaatgcagatttattatatcaccattgatagcagtcaagctgatgagaacaacatagggtagtataatgcatggtcatcagggagatgacccgaggtgtactagtatatatagtacatgtgtatatatagttatcaagaagatgatagagatatagtttaacatcatatgtggtgtcaaggaggtatacaaaccttctacagcattgcatgcaatatcaagaatatgatccagacacagtgtagtgacatgcgtgggcatcatagagatgaggcacatgtcgtttctatcatagctggtcatcagggagatgacttatgatgcagactcacctatgtttattaaacaaaacataaatccttccataaattaaatgtacaggcagattacctaccatcggctgaagcagttgcaataagctttccggtgtaatcaaaacagctgtctagtatttcatcatcatggcctgttagtgttgccacacattttccatttacagcatcccatagctacaatttaaaaaaaaatgatgaagactatgacttcctctccaacacacaaagatggccagtagtctttatgacatgtttacagctgattaaataaactgtaccaaaatcatgtgtataattttcactttttgttcattttcttttgattcacaaccagagactgcaaccaaccatctaacaaggcaagcttttgacatagagaagatcaaagacagacttcacaatacaaatctgtcactattttaggaaaaaaaa

SEQ ID NO: 37458 - DNA, 1821 bp, Bovine  19866880783064
atggtctcagctgagcatgactttcgctcaaagactattaaatatgcaatagcattatgccaaaaaatagtatataccttaattgaaaaatattttattgctaaaaaaatgccaaaacaattacaatagtaacatcaaagatcacttatcatagattccataacaaacataataacaatggaaaagctttaaatattgcaagaactaccaaaatatgaccaaactaaactaaataaaatgagcaaatgctgctggaaaaatggcaccaatagtcttgcccaatgcaggttgccacaaacctttaatttgtaaaaaataaatgaataaaaagaacaaaaagtaaaaagcacagtatctgcaaaacacaataaaatgaggtatgcctggactctagtgtgtatacagttagtatagttcacattgggcttccctggtggctcagtggaaaagaaactacttgccagcacagaagatgcaggttcgatccctgggtcaggaagatcccctggagaaggacatggcaacccattccactattcttgcctcagaaatcccatggataagaagagcctggcggactacaagtccatagggtcttgaaagagtcggacatgacttggcaactaacccacaaagttccgattgcacgggaagctgatgtattcttgtattgaaatgcatgtagatgtataaagtgggtttttgagggggtgggggagttctcctttcctagggtttccttgaaaatcagttttctattctgttttctcgtcatatgaagataccctatctaatcagggcttccctgctggctcagatggtaaagaatctgcctgcaatgcaggagacctgggttcaatccctgggttgggaagatctcctgaaggagggtgtgggacccttctccagtattcttgtctggaaactccccacagacagaggaacctggcgggctacagtccatgggggtcacaaagagtcagacacaactgagcaactaagcacagcaccctatctgattagatacaaagttttatattgggcaagccacatggatcaacactttagtaatacacaagtctgagaaaggtaaccctcctcacttcccagtgcttcgtggtcacagaatccattttccacctctgcagctcacaaatgagatcttccccgtgtggacctactcttacctggcactactgcttccagtctttgtcctcacggattatgtccgctacaagccagtcatcatcctccagggcataagcttcatcatctgctggctgctgctcttgtttggccaaggagtcaggaccatgcaggtgctggaattcttctatgggatggtcaccgccactgagggtggcatactatgcctacatttatagcatggtcagcccggagcactaccagaaggtgagcggctactgcaggagtgtcacgctggtggcctacacggcggcctccgtgctggcccagctcttggtatccctggccggcctgtcctacttttacctcaacgtcatatccttggcctctgtctccgtggccttcctcttctcacttttcctacccatgcctaagaagagcatgttttttcatgcaaaacccagccaagaagcccttccaaagccaccaggaacggacgctgtctcagaggaacctcaaaagaatcacaaaccagtgggaaaagtagtgttcactgattcagggaacccagatgatggccaggtgaccaacccaaagccaggaaatgtagctctgagagtttttgtgcagtggttacaagatttgaagcagtgttactcctcaaaacatcttttt

SEQ ID NO: 37459 - DNA, 737 bp, Bovine  19866880861678
caccctgtctctcaccatgggtatctgccccctcccttctcctctgctccccttacaggtccttcttttccaagatactatcttaactgatgtcaatcaattccattcaaagcttatgctcagttccacattaagagtaacctttaataatctgaatatagaattcaactgtttaaaggaaattattcataagcccttggtagttacatgtatcagaaacacaggagttgggcacaagatatggcttactcttttttttttttttaattagtgttttggagagggcagggcagaggaaagtaattggtgcttcaaggaaatctttttagggaccacagggaaatctattcactatttcaaggcaactaacaaattatcatctttcagttgggacattagagagacagcctttacagatcatgaaatctgcatgacaaatgttgaaaacaaatgtgggttaataataactttgtatagcaaggcagatgccaggtagcataagagcacacgcagacagtgttaattctgaagtcctggaagctgtgaggtgctcatccatcacatggctgtcacaaccaggtaggaatgactgaggaaagcagcgaagctggccatgccagcatttacacatggaacacttcctgggcagccaggtgtcatggggcacagacccacagttctctttgcaagagtcatgctcacagttgcgtccatagaaagagggagggcaggcacaa

SEQ ID NO: 37460 - DNA, 1203 bp, Bovine  19866880965657
ttagggatgacttatttaggatggacttgttggatctccttgatctccacgggactctgatcccacagttctgaagtgagaccaggtacctctatatttctaaagctatgtgggtgattccaatgtcctttgggaaaccattggccagcaaattttcatcactgttccaaaggtgatgatgaaaagtttgctcccctaaaagtagtctgagatatagtacctgtcaggaacgatgtgttccccagtccagactcctctcatctggtcccaggtgctcaagctcagctcccctcaaggggaaccagccctcggggaagtgctgccaggaaggcaaggagctctgcaacctctggctctttccttctcgatcagaaaaatcaccaactaaagcagcttctgtcactgagaataagaaagccaggagaaatgactggagccatgaagtcccttctttataattttcctgaatactttagattgagtaaaatagccttaagaaagttgcatctatttccgtcaatatatgcatgtgagaacagattttcaacaataactgataaagattaaatccaggaagaagtaggatattgtcacttcatgtcacaccaccccaaaaatagatgtgcaaatcgacaagcttgtataaaacaaagtgcactcaaataaagtaagaaaaactgtcatgttgctatttatttttatctatccaaattatttaatatattattttttaaaaattttaggtatcaacagaactttacttcctatgcttcttaagatggatttcccagtattctgaaattgttcttcccatacttatggtgtggaagcatccttcctttaataaattcatggtgtatttgttcatctatttgtttttgatgactttgccttgaaaaataaaggattggtaactctgttcatcaacctcccttcattgtgaatgcctcacttcttttttaaaactgatttatgtgatgggtaaatcagaagattggggttgacatatatatgtggctacatgtaaatagatagctgataagcaactactgtgtaccacagggaactatgttcaatactctgtaaagacctatatgggaaagaatctttaaaaaaaaagtcagtatctgtataagtatgggcttcccaagtggcaccagtggtaaagaacccacctgccaatgcaggagatgcacctttgat

SEQ ID NO: 37461 - DNA, 1093 bp, Bovine  19866881054505
attttcaaaatctagcaagcaaattagcaaaattgttttccttattcacaactatcttattcttaataagatgaaaaacgttaaacatttgtatgccaagtactaaaaattagttgggtttctgtaaaaatgaatccagaaaatagagtgcaaaatctgaaacgtgtacatttatatgactgcttcactgtgacaagacattacggcagtatgctcactgaactccaataccagcaagaggctgtgacgtgtgcaatgaaaagtacaagcagaaaatagataaagatgcttccaggaatacacgttgttcgtcagagactgtttcacacagtatcttaatattcttgatcttctcctggctgaaccataggtaatgtgtgatttccaaaacacttgggtaagaagatgaccacccctccccaaatctgcaatgtaccaaaaggccaagcttcaaaaggtaaaatagtattgcttacccagctcatattcaatcaacagaaacctttaaagcgcacaaaataccaaccagttcaccctgccgcttatttagatccttcttctggccaaagaacaaggggcccacatgcaataaataaatgacaaagatcgtcatacctgagtcaactgaaaagcatgtattcaacacctactctttacaaagcaacgagattctgaagaataaaaaatagggaaagccccaagtttgattacccacattactgctacgttcctttagtcttcgggaatctaggttagggagaggaattattcagtggatgccaacaaaagaatgctcctgacctatatgctattcaaaagagggtgggaggactgaaattaaaagattaggaggtgagacataattgctttatgcacagaagggataaagataacatgaaaattattcagtggtgagccatacttttcctatttgataatgttatttaacacccacctgctattcagtagtaccttggaaacttgcaatatcatggtggctttccaaagatcagaatttaagtatctaacatgctaagtgaggatgatcttatttattataagacaatcattaaggcaatagtcacaaccataa

SEQ ID NO: 37462 - DNA, 566 bp, Bovine  19866881634546
ttggctctgtactcatacacttatctcttatttttagtcaatgcaggatatgagtctttgacagtatctgcaagatattaaaactagagtagtttgtgaatgatataaacaccatcatatataatatagagaaatttaaaataacagatttttaaattagttataaaggtataaaaactacttttgcaatggaatcctaaaaagaaataacaactatgtgaagtgccaatgtaaactcatcacttgcaatatatgtgctgccctggtgggaatgctgacaatgggcatgctttggaggagaggtggaggaatatatgggaaatttttgcactttccactcaatttttctgtcaacctcaacttctctaaaaaataagatctactgaaaaagataaaaacaaaaaagtaaaacaaagcaaaaacaaaaggaatgacaacataaaaatataataaaataaatatactcactatttctgctgtatgacccctaaaggtatggtaacattttccagtttctacactccatagtttacaagtcttatcaaaggacccagtggcaattttgt

SEQ ID NO: 37463 - DNA, 713 bp, Bovine  19866881765763
atggagtgacttgctataaaaatggtatgtagtcgtatgggatttaagtctagatagtcttgactctagagttagggtgactacgtattttaaagtcccaattggaacagttttaagaattaaaaaaaggtgctaataagaattactttggggatacatccatacagtaagctatctcggggaaaaaataggacatatggcatgaggccaaatccaagcttctcgacactctgctatgctgcctctcaaaaggaaacccaggctcccaagtccttcagccattgtcctttccatcacagcagaactgtttaaaatcagatctagccaattccctgcaaaaataacaacagaaattggctccatagatatttagaaaatggaaatgggaaatgtgatctggtttcagagctgaaaagcagttgaattgggcccttggggacttgggagggggctgtcattagcaggaggataaagcctcattcgagttttgtctccaagccaaagaaaaaaggctaaagaatccggagacgtgagctcttgctcctgatctggaactaaatcggctggttgatgggaatcacttatctctaacacgtgcactccgcccctgtaaaatggagctatgtctactccttccccaccctgaccacctcaggaagaacgaatgattacactgtgatagctactttctctcactgctttatatccacgat

SEQ ID NO: 37464 - DNA, 927 bp, Bovine  19866880159474
taagaagaggtggcaagaatatacagaagaactgtacaaaaaaaatcttcacagcccagataatcacaatggtgtgatcacttacctagaaccagacatcctagaatgtgaagtcaagtgggccttagaaagcatcactatgaacaaagctagtggaggtgatggaattccagttgagctatttcaaatcctgaaagctgatgctgtgaacgtgctgcactcaatatgccagcaaatttggaaaactcagcagtggccacaggactggaaaagggcagttttcattccaatcccaaagaaaggcaatgcaaataatgctcaaactaccacacaattgcattcatctcacatgctagtaaagtaatgcccaaaattctctaagccaggcttcagcaatacgtgaaccatgaacttccggatgttcaagctggttttagaaaaggcagaggaaccagagaccaaattgccaacatccactggatcatcaaaaaagcaagagagttccagaaagcaacccttgccccccacgaaaaaaagaaaaaactctattcctttttcagctaagaaccgagaggtctctgataacactgtttacattggataaggggagccttctctgaggttttagaattttatagtggtctcctggtatctgtaggggattgttttaaagaccctaccccctacagataccaaaatctgagaatgctcaagtttcttatataacagatttttcatgtaacctataagcactctcccatatacttaaattttttttttcttttggctgcactgcatggcttgtgagatcttaattctccaaccagggaatgaaccaaggtccctaacagtaaatgcaccaagtccaaatctctggacagtcagtgaacttccccctctcatatacttcaaatcatgtctagatta

SEQ ID NO: 37465 - DNA, 2136 bp, Bovine  19866880349863
aaataatgccatttgcagcaacatggatggacctagagatcatcatactaagtgaagtaagtcagacagagaaacacaggtaccaaatggcgtcactggtgcgtggactctaaatgcgacaccaatgaacctatctacaaaacagaaacagacttcacagacatggttgccaaggacgaggtcataaggatggactcatagtttgggattagcagacacaaactgttacatatagaatggataaacaacaaaggtcctactgtctagcacagggactatattcaatatcctgggataagccataatggaaaagaataggaaaaagaatatatatatatatgtataagtgaatcactttgctatacagaagttaatacaacattacaaatcaactacaataaaataaattttggaaaactctgccaaggtttataattgatttgaattgacagcactattaaatttttttttttaagatgaaccactgttaagattgtctttgattacattgtatactttcaacatgcccaaggcatgattcattttttcaatcacaagcttagtgaaatatagttgttccattggttattaagaagaaacatgactggtgaagaacttatatttttgcctaactgaaacaaaatgtttgccaagtgttaaacttactttttcacacttgatcttacaccaactcaattacactatactcaagggagctatgagtgtatatgtgtgttttcttgaggaactacagggacagtgataggaaggggtgtgtcttctacgcaagcacagtgcagttttacacatcagcaatgcaagggagaattcagtcaaggatgctcaatgactctgaataggtatgacaatataagcagacaattattagaattctgaacagctatggtttcaaaacccttccaaaatgagtgaaggattttcccctccctcttttcaaggattatgctgaaagaaataagtcttacagattagtggcagaaggagacagtttttcatgttagaaataatagaataacaactgggaaggcaattttatcaagctttagtcacaaaacgaacaggtaagcactgtgtgcttagtcgctcagtagtgtccaactgtttgcaaccccatggactgtaaccctctaggctcctctgtctacagggattctccaggcaagaacgctggagtaggttgccatgccctcctccaggggatcttcccaacccagggatcgaacccaggtctcctgcaactgccaggggattctttaccatctgagccaccagggaaaccctagaatactagagtgggtagcctatcccttctccagggaaacttcctgatccaggaattgaaccagagtgtcctgcattgcaggcagattctttaccagctgagctaccagggaagcatgtattaggcatgttaaaaatatgaaatataagaaacataatatataacgttaaattgtcttttaaaatgtagcagtatgtctaacaagttctgtattcataaaacccatgcagacatgaagactttaggcctgaaggggaaaacaattatgtcaattttttaaaccacaaatttaaataattttatagaaattatttaaaatcaatatgaagccacctctggaaatacactccatattttcatcaggataaacaaacacatagttctgactagcaggtacaaaataagaatgggcactgatatgtccacaggtgatcatgtttcatgcatgtttcaagttcatgtggtatctgatcatgttgattctgcaatcttttaaccacttatcaaatactgcacatttatttctaggttgtcatcagcaccaagagtgcagttatgagaatccggtaaatacttatggtttgctggtcagtttacggttgttttcttgagatacacttcccccaactagatttactaagtcagagtgattagacagttttatatttcttgttacatcctaaaagttcattctccagagaagatgaaccagagggacttccagctactgcaatgtgaagagggcagtaaatcctctctgtaagagataggttacaaatagatgaaattatcagaaacagtcccttggggctctagaaatttaccaaatgggg

SEQ ID NO: 37466 - DNA, 1613 bp, Bovine  19866880367724
gctcttctggctctcacattccatgttcctctaaccatgcaaaggcctctcctccaccttcttaaaagataaattccatgtccctagcatgtctaccttgccaccctctgagtgcagcaccacctagaaacactcagaaaccagtgtttctcaatcattttttaaaatcatcatcctgccacaaaagaggctttttatacttttttccttaatcagccccaatgagattttaataccatgaatatattgtatatatgtttatgcactatatatttaactgtgcttaatacatgaaagtttttttttgtgtgtgtgccgtacacaagaaccaattcgcatcccccttggaggcaatattgcccccattgaaaattcatgacctagatcgagctgaaggctgcctcttgaatgatataagtggagctatttgccctaaactctaaaagccacaaacatattcaaaagccagaggttttttagaaaaaaatccattacacaagccagagtggaatcagccagaatttccatttccccaaggcaaagaatggcttcccatccctgcccccacaggccacactgtcacctgttccagggcctgtcctggtcctctacggctggaaacttcacctctgcccatggttccagcatccagcttccactttgttcatatgaatcccagcagtaacaatgggaatgctgggaatgaggtgaacaataggtattgacgtaacagaaataattagaatccattccaagggcagacagcttacttgcatcaggccagcttccccctctctcccctgcagaactttcaccttaccttggcacgctggccagataggtcaccagtttccgcaggtcttcctgtcttattctgtcatgattgctgcgagcagggaaggtcaggatgggtccacctcgcttatcacggccccctgcaaggaagagaaggatgtttaagaaaaaccagctagaaactgccacagaggaaaaagaattctcctgagtgctagataaaacaggcagaaagatggtacccagagaaatctggtcactgccttgggcaagggcaaggagtttagattcgtgaccttgggcaagtcttttgacatctctgttgcctcatctgcaaaatgcagatgaaaataatgatgactacattacagggctgctgcaagacttgataagatggcacatggcgaagcactttgagaagtactctctacaaatacgagatgataatgaaggaggtgatacttgctcttactgagaaaacaagccaatcaaagtgctatggtctttggaaattcaacctccagtttacttctctttgcagacctctatgagcagagtgctcagggttaactgaataccgtggtgagaagcccctaaagcatccagctgggacatcattgctaggaggtttttagggtcatagaaaagacctaagtgtggtctacacagcccaaggatccacccctgcctgcctgcctaagtgccacctgtcactcttgctggagaagcccatgaatcttcattggaaataggatgctcaaggtcttaatcactgcaaatgcatatgtacacactatgattacaaatgtcttctaaca

SEQ ID NO: 37467 - DNA, 3402 bp, Bovine  19866880450084
gttctactttatgcccctacctctttgcaggtcactaagggatccctgagttcgcccaaaacctggtatcaatttattgtggggagttcttggtgatttgggaatcagcaggttggcaggcacacaggtttttgttatatcctatctttgaaaagcacttcattctctaactagagaagggagttaaaatataattgtgggcttataattgtgggcttccttgatggctcagttggtaaagagtcctgcctgcaatgcaggagacccatgttcaatccctgggtggggaagatcccctggagaaggaaatggcaactcactccagtattcttgcctggagaatcccatggacagaggagcctggtgggctacagtccatggggctgcaaagagtcagacacaacttagcaactaaaccaccaccaacttataatttataagagataatttatagaatgaatagaactttgtaggctaggcctataactgtttttccttcttgtactaaaaaaaattgaagtaaaatttgcatacaataagatacacaaatattcagttctgtgagttttgacaactttagataccagtgtaaccgccaccaaaaacaaaatacaggacctttccatcaccctagggactcaccccttccagtcagttcctgtccactgccttcaggtactactttctgatttctatcatcacagattcttagattctgtataaatgaaatcatacaatgtggactctcatgtctggcttcttgtgttcaacacactgtatttaagattcagttgtgctgtatctgttcattccttgctgctgctgagtactgttccacggtgtagagacaccgtgattttttttaccagccctcaagttgatgaactcctaggttgttttcagtatttcgctattatgagtaaggctgatgtgaaagacttacacaagtcttttgtggacacggcttttcatttctcttgagagtcacttaggagtgtgactgtagggtcataggataagtatatgcttaacattcccaagaggaatttcacattccctgtgaaagttacagttgttcaccatcatttggtactatcagtctatttaattttagccatgctagtgggtgtgaagtgatatcttatgactttaggttgtattttcctgatgactcatcatggtgagcacattttcatatgcttattgaatctacttttagaaagtgtcaagttttttttctcatttttcagaacctaggttatcttttgattatagatttgttagagttcttaatacatgctggatataagtcatttatcagataatatatgggaaagagcccaaacaaaatttttagtccatttccttgcctacaaacttaagggaagtaagaataagacaagcatgaaagaaagagtctttttctttacatttctttttcttaacattttagcttttgctttgttttcatgaaactgagtcaatgaagaagctgtttgttgcaggaagaccctagagaggtcccgagccatgagtctgtggagcggaaaggcaagtgccaagagtcctgatcagcgcagagcaatgatgaggtgctttagctgtgagaataaagctcagaggtctggtatcttgagaatctgaatccaaaccaaatgtgaaatacacccaggattctatatctggtgtttctatattccttccttccccttctctacctacactacccaaccccattaagctgaggggcccacgtctgaaatgaagcctgaagaatgagaatttcaagaagctactcaatgcaacagcctgacttccaagctttgctccttgggtctacacattctttactatctctgtggctgacctttcccaacctccaagaactgaagcccagagccttgaaatagtctgatttatgtatttcaaatgatggctagagtttaattattttctttcctgagtattttctgtttcctcaaggaatattctgttattggcttccccctctcgaccttctttctagggcacaaggctggcacagagcaggggttcattttttaagggaaaaaaatttgttttcaaacctgaagttcactttactgctaatgaacaaacatagcattctagccccatctcatgctgtcctgttatgtgaactaggcatgtggcttactctctggtgtgagaagttgctctgccctctccagccaccttctctggtccagcagccctgagacatccttgttcctcctcccagtctgctcaagtcctcaccacccttcaaagtcaactctggcatagagtttcatgacaacccccaaaacctgatgttgttctctggcttatctcattacacgggacaagggttaatttgctagtacagaaacaaaaccacgaaaagaaaaacctgcccggtggactaatccagtgatctaactccatttggaaaggaaacctggaagaatttgttctgggcagaaactaaggcctgaaccaaatgagtgaaagatggaacataaggtacccacaggacattcagctttcaatcaacctatttttctttctccttccactcaattagctccatctcagctcctggctcactcagttcctctcttggctctgatggccactctctgcctcgttcttctgaattaattgaagtgttaggatatgatgacctctttgagagatacattggcagtgttttctattctaacaattatctactccagagtcacagccataagggaaatcagagaaaagagctaaacaggcatttagataggataagaggcagtgggaaatgggaaggcacttcaaaaagaagcccaaagctttcctgccagatgagattcactgaatccagtattctgcagcccaaaattgactccagggacttggtttagcagtggccttgggctctgttctcagaaagccctcttctttggctcctctcattttctgggtccttcccagtagttatggtagaggatactttctcccctcacccccaagtgtcttaaagaagatatttgaccctgaactgtgtattcattatgggatagacagtattttaccacaaccttcccaggtggcactagtggtaaagaacctacctgccaatgcaggagatgcccgagacaagggtttgattcctgggtgggaaagatcccttggaggagggcatggcaacccactccagtattcttgcctggagaatgaatccccatggacagaggagcctggcaggctacagtccataggatcgcaaagagttggacatgactgaagcaactgaagaatcccagggacagggggagcccttggtgggcctgctgtctatggggtcgcacagagtcagacacgactgaatcgacttagcagcagcggcagcag

SEQ ID NO: 37468 - DNA, 1599 bp, Bovine  19866880455436
taagctggtctctgggctgtgtgcttagggtgcctggaccaaattgcactgtgtgatctggggtgaggcttccattgcctcttcccagaaaagagagagacactatctgtgccattcacaggtacttcatgagataacacacctgaaacccactttggaaaaggttttgtttgatttatgtatcatgtggaattattatccagttaagtacttctgagttgttcctgtgtgtttgattgcagcgagcctaaggaagtgtaggattcagtctccgggtgcaggcacttatttgagtaaatgagggcatatcacatgactgaaactgtagagcaataaccaattagcaaatccatggtagggcagtctcccttcattccatgcttcagtcttcattagaatcatgtgtgcctttcaatagcgtgtaatcttcttggatttctactggtaagctatacatttacaccttctttagtcactattaccaggcatcaccctttgtgagtaatagaatcctgtacccagaacacaggaaccagatcaggatccctgggtttggtgtacaccagctctgaacaattatgtgaccttcggtcattgcctgggcttctccagccttctgtttgtttcttgaagttaggctcagtacttagtttctgaggccttctccaatgatgagatctttagaacaacagttacggtatggtggactaagtgtttgcagtaaggagagaaactgagttatgtcctccggtcgtgtccctcatgagtagggtaaactcggggcaaaccattccatctgtgtgagtgagtatcggctgctttctctgtgagatggacctagagatctccactcggcctctgtctcaggttattgcaggtggagtgagatggagcatgcaaaacctttctaaaccataagtcatcatttaagtatttgctgctgctgtagacactaaagcacagggagaacaatttttttaacattttaattttatattggagcatagctggttccaggtgtgcagcaaagtagctgttgtagacattgaaacacagggagaaccctattaaaggcatgcatacatgggtgcctggcatcattgcttaaacgtagtctaggggtcaggaaagagatgcaaagcagagtcagatctgacctagattagttaataaggctcagaatcagtgagcttctacatagctgtctcttgtgaaccagtgaagctgcactgacggtggttcccttacaggtgacagcagagctcgacgcttggaatgaggatttgcttcggcagatgaatgacttcaacacggaggatctaacactggcggaacagcggctgcagcgccacacagagcggaagctagccatgaacaacatgacctttgaggtcatccagcaaggccaggatctgcaccagtacatcatgggaggtccaggcctcaggtaggagacctgtcctgtgcttatgtgtccagcagggagatgatgaaaacaagaacatcaatcagcttaactccaagggccatttccactccactcattcattctcttcccacaggtacaagaaacagagagttttgtaccatttaaaaaca

SEQ ID NO: 37469 - DNA, 1084 bp, Bovine  19866880517871
tggagagactgtacagggaggcagccagggtctgaatggacctgccctcctgtgaagagcatagtggcagcattggaaacggtaataaaagagaagtggggccccaaataatagggaacaggtccaaattccttccacagaccttttttgttttgataaaagcaaattagtatctgaaaagctcttaagaccccaaatagaacaattgttgtgcctaaatggaaaaaggaaaaccctcccaactttccattctgtataatgagatatttctttcccaggagattggcctcagccacaacccggccgggctccttgattgcaagcatcctggcggacaagcagcaccaatgtctcgggtaagcgtgggggaggagaggggtagggaggtgggaaaacccagacagtgctcttcacagggagctgctaagacactttccgggttgacagcaaactcattctagaaagtgaaggtgaaaatgtcatgtcagacaagtcactcagtcatgtctgacactttgtcactccatgaactatagcccactgggctcctctgtccgtgggattctccaggcaagaatactggagtgggttgccatttccttctcccagggatcttcccaacccagggatggaacccaggcctcctgcattgcaggcagattctttaccatctgagccaccagggaagccaaaatcatcctagcaccacaagcaaactgacagatatgccgaggtaacatgcaaagagatcctgcccatcacctccatgccctccaaaggtccttgtggccgccagtgaccccgagaccgggcgggcgtccccagtcaccgtcatgtttccctgctgtgtggcactctccatttctccagttgtcgccatcgatcgctccacatccccggaagtcgtgctacggttggtgagagatcgcagtgtgcgctccccaactccagcgaacgtagccaaagtgtgcgggctgtgggtgcggactccaggcactccccaggaagccccctcctcagctttggtaccagcacccagctcaggactgtcttcggggctacaagaggacaggaaagaggaggg

SEQ ID NO: 37470 - DNA, 1001 bp, Bovine  19866880526053
tggtgcgatgtgccctgagtattccagtttctaaattgattcctggggaagaacggactggaagtccaaggaagagttgttctgtcttcctgaagtatactgaatcatgtcaggaaattggttctttcaaagcatactgatctgataatctaaggatctcaaaggccaataaatatgaggaaaaggtttaaaaagtctcagaatgctagagctgagtggtactctggagatcatctgctcagatcaccagcatttggtgtgacagatgaggccactgaccttgtgcaagtcactttaggaaaggttaacatttcattcatatatttattttgtcatcaaatatttattgaacatttactatgagtctgtgcagacatgtacctagtagtgaaaacatgttgctatttcattggttctgtttgagttagtgttcaatgaagttttcctttcttacagattatgtatgacaactggtttcacaagggccatggggttattgatacataggatctttagccagtgcaaataggttttctatgcaaggtcaccaacttctgagctgctagactaattagtttagctctacttggctttacataatacatacattgttgaaaagttatttgtaattcaatttctggcaaataggaaactaattcaaaccactaaggcaacttttatttaaagagaccctggatcacatccttttataatgtgaaaaatgttgttgctgttggaaatgattatcctttagttagggattttgtaaacctggaccctttaggttttcttatggctggacacacaacctaggaaatagctcagctgtggtctgaattggatggggaaaactccggcctgggaagagaaaggacccccaacccctgccaggaatcatagaccagcccaacccaagatagtgacatatacttggagcagtaactgcaagctgcctggataagctgctcctcttctctcaggccttggagtctggagtggaa

SEQ ID NO: 37471 - DNA, 1694 bp, Bovine  19866880529470
ttcattctcacgtggaattcttgaagccaaaaaaatagcggttggtgagacaggatctccatggaacagagataagtagggccacctgctgcagggtttggcaattcaagagattggggaggcggggagctgtacccaaaatgctgttctctctcaaaagagtaactttgcactgttgctgtttttcctgttttccatattctatgtttggctgtcagtgggaggcagtgggcgggaagagggagaaggcaggcctttggagaaagacagttggtttgaaaatactgctgaaagccttggggcttgtggacttactttctcttctgttctatcctgaaaagggcagacaaaaaaagatgtgcctgacccagggaaatgggggtcaggtgaaagggggaatgagcagaggggctggtccacacttctgcttctgccccagtgagcacagtgcttctcgagccctttcacccccatgtggtcacatatagccctaagtgtccacattccgatctgaagggagcccactgcctatgaccctctttatgaatggtgttcctgctcattttcaacttcatggaccctggacccctatctgccctgttcttatcatagctaacctccctgggtttcatccatagactctacgaaacagggtctcttaacagcagcactgatatcattttgggctggataattctatgttagggggctgttatgggttgagttctgttcttccaaaaaggtatgttgcaaccttaatggccagtacctgagaatgtgactttttttttaaagaaatagtgtcaatgaaggtagaattagttgaggtcagactggagttgggtgggctgtaatccactatgacttgtggccttataaaaagatgagttcaggaacatacagatacagagagggcactgtgtgacacgaaggccaaggctggagtgatacaaaggaataccaaaaactgtcagcaaacaccagaagtccagagagaggctcggaacagattctcccttacagaaggaactaacctacaaataccttgattttagtctttgagcctccggaactgtgagacaatacacttctgttgttttaagccacccagtctgtggtcctttgttacagtagccctaggaaattaacacagggctgttctctgtactgcagggtgtttagctgcatccctgccctcgacccacaggatgccaaaagcaatgccttccccagatgccaacccagaatgtcctcggacattgacagacatgccctgggtggaggtgggggatgggcaaaaatgtcttccagtgggagaagttcttttagatcataagaccatcaaggaagctccagtgagggagcccatacaacctccttagcttatactgcttttctgacagtccctcagatggcagaagccttaagaaatctaatcctgtggttcgcataggacaggactgggcagtagatcaaggagcctgggggagaaaagcagtgttcaggtcctaccccagattactcaaatcagaatgggagctaaggaggaggtgggggaggggagtatccagcagcatatgtttttaaaaacttaaacttatatgtagagtacatcattctaaacactaagttggatgaatcacaagctggaattaagattgccaggagaaatatcaataatctcatgcagatga

SEQ ID NO: 37472 - DNA, 809 bp, Bovine  19866880620264
ttctgcaggactctgatttctgatgggaaacatcaaccaagagaaactgggtgttgcatgggaaagaaatctctgatcctctattattgcctcttaaggtgactatttctatactaggaattcccaaatttctccagttgcagactgaatgctctaacagaccccccccaaaccatctgcctccccagccctctcctcactagaaataacgaggaaattttgccccatattggttgagacctcagtgtaaattatcaggagcaagttgttaatatcatcaacctcaggaggctagtaacttccagaccacccaggacaccaggcagacctcagggagctaggacatcgacctgactgttgccagaaaaaagcagcccagcccaatgcccctccttgctaactgcccatacctctttggtgtgagtatggaaggagacagacatgtccagcagaagcttccgctgctccaccctgcgcacgaagtcttggatgcgcacctccaggtgtctagctgccttgtagatctcctccgggtcacattcccctgtctgagccagctgctctgccgcttctaggagcttgtccgcattggtgtatgtattctgccagcaacgacagtgaggaaaagtcaacttgcagtcacgaatggagcgtcacgtcttcccccagcccaccagggctgcccagagctggagcgcagtgcgtgggcactgagcccagagctccctaatctggcacggaagagctgagtgcccagctcacccaccacctcccagcaagccagcagcctgccggcagctcagcacaag

SEQ ID NO: 37473 - DNA, 2441 bp, Bovine  19866880653370
tccgctgcaggcagcggtgatgctgaggttggaggagtgccaaagcccaagcatcgagtcttcagacaacttttcaaaggtggcagggatgtgggaacccatgtagcctgggtcctgggagaaatccaatacagttcagaaaaacccagactcttcagagatgggtgtgttagctgagagggtggaggctgagcctcaagtcttcagccctgcctcccgcctgggtgtcagtgcagatatggggcaggacagggtgaggagctggcaggtgggcatgtggtacctagcccaccatcacacctgcctgccttgtcaataaaagacaactggcagtctaagctctactgggaaaaatgaattaacattcacttgttcccaagtgaatgttcccaagcctcatgtttgattttcagcctgatttgactcttcttccacgtacagacacttctctcatttataatatcccccgccattgccactcccaaagtgtaatcagtgcaggataaagaacaagactaaactatggagagatctagttgtttttagaatggttccctctgagatgtgctcatggatcagcaggagacaagggggctgtgagctgtgaggggatcgcagagaccaagagccaattcagcaggggctggtggtgtggcttgcggtcctgggagtgggaggggaggttatgcttgagaacactcatgagcatgtctctataggggaagaaaaaggaatgtacacgtcagagcagaactgcctccctttacaaaactgggtgttctcagaaagctttgaaaatcagattcctaggattcaaggtgctttattttcctcttactagctttcagggatgtgcctatatatctccctaaaattgtatcttaggcacatgttaggatatatgcctgccatgagggtagcaatcagccaatgtataagcagagaccccagaaaactgccccttgaaggaacccttcaacccactaattgagaataaataaagaatgctttggaaatcatattcgtgcagaggcaggagataagagcctatacatgacctagcttggaatcaacatgctggcatccggtcaagggtgggcagagagcagggcaggacttcgcattcagagatctagcattgagcagtgcacaggatgtgtggagcgggtgtcagctggggggctcaggcccaggggatcttagcagaggtcataggaattgcagctcagctcagcggggcacagggacattacagtcatcaggtacaaaaagcctggggccagactgggcctggaaatgatgcccaaagctctcaatttaacagcaagagtcctttatgaggtggacagcccacatatttctcaaaccgggtctttaacatatagctcttttcagtaggcacccccaagccattttcttctgcaagggacattgcaataaagtgctacctatacttatcccttcagaaaattcatattgaataggttaactttgtatatcttattcgtcatctgtgtctgaaaacgctagcagtgccatgatgcctgctttccctcagcacctgcttctgtgctcagagttaatttcaacatagcaacacagtttagaagagcccgataattcctacaaggatccatatgaatgttcaagggctgcaggcacttctactacagaaaactagattaaccaaaatatttgcagcttccaactccttcaagagttccagttctgcctcaactgttacatctaaaaacttttcatacatgcatcaacacaatttttggctttctttatatcagcactgacatcctaacatctttccttatgcaaccacagcacctcccggtgctcaagctcatgtgaagccttggatgaacaagaacccaagaaatgtgtgcaattcacaaagcagggctacaacatgcacacttgcaagcttttgttcgtctaaacgcagaacagagaattaattacatcagtcaaccttctcagtgttgacccatgagaaggtcaccttgtcccacacctccctgtgcccaattcttcctctaaagagcagcgaaggaaagtcatccttctccccctagtccaccagagctgagaaacgtcccaaactgccttgtagaacgcagatagctggctctcccccctccctccaggtatttgcagatgacattttcaggacatgccagcaacgctgagatctggagatacaggcgccatgaggcatatctccgagctgacaggtgtgggcgtcccaggagttggtgcttgtcctgtgaaatgcaaggaaagcagagccagaaatttcccccaccttcctcactctctaagatacatttagactacgaaggccatatctgcttcctcccccaggggagcaccggactggcccacacctgccagatttagctccgggcaacacctgcagccacagggga

SEQ ID NO: 37474 - DNA, 1279 bp, Bovine  19866880675658
agtttgctgccccagtaagtgatccagggcatccctgtatccctgggcaccgacatctggagcatcggggttttgacatacgtcatgctgagtggggtctcccccttcttggatgagagcaaggaggagacatgtatcaatgtgtgcagggtggacttcagcttcccccatgagtacttctgcggtgtgagcaatgctgccagagatttcatcaatgtgatcctacaggaagactttcggaggcggcccacagcagccacctgcctgcagcatccgtggctgcagccccacaatggcagctactccaagatccccctggacacctcccgcttggcgtgcttcatcgagcgccgcaagcatcagaatgatgtgcgccccattcccaacgtcaagagctacattgtcaatcggctaaaccaaggcacgtagccatctcccagccctcgtggtttcacatggaagtgcagtgtgaaccaaagcaagactgaatgtgtctgtaaataattctgtccatcattcactccatgtggttctctggattgagagatgtacctcttaaacttcctcagtggtttgtcaaggtctgagcagcagtgaaatcaccctaaatccagggactttccagaaggtcgttcagaagagatacagatgtagagtcacggaaattattcagaagagaggcggagataacaagaatagcagctgttatgacattttaactgtgttccaaaatgagtggttaacttggcaaaacataaaatcactgaagaaagtataaaggttcctgcctttgctgaaattttaagcaagaagttctatttaacagagatgtcatgtatgtcaactgtgccggtttagattacttacatatagtttcttaataggatacatgtacacatacagtaaaaatatatcacattcaactttcagagttttataatatagagatatatatgaaatcaatcttaagtaactttgagtgctccagttaagacagtaacttatgtaccgaagcattacattgttttgactaagcacaattagatgacaggttttgtttttttttttttagagccttttataaatcttgtatagaactattttaccagaacctgtgcattaagagaaagcaatgttacccttttgcaatctgtgagtgagaaagatttttctctcggtcacaggtatttgactaacttagggttctgtttatgaaatgctatccccggattcactggcagctcagagttcatctggcaggaaagcctgccagggaata

SEQ ID NO: 37475 - DNA, 1604 bp, Bovine  19866880676379
tgaagcttgtaacattcagccgtcctgagtgaagatcctgggacttttgtttcccacactactacaacaaaaatatgagtgcctttcctctttctggttttcttttctcttttcctttcgtattagctgttagctatagctttatgtcactttgtcaaggtagatgatacttgtattctactttgcagctaaacttaagtcctctgggctatgtctgtgactctgtagctgtggttcactgaagagcaaagtggtgggctacaaccccacttccttggctgcatctgacgtggcccttgtgtcatttaggggagaatgttcctaatataatggccaaatggattcactttaagacttttttaattagttgtttaaagtcatgtcctattttagtttccttcctatttacatgttggctttcttatttacttctcctcgagtttcagtaagcgttttctcttgttgccaaaatacgcagtcagcaaacctttaaaataattcatagtgtcctttgtgttgaatccagtcctatccagaggcatccctaccggggtctccgttcttctgcttcagtccctgcgggtttctctgctgcaccactgttactctgggactttgttaactcctgacttgtcaccactgctttgtgaaccttctctttttctctttcatagcttatatcctcattgtactaggagtccttgctttagtgtcttcctcagaaatgatgtgtgggaggtaaattttctgagcccttctttgcttaactttactttcacttaattggtaatctggctaaaactctagtttcaaaatagcttttccacagaatttaaaaatcagtgctcttttctagaactcactgttgctgttgagaagtctgatgccagtctaatttttgttcctttgtaactgttcggtttttatctttgaaaatatttaggatttctcctaaaattgcacagtgatgatttagttgtgggcctttatgttgtttactttatgggatatttcagcctgaagacttgtgtcttcttcaggttgaagacatttatttctgttgtttacctgcttaatttatctttgttctctctttctggacctcctcttagttggatattgtaactccaagatttcttctctttctcctattttttgctgaaaatttttacccctttgtctttctgttctaaattctgggatatttacttaactttatcttctagatactccactgcatttttagtgtaagtgatcatgtttttaattttagtgatcatgtttttaatttccaaaagtctttttcttgttcttattttttgtttttcatagcatcttgctttataggtagaatattcttcttggatgtttatggagctactaattagtattttcttcaaaattttatcctgtgttctgatttttatgtttcttccagcccaggtggtcctgtttttgccgtgcacgtgtctgtgtgtttgctgctgggtttgttatacacgtgaccacctttggttgctggcgtggatctcctgctgcagtgtggggggggtctgtctcctgacggggttcttccttcatgaaagggtgacagcagcacattt

SEQ ID NO: 37476 - DNA, 1189 bp, Bovine  19866880696493
cttctgagtcctgcatcttttacatgttgaaggtttgtggcaaccatgcatcgagcaagtctaccagggccattttccccacagtactggctcactttctgagtcacattatggtaattgttataatatttcaaaccttttcactattattaatattacatttcttatggtgatttgtgatcagtgatctttgatgttactattatgacttgaaggcttagacgatggttagcattttttagcaataaagtattttaatagtaagatatgtacaatgttttttagacataatgcacacacttaacagactgctgtatagtataaatatgacttttgtatgcactagggaacaaaaaaaagtgtgtgacttgcgttattgtgatattcattttagtgcagtgatctagaactgaactcacaatattttcaaggtatacttgtcttttagtagttgcttagggtttgtaatacacctttttaacttaccacagtctatctttaagtgatattctagtacttcacatacaggataagaaactttcaacagtctattcctatttcttccctcctggctcttaggctattgttgccatccattttacttctacgtgtcttataaacctcacaatttattattatttttcatttgttatcatttatgcacatgccatatttttttctcctagactgtcagcttgaaagtgggatttgtatctgagtcagtgttggcatttaataggtgttcaaaacctgtgcttttcaataaatgctgaaagagaagaaaggaggtggtggcagaatggctgtattgctcaccaaggtgaagtccgggatttgtccgaccaatgtagaaatatacaatggcagcaacacctatgttaaccagggtatagacccactggataacaaacatgatgagaagcgacccaacagcctgtggaaagagaaggaagagcaagtcagctcatggctgaaacacgcactaagcaagccacaagacaagggccttaagcggaggaattccctgtgctccagtggttaggactccacgcttctactgcagggaaccagggcttgcttcctggtctgggaactaagattccgcaagccacgtggtgtggtcccctcaaaaaacaaacaaaaacccttgataagactaggacctttagaaacaaggtcctctcatcaa

SEQ ID NO: 37477 - DNA, 800 bp, Bovine  19866880704110
tttggcttaatctgcccgatctgcctggcaggcactgtggggaaatgccaaccgcatctggggagacgtgaattctctcccctttcctctggtcactgcgacaggatgagagggtgactattttcaacctggaaagctgtcatgttgttgtggctggtgaacaggtgccatattccatcctcagctggccactgttcagagcctggagtagcactcttgatagacagagtcggtgtggcatgtgacaagagtgggccacgctgaagcctggctgccagaagcccagccaagccacaagatggcaggaagcagctgccaagagaagagaatcccctgagggttagggtaggtgggcttttcttaggtcaaggctctgggccaaccaccaccagtggggagcatggccaacatgccaatcttctcggccacagtctcccccacaggcctgatcagtaacagccatctccaactcccggtagaggaaaacaaccaaatgagatcattcacatcaagagcattttataaattaaaacaggctaacaaaggctcatttaaggaaaagtgggtccagtctaatcaataacaatagccagacactcaatggctactaaggggaatggtctgtgcctctcgagtaacagtcataaaaccgggcgcctcggctggcctcctggtccacgagtgtcctttagcctggtgtgtgctctccttatgcaacccagagaaaactcactgagcaaaacagagactaaatgtttcctaaaattttgaccaaaataaagcgtacttattagggaaga

SEQ ID NO: 37478 - DNA, 1441 bp, Bovine  19866880719232
ttgatgaagtcttttactttactttcatctggacaggttggaggaagcacacagacattttatttgccagctgagtttatctgaaacagaggtaagggatggttcagccaaggtcactgtttaatccggatgcagtgacagctatagaaactgattttgtccatttaagtatgtgagaaagacactgcttcttactcagaatgaccacagaagagattgggttcaggctggaccgtgtgtaggctatgaaagctttgaccatccccagcaggaacagatgttgcaactgaatcaacagaaaaacagtggcttggccaggtaaggcttggtcatgcagaggaagcaaatcctcaggaattaaaaaaaaaaaaaaatcagtcaggtggcccaggagaagactgtgtgcagggaagctcagaaggaggagcacaagcttagaagctggctcagagcaagcctgcaggtgaaaaacaggaccatggtcaagggccacccagcccaggggtggccacttctgacgttaaagggacaaagctcatcaggacagtcatcagtacgttcttcagccagaaatcctctgaaattatctcaggatcttcctagagtagaccagaacattactactgtctggaatagagacaagggtttccagaactgggttatctttctaagctatgaaactacaacttatagtcctttaagatcttcagatattactttactgaataacttattcttaaactcccaagaggacatcaatcctccacattatctagtgtttttctacagcttctcagtgtcttttataaaattatccaattttttttccaacccttgagtaacagtccccaaattcaatgtcctgttgtaatatttatacatctcttctatctttctatcatttccttttccttcttgcgtaccctcaactctcaaacctatttctctatgcatcttagaacctattttcctcccctacctattttctcgaatgcatctggcttataaaaatctacaaagaacaccgacaaaaaatattttttaatgtcaacaggtttaggctacgggatgcacactctgatgcagcatcagatggggacatttttctccaaactgcttccacatcacttgcaaggtgatttgtcaaaacaaattaccgctcttctctggaggatttcatctactccatacatggtggtcgccttccatttttaatgattctgaaaacacaaaagatgtttcaagtgtcctatgacagaatctgaggttccctctctctgtgcaaatgatcgaccctccactgcaggagctgctggctctcatgggtgctttcattgcccatgtgttcacagcctcactctgaagaggtttgctaacctgtcctctgaacttggggctagtgagcacctgaaacatctagctaaggtccactttcaggcat

SEQ ID NO: 37479 - DNA, 1525 bp, Bovine  19866880728270
attaaaaagcagacacatcactttgccagcaaaggtccatatagtcaaagctatggtttttccagtagtcatgtatggatgtgagagttggaccataaagaaggctgagtgttgaacagttgatgctttcaaattgtggtgctagaatagactctagagagtcccttggacttcatggagatcaaaccagtcaaccctaaaggaaataaaccctgaatattcattggaaggactaatgctgaagctgaagctccaatattttggccacctgaatcgaagagccaactaattggaaaagagcttgttgctgggaaagattgagagcaagaggagaaggaggtgacagaggataagatggttagatagaatcaccaactcaatggacatgaatttgagccaactctgggagagagtgaaagacagggaagcctggcgtgctgcagtgcatggtacacaaagaggtggacatgacttagcgaaagaacaacaacatcatatgattttgtttgcattctttattttttatttatttttgttacagaattcatagtagagccaactttctaattatgtttttcttgactgtgatgaaaatggaaatgaaatgaatttttaactttccaagtatacattctgtataggatggggagctaaaggatgataggtagtttgtcaagtggggaagtagattaaccaaatatggatcatccaggcttgactaattgcatacattcccattcagtatttcatgaattatagagcaaaaaaaagttctggaatttcaaattccagaagagaaaattctagaatgagaaaattccttcttctcttcaccacggcaagaatgacacatgggggattgtagttcaaaatggtactggatggctgagatcagcctttaggaaaccacgaaggccttggcagcggatatcagcccttgcaggtgccgaggggctgctgttccgttaagccattatgcctcattaaacagacttgttctccttgtcagcgtgggctctttctttagggagtcatcgaatccagtttcagagaaggcattcggggtttgatggaagttggtggagcaggaaatattgacttggaagctgttgacacttggaaagagggagttaatttagatgtcagtattgatcgtgtgggctaaatttagacaccagcttgagagtttctctttggaatgtactctcaaaaaaaaaaaaaaagacaccttaattgaagtgccattaatagagacagaaagggagaggacaacactgtgttatgtctctgtcattatagcgcagaggttaaaggtttagatttggccttcataacctatgtgaagttataccacagttatattaaactggagctctgaggagcagtgatatcacagacgttgactaaaaataattttcaagtatttagaacaaatgaaactgattagtgcaactgatttgctttctgagggattacttaggattttgtgtctaagataaatggccccagcatctccagagaaatg

SEQ ID NO: 37480 - DNA, 1032 bp, Bovine  19866880767676
gatgtagtgattcatctaaatggtggttgaatattttccctcctcaatttgtatactcaaaggccagttgttttgccgatcttgaataaagaaattgttaatggaaaaaggaatgatttcattgatgatattgtgctattctttaataactttcatcagtccaggtgatcttgcctaaagaaacccatatttgaaattttgatcataaacacattgtgatgttttacgaagttaaataatttgctagttttattgtaaatattctgtatatgtaactttgacagtttggaaatagagacatttaacaaaacagtaaatcatagcacattgaagattcatcagaaatttaaaaaatatatttccaaagtggattatcagaaagtataatttagattatccaccttttcataaatacatgccaaatttatactatagatacatcttgagttggttgaaatacataattttaaaatggaatcaacataattttttctttcccaggtactaaacggcttatagaaggggctgttaatccaggagacacctgcttgatcattgaagatgttgtgtccagcggatctagtgtttgggaaactgctgaggttcttcagaaagaaggcttgaaggtcactgacgctgtagtgctggtggacagagagcaggggggcagggacaatctgcaggcccgtgggattcgtctccactcagtgtgcacattgtccacagtgctgtgtattcttgagcaacagaagaaaatcaatgctgagactgtggagagagtgaagagatttattcaggagaatgcttttgtggcagctaaccctaatgattctctcccttctgtgaagaaagaacccaaagaactaagttttggtgcacgtgcagagctgcctgggacccacccggttgcagcgaagcttctcaggcttatgcaaaagaaggagaccaatctgtgtctgtctgctgatgtttcagagtccagagagctgctgcagctagcagatgctttgggatccagaatctgcttgctta

SEQ ID NO: 37481 - DNA, 2206 bp, Bovine  19866880784127
ccttaccagttttgctaataaactaagtatcgagcttacaagatttttttctccttgttatttctcaactagctaagcagatggaacattttatttttcacaaataggtccactgatagttactaaaattcttgaagtgcttcactgtttgattagcatgttactagattatttccatattgtaggtggttggttgagttaaaagttaaaggtttttgtttgaaaattgacaaacatctttttttccctttctgaggtggggtctttaaaatagcttcctgggcagatcttgtgaatgctcacgccgtgcccggctcaggagttgtgaaaggcctggaagaagtcggcctgccactgcaccgggcgtgcctccttgttgcagaaatgagctctgctggcaccttggctactgggagctacactgaggcagcagtaagtgacagaggagagggactggggcaaggaaggcaggactgtggcactagatgttacagggaaagaaaatacctgcatctggggtctgtggacttgccgcccaaaacaacaaatcacgctgctgttactggggcagtatagtaatactagttggctagaatgcactgatggttagtagccttttatgtcttatagcagacactaaagagatttgaatggtactacaagagaaacattgaaacacagatattgggtcaaataaacatatgtgtccatatgtacctggcctttaagatagagtttttaccatctccccatgagttgaaattgaagagcttttttccagtttcttggaatcttcctgagtcacaaagatacacgttctcatgacagcagcccacgaagtgggttatctttttcagtctttgatattgattggggttctataggagagctcttaattagagtccagacacgttatttcctctagtaactccccattattaaaaattcttatgtgtgtgcttagtcgctcagttgcgttcaactctttgccactccatggactgcagtccgccaggttcctatgttcgtggggattctcaggcaagaatactggagtgggttgccattcccttctccaggggatcttcccaacccagggatcaaacccaggtctcccacattgcgggtgaattctttaccgactaagccgccagggaagttcttatagcaccatatatgttctaatgtaccatacccagctcccaccccctgcacaccagaacagcataagagatggataatcatctgcttataaagtccctcttcacattctcctctgggcaagtttcctagttggatagtcacctagaaagatgagatggattacctttgcatatattttaaagactactttttaaagtagtaggaacttttaataaattcccatgtaaaaattaaaactttatttttcatatttcaaaggttgtggaactgtgaaaaactcatggccctagggccaggtattaacccttcccttgatttgaccataaatgtctgtgatttcccagctgacttagcagagggtccatgagtcagtgttaatatttggcattctggatctggctcaaggacagtacattgattattggtaggtggtagtacttagtagcaagaatgaaacagtctgggcctcagggaagaaccaaattagaaagttaggcagggggcggaaaaagaggcagacctagggaatcttctaaagatgtgaggtaatggaagagaaattgtggaggcagtgttaaagtatagggaaagctgtggaggtggcttcacacctcttcacacctcttcagctagctctttacagcacagctgtttttatgtggtggctgtccttggatatctgtgtagatgggcaataagacttcagtgtagctttatatcattataaatgtattctagggtatgatttatatcctttttggaagtaggtaggtccctaaacattattaaaaatagataataatggagcatctagatttttgatgcaaatagtataggatttttagtgtttttagtgtttgcttatgggagaaggggataggagttattttagggtcttagtggagcaggtatgtagattcatatctaagattacctgtttagatatgagttcaatgtgacatgagaaaatacatccataagacagcagagtttcttatgtttggtgtggttaactgctgtcttgtcatctgtttattacatt

SEQ ID NO: 37482 - DNA, 1014 bp, Bovine  19866880784520
tagaaaatctcttagagcctctgcattggctgttccctgtgccgagaatacttttccgcaacggttcaacctccttctggtcttcatgcagaacacttcagtcagaaccatttaaagctgcagcatggccccatccatactcctgatcgcccttactattttttttttccagcttctaacatactacatgatgtattttaaattttattgtatgatttctcacattaaaatgtgaacttgccacgagagcatggacttttcttttgttgttattgtttgttttattcctgatatatgccaagcagttggtacaacagatattcaacaaatatctgttggataaatgagtggctaaaacttgaagacaattacatccattcttgacttttttcttctcctggacagataactgtctgttttcatcttttttccatggagctcccatttaatactctgaggtcttactggattgagtctcagttctctattcccctcagcctccagcctcatgtggggtttacaattaaacacctacacatcatctctttcactgtggccataaattatagcagaataagggcaatatacagcaaaaggaatgagtcattctaacagctggctttttgggacagcacgggatgtggagagatacagagctaagcgagggagagagggggaagaagcaacaaacttttgcctctcggatcgaaattagacaaagtcacgtctggaagcaagacaatgactggaagcttaaatgactgtttacaggctcttacatagagataggctttgccaaggagcacctgtcatctcaaaggtcaccaccctgatataagcgttcatcttcctgatgaaagttttgctttggcttgacaagactggaacctcagcttcgaccctgcctcatctatgtaaaaacaacctggaaagctaagagaattagctttgtccaaatcctaagaaatttccctttgggggatgggatttctttacctctattctattctttgg

SEQ ID NO: 37483 - DNA, 4137 bp, Bovine  19866880790384
tccatctagtcaagctatggtttttccagtagtcatgcatggatgtgacagttggaccaaaagaaagctgagtgccgaagaattgatgcttttgaactgtgctgttggagaagactcttgagagtcccttggactgcaaggagatccaaccagtcaatcctaaagaaatcagtcatgaatattcattggaaggactgatgctgaagctgaagctccagtactttggccgcctgatgtgaagagctgactcatttaaaaagaccctgatgctgagaaagattgaaggcaggaggagaagacgacgacaaaggatgagatggctggatggcattacctactcaatggacatgagtttgagcaagctccgggagttggtgatggacagggaagcctgggatgctgcagtccatggggttgcaaagagttggacatgactgagcaactgaactgaactgagttttatagaacatagaagcagcaatggggaaacagggcatgattgtctagggttgcatatctgaccttatgtagaaaaaagtttagagcccagagttggcttcagtattgaggatgggctgactgatgcgctgcattactaatcaaggggagcattttaggaacttgaaagttggacttgctgatgtggcaccccaggcaggtgtagctgcatcttggggctagaaatgtatttcagcaacttgtaccctactaaaataagggtcgaatttgaaaattgtttaaaatacagggatcaagtcaaagtgttattttttaaggtagaaaaatctgagaatatagacatcagtcaaagtcaagacatgctcgtaacctattcctagctgcaccctgtaggaaataagcaaggagttttctgtttaagaatggagacggaaatgattttattttgaaacagtatggaaaagtatacttgcccagagactcaaatgccaggtttccagttccagggtcagcatgtacagcacaatgactccctgagcctcaatttcctcatctgtaaaatcagattaccacctgctctgcttcccactcaaggatattatgaagagcaaataaaataatgtatttgagcaagcttgggaagtggtaggattcttcagatgggaggtgtcctttgacattaggtttctaatctcttggaccagaactgaaagcaatgaaagtgataaactactctgaatacagagcaataattatgggtcttttaagagtaaatcaccagtgaaaaaattgccctagagccagatgatgtaactgcagtgtgaagatgtgactatgcctgggggacactgtggagccttattcacgttcacacggatgcagaggccatgtttactgcgctgattgagaagagatctgtacttgccggttaccatatgtgtgtttctgcacagagagtctgggtgcagacctagacctgaggatggagtggggggactgttctggaagcctgtgtgtggagtgtcccacaggcaccgtggatcaggaggagagccgcttactgtgttaacaatcatctttcccttttcaagtcatttagcttcattgttcataaacatcagaggaacatgcaaattagagtgtgctgaaacgctttcatttggccaagaatgttttcaaagagctccctgctgctcagaaagagtcctaagcagctggcttcactgaactgtagaacaagcaaaaagatgttaaataaggattaagggctttagacagtaagtatacgatgttaaatgttttccctggctcatttgtgggcctttttcttaattcagcaggcaagctttctgtgaaagagcagcttcatgggtttctgtgttgagattttttttttcttgtccagagggagagataagaatttaatctaaaggaagataagaaccagatataaggcaggctaccctaatttttgattgcctacccatttgtaagttccattcccctcaggcccaatcagcacaaattgatgttaactggaattttattttaggagtgaaatggaccttggaaaatggggctacatgcttttgtgtctgaacccaatggtatcttgaatatgggttgttttcatatacagcttatcatcatggagtctgacagctccctggggtggggtcctgctgcagatgtttgacacctttctctgcagccacttagttgcccttagactgttggattcctcaggggtctgtgggtttagggggtagaacaccttggaacatggacgcacgtgatgttaaatgttaattttggcccttgggagctgggtgatcctgggaagtaacccagcttctggaagcctcttttatcagtgatagaacagacatttcctctgagcaagaggaatagggattggatagaggtgactaatgagaagaggaaatcagagcacacccttgaagttagggcttgcttactaacttgataaaagacctagaaggcaagaactttgcttcatccaaagctttataggggttgacaagtctttccagccccaggtctccctcccctcctccttgaactgtgtccttagctcacctctcttctctgccacagcttcactgagcatccaaggtgtgagagcccactggagaggtgaggaaggcttgtgctcacgtaggctaaaggctccttggagcctctcacccagaggtctgctcagtctcagccttcagctcaactgagtaggtgctcatgttgctagaggagccctgaggagggagaggtggtctccaccctccaggagaaagaaatgtttagagagcatcctgggaggtggaggaaagctgggtgccctgagatttatagatgctcacacttgtgcaggttgaccttgtgaggtctaacaggttatgttttcattttcagttagaaccttcgtgacagagtttaaactaaagaaaacatttcttaataccactgtggaaaaacattcagacctccgtgaagttgaaaatgagatcaccaaaatggtaagtttcccaagaggcatctccctgctactcctttgttttctagaacagattttattcagagtggaaacttcctgaggatcacctgtatcttcatttctatcatacttgaaaggcgaatgtcagggtaaaattaaaggcctctcagaaatagtagggaggtgttgagaactagtgatgttggtagaagcatttcttctaatgtgtcttcctgaactgcttttatcaatgccttggcatttatttcttttccatgtcacacacttagatgacatgcactagtaagagctgttggtaaagaggaaagacctagagaatcctgccatcccatctgctgttaacctgctatgtgacttttttgtgtgtgtctcagaacttggggcggagaaggcaatggcaccccactccagtactcttgcctggaaaatcccatggatggaggagcctggtaggctgcagtccatggggtcgccaagggttgaacacgaccaagcgacttcactttcacttttcactttcatgcattggagaaggaaatggcaacccactccagtgttcttgcctggagaatcccagggatgggagcctggtgggctgccatctatggggttgcacagagtcggacacagctgaagcgacttagcagcagcagcagaacttggggagaatgatgctttttctcaagggaatgacaaaggtggaggttaatcccattatccagggttgagaattcactgaatggattatctgggggcctttgattcttcttctttccctcctctcctcctttttgtcaggaaaaaagtaaaaatggagaggaaggaagaagagtcagaaatgaagctcagacagtattttgcttctcagctgctaccagagtctgagttaatgctcagaaacttgaaatttgccattaaaataagttttagagattgatttctgattttaattttacttgttctttatgggtaagagtatattagccaaaacctataagattttagaagaccatgggtttgatttgtgtaaaaattagattccagttccctttctgtatgagcatctactctgtagcaggcactttgcctcctgtaggaggtattgccaacacctttacagatgaaaactggagggctctcttcca

SEQ ID NO: 37484 - DNA, 1903 bp, Bovine  19866880809565
tttttacagcatcggaccttgcttctatcagcagtcacatacacaactgggtattgtttttgctttggctccatcctttcattttttctggagttatttctccactgatctccagtagcatattgggcacctactgacctggggagttcctctttcagtatcctatcattttgccttttcatactgttcatggggttctcaaggcaagaatactgaagtggtttgccattcccttctccagtggaccacattctgtcagacctttccaggtgttgactagacttactgtgatgatgtatccaaatactgtttccaaatacattcataatgtataatgtgtccaaatactgagtcatgatgtacacctgaaactaatgtcatgtgtcagttacacttcagtaaaaaaacaattcttaaaaaaaaaaaaagccagaattaagaattaggatctgtacataatcgaagcatttggtagagttgcagggaaagcttcacacatgtggttgtggtcagggcagatgccttatgaggacttttccaacagcgtggcgcagtgattctaaaatgtatactagatagtcttgaattgtgaggtactttttattgcattatatttagtattgaaccttttagggcaaaataaatttttttttttatactgttaaagtgtaaatgctctaaaattagacatcaaaaaggaattggtgagcatctgtttccactgtggagatctctggccagtttaagagtctcttcacctgcctttattcagttgctgtgtagaaggggcatggtgaacaagagcatattcttatttaaatcaggttagatacttctcagaaaggtgacgtttcaggtttttttcattttctgtattaaacagacttctttgcgtttgtaggtgataatctcggccagcagtaccacagcccacaagaagtcatcggcaaacgaggctctgatatcatcattgtgggccggggcataatagcatcagctaatcagctggaagcagccaagatgtacagaaaagctgcttgggaagcttacttgagtagacttgctgtttgagcctcttggatgtgcttttgggatggccctggagctagatacatggactcctaagatgctactggcttgaaacaataagcagcctttaatcctgcttggatttttccatgggtcctgtgtggaactggagttaccgtggtctacaggaaatatctaatgacttgtgatcactacactgtcactgtaatccgttcaagatttctttactgagactgatggtagttaggcagtcacaccccgttctgtcagaatgtcacattggaggactgtgccccccaccatctccagatcagaccttttgattcttttaactgccgtgagacagaaattttaggtcataaagagcctaaaactagtacaacatttctgtgtcctttattctctaatgtggtaccctaataatacttaaatattagccattctgcctaaaagtaatagtccaggtgtctacatggtgctagctcccagcactgctcccgaaagtgtctggctttcattgcaacagggagagggcttctctgttacatatggagcagctgctctttcatttatttaaaaagacaacagtgtcaagaggtctgaggtttcaccttggaagtttgtcaggggatcccacatgattgtcccaaagggcattgctagagagagagacgtcagccttcagattccgaaatagaaaggagcccagcaacagagttgaagttggtagtgacaaccatctgggtttccacagtggaggcgctaggcacatccacctttcctcacacatgcggcagttaggcagccctcttattctggccacaactgcactttttcctagaaattctcagtt

SEQ ID NO: 37485 - DNA, 1855 bp, Bovine  19866880842515
ccagacactgtaacatgtaaaaaatgaaccaggcaaaccatgagtcaaccttctcaggagctcacaaaaggcatagtatggcatttgtaaccttcaaaaggcagatggttacaaatgccataaagagacaaagtatactgcacataaagagaaaggcaaggattcacgtaggaagcaacacatgactgtgaccgtttaaggataggaagacttctaagggtgtctatgtgtgcctgtgtgcagtgtgtgcaaagggctcacggtctatcttaggcagtgagaatagtgtgtgcaaagataaggaggcagatgagtctacagcctactcagagcacaggatatgtatgttcagaaaaatgtgaagtggaagacaggacacagtacatttaaaacttcaaaaagactcttctagatactattgataaaaaaccagaaatatattaagagaaacacattattaaggagagagaataggagtaaagggcatctaaaatgatacccaataacttctgataccaagtcagagaagtgcttttcttgagttttcagtttaaacaaaacctcacaaatttcactttgggaccatttccatagtaatactccatctttaaaaatcatgtctgttttttcttgtctggttttcacccattcaagtattattccttcactgagcaacaagacacttgtagaatcatttctgttacagcaggtaaggctagaaagatgctcagagaaggattattttgtaaacttgagtatgggaaccatgtttgaatgtctgtgaccccatgggacctggcacattatcttgcttacagtagacattcaaatatttagagaaggaatgagtaggcagaaagttagactgatagacatttaaaattttctgaatttcaagtgtttgttacttctgctatgactgtcagaatggccatcattgctatcacctatctctcattgaacttcacttttttattctcatttctttcttcccccttgttctttccatgcatcctacagtgatccatttgattctgttcatgttatagccagtaagtcactctctggggaccagtatcatatacacatcatttgccaacaggactgtgctcacccaaaaccagaggccctgacaaggtgcatcagctctgaatctcctcttggcttccactacagaacaagtgctcgaccccggctgcacgttactctcacctggaaatgtttaaaaatctcaatgcccaggccaaatccaggctgatcataacacaatcagggctgggactggaaccagtatttttcatagctctaaggtgattccaaggtgcagtcaaggttgaaacaatcgtattagagtagttagtgattctcaaacttgagtgggcatcagagtcacctgaagggctccttaaaactcaagattgtttcattccagccctggggattctgattcaatagatctggagcagtgtccaaaaataggcatttctaataagttctcaggtgataacgatgtagctgagctgagaccacactttgagaagtcttgcatttgaggagctatagaggtggctcagatggtaaagaatctgcctgcaatgtgggagacctgggttcaatccccgggatgggaagatcccctggaggagggcacggcaacccactccagtattcttgtctggagaatcccatggagagagacaggagggctactgtccatggggtcacaaagagttggacatgactgagcgactaagcatgcacacacacacagacacacacacgctgtagaaatggaacatcttaattggcacctgcatcctagtacacctcttctacacatgagatttatggctag

SEQ ID NO: 37486 - DNA, 1227 bp, Bovine  19866880850452
tgatgaggaggtgggcgttgaagtttttgtagaggctcggatgttgatttggggtgctgccaagggctttcgagttgttagctttggctattagctctcatttacttcaaaatgtgtggttctgcctttttcctgatacaggtgtaaattcctggtactgatcttgcacttcagtcatgactaggattattttttggctcaaaatggaacaaagcagggaggagaaggtagaagggagggagaaggagatcttttcctaaggtagtttggagagaattggaaataaagaaaagagacaggcctaggatgttctgtgaaaatacagtttatagtggaaagtgattcctcttaggaatataggagaacagcatctctttggtgggaaagaaagaaaggaggcagtagaaaagggtgaaaccaagtcaggtgggagagtgagtgccctcgtgttttagaaacagggtacagagaccttgtgcagatcaagaatgagaatcctgttaccaatctcagtttgaatgtttccacattgactgttctgagcccagaatgcctttatagtgactgtatccttctgccataggaaatatcaatctgatgaaaattatatataatataaaattatcctaaggaaattaagcccagatgtggatattggaagatattaattggtcagaaatcgaaaccataggctggcacattttgggggctagagagaggacttgaaggtagtgtgttagttatctatttctgtgtaacaaattactctgaaacttaatggcttacagtaacacacagttttcatcttacagtttctgtgggtcaggagtgtagacacaacttactgggtctgctgcctcatggcccctcatgaggctgcaatcaaagtgtcatccaggtacccattcaatgataactcttcattgtcccctcccctagcaaccaccattctacctttttctccatgattttgcccagtctaaggtaccgtatctgtctttgtggctgacttatttcacttagcataaggtcctcaaggttcatccttgttgtagcatgtgtcagaagttcttttctttttagggccagacaatatactagtatatacataccatattttgtttattcatttatctgtcaatggacactttgagttgcttccatattttagctactgtcagtaaagctgttatgagcataggtgtaccaatatctcattaagacctg

SEQ ID NO: 37487 - DNA, 1231 bp, Bovine  19866880852284
tggacctagtttgtagttccccagaaattccctactgaagggagtttgataccttgcctcttctgtatcctgcaggcctgcagaccataaggagctcaaggttctgggagatagtctttacactggtgtctatagacagggaggcagttgggacttgtgcctgacagacagttaataaatacctactgaaggggagaaggtgttctgggccctgtctgttcttctttaggcttttggaatgacagcaggcatagctgtatatatggtacaagaaagaagtcaattttatctatcaccataaatccagctcttcttagaggatggctcagcctggttacctgggagaccccagcactgacctcaggaatcagtcagggcaccaaacaatatcacaggccaggctgtatctctgacctgcagacatgctattgctgctctagcatatttcttacccactctgacccgcaattccctaattcccagatctcagatctaacatcctaactcacatcatgatactcacatctagaactgcccagtttctctataaaacagataaatgtccctgtttgctcccattgtgagcaaggagttaataaaaccctttccccttgagcatgctaatctgaccttcagttaacaccctagttctgtttccctggaaacagataaagacagtatgtgccaacatgttactaaatcatgttgcctatggttaaaaaaaacaactactctcccaactggtaaactgaatctggattggaaagactatcaatgaactataaataactggtggggataatgttccttgatcttccctgaagagggtgactcttgtaactaagggtgtgtccattgccagaaccctggaagctgtgtcaatagagttgctataagagatactggctcgtgtgagacatgggttattgagccgtgagagcttctgcagctgcccaccatggatcttgtctccttgcacctgaattggcccactgcaaggactgtacagcaaggaaaccatagctcccatcttatattgtcctgagtggatcagcaccaaaggtggcccatagcagtctttgagtgtgaatgctcagtggagtctaaggagactccttagtatgtgtggtatccatattgcagagccaaatcctgtgtacatagtctctctttgtcttccctttccccaggctcctttctcactttcaacttctctcaatatcagcagtaa

SEQ ID NO: 37488 - DNA, 1087 bp, Bovine  19866880864664
cattgacatggttaagaaattctttcttgatatgaaaccagacctgtttttgtagttttatgctatctgctttttcttcctctgagaatgacagtagagcctggtgacatttagactgtggtttaatcattgttcataaacttaaaatgctggtttctctctgaccactgtctcagcctttcttttcctggctaaccagtaaagtagatgtctttcatgtgtgtgtgtgtgttttccccatttggtcctcactgtcctttgagataaacaagggtgcccattccacacagggaaaaataggagtgtgttgagagaggagggtatcatatgttgttttttaagaaatcccaagtcctgaaccaactgacatctctaagtgtaggaaacagtgactaatgctgctcttttgttctagaagagcaagaaaggttggggtgaagatgaggcagatgaagagtcacacacacccctccccccgcctatgaagatctttgacaacgaccccacgcaggacgaaatggtaggatctttttcacacttgaaagagccatgtgtgaaatgtgattttgtttagtgtgtgtggtgagggtagtaatgctctctctcccttggtatctcttatgcctcatgactcccagatgatgcagattccgtctgtattgggttatggggactaacttcaatctgggcagtgtaggggtgggttctcaaagggagaattctcaaagtgagaatctgcctagtaccaggtcctgctgatgaaggataatgtctctctcttcggaaacagcagatcccgaaagaaactacttgtctcaaagaggaagctgagatggctctaggtagtgatcgttctgttgtacataaccgttcaaccaatgttttagctgatggtttttctcatccttaactctaaactccaaatcacagtaacttccagtcaagcgtggtgcagacagcatgagggatggagatgctgctagggggaggttttgccatagatagacaaacccaatatgccaggttgccccagttctttggtttgcaaaaccccctggctcagtggcatgcagaggctcgctggcgt

SEQ ID NO: 37489 - DNA, 1151 bp, Bovine  19866880877721
tggatctctgggaacaggagcagaggctatgtacaaggtgcctataagcgcccccggggaggaggagggccctcagcagtctccagggcctggtgatgaagactgggggcacagtgggctccggggccatgggaggaggaccggaattctgtggcagtcttcgaattacagagtcgttctatcagcagggactccaatccactcactgggctgcctctgctcctctccagcaaagggactcatgagaacttagccaagaagctaattaatggctctgaggaggcggctatctctgtcctgagggatgggcagtgctgagtggggggttcctgaatgggttgatcttggcctgagtttcttgccccaaccctggttcagccaaaattgagcagcttacttcaaagtaggcgtcgtactcggcgacgatgtactcggagcgcggcttgttctggcagtaccacacatagatgtgcagcttccgctcctgcaaggagggaagagggaaaggcgctcaggcacctgagctgcgcagtcaacctgagagcgctaagctggtctaagcgtggagaagaggacacagatctggttcacgctctggggatgcaccagggtggctgaacaacagggacagaagagtaaacacagtgggcaagagcccatcttccaaactgccaaggaaggcaggaaagaaccccaacagctcagaaaggggtgaggaggaagaggagagaagggaagggattgtaaaatgcatgcaatgagcctgctgtgagggggaggggtggggcgtggggcaacactcacatatttaataaagagctgtgccaatctgtcttgctcctggatacatttttccagttcacccaggaaaacactaacggaggatggagaagagaagaaagccacattcttcagaactgtattacttctcaatgaggagataaatgacagaagactccccccagactctacccctaaggtcagatgcgggaggctggaagcgccccaggttccaggacaccctgatcctcagggcaatgcagcacttactccttatgccaatcataaatctggtgaatatttccaaacacgattttatcctttcctcgcatgtcctcggggacacccttttcttctattctcttcatgaa

SEQ ID NO: 37490 - DNA, 2410 bp, Bovine  19866880958783
caaagagacgtcagactgaaattaaggaggaaatgattgcaactgcccaggtgggagaggatttctgagcatcaaccccagactgtgagctccattaaggaagattctatgctggtaagacgggcacagagtaggactccaagaatttactgaatgaaactcttgggtagaggtcaaagttcatctgaaaaaacaacagtcaagggtgctgatccagcatcacccaccacaaccaaccttttagctgtcctacccttttatacaagtaagtatgaaatatcttgacaaaaaatattacgatcttagtcactcccaggcaaattgggggcaggggtagggaagccattttaaagtagaaaaactgaagtctggattttccaggcaaatgacattacacatttgagacttcagattaaatttttttggtggaaatctaaactattctattttaacaagctcaggaatcttttccacagaaggatgccagaggaactcagttcttgaaagcacacattttcacaatggatatgatgaggccattatttcctcccatctggactgttaactctactgtacctttgacaaagcaagctgatttatctaaaggagagcaaagcatacacacaaatgcagcctggacctagctacgttctgtgacccacagactgacctagggaggtgaatactatcaaagtagaagaaccagagggaacgaagtcttgctgaagcagatagggccaattctcagggtgtcaggccaccaggtagaccaaacaagagctcaatcctggccagcctcctccctaaagatggaggattttcagtcaagggcccagcagtgccaccatgagcccagtgaactactgtgacgtgccacctggggacaggagttcagtgaggaggctttccttcttgaggcctagtccctggtgggtcagacggtaaagaatctgcctgtaatgcgcgagacccaggttctatccctgggtggggaagatcccctggagaaggaaatggcaacccacttcagtattcttgcctgggaaaccctatggacagagaagtctggtggggtacagtgcatggcgtagcaaacagtcagacacgactgagtgactaacacttcactctttcatctaaggtaggtggtagaatcctgggctgtttacaaatacagtagattcccacaaagccaggaagcccttgctcctcaaacttgaggcatgctaagtcacttcactatggactgcagtgttagtcgctgagttgtgtccgactctttgcaaccccctgccaggttcctctgtccatggggttctccaggcaagaatactggagtgggttgccgtgccctccttcagcagatgttcccaacccaggaatcaagcctgagtctcctgcactgcagggggattctttattgtctgagcccgccagggaagaccttcaaatttgaggaataaaaccaaaatcacatagactgctaaagctactaccctgcatgcaacattcacccaaccacagatctactaactgacaaaatactgtgtccctgtgttccgggtgaagataaagtatgactgacttccctttccctgcccttcacaatgcaaataaggtggttaagagctaacatttgtgggatgctcacctaatcagtttacaaaacacattcataccttactcagccctcagtgtaactctcttgagattagattcgagtagacagaatcatcactgttgataggcaagatacaagagaggcctccaagtagactaaataacttgcccaaagctacacaataagtagcagaggcaagattaacattatgtcttcctgattccttaggtacttagtagcaccacagccagtccctacatctaggaaaaactttataaaaatcacacagaaaaacaagagagtccttagtcctggcttaaagaccataccttaatacaaaacccagaaaaagtatttgagctctctttgggggaagatgtgtgggcatgctctcctgataaacaaaatcactgattaaagaccaaactggggaggtgagacctcaggagcatccattaatgtccagagggactcaccaaaggagttttcagggttttatctgcactgcaggtgagtggaacctctgtcctagctccctaatggcatctctccagcaggagagatcacaacttctggaggctgtagccccgaatgtcatagacacgtgaccataacataccaagggcagctttcagacccagggacatgagggatctcatggcttttgggtggaccttggggccaaatgatttctaactacagcatctagtaccatctcttgagcaacccaaaaagaacgcagaaagaatctaagccctggatgtaaaagtccaagcacgccagatgctc

SEQ ID NO: 37491 - DNA, 764 bp, Bovine  19866880998499
agataatgctatggccgcatagtgactggaaagagtatgaaccatgttcaatacatggtggatgggtgaagagttgtaggtacaacagtgtgactggaaatctctaaataatactaataaacactagacagtcctacatattcattcttcttaatttctagtttaaaaaacaggaaaagtaaatatttgtcttgtagttttggttgtatgagattttctgccagcagatattttgtgagaattatttcacatggagatgtatttttgatgtattctgccatcttgatctggctccccacagatatttttcttcttacaagaaaattagattccatctctccacaacttcaaaatcttcatttctagggcgtacaccagtgggcactccctctctctagagatccattcagaaagtaacaaagggaatgaggttcctctgggaagcaattttgcctagaagccccaaatttaaactgtgaccactgctctgagctaatctgagaggaaaatatggttttctgaacatctaaatttggagatttccgaataggtgactgatgagtgaagatggagatgggcaggaactagagagaacctgaggaccttgtactagcagcctgggcccagcacgcccacagctctcttcctgagggatactgctgacctgtgggcccttgtggaatttttgaggaggcgaagcaaggtgacagatgtaacttctccctagcttggctctcgccctgggatacctgcaggtagagaat

SEQ ID NO: 37492 - DNA, 1015 bp, Bovine  19866881024797
ctgacggcccttcagcctctatctccctcctcgggtgcactccagcaacaaggctttgggcagaggaaggcagaagtgcttcctgctctcctagggctgcttatctttttttttttttttttttcctgctgagcatgaagtgttaaacctgcattagttaaatatgcagttttcccaacacattaacagcttattgaaaacactctctgcaaaaaatagtctctccctttgccacaaattgtctaagtgcttctacaactctaaaaatattctctcttaaatccacttcctcttctcttggtagtgccagcctccactggcggaggactgcgagagtgccactcagcacgcacagctttgctgaacgcaatctgttgctgttcagttgctcagccatgtcctgctctctgcaaccccatgggctgtagcctgtcagcctcctctgtccatgggatttcccaggcaagaatgctggagtggcttgccatttccttctccagggaatcttccccaacccagggatcgaacctgcatctgctgcattgcacgtggattctttattgctgagccaccagggaagccctgctaaatgtggtcagttttttttacaaatctgttctccgcactgagctgtgaattccaaggaccatagcatatttctctctaggactgaacataaacttttattgaatggatggatggagggaaagatggatatttttaacaacagctgtgctaggcagctcaggcttagcggaagaaaatttttggaagatgaggtaaattaaaattgtatattttaattgtgagtaagtgaggatgaggcaaagcagtttatcattaaagggctaggtagactggagctatttaaattccttaggctcagtcccatgaaatgcgaaggccccatggctcacaaacaagacattgggaagaagcatcagtacttgccatcaagatctcctgaagctactgccggaagaattaacggggaatcggcggaggaaggggactc

SEQ ID NO: 37493 - DNA, 1424 bp, Bovine  19866881025462
tgcagtcataatgccagccatgaggcatttaactccagggggtgggtattggtgcttgctgtgtaagaactgggttgggaacctgtgggagagaaagcatgtgggaagatgaagctaatttgaaaagaaatttccaactagggtaagaatcatggactttcagagttgatggaatcttggaaacctttagttaacactgtccccttcatttgtttgttttttattgtgctgaaacatacatgatataaaatttaccattttacctgttttaagtggcattaagtgctttcacagtgttgtgcagccgtcaccattattcatttccagaactgtttcatcattccaaactgaaactttacctgctgaacaataactccactccactcgccgtctctccagccccttccaagacttttagaagaggaaaccgaggcagaggaagttgtggctttctgttcacaaaatgagcaggtgccctgaagcctgtttctggttttccctggcccttgttcccccacccacagtatcctgctctccgcttggagctgcccacccccatcttcaggttgtttttaatctaaaacacagattctggcagacaagaagacgtgccttccagtgccagttttcctctgttcattttttattcagttttccagctcaacaaagaagaatatattttccacccatcccagccctgcaaggctgaagcaggacttaaataaagatcacacaaaggcagtatcatatggaaagaacactggcacaggagccaggaaacctggactccagtctagggcctgtcaactgtaaggcctcaggcaggttagcctttctgagcctgaggggtttctctgtgggagatcacagagctccaggagcacgggtgtttatctaagagatgttgaaccctttgagcctcatgccggttgtagaatcgaaagaccttgctctgctgaacttctgactctgagaacaatgaggccccaacagaagagaaagtaaaagagtttgtgttttgcccctgagacttgttctgcaggggctgtggcaggagtggcctgggtacatttcctcccgagccccagctggagcgtccacttggggctctgggaagggtttgagtggccagaattgacctttctttctcgcccagacccacaattccctagccctggctttcatgtcttcaaagagctagcctgctgctcccaccttagctgcctcggcgccttgtcccagattcagagcttcaaaataacctggccagacagattcaaggaaacttttacacccctggtcgggtgactgacctcccggcatcgccagtgtatttccactggtgcctgtttctgcgttttataaaaagaattttttttttcttttaatgaaaagaactctttggagaaaagaaagtgaagcat

SEQ ID NO: 37494 - DNA, 1918 bp, Bovine  19866881146353
ggggcgtgtactttgtgacacttggctgctttgtcactagtgaatgtgacccctgtgaaagtcctggcacttggatcagtcagaggactgatgctgctcactagggcctggggaggatgggggtccttattcgaaacatgaagggattagaccagctgatcctgaagatccttctagttccagcatctgttattccagacacatcagcctttgtattctgtgactccttcacttctcattctgctgcacacagatgtacacacaacatagcctttctgaggcttgggtagccaggagttgcctgctttcaaaaataaattacatgctaataaatatatgcattaaatcaagtataggcctagacagctaactcagattttaaaaaaagagatcggaagccatttgaaattttttgcttcctcctttttttttccttctctactttttatattttctcgaatgaccatgtgctatttgataattagggggaaaagtaagcaaagcaactaatagggaaaaaagttctcttttaaaggtgaaaagagatatgtgtatgttgaactatgtgagagtggctacagttgagcactaaatttagtaccgagcttcctggaaaccagggcacagagggaaactgggttgggtatgatatattgtcagataaagtgagtaatacaatttcatccataggcttcagtgttttgggggcagtaccttctaagaggaattttatgtaacgaatattgaggatcataatagaaaatgccttcaattgctgttttgtggaaattgtgctaatgttctttaaaaggtgatgttttctatatatactaaataggagcagagggtgtagtaatggatctcaactcatgaaagtgtttctgtgggcagctgagctgatatggtccaggtaaattgctctgtggtgatttcacttggtagaggaagagaatataaataactcagaaggttgtagatttagcaatacccttgccaaatatcagctgcttcagcaagatttttggcaagttctgggtcacagccaagtcgagggcaagcatcgtaacatgtgcccgaggctccagtacactgtgttgtaatgggagagggacctgtgttctttccccagaagagcaggtgttcttttcaccccttattataaatattagggaattagctttttctgctccaaaatggatggtcttctcatttttgaatggctgcttcaagggtagaaaatgagcaaggaagggcaattattaaataatcagcagtgctgttctgctgattataaacatagcacatttccccctagatgtattcagcaggtgcgcatttggtaacataagtggtgactgtagattagtttgaccaagccttttctccttttgttaagaagcaccaactctgcagaagtattcacactgcttagtagctttgctgtgaggactgaatgggattatacaaataaagtcttaggcagcacaatctggaggtctacgtaaagtatggcacattgttattggttgaaaaggcagcttgtaatactgatgataatgaaatggtgaaacagtgttccgtggagctcagggtcagggaaaacctagccgttttccttttgtgactttcagcggttgtgatgtttacggttgtatttctgaggccatttgctttgctggacaggtattcaggctgagtccaataaaaccgtcactgtgcactgagtcgatgaaataatgcaatttactgggaatagaagtgttttgaaggagcactcagcagtccgatggggctgtaattggtggatatagatggtgactctaacgaagttaggcccaagaagcgaagtaggtggagtgaggatttgggacatggtctgtgttgtgctttgtttttttttttttttttaaatactgaa

SEQ ID NO: 37495 - DNA, 1992 bp, Bovine  19866881155797
agaagaaccaggaaatttgaggtcacatgaagaccaggtaccaagctctgatccatgtggctggagtggcttcaggttggcagggctcacactgacctttcacttgctgttcgggtcctcgggtgtggctggcagcactgggcatgctgacgttgttcctatggatgtacttgagaaagacctcagcattccgccgtgccagggtgcaggcctgagagagacaaagtgtgaagtcccagtccagaggtgcacatgatctaaggcaccagagaagggatgctggcgatgaggcttctgggtctctgggtgagcagagtcctggaggccaactggagcaacatggatgttccagttctaatggaagaggttcacttattcttttaagtgcaaagcttaaaaaagaaaagctccctgttcctctctcctttccatcacaagcgaaaaaagaaatcagctactccttgactactacatgtattgattcagcatgaccaccatccccttgcagcctgatttccctctgccacatataagagtgcctcatatacgaccttggtgtaagtcgctttaacattagcttaatttagactcaagaaagcaaatttagtaatcaaacttattaaccacacgttccaaatataaatggaaattacccacattttagaaacatgtttgtctataaaacccaactccacctcaataagattaataaacatcctactgctgggcacagtatatcatgtaaaagagtaagagccattgtaccatccccttaaggctcacagagcagtgggtggcagagaggacaggtttgtcccatgctgctgtaccggaaggaggctggggcccagcaagggcgggagtcatgatcaagtcaggactagaatctaggtctactgatagagtgcttctagtttctctcaagaccagagagtttctgaaatttctttacaaagcagtatttttcctgttggtagaagtaatacatgttattccattaattttcagtccacagctttcagaactaaattatctctaaacaaaattgttaacttctaaactttttcctatttagcatctgattctacaaattatatggtcaaaactaagcttttttatatttagcatctgattctacaaatcacatggtaaaaaattattttaaatgttgctttcacaataacggtttctgggagctctggtaagattgttcatggttctaccaccctaaggtccatgaatttaacagctggatagtggtccacaactaaagaatccaaaatacatccactgatgtgtacagagagcttgatcttctgtccatttggcttgtaatgtccacaaaaacagcttctcaactatggttttaggcacatgtggaaaacctcagaacatttttttcccttcttcaaaaaaaaaatttaattttatgaagaaataccttcatacctctatttaaaaactttgacatgctctacttaaattgtttcattttaaactttgttttatcagagggaagacttttaaaatcatcttaagccttatatggaaggatttctatttaatcttattagtaagagctgattactaagggttcagatcaaatgcaggtgcagatactagatagatgggaggagagcagcaggaggtcatctttaaaaaagaataaaaataaaacttaaacaagtggtcaagtagagaaaatccctaatgaaagaaaagcagttaattacagaattgtagaaaatcaggggcaacatgttaaggtgtaaaaagtctctagtgtgctttcagaaacctgaaaggaagcagaacataaaagcaaggaatttgagagtaaatggatcctttgaaaaagttttcacacttgaaggttctgtcagagagaagatcaaaggcagaaggaaagaggcttaagaggtcttcccacaccagctgaaagctgttcagagctggactgtgtttcccccctgggaagctaggtatttctgt

SEQ ID NO: 37496 - DNA, 2773 bp, Bovine  19866881271858
tccagcagccagagccacagcttgtgttctaggtatacctggttctgtggtttggtacgaaagtagaaggagcctttttgtttcctgtgctcgccctctatgtgtatgtttaacttttatctgtgcttttgttaggactgcatgttggactggtcttcaaagaaacgtttataatgaggactttattttttttcctttcctgggtcataattaacagtttgaagcttttcattttataggtatagagagtactttttaaaaaatttggcttaaaaagagaaaaaaagcgctcttccttcttgcctctgggtcttcttgcccactcaccaggcttccctgcagtttattcctgtttggcatgaggctttcagtgcacccttctggaggtcatttctcagggtgtcctttggaaagttctttgtggaagggaaccaccagcaagccactgtacttctgtagagcagactgtccactttgaccaatggtgtgttactcagctcttgaggctcttgacaactgttccagtgtctgccatccatttcatcagaaatgctgttcccaacctggagtccttgggacccgctggagtactgtgtgagccagtctccaaagcttcatgaggttaactccagggatggagcctgttgcttttgggtggaattaaatcaaatcagtggggtaatgatgagtatctcctgctgattagaagctctgctacttaataaatgcagcttggttaatagtcttttgaaatgtcagctttacaatggccctgaggtggcaagtaataaagaactgtcgctggcggcaaggctgggaatgactgttctaggccaccattgtcccgactgtggatgcagagcccaaggcctcctcgctggggacacggtcccctgtaatgcacccacttttatgcagttttaggtataggctttaatctataatagcatttgaacaaaaggcttacgtggctaaaacaaaacaaaacacagactgtgtcacagtggtctgtcctatataggttataaggtggactcaagaacagaagtttttagcttcttctatatagactgacgcaaatcgggtctagaggctttctgctgtcttcctcttagcttgatctgaagctttctctgtgctcagtgaaggatctcatgcttcttcacttagctctgtgaaaagagggagaatgagttaggtgtgtttatctattagatccatattacatatattcacctaccaaaatgtaattaccatcatttgtatccagatataccctggctagtcttaaagcatattttcttccgttctagcttctggaagtacagaggatttaaacaactctactgctgtccacagctcctcggtgagtgggacagagagtgtccatgttgccaccacgttccccaacagtgtccaaaggacgccccagtcttcagccaccagtctgcgacctctgaatgagacagaacatttccccgaggactctgaaattgccataacttcatcatcagtccattcttccccgtcggaggcagagttgagaagaagcagtggagtattcgggagcccagggaatggggcattcacagagctgtccacagaaattgcatttggtcctacatcttccaacatctcaagggaattttggcaaaatgattctccaagtaagtcttcaatctctatttgatctattatggacatttaaaaattgttgaattttttcaaggggtcacttcaagaccatttgtaatcttaaaaaaaaaaaaaagaaaacagctgttttcttggataacactatctcctttatctggtagaccacattatcacattttgattttcagccccatgacaatgttgtgaaattagtgaaacaggcatcattcctcctgctttcttgtaggtgaggaaactgaggctcagctggtttaaggagtgcgtgcgtgatctttatctcactcaccgcagagctgagactcccacctccgagctcccggtgctgatgcatcttgtggctctgcagcttcaactgcagactgagagctggccgctctttaaagccagcttcagttatcttatgtacagatcatcttcacaaataaatctgcagagtatgtaaatatactcctcaagttcatggttttagtgagcccccatggttgattttttttttctttttttgtggtatttcagaattagaataacctttatttataatagaactgccttaggaaaatactgactaagcataatatttgggcacattgtgtttgatggacgtagcagcatactcactggctcgtactaccccatgttttaggggaaagaataaaacactcaagcctgtaagttactctgagactttgcacatgctgtttaaaagctccgctcttcaccagtttttggtattgctgtcttattgacactgaatagttttgaaataattgtttagaacatggaagtgtatgtcacgtcacacatatagtaaacactgtacaaggtccttgcagagggcaccttctcttggggagctcatgtcttagttgtggagggatctctcttacatccacttaatggccttttatgtctgacacctttcagcctccggaggaccccagctggccagtggctctggcgcagggaatggcagccctgtgtctcagacagaaacctcctctcggtccatcccaccagtcagaggtgaagagagcaccgctctctggttttccaccggcagcgagccctttgcaggtgcagcaggaagctccacttc

SEQ ID NO: 37497 - DNA, 1411 bp, Bovine  19866881318594
ctttcacatgcccttcagtatccctatctgtatgtaatgaaaatattttttatgtctgcagagtattaaacaggcatcatgaaattcagcacactctgccaaggtgctggggaagcattataaatgagctctgttatgatgaggactccttgcttcggccctctgggtgttcccgttccccatgcagctctcctggtaatagatgggttattgagcctggggacgggacccaagtggcccttgtcattttaataacacatggtcctcctaggacattagggcattaggagaggccctagggctgaccagaggatgtggaaatctgcatgtgtgggtcgagggaaaggcaggttgaggcccaactgcagggtctgagatgtttgggttaggatacattgtgaccagatttacatgcttggtgacactctgtagaggtcacgctttctggaggagacatggaagcttaggctgagatggcgcgtggctgtgccttattgccagctcctctggttgggaggccgtccttggaggacggtgttgagggtgattctgaggctaatcccaggctccctggcagagactcccctgattagacggtaggatctgcgtgggagtgaaggagggcaaggtgcgtgcgccccgcgtgcgcccctctctgctgtagcttctttccactgtcttgggaggcagtggatcacctgacggacaaactggggccatccagggagtccctgaggacagcccttaggcggattcagccactccaccaagcgtggcttctctctagtgtgacttgctgggactttgcattggaactggcaactgttagaagccgaagagccccatggatgaggactttccagtcctgtggcctctgtgcctcccacctgctgcccccactaatggcacagctcttgtgtcctcactcacaggctctttgcacagcgtttccttctctccatgtcctcgctgctcaggtgctgggggcgcggcttccagggatggcttacatctctggccatgagtcctgcccctcaccatggagccacattggtgaccactgacccctagtatctcctgcctgtgactcctaactctgctcacaccccagatccaggacacattcaactgctttgaccttgggctggcttttggagctcttgggttctcatgggtcatatgtgcccgaggcagctgggtttacttgccagtcaacaatcatgggggaaagtacgagcagttggcaactttgctatcttctcattgagcagatcttttcacgtgagatgctcagtcacaatggggagcaagttcttctttcaacacacacatacccacacttcaccacaaaaaataatatactacctcttctccaaaccactgacagtcggaatagtgtcaggttacatct

SEQ ID NO: 37498 - DNA, 1760 bp, Bovine  19866881342378
ttagttaattggtctagagtgagcccagattttttaaacttcccaggtgattctaatatatagccagggttgaaaatactcatctaaaaacctgattaaaggactttgtaatttcagaactgggtgttaattgaggtagtgacacagaaagaggagtggggggaggagaaaagaagatgttctctatctgaggcagacacagatatttaaagaacatacaaacagttgaaaaacatgttacaagtatgggcagcatagccagaaatacctaactctaccctagaccacagcctcctctctccatgaggaaattaaagtgatactctcaatctggcagcaaaggaaaacaaaataacattttattactaactgtgggcttgaaccctaagtaattgctatgctgaacggtctggtaactcagtggtaccctgaggaatgtctctgtccctggatcgctgaccattgtttcatcttatccagtggatcccaatcttcattgcacgttggaatcaccctgagaactttaaggtgggaattcctgttgcctggttcctacccatagagattttgatgttattggtctgggctgtggccaggacatggtgacttttaaagttctccagatgaatcttatgtgagccaaagttgagagcctagtctagtagcatccaaatcatcatttctaatgatatactttgaacaagctcataaacatctgatggtaagattttctatttacattttatataagtcattcaatagtcccatcagtaatcaacacagaatataatttcccccaagggaaaggaaaatgtggggatatgggtgtttttgagcctactaaatgccaggccctgtatctaccttatctctcttagtcctcataacaatcccgaggactcaatgttcagattcccatcttacacaggctcagaggggatttggaacccagagcctcactgttaataggttgcagagcctgcattccaacctaactctgtccccagagctctcaggttacccgagttcttcctaaagaggcccctgtgttcattaaacaggtattttgggagtattatgtgtcaagcactgtgctaggtcctaaagaagctgagatacatgaaatagaaatggccctggccccagggaacctacattactgtgaggacacagacaagttagtaaggaactgacctcaatggaagtgttctgacacaaggatatttgcaggacattgtggaggtatatcagaaagaaatttcaatacagctttctctagagaggctgacaaactatttcagtatgaatatatttcattacttgatggaaaagacaaacatcttattgcatctctggagagcccctaaggaagacaattaggcctcagattagattgaaaggagtaatgtcaatacacgaaaatactctttgctattgattgatgctgcttaccagttgatgggtattagctgagactcatgtcagtgtgcttgtgggcaccaggaaagaggcatgagtttctgttcttctaggtattgctggagtaactctgcatgttcctcccattcacttcattcatgtgatgagttgttgagtgtagaaatgcaataggcattgtcttcacccattttatttcctgttcatctcattaaaaaaaaatcaagtgaaattaatgaaaataaaggactggagtctcagggcaggcaggttctagaatggtgttctaagcaggtggctggcccctttgatgaggtacgagg

SEQ ID NO: 37499 - DNA, 1377 bp, Bovine  19866881344390
atttacttcactgatagaattttggggcctaaacacctttcttttgttatactaaaagcaaggttccttattcaaggagctagctgtgtgtatggatggctattatgcagtaaaaggtctgcctttgacccaggccacagtgtctgtgcttaccttgaaattaaccctttgcagattgataggattattaaattacacatatgcagtagttccccaatcggaatgtgtataagcattagcaaggtactgatttaaaatgtagattactaggccaaaatttgagaatcttattcagacttttttaatgagcttctttctaggtgattctgacgcaggcaatctccagaccacactctgagacatgctcttcttgtagaagattgcaagcttctggcccagaagatgtgccgattccctgctcattgtggaggtcctcctcgtacaccaggggtgtcaccaggcacgtatggagggctggtctgtgactaggtttggaccactgcatcagcaaggctatctttacagggtataaaaggcaggtaaaccatatagggcataacaggtatagagccaagtgaaaccctcgaagggcctttgtggctcagtggttctcaaatctgtcagcacagaaagaatcacctggagtgcttttatgactccgtctcccaggcctcaggccagtagggaatatatatgacactattgatactaacggtttcccagtggttctgacacacagagcttgtttgttgatggtacccaaaggccagagggtatttcaatcaagatatcagaccactactgtaaaaatgctttgaaaaaataagatgctcttaaaattctccagcaaaaaccaatgaacattagcagggtttctgctggcttttctcttccttctcctcctccttgctcactgtagacactaactagagaaggtgggctacactggaacggcctgaatgattccagatggtgagcatctggacctcttggcctgagtgatcctccctttaccctggagtcttgtacaaatattatcattttctggctgtgcagtgacatgaaaacagttgggagccactaggtcaggtgtaaaagaaacttgtggaaaaggagggactgtttggcccagaagtgattgtttttctgaatctctacgaggtggaatccacacaaacaggaagcaacaacatgcccaagcttgtccacacagggcctggcattcaatcggtgggggcaagatattgagagaaatgctaaaaaggcagcccatctcagactgcttggcacagaggcggtaacagggacatctgggcacagaccacagctccaccaatacagagaggataataagataatatccataataataagact

SEQ ID NO: 37500 - DNA, 1460 bp, Bovine  19866881345069
tttcctcttgactttctcttttctgacccggctcccctgggggtcttccccagacttgcccatgcatcactgagtctccctctctgtgtctgcccatcccagacaagcatggtgtccgtggagggcctcacgaagctggtggacccctcccagctgacggaggagttcgatggctccctggactacaaccacgaggagtggatcgagctgcggctctccctggaggagttcttcaacagcgccgtacacctgctctcacgccttgaagacctgcaggagatgctggcccggaaggagttccccgtggatgtggagggctcgaggcggctaattgatgaacacacacagctgaagaagaaggtgctgaaggcgcctgtggaggagctggaccgggaggggcagcgactgctgcagtgcatccgatgcagtgacggcttctcagggcgcaactgcatcccgggcagtgccgacttccagagcttggtgcccaagatcaccagcctgttggacaagctgcactccacccggcagcacctgcaccagatgtggcatgtgcgcaagctcaagctagaccagtgcttccagctgcggctcttcgagcaggatgctgaaaaggtaggggcgtgccggccagacctgagtggggctggggtgggggcacacacagatactgctagtccagctttttaaagctcccctcgtgtagtgtttattatgcatcaggtactgttctgtgcaccgtgtgtaaattaacccattttaatctgtcaggagtcctacgaggtaggtatgttatcatcatcccattttacagatgaagaaactgagaagctaaatatcttgggcaaactaggaggtgcagcgtggctgcagactccacacttttgcactgttggacactgcccctcttggggcgtgctgtgaatgggtcaagccggccgagcaacagaagtaacaatgctattaccagccgcaacatgacttagtgattattgccctgcactatacttgactattgacaaagcacttctgcatacagagtctcatttagtctatacagtcctttggccctttgagtgggtgatgttgggtgttctttgatcttggggctacaataggagcttgacatgggaatctagctgtcttccatttgaagtccagggctctcttcctgccataccactttatttctggaggtttttcctcactgctgcacattttctcaagcaagatattttttccagcagtaaattttcaaagctttccccttatcagtgaaaaagagaaaagtgaaaaaggaaaataccctatagtgcctcttggctaaggatgcaaaatatcttctctagatgctctctgagctaaagaagagagttgactgctgcatatacttttaagaggagtgaaaggggctctcttatcaattttctgggaataaaatttaaatacataatatcaca

SEQ ID NO: 37501 - DNA, 690 bp, Bovine  19866881350334
ataaattgctgaaggcttgtgcaccgcatagtacaggagtctatcaaagggaagtcctaggaatggagcataagaaatgaggaaatgaagtgacaacaaatggagtggagtcgggggcacgcaggcagtgtgtgtcatcagccccattctgggctccaggtcagctacagcgggagctgtggagggagaaggagagatggcgtttgcccttgcaggcactccccggctggcagaaggctgggggagactgctctggagctctgcgtgagattcccctgacattggttcggtagaggagacctggggcagaaagggggtctgatcccagtgccatagagctgtcctctgaggtgtgcaggagccacaggaatcagcctgagagaaaagtgtgggagctgaggggtccctgtcaggaagcctgcctccaagaggggactggagcaaggggcccacatgtggtggagaaatcacacagactggaaacgggtttttttcagggttcgacgagaacctggacgtgcagggggagctgattttacaagatgcctttcaagtgtgggaccccaagtcgctgatccggaaagggcgggagcgacacctattcctcttttgagatctccttggttttcagcaaggagatcaaagactcttcaggacacacaaaatatgtttacaagaacaagctactgg

SEQ ID NO: 37502 - DNA, 1794 bp, Bovine  19866881353087
tctttctgagcctttccctggagtccggatatgtctgctaatctccaccttggcctcattagtgcttgtgaaagcccagaagatacagtcatggatctttaagatccctctaatttttccggctccaatcagattctttcattacagaggagaacttaccctcactgccttcccattttctgagcatcgacagtgacagtaaagcaaagaatgcatctcacagtctgtctggtgcttctggtggcagaagtctctagaagtgtggctggctctccatcaccgctctgcctgcctctgagccagtgtttcatctctgttctcatcacttgtacatcttcctccccccgtcaagtccttagcttggaatgtatcttcatatgcgatatttcttccccaccgtttgattatatccacttaaattcagacaaggcaatccatgctccctccattgtgacagagttatccattccatctgatcagatcagaagaggtgaaaggttttcttcatattttatagaaggggaaagtgaagatcagactacccaaggcacagagcaagctccaggagacgaggaatgaaggcaggggcttttaggtttccacttacactcccccaacccaatttaatccttgtcaaacaaaggtaataataataagttaaaggcaccaaaggtaccatgtcaacttgaggaagccaatatactgagggctgtgtaccgactggagtttttaagaagtccacctgcatcctgaaggcacagcacagagaaggctgagctggaagacagaatacaaactcccaaaggcctctagtaagtcacaaaagttatcagaagccaaagcacaatgaccaatgttaacaagtctaagcatatgaggaggtgagaacttaccgtgtccccgatcttcaggccctcgcacttcctctgaccagggtaggatacaccgtcctggcaggtagcagtgaagaagagattaagatcctcaggctgatcccagacagacagctccactttagaccggatgctctgaacagagagagaagaagccggaaccactcagtcaaggctacagctgagatgctctccacactggtcctctgatgcccacatggcttcctctgactctggggtctcaagccaaggtgagagccagtgagctaggttcgctgctcctccctcatccctttcctcctctccacacccacacaccatcgtactaggctgggcctgaggtctccctctgggagctcagagaagtggctagtggtccacctgccgcacgataacctcatctgattccaagggtgatgaactgtccctgctcatctctgcagagccatctctcatccccaccctcagctttagacatggagctcttcatatcttgccaggtgctccctagactatgggccttgcacatgcctggggttacggtcctttgctcaactgctcctctctctcctcccctgaccagctccttatcatcccttcccatcagctcagcaggcactttctcctggaacccaccctccactgctcaccatcacatccatcccccatcagatgaggtccacattcatgagctctcaactactttctgagagaacataacatcttatgtgtggatatgtcctcaagacaatagatgaaaccaaaatcgagttaaaattatccatcagaatagaaaagataaaagactaaaaacaccaaatgttggaacggagttggggcaactggggctctcaaaccctgctggtgggagtgtgcacggtacaaccctcaagaaaaacat

SEQ ID NO: 37503 - DNA, 630 bp, Bovine  19866881373330
gaaatcgtgactgtcaaatcaagagtgatgagagttttccctgtgccatggctcatttttccaggcatgctttgaagatactcctcctactaatctgttcttattctgctagttagcaagctccagggctcctaaaatatttggtctttttgatgtgtaataaacacttcttcttgggcttcatataagttcattgtgaaacaatcagtctatttcattttagccctaccaatacctgctgtttatacaattcctttttctatagtaatatcgagattgacactttgggggtttttcctattcagtttaacatgtggattaataggggaaaaaaatgtccccacctgaaaatgtgcactgtctgtaaagatatccccataggagtatgtctgtgtccggtcgctcagttctgaccacctctttgcgaccccatggactgtagcccactaagctcctctgtccatggaattttccaggcaagaatactggagtggcctgccattccctactccaggggatctttccaacccagggatcaaacccacatctcctgctcctgcattgggaagtcgattctttaccactagcgccacctgggaaacccataggagtgtgtcggggaatcaaaat

SEQ ID NO: 37504 - DNA, 900 bp, Bovine  19866881386126
ttgctcttgcagcccaagcttgcatatgctggcagaaggtcacagttaaatttagacctgaccacctcactgggaaggagctgggaagctggctgtttgaggagatccaccagacactctgggagaggtggctgattatattccaagtggaagcaccatttggtggttaagacataagttaaattgggaagggggtataattttcaaaccaaagcataaagaaacagggacttaaaaattagaaagacgggaaaaaactcaaaaggttactgaggtcttctctgttttcacacagaatccaagtaaataaatagaattgtctgttttttaaacccttgtgtggaatgggaactggaaagagtctcagaagccatcgagtacaatgtcctacatgttgtcaagtcaagtctacaacactactgaagacgatcacttcgactaggctgaaaactgtcctcacacacgaggggggtgtattcctacaagaagtggcagctgtggatggtaatgccccaaagcagaaactagagccaggggcaggggtggggaaacccaaggtgggtgggtactggtgagtgggaatttagcccctttctctggatcccagtttcacagtatggaggaatatgacagctcccgaggactcaggtcatgaattagaaagtgaggccctcaccagtggtcctttgtggacactgaacaggttccccaggtacttgtggatcacagaaaggcacataagctcttgaagcaagccagtgtcaagtaagggaacctccaaaaactatctagctttatgcctcttttactttacgcccctgtgtttgttttcccatgatagtgagcaaaacttttgcaaaagactcttttaaatgaggctcagaatgcaaatgatacaca

SEQ ID NO: 37505 - DNA, 1650 bp, Bovine  19866881424532
atggaagaccgactgaaactggtcaatgcctcagtggccttttataaaacttctgagcaggtgagggagagggctgtgtgggcctgagaccaatggagggcagttttctgccacacatggcaagtctgtaggatctaccttagcaagaagccaatcctctcagcactagcctgagagcacaagaatgatttgtggaaacaccatggtttgcttccatatgattatttccattaaaggagtgaaccacgtgatttgtttcttataaatttctcaaactcactagatgtaggtgttgaagtagaaattggttgggcatatgctgaatgctaggtttcagtgatgtaccagttagctctggccacaataatgctgtataacaaatcacccccaatcccagtggtgtaaaacaatgaacaactatttttgcttaggtatctagtattcagctgatcttggctgagcatagtaaaactaggctccaagctacaggttggaactagatctgttcctgtatttctcttccttcttgactggcaggtatttgagccacatttatggtgaaaggcaggggtgcaagagcccaaaatctactgtgcaagtgcatttcaagtttgcctgtgtcatgtgctgtaacatccttttggccaaaacaagtcatgtgtccaagccaacatcagtgaagtatgcctcctgtgaggattgtgaaaagagagtgatgagttcctgaacacagtttgctgctgctgctgagtcgcttcagtcgtgtccgactctgtgcgaccccatagacggcagcccaccaggctcccccatccctgggattctccaggcaagaacattggagtgggttgccatttccttctccaatgcgtgaaagtgaaaagtgaaagggaagtcgctcagtcgtgtccgactctagcgaccccatggactgcagcctaccaggctcctccatccatgggattttccaggcaaaagtactggagtggggtgccattgccttctccggaacactagttaggctcacagttctctgatgacagagagccgtgtttcctgtactacaccgggaatcccatgaatgagatgtaacctgtccgtcagtgggccctgcagccagcattcacctttacaccttctctcagtcctcctttcaagcatttcagagaggtggcatcttacatggcctcagaagtgagagcagcagactaacataataaagagcttctccagttgttttataaattaagcacagcccagtcacacctcagcaagctttttttaaaaatagaaatcgatatgctaattctaagatttacacagatatgtgaagaacctagaatagccaaaagcaatcttgacaaagaacactgtaggctttataccacctgactttaagactctaaagctgtagggatcaagacaagatggtattggtgtgagaacagacacagtggaacagagtagaggttgcagaagtagacccacatatatacagtcaattgattcttgaaaaagcaattcaacaagtaaagttttttaaaaaatggtgccggataactggctatacatatgaaaaaaatgaggcttaatccctttgtaatatcatatatagtttttaatttgagatggctcaacatgctgagggag

SEQ ID NO: 37506 - DNA, 1490 bp, Bovine  19866881429671
gttcctccatccatggcattctcctttcacacacatggggtctttgtgaccccacggaccacagcctaccaggttcctccatccatggcattttcctttcacacacatggggtctttgtgaccccacggaccacagcctaccaggttcctccatccatggcattttcctttcacacacatggggtctttgtgaccccacggaccacagcctaccaggttcctccatccatggcattctcctttcacacacatggggtctttgtgaccccacggaccacagcctaccaggttcctccatccatggcattttcctttcacacacatggggtctttgtgaccccacggaccacagcctaccaggttcctccatccatggcattttcctttcgcacacatggggtctttgtgacctcacggaccacagcctaccaggttcctccatccatggcattttccttttgctcacatggggtctctgtgaccccacggaccacagcctaccaggttcctccatccatggcattttctttcgctcacatggggtctctgtgaccccacggaccacagcctaccaggttcctccatccatggcattttcctttcgcacacatggggtctttgtgaccccacggaccacagcctaccaggttcctccatccatggcattttcctttcgcacacatggggtctttgtgaccccacggaccacagcctaccaggttcctccatccatggcattttccaggcaggagtactagaatgcattgccatttccttctctaggggatctttcccacccaggcatcgaacccaggtctcccgtattgtaggcagatgctttaccatctaagccacgagggaagccactcttttcacacacagggctcagcaatttttaaggaaactctttaagaatgagtctccttagcagtgttctgttttctcagcaaaaacgactttaggtaattggtggatagtgaatcagacaattccatggacacaaactgggtggaagtagtccacctaccacatgggtgggagtatggccaggagactataaaggtgtgtgtgaaacagaaaacagggaagaaatgaacaaaagaagggtacagatataagaactcaggtggcaagagagaggagaaggcaagagaaagggggaaaacaaaagtggttacttaaaatacccccacaagggcaaaaatgtttacgcttatattgtgtcacctatttctacctctctagccatttagcaaacaatagtatttagttctagggcatatttgacattgcagacacaaaccattatcataaattatctataaataggagagtattacaaattttagcaccatcaaaaagaaaaggaaaaaaaaaaaaactattagatttatctacagctataagagagaaaacggtttttggttctataataagacagtcaacagacaaagtaaaaagaaattgattcagaggaaaagaacaaagag

SEQ ID NO: 37507 - DNA, 5005 bp, Bovine  19866881573524
cctgccattagagtatacaaataaagtgagggaatattataggacattaatttcttctagtaataaagtggtaaatagcgtagggtgggataggcataaattcatgacactgaagtaaagaagggagattcattggggataaagatgaagtaatgcatttaaggagaactaatccacactgaattaaggaaaaggtaggctctttagtggaccttaggcttatccacaaaacttctgacctcccctgactgtttgagggttattcacctatgtgaggtcttgaagggagtgatccccattttttattataggaccccaaatgaccagactcttgcttgcctgtccctttgtgcccctggtagggcatgtgacttaggctgggcccaccagatgcttcagatgtcatgaatgatgcaaaggtaaggtgatggtgagaattcatctttggggcagcaggtgctgatagcatcttgatcagactgctcctgttcaggaatctgaatgtgctgctagctttgggtcttgcctttttccaagcctcatctttcagccttctgatgattctgtgaccctccagtatcctgtaaacacatgcttaaaaaatatttcctgtcaagaatcctggctgatacagatttttggtgctagtttatggccagtgttcagtatagcttgatgcattgttaaagcaaggaaataaaaactgcggtgaggaacgtcttcatggagaagggtataagggacaaaacggaagatgaaatctaatgcagctgtaacagctggacaaatgagcgctaaaaatacacggttcagggcatttgcctaaagtaaaatatcaatagaaaggaaatggcacctcaaatactttcctgttggtgtagatgaagttcagctcaggagggggctatggactcacagactcatgacagagtgtgggacacagctgcacacaagcagcactgatctttgcaaggggacaccaagcagagcaactcttccctctctcctatctgctggtaccttgtgggctatgtggatctcactttctcatttaacacttacatctctgtattggcaccaagtggatcaggatgaactaaataggagccccatggaagtgaagccagtggaggaaatagtgtgtctggtgccccccaacctcacattgaggtgcagcagagccctgaggagcacccactcatgtcaggggctggagggtgcgctcatggaggaggagaggtttatgctgagtcttgaagcacaattgggagtttaagagacagacagtgagtggcttagggatgtggacagagggttccagcaagcagagaaatcatgctgatggattctgagtgtgcagagtgtgggactggaagtgtcacagaccatgaagggccaggtatgtcagggcattggggagtcattgatatttttatggcaggggcattcattatgaccagtgtgcatgtaggtcatgctggcagaggcctggggacagagcttagcccttagcattcttgctggcagtggttcacaaaggatagtccccaggccatcagcatcagtatcacctgggcgcttgttagacccgtggagaagggaatggctccccactccagtattcttgcctggaagatcccgtggacagaggagcctggtgggctacagtccagagggtggcacagggttagacatgactgaagcagctgagcatgcacacacttgttagatatccaaatttggggccatataccagacctactgaatcaagaaactgtggggtaagacccagaaaatctgtgttttaacaagcactctggatgaatctgtgattcacggggtcgcagagtcggacacgactgagcaactgaactgaactggatgaatcagaccagtcaatttgagaagctctgtgtaggccgtacaagaagtgatggcgggtcaaacaaatggtggcagtgccaaggtggtggggtggatctgaggtgtttggaatatatctaagatgtcgaatctggaggatttatgatcagatggggtgtgggtgggtgggtaccaggggaacagaagggagcagaagcagattctgatgttgagtaatgaaactgcctcctcatacaggtgtccctagtgggcttcctattccttttgggcttgtacatctcatccttggcctcctgtatgggaggcctctatggagccccccggatcctgcaatgcatcgcccaggagaaagtgatccccgcattggcctgcttggggcaaggggtgagtgaccttttctttgagaaatgtatgtttttgctgctcaactgactgttggccaataaattgctctaagtatttctgataagagccactggtctggttctggtagggagaaacaagcctgcacccctgtcctctggattctttggtctggggccactggacaaagcatctgtcaatgtcataacttcagcactgggtgccgaagtcacagtagcaccatggaccatataactgtcacagtagcaccatggaccctgccacagcagagagaagtagtgccacagcctttagtaaaaataaattccggatcctccaagtttagcctagaggggagaacctcttgctgaggagaggacctggtccttgcagctctaactctgtcctggagattcacctcccctttggggtcgctttatgctgaactctcacacttctggtctctgggctccctgttaatcttcatagcccgaaccctaactgatacaacttggtcgagtcaaatcaaatgagacattcctaaaactgaaggggtgacaagagaaggaagccgagagaaccccacttcccgataatgtgttttgcaagctgtcagtcagttcagttcagtcgctcagtcgtgtctgactcttggcgaccccatgaaccacagcacaccaggcctccctgtccatccacaactcccggagtccacccaaacccatattgcaagttgtagttgatttctatgttgtggaaacacgacagggtttctccccaccccagtcccatccccagccccactcttgtttgatgccacgtaggtacaaatcatctttaatccctctctctgccttcctctgcttcttatctaccagtcagtgtggacgggtaggacaagtgactatcatctctagtaacttccctgtggtatgtgccttttattttattttaatttatttttattaggtaacaggtgtagttgttcagtcgctcagttgtatccaactctttgtgagcccctggactgtagccggccaggatcctctgtccatgaaattctcgaggcaagaatactggagggggttgccatttccttctccaagataatgtgtgtacaggactcaaaactaaaaagataccctgagaatttttgctccctcatgagtcgttctactttttcatcacccatagccacgtcctatcatagctggttttattagtttttcatgaatccttctctctctttacagcggtggtggtctgtgtacattgttctttgccttgcttttcttcatttaatatagcttggaaatctgtcttttcatatgaatatagaaagaactttctcattgttttcccatcatgtggatataccgtagtttattaaccagttccctatagatagtatagcttccagtaaacagtgctacaaaggatactctttgtgtgtgtgtgtgtgtgtgtgtatgtgtgtacaattttacacatatgcagatagatatatctataggatcaattttcctaagtgagtttgctggtcaaagggtcagtgcattttaatattaatagatattgccaaaacaccttccatgggagctgtatcattttgtatttctaccagtaatgtatgacagttactgtcttccagcagctagcatgactgttagacctgggccaaggaccttgctttataggactctgttctggtctctaggagactcctgaggtcaaggggacatgcccttagcctgtgggcttacataaacagatggtgaccacatctggcccagggaccatggtttgccagctctggattacctcctccatatgtatatctaaacaaaatagttcagttttgcctgctttttaaactttatataaatatggcatgcttttcaggcatcattatgtgactcacccatgtttttgctgatagcagcggcttgtttattatcatctctatatagcatttcctcatttgctgcagtttctcactaatccctgctgtcgtggtatgtccctgtttgggactgttacggacagtgcagggaacagcctttagtagactggttcacgtgtggagttcttccagacctgttagtggaattgctcagttgtaagttgtatatatctttgcttcgtagatagcactgaactcttttctccaaagcagttgtgttaatttaaactcctgtcagcagttggtaagtgttcccattcttctgtgttcttgccaatacctggtattatcagatgttttaatttttgccaatctggtaagtgtttaatggtatctcactacaggcttaatttgcatttccctgattgctaatgaggttggacatctttcatatgtttaatagacatccttttgcacattgtctttagtgggttatctgtcttctaattattttgtagggattcttgtacattctgaattgctctttgtcagctacatgtgttaacaaatatcttttcccattctgcaacttgacttttatttgtgctatcttttggtaacagaagtccacgtgtgactgttttatcactttacaacccacccttatcatagtctttcctggatcactagcatatcctacagtttacctaagacctccttccacttatttcagaccctccttttatttcattagtttttgacaatttactttgttctttatagttctattgttagagtatgttaaatagctaacccactccagtactcttgccggagaatcccaggaggaagagc

SEQ ID NO: 37508 - DNA, 723 bp, Bovine  19866881712964
gctggccctcgcttgctccagcagaacctggcaatcagtaaaaggcacgctttggctcagagcaacagtgcttgcgggggcacctacctgagcagaggacacctttgttcctggcgcaggagaagttgtcgcactcacagaaggacccgtagatcttgccaaactcgctctcgaagcaggagcactggttgcagctgcactggccgcgcccgctgcacagtggcttaccctccgcctcccggcacaggttctggtacccgctctggctctcgccttcctggcactcgcacctggtacccaggtagccggggttgcactcacacaggccgcagacgtaagtcccgttgctgctgcacctggcgctgttcgggttccagccccgcgctgcagccgcacctgcagttgtaggtgacccccacctccaggctgtcccggaagcccacgggccgcagggtgaacgtgtgctgcacgtgcttgctggggcagctccgggcctccaccgacacctcaaaggacgcctgggcaggagaaagagaggggatgctgtggccgtggcgtgactgggcctcccgctccctgtactggcctccccatcacccaggggcctgagcacagttcctccaaggccctcagtgcagagctgggatcaaatctggcccctgcccacacgcagggaggccactccagccacccgaggaggatgaggccccaagtcagcaagcc

SEQ ID NO: 37509 - DNA, 1942 bp, Bovine  19866881740863
ttttcactctcctatttctctctgattgcttcatatgtgacctcttggctccaaatcagtccttgatcctggatcattttctctcacttctcccactatgccgtgggcactgtaagcactagtgaacaattagtttgagagacacagattcacactctagttggcaccctctttctggggtacagaatttcaaaagtcagaatttttcctaattctacctttttggctccttttacaaattaacagttgtgtttatgaataattctaaagaaatgggaaaatgcttatgataaaatgtcaagctaaaagagaaaggatgcaaaaataaatatacctgtctgagttcaactatgtaaaaaatacattaaaaggttggagaaaatatattaaagaaaaaagaaaataaagactggaaggaaatataccaaaggttaaagaggggttatctctggtaggactattaaagattgctatttttccatttagttttcagtctctcttttggaaatgtcagaaactgcacttaaattccagaatgaaagtcaaattggattctatctgtagaggagtcggtgagagtgaacttggtggtgaaaaagagttacgttagggaaaaaaaaattctaaaaatatttcattcagggtccaaacagacaaacaaaaatcactctaggaactaaaaatggaggaaaattgactacccaaacaacagaaaagctaagacgccaaataggatggcgtcagagtcacccatggaaacttcccatttccaggacaggtgggcctaacttccttcgcccagaaaatggagccatcagagagagaagagaataatgccccatctccttttttcctccacccatcagtttcctgccagtgtcttccattagtcaaattcagttagaggccagatctcacggggcctgggaaacacagtctgcaggggctgggcaacctgcaaaacccaacagggcaggacaagctgggagaggaggggatccgaagggaaactctctcaggaccagcacgaagggggctaaattagatcaaatatcaaattctaggtcaggtcaatacagaataaaaggacacatgttgacaattttcaggagtatgtaagttttgcacacatgcaattagttcaaggcaaacacattctattttaacagccatctaaatatcagtatttcccaaactttcctgatagtaagagtcccctggagttatttgttaaacacacaggttcccaggcccctacctgaagatatgaattttgatctgcccagaccttctgtggtagactaaaagacggcaacaaattgtttgctgctgctgctattgctaagtcgcttcagtcgtgtccaactctgtgcaaccccatagatggcagcccaccaggctcccccgtccctgggattctccgttgccatttccttctccaatgcatgaaagtgaaaagttaaagtgaaatcgctcagtcgtgtccaactcttagtgaccccatggactgcagcctaccagggtcctccatccatgggattttccaggcaagagtacttggaagtggggtgccattgtcttctccaaattgtttgctagtcctcccattaagagacagagtccactccccttcctttgcatctggaatggttttagtgacttgcttgaccaatagaatgaaatggaaggagccgtctacggccttggagcatctgccgagtacccttgaaatactcacaatgagaaagccagccacgacacaggaaatctaactaccctgagacccccatcctatcagaaaaccccagagagccttgtggaaggaccacacaaagagagggaaatggctggccagctcagctgttccccttagcatcagacatggtatgaagagctgtcctagacatcccagcctctgcacacacaatgtgagagtgtgtgt

SEQ ID NO: 37510 - DNA, 4057 bp, Bovine  19866880415214
tggcatctcgaaagacactcttgattgtcttaaactggggtttgtcttactggcatctaggtggtagaggccgtttgttgctaaaaatcctacaatgcacaggacaaccaccacagcaattgtccagctcaaatgcccatcgtgttgaggctgacaaaccccaaagaaaaatgaaagccagcctaaagcacaaccatgcgcctaccatattgtcttggctcagaggtcaggaatgtggctaagactgaagttcatgctgaagcagcctccacagagagggggctggatgcaccacaggcccatatcttattttcatcagcagaccctccttttgtggttgctggtgctggtagaccgattcctatcacttgagtcagggaaaccaaaaaggcaaaggctcgtggttggtgaatcattttaaagaaggacgtggtctccttttcccctgactgatgtttattattgaagacaaaaagcagagaaaagggaagaagtgaaatgtctatcagttcctttctgtgactcttcaaaggactgatactgtgaagtcatagaaagggcttgcctgctggatgcctgtgggatcatgagtttatctgcatcaaatcatgaagactaataattttaagagacaacacatgaaaacgagaacctcttctctgtatcagctaagtgaggtacatcggtgtcgtgcacgtgtgctaagttgcttcagtcatgtccgactctttgcgaccctctggaccagagccagacaggctcctctgtccatgggattctccaggcaaggatactggagtgggttgcaatgccctcctccaggggatcttcctgactcagggattgaacccatgtctcctgcattggcaggtgggtcctttaccactggcgccacctgggaagctctcacattggtgccagttctcacaaaaagaacaaagtctcagttgcaaggtcagtttaaaaaaaagaagaagaagaatcatttgttctgagaaggcaaattccaagcaagacaacactcagcagggagggatgcgctacctgtaccagaagggctatagagagaaggatcagttgctcagacagataagataacagaacctaagacagaggactcaactcaacaggaaagtgaaaagttttcctgaaaacaaaaaatggacctgttgaatttaaagagcaggaaaaaaaaaaaaaaaaaaactgggtctgaaagaaaatgggctttgggagctgggagagaatctaggactaaagaaaggttgctgatccatctccatcaaggaactccattttttggcctttcctgagtagaggcagtgtccctcaggagcctgagtcttcctgagataaacaggatccactttacatcggggaccactgaatgatttctcattcatccgtcccaactgcttctcctcaccaggtcattttcacagtcaaatcctctgcaggcccagtggcccctttctgtctggtcccacaccacttagcccccactcaccctttccagctaaccactgcaaacatcactctgagacaggcagggctgaggagctgtgacatccggacttccttggccgctcctatccttggtgatcattcatcaatagcaacattttaaactcacatagcacttaatacctttggccttaagttctctcattcagtctcggctccatctctaggttgacttattgtcctcattattcttacaagtaaactagagctcagatggactgagtgatctgaaagagcctgaatatgaacccaaatcttcttcctcccaggtcagggctctttctacacgacacacatctctgtgcatcttcagcaccgttacactacaccctgtaatgcagctttcttcacgccttttctttttatactcatcaatatgggtactagtgtcttcttaattaggttaccagttttctaaggatgtaagtcaggtctcatattgctgttttgtcaaatgagtaatgctctgttaaacactcaataagtgtctaagcatttaatttgctttttaatccattacaaaatgtaggaaataagcaaccaagatgaaaaacacaacatatgttctttgatgtgtattgaaaaccagtgaacaccctgaggcattagtggtagttttcaaggcccgattcattgcaaagtctctgaaaccactgagggcctgaacatgctatttgggtgtcagaattccattagaggtgattagactcagtccctaccaacctacgtaccaatgcctcagtcggcctatggttcatcaaattcttgaatttcatgccccacgtcactgtgcttctgttgaatgccaatgagaatactggatgaagaatcatggacaactcattccttataaatcaacatcaaattctactctcagtctccatacacaatagcaaaaaatatgtgtttttcttcaatcccaaggattcagctaaatagtcatgacttgctcctatcatttttaatgggtcacaaaaaagagaatcgatctttcagtcccattagacacagaggatttgtccacgcagtagtattctgcaacaataggagggtagcattgccttcttgcaaagctgtgtaacttttaaagctaaaccatagcagtagtccccactccaggtcaatgaggtatgtcaggtactcatgatttgagaacaaagacaagaaagaataagaaatcacaggcatttttctaaatgcttagctcagattttaaagctgaaatttctacattcaaaacaaagtagagattgtgtgtgtcatactcatcaaactgcatgcattgtagtgtgcaccatttttgtatataaattatacctcagcaaagctgtcgaaacaaagtgatgatcctaatagtatgtttcactttgagtgttactgagaagaaaagggagaaacaaaaacgacagcaacagttttcattagaatcagaaactgttttaaagtctaattggctccagaggaaatacttggggtgagatagcaggagtaggtttcttaggagcaggtggtcacctttaagaaattcttcagcctggaaattctccaagtgccagaaggcccacatgcgctgcccaactcttttaaggtccacacacctaaagttttggtgtcgttgcaagatttacagtctgaacatggtacaaacaagaaaaagaaaaaggaaaacatttccatacagctgtaattctacaagacaaggcgccttctcttctcccagaaatcttagtttccctgccaacttagtaacgacattacttcggggtcagaccatgagaccccacatacttgaggctcacatccaaccacagtcttcatgtcagccagcctaagggccccagaatttgaagctcatccattcttttgggtagaagagacaaatttacttactttccaggccagaagctcactcaccagacccttcatagaaaggtcaattctcacttaaactgcagtctcaaagaagagcttcaaaagacacaggttaatttctgaagaaggcgaaaagcttcctgagagctgctttgacctccttgtttctcaaagtgtagatgagggggttgagagtaggactcaacatagtgtatagcacaccagccaacttgcttttctccgcgctgtagctggagacagggcttatgtaggcgcagaagacggcagcatagtacacgcacaccacaacaaggtgcgaggagcaggtggaaaaggctttcttcttcccctccgctgtccgcatctttaggatgctggcgatgatgaagccatatgacacgatggtcatcaggaagttcagtataccataaaaggcatcagccaggacaatcatgatgctgttcacataggtggagctacaggagagaagtagcagaggagggacctcacagaagaaatgggcgacaacattggggccacagaaatccaagcgcagcatcagcccagcgtggatggccgtgttgaaggcacacagtgcccacacacctgcgaccagcatgccacagaatgccttgctcatcgcggtgctatagtgcagcgg

SEQ ID NO: 37511 - DNA, 1611 bp, Bovine  19866880784619
catcccgggcgttctcacccacatcatttagggattttgagaactttagtgttcttctggctctggtattcttagtaggcttcaaggcctggacccactctgaaccacaggagtttctctttgacgcctgcgctgtgtcttgacagacaactgtcacagtgagcccttgggtcagaggactctggcagggaggagctttcaagacaacagcagatggcacgggactgtggtgacaacactcagaaaacactgcactggaactgcatgcagagaacagtgggataaaagcacagaaagtaaaacaatattaaaagagaacagacatcaaagtgaagaaatgagactcgcatggtaacctggtgagcacatagcacataaaaccaggctgactgtttagagcagaggcatatggagaatcaagaatctgcagacattaacgcgtgtccccaggatgcacacgagccacggtagcgtgcagagtgttacctgcagatgtcctgattggagggcgtgacagaagtgcgagggaaggaggacactggagccgacgccaccgaggagcccccagcctgcaatacacagctctggtcagtgtttaggaggagccaggggaccacgaacaccacctcctgaatggcgctgggcctgctgctgcccacggctcagtgaaccatgctcgtgttaggtccctacgagccaaggcaagaacagaacaagcagcattcttcttttctcagatgaaggtaaaactgtagtcaagaatatctgagagcgtggagcagcagcatccaccttgtatggattcaatgggcattcatcttctaagcagctaaactgaaattactcgtacagaagccgagaaaccgagcaccacaggtacatgcaaacacaaaaggaccgcgaggcgccttccctgcggccttacttcccccagctggcactctctacccccgtgtctggggccatcctgtgccctgcggccttactcgcccggccggcgctctctacccctgtgtctggggccatccttgtggaggttggcaggacacaacagccctcaccacttggcagtgggtccatgaacccccaagcccctgccagcgctccttacacagaggggagactccctgaactgccaaacttagagaaaagatccgggagggtgaggaagttcatggtgggaagagaagcagaggagagaaatagaacaggggagtacagctgagctgaggctgcaggacgactgttctgggcgtcccccaacatctactccagcccctgcggggcacctgcgaggcctcatcaagactgaatcctgagattcctcggcccccgcagcggcacgtgcactcttccctcctcaggatagctattctgagggagcagctgctccgtgcaacctcaggggccacacagagacagcactgagtctgttaccagtctgacagcaagccagcatgtcctccccacccgccccaggccctgtcccttgattctggaaagccccactcttgcaaagtgttgcccccggggcacgctctcatcccagcactgcagctaaggaacccctgacttgcaacaccaaccccccttgcctggcatgtgcatcag

SEQ ID NO: 37512 - DNA, 1551 bp, Bovine  19866880842844
aacatatcagagggcccacctgttccatgccaggcattgggttgagtgccccaaaaggatgcccagagagaaatgaggcagatatacctaccatagggcagatatttggataccttgatcacaaagtgacttgtaatggactctacaatagaagtgagttctggatcctgaagggctacgaaggagaaaatggtcctttgtttctagggaagggatatttgaaaaatgtggggtgctggtaaaagagctggctcctgagaaggagggcattcctggctgagtgggttgcaaggatgaatgcacaaaagcctggtgtggttcatgcgttgacaagactgggagctgtgggcgtggttgggctttgaggggtgagaccactaggaagacattggctgaagaggaggtggatccaggagtagcaggtgggagcctttcctctgtcagtgatggggagctacagaagaattgttagacagagaattccatgatatacatgccttttagaaaggttagtaaatggaaaaatcagaaaatacagagcagcaaaaacgacaggaaatcaactgcaatccatcctcactgttgaaatccgagtccatcactcaccagccgttttttcctacaggtacgtatacagacatgcttttttaagactcaaaatgatcaaaagttgtacacacttattttgaaccattttcgtttattttcacaagcatcagagtttcataagcattctaaagcttcattctgataagcacactgcaatatattatatcaatgtatcatacagactcatctttaagagtataggctactttaaaatgttcgctattataaataatgctgtaatgacaacttgaagatcctcttatttcttcaggataaattcccagaagtgaatgttgtggctcaaatgaaatatgaattgtaagaggcctatatcttggcacctgcgctaatggtagtcagtatcatgcatttccagttttgccaaatcatggctgataaagagtggattatttatttggcatgcatttctttgaggttgagtgatgcttcaagagttcagttggacatttttacctgatttttatgaattgaatgttctaccctttgcctattgttatatttttgtgtttatcttaactgagtcttaatacatctatttaatattgctgtgcatcatgttgggtatgaatgaaacgggatagcagctttcctcaggacaccttgcttctctctctagccccgaaatcacatgaagctgtggttggagattcacctcatagtcccagaaacctctttcagcctaaggaccatgagtaaccagactctggtaacaaagtttgtcctgcagggtttctcagagcacccagaataccgtgtgctcttgttcagctgtttcctctccctctactctgtggcactcacaggaaatattcttatcattttggctatcgccttcaaccccaggctccgtacccccatgtactttttcctcttcaacttggcaactatgggatattatctgtacatcttccatcatgccca

SEQ ID NO: 37513 - DNA, 1267 bp, Bovine  19866881078347
tctcttggaaaaaatctgttgcttgggagtggcctgtgtctggccgaccccctatcaggggcagctggtaccagcaggcactacaatttcttccttggccaacttcctgccatttgctggctaacaggtgctctcgagggcccttttaaaggttcattgttttccctgccaccttcctgctggccctggctggtgatcgaaagttgtagccttgggctgcagaacaggggccttgggcttcccaggaatgcatggcagtgtcccagcacctgctcttttcttgagaaccgccttcctccttctggtctgagtagcctgggctcagaggctcccagccgtgcccctcacgccctgtcccttttctttggctcatcgtgtcatggtccttaacatatttaaatttcatcctgcttgcccgctcctgtattcttggctggaaaactccatggacagagaaacctggtaggctacagtccgtggggtcgcaaagagtcagtcacagctgagcacccacgcaaggaggaacatcagagtcgtaattttataagacgtaagagcagaggttaccaagcattcagatttcacacacatcctcagcacattttaatttgcacactgataacattttccttctgccaagtgaggacaatgaccatctattgttgccacaagtttatgaaagagggggcattgtgggaagcacatcatcttgaaatcaaaggctttccgatgcagtggatttagcctcaggaaaacaccactgcattagccttctttttctgcttcagaccttggcccataggaagtgggctatagtgatggcctgaagagccatctgccttctcccatgataaccggctccacaaccccaaagaggaaagatggtccaaaccaggcagctgaaaacctccagtggcctttgttccaaacgaaagaccagggacaatggggagggcaggcagccggcccactgtcctcacggcccctcctcacggctggcagagcagctactgaagtggaaagcgaaaacaattccctgcctgttcactgggacaggtaaccatggctggcttgctgccctggggcccctcctctggggacagggaacctgggctgcagcctgagtccttggattggggacagagtctcctccagccagggaagcaagagtggagcctgatctgtgtgccctggggcctgggggaggggagccagccaggacaaagaaagctgggctccgcagagccacagggcttggcctgcccag

SEQ ID NO: 37514 - DNA, 1104 bp, Bovine  19866881112002
atttaaaacctattcctttacagacagagtctctccggtttgtgctgacttcacactgaagaagcaggcatgtgtcgcccagctggggcgcgcgctgaaggtgctttcaggggcctgtgctcctggcaccttccgtgggccgctgcccggggcagagaggcagatgggctgcctctggctgagggccaggactgagcagagactgccacggcccaccgcgtcccgctcccagccacagccctgcccatttgccgccttaactgggctgaacccctggccctgctctcagtccattctgttgttagggattatctcctgtaccattttttcataaaaccaaaatcactaccatcaaatggcctttgtacctttaaaaaggtctgcttaaaattctgtttttaaagaccagtttcatcataccaggcaaaagagagtcaactccagaaaaacagcccagggagttctgcagtgtgagatgagtgtgcccaggcacttactctccgggcagctctctggatgtcttgggtggaggccccgggtcctgccctccatcctctgagcctcaggtgtttgatccagcctgtcaagagtaaggagcaaacagaagacgattcctctgcatttcagcgtgaaatggtttgttttgaaagcctcgggggagggctttgccctgccaatggctcctctggcctggcaggtgctatccagccatagctcaccctggaaataggtccgctcgccctctccgcctcccaggccacatccagcgcgtgcctgtgctcactgtgccccaaagtgcaattacctacgccccctcccagcctggggacaccaaatagctacagacagtctgctcaggagagccacatcccaggtctgccttgccggtgccctttaggaactgcccgggcaaggccccttgtccctcttgatggcaggtgagtcgtcagggaatactggatttctgagtgggcaccattccccttcccacagtggagctccctgtgctgtccctgaaaagcacggagacttctgatagagaggagagtgtgctcaggtgggggtggccccaggacatcccagccagtgtggctggtgccccac

SEQ ID NO: 37515 - DNA, 998 bp, Bovine  19866881267578
tttatataaggggaatctagagtatttgtccttctgtgactggtttacttcagccagcataatgtttttaaagtacattcatgttgcagcacgtgccagaattcccttcatttctaaaactagtaatattccatgtacatatgcatcaaatgtttatccagtcatctataaatggacacctggcatgctttcagcttttggctattgtgaataatgttgctatggtcttgtgtgtacaagtatctgtttgaatgtttgcttttgcttcttttgagtatatacccagaagtggaattgctgaatcgcatgataattctatgctaaagttttgaggaactgctgacttacagttttaggtataaaatagtagacctcaaaattgctaagtagaaacactattttttaacattctagagtaaagaatgcttttcccagcaagagagaaaagccaaaactcacaacaggaaatattttttaatttgactacatgaaaagttcaaaatttctatacacacagatacacacatagatatacacacactaaacaaaagctatttgtagtatgtggtagataataacttctaaatatagcaagactccatgcaaataattgggaaaaataatagctatgcaaattgaatatgtatgaaaagctgttcaacctttctaattaaagaaatagaatataaagcaagaacgtattttttcacttagcaaagatgaaataccaaaatagtatgggtgtagttgtaaaaacatttccttgcttggcaattaggcaatatgtatcaaaactccttgtcatagaattttagttcttaacatttgtcttatattgctatatttattgtcctgtaaccacagattccacagttgcttagtgatgattttatatttaaatgaatttcatccttactcttagtattttttctttttttgccacagcttcttcattctgaatcctttattttgattcattcctagacaactgcaacttg

SEQ ID NO: 37516 - DNA, 1168 bp, Bovine  19866881338757
cctagaaaacccccatggacagaggagcctggaggctgcagtccatggggtctcaaagagttggacacgactgagcgacctcacttttgcttttttaaaattacctgtcttcacgtcaagaaagaactctgagaagaatcagcctttatataaaaccagaaaggaaaaagggattcacttctaatttctaaaatatgcctcccagttgtgtgtgtgtgttttttaaatctaaagtaagtggaatttacattaattttaaattattgattgttgaaaccaatatttgaacgtatagggagtgaaagatatgaagtgaaagtagttatagataattacatcatagaatcagtgaatgtacactccagtggcccaggaaagcctcatgcatttggttaaaccctgtctttgtacataacaacatatttcttttctctcatattaatacagcatagtaaatgttgtactaactataaaaagaccaaaaacttatttgaagaatataatatatatgtattgtatgcacaggattgttgttcaaatttgacatgttatatcctgatggtgtacaaaaatgcattgaacttgatataaattgaaaacttatctatcagtgtttccatttgtagttcctctggaagatccacttaaggacatggctgaatacatggattccagccgagatgaggtctgggagaagacctcctgcaacaagcaagttacacttctggtataccaagaaggagatcagttgaatttcttccgtgtagtagacaggggagacggcactctaacaccgttgtctgaatctttaaggtaaagaggtttcatttacatgtctcacttaggaaaggagaacgtcatatgatacacccataaacctcaggtttaccttgtgttgtcaggataatcttactgtagtcaaaagattgactaagttttatgcgttctccccttctccccatcccacctcagttgtataattctgaaattgtccttcctatgattgataggagtaatttctaaaactgaagtttctttatggagtaggattttttataaaaatatttgtcattaacactcgaagatgcctactgggttattgagttttgttataatagtatgatgttatatcaatatagctatggcataatataaaggattaagccta

SEQ ID NO: 37517 - DNA, 1863 bp, Bovine  19866880392883
atctggggagattttacatgcccatgagccacaactactgagccagtgctctagggcacatgctctacaacaggagaggccaccacaatgagaagctcttgcaccgaaactagagaggagccccactcgctgcaactggagaaagcccacatgcagcaaagaagacccaaaagtgcaagtgaagttgctcagtcgagtcgactcttttcaaccccatggactgtagcccgccaggctcctctgcccatgggattttccaggcaaagaatactagagtgccatttccttctctaggggatcttcccaacctagggatggaacccgagtctcccgcactgcaggcagactctttaccatctgagccaccaaagaagacctaatgcgttcaaaaataaaaataatcaatttaaaaaaatatcccataggtatttatgtgtgtatctatccacttatttatctatccttctattattattttttgaactagaatctggatgtgtttcttcataaaacatttgttttatgcctccaaaatatttctacattatttataatatatatctataactaaatcatatataacatcatcactatgcattaacattagttaatattcatttatttgtaatccagcataagttatattcaggtggttcaaagttggaaggagaaaaacagtttattttggaagattgcacatttttctaatttcctaaaactgaaaattttaatgagtctcatatttgaggaattattgtaatgaagttgttaatccacaaacccactaatgcaaccatcaaatattttttgactgccatgctatcttgacacatttaatttgcggaggggttctaaaacttggatcccaattgtattctggtgataataacttagtcggtttcttgataaaaagatatttgtttaggtgatgttcatatatgctgctaagttgattttcaatgtcttgaataactcctttctgatattcttcaatgaggtttaaaacctcctcaactgtgccaccaaaaattgcactatggtagtagaaatctccctcttcaaaagggatgaaagctgctgatttacttcttctctcataagggaaagtgtcaccatctttaaaataccaccatgcactaagttgagctacagattttcccagggtttccactccaaaatcgtccttgaagatctggtctgcattcataacgaagagaaagttgacttcatactggatgtgtgatatgatgtagttaaataagttcgtcatgtatgtgaaataaaaatctttctctataccacttttgaccaataaaaatagtttaaatgttcgaaggggacctaacactatggaaggcatggtggagaagccatccagcaagatgtaaaagataacattgtagccaaacatgaagtgcttatttgcagattggatgaactcagtcaagctctgatttgaaaacctgtgaaacatgaagaacaaacaaacacataacaaaaaagacttattttgctggaaatcatcaggaaattacctgtcatttaaacgtgctaacattgcttcagtcatgtgcaactctttgtgaccctatggactgtagcccaccagcagacttttctgtccaaggggagtctctaggcaagaatactggagtgggtttgaaaccatgtgcaaatccctgcatccttgtcttttgaagtaaactgctgactcaagagttaatgactgggaaatgtgaagatgtggaagcaaagaatagctgttgggctaaggaactggtaacaatttagactataattctgctacataacaatcaccaaatcctcagtttcctgaaagatataaaggcatgacacacattc

SEQ ID NO: 37518 - DNA, 1674 bp, Bovine  19866880494980
aatgaagtcactgaaaaaacatttttcccgaggtcacacacaatggaggacttgggcttcaaagatagatcatctcactccaaagcccatgttataaatcaactcactctttgaccctttgcctctgtataataataattaaaaaatccttattaaagaagctgttgtgtttggagcactcctcaagacaaactccaaactggaaaagcatggtaggagttctgagaatgaaatctcatattcttacagaggaagtcctcttaattccagttgtggctatttatagcaaaagacagtctcaaggctcattgccaggctcaggcctaggtttccaaagtgaaaggaattccaaacaaggaatagatggggcacaaaaacttatctgacagcgtctggtactttctcaaacactgctccaagattcccttactccaggcaaagctccgtgttctcaacatcctagacgataaacaccctgaaggcagggctgtttcttttttatgtttatattttcaatgtctagcacagttatctcccagagagaggatataaaacacttcttagcttacctgctggatgtataatttctttacgcatttgaatcccttgtaagatgaatttccagtttcaactctgtgacttcttacttgtgtggtctttacctctctgaacctttgtgtcttgaataatcagactggccccccaggattgaggcaatattgctcaataaacacagatgacagttttctttcactctcctattttattcaagtgttctatttccaccacaaataatggggaaaaaatcggagaaggcgatggcaccccactgcagtactctagcctggaaaatcccacggacggagaagcctagtaggctgcagtccatggggtcgcgaagagtcagacacgactgagcgacttcactttcacacattggaaaaggaaatggcaacccgctccagtgttcttgcctggagaatcccagggacggtggagcctggtgggctgccatctatggggtcacacagagtcggacacgactgaagcaacttagcagcacgtagcagcaggcaccttttccgttcttgataaaaacctctgaaactacttaattttcccctcactttgtgcctgactggctaggcctggagagtcaaagaccttcaggaagctcatttatgaatgaattattaataccagatgagtacatgggatttgactgccaatcaagaggaagaagaaattaagtggattttcagaaaactgggcttggtctttcacttttcaaaggctcagttagaaataatttgagcacacactctggggaatcagcactgtttcaccctgaaactcttccccacctggttatagctttaaaagatgtataaaatcacattccttggaaaggtgaggtttaaactccaggctgtaattgaacccttaatcatctacagttactacaagtcaaggggaaaagaaatcctcagtaactccccccaaactgtaggacattcatttcctccaagattcccattcattaccttgaggactggatcctccctcctacctttatgaggttaaaagacaaataacgagtaataggtatttctgagatattctggttgagatacctgttgatattgctgggtagggacaattgtaaaggtcagg

SEQ ID NO: 37519 - DNA, 4686 bp, Bovine  19866880497865
gggatgcattccaagggtttgagactgccttcacaggatccaaggacagaagggacagtggggctcagaagggctgggcccagggtctagaagccctgggaactgagggtcactcggtctgtgtcgccagggccacatggcctcgtctctgcttttctctttgcacctgcttctttctcctctcttagtagactggctgcctttgcttctctgtgcacatggccaagcacagctgcccggctctggcgtttgatccctttcagttcaagggccggcagaggctgctgggcatctctgatttccatattcctggaagagagaatctggttatctcatcatgagtcagaggactattcctggtttgttcatttattcattcaaaaagtctttgttgaatgccaggaacagttttaggctcccaggaatacatcctgcccttggggactgtgtatgtgtgtgtgtgttgagaaacagagagagagagacgttgtgagaacttgttttaggggcaccagtttgcacattgcagttttaagagaaagagaagtatggtttggaattcatatagacctggattcagatccgcctgttaccagctctgtgcagccttgggtgtgttaccttacctctctcatccccgattttctcatcagtgaaatggatatcatcctttctagaatggttatggggattctaatgaatgggtgcctataaaatcacttgtagagtgccagccatgctgaatcagaaccctgcctctcagtggtcatgaccctgagaaagttacttagcctgactgaatttgttctgtaacacaggaaagaatgtcagcaacttcacaggcttgttacaagcatccagtcacatgatgtgtgccagggcgtggggaattagtacagaagagacactcagggcggtagttaatcacatttcccctctttcttccagttcccatttggccgacgcttgccttgtgacatctactggcacggagtttcatttcacgacaattgacatattctccggtcaagtgaacaagtttccaggtatctactgttattgctggcatttaaaaatgtgtctagggctgagtctcagggtacactcttggacaaaaatatgccagtgttttgagatcaaactggagggctcttaattgggaatggctgccaccgtgctgtgatcttgggagggaagatgatcaggacttaacccaccaagggcttaaagactggaagttccaaagtgtgaagagattggttcttctggtctaattccactggtggaagaacatgactttcactttggggtttttgatataatatgggtgtgtcatgaagggacgatattttcaaaatgaaaaaaactcaccatagtttctggaacatttcaatgactcagtgagtgtggactctgaatgcctctatgtgtgtggctttctctagtagatcatgagctcctgggaggggccatgactcccgcacctctgtagattcctgtggctcctgcaacccttctggacacacctgaggtgctctgtaactgctttctcactgactgactgaaactcagaggcagccccagttttatgctcatcgcagggaacaagaaagcctgacattaaagcaataaaatgaaccatttcccctacagagttagtctaacattaataaaagcttcatgttgcactaaaataagtaaacaaaccatttaaatttctaattaatttgcaggagacagaggtactaaaattccaggactttgtcccagaaatgggattcacagttgccatttcctttaagtgccatgtctggaggtgctgttttaaaatcaaaatgcagcatctccatcctgggaacaggaggtctggacagcgtctgtcttcataccctgagggcattatctagtgagatgattatctagtgagactgcatgggagacttggtgccagataagtgccacagccaacactctaggagacttccccattccgttcccagccaccctatcgtataacttttccctttccttttagcctctaccaccttcttctgccctgattactattcattatttccattggttaagtggagaggaggggttaaggtgagtggggagtgtgtaaggagaaatgaacatttggttaatcagggtatgatttcagtgaaagaggtgccactcattttcagaaatttttacataagacacaaaccatttagaatacaataacagataaatttttaaaagaacagggacttgactggcagtccagtgattaagactttgccttctaacgatccctggttgaggagctaagattctcacatgcctcacagccaaaaaaaccaaaacataaaaacataagtaatactgtaacaaattcaataaagactttaaaaatggttcatattttaaaaagagagagagagagaacatcacccaaatcccattcctcattgaacgaaaccatgatgtgaatatttctatttattgttgtttagttgctaaatcgtgtctgactcttttctatatttatttcctcccaaaccttaatcatgtttgtgtgtcatttttacatagttgcctgactataagatgtttgctctagtgtttcatttatgcttatttttaagaggagaatcaactggtctttttctttggcagtccgtgccatatggttaagaaaatacctcttagaaaacccaatatccatacattatacagtggcaagttatactatgtccactagggggggttttcaactaagccaacagactatcataggccccttggctcagattcacttggaaggacacaggacaggaagcacagcttgccagccagtcaatgtcatgcgtttctttttagttgagtctttacaagggttccagagctaagtctttggctcctgcagggaaagctcaggtgcaaggagacacgatccatattggtggctgtggatcggccttgactcagaaacccggtaggagccaatagcccacgcagctcctccgtagcatagcttccaacgtccccgccagggtcatgctaagttacaagattcgttacactcaggaaagcccagagctatggctcctgacaaggtatttatgtgagatgccagtaaatgatcattttaaccatatgctctgttgtctagtcacagagctaactttccccctttatcggtttcctggggaacagagctagaaaattaactcaagatcagataggttcttggaggaggcaggtttttgtctgaggacgaggagaactcttgcagccagggttcttgcatggttttaatgggatagctatcattttctctgtctggctgctcataaaagatgacttttgggggacttccctggtggtccagtggaagaatccttccaatttgggggataaaagtttgatccctggttggggaactaagatcccacatgccatggggtaactaggcctgtgcagtgtagagcccatgtcgcacaagagagaagcccatgagctgcgataaagaggctacctgctgcacccgatgcagccaaataaaataaatacatagataaatatctttttgagaaaaaagatgacattttaatgccactaacaggacttactgtgatattgggggagcaaaatttggaagaaagaaactctttgaatgagggcagagttcccaagacatgaatcatcaaatgggcttcactgacattttgcccattttctcgtttcatctgacggctgagagcaggaaggaaggagtcgctatagcttgacatttgggatgcaggtagaaatacaggaaaaattaccttcagaggactagtttcattaaaggtgatataagaacattcattctaaagaagaacgctcgccccatctcatattccaagtgccagtgataggaacatacaattatcctctttactaacaccaagctgctgctgctgctaagtcgcttcagtcgtgtccgactctgtgcgaccccatagacggaagccaaccaggctcccccgtccctgggattctccaggcaagaacacttattagctttaatgacaaagaaggctctggaacctctaggcagcagatcagtgctgccacaccctctgccctgtgaaagacaacatgcttagcgacgattccagaactgtgctcgggttggtgtccacgcttatcttccgtctctgatacatcccattattccaaagctgcatttcatatgcatcatgtattacttagagcaagttccagaggatgtgccaggcaaggataagcactgcacatgctgaataagctgaaaacttttggataaacatatggaagtaatttattttgttcatgtcggcatgttagattttagccacttttctatgggcaattgtcttcaagatatgttattatatcttaactgatgaattaaaactttcactaaaaataatctgatttagataggtctttactttaagaaagcccagaactgtcagttctcgactttacaaacaacggggttttgttttttcttttgctgagttgccggctctggaatatatgacagcacgtggcaggtggcacttgagagcccaccatgaggaggggactttgtcagaggaggagggggccccagggagggatctctgggggcggctgtctgctaatctcggtcgggctagggatataaag

SEQ ID NO: 37520 - DNA, 2893 bp, Bovine  19866880501879
tatgtgtgggtttatgacaggcagggagggttagtctttggtcctgattttaacttgataccatctggcctgtagccagtccagcccagagaataatttcttccctagaggttctaggatacgggcattcaaagaaccatcaaccatgcctaattaaaataatcatttgaaagatggattatagagtgctcttgtttgctttcagagcttctgccccgtgaattgcaagttgcgatcatcagtcgagtaaatgccatcattttctcaacagacgtttgtggataccctgctgtgctaatctgcctcctccccgctctacctgttttcgtctttctctctgtaggatgctgcctgcacttttgttgtttctcttccttcctccatttctcgtatttgcctttcttctatgtttccttcccttctgtgtctcctaaaatcccagtcgattgaaaaacgcagttatttaaacttttggttaattgaagacacactcacatccacgtgttttatctgccctttgcttgttctccgccttgcgttctcacttagcaggtcttccaaagacgctgtttcaaaacagtataagggaagagaaactggttctgtgggaaatatacccttatttgaaaagttggaagaaagagccaatgtcttatttaacttatgctttcctcttcctcaaatagatgaatatggtgtagaacaggactgggtcgtatacccatggacccaatctggctgaccgcctgcttttgtcagccccacaagctgagaatagtttttatacatttttttaaaaagaggaagatctgaaaattatatggaactcagattttagtgttcataaattacactttcctggaactcagccttgtctcctcatgtatgtgtagtttgtggcttctttcgcgtagtattcactggttgtaacagactttatggccaataaagccttgtgtttattctctggctgtttacaggaaaagttgccacaccttgacttggaatctccagtgaggccgaaaaagaacacctgtatgctgaataaatatgcttttaagaaaaactcaaaaaatgccaagacctttcattttgacctactgttaccccttaaaacttgctgttagaaccagataacatgtttttgagactaaattagccaggctatctttcatgatccaagcaacactgttcttgacaatttctgatacaaagtatttcaccgcattctgggaaggagaaaggaaaaagtcatgctttcagtcttctctctctctcttagtcgctaagtcatatccgactcttgcgaccccatggactgtagcctgctaggctcctctgtccgtgggattctccaggcaagaatactggagtgggttgccatttgcttctccagctttcaatgttggtatttcagtattcgctgccacacctcttctttctgtgtgagtaatgtgtatgacttagtcagattttcatatacgccagaaggtatttacttgaagaggaaatccagtatcttttgaactttagaacagagtcacaatagtaaacagaattgatcatttcacataatttctagtggtgacaaatttaatcatccttaaggaaattggccgatatgggatcatgatcagcatgcagtgctctgatattatgcatgttatgatcttgaaaagactgttttgctccttgtctggaagccaacccaacaacaattgctctacaagttggttttgttctttttttctctctcatttgtttcatggttttgttttgtttttttcatttgtctcttcccagaaagtctttttctttagtactttggtactctgagaggaatattttatgcctactttatagatttttataaatacgagaaataatgtatataagaagttagcttgtggctgacatgtaataggcattcaataaatgttattgttagtattcataaaagatacctccagaatgagagaaatttaagaattgtgtaatttcatcttttcagcaaaattagtttacactatgaagatgtatagaagttttactacaagtatattcaaaacaactgagtttctaattgagaaaactggacacagcctaaatgttcatcatatgaaacaatggaatattataataataaaggatatttaattgcatctttttaataataaaggatatttctttaataaaggatattaataaaggataataaaggataaataataataaaggaaaagatattaataataataaaggatatctcctgatatgaaaagatgtccacagtatacaggaggaaaacattttaaattattacatataccactatatcattttggggaaaagagaaaaaagcaggacagaaatttacaggacatatatatcaggttcagtcgctcagtcatgtccgactcttcacgaccccatgaatcgcagcacacaaggcctccctgtccatcaccaactcctggagttcactcagactcacgtccatcgagtcagtgatgccatccagccatctcatcctctgtcgtccccttctcctcctgcccccaatccctcccagcatcaatcttttccagtgagtcagctcttcacatgaggtggccaaagtactggagtttcagcttcagcatcattccctgcaaagaaatcccagggctgatctccttcagaatggactggttggatatatatatagcaaggcagaaaataatcaccatctagagataatgaaggaatagatcactttttccttcctctgttctgaactgtaagtttgatatagtgataatatcttgcttttaaaataaaaaaagaaagtaagatttttttaaatgtgtgcaagtttcttagaagaaagcctaatggaatgctcaattaaaaa

SEQ ID NO: 37521 - DNA, 1117 bp, Bovine  19866880521211
acttggtgctcatgctaagaagctcctgtcactaatcagcctttgccaggtcatagtgggctggggtgatgaactcattccagctttccagggacttcccgttgtaacacaggaacactcaggttctgggaaatccctcggtctggagcaaaccagggcagttgataaccctacataaagcccagatctcactccattcaaactcaaaccagaactgggtcacatctgtgtaaaactttcagtgcacatctagatttctgttctcaactcccacccgtgtgcccagttgccacgtcagtggagtccgtctcctctgtgtcacctgtcttcattttctcctctacgttctcactgcaaaagctacgggagactacagcaaccaagacaagaggggaccactgaagattcagagtctccaggaatgaagtctgcggtcataccgcctggtatagctgctggctcagagcaaaggaaataggaatgaggaggggaagaagggagctacaagtatcaactgcaggctcatgaccagagagaagaggggactaatacctaaatattattttcttctttgcttaatgtatgtctataaatctgtgtttatatatttgtgtatatagaaactaattttttcttcttttgcactgtaagaattaatggcagtggttaactttacagtctcatctttagcttacaggatattcaagagggactctaataactaaagttgagaagtaactgacatcacccaaagatcactaaaataacatttgcgatcttttctttttgtggaaaaggtgagagtgcctatttctacaaaggacaattgtattttgttaaagaaaagttgaagtttgttcttgctatatcggaagttgaaatagatgtaaaaagttgcgcacagatattgagtaggcaaagtgacgagctgtcccagttattacaccatcatctctcagtccaaacccacacttttaatactctgctttgtgatgccagggttgggactatgagaactatatttctactttgccagttgactttctgtttgattctgcaaggcagaggagggagaaaggacgcagtcttctctgacaagtggttaactgttgggggc

SEQ ID NO: 37522 - DNA, 1154 bp, Bovine  19866880530430
tttctgcgtgggctttctctggctgtggagagcagggtgttgctctctagttcgtgcgcaggcttctcactgcggtgacttctcttgttgtggagcacagggtctaggcacacaggctcgggggttgtggcgcacaggcttagttgctccacagcatatgggatcttcctggatcagggatcgaacccgtgtctcctgcattggcaggcagattctttaccactgacccagcagagaagcccagttattatttttcaaacattcagaagccactatccctcctaacacttctggaatcctgagaaatgacccaatcctctgcccattttactgaaggggaacgtgaggcccagagagggggagtaattggcccaaagccacgacacgcagagggcagagaccaggtgataatccaggtcctctaaccccgcagcataatttttcctcctgtaatcccagtcagttggctcattgattccacaaacacttccagaaagcctgctctgtgccagctagagatgggggcgcaggctccccagccgcaggacagcctagtgtggagatgagccggttggttagtgcagtagaagaagcaaatgaagccagcgtcatgatagtgctccaggcagcgggaggtgaaagggcaggcattaaagcagggagatgactggtatttttcaagcgctgcattgggctttttctagggagtgcttgataaaagccactctttacagacatagaaaccaagccctccagaggagaactggctcccgaaagactagacagctagcacgcagcagagagggaaccaggccagcccaatcagtcattcctccatggagccagatgccatttctcgggaaaggcccagttttcatctcctgcagtggagccctttgagaccccagccccaggcctgggggaaggactatggtaatgcttcgggggaccaactgcagctacagatcagagcagactgcaagccaccccaacaatggggagaagacagatcctcgtgattaaccacctcggagtcggtgcagccttcacatagctcttctggggagcgttctgctgcacagagaggaaccactaaagtaattctagtcaagatcactcagctttatttcccaccaccgattccaaacagaaag

SEQ ID NO: 37523 - DNA, 4434 bp, Bovine  19866880675476
aagaatggcgatgtaaatgatgctgtgacttagcgccctcccctgcttagcacgcatgtgctgtggagtgagcaggaagatgtgagttagtggtctcctgtcctgagtacacctgccgcacacggctgatgctagtattttttttttttttatgctagtatttaaggatgtgtatttttgtttttaccgatatggtccataaacacaggccagctgcccgtcaggaccacaacagcaggaataactctgtcccaacggtgtcagaatcatgtgtgacgtcttcgtgagatgtccttctccaggctgggaccttccttggagattctcaagggtcatgatgactgtgggcactttccgcctttacccaccgactgtgctgtgagtgtgctgtgtgctgagtcgcttcggtcgtgtcccactctttgtgaccccatggactgtagcccacgaggctcctctgtccatgggattgtccagtcaagaatactggagtgggttgccattcccttctccaggagatcctggggacccagggactgagcccacgtctctcttgtctcctgcattggcaggccggttcttgaccactagtggcaccttacccaccagctggagcagaggaaacagcacctgagccatcaccaactacacacaacagagctggtatgagggtcacgtgagctcaggcacgcagatgcgcttcctgataccaggccaccatatctgctgtccagattcactctccccccagttacagcccgatccagccctaggtctgaccctggaggtctcaccccaatcatttcaacataaacagaacatatccacagtcccacattgaatatcattttttgctgttaaaaccccaaaaggattttgaaaactttgcttggtggattggttgactacaagactttaacaattggctgtgatttcttgaaagcttgtgtgcacactggagaattcttgaaaactgaggaaaccaagcccacaaattgatttcaagtgtaataacattgtttgggtttctaaatttgatcattaattcaggcttaatgcattaattatcacatttattaatctcagtgtcgcagtttcccgtttcaagttcccgagtcagtcattttccccatgtctcttacacttgaataagccttgacaagcctgtgggtgccgggctctgcccctctattcccagtgagtgaagcagcctggcctcacctgcaccgcccccccattcctcccgcaagacctccacccacccagcccagaagatgctcctttttggggaagcaagagtagcctgggcctcccttcctgcccaatagcaggctctgcctgggcagcaatccctcagtcaatattggccacgccatggccttggcctctggccacaccactgctagccaacttcaaagcctctttcttgtcgggcattggtgaccgccctcactgtgggcactggctcaccgggggcctagccctgccctccagctcccaaagccctgcgtttgtacagagggtgtggctggactttggggcttcgggttcggctcctgcacccctcctccggctggggcgccaggtctgccatgcagatcccaccccagcccgaagccatggttcataaagcgcgtctgagcatgcactggccttgaccccggggaaagagggcagttctcacagtccagctcctgccccagagcctggcgtggcctggtgttctagatgcgcactgggctgtcactgcaggtgggatgcacgccctccctcaacgtctgaccacacaccgcagacccgggtactcagacaccgcctgccacgcacgtgtctcacagacaccacatgccacacgcgggctgagggtccccgaaggggactctcttctcttcaccaggcacctcagacacagccgcctacacacgcagcacacgccgatgcatgcttgaacacatttatgctcacactagggtagacgctcacatttggagggaagcacaccgcttgtggcagcctcagtgagggtgatgcccacaccagccggctgagcttttcccctccacgctggtggaatgaagtggggacatgccttcaccgctgcttaaacctccatgtcctcgtcctaactggggcaaccgcgtttactcactaaggtggggacaggtgtgaccctcttcccacagagccccgcacctccctggtgctcggccactgtgaccctcgtcccctttcccgaggctggacacctcgattcatcctgaactcttccctttcccagtccccacccgaggcccctgcatgccgggtgggcactgcagagcgctggtgaccacaggtgcggttggcccaaaggcctgccgagagctagcgacatcgggcttgtgggtacctggtgacctgaatccacccctttgccttctctgggcctgcctgccctggcctgcccctcgctttgaacaaaatcattagctgagctgcagctcttgatccttatgatgctgatccttgtgtaaagacctcctcctccctggttcctccctgcaccccccatagggaaccagaagtcccaagggtgctgagttccttaagaatactcccatgaaggtatccagtttgggaattaaggacccatcaaaatgatgatcctaggctcatacctcctgggtgcccacccagggctgttcagctccaccagtccccactctgccctttgccagaggtctggtgaaaccccctgtatggacaagctcgctcagagaggggcagtgacttgtctaagatcacccagcaggctggcagctgggctcacataggacccagaactcctttccagcctatgctgtgtggtcacaggtgcctgaagtcctaccttgtgatgacagtttctgtccatctttggtttgggcgcatttcctgcaggcaacatactaagcgcttttggaaatgatctcgattgactgttccaggcagccacctctgcagacgaggaaatgacacccagatgtgaggccacttgaccaagatctccaagctagcagctgctgtgctccaaagttcatgcccctaacccacggtaccacagtgtctccctgccagccatcaggggagccaagatggccttgcatttgctgttcgatttgcaagacacttcttcccctagccctgcaccgatgtgcaggctgcacgaatgccaccccgggtgacctgggccacactcggtggcctgtgcaggcctgccttcattgtgaggtcggccccaggtcagtcagggctttgagcttcctgagcgtgcctggcgcccaggtatgagcccagacaacccaccctccccgtgcggtggggctgccccgtccatggcctccagacagaaaaggaaaaggagccagcggcctgggtcctgcacttggcatgtctactttgccctctcagctccatttgctgagggtggagaagaaattctttcccctttgtctcaatcccacagggtaattcttacttttatgtccccaaatttacatttctttcttcattcattcaccctgtatttattaaatacttcttaagtgctcgatctgcattgggctctgaagaacagaagtgaattgatcatggctccccttggctggcaggggtgaccgtgaccaataccatgaccttgacctgggtcagagaaagtgacctccaggcagggcccaggtgcgggggaagagggcttggaggacacacgttcttcagggcctgaagtcagaaccatgtgaggcctgaaagaaaatcatgtttatgcaggcagccccatttcctgaccacaccgtccttaatgcactgtggatttctactcctttgacagaaattctagaatagcacttttatgttacatttggttctttgtgttaaaaacattacgttgttaaactgtgtttaaaatatattgcaattgttattactcatgttgaggtcttccttcacttttacatccagaagggtccagaaatgggacgtgccctgggcctctctctcctaaaaggaagagtgtccccctccctggaatggcgtgtacgaaagcacggggcactgagcacctgcctgtggccaactgcaaacagggtggctgcatttcacagtgtgaggcgggctgggcaggccagctggaaaggcctcaaagtccaggcgaaggagtgggcagcctttgcagggaagacttctcagcaggggaccctgcgggcagatgtggagtctctcttcccagtcacttttcgtctctataagatgcctctttctcctggtgatgggtgagactcatcgggtcaggcaggggaggggatgtggggaacagcggggtcacttccaaagtttgagaaccagaataaagaaatctttgtggccccagaggtggaatgaattgggagactggggttgacatatatatatactcta

SEQ ID NO: 37524 - DNA, 748 bp, Bovine  19866880685169
tgattagatgagcctgtgatttttgcacagttatgttgtctcaagtaagtcacctgaagttcatctgccatcaggattcatagctgcactctctaatcgcagggaattattttgctaataacagaggtaccttgatctaatttagttttaatgccaggaggtgccctcctagaataatcagctccagggcaattccaatttccaggtttgttacatgttctggagagaagattcgattcaaggaggctgaagttacttctttatcacccaaagtcatctaggggtgaaatggaatctacctctgcctgcttgcagaaaaacgtggggagaggcccagagagagggaggtgcaggggggctcccagataagaggaacccctggaagataccaccggcaggtgagggctgggctgaattaggaccacaaggcattccccgggagaacctggattttccttgcgtccattcattatcttcttcattctggtactgcatttctgggatctctcctctgcaagacctctgctgttacttgaacacaaatattgataacgaacccttaggcagccccattcttgatgctttacatgtattaactcattacatcccgtgaggcaggcaggtgctactcttattcccatttagggatgggaaagctaagacacagaggctacaaaatttgccccaagtcgcccagctagtaaagggcataagtgggatgcagacgttagatggtgaactttaagtt

SEQ ID NO: 37525 - DNA, 901 bp, Bovine  19866880686555
attagaattttaaaaggaattaccaggactttcctagtggtccagtggttaagaatcagcctgtcagtgcaggggacacgggttcgatccctggtccaggaagattccacatgccgagggacagctagggcccctacaccacaactcctgaggcccacgcaccccagagcctgtgctctgtaacaagagaagccactgcagtgagaagcccacacacagcagctagagagtagcccccactcgccacagcgagagaaagcctgtgcagagcaacagagtcccagcacagccaaaagtcaatcaattttttaaaaaaggcattatcaacaattacaatccaaatgtgatgggtaggggtatatctgaggatcttgtatcaaattttggttatcttctttgtttttgaatgttgagttgtattgtcaacttccaaatctcatttttcacagctcaacatggccaatatctgtgacaaaaagtcctgctttcactagctcctagagatgaaagttgttattcctctaagtatttaagccataccttttaatttacttaatgaactcagaacaaactgattgatggcccagctcagttggcaataacagctgctatttctctgatgaccagataattaggcaattgcattaagtgcatgtcaccccgatcaagcgacaaggtctattaagacaaagccagcctacttgtggctttcagtcggcttcagcagagcacaggtttttaagcactctggtaccagtttaaacacctttgtgttttcagtgtgatgaatcaagtgctttctcagtgcactctgaagaaactgggccagtaaaattagctttgtatcctattgcaaataatgattagtggaaatgttattagattaagatcaggagactga

SEQ ID NO: 37526 - DNA, 1301 bp, Bovine  19866880785053
tgtgacagggtgggcaggagcacctggcctggggccagggacacagctgagcaggctcagggcagcctgggtcagacctgctgcacaggactgggaccatcagcgaggcacgccccgcttccacaaacaggcgtggccccatctgtctgccgctgcagtccccccacccctccccccgcttcagtcccaatggtcctgcaggtttcccgcggccacgcccctgccaggtggctccccgaccctgacgctgtgcccacttccccactgcccgtctgggttttgtccagcctttaggataaagctcgctaactaaaaaccacgggctacatttggtccacactcatgtttgtttagcccacacggtgtttgacatttttaagtttcgaatccattaccaacactgaaagatgtgaaatttcaaaatgtcacccaagcccactagagatttctgacttgtgagtccaaaggcccagtgccatggggcgggggctgctgtcccttagcaggacacccaccctccagactgccagtgtccaccacatctgcgcttgcctcagccagggggtcctgtgtggcggccagcaggacggggcagggcccaccacacagcccagggacacacctggcgcacggtaaggactcacttatcacgtgtggaattataaagagacacacagcttcagcctggccgggcccagacccgagtgctgtctgcctccctgcaggaccgcaagctgggaagggacgatgctcctccgtcctgcgtccctctcacacagctgggcacaccccccagaggggacactagggctgtgacgagacgttcaccaatgtctcatctttgctttggaagccatgtcttctggagtccagccaaggtgagagtagatagagctcctggcatctcctgccttcaatcaaagtggcgggattccaagccggcccacaaacaacgatccccaggacttttattaaactgagaaggagagattcggcagcaagaactaacaaagccaaggcttcctccattcccacctgcaggaggcctgcccccctttgaagcccatagccagctcttccctttttctgggttttcaaggtcagagtcacattggctgcaagggttctctttgttctcctgcctctgacttcaccccgacacagtcactgtccccaacggccaggtccttagtgggtggcagaggatggccctaattctgggcaggggagggcgagaggggatcactgacagacagccaggtgttggtcgcacccctggggccctgcttcctgggaaacag

SEQ ID NO: 37527 - DNA, 2466 bp, Bovine  19866880788163
ttttctgagaagctgctgcagcactgctgtgtctgaacgctactggcctcctctctgtgacgtgcatcagagggaggcaccgctgttcccattttacagacaggcccgctgaggttaaacatccagtccgaggccacacagctagaaaaggaggggccccaggatacaggcaggtcaacgagacacacggtctgcccttgagaagctggcagtccagtgggggagggctgcacacagatgctggtgccaagcaaaaacacacttaacaggccatgggcccaggggaacccgtgaaagtatccagggcagggtgtggcccaacggaggacctgtgacgacggcaagaagagccccagtctgggtgtgagcaactggggaaggctgcacagagaggaggcatatcccagtgcaacctcctcctaagatcggggtcccccgccacactctacgcctggcgccccgtgcgaggacacgagtgtggacagatgggctgactgggggaaggccccaggcacactgtgccacgtggacatcgtgattgcctagccccgggaggtgtgtcgaggtcttatgcctcatttacaagacgaggagacagaagtgcagagcagtcaagtaccacggctaggaaaggtccctgtagtgtctggctccgggcccacctttccagcaagcgcttaatttctctgggtctttgtttgctcatctgtaagatgctccacggtcagagacacctccccctgcagactggagctagccagccggggactggaaggtggcggccaccagaccccgctcctaccgcctgctgggtgaacgacctccttcagggtcaagtctgccaaggaatggccaccagtagggagttctaattggtgaggctggcggcacagagcccagcaacgcagccggtggctgatgctgttgcacaggaaagcgctgagcacagcaaatatagccgttgacccaattcagttctgttctgtcttcgagaaaataattgagtttaaatgaataggtttcccatgtcccctccggcctcgggaagggtggaaaaggagatggcgggggtggggggcagacgggaacggttccctgggctcactgctggttatttttgagtcattaggcctgtgaaaggtttccttcttgccttggcggacagtgggcttggacatggctgagaggcagtgaggtgcagtgaaaaccatacgaggtggtcagtgcggatggaggtttaaggccaagctgacaacagccttgcgggggtggtccactcgggtctcaagctcgtcatctccagaatgggaacacttccccccgtatactcgtcctaggatcactgggaagagctggtgcaggctaagcaaactctaaggctttccaaggagtaaaggagtctggtgtaaaccacggaggccagttctctgccctgcaggaacataggcccagtgttactgcatctgtgtttttggattgttttcaagaaaagctggaaatccagatttttttggtgactgttgaaggtgaatgttttaggagtgcttaaatattgggaactgattttttaaaaacacaccaaaaatcaccttaccaccttcccagaccaaaacgaaacctgcctatgggctacgcgtggccttgagccacccatgtgcaacttccaacttagtgacaacgcgtggaaagccgttcaggatgtgcggtgtcctcccacctgttcattgcctcataatcgtccttggcagtggggccaagcccagccccgctggagtgggagaggcgagggacaccagtctctccagacctcaggggaaactgcagaaacagagacgcagacgtagagcacgaacgtacggacaccaagggggagagggggcgtggggtgagtcgggagcctggggttgtcgtacatacaccaccacatacaaaacagacagctaatgagaacctactgcacagcacagggaactcgacttgatgctctctggtgacctaaatgggaaggaaatccaaaaaagaggggatatatgtgtatgtacagcagattcactttgctgtgcagcagaaacgaataccacattgtcaagtaactatactccaattaaatttattttttttaaaataaaggcctctaagaccttgggaaggtggaggggcccccttctccctcaactcctccagccacacacacacacacacaggtagatggaaatatgaggctggttttaccctagaaattaagaggtcatgggcttgcttcctgcactgcctccagcaaccggttagggtctcaggtccctcttctgcagaaaggggggcgctcctgagaggaccaaataagaaccagatagagggagcccgtgacaggtcttcccagagcagcagtgctgcagagtggaaggagcgtgacagtcagcgagacctcaggttctcccctccacttctaggctgtgtgcgcccagg

SEQ ID NO: 37528 - DNA, 1079 bp, Bovine  19866880870720
agtccatttcagcaacagtgtctccctacactgattcacttctcaatgacttagtaaaagaacgtgtcctctatggccttcccctcctccttggaaggggaatgctttgaacatgataaattcactccgaagttcttatcttcctaaacctttggatttcttctacatcatactgtggaagctatgacatcttaatctcattgattatagaataacactgaattcaaattttaatttagcaactaagaaaactcttagaaccacttatagttgactaagaaaacattaaatccagaatcttgggtaagtgcacctgtttcagtaactatagttcaatccagtattatattccattcatcttgatctaacatcactttgaatccattctcacatgtgtttccctgctactataaattagcaagagcttgaaattcttttaatgtaactgtctcctactgaagcataatttaaattctctcctaggggcaagcaatatctgactctaggtgttaagtattgaggcaatgagaatatgcatcaccttgtaaatcaactatcttggggggatcattatagcatcttaagcaggaaatgcttgtctcctcagagttgaggaggaggaggaattgattctattgacaaaggaagcaaagaaggattacagttgcaaattctcagattcatttgaatctgatagggacagagtaaagggacggagtaggtgattaaatagttaatcccattagggagttgtaagtagaaaaatatgggagacccctgtaagtttaatgattactcaaacaaacccagatttgtttaaccacaaaaccaagcaggcttgcttagcaacaaaaccacataagagaagcacaagacatgcctcaaaacaatgagagagtggtggcacgaaaccctcaccccgctcagtggctcaggaaattaggacgtgctctctccacacataaaaaacagtaatctgtggacctagcttgatcatataggaacaagaaaattcccctgtccaacctggaggaagaattgatgatggaagcctagtgtctactcaagaatgacaaaga

SEQ ID NO: 37529 - DNA, 854 bp, Bovine  19866880897682
tcagacccagagagccctggaccactttgcctttaatctctccctgcacttgccatgcgactcgccatgactttagggtcaaatggaggctgggaggctagtatctcacccccagtagtcactctgctccccatgtgcttggttcacttcccttctggacccaagtttcccctcctgtcgagcccccacctctcaaagtgctctgatttcctctgtttacctttgtaaggagaggtttacctttgtttattaggagaagctgaagacccttacttgcgagatctgggtttgagtcttcatcccgctcataggtgtaggtcaggcttgggggtgggagagccctggacgggagccaggcgttgagtctcaccccgtaccgcagctctagctggggtccctgggcgtctccccgctgtgtgaactgggctgggctagtgatgacccctggggcattccgagccaggcttcctcccactgggctcatgagcctgtgctttctgtcctgggtgctgtgcccgtggcacgctgccctcctggcaggacctggcagtgctgcaggacaagttgcgaatctccaccaagaagctggaggagtatgagaccctgttcaagtgccaggaggagacaacccagaagctagtgctggagtaccaggcacggctagaggagggcgaggagcggctgcgacggcagcaagaggacaaggacatccagatgaagggcatcatcagcaggtgagggcggccgtctggtccctgctccaggcccagccctggccccacacgcgcagagtggcagacctgcccgctgccctccaggaggccccagatccccgggacgggctgctcagctgc

SEQ ID NO: 37530 - DNA, 1805 bp, Bovine  19866880906160
tatccaatcgcatgtctccccagtgccttctctactctcaaacacctagaggaatcttagcaaccccctgggcacactctcttctctctcccacagcctgggccagtaatcagcagaatgatatcagtcacaactaccgattgctgaacaggcgtcttgagctgggtgctaagtacttttcatacttaaccccatcttttctaaccctaattccagattaagtactactataatgcccattttacagatgaggaagctgaagctccaagaggagacaagaagtaagctatgcatggtcacccagttggccagtggtggatctgggaccagaggacaaccagagacgtggatccaggtcctgggcgtttctctaccatctctctgagctcttccggctctcaagcctcctgcagtagggagctcctatctcagtctctgttttatgtctgctgtgttggttggaatattgcctacactgagttgctgtcttttatgctttatggtcccaacagaagctgcatcagggtggagtgagaagactacaggacttgtaggaagagaggagtgggttagagtctcagcttcaccatcactggtctatcattgatcactccctgaccttgattcctaatctcaggacacgcccattcccggctcactggatgcatgggaagtttccatgagacacagggctcaaaagctcatgggctttacggcaggcaccttaaacgacagatgctggggattccctggcagtcctgcagttaggacttggcactttcgctgctgtgatcttgggttcaatccctggtgctgctaagtcgcttcagtcgtgtctgagtctgtgtgaccccacagatggcagcccaccaggctcccccgtccctgggattctgcaggcaagaacactggagtgggttgccatttccttctccagtgcaagaaagtgaaaagtgaaagtgaagtcactcagttgtgtccgactcctagcgaccccatggaccgcagcctaccaggctcctctgtccatgggattttccaggcaagagtactggagataggtctctacacaggtttaaaaacagcaaaagacaagacacaaattattaaatgtaagaaatgaaagaagccacctctactaatcccatggacatcaaaggaataaaagagtattacaaatgactatgctcacaaatttgataatctagatgtagtggattgattccctaaaagacaatctgttaaaacccacaaagacaaatagacactctgaataggactatatagattaagaaggctgaattaataataatttttcaaaacaaacaacgccagccccagatgtgtcaatgatgaattctaccaaacatttaaggaagagattctctacaatctctttcacagactagtggtaaaaggaccattcctaattcactctgtgaggtcagcattaccctaatagtaaaaggagacaaacacagacaaaaggaaagctagagcacctctcatgaacaaggatgtaaaaattgtcaacaaaatattagcaaactgactccaacaatatataaaaataattatacacaaccaagtgagacttaatccaggtatacaagcctggttcaacattcaaaaatcagttagtggtaacccatcccatttaacaggctaaaaaagaaaaaccagatgaccatatcaaaagctgcaggaaaatcatctgataaaattcaacactcattcacaataaaaactctcaataagtaaaaaatagagtggaactttctcaacttgataacacatctacaaaa

SEQ ID NO: 37531 - DNA, 1489 bp, Bovine  19866880912223
cagagctgggaagcggccccccaccgcggctagagcagcccagcggccgccagctgttgggggacagatgttgggggagctgagagaggcgttcggggaggggcttgcgctgggacctccgaaggagtggggcgttttaacctcttaaatgctggttctgttgttttcggcttcttcttctgtgggtttgcaaagcagggaagaagcagaaggcataggaccatcccccccgcaacttgtttgcttcatagaatctcttctctagggccctcaagtgatcgtcccgaacgcaaaacaagcgaacactggttttgagtgtcagcgccttgtctcactagcttcctaacattggccctcccactctgagctccggtttccagaaaaggggtagcttagcaatggggacaggagtcgtagtgaaattccgatgggctctttcgttgaggctcattcacgcaacaaataactgctgggatcctgctcggtatccaggagagacaggccgagagagctagcttgattccgtccctggcgcacagctccctccgcaaagccacgaatacccagatgtctgcgttcccggcttccgcggagagaggacaaggcggtgcgcggcgcccactccactccttgcagcagctgccaggctgtgcttcctacctccgacacctctccattcccaaagcgcctctgtgttttgcgcctttgccccgtggcgtgcgcggggacccagggaggggcgcgcacaaggcagggggaggcggacagtggcctcgccccctaatccctttggcgctcccttcgcagctcccgaacacccctttcttgaagtttcgttgtctctgccgccgatttcgctgcttccggaattcggcggctcgggcctagctgcccgcctgggaaaggagtctatcggtttgtcagagcctggatacgtagcctcctggtgccccttgtttacgccaccttccccgagtaggggacacgcttcaggagccgcccgaaacgcatcccaaactgcaaaatgactcccatccccatccgaggatctaaccgggaggatggtttcattgactgggcggagacacgacgcgcgcagggagatcctagagcaggggacaggtcccggcatttggggtgatacgagatgggagataacgttgctgaaaggtcgcctgcggttcccgcctcagaacaaggcgatggggctctgcgagcggccaatggaggcgcagaacgcgcccggcgtcgcggactcgtggagcgggaagatcagggatgcgcgaggagtcttggatgcatcctggcggaaaacgacgaatcctgcagagccaagcgctaggatccaggaatttaaactccggttctgcgcaccgatcccggaacacggaaaccgctggctggagacgcaatagcttcgcctgcatctcaaggccgggaccttcctctaccatctctttcaggatctctctacccgagcctgcggagg

SEQ ID NO: 37532 - DNA, 946 bp, Bovine  19866880914178
ctagatagcatattgaaaagcagagacgttactttgccaacaaagaaaagtctttggtttgatttaaatcaaattttcacaagagttatgtagtgagcaaagcctcaggtgtgtactgagatagtcctgagtacaaaatctttttttttttccaaagagttctgtttatgtatttggccacactgcacggcctgtgagatcttaattccccaaccagggattgaaccaacacaccctgcattggaaggcagagtcttatccactggattttgggggaagtccttgaggacaaattctgattcccctattgatttatggaattgggcaagactgggcagtatcgagtttctttgggcctcaggttcctaatctgtaaaatggggctaatttctacctaccttgcagaattgtcttgagaaaccaatgaaatcaatatatcaagtaagctgcttgacatcgagtgtgtacagtgtgttcagtcgctcaatcatgtccaactttgcaatcctgtgcactgtagcccgccaggctcctctgtccatggaatttcctagggaagatactggagtgggttgccatttcctcctccagggtatcttcccaacccagggactgaacccgcgtctcttgcattggcaggcagattctttaccactagcgccacctgggaagccccaggagtgggtctccgataaatactagtgattttcttttcagacagaatggtggtagggggtttttcacaggggttttaataaagcaaaactccattttatttgaaaacccataatagataaaacattacaggattctttcccctgttttagtgaatcaaagatacaccaaattcaattgtttttaaatgccccaaaggactagtaagcttgatttatattttctttaccagtcacttctatttcataagtctgacttttccattaaaatg

SEQ ID NO: 37533 - DNA, 894 bp, Bovine  19866880990978
aacccctcttcccaccctcccactactctgctggactgaatttctctgtttcctagttccctttgcattccacatctcctcctttctcagtaacagggaaatgcaatgacagagaaaaaaggagctggagacctgggcttgacgcccagctccactgtaagctactttcttcctctctgcctcagtctcctcatctagtaaatgggtataaagtggttgctgagaatccaatccgtctgtgtgtgtgaaaatggcctggtctgccagtgagtaaacgggagttcctgtcctccttccccgcgagctccagtcatccgtcccagctcctcctggagcccagcttctgtctaatcaggctgaagtttgccctccatcacacacaacttcctcccatttaagggggactgtgggtcagataaagggctaaaggaacacacacagaggagataaatcagactgcagggattataagaaggcttcacggacaaaggcacttatgacctgggccttgaaggacagggaggagggagattgagaagagaggcgtccaggggaggggacagcatgggcaaagggcaagcaagcgcaggcccccgcagtgcccgacaggggtcccgcctgaaaccccggacaggaggagacgaggctcgagagggcggcagaggccacggggcccgtgggccacgctcaggactcggaaaggtttttaagatgtatatgggtatgggtgaagagtttctcagagagcctgttttttgttttatttatttccttatttttggctacgccgggtattcattactgcaagcgggctttctctagttgcagcaaaagggggctcctcttcattgcaacgtgcaggcttctccttgcaggggcttctctcgttcagag

SEQ ID NO: 37534 - DNA, 1525 bp, Bovine  19866881020467
agtgcaggcatttgccatgttccccaagggcacccagtgggtgaggggtatctcagctccaggattcagctacaacatcagctgacaattccctttgtacttatttcagcgctgcaaagcaaatttccgatcatcattgaattgttgttgttcagttgctaagccatgtccgattctttgcgactccgtggactgcagcactccaggcttccctatccttcactatctcccagagttttcttaaactcatgtccattgagttggtgatgccatccaaccatttcattgaattactgaataaatttccctgcaagaagtagaaaccctcatcagccaacccaggccttctggtctacctggcagtttctttcacagtacacagtagagtttcttgaccagggtatttagaggaaccatcaacccctaaaaccatgtgcaaaatggtgtgtgtgtacacatgaatatttgtgtgtgtgcatatgtgggcattttttgagggggagggttcatagattttgttattcctagtagaactgtgactctagaaaagagaaaggttaggaatcatggtgttaaaggaaaatattctcattcttatttgtacactgctctcttgcaagtttggtcactgtaaatcagtccttctcagtttgatcagcttgtgttcactcaccaaactgaggttctggatcctccaaggtactcccctgcttgaagagcaggcttcttggaccacatggcatcactcactttccaggcctttacctgtgctgttcctctggctggaaaccctcttcccacaccttggggtcaactccccatcattttttggatctcaagttggctgtttccttcttgaatcctcaggatgtctggttctggattaggtaccacttctttgtgctcccacagcatcacttccatctctctggtaccccacccccttctcttctactcttacccttcatctagggccactttttcccattcattgtgcttatgccatgatgcaattaactgtttatagtgcttgtctgctatttgccaaacaaagagttggacatgactgggcaactgaacaacatcaagaagctccatgaggaaggggtttgtgactagttttgccctgctttggtgcccagactaacagagtgtctggcatacagcaggcactcattagctgcagggaaacatgtaaagatgggtacttgaatcctttcagtgctacacttatgatctgtcacagttagacctctaacatcctctgccccactctatgactaggtatagacttgtcagccatgagaattccaaagagtgaaacactcacacgatcaagtttggtctttcatcagcagaagcttctttcccactaaatgcatgaatgtgtgtgcacgcatgtgcacaaacctatgtgtgatgagagaggagaaaacatatgccgcagagtttggaataaacatacctgcatttctcagaaagcgataattatagtccttgactatcctcgtgttcgggttataga

SEQ ID NO: 37535 - DNA, 1489 bp, Bovine  19866881037652
agcgaggcctctgaattctggagtaaagaaatgtccttttgagcagataaccatcattccctccttttatttttattttttccttcctttggaaagataggagttactgtaatgtttccccctcttccttccttgccttttactactgattctcatgtgagctaaatttactatttattttaaagattgcagaacagtcagatgggctttctaaggaaccaaaggcaaatggttattacctggagatagtagaccctgagaaacttggccctctgacattagctatggattctgtggtctactcatcccttccctggtggctcagatgataaagaatctgcctggaatgcaagacacccaggttcaatccctgggttgggaagatcgcctggagaagggaatggctgcccatgccagtattcttgcctggagaattccacggacagaggagcctagcaggctacagtccatggggattgcaaagagtcaaacatgactgagtgactaacattttcactttctgtggtcgattaggtgagggaggctgtgctagaattgtgcataatgtttttgaatcatggtagcagggaatattttagatatctggaaagaagtgatcgacagccagacagctataagtaaatgttgtagacacttttagagacatcaacgcagctcacaacagcatgtccttctctgagaaccaccccagagagcaatctaccctccagtaaacctgctccaaggtgcagctgctgaaagcatgaatggatgctacaccatttggcttttcttttccaggaatttagagttctgaaggaagaaaccttgagtctggagatagttggagcttggtcatatatgcagacctttaggggaagttcacagttttcaactcttgaggcccctgtacttccctggctcttgcttatggcctggttgtagtgacgtgctagtaaatttttacacaaccactttctttaaaaaaaaaaaaaaaacacatggaaatggaaaggaaggggatggaaccctgatttctagtgtttgctgatttccatggtgcaaatattcccactgtggcccatatcaagctaccgcatgaagtcactgaacagggagcagggaagtattgcacttaacaggttctcataagcaggtatgaaccggcctcagtgtgccactatctggctgtcaactgtcccttatattcagtagaactctccagtagcctcccaggaacctccctttgggatttacacaactcaaggggaatgtcagtcctttgcaacgaaaatatctttaaaacacctagctagcataacccccttttattctgaacagttttgttgttattgttgttcttcatgataagtcatgtcccactctctgagaccctgtggactgcagcatgccaggcttccctgtccttcactatctcctggaatttgctcaaattcatgtccattgagtcggtgatgccatccaacta

SEQ ID NO: 37536 - DNA, 1417 bp, Bovine  19866881054021
gccccactcccctcccgccccaccttttgtaagtatgtgaaaaggaaaaaaatgcaaacgttggagtctggccagagtgcctccctccagctgtgactctaactatgtaataatgtacagagaaagttgttggtgttctaagactgtgtggctgtgcaatttctgtacatttgcaattagaaatattaaagatttatttagctattttaagcctgactcgcctctccatgcagctgtgtctcgagcttttccagaggtgacccccaagtcatagactgacactgttctgtaccaggggcccccagcacttggttcaccccagtggcagttgagggcagggaaggaggatgggatctcttcctccctctagtcccccagagcgtgaccccctgggctcacctgtagtggacaccagcttctgccagactctgctgccccagcccctgaaatccggctccaggagggagggaggttggtccagggtcaccagcaggttgtgactgaactaaacataaaaaaacccctgatacctgagatgccccaatgcgtgacctccttcctgcccgcaaggctgaacccagggcctttgctgggaacaagccagtgcccaagcccctcggctgtacctgcacaaggtgaggactgcagaagaagcactcccctttcagaccaggcccctgggctcccatctgccctgttctccaccgtggtgcctcttcgcagacctcccagccagatgttcttgctgctctgagagccaccctcctatcccaaggggcgggggtgggaggtgccacagtgaccctctgccctggtcaccgccagctgggcagccctgccctcaccgttccatccctgcagtggcgatgagagaggcagccccggccacctgctttcatccgtcctcactcttcggcccctgctgctgctgctcacagcatttagaacaccagctctccacctgctcatcacctgctccaggaaggttttcttccctcagacaacgttttttaaagtgtactgcgtgcggggaccagccatctccacctcctgccctttccccagccctccgtcacctggcttacctgtcacacttctaccacctcatagccaaaccgtgggccgcctcagtgcttctgcaccactgaccctggtccctctgctggggtgatgctctgtaaatacaaaactcaaggaaatagcaatagatgcaacagaaaaaattttcttgttgacagaggcacttacaatgaagctacaggagccacgaacttccacatgtggattaaggagcatcggatagaaagcaaaatctgccagaaatgcaagaggaaaaaaatcaacaaaaacacaattgcatttgagactaacacaccaccagtattagtttatgacagatcaaggaaacattaagaat

SEQ ID NO: 37537 - DNA, 2956 bp, Bovine  19866881185060
tttctgcctgctccgcaaactgctgtgttgggaaggttattttttgcgccgggatcctctcatctggaggttgggaaccagttggttctgttctgggatctttcggctccctgggaacaggagtctggtccaggtgtggaggcggcggggaaagggatgttgtctgattatgagcctggagtcaagccagccagggctggggagggggcacagctgagctctgggaggtccgagggccatagatttgagcctttatacttatttccctgaaaacagcctgggggaggttcccagctggtctccaagatcactgggcccctcaacattcatttcttctttggaggttctggagataagcaccaaggacaggtaatcgttccccgtggataatagaaatgaatgccgctccgaggcgtcccaggtgaaaggtgtgctggcaaaagcttttttttttttttttgcagactggaaattttcctgcctcatttacaagacagttttaatgttggtaaaagtgatcttggatgtggtgtttctgccctcccagaagataatttcaaagtcactcatttatttattaatgttcctaagtagctgggagggtcagctggcaatacagtgccttcctcatttttttccctccgcggtattttctctgggtgatgctggccctccacacaggtgggcaacccaggtgccggtacccaaggctgatcacgtggggagcaagggcctgaccaccccttccagggagtatgtgtgttgctgggagttcccacacctgaaagttactaaggtaggattccgggcagtgtaagactaagggagggagataattgggaggtagggatgagggccttcagggacccaccactggccctgagtaggcagaaatcagttctgtccctttgggtgaggcatttcttggagcagggagaaggagcttggtgaggaactggagaaaatggaagaggggatctgttttctgttgacagtagatgcaagctgggctgggcacccaggcctgggtgttcttgactctctccctcccctgctgtagacagcgagtgcctggtccttctccgccttctcttgggtgatctcaagatgatcgtgcatttcagtgtctgggagtaatgggaagtacgtgatctttggatttaaagccaggcagttcctggggcaagtcaccttaactgttctgagcctcagtttgcccatcagcaaaatgggtctgatgataatcacgtcgttggaaacattaatattaatatattcatcgtgcacttaatagaaaatgtcctgttcagtgctgtttccttggcaactaacactgggttttgcacatttctgaaatgtttctaaaattttattaaataagttataacacatgaaagcggttagacagccgtgttgtaggttttcagtaagtggaagttaatatttggagggaaaagtcagtccgtcttggtaagcctccgttgtcttctctgcagtgtgggaataataatgtgcaatcacgttattattattcaagagatggaactagatgctacttgtcccttgaaaggtgaagagggcctgtgtggaggatcacagctactttgaacacaaaaaatagccgagtagaaagaccctgggacttgtctgcacccgagaaagcaaacctgttctatatgtgttttaaaaatcgatttttgatgtttggaccatacttctttttagtaatctaggcgtttatgttatgtctagtttttctttattaaaaatggtgctggtatttaatccttaaatatgcatcatttgtctccatctgtgattgtttccatgagataaagtcttagaattactaggtcaaaaaataagagcagtttcaggcttttgataagtatgcttcccatcgagagcctgtagtaatttacactcccccaaagatttttgagggtgcccacctgtttcttcgcgcctttgaaacattgggtgtcatcggtaacacgatctttgtcgtttgtgtaggcagaagagtggcatttctttgttatttgcgtttcttgctggttagtcactgaacattgttttcctgggtttaatggccagtagtgctgtgctgctgctttaaagtcttgtctgttcctgtcctttgccttctgaatgttctgacaagccctttgcaagagtcttccttgccctgtttggccttccttggttccttcaccaccatccatgtaggtggatctttgttaaatgggcctctgccttccaagtggtatggcagggaattcattaatgacctgcaaggagtgctccccagctccccctcccctgctctgctctccataagggaaccagatttaattcttaatccgataattatcgtaaggaagcctggcacttacacagcactttgagaggtctgttgctgtgcagcgccggtaagcagtgcaggggttgttagattcagggaaactgaggcacgtgggcaaaggcatggtggtgggaccgtccccagaagcctggccttgcgtccaggtcccagcccccctgcagcgtggtactcggagccccatgggcacctttggggcagggctgactggagccttgccaaggagcacgtgattctaggcttcgtctctagagggagggggagccacagaacatgacccggacgtggaaaagaaccaatttatttctgctttctcgtttttatcaccctccttttagatctgcagctccctcgtgtgtatcttccagagatccgagctgggcaatatttttaggaatggcggaaattagctagtaaggatgtgatcagccccaagctggggttttaaaggctagagaagccttttcctgtacaggtggctgtaggcatgtacacatgcctttgacatgcacacgagtgcacgtctttatatgtcttacaagtatgcatctgccctcatgaaggtgtgtatat

SEQ ID NO: 37538 - DNA, 1230 bp, Bovine  19866881301788
accttcaaacacgactcttcactttcaacttcccgaggaggaatcaattggctgtcaagtttcccagcgcctctgccacctcccacacccaggccctgccagctctcctcaaggtcggtgggagagatgggggcagaggaaggagggaggaaggacccagcccacaccagggggaggtgaggtctgcccagggtggtgggctgaagggacacatggggagaccagtagcagtcctcatctccttatcctccaatcacaccatgaattcctcacacatggggtggccagtgagcggggacagcctgctgctgctgctgagggtcctggggcttcggggtgaggagtaggtccacacagagcccctggacccaacccaacagcttatgcagatcccagtttgctgcctgcctgctgtccctgcctctgaccctctctcgtttccaggattcgctgctgagaagacagagcggtgcttgaactcagcctcaccatctctttagtgttagtcgctcagtcgtggccgactctttgtgaccccatggactgcagcccaccaggctccactgtccatgagattttccagacaaggatactggagtgggtttccttcttcatctctttggagcccaagaattggaggccagtgatgggcaggaggtccatttggtcccctgttcccagctccttccccatcctgccctcatccaaggccccacagagctctcagggtcctgactggatggccagctggcactgggtgacctggagaaatggcgcccccacccccaactccccttgtagggagaagggagttgtaccaggcaggcgaaaggttccgtatcttgcctaggtcacaatgctggcatgagactcggtcccaggtctgctgacgttacggctcattcccttagtacatcaaaatgtttaagcaccttttgtatggccaaactacaaaatccactccccctcttttatagaagggtaaactgaggctctcccagggtcacatgatctccaagagacagacatgcgaacaacactgggtccctgatcccctgtggggcgactttggtcctaggctgactcacaaaaggggtgagggccagcatgtggggtgcaaacagcccagactcaggagcgctcccaggtgagtggtgcccaggtcaagtccagcccctccccggcctcagtttgcacagaggaggtagatagaatgaggcctatagatcc

SEQ ID NO: 37539 - DNA, 1467 bp, Bovine  19866881329515
tttataaaatataaaaatatatgcctataagaaatattggagtcaaattcttcaaaataaaaagtcattgcatctcagtggtgggatgataaatgggtttttttctattttttgcaaatttttaatatttaagcaatgtacaaggatgatttacataagtgataaatatggttttaaataaaactaacaaccaggctcaaagcccagtcctgcactgaacgatttcagtaaacaccaacttccagtggtcttgcttccaagagccaggaaatcatactccacttagggaaacagtatgatccactgaacaagatatggccagagagccaggactctgccctcgaattccaagcagtgtgtgacttaacacctttgaagaaggggagagttgaaacagatgacatacttactgcatactgactttggaatacggttacgtatgttattaacgtgggacaagtatcacaatgccccctgtgacagactaatagtggtggggattcaaacgcaaacctaactccactccacactgacacctgtgaaacagaaataaggagtctaccatgcttactgcacaaagtaaacgtcaactgggataaatgtatgtgacagtcccccaaaaatatctagttccttgaaaggtaagactctaacgccctccactgctgctgctgctgctaagtcacttcagttgtgtccgactctgtgcaaccccatagacggcagcccaccaggctcctccgaccatgggattttccaggcaagagtactggagtgggttgccattgccttctccgatctatggccacacagctgacaaatggcaagactgagcctggaaggtagatgttgttcttactaccctctgcaggcagccagttgctaagccccatgggcctctggcaggctccaaggtggaaggggagtttggttttcgattgtggagaccaggtgtgcaggaatggcctaatctgatatttcctgtttaatgccaggggcacttttaaataagacactgctcctaggggacttaattgagactatttgggtctggggaatctgagggatttgttcatttctattatttttcctgcttttctagggatagggagtgggatggccagtggtgagtaagaattaagaactactttccaaaaaaaaagaatttctttccagacataaaaggaaagagcagggatatgagagaaaagtcttgttagcagtatttgtatttttattgtttttgtttgttacaattgctatttgtagaataaaatagcaatatatacctattaatttttttaaagtatataaagtaaatgaagtcattcgatcatcctaatctcatatctgagagataagctattgttcactattaagccttcttccttaatttttataactaattaaacatatggatgcttactcacatacatacatacacacacacacatttacactcttcca

SEQ ID NO: 37540 - DNA, 2160 bp, Bovine  19866881335670
ggagactgtagggtccctgataaggagaaataagatagtattgagggacatgggccaggagaaggccagattatgtcaggatgccagtaaggatctgcgttttggttaatagccgtttaggagtcaccgaaggttttcttaagtagttaatttggttgtgctgggtcttagctgtggcatatgggatctagttccctgaccagggattgaaccgggggccccctgtattgggagcatacagtctcagccactagaccaccagggaagtcccagcattgaagcttttcaaatggtaggggcacggcacaagttggagcgtggtccagagggcgagagggtggcaggagaccaatttggcagcagtattaataatccaagcccagggaacaaaaacaggctaggaacagtgacagggagataaaagaggaagtaacagacgtgagaggttatagaaggacttggtgtgggattggaacacggagagcagtgagcggaaggagccacaggagcggcccatgttttgacactggaaggatggagacaccattccctccgatagggaagacaggaacaggcctggcggagcaaagggggcagataaatttcctttgggagcgtaaggagtccatctcattattcttaagccaagccagcgggaagattttctgactattatttgaagccccgctcggagattctttgcaccaactgctttcaaattgttccatgaccttttacctactgaaattgtaaatccatctgtggcatgggattttaggaattctgtctttacttaattatgactcttcagccctagaaggctgtgatgtggtgtaattccatcaagaatacaggaaagccagaagtgagtttctttgttcaaggaattcaaagcaaggtaggagggtggtgagcttctgtccaacttgggcaaaagttaaaacatccttgaattgaatttgaagccattaacagttcaagacttgttgctctggactctaataaagaggtgatgaactttcagggagggcctggtgttagaccctgtagctagatagattaatcatagatgctatccacagcatggtttattctctcgttacccaaagtgtggtccatggaccagcagcgttagcatcaagaaacttactagaaatcttaggtgccactccaggcttatggaattagaatcttcatttaataagacctaaggtgatgtacatgcagtcatacagattaagaatataggctttgggaatttccctggtggttcagtggttagaattccgcctcccaatgcagagaacgtggtccctggttggaggactaagtttctacatgctgcaggccaactaagcccacgaggcaactactgagcctgtgctataaagcccagagcagacaaaaaaaaaaagagaagagtatgggatttggaatcagatgtatctggctttaaatctcagcttagccatttaactaccaaacctcttgaacctgcttcatgtataaaaccaatcagtggccctagactttggtttcaccttaagaactggagagctttccaaaaccaccatggcctgggcatactgcagaccaactacatcagcatctatcccaggcaggctcctgacgtcagaatttaaaggcctccaggggattccacgtctgaagcgacttagcagcagcagcaggggattccaacgtgtaaccaaggtggacagccactgatgactttgaaggacaagggtgtggccatcggaatcaatcttcataatgtattccaattctactatttcacatacgaggacttaagtttccctaagcttgagctcctccatctatgaaatggcacgacatgttagaaactctaagggctctgggcattgaaggagttgacacatgtagccacgatgcacagtgctcaatgagtattttgttgttttttatggaaatggcaacccactccactgttcttgcctggagaatcccagggacgggggagccttggtgggctgccatctctggggttgcacagagtcggacacgactgaagtgacttatcttaccttaccttatgcaagtcccagcttcctttgcagaaagaacctaggaagcaacacttggttttgcagttatcacatgaacgccagtctgtggtca

SEQ ID NO: 37541 - DNA, 963 bp, Bovine  19866881575820
ccttcacacactcacgtcttagagtcagagttagttgtttgtttgcttatgatggactgtctcacccaccagagtcccagtgccacaggtaagggtgtcctgccctcgtttaccatatcccagcacccagtcagtgcctggcagaccgtaggcattcaacaaccatttttttgattgattaatgaatgagtgagtgaatgaactaatgaatgaatgagccaaatgaatgaatgaaagaaactgctcagatatttgacgataagaaaatacttaggcaaataatggcaaatgtcagccgcagctttagccgtgtaggataaacatcatcctggtgatgtaacatcaaggaaactagtgcaagcctggtaatcacaatgcttaaagactgctccgagtaaacaaggcctgggagaagctagagacaaatgagaacagctgtgatgctggagtcatgagatcttggttgagatttacctctcaggtttggcaaactctatccatcctctttctagaggtttctgttgtgaaccagaaaggcaggctaagtcttccacggtgacctagtatccatgagaaccctctctgtcctgagcactcactgtactaagcattttgcatatgttgtgtcatttaagcttcacagcagccctgcgatcagcacattttacagatggtgaaggaaattgctgcccagagaagttatttgcctaagtcacacagctcataaaggcaaagatacaattcaaactcaggattatctgacacttacacacagctcccaaacccacactaacccccacaccaagcctttgttcacaaaacataagccacatatgtttaaacataactgtgtccatatatatgtatatgtatttataccatatatgtgtgtgtatatatatatacatatatatatttgtgcttcccaggtggtgctagtggtaaagaacctgtctgccaatg

SEQ ID NO: 37542 - DNA, 1282 bp, Bovine  19866880098748
agatggctggatggcatcactgactcaatggacgtgagtctcagtgaactccgggagttggtgttggacagggaggcctggcatgctgcaattcatggggtcgcacagagtcggacatgactgagcgactgaactgaactgaaccatacttcctaatgtggcagaaacccttctcagaagctctccagattaattgaatcggtttgaattgtatccacatgtccatatgctattgtaatctcactgtaattaaaatatattattgactatttaaagatttttctgcaactaatttctcataatctaatctagaaattggaaggatgaagtgatgactcctcaaattcattagccttagttggtatacacttaggaaagcaaaatttaggatctttagaaatcaaaaccaaagttcacattgctagaaagttgtacctctgtccccgccctcctccagaatatcttagtccacatttttttttaaacaaatagatttaagtgaatatatgttctgcctgcaatgcaggagacctaggtttgatccctgggttgggaagatcccctggaggagggaatggcaacccactcctgtattcttgcctgaagaattcccgtggacagagaagcctggcaggctacagtccatggtgttacaaagggttggacattactgagtaaataagcacacacagcacaatatgtttttatggatattatagattctcacagtcacttctaacagttttcatttaaatgcacagtggttagctaaactgtctttttgttagtgacaaattgtatagcaaagaacacaaactttagagtaaagctctctaaggtcagatttcagctctgctgctctaagaccctaggcaagtcacaaccttgccttggctttctcatctgtaaaacagaaacactgttaccacttgtttcattggataaggaagattaggtaaattcaatatgagttcttagtagagtgtctggcacaggggaagaactatatggatgtttgctgttatcattgctaactaaattcttcctaagagctttgccctaaaattagaatgtagaagagaatctcaatatgtttttatttagaaatttttaagtttgaatcatttagtatattaaactcctttttgatcttttgtgtgtgtgtgtgtgtgtgtggtggtggttttggttaactttagtaatttcattagtacatgggaaaatttaagggataaaccactgaataaacctaaggcatcccaaagtgaagggggcaattaaa

SEQ ID NO: 37543 - DNA, 717 bp, Bovine  19866880129992
ctgggtgttcattggaaggactgatgctaaagctgaaactccaatactttggctacctcatgcaaagagttgactcactggaaaagactctgatgttgggagggattgggggcaggaggagaaggggacgacagaggatgagatggctggatggcatcaccgactcgatggacttgagtttgagtgaactccgggagttggtgatggacagggagacctggtgtgctgcgattcatggggttgcaaagagttgaacacgactgagcgactgaactgaactgaactgaacatgacgtacagatatatgttgcccatgagccagagtttgaaaaatattattataaaaagcaacaactttattgttaaaaaataaataacacactctatagttacaaaaggtctcaataatcataggatgttaaatttttaagagactgttcagtttgaaagtctcttttccactcttttaatctttcttcaaaacattttattttatattctaaataacatgatgtacttttagtacatgcacattttgttcaaatttcaatttatagtattctcccttgcttatcgcatattaaaatgttgcagaactggggacatggattctgaattgtatttccacttacccatgctctccatattcaagggttctgcttcttcactaactagaatataataaaatgatgttaaatttacattttgaatcagata

SEQ ID NO: 37544 - DNA, 1687 bp, Bovine  19866880410169
actcccagaaataaaacggaaaagtgttaggtcaaagaatatatatatatattatagatatgaaactcatatatatatatatatattttttttcccccagattttgataattctcgtaagtagctcatgaaagggacatatcatactgattttcccgcactcctgcttcattcaattataccaatctttctaggttttggcagtttagcttctgactatctggatccaggccctgtcctaaatcctgaccactggattcttggcactgccccatcctgacctctgcatgtctctgtctgcctggtgatagagcccttagatttcttactcccactttctggtgaccagttgcctggtgcaggagcaaagatgatagacccattgcttctttgggcttcatacagtaatcagtatcccatcttgtattttaaggggaggggaaaaacataaaccaagtgaacagctcacaacaagtatttagaagacaacactggtttcagagaacaaaagacttgtaaatgtttcctgccttcagggatgaaaagcaaatggttgtgttttccaaaggcttgtattggttccgctgacaggctggggcccaggccatctgttccaatatttctaaaaagcatcccaaaggcattgttatgtcagaacagtctgttgttcctattgtttttctcaatagtaaaggaccacacacctactcctccattttgcaggcaacttaccataataccttctttccagatggctacgttccaacccccaacagtgaggataatgtccttgtagaaaggtgacctctgaacggtgtggacagctccatcatggactgtgtagaggctcacaggcttctttgctgttggagtggaaaaggccatttcatctttcataacactgtttacattcctacaatgaagaatgggcagatctctgatggacagataggtcctgattaatgaggtctgagagtggagaaccagagatcagttgaggtgaatcaatctgtcaagggacagctcctccttttatggaaagtccagggaaattcccatcgaagccactttggaggctcaaaggaacactttctgttcttattcatttactcatttattaacccatcacttagtcagtgttatagattgctagtcaatagatatttgtggactgtttgtacgtaccagctgctatggatggctgggtaaaaaatggttaataaacaaacatgatctgccctctcagaacttaaaatccagtggaaagacagatactccacaaacaaatcccaaggtatataataagaaaatgtgaaatgtattatgaaggaaaaaaatatcacaagaaaaaataacaagggacatttcgaaaggattctctgaaggtgagtcatttaggcctgagttcggcacgggaagattttggtgtggagtaaatggcaccccactccagtactcttgcctggaaaatcccatggacggaggagcctggtaggctgcagtccatgggattgcgaagagtcggacacgactgagcggcttcactttcacttttcactttcgtacattggagaaggaaatggcaacctactccagtgttcttgcctggagaatcccaggaattgcagagcctggtgggctgccatctatggggtggcacagagtcagacacgactgaagcgacttag

SEQ ID NO: 37545 - DNA, 2424 bp, Bovine  19866880452428
cttgtgacccccatggactgtagtccaccaggcatcctctgtccatggggtttcccaggcaagaatactggagtgggttgccatttctttctccaggagacctttccgaccccagggatctaaaccccatctcctgcactggcaggcggattctttaccactgagccaccaaggaagcctagaggcatgttaatcaaaggagtgaaggaaatagcagtctaaagctttcgtgttcactgcaagcccaagagaaacctcccctttcccacactgcccatgtggagttgggctgggaagttttatagaagctggttgcttagggaggtagaaggcagtaggttcctccaagacagacacagagactctgagagacccctcccctcgagttcagtgagatcatccaccaggtctccaaggcttggcaccctcatagggacactgccacatccaaggacagcacccacactgcgcaggcctggctcctctccccatgaccagcccccctgcagccaaccacccattcctacaggaacatgtgtccccttctgcgcaaaatgctcaggagtatttccaacggactggcttcttctgggaagcttctgagaagcttcaagaagagtacaacaccacaggacatggacatggaatccctggttgctcagatgctggccccaaacagggtgctggctccaagcacgaccacctgctgtggagacatcaccgcccgagtttacaggacttccttcatgctacagatcagttaaatggacccagtctgaaaggacacagggtccactgggtagcttaggaaggtaggaagctaaacagccacaaaagccttagatttgtaacttaaaggaaacctgcatcacacgagtggcttccagtgtttgaggggtgcccacatctggacagttgtcaggaagatggtcaccccttatcaccgaaacttagcactcaaagccgaagttccaggacaggcacgtacgcctgtaagcactaagatccacagcccaactacctgatttaccaaattcagcccatccttacggggcttcccctgtggctcagtggtaaagaatctgcctgcaatgcaggagacaggggttcgatccctgggtcgggaagatccactgaaggagggtatgacagcccactccagtattcttgcctggagaatcccatggacagaggagcctggcgggttatagtccatagggtcacttagagtcagacacaactgaagcgacttagcaggcaggcaggcccatctttacccatttcctttctcttttccactatacctccaaaccagtccaccccaatctgggcaccaaggacaatgtcctaaatgcatatttaaaatgaacccccagcatctaaaaagtttcttttctacaaaatctcaaaaatctaagtaaaactatagtattttaagtaagtaaaaaactacagtattttcctatgttccaatctatacagaatttgcaatagtttttggtaggaaataatgataactgcttaccttaatggtgtcataagagtctgtaataattgcaatgaaaaggctgagaatcatgtatatgaaaaggctgatgaaggaatataaatacaggcgactgaacagccacaccaagtggctcttctgctggatgtgagcaaaggtcgcatacatgtcatcaccgttgaccagagaaaacagacactcggcaaccgtgttcagattttcaaactgtggaagagggagaccaaaagtagtctgagatatgctagccaacgaagtagagaagtatctagttagctggttttgttgaagacgttgttgctgccattcttattacaattgacattcactttagggcacctggaataccatgcattgcaaattgttactcaaaactctcctctacattcacaaagataatttcttggcacctctctcagttttttccctttgcactctttctgttgttgttgttgttcagatgctaagtcatgtttgactctttgcaaccccatggactgtggcacccatgcttccctgtcctctgtctctcagagtttgctcaaactcatgtccattgagtcaataatgccatccaaccatctcatcctctgtcacccccttctcttcctgccttcagtctttcccagcatcagggtcttttccaatgactttttatatatttgtgatcatgtcacctgacaattttggatcagatttttctttcttttctacttaacacagtcttgtattattcatacccagagatgatttgttggaaatgtcaactgtaactatttccctttcactggacatcctaatcatgtttgctcttgtaaagaacaatgcaaatcacacttctcggcactgagttttttcctattattaggtctcagtatcaacttttttttttttttttt

SEQ ID NO: 37546 - DNA, 824 bp, Bovine  19866880556450
cttggctttgaggcctcggatttctctccagtgccaagagtcccttcacgaaaatcagattttttttttcacctggcaattctatcactttgcagttggtgggtttcgtccacaaaaattgtcttctagaagataaaatccagtagagcactacccagtaaaagctacacagagaaccataattcaaaatcccaggccagtaatcagattcactccagatccgaccgcaccattctaaactctttttttagaaactagaaatacttgttttggaaataaatatcttttgggaatgtgttattaacttcacgagcatttctctgtggataatcaaactaatcagatactatttgcaaaaggaaaccaagattatagtcacaaaagaccaccatgagtgacttcgttaaagtaaaaatttcagaaaagatctattgtttcttcttaccttgaagaaaatgttatgctaatatgttctaatataagcaaacccaaaagtatgaatatcaacatagataaattagggaattattttagttgctttactaaggctttcagtatataatttatataagtagataataactatggtaggatgcaggtagaatttgatttatttaaaaatgtagctcacatatgatattttttaattattgaaaaatttattatacattcagaagagtgttataaaacataactaaacagcttaaagaaaaataataaaatgaacacttgtgtatttattacacagattaagcaatcaaaacttagaagacccatgaatacccttcctcactcatagtcttcccataggggtaactactcat

SEQ ID NO: 37547 - DNA, 2119 bp, Bovine  19866880598810
ttaaaagcttcaattaacatttattaagatctcaaaaatagcatttactaattttagattaattaagattaatcagatgcttttttttttcagatgcttttaaaaagataaaagttacagatgacatttgaatttcaccccctagtttagctgtgctcatactgtttacatggagaactatgatatagtataatcattgaagttctcaaacaataaacctgaaataatcagccagcattaaataacgttcaacatgctgtatttatgacaaacacaaataacacgttagatggatttagtttttttttttttttggatttagtttttagcagttaaaaaatttacacgtgaaaggctaaccttgaattatttttaaaaattgctatatgatgccaactgcataaaaataatgtgaattgctcattagagattgtcaagggtgttaattcaagagaaatatcaatgctatctcttattgagaaaatccaagggtgttatataacctagaggatgtattttgtgtccagtatactgtcaataattctgagataatatagatattgtagaagtgactttcagactgtgccatggaaacttttagagcccctgaaaagtgggcagaggagtcttccctttccagtgtgtggaaaaccagagcaatgtggctttgatcaggttcaaaggcaagggattccatataaactgtggcttgaaaaatgcattctactgctaaattagaagtctaaaaattcttggacttacgcccaccacactggggaggaagtagggtggatatgtgtgagaaaggacagagaacataaactaatcatattttagaagatctttcaatgtaaatatgtgcttcttctatccaaatatctctaaaagaaaaaatattagcccagagcaaagcagtgaaggcaggagaaatgaacccataccagaatctggagaatgcattgagcaatattctcaagccaatagatgacttctgcaccaagttctttgtgggaacagaggtgagttggaattacctgcttctaaaattagcatttaaattacatttaaatatatgattatgacctctatagtatgtttgtcttatgagggcttacaatacattttttagtcttctatcttttggcttacaatatttatcctgttttcatatttttatatgcttgcttacatttaaaaattttaacctcaatgtctcataggttcatatttgaatagtctatcaagttcttagatgtctttaaattcataaatgtgaacagtctataaaattagatatgactttctactaataaaagactataaaagtaagtatgactctttttactaataaattaccaacttgcaaatatttatcaaatacctataccatatggaaaaactatgctaagtgtttcagatttactaagaaaatatattgctttgttaggccagtacaatctaataggagagtgaaaaactcactcaattcaaaaggtaaatagcaattggatatagtaacaataatgacaaactatgcataaacatgaaatttaccatcttaaccatttttttgtataccattcagtggtactaagtatattcatatcattgggtaactctcaccaccatccgtcttgagaactatttcattatcccaaattgaagttttgtcccagttaaagcagtaactctgcattccctactgactccagctcctgcgaccacaattttacttactttctcaatgaatttgactgttttagtagtcaaatgcaagtggaatcatataatatttgtctctgtgcacaccaaagttttataggccaaggatgacagcttcagaaagaaaatctttaagatgatttatggacggaggttactgacattgtacaggagaccgggatcaagaccatccccgagaaaaagaaatgcaaaaaagcaaaatggctgtctgaggaggccttacaaatagctgtgaaaagaagagaagcgaaaagcaaaggagaaaaggaaagatatacccatttggaatgtagagttccaaagaacagcaagggagagataagaaagccttcgtcagcaatcaatgtaaagaaatagaggaaaaccatagactagg

SEQ ID NO: 37548 - DNA, 1187 bp, Bovine  19866880602336
ttaaagaaattctgcttcctctgaaaataataatgtttattctttatgcaatggatctcatccctgtaggccatgacagcctagtgtgcttcaaactttcatagagattgggttatacgttcatcaacatgtgcccaaaatattgttgcttcttctgggtgtgcagaaaacgactgtgctgtcttacagatgaattgtatatagagagatacaacttgtagttagtgctaaagatcatgtttaccggaacaagcaaaactcttgcagacgatatatatgagtatgaggccaggggagggaacagctcaactcaaataacagtgctgaagggcaatgtggtaaacacaaaaattctcaaccaccaagcacttaccaaatgcttgactcaataaatctgtagtatgttgagtgagtaacttgtaggctggactgggaactgtaaataccacttagagccttctttttgctgggaaatttgttccaagttccaaacaacttattagcaaagggattttggcaactcattatgttgtaacttgggaacttcctgaactggagcaacgcaaagtggaacagggatcttgtaggccagatgtgattacctttgatgtatgaatccttaaaagggagaaaggagaaggaaagatggtgaactgtgttgcaacaggaaaaagacattctaactagatggtttttaataaatctgagcagaagacaaggaagtgatgcgagaaagatatgcagaggggatggggcaggaagaacagctagtttattgacctataggcaggaacaggaaaaaggagacagaacacaaagggcaagtaaagagacaaatgtggctctaaattctagttttttggagggattatccaccagattctgtaaatccttgtagggcctagagtgtctcacttttctaaaaaaaaaaaaaaaaaattttaatcagtaaaaccaaattaaaattaacagcaaaaaatggtaaacacaaagcctgaggatatactttgccttaaagatcactggctggaaaatcattcaaaactttttcaacaaacatttgctgatcagcttcctgtatacaaactggtctagtttatgttcctggagacccaaagatttataacattgtttctatgaggggaaaggcaggccagtgtaggggatggattctacaatacttgata

SEQ ID NO: 37549 - DNA, 1829 bp, Bovine  19866880603421
atgagggggagcatttaggagaagacgacagtctagttctaagcagttggagagactgacacactgtactttttagcttctgccttcttatggtggaaaaaacacacagtaggtccatgtatcagttctttgtcaacgaaaaattagttcttgggaaaaccagaaaaagaaaaaaatgcagttttgttttttttgatatatgttatgggtagaactaagctttaggattgagaaatgcttgttacaatacccagtgttataccaaactaacttttgttcattctaaacatttagtttatataattatacgtataagatgttttaaatactacccagtggatatttcagggaggttatttttgttcccaatcaccaaaaatagcaagttttgtggcagaattcttcttttaatgatgatgatgtcattttcagtaaaaactttaggtaactgattactgaatacaagcactgcagctgtttgggaattttctaatgaatgcatgagcataaaaacatatgttttacatttttaaaagggatttaaaaagcatagtcagtagagtaagccaaactaagccagtcataaaaatacgtaatcaaaatgtcaagaattaacaggattagttttaaaaaccaaaaagtttctttctcatatatggtagagaatatcttgcttctactcataaaattcataattatttaaagtggaagatttttaaaaaatcactatttactgatagtgggcaagtaccagtatatatgccaaattcagaatttacctttgtcacagagataggagataaacatgtctgaccaccagcactgaaattgcagaaaacctcaatggcatctgaagggcatccaagatttggatcaatccagtattttcctgtttattgtgaaacaaaaacgtttaaatgacatgctaaaatatttctgaacaatccttaaaaagtatcatacttaaaaaacttagaagtttatgaagatcatacatttaaatcaatacatttagtgaaaaagtaaaagctgcaagcattatgttaaactgatagtgaaaatactatatttttcacatacctatcaatttaaggccatttcataattttaataaaaaataattgaatggctatatctgttacttcatgctatagataaaatgaactcagcaagttaagtgaattgtctacaaagttaatagagaagctgaaattaatgtaggataggtgtgtatttttgttctatgtccttacagagcttaaaaatgaatatatatattttaaaaatagaaacctctttagtctccctgaggaaaaatatatctttgtttaattgataattaaaaagaataaccatttttgtttccagaagaaaagtgtacaattaaatggttatttttgtgctttcttttcagatttgtgagtggaaaagactgaagtctctatagctagtgtaagcctgccaacctttgcatccattgagtggccaggagaatcaaatggggcataaagttggactttaggacatattcaaactgaaaagtactggggtagcatcttaattctggaataacaggctcagaatattcaaacagcaccttattctaaatgcaaagagtaggaatttttgaatgagatggccctgccttcttgcattaaaaaggcaagacaaaacacatagtatttgttaaaggccattttctataataggtagaaaacccttgtttgtttcattttttttcccatagcaaagatttcctcttgctcattctgggcttgccctggtctgtcatagtagatttacacacatcctcgaccattccccctcta

SEQ ID NO: 37550 - DNA, 834 bp, Bovine  19866880642428
taaagaaatggaaagagaagcaactttaccttactaaattttgctgcatattttctaccttcattaaaatttggaccccagtctgacagcaaatgtaggctttcaacctgaaataaaaaagtcatattaaaggaagtaaaactgctttttggtgtattttaaaactgtgtctatggaaaactaagcatctatgagtagctaattataatacttaaaatttacctatccaagcacagaaaaagtgttaaagatattttctaaccaacaatctaagtgtaaaaaaaattatctatcttctctctgtacacattaatcttgctaatttatttaattttttaaaaaagtatccaatttgatcacaggtattttgccttattgttaaatatatgaccagtaataacaattagattgttcgtagcaagaagaaaggcttccctggtggctcagtggtaaagaacctgcctgctaagcaggagatgcaggtttgatccctgggctgggaagatcccctggagaaggaaatggcaacccacttcagtattcttgcctgggaaatcccacaaacacaggagtctggggggctacagcccatgggattgcagggagtcagacatgagctggatgactaaacaacgactacagtaaaaggaaaagaaacatggtagcggtcccaaagacactgtgtggtatgcaacatagatagggtttgtgtcaacattttttatgaaaagcagaagataagatttaactagaactgaatcagatgctttagaattcacccaatttaaaatttaaaacaaaccaagcatgactatcttaagcaggtatcacctg

SEQ ID NO: 37551 - DNA, 1272 bp, Bovine  19866880663412
atcacattttgctatacaatatgatttgtgaggatattttctttcaaaatacagtcatagttagaatttataacacagaacaactattatagggggatagagatacctagtctacataggtgttttggaaatttttgagaccatatgacaaatggaagccaaagtggttttctgttttgatttctggctcctattaagaatcattaaaatttttgatattataatgctgccagtaatctgatgcagaatgtagtgttcataggttggccagtttgttactagttgagatgattatttaagaaatctaaagtcattccctagtaaatactgttaagtttccacaagccataaaagggaattttaatttatttactatacttcattacaagtctttataaatttaattagcagatagtactcaaaaataaatggaaaagtttattttcaagttgagcaccaagttgagctagcttggccttttaccgctttaaaaaacaattagcctactttgactgtactcttcttgttccatgatctgtgaaagaagaaaaattagggcaggtaacaagtagtattaaatagctggtatgatctttgcattatatcttaaattgaagttgacgcttaatgcagattcctaccaattctgttttctgaaatatatgtggctccatttttgtaactttatgagctatattttctttatgggtttttccaataaattctttcatgcattagccctttcaagactagtaaaactatgtaggcaagtaatttttgtctgtcttctacatctaaatccttctgttagaaattctgccatcgtggccccagaagcaagcaggtccatgttttagtttctgtttttttgttttgggaagagtgccataaaacatcagagttgctggtggcaggaaaacactgagaattacaaattcagcagaaagcagtgttgtgttgatttttgaaagtcctacatttctaaatggtgcttaatgttttgggaatctctaagactattggttgttaaaatgaaggtttaatatatgtgagggtgggaccttgaggttctacattttaacaaactaccagtatagatgttatttggtatacacttttagaatagtaaggctctgtaattctgggtacctccaatcacctatcttgatattttgttaaatgttttgaaaaagcattctactttattctggcacttggtacttatgctaacccctttattagagcaaagtgcttgagctctttctgcttccg

SEQ ID NO: 37552 - DNA, 2357 bp, Bovine  19866880851465
agtgagagttgtctagaagaagttaccccaccttgcgactgtgccttggttaaacaaagtggatattttaaacgtatgcatgaatttgttataacatttctagaagtcatgtctactataactatcaaagttgttcagctgttctttcagtgaacatattgccagggtctattggggtctatcggggccagatcttttgttagtagaatgccccgaggaacatgggagcatacagaaggcatatctaatgcagccagggcttgcagctggggcgggagcagggttctgctggcaggcttctgaggcagcttagtacctacagtgtatgaattgtgtatactggacacacaaaatatttctcatactttcagtctatttgcctttataaatgacaacatgcaacttctctgaattcatagaaaattatgggcacttcaagcttgatgtctggtgcttactttggatggtgtgcccagcaaatttttatgcttctcaacttttgggaaaattagtttaaaattttagaaacttgtcagttctctagtttttaacatactaaatcttgcaggccctttggcagctgacacttatttccctttggtatttggtgataaatcatatttgtatttgttctctgcagacagagtatcagtggctcttagaaactcaatagacgtactgtgttattatcatcaacaaggaaatgaaccacttgaatgagtacattatatcaagagagtaacaagaccagccagagctcctgctttgcttttcatttaaaaactacacgtttccagccttcttcccagaaactgtcttgctgtgatatcttaatgcatgggcctttgaaaatctagaactttgctgttatgtcttcatgttctctccagataatgacaggggtcttgcccagttttcttcagagctatttttatttatcctgtgtactctgaccccactgggtttctttctgttttcctatctaaccttcctattcacattcctctagatctaagtcctggttcagagatgagagtgctgaacagtaacttccaactctgacatatggaactataacaattgtgttttatctacagattaaggcaatgtaatacttcctggggtgcttttcactttacaaattatttataatctgttttctatgagcagagtgatcttcatgtgataagtgacatttgatcaacatgcttatcagccaaaatactgggtactatcagttaaaatatcatcttacatattgtgtcatttgttgaatagcaagtcatggtgtagtcctagagagagaaaattactaatcttccattagtagttgtttctacatcaggaatttaatgagttttagtagttttgtcttgttatggactctaggctactacttatcaattttgttatataagcaaatgagtttcttttagctgcagctaagagaaaaatcaaattaaggaaatgaagaatctaatgtatcagaactccaggggttccaggactggtccattcatcagctcacaatgtcatcaaggatccaggctctttctgtcactctgtcctgtcacgctaggtgatatcatggtgtcagaccagtccagttccaggcaccatacaggacaatggaccatacagaaagaagtgagattatgtttctttctatgtctccagaaactcaacagacttctcctccatggctaaaagtaggtcatttgtaccagtccctgctaagagggatggaactgccatgactgccttagactaggagatacctgaagggatgtggcataattaactgtgataatccatgtaaaaccacctaccacaatgcctgggacttagaaagagcttaataaattttacttaatgatgaaagttaagtctgtggcagtagtgccagagttacgagtagttaagagagagatttctcagaccttgatgatactcattctgtgtttaggagagagatgacaaggatcacttgcatgtagcgagcacctggaaagcccatctacagtgctggcttgtagaactaaacctcaggtttttagaaagaacatatagaaagactctactcataggaagagacttgggtaagttactagaacaggactccagggaaaagaatcaaaaagcaatacctagggatatagtcttaaatgggacaaagcgtaaagaaagagttaatactacatcccagagcattgacctggagcttgttaaatcctcctttttcaggtcatgattgatcctggggattgggtaggaatgaacccaaagctgatgaaatctcctatactttatatggatatgagcaagcacgcagaagttagcagcaaagcaaggcctac

SEQ ID NO: 37553 - DNA, 731 bp, Bovine  19866880914651
ttattctgcctttcctattttaaagggctcaaactgacttttaaaatccagtgtgaataatagtattagtgattgagtcggacacaactgagcgactaaatgataacatcttttcaaatcatgctcctaaatgtggaacatatacatggcgagttcttgacctatcagttccttgactgttctggagaccaggcctctggggtgatcccaagaaaggagggcctagcagaatgatgcattccgttacagcacacttcaaataaagaggtcaatttttcttcatgaaaattggattttaaaagctccccacaaaattttgaccatctgaaatgtcatgtttcactcacccaatacctaatgatccttacaatgctaataaaagattagaaagcttgtttgaaaacacagttactcaaagacaaaactttcaacattctagaaattctgtttcttgggatctaaaattgaagtcctttttctctactcagaagaaattaccattccattgatctcctccccattaggtactgtattttattgactctcaacaagttctaggaaaacgtcactccttgaggttcttgatgaacctaccttaattgtttcatatgtatcagtgatcagtgcaatgaaaagacttaaaatcatgtatataaaaaggctgatgaatgagtaaaggtaaattctgctaacagccagaccaggtacttttttgctgcattttcgcaaat

SEQ ID NO: 37554 - DNA, 1736 bp, Bovine  19866881000000
cataattctacacacagtgtttactatatatggggagaagatccctgaagctgctttagaaagtatatgtatttttcaaacgcctaacctttactgtctatgaatcacatttctaccactactctatatcaaaggtctttgggccattactgtctttagatgctcttctccaatttctaccccaaggttacatatatttgtattctataagtttcttctgtgcttataatgttctcattatcttttcctatttctaatctttccaagtctcttttaatgaatatctctggtttctttttggtctaaaacttttcttaattgtaaactaaaaatgaattacattgatattcaattttatcatttgttttcttaaccattaagcacacagatgcaatacagatgtaataatcttttatagtcatattgcaatttcataactataaattccaataaaactaggaaactttaattttaataagtgagatcataatgtatacagagctgccataaggtaaaaattaaatcatgtatatacataaatacacatacacattccaaaagtactttgaagagttccaagtgtttcttctttagctattgttagatgtttccaaacacagcattaaactgctcatcacaacaccctgtgtggtaatgccaagaggagagttggaatggggtgaaaggcacagaattcacagtaagacacagctcactgtgtggacaaggacagccagattcgcgagcactgatggttcaaacaacaatgcggaatcgctgcttttctgaactgactgtaagaaatagaagttcctagtacttacacaatcttttacataggacatcataccaggtgccacccaagtagaagatccattcagttgtctcaagaggttaagttacacacaaatcccaaggacaagaatgggcatctgagagaccagtcctcctgtggctagctggtgtgccacatggcccttcttagtgaggttccgctaaagagaatgccaacttttggctaacgcaggatccttggatcaaactaacacagttttcagcctacagaataaagcatattaaagtctaagcttttcaggaagctagaaaatacattaaaacattttttttttccaagatggtttaatcacttttcagagaaacaaaactttccaatgaccaagtgaaagtacccccaaatcttccaacaaggtcctctgccactatctgggtactgtcacattcttcctccaaaagaagtgctcaattttcatcaccaatgttcttagtagattcacttttcactgaaaaagtaagtaaacatacagtcaagagtgtatactgtttctgtttagcctgttctgtttttccctcttctctcctcccttctgattcataccaacagcactgctcatggggacagacaaaccatgtcatgtcccaggcagctgagatatacaattctggccacaataaatacagaaatgatgtctgaaagtggcaattatattttgtgaggtaacatccttcctgactctgcggaagactcaggaatggtcacttcacagtgtgggcaggatccgatacttgcaccactgaacagaccactattatcactcaggctggccaagtgtggttggaataaatttttccaggattttttttaaacttaaaattgagggtcagtatatattgaatgaatgtgggctgacagaagactagctaatcgccatctcctt

SEQ ID NO: 37555 - DNA, 1427 bp, Bovine  19866881108309
aacaaaacagacaagatctctgctgtcatggaacatgcagtgtagaaggacagtgtgaacaagaataataatttctgatagttataagccctatgaggaaaataaaacatggtgatgggattttgaatgccctgataaaggggctactttaattgggatggccacagaaggaccacctgaagttacattgagctatatgcctaaagataaaaagaagccaatcatgtgactatctgaaaaggagtattctaggcagaggaaacatctaatgcaaatgtcccaaggtagaaagggtatttattaaatgcgctattttaaaaaaggaagggtccaagtagtaaataactggaaaacaggatgtcagagaaataggaggtggcagatcacataggggactatagaccatgataagaggtttgaagattattctgattgcaatgggaagccatttggaaggttttacataaggagagatgtttgattaaaattgttcatgatcatttgggtcactctgaagaaatggaacctaagagtaaacgtgggtcaaatcacttagaaggctgtggcagtcatgtaggcgaaaaaacgatagagtgacttggaacacaggggagcaatagagatagaaaatactagccagattcaagacatcttggagatatagttgactggatttgctcatggtttggctgttgagaaagaaggaaagcataataaagaataaatctgagttttaggtgagcaactgagttgttgctcattacaattacgtgtgtaatagggttacagattggtactttgacatgtgcaaatataacatttatttctggctaatctggttttcctcacaagccctaacttagattagtggggagtggttggggaattgaaagagaaagaaaggaaacttttatatccaattcagttaaaagctcaatctattcctataatttagtagtctctttgggtaaagctcagactcttatgatgcttagtctctcaaatgtatcagtcttccacctccctcttttcttacttcctaatactgactctgtgtttgcagtggtggcaaggatgaggaggccttggatctagaatactggacaaaagatgggaactagtgattcccatatagatgctgaattactgtataaagagatattcattcttcctttataatcaggaatatgtgaattgaaatccataataatatatcattttgctcccttgagatggacaaattttaagtctgatagtaccaaacatgtaagatttggagtaattggaactcttaaaggttgcttttgggaatgtaaataggctaaaactctggagaataagttggcaaaatcttatgtactgaaaggtacatgtatcctgcaagccagcaatccaattccagagtatacaccctcacccaaaaaact

SEQ ID NO: 37556 - DNA, 2074 bp, Bovine  19866881111723
agaggttttatatagaaagcctattaacatgtgacaccactccttgcaatgaagattaatgcaagacaattactatcactttaagaaataatctgtgtgcttatcatatttgttaattagttggttaggttcagacttagtggaacaggaagtatacctgagaaagtatgtaactggaagtaaataaaaattttctgttttggaggagaaggtagatgacagaaaaggaaggagagacaaaatgagtaaaagaacatttttataatgcatcactaatcctgggttaataaattgttccagcaaattacatgcagtgtggctatcatgggacatggctatgtcaaggccatgcacgctccttttttccctcatgtgttttttattattggccaaatttaattacaagctatcaatcttaccatcctgtgatctagtcaataaactcagggccaggaaagatggtcaatactgctcatccatctgaacaaacatgcaaatacctttgggccttgaactcctgggcttcctggtgggcctgacgaaccctttgctccttgaggacctagagatccagtcagtcctattcttcctgggctgcctctgatgccctaaaaaacagataagaaatgaggactggagtagttcttaggatatccatccagagactcaataagtaagggaagggttgatgtgctgaaaggctgctattgatacactgcccgggtttgggagttaccctgggcttctttcgcaaataaacgaaatgcttacatgatgttttggcttacctgaaatctctaattatagtcaatgtaatggtcttgggtttttaaaataaaaatacctaggcagtacaaagtccaccagtatctcctgactaaagagcctagatatgaagcatgtttgttgtattctaactttttgtattatactctggtgtgcatgacaaatctaataactgattaatgtatccttaagaaggattttcttcttattgtggtcattatttctcaatatttaaaaataccaaatcactacattgtacacttgaaacttatataacattatattaacatttcattaaaaaataatattctttttcaatcacattattccagaaaatttgcttcaaatagcttaattagaaataaagtttggggagcatgtgtatacctgaaatttaaaaatgttaaaaattattaaaaaaaaaaaaaaaagaaatgaaaaaaaaaaaagaaataaagttaagtaagtaaacaatatttcctcaaagccaaatcctaaaacaaggatttttgtagagcttgtgagtgaaggatagttattacattttcatatgtttaaaaaatcaaaagaataatatttcaagacacagaaattatatgaaattatagtttccatatctataaacaaagctcattcatttgtatattgtctgtgactgttttgtgctaaatggtagagttcagtagttgtagcagaggctcaaaggcacatattgcttcccacctctgactgttgtgctgaaaattcctgtgacgcaattataaatggacaaatgcttcaagcagaacatatattgacttgctgtgagattttattatcactgcatatccattgtatcaaaacaaaaaaagaagaaaaaagtcgactttgaatgttgtatttttaaggtacagtggaatgtggattattttgtggtcaagctagatgtcaaagttttgtgtttattatgtgatgacacgacagctgtgcttaaaaaaatactatatacatcaacactattataccaagcacttgacacaatattcccacttcacagaaatgtaacagaaaaatgaggaaaactaaaatggagtatctcatcacaataaaaaattcttcacaaaaatttgaaatggagttgcaactaaagcgaagtttgtaagtggttcatttgttagtccaacaatgaaagtcacttattgatagacaattaaatcatgcagcaaaaataaacttgtttgttagccttttggcaagaacagttgcttgaaatgtcaaggacattcgagtactatcaatagtcaattaa

SEQ ID NO: 37557 - DNA, 1668 bp, Bovine  19866881154146
aaataaaaattcagtactgtataattactaggctgattctcataatcaggatctccctcagcagattaaaaagggagaaggggaggaggataaacagattttttttgtcaattttcatggccaaaagtttgaatctgaggaaaatagaggacctctgaccccccagactgtgccttaaccagctctcagatgaatactggatctcataccttaatgtgcatcaaagttgttaaaaatacaggttcctggactcccgccctggaatctgcagtatcagcaagcacgctggtcactgaacttaattggggaaatggagctctggatcgttcatacctacctcttcagccacatcaaccatgtgatagtgggattatcattaactgcttctgaattcagccctgggtctatcaccaaaaacagtaacactattcgtgtttgtagagggctttctcggtgccaggcactgtgcctggcgtgctgtatgcattaccttgttcatccattacagccgcctgtgcaggcactaatattattccagtcttacagagaaataatcccatggggatgctaattgactgaaatcacacttgaaaccatgagttgacagaattggggctggaacgcagctctaattccaccactcttaattaaccatggtactgaattttaaggaaccaagtacactctacagaagcctggtggattggttttagacagtatattttcaagtgatttttttttttaaacaatatgctttgatttatcatcagagaaaaatctgtttactgtttatttgaaggtttgacacatgctttctttctattcatgtcaaaagatgctctaaaattcacacctgtcatttaaaagcactttgacctgaaacccttcacttaaatcatattttggcaagtgtttctagttagcttgttaaggaaagaaacattatagttgagagggttttaaagtgtggagagagagtcatactcagactgaaattaaggccacagactttcatatatcacttaatccagcactgacaagggcagaataaaggcctttctagtaacaaccacatttctgacacatctttggctttgaggttagagcagagagctagtggttaaccaggctgctcgctttatgggttttgctgtgggcatgggtgtggtctcagtgacttgcataccttggggttccatgtatggaaagcctaaactcacaagctaaatgcattatctataccaggcagagggggtgagggtggggtggggctgggggggagccagggaaaacagaggcagaaactgaaccttctctacttttccttgattcctcctgcaggtttatgaaaagctgaaggaccatatgctgatccccgtgagcaattctgaactggaaaaggtggacgggttgctcacctgcagctcggttttaattaacaagaaagtagactcctgagtcgcagtccctcccttgcatccggcagtactgcactcctaaggccggtaactgtacccactcctgtcgttttcactgacaatctcctgtgccactgcgccactaaccctggtttacaattctaaattgcattccttcgttctgcacctcccccaccccctcccctgacagtggtacctaaactgtggatttgctcaacaagttaagcaa

SEQ ID NO: 37558 - DNA, 728 bp, Bovine  19866881187665
ccatgatttgaaaaaaagaaaataaaaaaaggagaaaccccccacacacacaaaagaccaacagaatgatgtccttattctttgttgaaaatattccaggtaacttgctagtatttagaaattatactgctttctcttaagtagtttttctatcgccatagtagcttttagaaataattcccttagaaatcacatttcctaatgactagtttagccactgtacttagtttcacagaacagactagtccattattaagcattataattctagtttcattacgaatattctacggggagcagagacatttgtaaaaaatatttctatatccataaataccaatagcatgtgtaaaccttggggttaaaaggggactccttaagggaaagttattttgcttttatttcaaaggttacaaaatgcttcaatatttttaacctcctgatattctaagtatgcatgtaatttttttcctaacattttttgaaaacactaaaaagtaggagacaatgagttatgatctgatacctaattgcttactaatagaaataccagatgccgctcaatttcatggccctgggaggtatattgtacaatattcaatattattgtaattcatttcatcttttcatcacaaaattcaatgagttttttatactcaaatataaagggatatgtggctcaatctattttttaaatgaccctcaattagaagtaggataaccttcta

SEQ ID NO: 37559 - DNA, 570 bp, Bovine  19866881439743
tccccatccccacccccacacttactttttgaagttaaaaaagcactcacaggtagatgtttcactgaaaactgtattttcaattttgtcctatgtaggtagttctactttctcccccattcccaggagagtcagaatattccaatggcaagaaaaaacaggcttcttccccccccttcgtattatggagaattgggagaggggaggggagaagaacctcacattaaaaccatgttctttacacttgtcgaaaatggtattagtatctgtagtcacagaaaatttctaataaataaaaatactgtaaaatctgaaacagtggacccttttattcaattaaaacaatccagctacacatttcaacaaaatacagggtagcacagagcagctgttagttcccatccttgaacaaatgtgtggcattattttaagaactccacacagatggaataaagtacacgtaggagatgttatgatttataaagtacaaatttattttaagcacattactgaattctttgtactttatttctcaatcaagagatactcaaagttcaataactacccatg

SEQ ID NO: 37560 - DNA, 2895 bp, Bovine  19866879993312
ctagtcaaggctatggtttttcctgtggtcatgtatggatgtaagagttggactgtgaagaaggctgagcgctgaagaattgatgcttttgaactgtggtgtaggagaagactcttgagagtcccttggactgcaaggagatccaaccagtccattctgaaggagatcagccctgggatttctttggaaggaatgatgctggggctgaaactccagtactttggccacctcatgcgaagagttgactcattggaaaagactctgatgctgggagggattgggggcaggaggagaaggggacgacagaggatgagacggctggatggcatcactgactcgatggacgtgagtctgagtgaactccgggagttggtgatcgacagggaggcctggcgtgctgcgattcatggggtcgcaaagagtcggacacaactgagcgactgaactgaactgaactgaactgatgtgtgctattaaaaaaaaaaagtagatcttcccaacttaaggcataaaaaaataaaataaaataaaaacatttgacttaccaaagataaatcattcagaacagacaccaaaatgctcctgttttaattaaccctctcacagatgaacactgctaataactactgttaacaaagcagattgacagacacagtcacacataccagcacagctctggagactcgactaattggaaatcttttcccagtccaaaagcaaaggtgaggcccaaggttgggatactcactcgtgtatggaaatattgctgtgatgaatcagaccaagaatagcacctaccaccttcagtcctagggacctcaaagagtgaaagctatgagctggataaaacttgggtcttagctctgaatctttcactcttggcaagtcatttaatccctctagaggcccagttccctcttatctttatactctgccatgttccctgaaggatttgatatagctgtgtgtcaactgatctgttttaaaaatgagggggttgggtttccctgggaggccagtggttaagaatctgccttgcaacgcaggggatatgagttcaatccctggcctgggaagacttcacatgccgcagggaaactaagcctgtgtaccacaactactgaccctgtgctccagagctggggagctacaattactgaagcctgcacgcctacgccctgtgctctgcagcaagagaagccgccacagtgagaagcccacacagggcacagctagagagcagcccccactctccacaactagagaaagcctgtgtacagcaacaaagacacagcacaaccaaaaagaaatagatagatatttggggactaactaagggtcaaagtaaaggtagtatgttcacacaaaaatctgcacccagatgttcacagcagcattactcagaataatcaagaactgcaaacactcaaatgtccattagctgatgaatagataaaatgtggtatactcacattatagaatattattcagtcataaaaatgaagtgctaatgagagtttattttgcattaaatgctcaagtacaaaaaggagggaatatgtggttttcctgtgtttgattctttaaaaaacaatcagtggtatttgtagttgtgagttacatgggtttttgcagagagaacagtttgctagagccaccaaaaaaaaaaaaaaaagtcttgctaacacttcccaagcactttgagattcctaaacttattttctgatatacaaaatgtatttactggcattactttgcatttctcaagacaaaaatgacattaagtaaaagttgtgtgtaaatttgattcacaggtacttaaaaactttaaagctgcaaatgaaacgaaaggtccccaatattcagacaatgatattttctttttctgactaggagtttatatctcatttattttataaatggtttagttaaagcaggcttcaatggtggctcagatggtaaagaatctgccagcagtgcaggagacctgggttccatccctgagttgggaagatcccctggagaagggaatggcaacccactccaatattattgcctggagaattcattggacagaggagcctggttcgctattgtccatggggtcgcaaagagttgggcacaactgagcaactaactctccttttcttctttaaagccctgttccttttgacattcaagttttcattgtactacatttttcatgtaagaccaaatccagaactgcattttacagttttttactgtttttttcctctcagtgctgctaaaaagaaaaagcagctaacattttgaatttacaacatgccaaaaatgacacagaaattattacatttatttttgttcttgttaaaactctgtgagcaacatttaccaagacagcatgttaaattactggcattctctgggtactaaataaaaggctgcaactctctaacattaatgtatatacacaacattccctagcggtccaatggttaggattcttgctttcactgctgagggcacaggttcaattcctggttagggagctaagacccaacaagctgcaaggtacaaccaaaaaaatatagacatagaacaaaaaagaaaaaatactaaaaaaataaaaagaacaaagtactgatacatattacaatgtgggtgactcttgaaaacatgctacatgaaaaaagccagacataaagctctatattacattccatttatgtgaaatgtccagaataggcaagtttatagagacagaacgaaataagtggttgccaggggacaggaggttggggagcagagttgggggtgttgagggggaggactgagggtgtcagctgagggtgcaggtttctattgattgtaatgaaaatgttctgtaattgatagtggtgaggtcacacaact

SEQ ID NO: 37561 - DNA, 876 bp, Bovine  19866880851796
ctttctttctgccagcagactgtctggaccttccccaggctgtctctgggcattcatgaatgcagcattcactcagctgaaaatccaaagtgactaacgggtggacaatttgggctgcctgcagttgcatgtaatgtcctcttatgccatttatcccctttcccccatttagcccggaaatgggaacagcacataaaatgcagcgaggctagtaggaatttggcgacagtggggacataaaagtacagaagtctggctagtcctgtacaccatctgtgtatcgatggctcaccagtacacagtttgagaagtgttgcctctgagctgacattttcatgcaatcttatgaaccattaaaatacctgtaagttaatcagttattttgagaataaaagatctccctgaatgctttagatcagcctttggcaaactatgactcattggctgatttctgcccacagactgtttttgtaaataaagttttattggaacacagacacactcatttgtttacacattgtctatgttagttttgcgcaaaagtggcaggtgaataattgcaacagaaactatgatattgcagggcctaaaatatttactgtctgatgcattcctgttgtagatttcatacatgttgttggatatgaacttattcatttctttcttccttcattcagtcagtcatttcatagatatttaatagtcaaagcaatgaaataaatactatatggaatataaaaaagcataaaataatatcttctcctttcaaaacatacctggacatcaatagtcattttgtttccattacttaactatagggcttccctggtggcttggagcttttcactttcattttctttcacttacctacaaaat

SEQ ID NO: 37562 - DNA, 1361 bp, Bovine  19866880017299
tgcagatggtgattgcagccatgaaattaaaagacgcttactccttggaaggaaagttatgaccaacctagatagtatattgaaaagcagagacattactttgcaaacaaaggtcagtctagtcaaggctatggtttttccagtggtcatgtatggatgtgagagttggactgtgaagaaagctgagcgccaaagaattgatgcttttgaactgtggtgctggagaagactcttgagagtcccttggactgcaaggagatccaaccactccattctgaaggagatcagccctgggatttctttggaaggaatgatgctaaagctgaaactccaatactttggccacctcatgcgaagacttgactcattggaaaagactctgatgctgggaaggattgggggcaggaggaaaaggggacgacagaggatgagatggctggatggcatcactgactcgatggacgtgagtctgagtgaactccgggagttggtgatggacagggaggcctggcgtgctgtgattcatggggttgcaaagagtcagacatgactgagtgactggactgaactgaactgaagcttcccaacagtttttctggctgtgcatgtacaactgactgatcaaaaatcttaagctgaagatcatagctttaacaatgccaccttgtacctatagctgcagctttggctcaatatgtccaaggaaacaacaccgtatgttcaagccctgagctgtctgccagagcagatccaagattacatggatcgctgccactgaacacttcaaggtcagaaaatctcccagagccaacttttctgcttcagactgtataattatcttgcatctcaggtcagcttctaccttaaaatgtgggttgagcaatgcccatttctaaagaagcaagaggaaatgcagctgttaatcagccaccaaatgttactcacccactaaaggacatcttatcttgatttttgttagtttatatgtatttaatgaacaattatgcctttctaatttcacaatgatatgaggtggcttgctcacatagcacgtggctcactggcaaactattctcaagagagagtgggccagacgccacgtccaaaagctatgatcaagcacgtaagtgtatgatgcacgtccggtctcttgaaaggcaccctctttttcaggggctgtgacacaagaatctcagtgaaaagtcccaatagttgcaagaagccattccagaaaccccttttttgactatattagccactttcctacaacagggtccggtgtagccctggtgcatctcacatctcctaggacagggccggctccacacttaccatctgctgcacatggtggctggccttca

SEQ ID NO: 37563 - DNA, 2222 bp, Bovine  19866880401560
tacatcttgcttgtgctttactccttccgaatttatctcccagacctgtttgtctctcctggttctctgcccattcaccagcctcacccttccttcaaaccagctctttcacagagtgattcaataactaaagccagagctttttaatatcctgttgactctggtttgctctattagcttaatggtaaaaatcacccaccacctgcagaattctctcttttaaaggcctagaacttcacacttcattaggaatattttatatctgaattgcactgcttatcaatttgacaacccacaccagcattcttgcctgggaaatcccatggacagaaaaacacggtgggctacaattcatggggctgcaaaagagtcagacacaactgaacaactaaacaatcaactgtgagccatacctttgttttttgtttgcttgtgttgtttgttttaacacagcaaaattgaacctaccagctacctcctctgacctcctaggttaaattagttcctctagtattctttctcataatacgctgtgtcggtcaagtcctgccccaaagccacaggtgcaaagtcttgcaccaaggccacagaagtggagtccagaaacaaggtcatctccagaactgactgagcccttttgtaatcattgccacaagcccctcaatcatcaccagcaggctttctgaccccaaattaggcaagaatgcccaccccgctagtagtcgccctatagtgccccaaccaatcacctaatggcaactttccagcagaaattttctaacttaaggctataaatattggctactaacccacgaaaagaatcaactctccctggtctgtcaggcccaatgtgcttgcagtgcccaaattatatctgctctctgttcttaataaactcactcctttctgaaatgctctgtgtctggaaattcttttccaatccgtgttcagactgcctcaacatcctttacttcttgtatttatgggtgtgtaaaaaactgtttgtctaattacctgtttaatagttttcctcggcaacctgtaaactttatgagagacagggaaaagccaggtggttcctccttaagctgtcctctcttctgccctcctcattttctgttgccagcacaaacacagagcttggcacatattagatgattgagagaaacatatcaactgcaccatgcactcacaaaaagaaaatgggaactatgggaggcgatggatatgtcagttagcttcattgtagggaatatttcacaatgtttacatatatcaaatcatcaaattatataccttaaatatatatacttaataatttttttttcttttttttggttgagctgggtcttggttgctgtgcacaggctttctctagttgtggcaagtggaggctactctgcattcagttcctggacttctcatggtggtggcttctcttgctgtagagcacaggctctaggcacacaggcttcagtcgcatgcaccaccggggctcagtagttgcggccaacaggctcagttgctctgcagcacgtggaatcttcccagatcagggatcgaacccgccgtgtcctctgcattggcatgtggattctcatccagtgtaccaccaaggatgtccaaatatatatatatatttttaattgccaattatacctcataaagctggaaagaaaaaaaatgcattttgaatggacaaatgaatggatgatacctttcaataccacacctagttcttatctccaaccacgtggcaagttggccctggtaggaccagggaagcatatggccagcccctggttgattatatggacaatgcttctgaggtccttcctggaacagcattcagggcacggtcctggtggtaagactgtgcttaactgcaacaatgcctctttctttaatattttccaggaaaaaataaccttcctttataaatgttctctgtctttgtgtcaatgtattaaactgacatctctgggctctgtggtgacaggttttgccatatatacaggaaattcttcttcaaacgtgaatagaagttggcaaaagattgcttttctgcactactttgcaaaagccactaatgtgagatgagttgcacaataataaattattcaagtcataaatctgaagaaatcagttcatcatgatcaatataatttaagagaatggggtgtgtgggattcaatttttataatataattagtttttaaata

SEQ ID NO: 37564 - DNA, 4998 bp, Bovine  19866880508068
catgtgctctgagaacatgagtctttgatatcaccctaatgaacacaggagacagatgacactggggtgatttcatgaagggctatgtggatggtgaccatatatcctggtttctctgagttagttccaatttacggcacaatttcatttattatgctattttattaaatactattttagtgtaattatgatagcactcccttttactctcaaatgtattttggtctgggcaataaattgtaggtcatgtgtatcagactctcctctgtccatgggattttctaggcaagagtactggagtgggttgccgtttccttctccagggaatcttcctgacccaaggatcaaacccaggtctcccgcattgtagacaaactctttaccatctgagctaccaaggaagtcttcacccacggcagacattactaaattatcgtggtatacattcccgggaaagcccacacttgtattctgaaccttcttagaagtatcgctccagacatagattgaaactggatgtacatattccttccacagtatgggccagatagggtacaaactggcagctcacaaactatatctagatggcatttgtattttgtttggcccacactagattttctaaaatcctaaagccaacatttactatcacaagatttaacttagaaatctatttttctggctttatgtgagaaatggaaaaatccagcaacataggacctgtgtcccaccatacggacaactggctgaagctggatggtaatactactgttttgtccaaacgctacctgagttcatcagccagcaagatgtccctcagtgatcctttcttcttagcacccacacccatgtagtcccctcccacactctatccagtctggtagatataaccaacagaacagtacagaagtgataccataccacttccatgtctgtgtcatatatcgatgtcacaaaacacactgtgactctgtctctcttgtgtcacttgctctggaggaaatctgctggcatgttgtgaggagaggagcacatggtgagaaggtgcaacagccgtgtgaataaacctatttgaagtggatactctagctccagtcaagtattcagatgactgaagtccccatagacatcttgactgaaacctcataaaagatctgagcgagaaccactcagctaaaatgctcccagactccctacactcaaacactgtgtaagaaatagggtttgttgttttcagctgctaagttttggagcaatgtgttacacagcagtagataattaatacaccaaccacaactgagtttcttacaatctacttgcctgtaccaattctgttacttacattacgctaaagacagttgcggttacatccggggctgtagaggaagtagtattgttgaggattctaagcaagaaaatgagatggttagatctggctttcctcatagtaaaactgatggtaagagactgatgtgtgttgttcagacaaggttaatacttaacactggcatgtctgaaaaggcagagtcacaaggaggttcaagtttcctgagaagcttatgaatagatcttgcaacctaacacagtggggatgtgatactgtattatgtctaagagagtaagctctagaatgagaatatgtgagttagagccctttatgagaatatgtgagttagagccctttatatacaaattttatataaatttttcaagttacttattacaaatagcctttggtttccttatctgaaaaatgggacttggaatgcattcggctgcaaataattgactggccactaacaaaggcttcaaaaattatttttcttacataactggaagtacagtggtaagcagttgctggacacagtttgtctatttaacaataccatcaggatcccagatttttctgccttttaactctacctctcttagcatgttggctccttgctttatgtttccaagatggctactgctggtccatcacatttatacctaaggcacaaaaaaatggggataggctaagagcgttactctagtctgtgtgtcccatttcatcaggaaagaataaaacttccaagaagcaggccccacccacaatcttctgcttacatctcattatcagatgagaactggatcacaaagccacttagtagtgacagaggctggtaaagtgagtatttagttggatacactaaaaccccatgaaaaatttggttctgttaacaaaaaagaagaggggataatgaattttagatattcagttgccctaaatggtacagtcaacttcagattattgatataagggttacaataaactgaggcatgctttagaatatagtgcctggcatgtattaatagtaagagcacaatagatggtagctactgaaattacaatagtccaggcacaacttgcactagattcaaccttgcactagaacatggcagagggaatcattctgacacccagttaagctgaaattcttgaaaacaaagacaggtgaaactgttagtgaaaaataaaagaatttggctttgttttttattacctttatttcttctttcttttagaaccactgacgtgtgtctattttccacatcatcatctcttttctttctagttattttataattgtgtgcctttgttagaacttcagtactttatttttttttaaatctaagggaaatataaaattcgtgttcttaaatctaattgataaaaaacctgttacagaaactttacctcctaattaatagcctgcacaattatataatcatataatgctgggcactgtgatgtgctctttgcatatctttgttttctttctttttctatataaatttatttattttaattggaggctgattactttacaatattgtagtggttttgccatacattcatatatttgttttagagacagcttgccagtggataactttctatgaagaaatagaaatatctcctctgttcatgctaaaattaattgcaatactgtagtcatatgatatgaaatgtttctagaactactagcaggcaacacaactaccaggaacccaatgacacatttagctgaacccatctccaggcactttcagggcggatcaaacaatcggtggacccaccatacatttttctaaccacagaaagtggtttagaggccaggattcaaaaaccattggcagctgtgtaattacatagtgttagagaccagagaggtaagtggcgtgggatatagactgaaagggaaaggaaggaattggaatatgataccccccatttcaagccctcattacaccctcctggtccttcccaaacacactcctctaaaatttgcttagtaaggggaaaaaaagtgagcaaaattacagaagagagccttccaagttctttctagatatgtacagcatcgtttagcctttctgtattttccattttttttttattataaatatgtatcacatttgtgatcagaggaagaaaaaggacagaatattacaaaacagggcaataaaggattaagtggcctaagttcctttatgtctctgacctgatagggtcaaagcaattctcccctctccctcatgaaatttgagtttccaccctaaagtatgaaatatcattcctttacctttcactgcttcagtttatgataaactcagggtcagcagttacatgactgacctggaatgatttcgcattgctgcatgtggcgccaggcttggggcaatgaactggagcaaatgactgtgtaagcagcttctgggaaagaccaaaattgtagagctgctacagacaacttactctcttttgttatttctgattagatcttttcatttttttgttgttgttttttcttagaggaggcaagggtgtttcattgaagcttggaggaaatggctgaattttaatggaatctaattggctcccatggttatctcaaaggagctgtggtcataaaagttaattaaattagattcatttgcatattcaagaccattcccttcccttactttaaaaccagagaaagagaagatgtgtcccctgcttcctgaacaggacacacagcagtgtccagatcgctttctttgtatgctgggaattattctaagtggcagtttatttttttaatcctctacataggtgagtatcaacccaagagttaaactggtatgcattgcagttcttgttttcaaatacagagctagtcttttatagaaagagcttctctgtgctcaaagactgaggtaatttttccaaacaaaaggtgaattcagaatgttcagtagataagaaacgagcaacagatacagccccaggactggcctgtttgtgtgtgtcctggcatgtttatcagcaacagcagtgtctatagctttattatgggtcagagggatggaacaatgggactttacaagtagctgtctagtctaacctgctgcctgtggtaggcccaaaataaccagctgaaatggaactctgggcctgttttctgaagcctctggggaaggcttcctctatattccaacccatttttaacaatccttaatatcacaccagaaagcattcccttgtgtcaaacctataacccctctgctcctgatttagtgttgatcctgtgcgggcagtgcaggtgtgggcagtcaagttcagcccccaccccagcacctaccttctttgaacatttccttgggacatcaacgagtgcctaggtcaggctcaatggattaaaggcagcatgtgccctacttcccccagccactcttgcctgttaatacacaaaaaggtatatcattaacatcattcagtttatgataaactcagggtcagcagatattgagtgacctggaacgattttgcattgctgcatgtcttcctataagggaagacaaggttgattttatttttagtgcttttttttctttaatgaacacaaatatgccaggcactatgctgagttcttgagaaacaacggggacaggacagaccaaagccctgcc

SEQ ID NO: 37565 - DNA, 1245 bp, Bovine  19866880555228
cttttattaagtttttatctttttaagcattactgatggtttttgagtactgtgctcttaactccattttccctcaaagctctggattttctgcacccatttgccctgctgcaatgactgctaggaatgccggggtcatgtcacaacagaaaatgcaatatttcctttcatgagctttctgctccaacctgacagacctgccttcccttgagttttcccaacctaggcatcctatttagaattccctcctctgtttttcatgaccaacaactcaaatttttaaaagatcgattcagtgctctcttgggaacccagcctagtgcttattctgtgacttcatttgctactctttctttttttttggtatttttgtcttatttcagcacttaactcttagtactcagtgtctgaatgtgaaagtgaagttgctcagttgtgtccaactctttgtgaccccatggactgtagcccaccaagctcctctgtccatgggattctccaggcaagaatactggagtgggttgccatttccttctccaggggatcttcccgacccagggattgaacccaggtctcccgcattgaaggcagacgctttatactctgagcctctgattaatgaagcctaccctattcttcagtctgattgaaagttttaaaaaacaggaactttagttcttaactactctcaaaattccacagcattttcagcaggccttccgtgtattaaaagtaaaaatcagtatcagtaaatattttattatatcttacatcttctgccattctccaacaacttattttccaaatgcatctatatggattcccttcaacaggttctaattctgttcctataaaatagtaaaagaaataaagtttacagtttaaaatgatatcttacttcaacaatttctaaaaacaaaagctatacttcacaaaattgctatttacagttaaatatatcccaactctcagaataaaatctattaaaatacctccattaacattggggtcatgatagagtttccagccttcaagtgttgcagctctccatgcctggccacagcgtttgcagagtcgctgtgcctttagaaacaagaaaaagatggttggccatataaccaacgcagtaccaaagaaatacgtgtgctttgtagaaaaatataagtgatttaacaaaggattatataacttacggcacagatgtcacaaaaggacggtgtagacaaattagtaaggcacttcaca

SEQ ID NO: 37566 - DNA, 922 bp, Bovine  19866880757861
ataattggtggattggtggatctaagattcaaaccaatttgagagtacataatagatgtcacacactatccaagatattggtaacagtgaaccaaagacaattcatctcccccttcccccatgaagctaacgttttgatgctctattacagaagtgaatctaaggcagaaacacctggcatatttagggagccaatggctcctgcatctccaaaggaatcttgggaacttgctgccatatttggtggaggtcagttggaccgttggaatgccaaaattggttccctgagattgcctttgggctttagagacatttgtaccacatgtttaaaaatgggtgaaaatttatttttattttaaaatttcttacaagtattaatctgtcatgagagaaaaacaagtcccaaagaggaaaacgcacatagtgctgtactccatgtccaaaaaagagtgaatacttgtctgctgccaatatgcttaattagggtagacagggaggtaccatttaaaattattgttttgaaaaaacccagtaaaaaaaaaaaaaaaaagaaaaaacccactgaaggaaatggtcagagatctattccaggttttttttttaatgcatattttttataaggtctgttttataagaagagaaactcagacaaaagtgggaatattataaaatatagttttatagtagatttagcaatgtatttctttaaaacgtgtcattcctgcaaaacagagaggttaagttttataatagtggccacaactatttttggttttttaggaattttgtttaaattgcctttccttttctagccaatttgctgaagtaaaagtatatcagaagattaatatacttttatttatagaataataatactttatgactgttgagctgatcacatatgctagttcattaaatcctc

SEQ ID NO: 37567 - DNA, 2701 bp, Bovine  19866880784631
aatgtgtgatgttttatgctacttagtttgtgatagtttgctacagcacttataggaaataaagatgggaagctggttgatatgaatattttcaaagggaaggcttttgaaaaaatatggaagaaccgtattctgtgggcagaagcctaaagccaggagacactacctctggccatcagatagaacctgtgtgcccagatgagctgtctctacttgcaagggctgcaaaggacctaagaatcctccagggaaatccaaattttcagctgaagccaggaaggagaagaggtagtaagcaaaaaggttaagagtgtagaggattattttaattttgggcaatagatctagactttcaaagtgtacaatgtaaacaattagaggccaggtcctgggagaagacttaactgaataggaataaaagtacctaacaggatctgtggcctccatgggtagcatgctgtgcacatatcatgagccattgctgagaatcacagggaagaaggaggcagaggccagagatggaactctgttcagcagttttaatgaaaagctttttggctcccgcttctacttagctggctagctttgatgcctctgctggtcttagtcaaattccaaaattagacatttgctttttaagggactaagaccaactttgtgtggatcatattatgtgtaatgtcaactcattaatacctgtcataaacaagtcagaataaactcattttttttttcacaagctataataaaatgttgtttctgattttgagagagtcttgcccatattaggcttgtaagtgctcattggatttaattgaattaaaataagtcataaagtgagagctgaatcagaaagtcatgaagaagttatgcggaagggaccttttatgcaaacgtcagatttatgacctccaacccttcagttttattagttggcctctaccgcgtgtgtgtcaaagccatcctcttgtacgctaggcctaccttctgaatcctggcctttagacattaccacgtccatcaggaggggaggcaggaaaggcgaccgcaggaaaggacagaggaaagtgagcatttctctaggggaactgcagcagagcaggctttggccatccactctctggtcctcaccaggatggggcatccctcccaagcaaatggtcactccatttatggtaaaagtctcttaccacacagctgcgaagataagaaagagaatccaagaggggcaacaataaaaggaaatagaaatccaaaaggccagctattggcaaggcagagttgttttgtttttccaccttcttttccattatggttttttgtaagatccctgtgctatacaatttttatatatatactgtatatacaaaacccttgttgtttatgtatatttagtaatttgtgtctgctaatcccaaactcctaatttatctacaagtttgctttccatctgtgagtctgtttctgtttaataaataagttcatttatatcatattttagatttcacatataagtgatttcatttaatatctgtcttcgtctgacttacttcagttagtatgataatctctaggtccatccatattgctggagaacattgagtttatccctacaaaccagcaaataccatccccttgcaaactgcgtgctcttaaactagaagttattgatatctctgtgttgtgtgtatgttcatctgtttgttccttcttgtgtaaaaaaataattacttctttaattaagcgttctttactcttattagagctgttagcatattcaagaacatttgctgtttttggtttcccagtggaccaaggcatgcattttcaggaaccagctggttttgttaatatgacagtgtgtatcaggtgcagaaggataatttactgcctttcaaatatctatttcttctcctccaaatggatgcacctgcattggaacccagagtgtctgcactcacatggtcactgaagactaatctcagctagctaacagtctccaaagccagacacagaatcagctatcttggaactgcttgtctgtgcatcatgaggaactgtgcagggagacatggatgagaatctgccacatctatagatgtgctacagaaatgtgctatagaaatagacgggcttgagaaataggattgggacacacagaatcactgcatggtctgtctgctgggtcaccacgatgctcagtcgcagagtagcagttatcctcagtacaggaagacacaagacttattctgaattatctacttctcctttcataactattaagctgagtgttgtcagggctggtccttatctttctggagaccagaatctacaacaaggccaatctgatgagcacagaatctgcatagttacacggaatcctgcacttagaagggccccttgcttggtttaatgctgtgttgctgctgccttgaaatttttaacaactttaaaataaggagctcagcatttttattttgcgctgggctttgcaaattatgtagcctatcatgatctcctatacagtttctttggttaaaaaacttctattcagtgtcacttctctaataatccaaaaccctctattgtgtacttttatttatgagtctcagcagagacattactttgccaacaaaggtctgtctagtcaaggctatggtttttcctgtggtcatgtatggatgtgagtgttggactgtga

SEQ ID NO: 37568 - DNA, 590 bp, Bovine  19866880889580
agagaagagatgatggaattccactcacatgcaggcaagactcagtgtcagagccttcaagctccctgttccccccagaaatctatcggtgcccccagtttctgatatgaacagttgatgtttcccacattttacataaagtactagacaaacacgattttgagacaaaccctcagatgactgtctttgaagcccttcccatacaggcgtattgggacctgccactgtcacatactttaagttgaacccacaaccctcagccgttggccccagacttcttatgaagatcggtcattctctacttgccctgccctcaaaggaagagctgtagcgaggcaagccagggcccggctcccagattccagctaacaaatgcattccaagaggaaagaattcacacagagaaaaacattgttttccagtagaaaccattgagacctctctggctgtcttcataaaactcagaagaatctaagctaacaaagctttcatttggggaccccaggactaattaataaacagtgcacaagtggaaaaggaaacacagagagttgagaaatgaaaatatgccctaccgaaaagctgccatc

SEQ ID NO: 37569 - DNA, 1360 bp, Bovine  19866880901030
catacatgtagtaactgcattatgttgcttgagaacaagtacttcccagggagtagtaagcatatcattgctaggattcaagaattgggggaataacagataattgattttttttttcaaagttatgtctttagatttacagttgccttctctttgtggcaaaggatactggctttgcatttatgctcataacataacattttttaaaaataaatctttattcttaatttaagtaaattaatttttagaaattaaactaatgatgggacacattggtggcacatgggtatgtcaaatattatgaaaattgtatgagaatgattgtttgggaaacactgaagtgataggaatgggatggtttctctaagaaagaaatccagagaaataaaatctgtcagcgtgactccactgctgctcaaaggagatggaaccataactggtaagcatgagcacctgagggtatgtccctggtgaagatgggtgcacgagatatcatagactgaggacaccagtcgccttatcttgctctgagttcatgcttcctggtaacattttgattataacgttaggctttggcagcaagctatagtgctctcatcagcaaactatgaacatctggatttctcagtagtttattactcagcaccaattaatcaatcaacattctggttttcaaacataagctctcatggacttggagacttggagacgtgtcagaaaccctgtttctgagtctgccagactgtggaatggagataagttggtcaaggtgacgtcacctgtgtacttgtctaggtggccagcacccctctctttcctcaggtgccaactgacccactgcatgacttttacgccaaaccactgcctgacttgctcctcagcatttccagccagtctctggccttgctgttaacctagtctgccctcaggaagtgcaaccatggtgttatgtgatctggacttctatttagagcacatcttcactgacctccctttgaatgcttttgagcctttgatgccaatcatctactttcttggttctctgccaaatctttaaaaaactatttccttagagtcacagatgtagaaaacaaacttaaggtcattagggggggaagtgggaggggagggataaattggaagattgggattcacatatacacactgctgctgctgctactgctaagtcacttcagtcatgtccgactctgtgtgaccccatagacagcagcccaccaggctcccccatccctgggattctccaggcaagaacactggagtgggttgtcatttccttctccaatgtagaaagtgaaaagtgaaagtgaagtcactcagttgtgtccgaccctcagcgact

SEQ ID NO: 37570 - DNA, 1522 bp, Bovine  19866880930231
tagttaaggtttgagagttaatcaggaagtcatcataaaggaggacacttcatggtttctctacaatctcaccaagtaagctctgatgcacagatgttctcggatagcattatcatcttcagcaggaagtgggctgtccattccttgttcctcccactggttatagatctctgctattgaatcctgaggaattttcacaaatacttcttttgcagcttcatgcttctttgaggctgtgaaaaagatatatagttttccaatatatatggatttctgtgtagtagtttctaaagcagtcaaattattagtctgtgactttcacaatgacctgtaaccatttcagggcccaaggtacttctgttaaaggtttgggtgatctttctacctaatggctgggcttttccttatttcagtgtgacagtcacataaaggattaattaaatgtaattacttttgttttcattatttatttcaatttttggctgcactgcagagcatgccaaatcttacttccccaaccagggactgaatccaaatccactgcaatgaaacacggagtcttaaacactggatcaccaggaaatcctaagttacttttacatactgtcttaaaaaaaaaattccatctttcaaaaccttgagattatatataaaattgagtgggacataataagtcactattaaatatgttttgtttcacagtatcagccataagagtgggtattttgtaccttaccctactggaagggttagaaaaacaacaaaatttaagaacagaaaaaaaaactttgaaaaaagaatataaaatagagcatacccaagaatttcctcattatcgcattgccttgtttcagtgcttctgctctctgtgctgggtcgaataccaaccagtcaattacatcaatttttaatcggtcttcctattcatttaattggaaaaaaagaaatgtcaattgtgcttttttcctaagatattctgcacattaatagaattggcttacatctgtactactaatgaatattttccttcaggttatacaaaattattaaagaaaatagcttttcttagtttattttcacatttaatagctctctattaaattatagaaaaaacttactggactgtcagtctggaattatatatctgatgtgccaccaatttaattatctgactcctttaagtgctattctacaactttttctttcctagataaaactttctattcttttctgaaaataaggaataagtaaactacataaaaattagttaactgatcaagtatctagaataatctgatgagtaaaaattcaatgctcaagtttttactattaaagaagcttcctttaacatataactactgctaagcaattccttacacagaccttaagtttgctgtcaattttcataacttggctaacaaagaaaaattcttaaaaagaaagaagccagagtattttaaagtagacatttagaaaaagctgaacacgagggattattcagttacataatacacttctttta

SEQ ID NO: 37571 - DNA, 1611 bp, Bovine  19866880934528
gcccatactgtgtcctcccagctgtcacagtacaggagagcagcttcacccgttccgaagagaaacgtgcagacacagtcaacaaaaaaaggaaaagcagcggaacctcttgatgtgaactataaaatcactataataacataaaacatatggattataaactatcacaccaaataaccctgtgtctccaacttctccccaaaccacaactttttttggtggaggggcacagtgggcagcatgtgggatcttagttcccacatggaaacagtgggatggaaccagcagctcctatagtggaagcgcagagtcttaaccaccatcagggagatccctcaagccacatcttctaagaagtctggactcttatagcatcaattttccatgctgatataagatggtgtttcaactaattaaaataacatccctcaaaatagctataaaatgtaggggatcgaggggggttgtgagaagcacacatacgttagacaattcaaagtcatactgtgccttggtgacacatttctggataaagctatggtaacaaaagttataaatgtgtattgtaattatatttacaattctgagaaactgacgtctgactgcacagattaaaacatcatatggtatatgggatacatcaaattaagtagctcaagttaccattctatttcataataatcttatcattgctattcttagaaactagcttaagcttatatgattactatattagaatattttattcagctgattccattccataggaaaaaagattaagatacattgcatacctgcttgagattcccacttagagctgcataaattgctctctcatatctattaaaaagctcctgaaatacaatgaatataaataaaattaactactgtttatctcagtatgtcaatttttttcataatctggaattctgcagtatcttctaaactgaacttatttgttccggaacagtttctaaactttagtaaaagatctcctaggggactaagaaggaaggatcccttagtttgatgtagtcaataatgaaatcttccagaaaagtcaaacagctaaatttcaaatacagagtgaaagcagattcaactctaatggatgctttgattactttatagtcaaattttattccagatagaatccgcatagacgttttctcctataaaatttctaaatacctaacactacctgatactgttctaagaacatcaaacaaggcccttggagcctgacatgtaccagtttgcatcaaattcctaagcagaattaattattttcaccaaattatcccattttacttttggattctattaatgacatttcctgttttctcatcatccaaacaagagacttcagagactctcactacataattgaatcttcctctgccttctatttccagtttctggtcctgaccaaaattgttcctttcttttctactcgccaaagtaacctaggacaggcccttatttcttagtgtctgaataattctgacagggcttctaactagtttctcagtctttagttcattcaattttaagcctattttccactgccatgctaatcttcttaaagtactgctgtcacgtgccctcaag

SEQ ID NO: 37572 - DNA, 957 bp, Bovine  19866880976805
tgtttttcagccaatttgggagtctcttaatcaccatattctgaagtaatcatttccccaaaacttaaggctgggtttatattgtaagcagtgttccataagtttgcttatatgcaatgcaacagaaaaatcctaggcttgtgtgtaatggcatctttgtttttaaacagcattgctaaagagttggtgccagaattattctatattgctctataatccaaaattatagagattgaatgtatgagaaagcatatcttgaatcagcatacgtatatagccttttgaaattgttttcccctaggggtaaagaagagcaactttaaaagatctcagaatacttaattatatcaataaaggaaaaacagagcacagctgacttgagttattgttcagtcatcatttaaaccacaaggcaatgtgaatgttgttaatttttaagtactaagtgagttagcttttattttttcaagcacaaagtgcttgtgcaagaaaatcagggactctctctcaatgtcaaccagctattttgatctaccctgcatgctgtcagactatagcaataatgaaagccagcaagctttaattgtttttatctgtgtgcactcttatagttaaaggactggggaattaccatgtaaaaaatacaatgatgctagtttaggtcaaagctttgtattgagtatgctctgaataattactctgattaagataagtcccaaatctgctattgggttccgagcaggaggttaaactgtacagtggtaactgggagctggttgccagggcatccttgtatggttgttggtactctttttgctagatggacagttctccctggccatcttgccctctgatgtaagatgcttacttagcaaacatgatttaccatatgtgttatttatttttcttttttgtattatgaacgtggacaaccctacctagaagggaaagtaatat

SEQ ID NO: 37573 - DNA, 862 bp, Bovine  19866881045143
atgatgctaaagctgaaacctccagtactttggccacctcatgggaagagttgactcattggaaaagtctctgatgctgggagggattgggggcaggaggagaaggggacgacagaggatgagatggctggatggcatcactgactcgatggatgtgagtctgagtgaactccggggagttggtgatggacagggaggcctggcgtgctgcgattcatggggtcacaaagagtcggacacgactgagcgactgaactgaacttgatacagatttcaggctgcagtttcctaagggcctagactttcttatgtcttctctagggcttagaagagtgcctgacataagtagtcagacagtgtatgttgaatgactgagtgtttgagagaggcttcaaggatattcccatagcccaaggtaacaaagcagattattgggatattgtcacatttggtatcaagttcaccataaaaggggccattaaatctgcacactccttccctacctcctcctcaactacttttcactgagtggtaagctgctttaatgcttgatcactcacactgactcttttttcacctgatttcctaattccgtaagctgagcagggaacctcgtattgacccaagcaactatgctaacaggccaacctgagttgctgttgtcaaggttcagggaggcagttttgactcagagtgtgggcacaccttcaccctggccaactgagctggagggtcttagagaagtaaatacaagagtaaacattgtgacttcaaggttatataaagaggtgctatcctgcccacgctggcagtggaccatgagtgtgagcacctgtagccccttaagagctacatcttatgt

SEQ ID NO: 37574 - DNA, 1675 bp, Bovine  19866881077678
aatgaggaaatgagcatggagattaaaacaatagcttattcagagtggtacaattagtagagctagaattcaagcctagatagttactactctgttttgaaaaaagaaacaggtttaccagtgtgattttgtttatgtaacttttacctacacataaacttaagaatcctctttttagtgaaattttattagttggaagtctcttggactatatactccctaatttccagattaatatgtaaatagagaaaaacaaggacattatgtcttaaaatcttaagtgtgaattaaaatactagtggcccgaattttattctttgtgatagaaaacatcttagatcctctcttgagagttcaaactttctcacccacccttctgtgtttaaagttacatatcttaagttgtttgcatttcatcatggaaacattgaccttaacggaatgtcacgtttattactctgtgacatatctcggacaagttgtttgcatttcatcatggaaacattgaccttaacggaatgtcacgtttattactctgtgacatatctcggacatatgagaaaaatggaataaattagtaacagtctgttttctttagttgcagaacttgaagtgaaaaccagagagaaattagaagctgcaaaaaaaaaaacaagctttgaaattgcagagcttaaagagagattaaaagcaagtcgtgaaaccataaattgtttaaaaaatgaaatcaggaaattggaagaagatgatcagacaaaagaaatataaacagttctgaagacaacttgatagtaagctaagctgaaaataaggtgggctttaaaggagagatggactacagatgccatgtgtttctaagaggaagtttgtatatagttgtcgaccatagatttttcagcaatggggtcaaagtatttgtactttaccagcaatctttaatgtgaaatatatgtgtataataagaatgaatggtgtataggtattttaccaacccattttggagtagttctgtgatgttaagcacaattttaaaacatttttattgcattgtatgtatagcttatccttttgacaggcattgaaatttcattataaagtataacttatacaaattttgtacttcccctagtagttagaattagtcgtaaaattaacatgtatattaaatttttacctcccccatcccagctcttttgtatctgatgtgcccagtgtccagtaagcactgaataaatgtagtctgcatatgctatttccgcctcttgggtttctttgtcttgaagcccgtggaactctctcattacgattaatgtatctccatagtattgtgaccatgtatctctgatttgcagtcattgtaacataccaaagctctcagatggccaagatcatatctgaagtattgttctgcctaactaccgcagtgtcattagttttcacatagaataatattcaatcccttgtgcatgttccaaagacacacaggatgcatctatgcagcaatttcgtacactacccctgctttctctaccttctctctcaggctgtcttgttcaaatccacatggtgagtcctctactttttttttttcccctgactgtgctgggtgttagttttagcataagggatctagtttcctgaccgcggatcaaacccaaggcccctaccctggaag

SEQ ID NO: 37575 - DNA, 814 bp, Bovine  19866881226573
acaaaaattacataaatgttaacatttggcaatgtcatacttttaacactctttacacctcacccacccacagaacaatgtgatagtcacaagataattgcaagatttattctaaaacaataattcatgggaatgtaatccagtgataagatacacatttaacattgtagaatgcatctggcaatgagactctacatgtgacattgtttggcagtggtataccaaaaatccaaatttaatactatttgtgaatatgactgtccctagccataataagaccttattccctatgagggaaaaaaacaaaaaacaaaaaacatttgacaatgtgctttcttctagaacaaggaagaaaagggcatatttgtattctggatttccaatttgaccattcaaatctcagaaaaggggagcttaaatctgagttcctttgaaaacatcatcctatcaagaagaatttattatgcagcatgcagttatttctcccacactggccagtccagtgatttaaacactgaaaacaaaagaagcctttaccatgccagtcatgtcaatggcagagcacaagtgtattcatattattcatttaacaaatgttacaataatggcaacacaaaaatgtaataacctaactttatctttcttaaattattaaaatattatagaaatatataaaataaactgcctatgaggcatttttctaagaggaaaaatatcgtacaaatatttatggctccagataattttcagtatatttgccagttgaaacatatcatgattctacctaattatataaatttgagcctcactatta

SEQ ID NO: 37576 - DNA, 954 bp, Bovine  19866881289888
aaatgggagggatgacaatagcagtacgtaatccaggtttgtggtggtgcataaaaagcactgaaaaacaatagcagacccaccagtgtgtacttatttattaattagctggtgttagttagctgttatatagtaatttgccaggtcacctagagatttgctatctttgctctggctgctgcagcaaaaatttctcatctgcaagtataaaactatgaattctgggagcttggtgggctctgcctttcagcggccctctatagatgaattacctggcagccctcctatctctagggatatactcaccacatcctctttaagatgatgggaattgatttttatctttaatttttgcttacaaataattcatctgttatgagaaaaataacaagctccaaagggaaaatgcagacactcatctgttcctgtactgccttgagtcaaaggatagtaattattaacaccaataagcttaatgagaaacaagttgcaagttataatttctatttagactatccattgaggtctaactgtacccatggttcagttcagttcaattgctcagtcgtgtccgactctttttgaccccatgaatcacagcacgccaggcctccctgtccaccaccaactcccagagttcactcaggttctaaaattcagttaaacgccatctcgttacctatcatattagtcaggattctttctgatgcaagtaactgagagccaactaaaactaacttagaaaacaaaagtggggaggtgggagtggggatagaaatttattggctcttgcaacttagaagtccaggacattctggctttaggtgtagctggatcaggctcaagtctgatcaatacggttctctgccttcgggctctgtttctctctgttgtgctcactttcttctctccaagtgagaattaatgtcatcaaaacaaaggataacaagggaa

SEQ ID NO: 37577 - DNA, 731 bp, Bovine  19866881334798
atggcaatttgcttctgtttatggcaaataagaggtgtatatagtgaattcttactaatgggtctcttctcttggggttactcttcatgttctaggcgggggaaaaagtgtgtaaaattgaagaaatatgaagtccattagatgagaggtatattaatcaagaataaaagttctagcctacatcctcaattttgttttcttgattaaagttagattttttttttaatgctaattatagtgaaattcaatagcagggagaaggaaaaagtaaccaaactgaccacaatttatttttctttaagtcagtttgttaattgggttagactcctactgttaaaaaaaaagaagactagataagattatttttagcttgttgctctaaaattccttagtgcttctttctgcttcatgtcaaaagaagaataaatgtctacaagtgataaaaggtgaaagtttccttcacattggcagcctggttctaatgaccagacagtgtgatttaaagacagcagaccctgtgttctgtttgttctgttcgttactagttcccaacctctggcttatgttggtgggaagttttaccattcccagcgttaatgtttggtgggttgagtgctttatcactttacaacatacacctggagaagggtgtgggagaaaagggaaccctcttacactggtggtgggaatgcaaactagtacagccactatggagaacagtgtggagattc

SEQ ID NO: 37578 - DNA, 1476 bp, Bovine  19866881336085
atgttggggtaggagagaagaaattgttgcaaataaggtcatgtacttgggttgtattttttctctctctcaacaaaccttttattgctacccttaggaaccgaataagataacatgctcaacttattattagcaacaatttatctgtacacattgaattgaagatgaaacactccaagttgtttaagattttttttttttaattcattttctcaccccaacccctcacctcaagccaacatcatacctctgtgaggtagctagttgctggcatgggagtggtctatttccaactcagtcaaatagaagctgaactcacaaacatggcaccattttcacagagtctaacatgatttgaccccaaagatgatgagggctggtatcagtgccttacagatttattttggaaaatagtttccttgactactgattcaataagattttctattttaggatttatttttaattgaaggataattgcttaacaatattgtattggtttctgctgtataacaatgtaaatcagctataagtttacataaatcccctccctcttgagcttcccttccactgcaaaaggattttcagttaaagagcaatttagtaaatcagaaatatcatgtaaatataaaacggtaaacttaaacctgcttaaaaaaaaatgaatggatgtttaaacatctaggaagttaaggtacttttaagttttctcataagtatactatcttctaataggaaagtttacacaaactcacttatacatacgtgcatgactactaatttttctgaaaaataacaggaataaaataagcctaaatatagaaacctggagaaggaaatggcaacccactccagtattcttgcctggaggattctatggacagatgagcctgaagggctacaacccatggggtcacaaaaggttggacacgactgagtgaatgcacttaaaatatcttccttatgtaaaagttcaatccacggcaagtcaaatatcctctgcgtagtcagcgtgtgaaatctggtcaggatttgaatttcatgatgggactgacctggctttctaagcagtcttcttccctccaacccagtcttcatccagagcatgccaaccttgaactcagaggactcggcctttataacacacatatgtcaagcacatgtcacctatgactttattgtctatcctgaggtttgccgtcatgtccttatgttcatcatgatgagctacttgaggtcttatactcccttaaggcttctctgctttctcagaaagaaggacactcatatgtatagtgtagacattcaatgaaattggtaaattccctgtatataaatatactccacctacaattaaggtgttacactcctctcttgaccacctgtgttaaaatagtgttttgatattccaaatgatgcagggaagtaatgcaagcttacaaacaaatatcaaccacaaactacagccaggcttcc

SEQ ID NO: 37579 - DNA, 1215 bp, Bovine  19866881397760
cagtcataaaagaaatcagtcctgaatattcattggaaggactgatgctgaagctgaaactcccaatactttggccacctgatgtgaagaactgactgatttgaaaagaccctgatgctgggaaaaattgaaggcaggaggagaaggggatgaaacaggatgagatagttagatggcatgactgatgcaatggacatgcatttgagtaaactctgggagttgtgatggacagggggacctggcatgctgcagtcaatgaggtcacaaagagttggacatgactgagcaactgaactgaactgagctgactctaaatctggccttgtgtggtgcatttctgtgtttagaattgtcaggacacatttatatattttctgtatgtttctgcctctattaatgcaattaatgacacattatctcaacagaatacatcttttattaaaagataattttatcctcaagtttcgttccatttaaaagtatcttttaagtgagaaatattttctcttggtttttcttaatttcactgagtttactgaaatttaggctttcaaaattttgctaaggctgggttagtgtccatttttataaacaccaaggctatctctttagatttcctatatttttgaaaaaatttcaagtgtttttttgtgtgtgtgatgagcacctcatcatcttttacttgggtgtgtctctttaacagtagacaaagatactacaactgcttcttgaactgttcttataaagtaccacttcatggcagaattttctttcactaaattggattttggggaaagcttaatgtttatggcttcccaggtggcttagaggttaaaagcctctgcctccaatgcaggagacccaggtttgatccctgggtcaggaagatcccctggagaaggaaatggcaacccactctagtattcttgtctggagaatctcatggacggaggagcctggtaggctacagtccacggctcccaaagagtcggacacgactgagcgacttcacttttactttaatgtttatggggaatttttgaaagaatgtgatttttactatttttcttagtttcatatttgattttaatgttcagaaggatatttcaaagaaagtctttaactgcagatcagccaaaacagaatctttccaaagtgaatacagagacattttcctgggtctcaatgcaccctcagagacatcctcaggggcta

SEQ ID NO: 37580 - DNA, 957 bp, Bovine  19866881423530
tttcttcctttctttaggatgggaatgacaggataagaatggcagggctataaaacttgcacactgttgtataatgttgggtctgtaacatttagagaaaaatgggcataggtttccagtacacggaaccagtcataatcagtaatttaaatcaaactcaaagcatggattttctaaaatggattctccaatgaactaaatataaatattaagatgacttctccaatacaacatataacaaatgctaacaagactggttaaaatgcacatcttttaataaaagcctctgaggggggtgcttacttttcctggactgcatttcaaattgactcaggaactgtttattgcatggcgttacaacaggattctgaccatgaagctctctcttaggcaacagatccattaacttttttgaggatgcttcagatccaacaccaacaagggcaaacctagaaggtgtttaaagggatgtgggaagaaagtgaggagggattaactgttattgcagttattaaaaatgaaatgatgtgaatttaattttacctaccaaaaaaaccaaaatatttcttagaatacaatggtcacacttccacctctaactttttttataataacacatcatattattcaaagtgtacagaattcaatgctttgtttgtttagtatactcagagttttacaatcacagccacatcaattttaagaacattttcatcactcaaaaaaaaaaccccataactgtcagctgtcactccatttcctcccatcctccaaccctaaagaacaaatctgtacatctgcctattctggacatttcattaaatgtgaataacacggtgtgtggtccttcatggggactagcttctttcacttagcatgatgttttcaaggtttaatgcatgttaaaacatgtgtcagtgattagttctttctcatgactgaataatatttcatttt

SEQ ID NO: 37581 - DNA, 1020 bp, Bovine  19866881440118
cttctgactgcttatcctcgtcatatacgggcatctcactatgaatatgctccatgacgcccagcagccaaagaatgaggagcatgggaggagagtgagtttgaaatgtgtggagtcagaagccaatctgcagtacatcttcccaaagtttatagctcatttatgaaagaaacttaacagaggctttctcgaacttgacaataatcctcaaaagtcacatgattttaccaaataacaaattctgaaactaaaagaagctttaacaaaatatcactaattaaaaaaaaaaaacacgttttttcatctaccatgttaggcatgaaagatcaaaatgtctttaattctcttaacagataatttattatcaaatatctaatgggcttccctggtggctcagaggttaaagcatctgcctgcaatgcaggagacctgagtttgatccctgggtcgggaagatcccctggagaaggaaatggcaatccactccagtactcttgcctggagagtcccatggacagaggggcctggtgggctatagtccatggggtagcaaagagccagaaagagtctgttaattctcttaacagataatttattatcaaatatctaatggagaggtagttaaaaaatgtaccatcaaaacatggaggaaaaggtattacagaaatatgtcagggagttaattaatataaacatctgggttttttcctgggttttgtgatgtttgaggtatttattagcttttagtatttgtaatttgttatttctcattttgaataaatcttcacatttgtgttagttttgtatttatgattttatattcttttactttagaagaccccctgccccgccacctcccaaagagtaagcctcaggttctacaaaatctgagactaccccttgtttcccctggccagccaagctaaagtcactgtgtggtctctctcatgttactgaatgttcattctctcctggcacttatcactctctgacattttcccttggaatattcatagaggg

SEQ ID NO: 37582 - DNA, 1774 bp, Bovine  19866881512533
tttacctatctacttctgctctattgactatgctaaagtctttaactgtgtggatcacaaccaactgtggaaaattcttaaagaaataggagtaccagaccacctgacctgcctcctgagaaatctgtatgaaggtcaagaagcaacagttagaacagaacatggaacaacgaactggttcaaaattgggaaaggagtacatcaaggctgtaaattgtcaccctgcttctttaacttatatgcagagtacatcatgtgagatgctaggttggatgaagcacaaactggaatcaagattaccgggagaaatatcaataacctcagatatgcagatgacaccacccttatggcagaaagcgaagaggaactaaaaagcctcttgatgaaggtgaaagaggagagtgaagaagtcggcttaaagctcaacattcagaaaatgaagatcatggcatccagtcccaacacttcatggcaaatagatggggaaacaatggcaacagtgagagattttatttatttgtctccaaaatcactgcagatagtgactgcaactgtgaaatgaaaagactcttcctccttggaagaaaagttatgacaaacttagacaacatttagaaagcagagacattactttgccaacaaaggtccatctagtcaaagctacggtttttccagtagtcctgtagggatgtgtaaagcaagctgagcaactgaagaattgacgcttttgaactgtggtgttgaagaagtctcttgagagtcccttggacagcaagaagatcaaactagtccatcctaaaggaaatcagtcctgaatattcattggaaggactgatgctgaagctgaagcttcaatactttgaccacctgatgcggagagctgactatttggaaaagatcctgatgctggcaaagagtgaaggtaggaggagaaggggacgatagaggatacgatggttggatggtatcaccaattcgatggacatgagtttaagtaagctctgggagttggtgatggacagggaagcctggtgtgctgcagtccatggagtctcaaagagtcagatactactgagtgactgagctgaactgcaagtcttgcatatattaaatgacttgcaaagtcacacagtccactggggccagaggtagaatttgaactcagtatccattgactgaggagtcatggtacatcactgtatagctccactaaggcttagaggggagggtatgaattgatagtttacttggagagaagtttctcaagaaagaaggaatctaagttgcagtatacactgatactgatacagtcaaagccctatcatcaattttttggtttattccccttccagtttatctggccaaatcatgatctcgaaattaatgagaattgtcacccctacttagtttaataatatgcatgaattgaaaccacaagtctatttactcttattgtgcacatcagcagatgacctcaattcttatgtcatcgagatcatggatgccattcaaacggatcccataaacttctagccatacaaaatttctctttgttatcaccaaatcctcctttctttcatctccctaatgttcttctcatctgtagttgtggtttcaatttgtactatgtactactgcaaatttacaattaggggaaaatcacttcactttcctgagcctcagtttacttcagtgtgaatatgactggactactcacctcatgcaattaagtgaaatagcacatataaatatacttgaatggtgggaataaaga

SEQ ID NO: 37583 - DNA, 1148 bp, Bovine  19866881661265
cttataccaccccctacccccaaggagcacatagtttattgggtaaacaaacacaagaatagctaagacactgtgttgtaatgatgccataatagaggcatataccaagttccatgagaccaattaaccctgctcagagtctagggactggttcacagagaaggtgacatttgcattcagccgcaaagaatgagtcagcttcgccaagaaataatgagcattacaacatcagagtcaaatttcaaggagggtatctggttaaaactcggactacaacaatgtcacatcagagaaaattctctcctttagcttggtccagataatgaaaggcaaaaagccatgatgacttttagagttaacctgctaaagtcactcggtgatggttttataaagcaaatgtgtggtggctaactatcccaaagccaccatagtatagcatttagatttctagacagtgggaatttctcctttgagggctcataaataatgaatatgtgttatagtaaagattattgaagatcgtaagccttcttttttcatatgtaggattggtagcttttaaaatattgatgcatttgtgcaagttacttgaattttacagtaaactcaggaaagaaaacgtcaacataggacatcaggccctgggaggagacaacctggctgatggtcccttccctccactgaccaaactttgtttctgggtccagcttgtgcctgactgccttgcctgtcacagcaaatcctcaccagagacacccatgttatagagacagcttgacatgccatttcctcagataacgccagactacttgggtttataggattcttgatcttatttctacttgctctggttacgtaatgaaaataggttcaaccttataacaaaccttggaggaagctaatgtccatttttatttggtttaagatgaaggaaggaaaggagggaggtctgtcctattaaacagtaacttttcccaagtcaatggttagttgaagcattcgatctctataaccactatgcctaactcattcttatgatttcaagtattttgttctttgtccttaagctaaaattatcacattttacaaaagcttttccttatacctcccatcattttagtttttaagtaccttgtgaaatagatatt

SEQ ID NO: 37584 - DNA, 1178 bp, Bovine  19866881693847
acttggtatcctgtggtttgattgtgtgagccaattaatccacattttagacgttttgttttagagctggtttgagctggctttctagtatttgtgtcctagtgaatacagaaaccaacggaacaaactgcaagggattactgtgctttttaaatgttgattaaaaacagatgatgtgtggagggtacccaagtgacattgtgtcatttactgacctctctgtgccttgatttttttcatcgcaaaatggataccattacctatttcattggattgttgtgaggattaattgaattattaataattcagttagaacagtactgtacctgatataaatttattgtaagttggtgcaaggaagccgttctctttcttcatttaagaatcaatgggggacttcccttgtggcccagggccccatggttaagactccaatcttccaatgcaggggacacagacttaaacactggttgggggactaaggtcccgcaggcctcgaggtcaaaaaagtcagtggtaccaggcttgtgccaatcttgaatcagtgactgtcatgcaaattccttttgttgctttgtatgttgatgacattatgatacaagacactgagattatttaatcagtcttgcaaacgccaatacctacaggaacaagccagtagctcaaatgaaggaagcagggagtaatgggaactgtggcaaaatggaaagcatacactttgtctaaagtgagcagtgacccaagcatagctgatatgcttccttaaccatatgcaagtaccttcctttaccctatgcaaaggaaggcttatcactgctaaagttttaatttttcaggaaaaattttaaaactgtacttttatgtaaactttttttttttttttttgcaatattggccatttaaaaaatacaatgaaggccaaacaaaacatatctgtcagtcaccagcttgaggcttcattgtatgatatttattgagtggtagtggattttttttcttaaaatattttaatcaaaataatacctgagcataggtcttactactgctactgctaagtcgcttaagtcgtgtccaactctgcgaccccatagatggcagcccaccaggctcccccgtcccccggatcctccaggcaagaccactggagtgggttgccatttccttctccaatgcgtaaa

SEQ ID NO: 37585 - DNA, 1648 bp, Bovine  19866880033723
aacagagatcattctgtcgttttgagattgcatccaagtatgcattttggactcttttgttgaccacgatggctactccatttcttctaagggattcctgcccacagtagtaaatataatggtcatctgagttaaattcacccattccagtccattttagttcgctgatccctagaatgtcgacgttcactcttgccatctcctgtttgaccacttccaatttgtcttgattcatggacctaatattccaggttcctatgcaatatttctctttacagcatcagaccttgcttctatcaccagtcacatccacaactgggtattgtttttgctttggctccatcccttcattctttctggagttatttctccactgatctccagtagcatattgggcacctaccgacctggggagttcttctttcagtatcctatcattttgccttttcatacagttcatggggttctaaaggcaagaatactgaagtggtttgccattcccttctccagtggaccacattctatcagacctctccaccatgacccgcccgtcttgggtggccccacgggcatggcttagtttcactgagttacacaaggctgtgtgtttagattgactagttttctgtgattatggtttcagtgtgtctgccctctgatgccctctggcaacacctaccgtcttacttggctttctcttactttggacacagggaatctctttatggctgctccagcaaagtgcagccactgctccttactttgaacaaggggtatctcctcactgctgcccctcctgaccttgaacgtggagtagctcctcttggccctcctgcgcccgcacagccactgctccttggacgtggggttgctcctctcggccgccacccctgaccttgggcgtgggatacagatcattgggatatgccaatttgtaagataaaaattttgactgttaggtatgtcatagtattagcttctctgccttgtggttctttaccacgatctaacacatacttctgtgagtaaagcgaaccacatatttaggctatgaggtgtttccaatgatgtggatcttcaaaaaagcctccctgcttagatttaactggtgtaaggctttttgatacttgtatctaaaagcatcccaacagatacacctgaggatgtggctcagtcatgtgtcaggagactgtttctcagtcataggtggtggtggatcttatttccctactctgatcatactatgtttttgatgtgaagtccattaactgtaggcaaataatactatgaaaatttatttatttaatgtgagtttaggagttactatgtagtagacccttaaactaccacatagtgtttgaaggtggttatttcctcactaatctggtggttctcaaatagtaccccaaagacctgacttctggtttcaccccaaacatgcttagaaactgttactgctttcctcacagtaagaagaaaatctgaacaaactggaaatcgataactcttctgagatccatagagaattgaggtgacagggcaaattgccacctagaaaacttgagagacaagtgaatacagagaatcgcagctcaccaggagcacaagcctgctgaggccaattatggcaggaacattcacatagtaa

SEQ ID NO: 37586 - DNA, 1208 bp, Bovine  19866880357889
cttcaggacatctttgattaataagaagcggaaagataagtctcatgataattaataaatcattagcagtgttacttttcatcagataagtccattaattgttcccatttccttaagaaaagcccagactcaggggcctcttgcagtgggttgattttatgagaaacccaaacttataaagaaaagcaggtcccacctgcagaggcaccggagacactgtctgcccaacccacacctctgagctttggaagagcagaaaccagaagacacacaacaacccctgccccataggaagggccccaaaggagctcgaagacccctaacccagagctggcacagcaccaactgatcaccagtgtttgctgcagccatactcaacaacaacagcaacaaagccacatcctaaatgagagggggaaagcaatgcctggcagggccacggggccaggaatgaaggcacaagagggaagtccatccattcatccttcatcaagcaaatgatgagtgaatgtcaaatgccatgcaaggggctgggatactgtgcagatcaagaaaagacacagttcctgctctcatggagtttatatctgccttctctaaaatcccttgtcagaggaggaaactgaaacagagaagggacttcccaaaaccatactgagggtcagtggcaaaactggctacagctcctcactgtccccttcccagcccatccttccctcaaagaagcagcaaagggatcctggctctctattcccctgacacccaaacacagatgctctgccaacttctcacgcactgatccccagactctgaggatggcagtgtgttctcattcactcggagaaatgttttgaataccaatcatgtacagaacactgaactggggtgcacagaaactgtccccagaagctggctggctagtaggatagaaaaggcttctttaaaaataatgataacaaagcaaaacaattaggcacaataggagcacttaataacgagctctgagaaattgaaggcaaaatgcttccttgcaagttggagaatcttagaaggctctctgaaggtggtgatagcttaggaaggaatcagaaagaaggtgtggagacagatcctagagggcttagaaggcactgattggaagctcaaatttgttccttggggcttcacttgtcccctctgaaggcatactaagaggggaccactggata

SEQ ID NO: 37587 - DNA, 634 bp, Bovine  19866880384732
ataactatgttcctcctgatgcatccatccctgtacgtggtactggcagcttcctgcgattgccaagcttctggatgctccacatctcctactaggcttctaagctttccatcttctgtgtaagcaattcccggtaccaaatccccttcataagaaatgcctagcaaggctgcttccctcacaggagtaaactgactcatctgtgtctccagcctctgaccctggcaggtgctcactaatctcttattggcagaatgcattttctgttagaatattctaaaaaaaggtggaatttgaccattttttccaggttttctccttggtgccccttcactttccataaccttggcaatccaagaagcatgaggagcaactaaagtgaggccagccccagaaaaatctatgaccaaatcttggaagttcttgaaaattctgtctagttcatttctatttcattttcttaagccccagcttttcactgcatccatctacataaccaatgtaatcagtgagccaaaattaaatatccctaacccctgaccttctaaccaatcacaaatcatgagtgaaaggagccagttcaagtggaaaaatcagttccaggaagcctgctctgtacatcagttctgtcggg

SEQ ID NO: 37588 - DNA, 1527 bp, Bovine  19866880510471
agtagaagcaagatgggtatgagatctctggatgtaaaatgtgatgtaaggcactgggaggggatcagcacccgcccacggtaagcccccctaaaatagtcactgggcagtaacaataaaaggcatgaagtaccagtgaggttcagttctagaatgtccttagaagagcagcaagaagatggaaaaccacacaggagcttgtttttaaagacaaagaaaaatatgattaagcctgagaatgatataatgaaagaatgaaaatattttccttaccagggcatttgtatgtcaacagctgatagggggtgggaacggccaccacaaggctgccaggtgctgccagcagcaccacatgaggacccaccagcagagacggagtaggctatggctgcacagtggggaagggaggccttgcgagggcctcagttctccagcctgtgaaatgggactacccaatctgggctcagtctggccatgtgaagtgaaagttgctcagttatgtccgactttttacgaccccatagatatacagtccaaggaattctccaggccagaatactggagtgggtagtcattttcttctccaagggatcttcccaacccagggattgaacccaggtctcctgcattgcaggtggattctttaccagctaagccaccagggaagcccaagaatattggagtgggtagcctatcccttctccaggggatcttctcaactcaggaatcaaaccggggtctcctgcattgcaggcggattctttatcagctgagctacatgagaagccccatggcgcccttcttttattttttaaataaaaactgtatgtgtgtaagatgtacaacatgatgatttgttatacatagtaaaatgactactactacagtcaagctaattaacatatcacctcctcacacagttacctcttggtgtctgtgagagcacctgaaatctactctcttagccaatttccagtattcagtacagtttttttttttttttttttggctgcacagcacagcatgtggaatcttagttcccccaccaggaattaaacctgtgcccccttcagtggaagcgtggaaacttccactgaaccaccagggaagtcccaatacagcatcatcaactatagccatcatcctgtacgttagatctctagtcttattcctcctacagaactgcaggtttggaccctttgacctgcacctcccccatttcctttatgcccctgcatctggcaagcactgtttcactctgcttctatgaaatcgactttttaaaattctacctataagggagatcatgcactatttgtccttctgtgactggtttatttcacgtagcataatgtcttccaggtcaattaaagttgcaaatggcaggatctccttctttcctaaggctgaataatattccattgtatatatatcccaccatatctcaatccattcatccgtagctcctttctgtctgccctctttttggtaatccaggctgcagcagctctaggttggtctcaaggt

SEQ ID NO: 37589 - DNA, 1466 bp, Bovine  19866880617086
atgctaccagcatcagagagtaaatattgtaacactgtggtccagtgaagagattccagcaatctctgaaactcttggcaatggaatttgatctatacttttaaagacactgtatgtgtgtgtgcacgtgcgtgcgtgcacgtctatgtgcgtgaataaagctcttcaactttctctaaaagataacataggaagagggaggttgtgcaggccaggcctctccaaataaggcgaaacccaaactctcctttatttttagcagtgcttttcccaactgcaagaaggcataattccgtgaaccagccttgcaaaaatccaccaacttccagaaaagtttcaacaacccatgaaggttcccatgtgtgtgaaaacccgatgacccttttagggaagggcccccagacaaagcctgaaacctgagctggggcccagttgcctcttctccaggacaagtccccagccagactggacagctcggccccagagcaaggccaacctgcacagtctaccggtcctcagcctcctggagaaactcagctcaaaatgtccctgatactcagtgcagtggccatcagcacatcctcaaaaagtcacatcccctggaaaatctgactaaacagtaagaaaaatagcgacagtcagctaacttcatagagactcactgagagccgagcccaaagcagatgaactggaagaagagacgtttaaagtccctcaccatcatcgtcttcctctctctaagctgagtcaggttccttttaacctacgcagcagccaccgtagactggatggcaggaggcagatgcctgggccctccgctcctcaagtcaggagctctcagtgtccgtcaactcatctggaaaatggggataacatcaggatgagctaatcaaggcaaaagccagaaagcccgctgcctcaccatttctgtttccaataggatttttatggcctccaagatggtgtctccttgtaatctttctcggcaacaggctcatttttctcctcaaattcctctgcgtttggctcaggacaatctgtttttcctacatttgtcaagttgctcgaaattcctaatgctcattcatgttctttccaaggattagcagagcaccccttgctcatctttcatcacactccctccgcacgcagggtagaaattatatgtgagtagaggcctggctatcgatgcccataaaatggagattttggcgagacttgcttgcatgggtcagagcgggaatgaggccgaaaatcgggcttgaacatctttaatgatgtgcagaaagagaggggcctcggcccgcgcaggcagatgtgcacagctgttggtggagaagcccctaataccgcgaccagcatggagtaacggataccctcaaatgcttcctagtggagttaagaattttttgttgatcgtgcctttaactaaggtcatttaagtatacaacagatgttcctctagg

SEQ ID NO: 37590 - DNA, 940 bp, Bovine  19866880676884
tggcattgaaaggctaacttattagacagagaaagagccagcagttattcttggaagagaaggggagactggaaaaaaggtaagggataggggtaaggagtggctgtccttgcagagtcaaggactcttcaacagtaattgttacggctgtatatgggctttgtgctgattatacaagcccgggtgagatatgagtcccttgggtcttcattttcaatgagccttagagatgcatgtgacttgctcgaggttgaacaggtagaatggcagggctgggactggatttgtgtctggctctgtgtgacctgcggagagggcaatggcaccccactccagtactcttgcctggagaatcccatggacagaggagcctggtaggctgcagtccatggggtcgctaagagtcggacacgactgagcgacttcactttcacttttcactttcatgcattggagaaggaaatggcaacccactccagtgttcttgcctggagaatcccagggatggggcagcctagtgggctgccgtctatggggttgcacagagtcggacacgactgaagagacttagcagcagcagttgtgtgacctgaggcccagggtcttagccactgcttggctcctgagtgaggcagagatctatggggttcttggcatgctggcactgataaataagcccacagaacaaaaccccagagagaacataagtcttcagagtcatcatcaatatggaagcagagcttcaatctccacgtgaaatgcaagcacagagcatatattctaagcagaaaaatctataaaaagttaaagattaatggactttagtgaggctccagccagatttaaaaagaacaaatcttgccagaccagtgtttttgccttcggggggcagaattatacaatgaaaagatgaaagggaagcaactggtcaaacacattg

SEQ ID NO: 37591 - DNA, 2538 bp, Bovine  19866880692355
gggcattaaacgccattcaacccagactcaatggctgagatgatcaatgtctcaggacaacttgattgagaaataaaatattgcttttttggctttagagtcgtcctcagagaatgatgacctcttttcctccacatgccaggagaggagccagagctctgggggaagagttgagatctgcaactttgaaggagctcctggaagcaccagaaagagtgggactctggggtgagaggtgcttacagggaaaggggaagcacaggctggtgggtcctgcttccttgtgaccctccaagaggctggctctctgtggaggtgagagcatggataactgggcacaggagccttagtccagctctcctcagcttgggagtcaagagagaggtcctggtggccgcactggcagagagggagtgggtaccatgaggcttcaagctgcccactcctgtatgaactgcacgggcttgtgctggactgtgcaatctcagggcacttgtatgatgctaagatttgggtgtgggcacccttaaattggatttctccttatttgtgtttgttgggactacccacatgcaattagatttggaaaaccaaagacgttcacactgattgtgagtgtggacatgactgagattggatttctccccatttgtgtttgttgggactacccaggtaattgcatttggaaaaccaaagacattcacactgagcatgagcgtggacagtacaagagtcagtcactgggctgtgataccatgaggtgacacaggaggagagaaggacctgctgttggcctcatgttccccaccaccaccccacttctccctgctactaccaatttctgccttattcctgaaggccccttgggtgagggcctgtctcttctgcagactccagttctcaggcttggagatcacttcccactctgcactcagtcgtctgcttgccttaggtgcctccctatattcaaacagtttaagcagctggaagtctgccttctgacgcacagagggtttccttgattatgtcctgcaagttaaggtgaggctgagactgaaaatgcaaacttgacagagatttctctgagttactaggattggagaaagcctgacttcatctagtctactgatttttgggtgtggtttgcattgcaattttctaaaagataaatagataaatcagttgggatcatcgaaaatggagacatttcatgtaagaacatatgaatgctcaacagctcctgaaaagaataaaaactctagcaacatgagggcttcatcctctatggcaatgcttggctgctgctgaggagggctgccctgtgatgaagctatgctgtttatttggcaccattatcatccttccctatgtctccccctggccctcttccctttgcctgctaggcccatgtcagtctatgagtcagtctcttactctggatacttgagaggtcagtatcctttaatctctccttggcttataagctttgttcagagaccagcctgcttcttcccactaaactttcaatacttgcttatccagcatcattgagtccatcctggtgccactctcctgatgcctccaggttgtttcagtcattgttcccttgtaaagccaaaacccagcccctacaccaagagcacgccagtgaaacctctagcccggtcagtaccttaactttccggtcgtccaggccctttgtatgctcttcaaactccaccccaactgtgaaatccacattatagttacggaatgtgctcttggtttgcgtcttgaacttatcgccatcttgctcaatgatcttcgtttgagtcagatggagggcgatcttgcgggtggcaaaatcaatatctgttggcacaaggagttgtggaggttatgaggtgctcagccagactcattcatttctttaacaaggccaaggacttaagaccagaggtgcggatctcaggctggccacatttcttcgcttaagtgggaagcaagagctgtattgtatatggccagtccgggcatctcagccaactgtcaggaaacccagggtctctgcacacctacttgggagccctgatgggaacaggaggtagcaggcagggttcacccctgagctgcaactccccagggtgtgtgtgtgcacacgtatacacacacatacatacatatatacaacgtggacacacccctcccccacaggagctcccttctatctactgacatattggtttcctcccaagagtctgctgaacagaagtctttgtggtttaaaaaagactgtttaaaagcaaccagtctagatcctgggtaaagacagaacttctgttcatgctctccaaaaggaagcatacatacaaacgtccattctatagcagctttaggaggctgttgtgccttagtcatggcccccagtgcagcttaaacatgcatcagacacttaaccaacactttctcagagctttcttttgttgtctttaaggaaaagatgaataattttttatctttttattacaaaaaattccaaacaaaccgaagtagagggga

SEQ ID NO: 37592 - DNA, 1413 bp, Bovine  19866880743390
aaatgtgagctgagtgatcctgggctccatagatctgagtgcctccacccgtcagcctggggagagaccgcagagccatttcaggtggtgctggacatggctgccatgtccagaggggtccaggaatgggctaagccatccggtggcatgtggccctctacaccgggcctaaaaaatatcactgagtgttttccactttttctagagacgcagttacagagaggtttcttttctccaaagtggtggttctcaaggtttagttacaccagaaccacccggtggcttattgaaacccagattgtaggcctcacccccaaagtccctgatctgggaggccaggggtctggctggaacacgtttttctaacaagtcctcacacactgctgctgctgctgctctcagctctgggaaccactgctctaaggaatgcacaaggcaaacagtgatatatggctgtttgatcctggacttcaggtaacggggtgggcgagggctggggtaaagtggaaaaggtcccatcaaatgggagcaactgtggccatgtcccggggatccacatggcacagaactaaaagggcacccagcctttttagcagtcttgactctgttgaggtatgaacagccaggaatatggatttttctatgacataacaatctttggcaatcactggcaattggctttgaaatttgtcaaacatggtgcaagccaaacaaaacacatctgcaggccggatttcatcctctgttctagaagacagataaggttcctagggaaagaggcaggagcagagctctgtgggctctttggggaggatggcagcctgaccacgcctctcccaggctctctggcgcccatctggtcacctccaggccccctactggcgccccagcactaacctcttctccagccacaccctacactttggccacatgaagtctttgcagacggcacctctttccctgataaaacccctcccagccaggccttctctgacctctgggcctctgtgcatgtggttccctttgcctgaaatgcttttcacatccaccctaattcttacgtgtccttcaaggctccccacagctccagggaaccctccttgaccactgcctgctcctgccctaccagccctgtgttcccagcccactgtgcttccaccactgcaccgggtggtgaaggcctgaggatgtgtctggctcctccactggcctggctgcctttgtgcccccaggctgagcccaaggctggtgtgggacaggtttgaaatagcaagtaccaagtgctgttggagaagacacttgagactcccttggactgcaaggagatcaaactaaatcttttaggattgaccctaaaagaaatcaaccctgaatattcattggaaggactgatgctgaagcgaatctccaata

SEQ ID NO: 37593 - DNA, 4109 bp, Bovine  19866880762523
tgttgtcctcatcctacagatgaggaaactgaggctcagagaggctaagttaaataagttgcacaacagataagcaagtggtggaaccccagtctgttggactctgaagctatacgtatggccatcttcaaaaccagtgatctacagaggggaacaccacgtggctgactctgtttcttccgcagtaaccctctgatcaggcttagctggagaccaggggatgctgaggacacaaagaatatgctgccagggtcagtcatcaggcccaaggccggggacaccagggtaccactcaggcaagcaacaaaaggaagcaatgaccccccccaccccacaaaggcagagtagaggtctgtgaggaagacgcatttggcactgaaagtagccttttgcacaccagagttccagctactattcaaagcagggtcaacttgaaccaggggcttcaaggtcagtaaaaataaaatgataataccagcttttactgatcacctactatgtgtgccaaacataataactaggcagctcagcaactctgagaagtagatgagtttggccccatttcacagatgaggaaacaggttctgaaagagtcaacaacatattcagagtcctacaatgagaaagtaaagatggcacccgaacctgtttccatctgttgtgaaattccagactaatctgggagtgaagcctcaagaggtgatgctttctaaaactgaagcagtaagacaataatggcgggactttcctgatggtccagtggctgacactctgtgcttccagtgcgagggcgctgattcactccctggttggggaactaagatcctacatgccatgtggcatggccaagaaaatattttaaaaataaaaactgcacatttatatttttaaaaaagacaataatggaagcacagacgagtccagcaaggccctaagaagactcaggtgagtctctgagaccatcaggaaggactttagacctgaactaaatgtatttatttatcccccttccatctttcctgaattcagctgactttaggtaagcagtttcctaggtaccaagaatataaggataaattaaatgagtttcctgttcacaatctggtggggaagaaagactgagagtaaggctgttaataacagctcatgttgattgggcacttttctgtggatggaccgtgctcagctctttaattcagcctcattatagctctctgaggtgggtactgtcattgtcccccattctacagatgaggaaagggaggcagattgcttaagacacccaagaagattccagcgctactatttggaaccagtataccaccccaggcagtgtcattctagaacttaacttctacactgcaccttctcctaacaatccgcatcagcctcttccccagccagggagaagctcttgctccttaatggtcttgtgatactcagtgtagacaaggtcgccattaactttcctgaccaaataacagaggtcagtgaggctctgagagtgttcatgactcacccagcagcgtacaagcaggagagcctacacttgaacccagccactcgtactgaaaatacctgcttctcccatcaggcacttttccccaaacacagctccagtcaatggataatacagtaggcggaagacggaagctccaaaccaggctctgagccatgacccagtcaggttctaaagtactagcttatgatccgagcaagcctctgttttgagaggcagctgtgggccacgcactgcgccagtgcttgaaagtgttagccgctcactcgtattcgactttttgtgaacccatggactgtagcccgccaggctcctctgtccagagaattttccaggggatctccccaacccagggatcaaattcagggctcctgcattgcaagtggattcttcacctgctgagccatcagggaaacccggtgccagcccttactgtgtggtaacgtccttacattcacagaagtctgaaaagtagctacattattccagctttttacaactgaaaatttgtactcggaactcaggtctgattctaatagcccaggtccttaatccctattcaacttttataaaaagtgagctatggaaagaaaatacttaaaagagtagaaatctgcttgtttcctcctttcagctggggctcatagaaggcagtcttggatggggtggtctgtgagcacccagatgcatcacctggcacaaggcccagcacacagtaggccctcagtacgtatttgtggaatgagctaccttaaatggacaaaggcagaatgagacttaaaaaccagagacccaccctgggtggtggggggactgtaggccacacggatgcaccctgagcccatatgcttaccccacaggcatcatcacagcgaactgctcagatctctgccccggatggaagacccagaccaaggcagtgccagctcccccgcctccgcaggtaggttctaaccctctgctctgtcgggggtgcggagcatgggagagggggtgagatgtcagggcttcaggtgagaacccatgtgagccacagcccctgggcacaggtaagagtatttgaagcctgcttggggtgacactttccgtgttgaaaagtcaggttaaacaatctgccaccatcccttgtaaatcgttgtttactaaagtgggatttcctgccccaaaggagtttacctaccttatgacttgcgcttgtgacctggattacagccaggacaaagctgggatcaacttctgggtgctgctgagctagtttgaaagcctttttgaatacaaaatgtgccattatatcgcttaacctaccactgtatagcattgttactcaagtgttttactcggaaaaggaaacctagttttaagggactcggaaaaggaaacctagttttaagggatttaacgtctgtttggatcttccttttaatctgtaaccctgggtttctgccctgtggtcagctcctggtgtttgatggaaccttgtcagctgtgatttcagagcacctcccatggcagccctggtgccaggggttaaatgcacagccccctcaggcacataaaccagagcacagtgatgggggacagggtgggccaggagcaagggatcactggtcccacccggccagcattccaacaggctcttccgtggggttgcctccagcagccctcccaactttagctggtgggacactatttccctatgaggagacctccagattgtcatggttaaacacgcttacaatgccgtcttagaattttacaggacttttcagagccttaactatgttcctgtatatgggactctaatgaggaagggatgtagattgaagccattcttagcactttttaatcatggggctctttttaatgcatattagtattcctcagaactggtgctccccagaacacagactgggaactgctctcctaaaaggacttgaaaggtggggtgagaagagataaactaggagtctggtattgacatgtacaccctgctatatataaaataggtaacaacaggggcctactgtatagcacagggaacaataacctataacgaaaaagaatctgaaaaaaatatatattaaaaataaattaattaagaggccttgaaaatgccctcaagtttcccactgcagtcctcggatgctgatcaaagcatcactcacagcagaatcacctgggtggcttattaaaaacactgaagcccaggccacatcccagacctcctgtggggaagaggcctggaactcagtggttaacaggcacactggggatctgctttacctccagtctggggaactgtgctgttgagtgggaacccaagaaagaaggagctacagagtttcctatatgatcagcttctccagtattgattacattcctctggcctccctgtccgcctctcctccggagccagcaggggctcctcctcacctgaccccagccctgagcacagcacacagtgctcattctcagccctctgtcttctttctgaatcacctctggctcagcagtcactcctgatagagttctcgagacgctgggtgaggacagaggggcctgcccagcacctgcctgatctggagaccat

SEQ ID NO: 37594 - DNA, 1324 bp, Bovine  19866880772562
ttaattgtctataaattggtaatattatctttcctccaaaaacagatgtaaaaacttcagatttcatggaataaaccattaactaatgttaatatcacatttcttttcaaactacagtgtttaaagaattaaaagtttagcatccaaccagtgactgtatatgtgatatgatcttcctttctttgataagcatcatcagttaatttcattaaaaagtattttcatttggggacctgaagtatttgataaatctttactgttacctttttgcagatctgaagtacacattcctgctgtttcagtacaatttggtgttatccttgaagcgtactgccggggaagcgtaggtcacatgaaggcgctttctaagcaggtatcagcttgctttaatcttcatgttcactttgccacatgatatatgataaattgtgtcatatgctatttctcccatcacattgtttcataagagatttccatatctaaattcaattaatacattttttaataaacaatgtaagcttagaaattaagttttggcaaatttagcagaatgttatagaatgctatttgaaaaattaggattcctcatagtattagtaccatgacttaacttttagtagcaaatacctatttagacatgcttaacaatgggtttgatggtaactgttgtgaaatctttagactctgttttttcataccactgagatactctttccaataagaatagtgtatatgattcatatgctctgtcatttgttttagattgacatattttgacaccttagttcgtaggtgttataacttctagaattcaatatactcaagctgctttttcaaactgtgtacacatgcctgaaactgtgatatttcaggcatgaaatatctctcatattctgtcattttcttcctaggtcttcattttctaatcattgcagataatgaggtattagtcatttttaatagattagatattaaatgcttactatatgccaggaaccaaaataagtgttttaagtatgctattttactctcctaataatgtgccacagtaggcactgatactgcctggatttgacaaggtgaaaaacaaggttttaagagattaaataagttgcctaaaagttcacagttattaagtaaaagaataagtttcagacttagttctgtccaactataaaactaaatctctttttttttattattatactgggagttttcacactttttagcaatagtcctcttttttaaattaaaatagagaacaatttcattttttcagtataaatgtatcttgaagctaaagtaaaacatagccaataaacag

SEQ ID NO: 37595 - DNA, 1861 bp, Bovine  19866880786401
ctgctgtccagtccttgtggctggatatcattgattttcagaagtacagagttgaaatctcattaagtttttccaggtgtgtcagtaacaagttatctaagtccttccaaagccattagaagaaatgcaagttctgcttaaggcagatgatgaaggagaatcgggggaccagctcaaagggactggccatggggacagtttcaggaggttgaaccctgggacggggagactaagaaaggctgggacccgattccagtgttgctgtttggactggaagacaggcccagaatcttctctcttgagccactttgaacttgcacacaggcaacagggccaggggtcttcttcatgcatcctgatttgtccagagagccctttgaaggctgtatgcggtgggcttcctctccacttaaaaagaccccttctcttgaggatttaaagcatatgcttggccgaggctgtcagaatgcatcatagagatggtcccaaaccaactgctgagcaccccccggtcctgatcaaagtggaggcggcagacgtcccctgcctgtgggtgctggagcggaaagggggaggagccagccggggctgcaggcttacagcccctagttgtggtggggagaggaatggccaggagctgctgaccaggtaggcacctggatgggccctctgctcaaggtgtctgagatgggtcagtgactcttgtccagaactggaccacagcagcttaggctgggccagggaattcatctggtctgtggctggcagggctgaatggtgtggaaccgtggacaagggggcaactgcagggctaggtgagaaattggaaagcatttatacctggtgtttagacccaggaggtgggcagaggaccaacagaggccctggaagtcctaaatctgaaggtagctctaattaccacagtgcccttgcgtgagaatcagccatacacctggcgctgcaccagctgtggcacctggcctcccaccaggccacacataccagtgtcccctagtgtgacacatcacaaggaggagcagagacgctgagtgccgtgcccaccttcatgcggccagcttgcagcagagttaggatttgaggccaaggctgttgcgcccaaagttggggcccctcacttgagtcttcacagatcagaccacatgtgggttcattagagagatgtggtggtgtcagagggcctgagagcttggggttcggggctcgcagtggaggctggctcagaggccgccatatgtgcagctcagcagctgcacggctgtgtggatcagaagggaaggggtggagcaagtgggtggcgggggtggggggctgtcctgccagtgaccacccaggctggatctgcctgcagatgcctggtagagcagcccatactccccatcttacagctcttccgtccaccttagattctagggtgcgaccccaccctctggaaacttctgagaataaaggactcacagaggtggagggagtggtggcttgcttgcagctgttacaacagagaggctagtctcaggagaaaactgcaaataaagatttcatcagggcccctaacagccttgcctcaggaagacttcagctgaagagggtgccgtgtcttggggagctaggttgcccagctctgtgctttctgcttttctggctccccactcccatcagtagtggccttgcactccagcagcgactgctggttccttgtctgtgtcctccacaggcccagacacaggccttgtgtcccttaaggtctgggtcccaaccccagaggcccctcctccaagtatctagatctttataaccccaaagtctcatctttgtttccccagccctgggggttattaccaat

SEQ ID NO: 37596 - DNA, 1093 bp, Bovine  19866880813933
catttaccctgatacatgatatacaaatgtcattatgcatctataaagtataaacgtgttttaccccataaatataaatctcacatcttgtatctgtgcatacctgtgtttctgcacacgcacatccgaacagctatctcacgtgtcacaaggacagaccctgcccatgatttctatttgtaatacgaagcacagacttaaactatcccccaaagccccacgacaacgttcgcgcctgtgtcggagcagaagcagagtggggtctacttggtgttttaaagcgtacgtccaacccgcaggattaagacgcggatactgagtaggtatcataggtccaggagcagcgcgaggaagagcgggagcttcaggcggagcccctgggcgcctcctcccagcgatcttctccggctccgtcccggcccagacaggccaggccaaggtttcttcgttcagtgacacgcgtttctgggctgattttcccaaagccaccgctcagccctctccactccacccctgtccggccccctcgccgtcccgcccctcccccgggcccgagctagtttagccccgagccagcagcgaagggcagagcccaggagccgttttctttcacctggacgctgcgaggaggcttggcgcgcctctccgcgctagggcccaagttccttgcgcgcgcgggctgagggcggacggacctcgccggggccctcggcatctcccggcccagtccgcagagcgagccccggcagattcaagggcttgtgaaagcgtgagcgcggctgtccgccgggctccctaagctcgctgggagggggcaaaccggtccgggctgtgcggggcgtttacaaaaaagtgacttggagatgaactctcccgtgcgcgactggccgccccgctataggggcgaaggcgcctgacgcaagcggaactccgcggagcccatacgaatcagaacagagcgaggctcctggcgctctggaaactccaggaggcagctccgccagagacgcgggtcgtgtctcgggaaaccggagggtggggggagggggaagagcgcataaaagaaaacccaccgaggcggggactggcctgg

SEQ ID NO: 37597 - DNA, 1540 bp, Bovine  19866880845339
ttctaatgacactggtatcagtggttagaaggatgaaggaagaagatggaagcaatgcaagccttaggtaaaagaattatacttgcctccttttgaggcaatgggctaaagtaccaccaagacttgggtccgtgtgtcagagtcaaggccagagaaaactttctacatacccattcagagtagggtgatggggctgccatccctgctgctttagaatttatctcattttacaattcttgctttaatggaaagataacaaattgcgccttgagtcagagagtctgagaaaggaagataaactttgctaagtattgtcatagcctgaatgagaagttgagtgctaagggggcccctgtaaggtggtcagggctccaagagtttgtccccagcttgacttctgtcaaactgtctttatgacaaggatgttttttcctacccattgtgagcgttttatcctcaagacactaaatgctttcatcagtgtctgcttgtgaagaggaagttgttggagttttgcccagtttggctacaagtagggtaggaagagatgtcggaaagtgagccaaagtgcacttgaccggaccgtgtttacctcacatgtgctgtgtcatgataaggatggggggattggtaaaaactgtcatgctccataggtgccttttctagtgaagggtaaactgtagaaaagggaaattgatcaataatgcagatgtaaaggcaggctatttgtatatcatcaggctgtcagcatgtagtttcacaattttgctcccaaccatattttgttggaaataggaaatagcttaaagaaccataaaattgaattgttggttagaaggaaatttaaaaactttaaaatgaaactctcttttatctgattattattcacactaacacattcattcattcccccaacacacacacacatatatttttctctttggtaaagcccttacatgacagataaagctccacctggtctttcaacactgaccatttcctctcctgatccggcatttattctctaccttgtacttgcctctatcccttgtgtccttcctccgcacagagctctttcttagtccttgacaggttctagtggcacttctcattcatccaacagtcacattcatccaacatacatatagctgcacttgtatgtattgaatcagtgaattctatatactttgcattttctgtagacaccagccttatatttgaaatttacaaggtatcttattccattttgtatttgttctagtgataatacagtttttagaaaaccaaagaaaacgttaacaaccaaaatgagaagataatactaatatataaagaattcacataaatctctaagaacaatgtttaaaactgtaataaatagaccaaatatctgattaactaattcacaaaagaaactctacttgaaatgtctaaaagagacctgagaaagtgttgatttttattagggatcatataaatgcaaatttaagcaaaatgctacgtatgaatttagctaaaattattttgtacaggaagcagc

SEQ ID NO: 37598 - DNA, 1901 bp, Bovine  19866880847679
ctggtatatgaggggaacgccccaactaatcatacaagtaccaaggccaccttggaacagacagtgtgaaatgcaaacagaggaagcgtctgctctggctgtatggaaagagaatcctctgagctgtgctcggccccagcagccaaggcagggaccatctcacgagcgacagaactgggctattaaaggactgctgctaagtcgcttcagtcgtgtccaattctgtgcgaccccagagatggcagcccacccgtccctgggattctccaggcaagaacactggagtgggttgccatttccttctccaatgcatgaaagtgaaaagtgaaagtgaagtcgctcagttgtgtccgactcttagcgatcccatggactgcagcctaccaggctcctccgtccatgggattttccaggcaggagtactggagtggggtgccattgccttctccaattaaaggactgaaagtgtcccaaagtgtgacacccacgtggcccaggacaaggcaatccacacacctctgggtgagtccaaggaggaccacaaatcacagcggtgatgggcaaagcagggccctggcagccagaagatgctgagctcagctgcagagtaaaacagcacatagcagagtgcacggcacacagcatggtcctttggcaacaggtcaccggtagcatgtaaggtacctcatcagaagccaaacttacgcaagaaaaactccacctttcttttttaattgctctatttttttttctgatgacaaacatgaaatctgtgtcgactgtggaccgtgtggaaaatataagtatttaaaatagaaaataacaacaataattctgctttctacaaaaatttgtcaatattttggtgtatttcttagtcttttctatttaaacatgcaaatagatgtgaaagtacatttacatatgtttatatacttgagattatccagtcttgtatcctgatttttttcccacttacctcctaagtgtttcgccatatcatgaaaaccttttgtgtgggttcttcatcctatattatatatagtaaatttacttatacattccctaacattttaacactgaggttgctttatgttctgccattataaaaattgctgtgataaacctctttctcataagtctttgtcctaatttctaattacctcctcaggcagattcctagaaggggaatttatcaagcaaagggcacacacatttttaaagccctggatatattttggtaaattgaaaagcccacttttcattcaatgtaaacttttttttttttcaaacttccttttttaacagttactttggaagagaacaagagtaggatttagggtttgaacggacagaaagggaacaagggacaaacccccaatgtcatagggccaagcagagcaggctagtagcccctggacaagcacatccaaaaagaaagtggggtgacttgaagtggtggagggggagctggtttcttagggagggttccttcttagagaagggcgttacaggacagacagcttttcaacagcagagccacaaaaggaggtgggagaagaggcaggccaggcaaagagacagggcttctggaagcatctgcagagcggtgagaagctgggagcttcagtgtggaatccctcctgcctcactggcagctactcccttctctcaccacaggttccagcatcctgaatggcatggggtggccagcacttcctgccctgcgtgccttactcagctgctcctctgcccccagtgtcccccaccccagataacctacaggtcctgcaagtggtgatgcagcgctgcctcctccagactgctcccctatccacacctggactcactgccatccatagatggtctccagatcaaggcaggtgctgggcaggccacct

SEQ ID NO: 37599 - DNA, 2072 bp, Bovine  19866880855831
ttgcagccctccaaaatgcaagctgatcaaattaatatgatgtaaaatgaatgcaatatccttataaatatttatatgtaaagtctgaacttggaggccagaataatgttacatcgactctgaaaaaccactgggtttgcatcttcccagctcattctagtcttctagcaccgtgtggcagcaatgtgttttctcagaaaagtcaactaattttagagaaaattcatcttttttcatttcttaacctggcccatgagagataacagttcacctaggtttcaacatctgctgagaggaagattaaaaacaaaatcctaatttctggtgtgttcttgttgttggaaaaaaatatcagctagcgagtattattagctatcttcgagttgacaagaatgcaggattaagtttctttaaggcaattacacttttgatgacccctctgcatataaaacatgttagctaatgggggtgcagaggggcagcttaagtgtttgatcaggaaatcctgcgtgagcatattggatggaaatttgattagtggccttagtgacgggcgatcagatcctccgggtctgcacaatcagatctggcagcacttgccttcttgcctctttgaaggaggcgaacatttgtacagaatcaagacagtgctgggtccttgggttttggttttttttttcttctgggtcctttcctttaagttattgcagactaaagcctgaaaagtaccttttattttctttgaacaatatgtttgcagttaccttcatgttgtagaataaaataaaaatcggcctttctctgaaaatttgaggtcagaggaagcagaaatgaaaaattgagagtcagaagggacctcaaagaacatccttgtaagcaaagctaacactcacacagtactcattacacctcactgccaccttgctgcaaagatatccacacattcatcctcacaacgcccctgttttaccgaggaggaaattcacacagtacagtgaagtgacccagggtcatctggtggggattcgaacccaggcagctgggctcctgacccgggctcttgaccactccacacattctgcacttctgcttccccagtgatataagtgggaaaactgagctcccagagaagatatgaatctcccagagtgaatcagctatgatttaaactacaatcttttttaatcgttcgatgttcttctctcatgccacctgaacttctaaatttcaccttcctctgttaacctggacaaaacagaatctgttctaggtgctttccatccatcacgccagacagtgtgcaaatgacccccagaaatggatactatttctgttttacagatcagagaagctgtgtcttagagaggttacgtgacttgtctgtggtcacacagcaagaaacagaaaagagatttcatctcacatccgtctcactcctttccactttccttctgagaaaaagtgaagctgggaggaaagaataatcccagcaatatttaggggtcaaacaggagctaaaacagttagtttgcattgtgcaaatttcatgcatttgtttagcatgaggaataggacttcacgttaggtgtattgtttttagttaaaccaataggtattctccatgtgcctaaaccccagtcagccaggtgaggcatggcattagcaagaagtaatggccagattcagcctttaaaagatgcatttaaaaaaatgcaggaaaaaaagtcacatgcgcataggcacgcaggacgtgacacataaacatcatacagtctatgtttcactctatttttcatatggactctaagcttcccagatcctcccctccggtgtgaaccatataactggatacttttacaaaggaaatgaaacaaaacaatcctgaaatctcttagtaacaaaaacgatccaggtaggttctggcatcagactgaccctgagtcacagaaaagtcaattaattgtgatggccataatggatcgattattctgggaaatctccgacatgacttcagcccagcaggctgacaaggagacacacatcaaatgagctagccctttccaagggagcaa

SEQ ID NO: 37600 - DNA, 2273 bp, Bovine  19866880874935
tatgggtggcaagaaaacagtctgagtcaatcatcaaaccaagcctgacccttggttctgtgtgactcacctggtttcttggcttgtttcttatttcattgaaagccaggtcagactgtccaggtggaatgttcaaaaaaccaaagccttaatgtgaacattttctttaaggtcagggtaatttacaatctgtccagagaagcttttagagatttagcatgtgatgttgaacgtgaccgtaatccacaatgccctctcatggcccttccttcctatcagaaattgattctggcatggttcgttcagatggaaagtgactctgtcagcaattactgtttcttttttcacacactggggttcccccccaccgaagtattaaagcctctttaatgctcctttaggaaaggttaaatacaattatcaccaacatctggagtcttatatctgcctgctatttctactgtgctttactccttggacagttagccatccaatagagtagaagagatttccctccaatcctgagcttgactactctctgtgccaagtgaccccgaaggaaagcataaccaaacaaggcccttagctctggccatggtttacagcatatgttttcttttctccctccctctgtgggtcttccttgcacttcaggaacatatgacactgccacaaaactgtttgtgaccacttacatcttgactctagacaggtccagagaacacactgacccctttcaatagatgagctgaagctgacaaagagggcagtcaattcatctttgtatatggcctttagagctcctataactttcagagtatttggtaaaagtgaaagtcacttttagtcacacacttaagttgtgtctgactcttagcgaccccatgaactgtagcctgccagactcctatgtccttgtaattctccagccaagaatactagagtgggtagccactctcttctttaggggacccaagggtcaaacccgagtctcctgcactgcaggcagattttttaccatctgagccaccaggaaggcccattttgggtaatatgatggttaagtttatgtgtcaatgtgacaggatcaccaggtacccagctatttaaataaacattatctgggtagagaggggatgtctgtgaaggtgtttccatatgagattagtgtttcagttggactgagtaaagcttgtggccctccccagtatggtgggcatcattccatctgctgagggcctccctttcctccaaaaagtgaaggaagggagaatttgctccattcctgtttgagctgagatgttgatcttctgcccttggattgagatggaaaccattggtttccctggctctcagacctttggacccagattgaatcatgcttccaacttacctgggtttccagtttgcagatggcaagtctgggactttgaaacctccataattatattcctcataataactctctctctctctctctcacacacacacacatatagtttcccaggtagcgcagtggtaaggatttgaggtgcaagagatataggtttgattcctggatcaggaagatcccccagagtagaaaatggcaacccactctagtattcttgactggaaaattgcatggatagaggaggctggtgggctacagtcgtggggtctcaaagagtcagacacgactaagcatgcatgcacactcatacacacctacataaatatgctttgtttcataaagacccctgattaatacagatggtgtctcttaatagtgcccaaggtgctcactttctgttatcaaacttttcaatctgcttaaatttatgtcctctttggttaaatataaaaattctcccttaccatatataggtcattacagtttcagattcccagatgtgaggaagatgttaagttaaattttttttcaacctattatttattttaaagttcccatatatgaaagcatattgaatataccttttaaaaatgaagtagatcccctagaagttcgggctggttagcataaggagaggcccctggataacagctatggattatggcaaacctgcagggtgctggacccaacagccattctcaaccttcttgttatagccatccacttgaaacactgactagcttttccagatttacttgcagtgaggaatggccatgttacatagtattgtaccagtgatatgctagtagaagtctgtcagtgcgggttctgagaaagccttcactttcctaatagaggggacagatatagctgactcaat

SEQ ID NO: 37601 - DNA, 909 bp, Bovine  19866880892205
ctggaatctggagaggtgaaaggagccgggtcaaaactccccacttcagccctcttcctcccaccccagacagggtgccctgcccagaaatggccagagatgacaattgctagggctgcagtagcccttcagagaccagaggtgctgacctctgggtcagcagtggacccttgactgttcatcttttatatatagatatatatatttgcctgaattgggtcttagcagcagcactctgaatctttgatcttcattgaggcacacaggacctttagttgtggcatgggggatctagttccctgaccagggactgagcccgggccccctgcgttgcaagtgaagagtcctagaccctggaccaccaggaaagttccttgaccatccatcttgaccagcagtcctctacttgtctggggtctggaggctgaaggagtctagctatcaggaaatacttgctgagcccagctgagcacggagccctgggccatggaaaacagaacagaagctcagaacctggctcctggggccagagtgggtgccagaggtaccctctcaccggtgtggcccctccacaaccctggcctccctccaccctgctgctgccccaggccttctcctggggatggcctgggcagggtccatgggaacgtgaggctctcctggctcttgtttgcctcagctaatctcaagaatgcacttgttttcccttttggtttgggaagtcctcagctctccctttaatgtcgatagagctggggacagaggccgtgggagccagagggcaatgatccctggcttgttctcttgctggctatgtttctctctttccaattgtttgttacttcctgcctccatttcagcgtctcctcacagttcccagaaactgaaataaatgtcctgaattttgga

SEQ ID NO: 37602 - DNA, 1280 bp, Bovine  19866880907460
tctttgcgaccctatggacagcagcccaccaggctcctctgtccacgggattctctaggcaagaatgctggagtgggttgccatttccttctcccatgtgagggtcctaatatggagttatgggagagggagcttcagagtgagcaaggttcgtcaggatgaggacctccaaagaaggcaggagaaacattcagaacactgcagagaccctgcagaaacactgcaagagaataattcagagtccctgggtagaaatgaatgaacaagtgaatatgtgaatgaatgtctgatgacctaacaaagagttagtttcacgacatttaaattgctgctggtgctcacaaatcaatgaagttagacacttgcgaaaatctttacttgattgcattttcacacagggacagtgctgtgggaaaaacccaggtgaagataagtttggtccctttctatgggtcttccctggtgtgtactggcagccccatctccctgacctccatcccaatggtggggaccagactttgggtggggcaccaagccattttttcaacctagagaagaaggagtgtttgattcaatttgcatagagatgaaaagtacaagggggcatggagacacctcagggtctccagcctgcctctgctgcctagggaaggcttcgaatatatttggagaagtccatgagggtgagagaggaggaggcaggagggggcaaggacagttcctctcttaatggattatccagaggaggaaatggcatggaaagatggagaagattgctctttcactctgcttctcataactgcctgagtgctgatgacttgtgaattaagagtcgaggtttgaagtccacggaaagctgcacttggaatgggtctcagatttcatgtgatgaatccgtgtgcatctctgctctttaatttacaaagctcgcctgcccttttagcctacaactttagctttttccacaagcacattacaaagcatttttaatgttgagtagcatactcatatttcaactttatggcttgcattgttcaaaatgcagttatgaaaagtatgctttaataaagtcacttccgtgggttttttttttttcttttgcagcagctacaagccatatatactattcagaaatagcttgcctttggaccttttcctctgagatagaaattcatttcacctggctataaatcaagctcagagatacctttaatccagaaaagcagatcaaatatatttgataaccctggtgttaaaataccgtatcaggaaaataattt

SEQ ID NO: 37603 - DNA, 992 bp, Bovine  19866880920488
tctactatattgctgggggcagtgagagtctgtctgtgtccgtctgtctgtctcggctttttctgctcactcactcgcttgcacatggccccataatggccacacagaatctagcctcggctcttgagtctgcggttatacctttctctgtatcttagttcaaatctcaagagaggatctgaataatttagtctagtctatgatttgagtcctctggagtcaagtgatcttccttatccaatcagctataaactggccccagggggtgctggcatggggcaggtgtttaaggttaggtcacatggcacaaacagagcaagtggagaatgtgatgtgagaagtgacgggggcaggaggaatatgattaacatctctctatataatatatagatgtaaagatgtttcatgtggaattgtttataataacaaaaatcaggcttctcactcactggctcactcaacattattaattctctatgcatttgctgagcatgtgcagctttccagactctgaacggaaccctggacactaagacaaggaaatctagcctctgctcaggaaaaaagcacaatcactgtatacgtaggggaacagacacaggcttctcaaagggaggtgataggcaaaacctggaaggtatctctagaaaaaaaaaacataataaataaataaccaatgaatcaaataaactaagcctcaatgagaaacctgctaaacaaccaagatgatgtgacaagcaatagtcaggcccttcctggactggaggcagatgacgatagaatcagagccctctgggccactggccagagccctggaatctggcagaagaggcgattcctctccagaattggcaggcccagtctcccagtttgaacctgcattttggcccaagagtcagcagccccagccgacagatacagtgtccttgcctctacctgagcttaattcaaaccattctgtctgcccctaattcggagcttttatgggtttt

SEQ ID NO: 37604 - DNA, 1381 bp, Bovine  19866880946322
ctacgattctctgaagaactcaatttaaaaaaatagtaaaggtataattgacatattattatgttagttttaggtgtctaatacaatgatttgatatttatatatagtaaaacaatcaccacaataagtccagttaacatttgtcaccatacatagttataaaattgtttgtttttgtgtttttttcttgtaatgagaacatttaagatctactctcttagcacctgtcaaatacacaacactgtattaactgctttgctgtacaatacatctccatgatttactttataactggaagtttgtaccttttgaccccctctacctatttctccctcttctacactccacctctggcagctaccaatctgttgttctctgtatctatgagccagttttttttttttttttctcatgtatcaaccagaacaacatatcacaacatattgagggccaaagtagatacgagaaatgaactgtcttgttaagtcagaatttaaagagttctgcagaactgtaaacattgctactcttatcactgaatttctttcaaagctgtagttattttgtttaagttaacgtgaataggtttagtttgtttttgaaaatgaattaatacatgaatattttggaagttgtcttagttttaatttttaacatgataaatattaataaatataatctacataaataaggtggctcaaacggtaaagaatctgcctgcaatacaggagactcgggttcgatccctaaattgggaagaacctttggagaagggaatggcaacccactccagtattcttgcctggcgaattccatggacagaggagcctggcgggctacagtccacggggttgtaaaagagttggacacaactgagcctttcacctttcacccttcacataaacaagctttttagtgtcctcaaaaattaatactgtaaaggtgtctgtaaaccaaaaagtttgacaagtgctgctatgagttaaagttttttaaatagtcatattttttgtatgtatgagtgaataagtaggtgctttagactttaaactgtggctacagtttcacaaagtaaaaactgaattgttttgtatgcatgttcagttcaattcagttcagtcgctcagtcgtgtccgactctctgtgaccccatgaatcgcagcacgccaggcctccctgtccatcaccaactcccggagttcacccagactcacggtctgtttttactcaagatcgcaaacatgtttcatttgacatggcaatataacattttgtttgcttgtttttcatgtttctccttagcctctgcgacttgatatcaagagaaaacttactgctcgatccgatcgagttaagagtgtggatttgcatcctacagagc

SEQ ID NO: 37605 - DNA, 1309 bp, Bovine  19866880949963
caagaacactggagtgggttgccatttccttctccaatgcatgaaagtgaaaagtgaaagggaagtcgctcagtcgggtcgactcttagcgacccccatggactgcagccttccaggctcctccatccatgggattttccaagcaagagtactggagtggggtgccattgccttctcctgaaacactgtaaatcaactatacttcaattttaaaaaagaaagatacaacactgtaaattaactatacaccaataaaaaattaattaagaaagagttttagggatttccctggtggtgctgtggttaagaatccaacttgcagtgaaggggatgcaggttcaatccctgatcagggagctacaatcccacatggcagaccctgaaaatactgagcctgtgctccacaacttgagagtctatgtgttgcaatgaaagagctcacatgatgcagtagagatcctatgtcctccaactaagatctagtgcagcaaaataaaatttttaaagacaaaatttttgatttttaaattatttttaaaaattagaaaaatttctttaaaaaattagaaaaaagaaactgtgaggctacacttatattccagatttcctcttctgtttccctgttatattatttcttaatacctctgagagctaatcataaaaaaaaaagtaaaaataaataattttttaaaattcaaaacaaattaaacaaaaccagggggaaaaaaagtcaatgcttagatcccattctggttccaccagtcagaagtgagcccaagaaccagtattttaactccttcctgttggttctaatgtgcggcaaggctgagaatccctgctctaaaatgtgtcacagtgaaaggcatgagttcctcttgtttttggagtgtaggtggcccaacagaaaatatacagcctaaaaggaaatcaagtagctataaaatagcctgtggggaaaactagcaactatatttcctctctcagcatgaaattagccatttcccctctgattttgaagtagcttacagtgaggacttccttaattatttaattggaaatacaaaagagtgaaatggagtctaactcaatcgggcaataagcatttggtgagcacctgctgagagctgggcacagcgcctggcagccggcagccagatctaatgcagctcctgtctttagccagcaagcccttgggggggccgtcagaacagcaaagcagtgcggggagggcagtgacagacacctgtcccgaaggtcccagagtccagagatggtggaacactgcattttattcagtggtgtctgtgtt

SEQ ID NO: 37606 - DNA, 849 bp, Bovine  19866880985486
tgcgagcctgactgtcggtgcccacttgaaatacaatgggaattaacactaggaaaagccctgtcctcacagaaccttattttcttgaaggaaagaaggaaattttaaaaattaccaatgagatgaattatgaagggggaagcagatggtcctgcagaagggcacagaagggtacaaacacaaagatgaagcaaagtagatgacctgaatcaagcagttacattatagtaaaagtaagcgaagtacacctgggctttagagcataccatagtgagaggaaggagagcgagcgatggtaaaatggagctgacagagggaacccctaagaagcatggcgggggtgggggaggcaccaatatatctgttaagcacaaaatcagaaagattttaaacatttggatagaatagatcccctaccccaccaaaagcagttagcaagcatcctttccacagcaaggcaaaaggaattcacaagatttgaaactgcagaggacagaaattctgaattagtgatatactgataggaaagtttattattcagtagttcaacacatagttactgagcacttattgtatgtcaggtaacgtcatagacactgggatacagcagaaaacaaaatgttaatgtgaataaaatatcactggtggggtcctagttgaatgtgcagtccttactgtttcattagaatgatataagctgttaagtttacttttgaacttggttcctcctaaggcctatttttgccatcttaaacccctcaaatgtgaattttatctggattttaaaaacttaaccttggatgttggggataattactgtataaatagacacaaaactgtatagtatag

SEQ ID NO: 37607 - DNA, 1400 bp, Bovine  19866881018027
caaaaccgatttgaggtcctgtctgtcctgacctaacatttgccccaggactccttccaccctcactgactctcccctcttctgtgcacgggtgcccggtgtcccctgatggaggtacagagtgactgtgattatccctggctccactttaggtaaagtcaggggtcacttgcatggacttgttcgactgctttgggaggacagagaaaatgtgttccttgtgtttgtgggaggagatcagagcctgccacgaggctggggaggccggcatgagacgggcccatataacaaagagaggaacgtgggacacgattcaaccatttgtggagatctaggtaaccagacaagcctgtgggggagggaggggactcccttctttcagatgagaagattaagtggctcattgatggcataaaggtcttcagcagaacctgcccccaatacctaggatcaaacccagctctgcccaccgctgcagccctccttctgttttgtcctttactccactgagccccccaagcaagcactgtgcactggcccctgccggcaacacatatgcgcacacagtcacccccaacacagcactccctttgacttcgatgactgtgccatctggaactatgcagacagaaaagaaaggacatttcctatctgtcctagatatctctgggtgggacaccctgcgaggaaatcctcagccacctcaccatcaattatcatgcgtggagtcaaggggaggcttgggaagagtactttccaaatttccatcagcaccttcctcccaaccaccgaaagtaaagtctcaggtagataaataggtcaaataaataataaataaagaagtaaattacaatctaagacaattccatgtccttattaagcaaccttagctctgaggcaaatctcctagccacttccctgtgttcttaacaaatttctgccctgatcctcttctgtataaatgttgaggcagtctctgttaataaggggctagaatggccatttcaacatatctcatttatttccttattctttaaaataatcagggttttgaattgggcttaaaccagcttgggtggggcagaggcagagaaacacttcatctcaggacagtttgagctgctagtggaagactggttgttatttgattgctccgaatgacccatatctaatttgagaaaagagtcaacaatttgacttttaaagttttttttatatttgtttatttatagaacaatttaatattttgctagttgaaaataaaaaggtccataatagatgaatgcaaaactcatttgatatgttaaatgccatgaactcagaggatgtccatgcttaaagagcccctaaatgttatggaccagccttcccatttgacacatggggctgcggagggaaag

SEQ ID NO: 37608 - DNA, 1445 bp, Bovine  19866881108969
ttagcaagtgctctttctagtaggaatctagacaaggcacaatcaagaaaaggctcatattttaaaacttgcaccaactgtaaaagatattgagagagttcttcatcactgaaagaaacaaaacacagagtaagtcactcaacaatcagagctggaaaaagacccctcttacttataaaacttcaaatactaactttgaaacagtggttcttttgggtcaagcctgttgcatgcttatattcactttcatgactataataacacaaaataagctgaggatttcggtggacagaagagtatatgaaaaggagcaaagaacagctatatggggcactttgagtaagttaacgaggttgatacaaatgatgactgtatttacaatcagcccagagttataataaaaatagttttctgatcatgctgaagaagtttacatactcactcaatcagtttttttaaatacaaattccatcagtacttcagcaacttaattttcctttcctatcaaagggttaagtaatttttgatcccagataatgaacgaacaattaaaattttcaaatactttgaagaataaagagtacatttataagttggaaggactcaaggaattaacaaaacactataattaaatgagctgaattaattaagattgtggctctctattttgtatctatctccaaaccattcacatgtaaacagtctcattagaggcaattcctgtagtcaggttaagatatgttatctcaagtcctctacttggtgactagtcttggacaataaacggttaagaatgtagtctaaatcagatgtggaacctaaatctagaacattattcatctgaaaaaaaaaaaaaaaacaaacctcacaagcagaaaatttaacagaggaagacacattagaattacctatatggaacatgagatcacagcaatctctgcctaggggtcaatatatttgaaaacaacaattggctcattccaaggaggtggcaggtagcctgcccctcaggtatccaatgcaaacttagggaggctgaggaacaatggggagcctcatttttaaaaactatctatacaacaattttaagcttactgtaaaatccatgcccattataaaaccgataaatagtgtgacagaagtatagaaggggcctcctctttcctaatacttaaaaagacgtctcataaacatacctgaaaaaatattttgtataatttgctttgaatatcacacaatttaaaacataaatgatttattttaaaaagaaaaaaaaatcactatatccttaattttctggagaagttttgctttttaaataatcatacagagacttccctggtggtccagtggttaagattctggactgccaatgcaggaggtgcaggtctgacccttggtctgagaactaagatcccacatgctgtgcgtcacagccaaaagaa

SEQ ID NO: 37609 - DNA, 756 bp, Bovine  19866881133856
cacccacaagttattccttgcccccaaaaagcctcctgcaggagatacctcatctgttgcaggcagcccacagcatattctcgcacatactgatctggatagttgaaatctagaagctcaagggcctcccgggggggcagtttaggccaaatctgaagcagtgcttgaagctgtttaaaagttgaaaggaaaaaaaagattacttttctctcctataacttctgaaccacttatccgttttttctcggtacacaggaacagagatggtcaaaagaaaggagaagtatacgtgcaattactaaggcctcaaaaatctattattgctaatataggttaacaaaagatggtctctgctgaggtattctataggtaagcaggcaaaaaagcgattatatacttagctagaagtagaatgatacactgaatatatgaattctacaatcattaaccattaaatttttttttaaaaaaggaaataaaggcagggcaagaggagaggagaaggtgagaggaaggggaggagagagaaatgactaagaaatacttaaaggcctttgagggagactaaagagggagggatgtatgtatacctatagctgattcaccttgttgtacagaaatcaacacaacactgtaaagcaaatatcctccaattaaaaataaattttttaaaaaagaaatacttaaaaaaataaaataaaaaataaaaagaaatacttaaaattcaaattacaaatataagctaaaaagtacatt

SEQ ID NO: 37610 - DNA, 2491 bp, Bovine  19866881158918
atcgaacccaagtctcctgcgttgcaggcagacgctttaacctctgagccaccaggaaagccctagacgcgcctttaaagtgacacccagattaaaggcgctgccgcctgcatcacctggaggggagcctgatgggtcggcgaggatcctctgctacttccgggctcctggccaattggttcttcctttgggatgacagttgagccgcaacagatacacctctgagtgtagtgtacgtcaaattcgatacactaaactcttggtttagtgacggaagtataacaatgaccatcatgctaaactgatacatacataagttgaccatgcagcagttgatattaagacaatcaattctaacatctctttcccttccaacacacctgcaaggatctgacaatcattaacaacagacaaaggcttaaggatgccatccaaaaactcacctcactattggaccaaaagaagataagaggtcactaccagggcgacgtctcaggggatgaaggaactacatttcagggtcctggtgcagcgttccaatggtgagacttcaaatgtaatcggttttccggttaaggttttcctcatctgaggtcaacaagaggaaagccaaggacttcacccaggagtggcacgattgctccgcccccttcaggcctataaaagcatctacactgaactacccaccagggtcaggactctagggcttcccagactactccatttctgtaggcggagcctaggaaggggcggggcttagcgtgcggctgcttagcgtgcggctgcttagcgtgcggctgcttagcgtgcggctgcttagcgtgcggctgcttagcgtgcggctgcttagcgtgcggctgcttagcgtgcggctgcttagcgtgcggctgcttagcgtgcggctgcttagcgtgcggctgcttagcgtgcggctgcttagcgtgcggctgcttagcgactctggttccgcccgcttcactcacggcacccttggcccactcctctgcaaacccgtccacgtgaggagctgaagcttcaaactcgcaagactgaacgcagcagctcccctagaagccacgactgagtgactccccagaggcaaccccaaagttcgaagactcgtcctgcgttcctgcgccccaccgcccctcgtcggcctcacctgtcaagccgacctttcactgcctgcaggacccagccctctgtcgccttctgccaggtcccaggcccgcggcgacattcacatgatgggctgccgaccgcgcagccccaccgcctaccctgaggacacgtgggaacagcaggacggaggacccggccctgccaagcgccgccgaaccgaggagcccgccctccccaagtccgagtctgaggcggcgcccagcctgcataacctgacctggtccccgacagcgggcactctcattttcgtggctgtcctgccggcgggatgtgctctgcacgtgctcctggacgacgtcgaactgctgctggagcccgagccaacgtctgtgtggcaagtgtgtttcggaggtcgcatcctcatgctggtccccgaggccctcctgggctcgggtgtggaagggccgtgggggcagggcctagaaccgggcgctgtcctgagccctcccggagagtacgtggccctggagccgggactctcctgtgccgctgtcccagagatcgcctgccagggagaggccagcaaggaggacgcgaatgctgacgctgacttcctgctgggcgggatggatgctgcctcagtcccagtcgctgggctccgctcttctgctggaagtttgactcactttgacctgttcgacctagtctcagagctctcccctcgggcctccaatcctagtccagagagaggctctcctcagcacgacgacaacctggacttgcaccttctggagccctttcctgactcaccactccaacctctacctccttctccgagtccaggtccccaggaggcgcccctgtcgcccaactggtcctccttgcaaggcccggagatgcctgttccctgaatccactgcctcccacaattcctggactcctgagcgggcaccaggacagaatcttccgatgttggttgtgtatatattgaacacaccaaaagaagcacacgaataggtcctttttgaatgcaggctgcattgcagaattttgatcagtggctgcctgaacacctgaaaggaagctcacctgggcaaagaaaatccacttgaaatgcagcattctttcagccagccagactgctggtaggttttctctaaagaggttacccttaagcagatctgttgttgtttttgtttgtttgtttgtttgctgttgttttggactccgtgcaactctgtggactgtagccctccaagatcatctgcccatgtgatttcccaggcaagaatactggaataggttgtcgtttacttctccggggcatcttcctgacccagggatggaagctgcctctcctgcattgcag

SEQ ID NO: 37611 - DNA, 1676 bp, Bovine  19866881176754
gcaggagggaggagggtttaggatggggaacacatgtatacctgtggcggattcatgttgatatatggcaaaaccaatccaatattgtaaagttaagaaacaaaataaaattaaaaaataaaaaaaaaaagaatatcaacaaaaaacttggaaaaaaaaaaaacaaaagaaacaaacaaaaaaaactacatgataataactacaggaaatgcttacattttcatgttaagaataaaaggatacaaattcttatagataaatatagtaaccacattttttaatatataaaattcatatacccatcttcaaaaaaaaaaaaaccctttccataaagtaagaagaaaacaaaaaagacttgaaaatgtgaaatggaagatgagatcaggttcaccatcctttatccacaatttcaaagtctaagaaactcttaaaaagcaaaggttcatttataactcatttgacaataaaacatgaccagaaatgacatgaagctaactgacagccttcatttgtctcatttagtgtgaatattcatatatttcacttctagaactgatgcgtttgattactgagttgtcccagaccctacatggggtgttgagtgatctactatctttgtaaaatacataaaagtttgaattcttaaatacatttgacatctgaagttttagttaacctgtaatattttaactctcttcattcttaactatattttctaaaaagcaaacatttataatagaacacttatatttatgatatttactaaatttgccaaagcaaaaatgaaaacaacataagggagacttactgtcttttcaaaaatcaattcttagggacaaaaattatatgatataatttcatttatattaatccattattttaaagtttaaaattatccccattatgttattattattccattataaaactttttcagaaattagtatataactaccacttttccagatttcctgatggtctgatacttagagggattcatggttttagttgatttcttagttttcactttatccaaaactgcataaacagcaaaacataatcgagtcattcgtggcaggtcacaagtgttgatatcaaattccagtggttcattccaaatatgatcattcttccctgatatctctgagcttacgacagttttacacaggagttcggtaccatgaaaaaggccggccctgacatgaacctgtaatgacggagacaaaaacaaacagagagtcatgaatactgcaccagtaaaacatatttgaagaatggagaaacgcatactggcagaagaagcagacaaactctaggaaagtctattagtccacagaaccacatgtaattcacaaaactgttagctaaaacctatttttcacgtactaagcagactagctaaaacatgtctcaatggtgtaaatggatctaaagaaaccaagaccataagtataaaacctactgctgctgctgctaagtcgcttcagtcatgtctgactctatgcgaccccatagatggcagcccaacaggccccgccgtccctgggattctccaggcaagaacactggagtgggttgccatttccttctccaatgcatgaaagtgaaaagggaaagtgaagttgctcagtcgtgtctgacccttagcgaccccaggactgcagcctaccaggctc

SEQ ID NO: 37612 - DNA, 1290 bp, Bovine  19866881270597
atttgagagtcgtttagaagtttagaaaatagatataattgctaacataggctgtaaattctacagggaagtcaaagcacagaggaaagcggtaagatgaaatgaagacaggctttggatctcagcttaaatgtcacttcttcagagaggtctcctgcacataaccctattctcttcctgcatagcacgtattataatagcatgattatttgtatttgttccatatttctcttctcaactatactgtaagctccacgtgggaaggaactgcacctggtttactcgccaccgtatacataacagcatcaagttgaatctgggatacataacagttgcataataagtttctgtaaatgaacaaatgttaaatgagtgtttgagctatttgaatcctggtgggtagatgaggcccatagaagactcttgagaccagcacagcaggacactgagctaaagactgaacttgtgtgcagagtccttcctttgctagcaaacagaagagctagaaaggccttcgggctcgtaagaaggaattcctttggagcacatgttatagagcttccttccctctatttgctacatacaaaatccaggggcgaatagagagaggttgtattgttagtaattagaaaataatcagtctttttgtgctttgcaaattgtgaaggatactggtgatcctgcatctagtgtccattttcctctcaatctttataggactccagttttacccaaatagccatgcttccaccttacaacccatgtgactcaaggagcatccatcccactgctaattccaattacgctaactccttctccctgctggaactcaggcttaaatcatctgtacatttgccaggcagttactgattggaggcagagtgtgtgcctaagtgacctaattggctcaaaaaatcagaagtaaagatttcagatggaaaaggaagcatgtggtcctgattgctcctggtagacatctggaccagcgctttcatttgaatttgaaacttactatgtttacagcagaacacagggaaaactcttcctagatactttgataaacttgatagcctttactttccaataacttgtccttgatagcttgttgaaccactgaatcaacctagtccaaagtctgtgttgcctctggatgaccgttatatgagataacaattttcttattgcttaagaagacattttcatttcagtgttctatttatagctcaaataatcctaattgaccaatgatatttggcctcctacctataattaagcagtgacactcagaaa

SEQ ID NO: 37613 - DNA, 1352 bp, Bovine  19866881600838
atttgttgtggggaccaaagagaaaaagtgcgaaaatatcagggtcaggcctggcgcttggtaaggatttagcacatgttatttccctttgttcctaacaaaaccccaaacctaacaaacaagtgtgattcttgaaagctactttgtgaattttatttgggttgctttaattctcctttttgtaatcctcaaaagcatgctgctgacactcatttcaaaggtcgaagaactttagctaagacatgaaagacactccgtgtttccttcctggaaaggacccagccaaatgctggggccctgatctgggcaggggcggctctcagaaagctctcaaacccagtggcattctcagctctgcggcccagggagtgaattctgccattgacatcgtgtttttgtttttttaaaataagaatcaaagaaatctctttaatgaatcaagaataggatcagaaagctggcaaaagagtttaaaccaaactgttaacagaggtttggtagatacttagatgcatgaatggatggatgaaagtaagtcaaggagggaaggaaatgaaacatgtttaagtgctgatatagaaagatgctgaagaaatattgagaaacaatgtgcaaagaagtagatcctttctttcttctctcctttctttttctccttccttctttccctacctccctcctctctctctctctctgtttttctttctgtcttttccggcttttggtagaaatattgaccaattctggggggcttcccgggtggctcagtggtaaagaatctgcctgctaatgcaggagatgtgggtttgatccttggatcggaaagatcccctggagaaggaaatgaaaacccattctagtattcttgcttggaaaatcccatggacagaggagcctggcagactatagtccatggggtcgccaagagtcacgacttagttcactaacaacatttgaccaattacctactcaatagatacagagctgctggcttctatatttgaggaagatttggggacagaccagccagaaacagtaccagtgattacctctggggagtggaaacgaagctgagtaaggaaggggcctttccttttcagtccactttctcctgtgctgcttgaattctttttttccttttacctaaaaacagacagcagcaacagaaggctggaagcagaaggcaggttctgtggaaggggtcatcctgagttcaaggctggagctggaggcgaggcctctgcctgggaggaggagcctgctcctgagtgaacaaagctgcagtttcccaggggtccacagtgggatgacaaatggcccttctgtcaccagcacacagagccaggctcctg

SEQ ID NO: 37614 - DNA, 2725 bp, Bovine  19866880036724
ggaaatagatggggaaacagtgtcagactttatttttctgggctccaaaatcactacagatggtgactacagccatgaaattaaaagacgcctactccttggaaggaaagttatgaccaacctagatagcatattcaaaagcagagacattactttgccaacaaaggttcgtctagtcaaggctatggtttttcctgtggtcatgtatggatgtgagagttggactgtgaagaaggctgagtgccaaagtattgatgcttttgaactgtggtgttggagaagactcttgagaatcccttggactgcaaggagatccaaccagtccattatgaaggagatcggccctgggatttctttggaaggaatgggtgctaaagctgaaactccagtactttggccacctcatgcgaagagttgactcattggaaaagactctgatgctgggagggattgggggcaggaggggaaggggatgacagaggatgagatggctggatggcatcactgactcgaaggacgtgagtctgagtgaactccgggagttggtgatggacagggaggcctggcatgctgcgattcatggggtgcaaagagtcggacatgactgagtgactgaactgaactaaactgattgcattttctactcattcattatattgatcaattccaaaattctgtttggttctctatcgctatttctatttctctattaaacatgtttcgttcatgtgtttttttcccccccagtggattgtttttctgttttgttttgttttttctctcttgtagtttgctcagcttccttaaaacaattaccaggcaaaattaaggtcttgatttctttggggtcagttgctgggaaattattgtgttcctttggtggtgtcatgtttcctttatttttcatattcctttaagtcatctattgcagcctttgcatttaaataaggagccacatcttctagtctttactgactaaatttaggagaaagtccttctgtcacccctgttacagattctaaggctttttcagatcttttctgaaggtctgaaatgctgggctggatgaagcacaagttggaatcaagattgcagggagaaatatcaataagttcatatatgcagaagataccacccttatggcagaaagcgaaaaggaactaaagagtttcttgatgaaagtgaaagaggagagtgaaaaagctggcttaaaactcaacattcaaaaaactaaaatcatggcatccagtcccattacatcgtggcaaatagatggggaaacaatgggaacagtgacagacttaattttcttggactccaaaatcactgaagatggtgactgcagccatgaaattaagacacttgctccttggaagtaaagctgtgacaaacctagacagcatattaaaaagcagagacattactttgccgacaaaggtccataccgtcaaagctatggtttttccagtagtcatgtatggatgtaagagttggaccataatgaaagctgagcaccaaagaattgaagcttttgaattggggtgttggaaaagacatgaaagtctctggaactgcaaagagaccaaaccagccaattctaaaggaaatcagtcctggatattcattggaaggactgatgtgaagatggaactctgatcttttggccacctgatgtgaagtactaactcactagaaaagatcctgaccgggaaagactgaaggcaggaggagaaggggatgacagaggatgagatggttgaatgacatcaccaacttgatgaacatgagttcgagtaggctccaggagttggtgatgaacagggaagcctggtgtgctgcagtcatggggtcacaaagagtcggacacgacttagcgactgaccaacaagaggaggaaggtgaaggaaagggggaagagaagatgggcggccctggaggcggaggtggagggggtggtgatggcatgtgtccatgtgtttggggactacttgcctcgatgagtaggacccccttcgctgtcctcagtttcggggctgggcgcctggggcctggagcccccccactgacctaggtcttggccaggctggccaggctgtgggcctggccggaggctcacgctgccttgcaaggcatgtaccaggtactcctccacggacagcttgtcccttgagccacgagacgggaagctgggcttcaggtgagggctgggcaggggcttctggctatctgcacaggccagtctgcccaggtgagggccaggcaggggctgctggtcgtctacacagtttgtcagtttgccaaggaagaaggactctagcgggtgaggcttccagggctggagagggtggaatgggaaggggtgaggcagcctgctgtaggggaagggctggggcagggggctggcgtcctgtgggtggtggactttccacacgtggttcagacactgcagggggctgatcagtttgtggagttctggtcgaggcagcgttggccgcaggccctccccaagcttcttaaaccagagctgaccaaggcccggctccttcagaggcttggtgaactgcggggcatttctaacatatgggggacccagtggaggctcatcttcctgcaggggaaacacagcattaggacacggagctgcggtcatggtgcagttcttctgcaagccctgagccgggcacggggactggggtcgggggaggcctcacctgcactgggaccg

SEQ ID NO: 37615 - DNA, 1599 bp, Bovine  19866880487877
ttaagatcaaatatgctttttattgtgtttgacttcgcttgggctagtgactccagagaagggtatgtcgttgaacagagcagggacattcagaagcaagttcacaaccctgcaagactcctaacttttctctcttctaacaaatgtcaaaatacagctatttaccaagtgaaaggtaaaactccctttacgccagaccaataaacagtttccccaaatgtcagcttactacttattgtttctttacttatctttcccacatcccaaaggaaaagttttacttcacaggagacctcaactgaatgctttcccttgagcatgacatactcattcctctgtgtcctctaagaaaagaagagcaaaccaattttgctattctccaaagtaatttattttatacactgtaaatcatccatttattttaatatagacttgtttttttctaaaatttaagacatcttaaactgcaaattctttttattttttcactgaaaaggccagttacttgttgagatattccagtgtcccctactttctgcagagggattagcagaaatgtacaaagttatgtgaagtgcattatcaaatcaaattgatctgaacctaagaatagagaaagaattttatgtaggatgcaatttggaggatacagtcaaatagcagtctcatcaggatggtcttcctgaagccattgtgctgatcagcggcaatggaaaagcctatctaagtggtattcaaaggattagcatattccaatattagcacattttgactcttcctcagtccattgccacagttcaagggcatgggcacttttccatttccatgtatttttcccctaaattctctctttagttaatgctgaagtttcgagctttcactgataattacagtcagaaatgtggttttgcacaaacttactaagaaaatgtcaagtgtattaagcaataaaagagaattacatttcattggtcaattatttgaatatacataatgtccattgcttttaaaacatcaagttctttttataatgggttttcttgaccaccatacacaatcaattgaaaatggagctcaaattacaaggttactattgtcatcaggttaatttcttatatactactgcaaatgtgcaggaatggagtttaattaattcatattccttaatttgaaggatgtaaatgtaattatgttgatacaatgagactattgttgttcagttgcccagtcgtgtccgactctttgcaaccccttggactgcagtatgtcaggccctctgtccctcaccatcttccggagtttgcccaagtttatattcattgaatcggtgacactgaaaggttgtttttgaatcacgcgaagacaccaggattcttggcccccggaggagaagaattcaatctggggccagagacgaggcttgatcgctcagagcttttgtgtaataaagttttattaaagtataaaggagatagagaaagcttctgacataggcatcagagggggcagaaagagtacccgcttgctagtgttaacaatgaagttatataatccaaagaatgtctggaggttgtaaagacctcatcagacctactccca

SEQ ID NO: 37616 - DNA, 1613 bp, Bovine  19866880789406
cagcataaactggtaacctcctttgccactacatagcatgtatttacaaattttataaacacttgtcatattataacataattatttccaagcttcttccacaataacgtaaattgcttacaaatagtaatgtgtccaaactcacttttccatccctttcatctataatacaattggttttcaatatgcatttgttgactaaacaagagaatattttatgaatagaacaaaattccatttttcattaggccatacaaatattggtctcttgttatttcagagaggaccatcctcagctttatacaaaaaggaaataatatcgcttaatattatgattaaatgcctggttcatcacaatggtctgtagccaatgggacaagccatgaaatggaacattgttgctgagggtggtacagaaaccaagagaagctccacactgatagaccatatacaacatccaaacacacaccaaggtaatgcactgaccaacattcctcatatggaaagtgtgatgccaactgatgatatttaacaatacctgcatctttaagctctgttaaaatcttctcaccactgcactgaagtttaaagatatgggtcttgatttctaatttagacaagggcttggtcctatagaggatgaaatattggtcaaaagtcaagacaaattttgtcactaggaaaaacacagccctctgaaagctggagacaacatgaaaaggagatctgctacataaatcacaagtccaatatagttttaaatacagaagattgacttggggtatggataacttaaatttaagtcttaggtggctttcctgtttactatcaaaattcaggattctttccagagacaaaactggtctgaacctgctaatgggagcaaagtatctctatcagtgaaaaacgtttgccaagataaggaattaggcagaatctaacaaaaagcttgcaactatggttccctatgagcatatccagtccttcatggataggcagcccctttcatggcttcgtgaagtgaacttaaacaggtggcaattggacacttttagcctcaaaaaggttctgattcactgacccatattacaatctgcagtctgggatgacctcagatctgttatccaatcctatttgaagtttacttacttggaattactgttcctaaatacctaactgctcaaatttcagactgggtgtatttaactttgctttgtaaacatgaacatttacctcgtggatcatacgtgtgtttggactcaagctgagtaagcccctcgactagatgaaacccacatccttagagcaatcagcaaaatcccttttgcttctaactgttctatccttgaagaaatgagatgaaatgactccacatttttcttactaagaggcccttagtaggattgtgcaactgcaggatgaagggtcagacccagattaaacacgactttttagttcacaccctaaacgcttggatcactgtccaaacagtatgtgtggccctctgctatttgtatttctacactaagatgcatttcttctctcaaaattataaataatatttattccaggtgtcaaagcacgggaagcaacttcatgggttctgggttctg

SEQ ID NO: 37617 - DNA, 1774 bp, Bovine  19866880963570
gccattgtcaccttataaatcaaatcctttatagcattattttatagccaaaattttcagtttggcttcttatttttacttcttatttgatgtgttcacttaatttttcctttctggccatttttgacatctacatattcactgatttaagggaaaaggatttgccacaggatcagcatcctaagtagtaggttcattaatttataggatacatgaagcatctatggagaataggattgagccacagtggaggaagggcttatgggctgaattttacccccctgccctcccgcccctgctatttcatatgttgaaatagaaggtatttggagataggatatttaaagaggtaattaatgttcaataaagtcattgcaatgggagaaaaggggaaattaagacatagggggaagaccatgcaaagacacagggagaagatagccatctataagccaaagagaacttctgtttaagccaccttatctgtggtgctttgttagggagatcctacaagtagaattactctttcttagaaaggtagtttgcagttcaaataaactgatgtaatcacacacaataagaacacagttggcaaacttaggtgtaaaatagaaaacaaaacaagagacctccaggaaaaggagtatttagtcaggcagatgtctttatacatgaaatcttgtaaatgggattcagtattatccttcaacctgacattgtttctgctcttccatttactaggcttaaaaaaaacaaaaatgttaagcctcatcaataacagtctcggggaaatagtactattcttgttgacaccaagaacacaggagagccaagcaataatgctgttaaggatcactcagtctcttggttcacacctcatctccagtcataaatctgcattcactaaacatggagcctttgctgcctgcacagcagactatcaatgaagcactatataatattaatcatgtactaattagaaattaagttaggctgataggacttaatttttatagttccttaggtacatgttacatatcctccaaatttatcaggatctcattttctctttagattcaaataacagcaaagggcaataacaaaataaaaatagccttctctcccgagactactgaagacagtgattaaaagttaccagacatcgataggctttgtaaccatgacatcatttatatgtatcatctaaattatgtggttattaatttttaaccaccaagcatatagtctccagtatcacatgaaatgtatacttttatttatttatttattttttgtgtggtaagaatacttaacaggaggtctgccttcttaacaaactagatgcagaacatagtattgtaaataataaacttggggttgtgcagtagatccctagaatttattcatcttgcatgactaaaactttatacttgttaaacagcagctcctcgtttcctttttcccagtccttggcaaccaccattttactctctatctctatgagtctaaatattttatatctcatatacagtatctgttcttctgtgattggcttatttcacttagcataatgtcctcaagattcatccacattgttgcatgtggcaggatcacattttctttatgttttcatgtattaatgagtatcagacttttatactgcttccatattgtggctattgtgacttactgatttctcaaaaattaagacttagcactttgtaatggtttcaatcagttttgagagagcaataattttgcttaaaatattaaa

SEQ ID NO: 37618 - DNA, 1910 bp, Bovine  19866881239668
aatgacacatgttcttaaaacaaatataattatgattagaaatattagtttctatttagatgataagaaaaatatcttaaaatatagttactaatatctttctaccaatattaaaaattttaattattaagaaaattttaagcataatgattattaaaacatctttctgaaaaatgttattaactggtaattaataggacacatcatagaatgtactatcttttatattttttacatataaggctcatttacaattttctgtcttaaatttgttaatacattgatatttaataatatcaaggataatttgatctgctgatataatcagtactgctgatataaaacaaccaggagttcatattttaggaaacagaaaatagtcaactaaatgaaatccccctaactaaatgcttaatgtatatttttttggtttccccagaaaatgttgatgtgcaaagttttaattatattatatattcaaaaatgttcatattttgaggacccacacagaaaaaaataatacagttgatttaattattaattataccctactactactaggatcaactccaagcagttaaaaaggcttaattaaataatttcattctattgcagtaaactcataaatatcttcattgtttccaaaggatacagtaaaaaatgattatagaaaatagatttttagcattttaagatgcagtaaataattggaaaagttataaagacagtattacaactgtttcactgtaacattccaaccatattaattttaacactttcaggaacacaaattaatattagattttgttttaaatggtaatcttataccctctgacatccatcctttgctatttcagagcagaaccagaatttttctggacatatcatttttgaggcttaattaaatatcatatatagttttatcccttccttagacttgatgtttttgtttaagtaattaagttagattttttttttttacttttttatgtattcttattgtcttttttgaaacgttattgtctcattttacactttatgagaatcacaggactattatagctaattctgcttaagagaatactatacaactcttcaattcacaatgtagagaatgaaatcatgaaagatgaacagaataaccaaaattatcttaaattgtttcataacattttaaaatataattataggcagttatcctagagttgttctcaagcagaatatttgtgttgtggctttttaaatagtaaacatactttagctctttactgaacatgtattggaaaatctgaataatttcagggagatcgataaaacacacacatacacacaaatcaaatttaccttgacacatctatgctgtgaggtgacagtcagatgaggtttctaaacttgagagactacttccaacgtcctggagtaattacaaactagtcttcctatgctacacctgaaattttagtcacatgtatttctcttacttttatgtcaaccatttgccttagacacctgtatttgccaccacactgacttgatgaagcagagaaaacacactttcaaaatgcaatccccaaaagtgattattggtaccaacttgttaaagctaccaatacaactatttaaaaaatctttctgtcatgttttatctttaagattgaaaaatataatctttatataggatctttagaagaatcagccaccttaaagtcaggggagtttgtagtacttaggcagggccaatcgcctcctttgtcagtggttaactattgaaatggttttctactggttggtgacaataagcacttgcctccagtccctgagcattacttgtgttatatgcttattgtaactccttcttagagattctgaggacctcatcatgatgcataatcttccggcataccagagga

SEQ ID NO: 37619 - DNA, 1316 bp, Bovine  19866881259048
ctccaggactgggttgataagtgctcatttcttccacagtaagcagatgagcagacatgtaggaggtctaaacagctgtcataaatgtggtccctcagggcctgattacagaagctggatggacttgcctactgcatgcaggtccaactcctgcttggcttccctcattgaaatcactatcttttatgctggcatccacatttgacatcatttatctacatgaacaggtgctcccataaaatgaactgcagaaaaagcaaatgctatggcagggctcagtgatttccgacttgatgtttctgtagagggtatgttaggagataggcaaggtttctctacagtctcaagaagctgaacagagaaaacacagagaacaatgttttccactgcagaatagctttttaaaaatctagaaggttttattttatatcacttatttaaaaacataccaattcccccaaattcctttaacatcctatatttcatggtgtctgaatttgtgtcagcatgatatttattatagcattaaaacaaaataacaattggtggactgtatttcaataagattatggtgtggcaaagaggatgaaggcgagagtggagcagggataaaatgagattttttcccaatgaaaagcaacatatttaattcagatcaaatgtttttggagctcacactattgccaaagtactggggtgactactgaagacaaaaatctttggaaaagtccaggaaattgggacataagtttaaaaaagaattgtagaatttccctaataatacagaatggcaataatttaaatatctgaccatcaggacttcagactagtccaactctcacttggttttcaatctaggaagacttctatattttaatttttacacaggtgaaatcactttaaactttttgttcaaaacttcatgaatttgaggactgaataacctgtgtagaggtgaagacttgtccaatccaaggcaaatcctgttcatctcatcaacttaaaagcccatatcacatcaaactcttacgaaaataagacaatgccatactttaggggtaagggcacttagaaaatcagtgtgataattttgtatcagcacatcctcactgtcagttatcacaaaattgaaatatcatctctcagcagggggaaaataaaaaagaattaacagattctttacaaacaaatcccacatttaaaatttatagtttttagattaaagaaaataaaaatcataaaatgaaacttttaaaaattgggaaaaaatatatatctctatattatccagataaatagtcatcatgtaagtaaat

SEQ ID NO: 37620 - DNA, 2430 bp, Bovine  19866880071524
ttttgaatatgctatctaggttggtcataactttccctccaaggagtaagcgtcttttaatttcatggctgcagtcaccatctgcagtgattttcgagcccagaaaaataaagtctgacactgtttccactgtttccccatctatttcccatgaagtgatgggactggatgccatgatcttcattttctgaatgttgagctttaagccaactttttcactctccactttcactttcatcaagaggcttttgagttcctcttcactttctgccaaaagggtggtgtcatctgcatatctgaggttattgagatttctcccggcaatcttgattccagctgtgtttcttccaggccagcgtttctcatgatgtactctgaaaagaagttaaataagcagggtgacaatatacagccttgacgaactccttttcctatttggaactagtctgttgtttcatgtccagttctaactgttgcttcctgacctgcatacagatttctcaagaggcaggtcaggtggtctggtgttcccatctctttcagaattttccacggtttattgtgatccacacggtcaaaggctttggcatagtcaataaagcagaaatagatgtttttctggaactctcttgctttgtccataatccagcggatgttggcaataaatgctttggaggaaaagcaggctatgaggaataaagagtgatggagtattctatatcagatggagtggccaagaaaggcctttctgaaaggaagatgactgaatagagacttgaaagaagtcaggcagcacacctcacggatatctgggggatgagcaataaagacagagggaatatttagtgcaaatgctaaaactcaagaggcgtggcttcaaggccagctggaacagaatgagggagggatggaaagagaggagatgaagttagaagaagataggggcaggaacagaccacatagggcttcataggccctggaagaaactttgggcactggagggttttgaggacagaagtgacatatatttttgatagatcagtctgactgtgtggagaatttgaaacagagagacctgtaagttaatgcaatgatctgggtagcagatgatggtagcttagaccagggcatgagagataagagtggtcagatattacatatatatattaaaagtacagctaccatgggagttccttgggggcctagtggttaggattcaggtctttcactgccatggccctgggttcaatccctggtctggtaaccgagattccacaagccgtatggcacggccaaaaaaaaaaaaaaagtacatacagccactaggatattggatgtggaacttgattagaagacaggcattaagtatgactgtaaggcttttggtgttattgctctatagcaagtatagttcatgtacttgtcctgccctccattgctattatactagagtcgttctgtgtattgactcatctaatagccatgatgccagagttaaatgccattcaagacactgtgcctttaagcacagactctccaagaagctgaccccacacagaaatgcagggatgactcagaacaccatgaccatcactttgaagttgtctgtaacagatctaattacaccttttttttgcttgcaacatttccttgaagaagttgactcaggaaacagggagaatctagaagccggttttaccatcgtgggctaaggggcaaatcaaccacagtaatttatgttgtttctcccaaagaacttggtgggctttcttgtgtgtatctggggtcttccctacattcccaaagtaactgaagagggagacagatattattggtgtcatttaacaagtacagtctcaaaaggatttatggaggttgttatgagtcatatattttaagccttgaagaactggcaagataagactgtagttaacttggatgattccaggaaagatgaaggcatacttttaattcccaggtgagttccttaccacctaacaccggcctagccagctgcttctttcctctcgtttcaatttttttgttttgctttgtttggccacacagtaaggtttgcaggaccttagttccccaaccagggatcatacctgtgcgtcccacctcaacagtggaagcacggagtcctaaccactggactgccagggatttccccttatttcgtatccccatggattttgtggcaataatagtttttttcaacttgtggcaataatagatttttttttaacttgagcataatagatgataattgccctgaagacagcactgacctttaaagttcagcaatctctagactttcaaactttttaaggactcgctataaatttagtctccagaaaaacacctaaatactactgaatcatttaagttttttgactttcaaatattaactgaccatctaataaaatg

SEQ ID NO: 37621 - DNA, 2110 bp, Bovine  19866880351071
catacccgctactcttaacatctcctgcattggcaggcaggttctttaccactagtgacacctgggaagccctaaaacagttcaaattttgctgtttgaggagatcgtgctttgcgaaagatccctagtattcttacttgctgcaagtaatagtaaattcttctgttgcccagtctttggcttggttttgtcttttggctcaatagccacaaagagacatagttttcagttaatgttatgacttgtaacaatttatttgtgtgtatgtctgctttcccactggaatgaaagccttgtgtgggcaggaatcacataacaccaagcatagtgctttcttataagcatccaattaatattttcttataatttatttacttatttatttttggttgcactgagccttttttgctacatgtgggctttctctagctgcagtgagcaggggtggggaggacgggctactcttcgttgtggtgcaccggcttctcattatgatggtttcttctgtgctctagagcatggcctcaacagctgtgatgcatgggctttggttgctctatggcatgtggaatcttcccagaccagggatcaaacccaggttccccgcattggcatgcagattcttatccaccataccaccagggaaatcctcaattagtattgagggcagttgggcaaaagttttttaagaaacaaaagtaattactgtgatctaattaatatgagaaacaatgtatgttgcaggaatataattataatataaataggactatgtttccacagtgctgtcatcctagaaccaaaggggacagtctgcggttgaagtgagttgatttatatacctagtgcttaacagccagagcagctcaatcaacttgcttttcctctctctttccctcaggccttccctccagctaatgatagttttgacttccacactgtaagaaaatctggtacctggaaaaggcagaggttacttcagttcaaccagcaagccaactgcagcactgagaatagatttgccctctctgccgcgctggcatgggtcctctgcacaagctctagccttggggatgtggagatggttcccatatcaggatgcggatgacacacaccaaaggagagactgcttgtcaagttaatttctctccctcacgtttggagaatggaagggagcttctccatctgagatcttagggccccagtatatgcctgtgttatatcccatactctttttaagggcttgtgagtatgtcacagtctcagccttatacttaagcacaagcatctttgtgttgaggggggaactcggaggtataagctatttaatatgctgggagcaatttgcagggatgcagcttagccacgaaatctgcttaaggatgctgaacatcaaagtctggatgattgtctgtttccaagctgctttccaggctggctaaatagtccattttacctctggcctgacctccaagagtagctggagtttggggtccaatctgcacagttacagccagctaaaccagggtttccgaatctcagcactactgacattttgggctagataattcctcgttataggagctgggatgtgcatggtaggatatttagcagcatccatggcctctatgcactagagactcccagcatcactcctctgccagccagctatggcaaataaaaatgcccctaggtattgccaatgtcccctgaggaggaaaatcaccccccaagtgagaacctctgacatagaccctgagcttcatgctcactgtcctccaggccagacacagataatcccaaactcctctcctctccaggatccccaaccaagtgatgtcttctttcaatgagcctaggttttgactatttcttccttatttgcctgacaagtgctggtctcttgaatgctcccactcctcgatcaatcatttcccttcgaccttgggatgacctcactgttttcctgtttcagcccatgaatttctggatcaacaaaaataatgtactccccccaaatttgcaacatttattcaataaattttcaatattatatattctgcattgatgacattaacatatgctaggattttaaggtttaacagttaaa

SEQ ID NO: 37622 - DNA, 2046 bp, Bovine  19866880357883
agctttaagccaactttttccactctcttctttcactttcatcaagaggctatttaattcttcttcactttctgccataagggttgtgtcatctgcatatctgaggttattgatatttctcccagcaatcttgattccagcttgtgcttcatccagcccagcatttctcatgatgtactctgcatataagttaaataagcagggtgacaatatacagccttgatgtactccttttcctgtttggaaccagtctgttgttccatgtccagttctaactgttgcttcctgacctgcatacaggtttctcaagaggcaggtcaggtggtctggtattcccatctctttcagaattttccacagtttgttgtgatcctcacagtcaaaggctttggcatagtcaataaagcagaaatagatgtttttctggaactctcttgctttttcagtgatccagcggactcccaaaagaattttgaaaaattcttctatcttttcctcatttttatatcaacatccaaatctttttctcataaaatcaagcaattgtaaaggaagttatttccagcattatgttgtaaatattggcatttgaaagtaaaatagttacacaactttaagtttgtccagttgaatttaaataccatctctatttaatacaattgaaagagtatcattcatttgatgaataaatgaaacactgtttctttagctatcagaaatgtaacactgttcccttttcttcttgaactttaataattgcattcccttataacattttttcctgttacatacttttacacattttaatctgtttttcaaccgaccatacttctctgcaatagacattttaatgccttttactttcattgaaaactttaatttttgaatatgtatacacactcttgcctttctaccttgtccatacccacatagaatttttattgcattcttccagtgtcagtgttcctttacagagatcaaaatcaaatgtatttttaaacttcaatataatttcatccccttttcttacataaagatggattacttaattatattttttaaaaactgcagcgtgacaatctactaattagtattaatgaaaatacactgattaaaccaatatcaaatcatactcttgataagaagtttttcttcccctttcctcttgataatggggttggatcacagaactcgacttacattcttcaaggattttttggaaacctaggtgcttttagttctttgaactcagcaccagtgagagcagaggttgcaaattgcagccctgggcagatgtgttttgtttgacagatccaacatgaacagaataagacactttacataaatgtccagattttttacttttctaaaaaatcagatgatcaactagccaagtctttcattcactcagcaacaatgagctggcactgagtacctcctccttctttgagggggccaaggctctgcagtttgccacaggtccctcactccttaattctcctgccctagccccccacatttatttatttttccagtctggtccttgtaggcatttgacattatgacctctgagttaacctcacagtgatttgggcaagtagacccaatcaggagcttctttgaagcttcaaaatgggaagcaggaaagggaactagtaaagagtacagaagggaggagattaggctctgaatgaatactgcagttaaaaaagaacccacgttttaccagaacttccctagagaaaagaatagacaaattatctatttacactgtttaacctgtatccactagatggcttagggtattggttagccaaggtggagactaaatttgtactccagaaaaaatgagtctgttgtgttttaggcatgagatcatagactaaaaggagagatagggctctcttttatcttctatgaaaaggcaaattggatattgaagcaaaaaaaaaaaaaaaatacaatggttctctgattttccactaacaccaccacctaatactatgaaccttttatgtccaaaatgttataaaatgatgttaagag

SEQ ID NO: 37623 - DNA, 2186 bp, Bovine  19866880561561
ttgcgacgcgggtgcgcagagaagaatcaggtatccgagcaagacatactggaccatggacacctaacaacgtctcggaaaagcacttgccattctgctcaccagaaacctggcctacggaaagtccagccggattcgtgcgcgacggctgggaaacgcacgatgtccgggagtccgaagaaaacccaccttttagagcacgcggggagagcgcaggctgctctggcagcagcaggagagccggggtccgggctcgcgggcctgggagggagttagtgcccgctactccgctctcattaacccccacaatcagttcacctaatcccggggtcgaaacctgagcccggcggggaggcggggcagcgcctatggttcttgcccctggctcgctacgggggcggggctaggagggctaggaggtccggggaaaacgaatgtgcctttctctctcggtgaaggcgatgggggccgggttcacgtgcgagctgtaggctcttcgggcatggcagctctcggttgtcttggttagttcagacacaagggcgctggggatccccggggcgggacaagggtcatccttgggctttgcccggttttttctgccagcctaggggtcatgcggctcccagggtctaaagtcagccggtgggcgctccggagtcaagacggattctcgctccacgcccccaccatgtccccttccccggaagaaggacaggataggcttgagagaaaaagaccgctgggacgtgtagctgagtcccaagggatgtttcccgtgtcctaaacgccagaaggcccctaggggtgagggtgccacccgcccgtgtccgggccagcccctacgatcggggatttaggaggcttcggggtgctcggctgccctagggcgaacgactgtctgttcagttttctctgagccccggcatgagccgctccgtcggctgtctacttaagacaccacaaagccaaaaatcaatttcttaaacggctatgaaactcggaggaaaaggaaaacgagggtgaaaatgtcccgaggggccctgctgcggctcggtgcggagcgggacgggggtggggcggagatccagggatgagctgtccgcaccgccgccgagtctggactggctggaacagcgcgggatcaggcaggcacgcaagcaacctcccgactcgggccacagccgcacgcctctctttcagcctggcaggctccgtccgttcccgggagggtggagtgggtagagcggtagtaggaccaagggctgatcgcgtgggaaggcgacctctcgcagcagctggcggccgaggggtggggcggtcccctcggcgcacgcgggccggccgagactcttcgcagccagggcctgggatggcgggagctggagagctcagctgccgccgtctccccaccagatgtttcctttcctgtggatcccgctccctcgcagaaccaaactgcctggcgtgggtcctctgagccagatccccagcgcctccgtatgggtcgcgcggggaccaagaggatacagctcttttggctcccaagctgcggccgacctcgtgtgggaacccggtagagccctccggtcttccccgcagcggcagcgccgtgccagttcccgcgtccgcccccgccagggagagaggcgcagcggacctacctgaggggtcagggcgcgggcacagcgctccgagagttttcaaactgagttgctttcgggagagaccgcgctgtctctctttctctctttttttaaatctccttccgagctcagcccccaaaaccacaagcttcacttcctgagcgttaaggagtagctcgcttagccttgtcagacctgcccccctcccctcctccaagccccagtcgggcggcagggcgcgctcctcctttgcgcaagggtgtataggaggtggacaaggggcccggccttcctagcgccctcccccgcggctctctccgtgttttttttttttttttcctctgtgggaaggcaggagatggggagacccagagggcccaaacacccgggcactagaaatgactcgaaagaaaaagaactattcttggctcctgggagacttccgcagcgagaagaagtcacagattcaggacacagattgactggagcgccggggctggtagcgtccagctccgagggaggcttccccgcccatctggg

SEQ ID NO: 37624 - DNA, 968 bp, Bovine  19866880611866
aaaagtgctgaacattttaagaggaaatttgccaaatcaaccaagtttctgggtcagcttccagttcttgcaggtgtgccctgaaattgcaaaggcaaacttacttaaagccctgaaagagactttgattgagtggaagacagaagaaactttgaggtttttgtatggccagaattatgcatctgtatgtctgaaatcctcctcaacccctctggttaaagaagaagaacttgatgaagatgatatgaactctgatccagatagtcattcccctgccctgcaggagttgaacagcttggatgagtctttaccatttagagcctcagatacagccattaaaccactgccaagttatgagaacttgaaaaaagaaactgaaacattaaatttaaggatcagggagttttatagaggacgatatgttttgaatgaagaaaccaccaaatcacaagactcagaagaggtatgtcttaatgacaatttttttttttaatattgatttatttggctgcaccaggtcttagctgcggcatgtaggatcttcagtctttgttgtggtgtgcggggatctttttttattagttggcggcatgcaaactcatagttgcagcatatgggatctaggtccctcacaagggatcaaacccagcccctctgaattggaagtgtggagtcccagccactggaccacaagggaagtcctttaatgattttgatttttccatactgctaatacatgagcaatcaccatagtaaatcttggagcaggaagaaaagtactgaaagaatttaagaaagaagagtcccttaatcatttggtttaaaatgccatctccagtattgacattgaaagtgaaagtcgctcagtcgtgtctgactctttgtgaccccatgactatacagtccatggaatttttcaggccagaatactggagtgggtagcctttcccttttccaggggatcttcc

SEQ ID NO: 37625 - DNA, 893 bp, Bovine  19866880748970
acttttcacttgcataggctttgaagtgaaagtgctcagttgtgtccgactctttgcgaccccgtggactgtagcccaccaggctcttccatccatgggattctccgggcaagaatactagagtgggttgccatttccttctccaggggatctttccaacccaggaatcgaacccaagtctcccacattgcaggcagacgctttaacctctgagccaccagggaagccctgcataggctttgaaaggggtgctaaagctctagagttcctgctgcagggagttaatcttccagaaaaggccagcaaaggctctgagaagcttcactcagcccagctttcctcagatctccctcaggcagctgtgactccttagttacctcttggcttctccccagtccagattagccctggttgcgttgtcatttcactgtcattctgagcacatctatggggcagagtcacctctggaggctcaggagtctggggccccagcccgttgatagctgagttttagaaataccttgagatttggagggcaccagggaacagggtcaagggtactaaggagctgctggagtaaggagctgtgttcaggggcaaagctgattcacagggaaagctaatccttcagtctacagtgtttactgatcctactattgtttggtctttgagggcaggcatgctaggcctgagagaggcactgatagtaataacaacagctactttttatccagaccatccatatgtcagaggccatacatataccctgtcatttaatcttccagtaactctgtgagagagctagtaatagttgcattttatggattagatagtttaaaaaaaggaaaaacaccctgaagctcagagaagttgcccataaccatgagagagaa

SEQ ID NO: 37626 - DNA, 1601 bp, Bovine  19866880874849
cttatcaacccactccagtattcttgcctggagaatccggggacagaggagcctggtgggctggggtctatggggtcgcacagagtcagacatgactgaaggtgacttagcagcagcagcagcgcttttcatatcctttcccagagtttcaagactcttgcaaaggaaatctatctggatgccgatacagaaaagaggtagagttgcttgacttctgaaggtggactctctcccctaccatgtggccatattgaatacagttttaaaattcagttttaatttttcccccgaaagatggataatatgttaataggataatgggagaaagaaaataaagaggtaagaatgtgggagggagggagttaacaaatcactggctatgctttccatataaaaaaatggagataggtagtataatagaagatattagtatactgtttctctgaaatgtcttacaaattatgatatgaaattttattgttgtttgtatgccaactcgaataacattatagttaagtgaacactgtcttggctgtatgactctagcaggtcagggctcggatgggtatccatccagggacctggcttttcctgcccatctaaataataaaagttttcactgctacagcacttcaatttatgctgtcttacttttgtgataggctctgtgagcttggttgagtcaagggtcacccagaaaataaccagcttccactttctttaattatgcaaactagagctaggcgactgagatcttgcctttggtctgcaagacacagggagttttgcaagccctaggggagtgcagaatttcctgaagatgttgcaaggtggctgactttcttctgaagtcatgcaatattctcctttgctttagttatgagtgcagaggtgctgggaagcaaactgaaaactagcaccttgaccaggcttttctccataggtccaccagaggcgaggcaggctcactgagagcgaagagcttggtgcccctgctttcagctaaggtactgtgacccagttccacctcagaggcccccaggagcctgtttaaacctcattcagccctttctaggcacatttcagatgaaagtcacccctgctcctcactccaccttcagcccaacagaggtggccttctagacatccttcctcctttttttctgccaggcttataatgtgaaactcttgaagattttcaaacttctaagtggtatcactttccttgagtttaggtaaatctttatagagaatggatcctgttccctaatgagtaggaagattacctagtatttggacatgaccataagcagaagatgctaaataataccttatagagattccactaaaatattaagcctagtgaggattttaagtgtttgagtatacgaagggaagggaattattcaaatggaaagatttttttttttaaagtcaccattgcctgaatataacagcatatgggctagttgctgaagtacttaaatagaaagtgaaactgaatcatactgtttacttttcagagtaaaagctattgagaataaaaattttcccgaaagagcaacagggattttgtaaaatattcctttctgttctttaaa

SEQ ID NO: 37627 - DNA, 1494 bp, Bovine  19866880881770
tcccgtcgcctgggatccagcagccgacccccgcgagcaggctgacgctggcctagagaagccaatgcctccactcgggaagcaagaacaaatccctcttctcgaaaagattctccgcaatcgatttggcacttctgtgcccaaagccgcgcgggttcattgctcagcgcggggtccctgtccccgcctccctccccgggccccagagcccccaacaggtccctacctggagacacagaaggcgacggaggcctccaaaagtcttcaaactccgagctccgatcgcacacgctgccctcacagctgccaggggacgcggaggctctgtcgggggcttcggtcagctgagactcgggggacatacggcccctgagctccgccttcgccccgcctgtgctcgagatgccgtctgcggagaagaggccggataggggctcaggttgggtctggttgggcccgatggttctgaagtgcgtccccccagatggtggcacctgggctctcttagctctccccagacctggcctgaaccctcctggatccaagggcgagagcagggaggccttggcaatctaggcgacgagcccgaaaggaacccaaacagtgggtaacaagaaaaggcagcaaagggggttcagaactcttcccccggttcctaggagatggcgtggcgggacgcagagtctacggccccgggagcagtccctcccggcccgcgccctccccgcacctgctccgcctggcgccagtacattctccaggcggagggaatagtcaggtcccggggagcgcggctggtggtaactgtgagcttttttgctcttaaccaggaacgaacgcggcattggtggtcgggcgcgctccccgctcctctccaagggtcgctggagccgccgtcagcccaccttcacccgagttcgtcagccccagccaggcggagacctgcgagaggagaacagggtggaaacgcgcgggtcagcacgctccggggccccgggactgggcagcggagcagagagagcgttcgggcagggaggagggaaggaaggcccccgggaggaggggcttggccccgctgcgccacgctcaccaggtggcactcggacaggtggcgcgagcccgccgctgctgccgccgtagctcaacccgtctccgggctccgactcaggcctcttccttctgccctgcccacgcccctcggcccctccccttccctagcaaaactcattgtggtatcaaactcttggagagctgaagtccccagcgggccagttaccccaactcgaccacacactgcctatacggatctgcgaaaggcgtagacgcgccaatcaatttagtggggctgggaggggaatgtgtagacggtagcgaactcgcttggggcaaagagccaagcctccaagagcaggctcacagactgcagtgaaaagaggtctggggagaaagggctcctgcggctagaggcggggtcgggggaactcagcagaagga

SEQ ID NO: 37628 - DNA, 2017 bp, Bovine  19866880947328
caggtctcccacattgtaggcagatgcttttaccgtctgagccaccagggagagaccggaggtgctgctaaacatgccacagcggtggagcagattcccacccacccgactacaaagcatgatccaaattatacaatttgtaaatagtaccgaggttgagaaactctgctctggggcatatacttagaagtgggatttataaagccctagaatgcttccctggtggctcaggtggtaaaggatctgcctgcaaagtttgagacccaggttcgatccctgggttgggaagatcccctggagaaggaaatgacaacccactctagtgttcttgcctggagaatcccatggacaagggagcctggtgggctgtggtccatggggtcacaaaagaagttagacacaactgaatgactaacactttgactttcaagatgtgtagtttttttgttattatattaatggatttctataaaacatgaagaagatattatttccaattcaagtaaaggttttatttggaatacctggaattaaaatgaaggtttctttggtgatgctggtaatccagcagttataagcaatttaattgtcttaaaccagatgaaatagcagcattatccagagttcacttaatttgtttacttgcccagagggggcacataattttttaactttgtgaactgtacttcctgcctgattacaatgttgattttagagtaagaatctgctgctaattaatctgtgctgaacaatggttgactgaatgagaaaaaaattacagtgtgaaaaatgtagaatttttttttctgacaaagatgtttgttaaatattgaaagcttaaagtttgaaaagtttctctctgtgatttaaattggtttttaaattgaagacagaggaatgaaccttaagaatttcgagactcacttttaagcctgtaagacccatagttctgcatctgaaaatgtgatgggatttatgcctgggaactgtgtgcttttgtgtacgtgccattttgcatatgattttgggtggtttatgtgtgttcccgaagcctgtttgtggaccactcctactccctttgaaacttccaagattttcagattcaggactttggtaaaattcttaaaatgctaataataagatacaggtatttgaaattatcactgagtagtgaagacacagctatatattgttcatgtctgatttgccaaatgcataagactcggtggtagaattaagtccttcaatgttaaatgaatgaatacagatcttattttaacatctataaccttcattttgttgttgttgttctttttactaggcatatgcagcagtgctgtggcaacaagctaatgaaagcagacaaaattcaactgaaaaagcgtgttttggaatctccctaccagaagaaaaacttaatgactttcgtgatgaacagattggacaattgcaggaactgatgcaagaggccactaaacccaacaggcaatttaatatcactgagtctaggaaaccaaagctttagtctatataataaagcttaaaaaagcatttcaagttcagagccctctaattggtttttaaaatttgtttcttaagcatttaggttttgagaatgcctggtgttaatgaaatattcttttatttggggatattttgaatgttgtaatatacaaatcaggatcatgagtggatgaaactacatttattgaagtagtaacagttgctggataggatttgtgttttggactacataagaaagaatggttgtaaactggacaagcttgtgaaattttccccaaaattttatatgtaaatttgttttaatgctgttcatgtttaagcattaatcttgtggctctagatgtatcagataagtatatcataatcatgatagatacagaattccatgttcattatttaattcctatttgcatggaatacctttttctaccctctcactttcagtatccctagattctgaagtgggtctcttataaacagcatttatagggat

SEQ ID NO: 37629 - DNA, 1612 bp, Bovine  19866880976053
ctggcttggcagaggggagctccggcaggcggcccggaagggaagattgcatggagtcggtctcagactactggcctgagtggagacgggctctggcttctcggacccagctccgctcatgactggtgggttttccgagggagcgtcggggtcggcaggttgtttgggaaacctgtgttactggtccgaaaaagtggcttttaagccaaaaccatcagtagaacctggaggctctggtgtctttgggccccgaaagaaagcccatttagtttggtgtacctctcctgcttttttctctaaattgtcgctggtaccagattttagtgaattttcgggtggtgtggtgctgtagtttgtgggggactgttgttttaatcgggagtgattgccgagtatgtgcttggccagttgtgtttcgtgacaagaaatttaggcttttgaaaaaagttcgtggaaagggaaaatataggttcatgaaatgggacagcattaagaacagactgacgtttgcaaaatagttgtcttaagcaaaagttgggacacaaggattgttggtccaagagggaataaaagtggagagtgtttaaaactttaatagtgctcgttttatatctggttactataataaattggcctacattttgtatgtttgctttttcattcctgttttggcgctgattcatttttattttgttgtataaaattgtcagtcttgatagatggaaaatagaagaaaagtgatttgatttctcagatttgacaaagtgatggttttctggattcacttttgaagtttaggttgttactctgtcacaaagttaagttgttactttgtcacaaagttttgtttgtcacaaagttaagttgttactttgttacaaagttaactcaaatgtcaaagacatcaagctaaaacatttatcaaagttttaataatttactcttttatcttaaaggggtttgttaaagttgtcaagaacaaggcctacttcaagagataccaagtgaaattcagaagaaggcgaggtatggtcaggttttcatattctcattaggaaaagattctgctttgtaacggagtggactttcttaatttatttttttctttcagagggcaaaactgactactatgctcggaaacgattggtaatccaagataaaaataagtacaacacacctaaatacagaatgattgttcgtgtaacgaacagagatatcatttgtcaggtaagttgtattttagacttaaataatagttggtaacctccacccccacttcttcaattactgtgctagagacatacttgggaagcagaacaaatgtatgcattaggtctgtctagtttggtgcctggcactccaaaaaacattcattgagtagttgttttagtaggtctgaaggtggagcctggagaattggtactgttaaaaaaaaaatactttgaagctcagctgttcagcaatcctaccccagtttaatccattcagtttaggggggcggattagagaaatttatggttctgtgctgtttttcgggggatgggaggataaatttaagacctagtagaaggttcttgaccattgtaattccagtaggatactagaatttgtt

SEQ ID NO: 37630 - DNA, 1373 bp, Bovine  19866881007070
cttgttgtggaaaccacttcgggataaatacgcccaacaaggctgaaaataccttgacacccaatcccagaggtttgctcatttcccttcggatttaggtaatggttaaatttggaagaggtgggcgagcgccgagcccccgggcctaaagggtgcaggcggcgcgtcctgcgggcgcccgactgggctggcaggcacgccctccccacgccgcgctcctctgagctgggccgggtccgctctgccggcggctaatttccggtggtcggagctgcaaaattaaaggccgcgcgggagggagcgcgcgggggcagcgacggcggctgctcggctgaccccgccctgccgggacaagccaaggagagccgtaccccaggcgcgggctccgtcgccgcctaaggtcaacccaggcacctggactggaggggagcagtaaggcgccataaaagcaccaccctgctgattattgaaaagtcagtcttcgctgcgattgtgtgttccacgagggcaggcagtggatctacagcattatatcctggcgggaatgtctgtggactgactaagcgaaaaaatagtattaattaactaattaattgtagaagacgaaagaattaaaacctcacccataaataaacaaatacaaaaccctccagtgctagactgtatgtgatgatccaaagagtgtggcctgtggtgtgtacttaaagcctaaacctttcctaagggggattgatagccgttataattaccttgatttcctaaataaattgagttaattttggtcactactttctgcacaataaatctccagggaagagagtggtgttcctcagttactgcacaataacttactattttttagattaatccaaagttgtcacggaaaaaagtccttagagaatttttttaagtgatttctaatttgcattgtaaatctaaaggtttgtggaaagtatttggttactattgccatgtttcaagcatgctttaataatttagacgctttatataccagtggctgcacacctactatgtaacaggtgtgagaccatacacacatcttaattgtgtgactagctgtcctccttacactactgttcatttgcttaacacactttctttataaataagtgcagaagcgagcaatcgtaatcagaaggactacaaatattgaattagctgaaaggaaattacggtcattttgaagtttttatttgtgtactttgtccttgcctaagatataaaaatcttaaagcagtcaaaacacatcttttttcccttctattttattcaacagcaaaaaaaaaaaaaaaaaaaaaatttaatgataatgagaccaaagaaaacttactatcaaccaagttctagagaaa

SEQ ID NO: 37631 - DNA, 1306 bp, Bovine  19866881085689
ctttaagaatttgcctatatactccatgtcccccatctgttaatgagattcattcttctcttgattctttcttttcattattgtaattctgagtttctcaggagcgatttttttctcctcaatgctaatagccttttagtaagtagtcatgaaagtgtgaaagaaatttcagcaaaataagaaaaaatagaaaactgctccctcttgcagataatattctacatcatgaaattatccttacaactcttatttctaaaaggaggatcttgaaagacacacagttgccaaagcctgtccctatagcttgtgaatataacaacagcttaaaagtttgtaattttgaataattatctttattaataaactgctgccctaaaaataatttttaaattgttttatgaaggtataactagttacaagttttctttcttaagcatgagtatgagcattggtacttgtatcaaattctacacacaggaaaaagaaatctgtcagaatatcacacctgataaaaattagcaatgcaaaaactcattcgggcaagattcatcactggattttaaaaactattgactataagcttgttgaggaacagagctttcaacatggcctccaagaatcatcccacatactgcttattaattataaaggaaaaattgtgccctgaacatggtgagatctggcagtaaactttaaataagggggaattccctggaagtccagtgggtgggactctgtgctttcattgccaagagccagggtttgatctctgctgggggaactaagatcccattagctgcacagtaatggcaccccactccagtactcttgcctggaagatcccatggacggaggagcctggtgggcagcagtccacggggtcgctaagagtcggacacgactgagcgacttcactttcacttttcactttcatgcattggagaaggaaatggcaacccactccagtgttcttgcctggagaatcccagagacggggcagcctgatgggctgccgtctatggggtcgcacagagttggacatgactgaagcgacttagcagcagcagcagcacagtcaaaaagaaataataataatgaggagaaaacattggatatatagtaattacttagcaaactctgagtaacttaatgtgtgctaagcattttatatcctcattttaattaatcctcaaatccaccctcttctagtgcattgttattcctattttaaagatgaagaagtttgaagttcagagagtttaaataaccaagccaaggttacagtcagttagtaagcacactgaag

SEQ ID NO: 37632 - DNA, 1210 bp, Bovine  19866881811078
ttctcaacccagggattgaaccccggtcttgtgcactgcaggtggattctttaccagctgatccacaggggaagcccaagaatactagggtgggtagcctatcctttctccagaggatcttcccgacccagcaattgaaccagggtctcctgcactgcaggcaaattctttaccaactgagctaacagggaagccctaaagtttttgtggatatgcaataatttctggggaatactatcaacagaacataaaggatactgttttataaacttctgcaaatcataatgtgttatgattacttttgacccagatcttaaattgaaatttacagactaaaaggcatttcaggtgggaagaaaattctagatgttccagccaaaactgtattatgggttggaatagaatgtaataacacatttttaaaaataagacttttaaacataatactttgcccataatgcaaataatataaatcaaatgtatttatattatacagtagttcataattgacaaaacacttattttcaaagttttgaattttctttcaaagatagctttgacaataaggaaatacgatacaggtaacaaaaggaaaaatagataagttggacctcaaaaataaaaacttttgtgtatcagaggacattaacaacaaaacaaaaagatagcccacagaaagagaggaaataccttgaaaaatatttgcatatactgatatggattgaccttgagaatatataagaaacttccataactcagcaacaatccatttaaaaatcaggcaaagtactgaacctaccatttccctaaagaagacataatggcaaataagcacatgaaaagatggtcaacattattaatcactggtggtgggtttagttgctaggtcgtatcccagtcttgcaaccccacagactgtaacccaccaggctattctgtccatgggattttccaggtaagaatactggagtgggttgccatctccttctccagcgcctcttcccgacccagggatcgaacctgggtctcctgcattgcaggcagacgctttaccatctgagccaccagggaaccccatataacctggaggtgtctccagaatgacctttaaagcaagagccacactgacacagaggagacaaatctgacgaggccgctgggtgctttatccgaatgcttctgccggccggttacaggcaaaacccagact

SEQ ID NO: 37633 - DNA, 2476 bp, Bovine  19866880084693
caaaagactgttctatacatcagtgtctcttttgctgtctcgtatacagggttattgttaccatctttctaaatttcatatatatttgttagtatactgtattgatgtttttctttctggcttacttcactctgtataataggctccagtttcatccacctcattagaactgattcaaatgtattctttttaatggctgagtaatactccattgtgtatatgtactatagctttcttatccattcatctgctgatggacatctaggttgctttcatgtcctggctattataaacagtgatgcgatgaacactggggtacacgtgtctctttcaattctgttttcctcagtttgtatgcccagcagtgggattgctgggtcataaggcagttctatttccagttttttaaggaatctccacactgttctccatagtggctgtactagtttgcattcccaccaacagtgtaagagggttcccttttctccacaccctctccagcatttatggcttgtagacttttggatcgcagccattctgactggtgtgaaatggtacctcatagtggttttgatttgcatctctgataatgagtgatgttgagcatcttttcatgtgtttgttagccatctgtatgtcttcttgtaaaagaatgaaactagaacactttctaacaccatacacaaaaataaactcaaaatggattaaagatctaaacgtaagaccagaaactataaaactcctagagaagaacataggcaaaacactctctgacatacatcacagcaggatcctctatgacccacctccaagaatattggaaataaaagcaaaaataaacaaatgggacctaattaaacttaaaagcttctgcacaacaaaggaaactataagcaaggtgaaaagacagccttcagaatgggagaaaataatagcaaatgaagcaactgacaaacaactaatctcaaaaatatacaagcaactcctgcagctcaattccagaaaaataaatgacccaatcaaaaaatgcgccaaagaactaaatagacatttctccaaagaaatttttatttcttaatcaccatgcttttgtcaaaactgggctatcttctccctttcttgcatgattactccagaagctgtaactctgggacagcaaaaaacagggattcatggagtgaaaacaaatgatgacggcttccccttccttttagctaagaacacaattatcagattcttccaccaaacttgtgtttaaaaagctacttcacatacctggctctgactaaactcagaccacacccatcagtcccaggaattgtgattatgtcaggtaggtgcatggaggaaaaagaaatttaacaggctaagcaaagaacagttctcacagtgcatctgaccaaagccagggaacctgtatgtttattaccctttgtgaaggtgagcccaatcctaaattcctccctagctacgtcttgtatgctatgatggatcaggcaactactttgaggtatgaggggtccatctcttcagtgcttctcagtaaataatgctctgttatattttatgtgattccaactcaacttctacaagtataaaagcaatataaccaaaaacatgccttttggcaaagaataaaatataaggagatgcaattccgccagatggcaaaatcccagactaacaatttgtcgacttattgatggacataactaagcccctaacttactaaactataatggaaatatagaagaattctgccattttgtagatttagctgcatcattgaccaaattgcatccccacaacatgacatcagatagagaaattctgaaaaatcacctttacctcaccacattggtctcctgtgcatgctaatggcattcttactgatttctctgctttccatttttttcttctccaattccctgtacatttcaaccatgttatgtttctaaaatatacatgagaggattaccgttaccttttttaaaattttgcaatggctccctccaatggagacagtccaagctccgatgtaaataaagcttttcatggttaagacccaaacctgacccactagctttatgtctattatttcaagcatggccttggccctaggatgacaccatcccgttctttgtttggtccacaaacatggtaaacaacatttctggacaggtcactgagccacagagccatagttctaaccataaaatgtggaaggaagcctaacattgtaaaggggttgttttaaagccattataaggtttcatctctcagtcggtcctccaaaagccccagggaactagaccagagaaccaacctcatgtaggcctcaagctgctgatcatacagtcctacaaatgaccaattctctctccctcattcattcagttctcactgattttccttgaggacatagcctgatgtaagatcttgggaagatcttgggtcttagtctacctgaatctct

SEQ ID NO: 37634 - DNA, 826 bp, Bovine  19866880096784
gatggcatcactgactcgatggacgtgagtctgagtgaactccggggagttggtgatggacagggaaggcctggcgtgctgcgattcatggggttgcaaagagtcggacatgactgagagactgaactgaactgaactgagcagttgtcttcttagagttatgggaattaaggagattcaggaacattaaaccagaggtgccagtgagctccagctgcttttaaattccagatttgtgaatctcagagtctcaggaagctaagaggacacctgaagattcatatatgttctatggacatgagctgtagcaaattagagcacttttttttagtacttagtgttttaattccttatttaatatttggctacagttgtcactgaaataaagttatatatttggggactctgttggatgctggaagatatgctagtttatttttgttcctgtttatttcataaaaccattcatttgtctgttcaggagtttcatgtggaattgcaggtgtgagttgaaagccagatgtaaactaaattataacatatgcagaagggaccccttacggatggtaaatgcatatttttcagctgacctactcctcaaataatagttggggggagtaaaatatttactgtagactatgcaatttccattttattattattttttaaagcttcaaatttgtaattcaacagaattgatgggattgagtagcagagaaagagaaaggggaagaaaaatttgacccagaaacaagttcattgagaagcatgtatgaagcttgtaggaactcaattagatctccttgctggggtaagggcagggaga

SEQ ID NO: 37635 - DNA, 1349 bp, Bovine  19866880376761
tgtacagggtgtgctgcaagatgacattcaccaccttgtgaagtacttcaaccctagaagataccttgcattctataaactggtcacaggcaaacacgtggtgttcgcatttagagatacacacaaaaaagttacataaaaattcagacattctaaggataaatgaactcaaacaaaccccacacctcagcttttggagcatgaaaagataaagaaaataatttaaaaacacacaaaaaatgccattcaattggtacaaaagccaaaagtcactataataaagagctacatgtgaatctttacaagttaattacacaatggtgttttgtaagaggttgcatctgtacaaagtcttgccaatgctgtctctacagtttatacagtcttttacatctatgtaacatttattaaacaagtcaattaaatattaagacttattagtctctcaacgattctgcaggccaaaaaaaaagggtagggggagggagaaaaagattacagaatttccgcaaacacagcagtcttccattagtaaagtataacagttttcaaagagggtcaaacaatatttgtaaagaacacaggtaaaaatcattcagtcagggtttttattgttgttgctgtttattttcaaaatcacacacttgtatacatacataacaatcaatcaaaaatttattcaccaaacccctggtttttcagcaactgctcttctattcagcaccaaaaactccagtctgtgggcgacacgtggacacaggcttcacttctgtgtctgggtcgagcaatccatcaggtccttggctgagttcgagacttgccctcttttctttccctcttcatggctctccaggcccaaggctctcaacgcttcagatttatggctcacagccctaccaccatctaaactcaacagccatttggaaagaattcaaaataatttgagatgaatgaaatgacaggacctgtgttacagatgggcattctccattccaagtaaatggtttcataatgagttcctagactctgtctggtcttgtacgtcatgatcatactgggtaattatttctagtctgaaacattgtggctttgtcagatgcctcaaagaaaaagtgatcaatatactggaaatacttccggacaagttaggaaatcaaatggcagctgagaacctgtggaattcagactaattagaccagacaaagaaaccaccaaaacgatgagaactcaacagtggcagagtttttaaacctgcagaaaaccaccacagatggtacctgaggatctggaatttttgatgaaaagagctcgaagtgaggactactcatctgtatcaaggaaaaaaaagg

SEQ ID NO: 37636 - DNA, 1055 bp, Bovine  19866880388051
ctgttggaataccctgagtggtgaaggaggatcctttgtagatgcatggtaaataagaaggaaactgaggaggttaacaaaagataacatctttgttcttgatgtagaagtggaagtgaagctctgcacctctaacagctacatatcgtaaccccgttcttctgagtgatgaccatagtccatttacatacaacctatgatgctaagtagagttatttctcacttgagaacaagtaggagaaatgaaggcagcctgagcagttcaaacaaaaagtaggtccagcctactctattgttaacatcttttctatcaggactgctcttttgtaccattatgatattactaacttccttatcacatgatctaattttttatactttcctattaggaaagaagatagtaatccttttaaggaaaaatatacttgggcataaggagctgtaaaacaaattactgaacaatagaaggaaatctagataatcctgttaataagaaaagtcatttattattaatattaattagtaaggaaacttctaatgcttagagattaactcagtgagtattctaaagtctgtttcttttgtctgtatagtagtggagatgaaatggaatacagagaaaatgatgtagaaaaaaataataaagtcttcctaaagatgctgttctatactgtcagcttgaaaatgaaacagttttaggtagaatacagactgtcaacatgtaaaggcagaacttcccttatgttcgagtgttaagaccctgtacttccactgaaggggcatgggtttgatccctggctacagaactaaaatcccacatgccacagagtgggggagtgggggacaggcaaaggtggagaggggcactaacccagctctcatttgttttgatttttagtcgactctatgtcctccaaggcggccttgcccagcaagagtggagagtgcctgagttattgcatagactactgaagtatttggagcccaaactcacccaggtttacaaaaatgttagggaaagaatagggaggtgggtattattttccctgtggtat

SEQ ID NO: 37637 - DNA, 3003 bp, Bovine  19866880393826
gaaacaatctgaattctaggggagggtctatctcaaaacacagagactcaacttatggcaacctgttcaaactctcagaggttaggaaaaatagatattcttaaagtattttaaaacaagtagatattttaaaataaatatttaaagacaacaaggggttttaacttaaaaaacctaggggcttccctggtggctcagacagtaaagagtctccagtggaagactcaggttctacccctgggtcaggaagatcccctgaagaagggaatggctacccactccagtattcttgcctggagaattccacagacaaaggagcctagtgggctcacaaagtgtggggtcacaaagagtcggacacaactgagcgactaccactttctttcacctcggagtcacttccttattcaatgggcatttttcattctgcatttcaagatgtgtatccttgttcggagagattcttccatccaggacaagtggaagatcccacaatttgtattaaacatgtgtgtgtgtttgctcagtcacttcagcattaagcatatataaccaaaatgtttaactggatcacccccagagaggtacttttgaaatccacagaaatattaatgaaaaactaggaaggctgtaatggactgccagtttgtaactagtctattttttaatagactgcttttaaaagacagtcttcataaaaatctcagccagtaatttgaaagaaatacaaatatttcttcatttgcggccaaggataagattagaactaagtatatagataactgctctgtctctgtaactagaaataacagtggagggaaggcagagatggcagaagataataaacagattgtactgacttaccatcctgaagcaaacacctgtatgaaagaaagatgaaaaaaagaaaaagaaagaaagatgagaagaaatgttagtttgtctacctttaaaaaatttatatatttcctgacttagctttctagtttattaaacagtaagtaaatgaaataaacaaaacctttaatatctgaatgccttcagaaagtgctttttaaaaaaattctttccttttaaaacaaaaagagaaaaggaagactattttggagaaaaagaacaatgttctgaaaccaaagcacaatgaaatgccaaactgcatatcattctattaaagtgctaaataaaaccaaataattactacaagaagagttgagtatgccggcataaagtttacccaccctcagcttttagaatgatctccttaaatgcaaggactaaattccagtttacatataataaaacatttctattttaattccacattctggaaaagacaaaactacagagacaagacactgatctgtgattgccaagggccaggagtgaggagaagaggggtgccagaaaggagcacgagggaactttcgggggtgattggactgttttatatctcagctgcgctgatggtgcttacatgacttattcatctatgaaaattcattcaactgtatactaaaaagggtaaatcttactgaatgtaaattatacctcaattattaaaaattaggaaaattattggcaaatcacaggggatagatcaaatccatttcagagaggtccattgcttttccaaacagcaattgagcctggttaaaatgatacagaagatgagctcagtggcttagataattgtatatagttttgtaagcggatttataacaaggagtattatttgtttcctgaggggagtgtactgtggtaccagatgaatatgaaagaaaagagtagtggtgcaataaagactgagtagtatcataaatgaaatgtttatggggctataaaaaagattttaaaagaaacctataaaatgtggaggaatgatgagtgaagaatactgatttgaaggagaatcagaaaggcaatctattatatagatggagggaaagacacaagttagtagatatattttaaaagaatgggtaaaaaactcaagagaaacttctggtcaaccagaccatgtaaaatagagaaacaaaacaggcagaactgtggagaagcatgcagtcattgcatcctaagagagaggggatcccagaagatgctgactgagcagagttgaaggtttgggtccaggcatattgtgcgtatcccttctgagtttctcaacagtgaacagtcccaaataacgttagcgctaagaaaagaaagcacatgcaactaaagtaaacagaatctggaaacacagcccagctctttcctactcaaagagtggtccaggaaccagaggccatagcatccatcacctgagaggacttttagaaaaatcactttctcaggcttctccccagaactaaagaaacagaaactctgcaggttgcatccaggaatccagtttcaacatgctctccaggtaattcctctgcccgatacagtttagaggttgctgctgctgctgctaagtcacttcagtcgtgtccaactctgtgcgaccccaaagacagcagcccaccaggctcccccgtctctgggattctccaggcaagaacactggagtgggttgccatttccttctccaatgcatgaaagtgtaaagaggttagctccgccttaaaggaaggtctgggaaaggcttgaaaaggatttatattgctggtaaggaattgtatcacaaaggggaaaacttcaaccttgcagagtactgcggatctgatgcgttccccactaatgttgttcaaattcgtgttataaatcatatacctgcatatcaacattgcttcagctacttcacaatgcaacactacatagaagaaactacagacaaagaaaaggcaagaaatccctgtgctgtactctaactggacatggtgttggagcagagcaggcataatctatcactcaggttgctcgctccacccttaacctcctactgccagaaacacaggagctgccagaaagggagtaacaacaagctgccatttccccaagccccaccccaccccaccc

SEQ ID NO: 37638 - DNA, 1135 bp, Bovine  19866880459619
tgggttgcggggaggggagggaggctcaagagggaggtgatatgtgtataattatgacttatttgcattgttgtatggcagaaaccaacacaacattgctaagcaattttcctccattaaaaaaaaaaatcagtgaagacatcaggtctgtggaatggtgagaggagaggcaggcaggtggttaggtaaaatgctcacctcctccagggatccaggctctagagagggcaggcctagactgagtttacaaccatgggcaaagcagccaaactccaccacagggaggactccgccttgacaggtgactggggaatgtgcttcagtgtgcacgagtcagcagcattggcccaagggtcttattgaagtgagggcttgaagccagatgcggtaattcttgaggggatgaaggaaactagttccttacttcctcaccaatccctaaatatggatttgttgattgagaagcaggtgctggcagtgattgtgatattcagtgcttcaataccacttaaacactaacaacaatcattttatctctctaatcctaacctctccctgagctccacgctggtctatcgagctgcctattcaacaattccacttggatgtctaatagatgcctcagattttattttattaaattagattattttttttttcctgtgctgggtccttgttacagcgtgggggctcaagctgtcatggtgcataggcttagttgccccacagcatgtgggatcttaattccccaatcagggatcgaatacatgtcccctgcattggaaggaagactcttaaccactggaccataagggaaatctcaaatctcaaattttaatgtgtacaaagctgaattcgtgattagaacccacttcccactaaatttgtgcctcctgctgttttatcagctcagtaaacagcacagaaatgaccagtgcatagctttgtcggagcccttgactcttctttttcttgcgtgccatgtcgaattgatagagcaatcctgaattattgtgaaaatacactctgaatccaactatttcttagctccttcctccccataatgcagccacggcaagggcttcgggtgatttactggagccacacaggcttcctggctctttctcacatgctt

SEQ ID NO: 37639 - DNA, 2095 bp, Bovine  19866880535028
tgagataattctttgcatcaggtggccaaattattggagcttcagcttcagcatcagtctttccaatgagtattcagcattgattttctttaagactgagaagtttgatctccttgcagttcaaggaaatttcaagagtcttctctgcactgtagttcaaaagcagcaattcttcggcactctgccttctttatggtccagctgtcgtatctgtacatgactactagaaagaccatagccttgactatatggacctttgttggcaaagtgatgtctttgctttttaacacactgtctagtgttgtcatagctttcctgcgaagaagcaattatcttataatttcatggctgcagtcaccatccacagtgattttagagccccaaaagaggaaatctgtcattgcttccacctttctcccttccatttgtcatgaagtgatgggaccagataccacgatcttggtttttttaatattgagtttcaagctggctttttcactctcctccttcaccctcatcaagaggctctgtagttgctctttgctttatgcaattagaatggtatcatccacatatctgaggttgttgatatttctcctggcaatcttgattccagcttgtgattcatccagcccggcatttcgcatgatgtgctctgagtatcagttaaataaacatggtgataataaactcccttctccatcctgaaccagttagttgttccatgtgtgtgtgttagtcactcagtcatgcccgactctttgcgaccccgtggactgcagcccaccagtctcctctgtccatggaattctccatccagggatactggagtgggttgccctttccttctccaagggatcttcctgacccagggatcaaacccaggtctcctgcactgtaggcagattctttaccgactgagctacaaggaaagttgtcccatacaagtttctaactgatgcttcttgactcgaatacaggtttctcaggagacataaggactaatttatctctggggatgactgtgggactgtgagattgtgtagaccaagaagagtatgaacataaatagaattgattaatattgactaatatattaaggaactccacatgccaggtactatcctaatttctttacacttatattattaaaacgtcccaaaattctatcagctaggtactattattattgcattttaaaaaccaagaaacggatgctcagaaaagtcaagtagcttgcttaatatgtcagagctgggatttgaacccaggtttgtctgactttgttcttataaccattacactatactgagagaacatggaattaatctcaatgtaggagacaagaatgttggtgtgtgtgtgtgtttgtgtgtgtgtgtgtactgggagagatttggtctagaccgagtttggcaagttattttagcgaaggacaagataataaatattttaggctttgtgggtcacatatggtctctattacataatctttttgtttttctgattaatactttaaaatggtaaaatctatcagtctgcacaataacatgacagactggatttggcttgtgggctgtaagttgctgattcttgttccaaaaactttttatattgatatattctaataatgagtataatttttgaaaggagatttgaaataagaaattcctatatttatctatggcatcttctaacttcaaattctgtgttagtagggcaatagggctgcattcttataaagtagaaatatttcactaaacttgataaactgtaaatagttcatatgattataggcgtatcttcatatatttaatgttgtttagtcgctaagtcatatccaactctcttgcaaccccatggactgtagcctgccaggctcctctgtccttgggattctccaggcaagaatactggagtaggttgccattctcttctccagggggtcttcctgacccagggattgaacacacgtctcctgcattggcaggcatattctttactgctgagccaacaagaagcacatattaatgtatgtgtgtatatatatatatatacacacacacacacatacacacacaggcatacatatgta

SEQ ID NO: 37640 - DNA, 1343 bp, Bovine  19866880614399
ggctgcattcgtgtgtgtaaaatgccttttctcttttttaaaaatagatctatccagagagaactaccgagaaacaattgctagggtcataaggaaacttcttagtaagtacatacatgtatttatttttttttactaagtatttagaaattttatagcatatgtgcttttacttaaccatttaaaaattataaatggtgagaatatcaggtggtggggtttttttttcccccgttcttttttagtatatcaggagtcctatggtaatttaaaatattttaacaaaaattcttttcctcctattatagaccacatacttaataattcagaagatgataccaagtccttatttcttatcataaaggtacaattgttatttacacagttgcatggttattaatatgaccagatttgatgtgacaactcattaaatataaaatctgaaattgtttggcacagattattggagaccttttgcagttccaaggatctcacaagcatgaatttgactctcgttggaaaagctttaacctagtaaagaaatcaatggaaaatcgggtcagtattttcacttaaaactcagaatttattttaaaggtatataatactgatataaccacctaatttagcatttgttcagcatacagaggaagtttccctgtacgtaaaaatagtagattttcaaatactatatcctggtataatcaaaaggatcctggaaataaatatactttactgaaacctcttctgtcaatttccgtgctagtctctgaactctcaatggcaatttggagtatgataacttggcaactgcattctcactatcatataagagcctaaagggatgaaaagtaggaattgtccataggcatgaatttaaagcattgtgttttatttaatcttaattggttctccaggagagatcaatataagatttcctggaagcacggaagaaagaataacttaaatcaaccatttgatgatcatagcacagttcttcattgggagactttttttggaaattgagactgtaaaggtttacgagtttgttgtttaggcatggggtacttcttattttaaacaaagagattgacatggggaaaggcaggggagatgtaccaacatggcatgccttagggaacactagttgtaggtaagagtggcaggaggtaaactaggtcagttctagttttgtcccaagaatgtgctccagttttacattcagcaggggggaagtcattaaaagttcttgagtagatctgatgtgaatattgaaaggatcaatattaaattcagtggattttaaaaagctctgccactgctgtaagaataagcagtaggca

SEQ ID NO: 37641 - DNA, 1715 bp, Bovine  19866880675486
tacgtttgagtctcttcatctctggcctgggtttctgagctcctaacttgactctccacctcccagatttgttactatcccttcttccctgtgactgcaaaagtaattacttaaaaatctgatcataccatatctttgtctaaaacctaaaagttgatgttcagacttggcatcacacagttttgcagcgtgtagtgcctgcttctgtctttggttttaactctcataccaccacacatctttgctcttaccgctttctcaggttcatgtgcacatccacacaacacataacagaccttcacatgagtcacagattattaatgtttcatgaattaagcaagggttttctctttgtgaagtctgtatgtttcagttcttcatcagtctgtttgaatcacccatgtctctgaatctgctattccctgtacccttcccttattacaccgcagtttgctccagggcagcacccaggtcctgctgcatttgaataattacaactaacattcatattcgttcccacttagccctttattagactgcttattatcctttctttatagatagtaaccacatttttttaaacaaaatataaaatctaacagatagtgaagtactgaagagtaatgagacaaaacatacgaagtagaaattatccctgtattgttaagaatggtcagcatacccctaactggtagatggaactaacacttgactagagctttctctatgctattaagtgttgcaaaattcattttcttaaagcacattaaaaatgagtggacaacttttattttccaaattttctaaagttaatttaagtcatactgaagcctataaatatgtgtttgtttaattttaggaagatttgcaatcaactaaggaagagagatttccagcaatccacaaacccattgctgttggttctcagccaatgctcactgttggaacaacccacatatccaaattgacagatgaccagctcataaaagagttccttagtggttcctattgctttcacggggtgagaaataaaccttcagtttaagtatttatcttacagctttcactttgtatgttatttatcaagagacattagcagcactgaaaaagattttttgtctgtagagaaatgacaggattctggaagctttccagcagacatttctctacatctcactataaggcatagtcattataatttctctttactcacaggctaaaacttgacttttacttgataaaaaaatatatatatatttaaataagtaattcatgtgtgattctggctaattgctagaatgggcaccaatgattgtatagcctgtattttggttatgaccctacattagctcatttaaaacttgagctaatatctgcaaaggtggaattctgcctctgactcagcatcagtggaaaatatgcttataagtagagttttcattttactttattttaccaagaaagttattctctgtatgtccattttttaagtttattagtaatttttagttgtgattttcaaccatattattgctggtacaattttttttattacatatatgtccattactatcacgtggcaatattgagacaaaccccagtacccctttctctgtactgaaacttgatctgtttcctttcctgtagggtgttggttggtggaaatatgaattctgctatggcaaacacgtacatcaataccatgaggtatggca

SEQ ID NO: 37642 - DNA, 992 bp, Bovine  19866880682708
attagccattctcacagaaaacactggtcctcccagaaggatttattatttaagttttgtgaaggcaattagaagtttatagtaagatttaaatttgataggaaccccagtggccttttctacatatcagctaaataacctgacccaggttgctccccctgcacccccacagtttaacaaactttgtcgaatctgacactagaagaacaaattctgtttgctccagtgaaagcttctttctgtttatcaacaataagttgatgggagataatgacttttctctcattatatctaagaggaagattaatgaggtatttaggtgataaaactcaccaacttcatttgaaaatgtaaactgatagcttgctatgtaacagtgctggctgttggggctagagtgacaaacagcacagaccctgtcttgactacggtagactgagtagtggcccacagaggggattctagtcctaatccagggagcctgtgaatacgttaccgtacacggcagaagagattttgcaaatgtgatgacgttaaggatcctgacataggagattattctggattatttgagtggtttctaaaagcaattgcaaggggtcctttataagaggaaggtagagggaggtatgagaggacaagaaggtaatgtgctgatggaagctgggatagaaaaggcaacctgatgcagagccctgaacctaggagggagcagctttcagacgtatggaaaagcaatgagaagccttctcccctagagcctccagccttccattgttgtcaaccactatgcttgtggttatttattatggccacaggaaacaagcgcatgcctttaagagagttgacaattgagttggttaaaaggcaattaaagtgaactatgaaataatgcttaatcataaccttatgaaagcaatatgagttagcctggaaagacagtggtgggagtttagtcagtcatgtctgactcttggaaccccatggactgt

SEQ ID NO: 37643 - DNA, 1228 bp, Bovine  19866880705810
agtgaaaaagttggcttaaaactcaagattcagaaaactaggatcatggcatcaggtcccatcacttcatggcaaacagatggggaaacaatggaaacagtgagagactttattttttggggctccaaaatcactgcagatggtgactgcagccaagaaattaagacagttgctccttggaagaaaagctatgaccaactcaggcagcatattaaaaagcagagatattattttgccagcaaaggtccatctagtgaaagatatggttttttcagtagtcatgtatggatgtgagttggactataatgaaagctgagcgccaaagaattatgcttttgaactgtggtgttggagaagactcttgagagtctcttggactgcaaggagatcaaaccagtcaatcctaaaggaaatcatgtcctgaattggaaggactgatgttgacgctgaaactctaataatttggccacctgatgtgaagaactgactcattaaaaaagaccctgatgccgggaaacattgaaggcaggaggagaagaggacaacagaagatgagatggttggatggcatcactgactcgatggacatgagtttgagtaagcctcaggagttggtgatggacagggaagcctggcatgctgcagtccatggagtcacaaagagctggacacctgagcgactgagcagaactgaacagcactctgggaagactggaatagtaatcatatccacctgacctgcattgccttggatagttggtagggggcagcaacagaccagaaattatggttagtttaacaaatcagggcattggaagtgttctttttaatgttatcattttgttaattttttcagactaaaacagaatagctgcaaagcaactagacagtaaaagtaaacaagcaggatgaaactagtttatagactctaagttacctagcctttatgctataatctttcaacagcaatttctttttcaaaattctaggctttattaccattcttggcttgtttttttttttttttgcttacaatctttatttattctctttgtaagcactgaaaattttaatgcttctttattgagcaggagagggatggcatatttgaacttgcattctgcttaaactttgatctactcctattgtgaagattttgcccctatacatcacatttggtaaagttcactccgtatttcttgcctggaaaaatcccaaggacagagga

SEQ ID NO: 37644 - DNA, 752 bp, Bovine  19866880853344
ttgaactgctgttgagtgacatcttgtctatcaggtcgtaagaaccccaaaaccaagggaatgatatctctgcaacagaagttatacgctcccaaggcagcaaaaaatgtttgctgggccttatttctgacctaaagaaagagtaatgaacagacgcttattaaatggcagaaaaacgacaaaaaaaattccatatgaatgtttaaaacaaagcagtagtaatttacatgctgttgtaataacagaaaaaatataccaaagcacataacaaaaatgagtaaataatcatctttttatcagaaggaaagcaaagtaccaccaactacatccaaagtttaagttacactcattcaatcatttttggtaaaagagagactgaatggaactgatatgcatttgttcagtaacataatcagcagactattaaactttttattctgagttattcttaatgagaaaagtcagactgtcttttgtgtctacatgaggaaaatcaaagactttccaaaacacaaaacaacttaaactttttaatgcaaaccttaggtataggccacatattttgaacccaaacaaaagattcagtataaattcataacccatgaactaaatgaactaaattacattactaaatgtaatgaacaacagctcattatagtaaaaagcaatacactgtacatttttcaaacttttaaaaataatacttcaggcaaaatctctgggttagactggtttcctaatttacagactca

SEQ ID NO: 37645 - DNA, 1352 bp, Bovine  19866880857702
tgctgtcttttgtactgacatttaaaattctcctttttccatcatgtggtctgctcctcttattgggtctttttatgttcacagcctgtgtaaaattttctaactaaaaaagctgctcaaaatgcagaaccttgcttcccatctcctctttttacttcctgctgctgttcttgaaaataattgctgtatatagccaatccacaaaactcgagaataggtagaacctttatagagtctacattataaatttaagatcgcaatctcttcattttcacaaatgccaaagatgggggtctcttctttcatttctttcctgtaaaaaaggcctaagtttagtttacttttttttatcatccaaacattaattttgcaaagctaaggagcttttccagttggaattttaaaagatattatacctgaacgctacagccccaaatcagaggtaatactttagggactttttctgggagtaaggatttttttcacattcctatttatcatttagtagatttcctgtctatatgcaaaaataaggtgtgagagtatgcattcatctgtattttctattaaggcaaaacaggcacatatcttcagtattataccatgttatacaggttataaatgaacccttagaattttgactttcagtcttgacataaccatattatttacttactttccttaatttatgctatttggttgtgagataaatgagttgattagaaatagatttctgaagtttgaatgtttttggagaggacagtcattttgagttggtgcattataaaactctggacatggccataaagttattgtcatgtatctccttaagtgaaagtgaaagttcagttattgttccaaacctttttcatacatatccagcttttacctttccatcatactttaggtaaccttgctttactttagttgggagattttgaagcatctttgaaaccatttggctgcctcagttttctactacattaaactcactttatctttcaaggtaaaccacagtgctataacatggccacagttttctaattgactcttgtccaggctgtttttagggcccttcaactgcagttggtgcttttgagagatcaatctaagaagaatctgtataataaatttatttaatctagattctgtttatatccaaccagtgcttcctatgaagcattttaacatacattttacatttctgagtttttaactttgattcacttttttcagatattatataaaggtgttgtatttgctagtacacttgagaatgtgtataatgttgcagattagaagtatcctaatgccaagatttaaaatgaggattttatatgattctttcataa

SEQ ID NO: 37646 - DNA, 1761 bp, Bovine  19866880876081
ctaaaacagattattgatctgctggacacacagtacatacaactatacaaaactattatgttcttatcaaataaaaaaatgttcaattctaatctaataataaaaaaaaatggagacatatatataatgacaattgaatcaactaaagtcaacagtacagccctagtgaggcaaactaaagtaactaggcctcctgtttagaaagataaaaccaaagaaactatacagtgaactatgaaatcatgaaagttatgcacagagtggatcccagatactagattaaccaaaacttcaatactcagagtacagtgtgtacctagaagcttaagttcagaacaaataaaaatgaactactataaacagcaaatgttgagacagtagagaaagaaaagcttagcaaataagttcttgataaatttttaagtcatagctagcaatccataatggtgaatttaggaaagccaatgaaatttgagattagcccacaaacctcttttgcatcattaaaaataacagcttctagctgcacaacttactttactattggttggaccacagattttactcaatatggcttttcttacataaagcctttttttatttattctattttaaaaccttacgagtcagatagacaaatcttgtctagtttggccagaagctaatcaataatctatcaataattcttcctttattctacttgcaggatcatggtagattagcaaaagaaacattaaaatttttaaatgtgtgacctacagaaataaatgctatataccaaatacattaaaagtgctataatatctataaaaataaagttttattttagattcttaacaagtcttataaatttcaaatgacaaataacctgaaacagtcaatacaatacttgacaaattttaaaatcttttttatctttttatctcagttttactgaggtataactgacaaataagattgcaagatatttaaagtataaaatgtggtgatttgatacacatatacatcatagaaacattcaccgcctcatataattatctttttgacagcatttaagttctactctcagcaaatttcaattctataattcaatgttgtcagttatagtcaccatgttaaacattaaatcctcaggccttagtcactgtataacttaaagtttgttttaattcttgaagtgttttgaagatctgagacatcagagaattcctgcatttactttaatatattaaatatttcccctaaaactgctacaccaaaaaatatcatccagctccaaagagaaaaggaaaaaaacctgacatcatcaccttgtctttgttatagtttgattagtgaaataatcaaaggtacatcatagaagcttttgtttttgtctgtttttctgtttttaagttcccaatttagctctaagacatgctattttatcacaaaagaaagtcatttggaaacacatctccatacggccaaaaagaatgaaagtaaagtagatatacatactccttttggaaagccatacacaagggagaactgaatccaaagacgaggcacatctgggcatctgggctgtagccagactggagcaacatttccaggcactcctcatgccctccaagcactgctgagtacacaggactcactttgtttggcccagtgtcacaaacccggttagtgagtggtattaacaagtccaagattctgccaatacacaaattcaggagtatgtttcggtatatacataatgcagacatttctacagga

SEQ ID NO: 37647 - DNA, 2056 bp, Bovine  19866880922517
taccaggctcctccgttcatgggattttccaggcaaaagtactggagtggggtgccattgccttctccgcccaaagaaagctagaagtctttaacctgcaaagcagaccccttaatattctgacccaggctagctcaccagttccattcaacaccacccctcccactcagttgcttagtgaagcaatatagtatagtgtctatagctaatgctaaacaattatccacttcttactttcagtaatggaacccttgagtttcagctgaacacaaggactccctaggtatgaccatgtgatttgactgtaaccagtgggatgaaagagaaagtgttgtgtgcttatttttgttttgtcgttaatatgaaacttctaggtcaaaagaaagaaagaaagaaaattactatgttaagagtattcaaaccacagccaagtaaaatccagaaactaaaatgacccattatctgccaaataagagaaacagaacatttaatacatttaaagcaagatcagtctgtcagcagaattcaaacttccttttcagacccaggaaattttctttaaaagagaaactttgaaatgcattgttggcaggaatcagaaagaagcaaagaaccttttttttttctttaattaatacatacctaatctagaaactatgtggctactatgccatttttaagtgccaagctcaaaaaaagaaactgaattttacatctcactgtactgctctcagaataattcatctaattccactataggcagaagtctaacaaatagtttgaatctttatcagttacaggttataatatgcactcatcagtgtcctttatcatataggaagctccctttttcagaactctacttggagcttcaagttaggatctaaggtgtggggccttgagttactggttaagtaagcttcctatatccacttgatcctctacttagtgaacctgggccagtatcgtcatcaaatttcctgacaggaaactgctttattctttcttgaaatgagagttaataaaagaccaagcacacctgtgtcctctccctgtgcgagcagactttaattagtcacaatcagctcaagagcagaaaccacagagtaatttaaacaggaagagctgactatagagcattactgagcaatgataggagagggactataaagatgggatgagagctctaaagggtgccaaagagctgagggaaagaaccaacagagaggaacctggaggaggtcagacttcagcatttgttgacgaaggtatggtcaaagtccacttgatgcagagaagttacctaagccagagatggtccaaagttgccaggaaagcagaaacaacctgctgggcacaggccagccagagctggttggcagactgggtatgcagaaggaaagaggtgcagagagtcaggaggcaggtgagtcagcgggccactgcaggtgaggcctgggatgctcagtgcccatgtcaggacagtcctggagaacagttctgtggggcacgggtgagatgacgctaaggggtgggtgcacagagggagccggactgccgctgtggacacttctgggaccaggacctcgaggggcctccctctacaggaacctggcacatctctgtatttggctggggacggagcagctcccacccactcaacaagacaaagcttaagcatcttgctcactagacagccagctcgatgagtcccagcatgcccacacagagcagcaacctgggctgcagtgaaggttgtgctgtctggagctcccagccacacttacttacaagatctgaagaaaacacacagaaaaagctacacactacaggacttaagcagtgaaaaagaaagcatgctcttcaggctaccaagagaaatccctctttctccttcaagtgtgtttctctctccagtgacctctatgacaaagcagtgtgccaaatgtcaaaggaaaaatatttacagggcccagacccattcaaacaggttagtcgatgaagggagctgacaggcaatgaattaataataagcacattcaccctctgactgaag

SEQ ID NO: 37648 - DNA, 1228 bp, Bovine  19866880927308
tggttttccttcataggtggttgtgtgaagtgatgtaataatatatatgcagtgaccatacaggacctgatatgcaatacctacccaataaatgatagcatgcacaacttctgagaggggaggatggagtggcagcatgaaggaaagagggggaggtgtgaggagaaaggatttttaccaagggcacagctgcctttcttaaagaaaaggcataggttacaagcccagaactgaggagctcagtacctgattaatattcagaggggacttgagtgagtgagtgaatgcaggaagaggcaaaaaataactaaaagatgaagaaatgaaaaataaagagaggcaaaaaagaagagctactcctctgtatgtgttccacatacacatgtggaacaattaaagtacaaaccactgggacagtgtcaccaccatgagtaaatgttagcaaatgtagaccagatcaatcataatttgaaagactgacctgcataaatgtgcttctaacaatgcctaagaactatttaccaaactaaaacaacttgtccacgttcacatgaatgtgagttaaggcagctggctgtacattggcgtgtcagaactcatgggccctcaccatggaggcaagtgtgcttcagtcattggttccccattccaaaccccaaggaaaagacataaggtctttggtgcctacaccctgcttttatttaatctattttctcccagttaaaaattgtcatttgtgagcctatatgctttttattctaaccaaatgacataaacttgaagaaaacaaaaatagatcatccaatagtgaactgcaaaaagtatactcaaaacagagtggtttaagcagaaactaaggaaaagagaataacttgcatttcttagaaccccaagttgttaagaccatacattctcaatttctgcactgcccttaagcaatgaagtttatatggaagttgattatgttttgaggcactggaatttaaattgattcttattatctcagaatatagaaacacttatgacttaagcaacagctgcaacttgtacatgacttccaaatgagctaaatacagacagttggggaaaataaattatgaatatatgtaaatatagacaatttagcttatcagttttttgatatttgatttttctaaaattttttctttagttgtatctcacatttaatgaatcatttctaattttctgaggtgcttgtcattacatt

SEQ ID NO: 37649 - DNA, 621 bp, Bovine  19866880934454
ttttgaaatatttcttcctacctcccttcctccagaacttcatcataaaggttttaagtaagtgtgtatatatatatatgcgtgtgtgtgtgtgtatcgatagattctagaatatagtagggaatgcatatgtgtaggtatgcacacatgcacatatacatatatatatgtatgtatgtaggcaaactagtacagtaataagtaaaaaagaaatgaccaactcaagcattatgtttcttacacttgaaatgtgtgtgaaagctaaaacaattaaatatcggtttgcagataaagagaaaataaggcatttatatatcaagccacataagatgtgggctttcaaagatattgggaaaggaagaatgataactgcaaaaaggaattgaaaatttcaataaataggcagtgatggaaaggttacattgcatagagtttagggaagggaaaaatatttttctaaacctcgattttaactcccatcatgtagtatagtttttcttgggtctctctctctcataactgcaggtatataataaaccctagaatgaaaaatacttaggttgtacttttatgaaaaaagtaacaggtgtaaaaaaaaactagaaggataatagaacatat

SEQ ID NO: 37650 - DNA, 1582 bp, Bovine  19866880995628
tgctcgattggctccgaataatataggatacatagactgggatccatatgtaccaaaggtaagtaagaacatttgaacaagtacaatagcactgacatcatcttcatatctttaaggagaagtgtgtgtggttgctgatttctagcaccacagaaaaatcaaatgctttgattgttagtaaaaacataagtaatttataaggatgggtcatttcttttcagaaagtaattagatcatatcaagctatcataagtgtttgattttttttttttttgtcttaccagtggagggcatgaactctttaagtttcagagtgagtaatttataaagtactaagaatattattcaaggtatcatacactggtcccttccagtgaattttttgtactatattgttagttcttctagagtactccccacttttaaaatcacattgtataccttcctagagtaagtaaagctggacaatgtctctaggggtgttgcatcttgggtattgtttaccatgcagggaatcaccttggagcttcaggaggagcgtggtcgggctgtggttggttctggtgcacacggggactagagcagggctggggagcagcggaaggcaaatgctccgagtgcctgtgcttgtgctgccttcctctgttgccagccagtagaaactaagatggagaagtaaatttctcccacctttagcccccgtatttgacatatttaattatgttttaaatataaatctaattgtattaagatattacatgactgattaaaatgcagattcttagaggaaaatcaagtcttaaagttgaaagaggtagagaaatcagctagaaaatatttttgtgcatccttggcttggaatgaaagcataggaagaaataattttgtgtgcatttagagaggcagaaagtagtcaaaatatttcacattgaattacacttacctactgtttgcctttttatgcttaactatgtgccactggcctgttttggggtacctgaatatgagtgcttcgtaactgcatgcctgtgacctcagagtgtcattttaaaaaggtatacagttatttatatgaattcctaaggaataaagcagattaccaaacaatatgtcataaaaaccaatcaaatgaaaatatataccgtaacaccaatatacaacacgtaggttatttaatgaacgaattactttctatttgtcaatagttatccttaattctttttttctttttaaaggtatttacaagaattctgagaagcttgaacctcccagtgggaagcagtcaagtgttagttccaagatttttaacaaatgcttatgatataggacatgctgtagtatggatcactgccatgatggtttgtagtacattgtttgttttatatagttcctataaatttggggttaaccatacagaaattctgcataattgcataagtctaaattagtggcttagttggtcatttgattcttggatattttctgatgcagtaaacttatgtttctcagactcagaatgtagtcataatgtaccatttataaatctccttaaataatggacctttaaagtaaggtcagaagt

SEQ ID NO: 37651 - DNA, 1560 bp, Bovine  19866881050465
atactctgcctcacatatttcttatagatttaaaagagttgaactctaaccaagataatggagacattattttagaaagtagaaatatgcccatataaaggcaactcgctattaagaaaacttccttctctgtgtgggcctgccaagtcattttatttgcctttcagttatttaaggcaatattcccaaacaaaggagatgcaaatcaaaaatatcacaggcccatttcgctaggactacatactaattatcaccttgtcatgagcacattgattgtattgtattagaatatggtttgggctaagtgaggaatgaaatgtgaaaataaggctgagtagatgtgttttctcccatttttactgaataccccctattagttccttgcttattactataattaaaagtagtctttggtagaccttttaaaattatttctgaagttgagaacaaattttttaaatgtgaaatggatttctttaaaacggttttaatatatgaaatatgtcatgagcattctacttagtagaaatacctcagctaccataccatgataaggaactctaccctcaagaattgagtcatagttctagaagagcaatcttcagtcattaggaagacaaaatcgctcctgtgatgtgcaaagtgagttcttttcttttcaacaaaggctcatccatagttgcttgtgaaggtaaacttggacttccacctctttctaaacagttaaccttggggttcactccatcactaaagatctgataagtacagagttgtacatttaggaatgactctccctaattttattttctttcacttttttggccattgcttcacaactttcaggaccttagttccccaagcagaccttgaatctgtgcccttagcagttctaaccactggaccactagggaattccctctccctaattttatatctcgctttaaaaaaactttttgtgatagtaaaacctatataacaaaatttaccattgcaaccattttctctttttttttggctgtgctgtgtattagttaaagcatgtaggatctagttccctgaccagagatcgaacctgggcccaccctgtttggggagcacagagtcttagcctctagaccactagggaagtcccaccattgcaaccatttttaagtgtatagtccagtgtcattaagtgtattcacatatctttcttttttaaaaaagaggtctttagcttaaatctgcacgtgtgtgtgtgtgtgtgtgtgtgtgtgtgtgtgctcagttgtgtatgactcttagcttgccacccgcacagacggtagcctaccaggctcctctgtccatggaattttccaggcaagaatactggagtgtattaccatttccttctccaggatatcttccaaacccaaggatcaaccccacgtctcttgtgtttcttctattggcaggaagattctttaccactacaccacctgggaagcctgtaagtctgcataattgttgccaaatctctgtaaataattagtgtagacacgacaaggaagtgacagactgccccggcgttttcaggaa

SEQ ID NO: 37652 - DNA, 1968 bp, Bovine  19866881069777
atcatctttactgaggtattatttttattaactggattataaattttaatcctttgaagcgttcaaatggggtcaatatttttcttttttggtagcaggcttattggaataaataatacattgttaaatcagaaatgtattatttttagctatatttaccaaaaatgcacaagcattagttactttcttttcataagacagtcatctaagaataaagtactatgattattaccatttctaattatagatattattcttttgtgtcagctgagtagctgtatagttctttcaaaaagaaatccgttttttcttgctaaaaatgaattattctatttcagaatgatcttacccaagaaacttagtgaagaggactgcatctatagtagagtgatgctcttcctgggagagtaggcgctaactgtggtcatctcattagggtgctgttctgttatgtgggaagtgggctagactgttgtatgtgttagacaatctttaattattgtctaagaaggtgtaaggatgaaatgggggtgtttcaacttatgctttccttctgtgtgaggatggtttgttcacaacctgacaaagagtatctaaataactatttagaaaaaattttttttatctttgtttatatattaccatggtagaaaaattcttaagatgatctgttttcaaactaattgtgttacttctctcccgtgaatcttaaactggaaatgggcagtaaggggaaatagattaagtatctctacacttaaaactaattttattatatactcagtgatgcctagcataacaactgtaaacttatttttttaatgtagaaatgttttcatgatgtagttgatttttgaactcagtacgattttggaactatagcttctagaaaagatgagcatcaagatacaaaacctatctttataaattgctatattcaagaactgttactacagattggaaggcactttgtccctttggatgaaaggtgttcaggttatagcatcctctcccatgctgttcctaaaatcagagattatgagaggcatggagaagatagttaatactcaattagaactctcctcagtctcgtctaataattctgaccttccagtatcaaccagtcatttctatttccaaggtttaagtatgagatatggattttattttgtttttaaattcaatttttaggactctctccttcccttccctctctcccttctatcctttatttttactattaaattttataacagaagaaaaaatatccactttcacttttttttttgggtaattgaatgctatttttggaagtcactatgacctatttcaactgtgcttttatatttttaatacaactctgttttcatttgttaatattaccatgaaataggttggtatataacctctttttaacaaagaattaggaaatctaatatcctctcccaagatcatttgaagaatggtggcaaattaggaattaaacatttatctaaattcagaacctggtatttatttcagtaagcctaacagcttttaagtaataacattaatcaagaagctatttcatactttttaaggtatgaatctctttttggccaagcatttcaaatgtgactcaataaaagatatttttaaaaattttctattgtacttgtaaaactaaaaattacaggtttcctttgtgacttttgagtttgagatgattttgacccatgtttggcaggtaaaaatcatagcataaagaaaattaagcatgtgcatatgagggtttcagtctctttatgctcatcaagaaattatggatttaacttgcatgaagtacatagtgggctagattctttatatctctgtatctatgtctatatgtaggtatatgtagatatggatgtagaggtaggaatatgtaacttgtctcttcataagttatatatgtctagccatatctatatctacctggagataaag

SEQ ID NO: 37653 - DNA, 1215 bp, Bovine  19866881094372
tgtccgactctttacgaccccatgaatcgcagcacgccagaacctccctgtccatcaccaactcccagagttcactcagacccacatccatcgagtcagtgatgccatcaaaccatctcatcctctgtcgtccccttctcctcctgcccccagtccctcccagcagcagagtcttttccaatgagtcaactcttcgcatgaggtggccaaagtactggagtttcagctttagcatcattccctccaaagaaatcccagggctgatctccttcagaatggactggttggatctccttgcagcatggatgtatctaaagtgtactttgctaagtgaagtaagtcagaaataaaataccagtactgcatgatctcccttagtcatggagcctaaaaagcataacaaacaagacaaaggaaaaacagattcacagatacagagaacagaagggagcagggtagaagtagtggaaataggtgaaggagattaagagatacaaaactccagttatataataaacaagccacagtgatgcaatataccatctaaggaatatggtcaattacattacaacaactttgtatagggacagaggttactagacttattgtgatgatcatttcataaggtatgcaaatgtcaaatcatgtagtacaccagaagctaacataatattgtattatacatcaactatgcttcaatttaaaaaatcagaaatgaatgccacacaaaaaaaccataaaacaaaaagaaccatcaaaataaggccctggtatagacagagcttcttgactcaatgaataatttatacagtctgtaaagccaacatctgggaactgctaatttaattagtttgtattgaacatttaattgtagtaggccaagatttcatactagtttgacagctgttttcattactcataattaatctgtggcatttggttctctttgacaccttgcttggactttaaggtccacttagttttgtttggtctgaaaaatcagttccatcaggtgacatcatatcactgctatatcccctttattttccctaattctaacaatttatgtgataatagcagagagtcttgcctgcttgaggacactccatctgcctgctgtggcctcattggtcctgctcaagcccccaacaccatgtgggcccagtgtctcccggcaagctttccccaacagcctcaatcgtcataaaggcattc

SEQ ID NO: 37654 - DNA, 1544 bp, Bovine  19866881160988
tgctgtccattttggagggcatgggcaccgcaggctgaccccgtggagatgagataagcacacaggaccactgggctgctccactgctgttcccaccaccatccccgtcagacacctgtccgaccacctgccgcctcactccctcagcaggactgctggccccaaggtggcacttgaacacaggcagaggggcagaggaggctgaggggactaatccaggtgttaatacccaatgcgttgggaattgctacacaaatggacaatgcaactttaagaaatgtgctccacaaattacatcaccttttcaaatgtccaatgcttagagcctctgattaagccagctataatttctgcaacacatcgctgggtgctctcatgtgaatctgcaaccaaacgttctaaatggggcttcagaactgggaggaaggcatcatcaaaatttctgaatataccctatgcaaataaagaaaaagttcttcagtactcaaatgactacatctccattataacatgctcatatttgtttactatattactactgtgcttaaaataatctatgttctcaccttagaacttaactgctttaacaatgtaagttaaaatgataaaaccacttgttatttgccacatcacattaaaatataatcaatgaaataaaacttaataatctttctgatcttacaaatatcacacacacctcaagaaaaatcaaacaaatatgaaatgcatacagtcttgtggggttttggtattttatctctactgctaattacaaatattagagataaacactaaaaagcctgggttttttgaatcctaaaccttaagccaagatgaatacgacaggcattacttctaaagtaattttaaataaaggtaacaggtgactaaactcaaactttgatcaaatactttacaactcacaaacctacaaactgagaatcactaagctttatgaaaagggtatataaataacagttaccttaaagaggcaaaaacgtcgaggattaaatttatcttttccttttctgtcttctaaagatagaaaggtaattaactgttcgacaaatttaggatcagaaaaatgatcaaatataatctgttctgcctataaaattggaaaaaaaaaaagaacattcagggattaaaatttattcaaaattatttccatatttataaactaccataagttaaaagtaaactttgttcagaattacagaagctacagcataaacgtaactgaggaagacataaatttaaaattcttcaaaatgataaagaagttctatgaagactgagaggttccaacttaaatctataaataattatttactgattatccaccatttatatgcaataaaaaactaaaagtcagtacctaagtgagtgctaattaggcagttgagagtgacttagagacataagccttgtgacagctggtcctaagagaagggaggagggttggggcagggggagaaagggagtatacatttgccagcacttactgtactacactgcaggacacaaattgggggagaaaaacg

SEQ ID NO: 37655 - DNA, 2022 bp, Bovine  19866881205671
ccttcaggctacatttcctgtaattgtctcaatggagtggcgttaatactgacactgccccttctgtcttctgcaactgcattctaaagtcacagctttgggaatcagattgaaaattgtggttactcagtgaactgtgggccactaaggccttaactaggtatgtgaaggggaaatggaaattgcccatgtaaatgaaaatgtcacagtacatatgctgtgtttttatttcagccttaaagaccaaagcttgagtcatgcaatataatctgaaaaaatgaagcaaagacttgtaatggtaattggctaacagctctaaaagatcaagtatgggctagctatgttgttacttgctctgtgaccttggtcagggtcctctgtgagccctgtttccagatttctacaatgaggagcagtgaggatcccatgacacacactcaccaagcccagggcttggcacattgggaggttcaatatttctacatttttatttccatctcttttccttatattgttttctgtgagacaaggttaaataatagaagtagcaaggtgacatcagaagtcatgctttcatgtgtatttaaaaacaaaaatcagtattgaagagattttccttgatgacactaagtaaataagctatctaattatggaaagtaaccagaataaaaataattttactttttgcatgatcacatgatttcaaaatgttctattctgacccttagcaccttgcctgtccttctgcatttcctccatgacattcctggcatccttcaccaataaatgcttattgaacatccagttgattagaagtagaggtaactttaggacctttgaaaggcctcggccctaggaaatggggaaactaagtcttggggctccctctgacttgttgtggttccttgggcagcttcaatgagataattattagaaaagtcaatgtcaaggtcctttctgcaccctctccttctagatggagatgttgtgagcctatgtccttaaagggcttccggggttcagcttggtgatagaaagagagtagtacttcatgagttcttgaaaggccggtgtgtgggttagaggtcccaagcccgtgcggttggataggtaaatgatggagggtaggtgcccgagaagagcagaaatggtggagactcatgagttggagggcagagtgcttgtaacctttgctctaaatttttctgaacttgtttaaatgctaacctataaaaatggcatctgttgctgggctggcttcaggttgctggttgacagattccagtaggaatggcaggttggaaactcaggtgaaccgagaaaggtgctgacctgcctcttctgggtattgttcttttggggagggatgggccccagtctttgttggtttttttttttttttttttcctgtttctaaaggtttcagcctcgttagagcctcttatcctgggaaatcagcagaatcttaactgctgaaatttctctgagtcagcatgaaatgctgatgagctcccagtcacacctttggtttgttttgcaattcaaaattgggtttccctgctgtggctgatgcagttggctttggttatagtgtaataaattcaaataaacatttatgagggtaagtaatcatattttatgcaaacaaattattcttccttaaaagtcacttataaaaaatgcatgttatttcttttctcagtcagcatatcaagctaataaaagttattgtctcatcaaaattcctttcacgactgtttattgtcccatttatgttaaatttaaaaaactggtctccattttgtttctcccctccttgcctattgaaattttatactctcaccacttgtataagaatcatgattagttcatatatcccattattatggcaaaaaactagagatagcgccttctgagagaggacaatgtccattaaaagtgtacatagtttccaaattcaaggaacataatttactagcttattaaaattgaaattcagtttgagcgcccaagaatctaatg

SEQ ID NO: 37656 - DNA, 1792 bp, Bovine  19866881259424
tctgaaagtgtaacatagagaaaaaggaaggatttgaagtctagcagtaagaattctcaagtcaaaggtttttatgggtaaagcttaaaagatttctaaagatacttatactacatcctaaataattgctaacttttttaaataaaataatttctaactgtattttaataaaaataatattaaatgtcagtgaatttcttagatgatgaaagagagatcaactttaggtcgggaaacctatcagcatgatttcttccaaaactatgcaaaatatctaataagaaattgtcacaatgcccacgactgctgtatcaacagcaaccactagagcctgtattttaaataggaggcacagttctctattaaaaaaaaaaaaagaccactgacttcctctgcaggtcttaaaacattatactattgcatagtaagcatttatcctgaagttcttcccaagtctaaaatctgcaccaggtttttgagtgctactcaattaggatgtgttttcagataaaagacagaaaaacagatacatggaggaagcatttagccatagctaatattaaatgtacaggttcatgtttttacaccaacaaaaagcaacaataattgtcagttccaaagttgtttgcaaagggatatagtcgtaatttattttttcccatcaaaggaaaaatattaaaaacatctcactaaaggagattagaagaaaaatcagttttaatttatctgtcaagaatattctgtaggtatacaaagggcttcccttgtggctcagctggtaaagaatctacctgcaaggtgggagacctgggctatatccctgggttgagaagatcccctggaaaagggaaaggctacccatgccggtattctggcctagagaattccacggactgtatagtccatggggttggacatgactgagcaactttcactttcactttccatacagaattataatgtccttttagtggtagacctgacattatgagcagatagatatttactgttaatgatgcaaataactgatagacttactcagtgatgcttccatatttgttaacaatagattatttatccaagtactggtatccttttagtaaaattctcacaattctataagaaattcaattaaaagtagagaaaacacaccaagatattctagattaaatgaaagttcatggagaaaaaaactatatatatacacatacaaatatacatataggtacatagagataagaacatattcatccataatgcttattacatttttgtacttcaaggaggtaagggataaatgaaggagatattaaaaaaaaaaagaaagaaaagtgaaatcagaaattaaaatcagaaagtagtaagcaaatatgaaagtcatgttgctctgaagacaagtgtcagtaacagcactgcaataagacatttagtcttggcaaagagtaaaaaggtagagctgaatttaagatgcttgaattaagccaagattctggaagaaaactaaagatttgctgctgccaggttaaacaaatgcaaactatctctaagaaaagcttctgaattgtaggtttacaggtttcgttttatataaggtgctatataagactcagaaaattgtgtgtgtaaatgatatatatatttggtatataccattatatatatacatagagatctcttcaagaaaattagagatatcagggaacttttcattcaatgatgggcacaataaaggacagaaatggtatggacctaaaagaagcagaagatattaagaagaggtggcaagaataca

SEQ ID NO: 37657 - DNA, 2228 bp, Bovine  19866881308487
attttattgtaataacaacaggattgcctgcttttattttttttattgtgaacaatctcacagttcagattaaaaaacaaatcaagtctttcttatataaaaattcctgtatgatccacatcatcctcacattgcaggagcagttgaaagaggggaaaaaaaaatcagtattttaatgagaaaattgtctaaattttctgacaagtttaacttggtctgaatatttgatttacccaaatttagtgacctcaagggccacatcaaattggaaaactaaattgtctcatcaaataattatagcaggcctaagaggttacttgcatctactgaaaaacattccattacagttatctgataataatagcactttatattgtcaagctcttaaaaatactgctttgttttatcattcaccagccatatctgcctttgtaaagtcacacttagcaagtccccagacctaacctagatattgaatccaaattaaggaacatgtatgagatgtgatttgaccattcttgaatcagatcataccaagtgttcccaacaactcatattgccataaattgccacattagagaaacatggacatttgcagtccacggcaatgattaccatacaaacctatatcccagctgacttcttttcttcatgaagtcaacataataacactgccaacaaaacgctaacaaagctctacaacttgcttagatgggaactttatcttctcttagaaagccagcactttcttaaaagaggtatattgtgaacttcacctttggtaaatgattgtcacctttttatactacactggtccttgaagattaaaatggtgtttacaactgaatggaaataacgccacagaaacatggaaaacagcatagtggtacaagccaaatataccatatataggattgaccaaacaatgctgagttaattttgctggttaaatgtttaacatacttgatcacatttacatatattattcaactatagcttagattacaatcttaccctgttacttttttaatagtgcatgagtgagtgctcagtagctcagtcatgtctgactccttgcaaccccatggactgtaacccatctggtttctctgctcatggaattttcctggcaagaatactagagcgggttgctgcttcctgctccaggaaatcttgacccagggatcaaaactgagtctcctgagactcctgccttagcaaggggttctttaccactaagccacctgtaatatttcccctaatatcccaaccaaaaggttttatcctgactacaaatagcccagattctcaagctgggctgagctaatccagaaaaaaaattttatttccagatctgattacttctgaaaatgttattctgtccatcttagtattaaaagcattattcaaccttattaattatctattatcaacttgactatgctccccagaatggtacagagcagacttccagtaaagcaagcttctcacaaacctgagactccactcttattttctcatttcaaaaataataataagccacaaatctaaatttggattagctccaaattattgttcactttttgatcaaaatgtattagattctaacaaacttaggttaaataatctgaaacaaataatgaactgtccatgtattttcttcctaactctgctcacaaataaaagggaacaaaacaaaaaggaagtaccaacttcttcctcaacctgactcagaccactactatctgcctagaaaatggatgagtctgtggccatggtagacccaatggagatcaaagcatgcgactcctgagtgtcccagtcagattacccattttagttcaaactcatatgcactatatagtttcaaaataagcctctcattcatatgttcaaactaggactcatgcttataatgagctccaccaactgacaatctgataacagcaagacagttataaatatgctaagagaataattgttcttgttttaaatagaacaaaaggagggaaactgaagtggaaatttcccacccactttgatttctactttacatgtaaatgaatcattacattaaatgcaacaatattacatttctatactaccagattcaaaggtgatagaacctggaatgatctaaatttagaaaatctgtcattgtctaagcaccaaaactataaaactggcactctgtaatgggggaatgtatcccttaaaaatgggcttcc

SEQ ID NO: 37658 - DNA, 1014 bp, Bovine  19866881392983
ttgagtaattcattcttacaccactctcctcccctttcttgtttatttatcacagagcctataaagctcagtgacatttgactttgctctgttgttgactgggtcatggaatgcagaaagcatgtatgtatcattaagtgcatctctgagtgatgggctcagcatcatgtcacatcacggggtcagcctctctcatcatgtcacatcacatcatgcttgatgtagacacatggctcaattctaagtatccacatgtaattgggaagtgagccttcacagcagtctgagcagtggtttcagataacaggaaatagagcagattgacctcaccatttttaccactgcaattataatgaaccctgttagaagttgtgcatatatatacgtattcacatctcattgataaaacaaaattctctgtataagacaggcattttctttctgaattcttctcataatgatgaggcagtgaccctcctgggtttattattgcgatgataagatctaattcctggaaccaggtattaatctaaaggaatctattgacagaatgagctacatgatagttattagggatttgcaatgtgacaatcaaactaaggctattgaaaaaaagttagactaggccattgagagattatttctgcaaaacgtctccactataaaatcaatccaacctgatacattaggcttctgttgcttgataaatcaggagtatgaatatattaaccagtaacactgaatacttccaattttaaatttttccttgattaagaactctaaggcactgaatattagtcctcgaaactcctttgcctttaatcctccatccttaagtcttttccacattagaagctaataaaaactaatctgaataaaacaagattcttgaaaattaatgaatgaagtaattaatgaataataagttgatgaatctatatttttcatattttggtggattccaaaaatacacgtgtctacaatagagagagacaggcatgtttctgaagattt

SEQ ID NO: 37659 - DNA, 752 bp, Bovine  19866881455750
acaggtttctagtaatgctgtcttaccataaaaatagtaatcacattattcctgaattcttagattatgtatgtgtggcattttttataaagaactgctagtaaataaatctgtaggtaccttgtactttctcattaccttagctcttgcccgtttcttcctcctaaaatgcgctaactgcctcttatccatcctttaaggcaatgacttctttcaagatgaaacagaggcagcatggtaaaatggaaaggacaccagcctaggagccaggaggctgaggtataggctatagttagctgtggaacctgaacaaatttgaaactcaattccttcactcaatcaattttttgagctaattacagaatattttcataatctctaaaatggaagtattaaactcattgagtgctttcttaagaagttttgttcagatttaagatctgtgaaagacagctatctatttcgttttgttttaaaccttaagacacaaatatacacatacacaattatacacatatttatggcattcgagtatgaaatgtaaaattggaaaactgagaagtatcttaaaactttccagtgtattatgtaagatgcaactattcaaggcttttatagctagaaattctcaagtaggtgtataagaattgttcaggaaactgatactcagaaacctttttctaagaaaaggaagaattgaagatttttctatggctctgtgttttatacttcagttcttttttttttcaatt

SEQ ID NO: 37660 - DNA, 1589 bp, Bovine  19866881462474
accaggctcctctgtccttcaccctcctgggtttgctcaaattcatgtccactgaatgggatggttttatttgaaatgcactgtaaagactttgaagatatgtcactgaagagatggacatgagacctacactgattctaggatctgcatggaatgaactgaaagggagatgagaggaagaatacgtttgaggactctgcaacaaaccatgatcttcattacataaaattacctggattagcacctccagaatatatttaactttaaaatggtttaaccatattctaaccaagttttagatcatttttggtactaatagaattagcacataatgttgaaccaggttgcagaagattgttttaactctgtggcagattcaaagtattgaaaccaataaatatgttgaaaacgcaaattctcaaaagtaaaaggatttgtaattctagaaggcagcagattatcaatagctgcatccacattctttggagtggtgggttgctttaagacatatcagtctcaccaggaagtaaaattgtctaaagtatatactactttaactttccaggcaattggggttgttgcttgaacagagacctttaaaaaaagctatatccgttaacagcagacaagattttttgtttgtttaaaaggtttaggtttttaaagtttcttgtcctagaatatatcagaatccatttagaatatggactcaggcccaaagcctttctgacttaatagagacgcagatgctgttgccaccctaagaacggctcaaaatcactgtggcagttacctaaaggtttaataaaaatttactaaccaagtactctgaaatactgggctagcagatctttcatttcagaagcaatcattttagggtaccaaactacgaacatctgggccgagcctccggcttttgtttacaaacacagaggaaggagcgcccgcggtccattaagccgcagggccgcggagccgggcgtcgctcccgggaagcgagcccggttcccccagcagggagcgggggcgaaaggagccctccggccgccgcgggcccagcggcctctgtcttccaggtatccccggctgccctcgctcccagtcctcgccgtctcatttgccacctcccaacgcgtgaccccggcgcgtcgcgtcccgggccggtgtcagacgcggggtgcgccaagcggtcccatgtgccccctccctctcacagccgccgcagtcaccgcgccccgatccccgctccggctcctcggcagagggctcgccgccgccatgtctaccggcaggccactcaaatccgtggactacgaagtgttcgggagagtgcagggtaggggaccaccctacagcgggagatcaaagaggtgttggggaggaagactagaaagctgcgacaaccacagcccatctttaggaacccctgccccgttgtgactgtgacttccgcccgcccatgacacagcacagcgggcgggaaggagaccaagggagcatgcgcaagagagccggggtggacggggaaggagagctgagacgccttagggagaaaggccgggagaaggaggaacagccgggcgctggta

SEQ ID NO: 37661 - DNA, 905 bp, Bovine  19866881473547
gtaatgaggacggtgaatttggtaggaatttgaattacatttttgatattcatcttagcattgtattaaaatagtagctcacctgaaatattttttttttttttttaaggaactatgaaaatttggttaacactttgctagatggtgtggagcagagaaatttgtaagtgcaaaaaaagtatttttttaattcccaatgcttttatcttcaatgttataggggatttctaccctgaagaccatgaatgactattaagtgtgttttctgatttttttcccactctcccccttttcaggccctggaaatttgagcatataggcattgggcttttgtctctactcttgagagatgacagagtgttgcctcttcgtgccatacgttttttttgttgagaatctcaaccatgatgcaattgtagttcgaaaggtacatattttattttagctatgatcttgcgtttgagaatttttacatgttgaagtatattgatttgaaatctacctctcttggatcagagatggtaataattcatccaacaaatacatgaagaggtgttctcagacgctgtgaatttcaacactggggatatagcaggaaacacgtttataggttattggacagcctgactttgaaaaattaaccacaggtatattataacatgttacaggaaggaaaaggtgtctgagggataaagatttttggttttacttgaaaactatctgaggcgggtgacctggcctggcacattgggaaaagatccctaggaagaaatgtctaggctgagataggaagaataagcaggaacaaagaaaggatacaggttgtttaggcagagccttgcatgggttgagggttcaacagtaagaactgcaaacgactcagcccaaatcagagttagcactca

SEQ ID NO: 37662 - DNA, 600 bp, Bovine  19866881540090
atttacttaaaatttttattcttagaatcacacatcattggcaatccacgctgaaatggtacatagtttctgtttactaatgttcagctgttggcagacacagtcaattttttagctaagcaaatgtcagttgttgccattgcacttctaaaattacaatacagctacaaaataattggcagggaagggtactttggggtaaacatggagaaaagtaaaagattaaggaaaatgtccacctttctagtcagtgacaagatcagtgataggaataggacccagtttgagatcttacttcttagaatgcaaagtactagtggtcaagatagcaaataattaggatgaaatatggtaagtacttgcataggctactgaacgggctaggggaagatttgggaactagagtaggtagtttttaaatctattttattcccgataaaatagatccaagagcaaaggttttttgtgtttttcaaaagtcagggtgtgttcagagagcagaataatcccagtgtctttaaaataggctacctataacctgcaggattaaagaatcagcctgcaaggcagtagaggcaggttccatccctgagtcgggaa

SEQ ID NO: 37663 - DNA, 1013 bp, Bovine  19866881578622
aatctttcctggtgtatttgctaacaatagttggtggaggcatagagagaaggaggagaaatacctgaattaaatggctgccctggcaaattagtgtgagagcaagttctcatttgaccatctggacgataagttatttgctggtggtcattcagagaaagtaaaaattgtccatttgatgtgtgaaacgtattttctttagttttttgcttgccctgtgataaaccagtgaatttccctaagctgttcagctgtactgtggggattaaatattgattctaaccttgtaaatgggggtagaatgtgaagctggctgatgggccccctagggaaggacactatgttttaggtctttcttttatagaaacttagagataagttgctccatttcaagcatgaaagtagacagacaaggaagacagcccttttcttcatcaaattaatatgaacaggctgcctatggtatgatgagtacaaagagaaaaaaagtggcatatacctgcctttttggtggagagtgtccaaagtgctgtttgcataagtgacagtgagtgtattgctttttagaatgtgcagtgcgcagagattatgagagcgaatccttcctgtcagctggacccttttgtatcttgggttcgttgttaagtcagttcacttgtggtctgtttcctctgtaatttgacttaaagttgagggcaaagataaaatcagcttagagaggaagttgacaatctggtaaatagctgtggcttttctcttttaggcaataggtgagataaccaaggatcaaagcagtgcataatatttccttaggaaataagttttctgctgctgtcagatggtcttgaatattcaaaattgcccaccagataagctgacctacaaatacacagggagactcggggaggactgacctccctacctgcccgagattcttggcagcagtacacagacttttctcacctaggtggcagcaagcttcagtggctggatggagactagtgtatgctgtt

SEQ ID NO: 37664 - DNA, 986 bp, Bovine  19866881740082
aaagtggttctagtgttaatcaatatgtggcatcatctcaaatattctggaaaatcccatctttctttcttccttggctttcagatttcggagcaactggacagagatttgaccttttattcttttgcctcaggagttgtgattttgtgttcaactatcttccaggcaaggactatttttgcttagggcttgaagatatttttagatgcatccaaaagaaaatctggaatatttcatgagtgttagacaggtggatcattctttttatttcttgactacataaaaatgtgataaaactaaatatgatgtagttctattctaaatttgaactattgataagatgctaactaggacattgaaaatgaatctcacaattctactcacagactcccttaaagggtctatatctggattattatttaagatatatgttaagttaaaattctccctctggccatttctgacagctttcctgatatatcaggctatacatttctgtagctaacactcatagtctcatggaaaggaacttggataaatgaatgggaaatacaattaatgtgtgaatgaaatattggtgtaaataagcacaggatatgtctattgttcacaattgtctgagatttaaagcagaagctttggagtgatatattccaaagtgtatcactaaaaatgctaaattcagagttaaccatgtaggctttgggcttccctcatggcctagaaagtaaagaattcccctgtaatgccggagacctaatttcaatccttgggttggaaagatcctctggagaagagaatagctacccactccatacttttgcctggagaattccatggacagaggtgcctggtgcactacagtccatgggtcacaaagggtcagacacgggttactgtttgagaaaactgaaactgccaatctaattatgtgcttatcagtacaagttgttaaattattacctgccgcaagtttaaaacataga

SEQ ID NO: 37665 - DNA, 1964 bp, Bovine  19866880394924
cttctgccttcaatctttcccagcatcagggtcttttccaacgagtcagttcttcacaccaggtggccaaagtattggagtttcagcttcaacatcagtcctttcaatgaatattcaggactgatttcctttaggatggactggttgaatctccttgcagtccaagggactctcaagagtcttctccaacaccacagttcaaaagcatcaattcttcagcgctcagctttctttatagtccagttctcacatccatacatgattcctggaagtcacttcagtcttgtccaactctttgcaacactatggtctgtagcccaccaggctcctctgcccatgggattctccaggcaagaatactgcagtgggttgccatgccttcctccaggggatcttccccacccagggactgaacccatgtctcttatgtctcctgcattggcaggtgggttctttacctgggaagctcaaaataaaaaggaacaggtgaaataaattttaatatcttatttagcccaatatggacatatcaggttccctggtggctcaactggtaaagaatctgcctacaattcggaagagctgggttcgattcctgggttacgaagatcccctggagaagggaatagctacccactccagtattcttgcctggagaattccatggataagggagcctggcaggccacagtccatggggtcacatggaatggacatgactaagcaactaacactgtagataaatagcagaaatgtatgtatgcaagagttctctcctccattatagaaaaaattactaaaaaggtcaaatatggatgaaccacaaaagtaaaaaacagtagatataaacattaatatataacattaaaaagtctttaatcatatttggagctttgcatgtgtacctacatgctaatatgattccagcagaaaaacaaaaaaattaatttttatgagccagtcctacttctgaaatcataagagtaagtaattggtttttgataatgttttaaaggtaaaataaagtattcagaacgcgtatatgatgcctgcatggatgcctttgactgcctgcccctggctgccctgatgaacccagcagttcctgtgtgtcacggcggtttgtctccagagataaacactttagatgatatcagataagtaaggttctgttattttccaggtctatccattttttactccttcggtaataaatgcataacatcaatttccctgcctttaacaataactttttgaattaaaatgatctaaagtagtcatggggagaaggcaatggcaccccactccagtactcttgcctggaaaatcccatggacagaggagcctattaggctgcagtccatggggtcactaggagtcagacacgactgagcgatttcactttcacttttcactttcatgcattggagaaggaaatggcaacccactccagtgttcttgcctggagaatcccagggatgggggagcctgctgggctgccatctctggggtcgcacagggtcgaacacgcctgaagcgacttagcagcagcagcagcaatggagccccagatgaaaacctgaacactgaaacttggatgagattccttggttggccatactatgtgcttatgtcacatatcaattcaaggagggtaacatatccagagaacaaaagaggcttcccatttggaacctaccccagactctgccttatgggtctccacacttgactagatcctttccctctcataagccataattgtgactataataattttcagtgagttctgtggaactttcaggtgaattatcaaaacagaggatgtcttagaaagtctcttcaaatctgcaattggtctcagatgtaagagcagtattagggaaccctcaaacctcatagtttgctaacactgagtaaaaatgatctctatcatttaagttcatgtaaataacaatccttaa

SEQ ID NO: 37666 - DNA, 1108 bp, Bovine  19866880791031
tccaaatgaccaaaccaccaaaactgccctcaatctaattgtgtcaccttagtaatgccttcttctcctagtccattccctgatgtggctggagaaggaagcattctaatcaaccaagcagaaccatttacagagaatcaaaattgatataataaactcaatataaacatataatgtgtctccatttatggcttctggagacacctgataattttgcactgcccaaatcattcaacaagaatttgttcaatgcataaagagcaaggcattgagcttggcactatcggttcagtgaccatatttttcaaactaaaaccttgagtatatattttaacaagtcattttatgtaacttccaagtaaatgcaacaacttgggagacatagtttagacaccgacatactagaatctccaaaacatcctaatactacatgtagacaactgaacatttaaatcagaagcagttgctcctcccaaaaagaaaaatgggagctatacagtcaccaaagtttttaacccttagaatcctggaactgacaggaattgtttttaatttaactgcatatgaataaaacattctttctgaatatcaaccatcatacttctggtttcacaactgtagcaagtatctgaaattgacaaacgctgaaaggtagtatgtcataatctccaggcagctgttaacataaatctcgatttctactcatttttctcttttgcagagacatgcagaatttccagctgcaagggataaatgttcatagaaagtcagatagaccatcttttaaaatagagttgactatattttgctgtcaggcaaaagaacagactagggaaataaaaagaaaaacacaaggttccaatcttccctataatggtctcaaaaggaatccatccaattccataaacaacattttaacaactgataactgcttcctcagagtttatatatatatttttaaatacctgaatatgcatttgtgaaatggatttgaaattcggcaatatgtctgcctcctgagaaatctgtatgcaggccaggaagcaacagttagaactggacaggaacaacagacggttccaaatagggaaaggagtacgtcaaggct

SEQ ID NO: 37667 - DNA, 728 bp, Bovine  19866880838231
tggggtttattttactgcttattgttaggatttgtatgtaaggtaactaatcagcttggttttaattagaaacctaacccctaatgagtgaatacccaaaatgtcatacagcaagtacttactctcaaaatgaaagctatctgttctcaaaattatattgttaaatataaacaccataagttgttccctatcctgatttctaaatcacatttcaatgggaggcagtaacaaaaatttcccccaaaatcaagtaaaataaaagcttctcaagaaatgaaacacaggtagaatatcagttggtaataacttaaacacttggctagatttaaaaaaaaactaagaaggagagaaagacaaagaggaaatcaggagaaaggaaaaacagagtgggaattaaagaagtgagagagaggtgtaaggtgaaatgaaggcagataataaatgagcatcaggaagaagaaggaaggaaaatggaagaggtgaggagtagacgaatggggaggaaagacctcagaacaggagagaggttggggagttcactctgtacagtgactgggaagcaaagatggtttttgtgaaatgctggtttcttccaagttccaactttccaaagattagtattttgctctctgtcttctatttttcttagttagaccgattcaaagaaccacctgcttatggacctatgtgtgatatcctgtggtcagacccgctggaagattttggaa

SEQ ID NO: 37668 - DNA, 2280 bp, Bovine  19866880905728
tttctgcaattttcttgcctctcttcacttttagctgatggtccaacttcttccttcactgagaacaaataagctcccagaagagccctctcacacattcctaccacaaatcctgtcaaaccaccttgtaccacatcctctgccttattattccactactaggaagggcttatttccccttctacctgcagctgacccttctgcttggtactgggtcttactgttatcttcacttgtcccctccaggatttgtgttcttcaatttcctctcctcacttttgcatcattaatattttcttcttcattagattatccacatcttcatacaaacctgacttcatctaccaccaccactatcactcccagctactacccagtccctcacaacaaacacagctaatgtggcgtgtacactttcattctccacttcctcttctctgtttttcccttgatcccactgtattagctctaatacccacctatggttccaccacagctgttcttatcaagatcatcaacaacccatgttgccaaatcccatgagcatttcccagcgctcacctcatttgacctaccagcagcatttgacatagttgatcctccctccttggaatactttcttcccttagtttctagaacactcctttttatgattttcgtctttcaaggattatttcttttcagtctcctttgttgattcttcctcatctttctgagctctaaactccttgctcattcctctgtttttttttctttctgtttgcattctgcatgaattcacttagtgagttaaagtttgaatatcactgctgctactgctgctaagtcgcttcagtcgtatccgactctgtgtgaccccataggtggcagcccaccaggctccgccgtccctgggattctccaggcaagaacactggagtgggttgccatttccttctccaacacatgaaagtgaaaagtgaaagtgaagtcgctcagtcgtgtctgactcttagtgaccccatggactgcagcctaccagggtcctccatccatgggattttccaggcaagagtactgaagtggggtgccattgccttctctgttgaatatcactagtatagtgatatttgctggtggcaaagcagaatgttacaggcaaatgctcaggaactggattacctggctttgaaacttatctttcaccacttgctgctgctgctaagttgcttcagtcgtgtccgactctgcgcaccccgtgaacagcagcccaccaggttcctctgtccctgggattctccaggcaagaatgctggagtgggctgccatttcctcctccagtttcactaccagaatatttatattgcataaatggtttatattccattattattgaacagtgatgcagccttctgaacaagtaaatgagaacagggtgagtgatggaaagtatattcttcactgtttctcctctttccacttcagtttctgcaaaacttcaaacgatctcaaaaatgactgcatgttggaattggttttaaaaataaatgatgccaggctcagcctctagagcttctgatttaacttgtctcgggtagggtcaggacagtggcaggtttttaacagaagcccaggaatattaatgtgcactccagacctatctatatcctaagtaaagacaaacaaaacgccaggcagtttaattcccccacctaaacatatgctccacgatgtcaatcagcagcagcagatacaatgtctctctgcaagtgtagacctctatttcatctctctctgtaataagaatgtgtccaggagcaactctgtcccatatttcacatggctactgtctgcacaaggcctgtctgagacacttacgtcagcacatgctaagagaacagcttaaggagatcacacgtcacacgtaacttaaaacacactctcgcctggcctccacagatgggtactccatttattccctcctggacactggtatatgtcacaaactattattctaatctaaccatatcaatcaagcaatcgattggccattaagtctttaagcacctactatgcatggtattgggcttcacaggtgacgctagtggtaaagaacctacctgccaatgcaggagacacgggttcgatccctgggttgggaagatcccctggaggaggaaatggcaacccactccagtattcttacctggaaaaccccatggacagaggagcctggcaggctacagtccacagggtcccaaagaatcagacacaactgaagcaacctagcacgcgcaggca

SEQ ID NO: 37669 - DNA, 2076 bp, Bovine  19866880945873
ttttattacatttgtttagaaggaatgaatgagtcctgcaagttcagtgaggaatgtaaagcattagagcaaaggtggcctcattcatcaggccgcagggagcaactatgctctattttcagctttaacatgacttttcaagatttggctgctcctgcacagttattactgactttgatctggtgtctctgggaaaggctgatggtgcttttcatcctgctcacggctccctgctttaggtatcaaatcactaaattactctttagtgactctaccaggagtgagatagaaatagcaagaagcagaaatcaaaagagccactgtagctactccatgaaaaagagttggaaaaaatctggcaaaaattagaatatgatattatacaatgtggagatggtcttttccccaagacagtcctatttacccttgttaatactgtaattgtgaattgtttttatactcctcacatataatcatactgtagattaaagtaatcatttgaggagaaatatactttgcgttatctaagaatagataaccgaatttaagtaaagagtagttaatcctttttaagaaaatatttgttttcttaagtccatgcataataacaacatgatgcatgatccatgtaaaaaataattaacatatgggaaatgaaactaaataatcttttcattctcaatgatttatttgaataatatagattttcataaccaagctttatggttcatgttcatttcctagaaatctaggtgaaatacacctggtagattcgtcttttactgcagggagtgaatgaaaaataggattataatagctgttctattttataatatgttgaatctattgtgaaataaatgttttaaagtgctgcagcacatagagggcataaaatgtgaagcagtccacttacaggctttctctacagaaataatttaatagatttcaatttgactaaaatagtgaggaactaacaaatccatttaaaatataattaaagaaaagaaaatagtttctaataatatatttaaatgaccagacataagtattaagacactattcagtgacatataatcaaggcaaaacagagcagaggaccatgatctcacctgagaaccgagaacactctggccatcttgccaatggctcggatcttatttcttatcacctccttcctggctgcagccgttgctcctgcattttaaaaacatagttgagaagtcaggtgactttttattgaactctaactagttgactagtttacatatataacaaactgctgtaaggcaaatcaggttttgttttttgttccccttgggcttccctgatgggctcagtcagtaaagaatccacctgcaatgcaggagacccaggttgacccctgggttgggaaaatgccctggagaaggaaacagcaacccactccagtattcttgcctgggtaatcccatggacaaaggagcctggcaggctacagtccatggggttgcaagagtcagatatgacttagtgactaaaccaaggatttatctgtgaatcaagttcaaaagcttatgcttccaggcataaatgcttgcctgtgatactttacaggttctcaaaatgccgaagagcaacttttgagatttccaatgaggcaggttcctgtcctcttctatttatacaaagggaatgtgtactggcacgaagaggaagtgagtcaccaggatcttctactcatttccggtctccatgcttggagactactttaggaaacttcttttgcaaaagttgtcctttgaagtgatcaaactaaccctctcttaaccccttatgttccctgggggtatttatagtatttataatatttatagtatcaatggccgtaaaacatttgttttagcacttgatactctttcatctactggttactgcacaaattctagaagaaaaagcagaaaactactgaactggatttagtgagagagggtggcacatagtttgtattttagcacttatgtagaaaagttacacataagtctaagttttaccactgactgcattttccaaatttaaaagtcaatctacatagggttg

SEQ ID NO: 37670 - DNA, 3888 bp, Bovine  19866881174547
atctgatttctaactcgtgttctcctttttttttttccttctcctgtcctgtacttgcctgatggattttgttttaaaatgattccttttttattattagtagcccaggtaaaaggcatgacttaggtcaaaggaaatttaccagttcatgagggttgttatagttggtgagcaagggctgtccttataactcactcttactctatggctcataagttcaggtaaaagtaagtatgcaagtcatttattaagagggacttcaagtcttcaatttgtaggtagttttgtcataataataatctttagtgtgtgttttttaatttaatgctcaaatcactcaatacttaagatagcgtatctcacaggcaatgcttagtgacttccacataatgactgaagttcaccaacttgaaatattttagtatgcctggatacaaatagtaggtatatgtaattatcttgaagctaagagctaatgactttgtacttatggaaatacacacacgtgtttctgtatatataactcttttatgcctatacccttattcttcctcttaccctgtacatgcctctttcacggcacctataacaccttctttagctttgtcacaagtctcctacataaaatgcagatgatattatcttacacaaggcaggtgactgtactagatgtatttgtgaagttgtctgagccaatcttatgattatgtctgtgtgtcactgaatgactgtatgtgtgttatgggttttccttcttaacactgcattggcaaactgtgaatcaagtattattcaaacacaaagttttgagtaaagtcagtggaaggtagatgatagaagggaggaagagggcatagatctctcttgttttcttttattgcgccttgtaccataccttgcacatggttaatggtcaatagttggttgaagtaaaagtttaagggaaggcagagagaaaagaatgacaagattgaaaaaaagaagaaggaaagaaagaaggaagataggtgaagaaagaaaaaataaagaaaaaatttaaaacacaaaacatgtaacttgtgaggatattaaaaatataaccaaccacacatgaatggaagtctcaaggatgcttgaaagaattttgggaaaaagtaatatgccacttcagaggctgaattctgtttcaaaactgttaagagtctaaaacagataagagtagaaatcatactgtctctaccacacagtgactatgtgatcatgagcaaatgtttctcattatttatttgagttgcaccatgctgcgtgcttagttgctcagtcctgtccaattccctgcgacctcatggactgtcgcccaccaggctcctctgttcatggggattctccaggcaagaatactggagtgggttgccatgtccttctccagggaatcatcccaaaccagggatcaaacccaagtctcctgcattgcaggcagatttttttaccacctgagccaccaggaaagcccataattatgagctgttctgtcatatttagagtatgaaaatcaaataaaatattaataacatatatgttaatattcataatatatacaatcagataaaatctttggcacctgaaaaatgtaaagtatcacgactcagttttaaattcctggaggagagaatagctatctatttttaataattttgccattttacaattcttacctcatgtgtcacatcattatattaggatccagagaatttgagccaaaaattgatccttggaattagctcaagtccagtcaaacactgtgaatcatttctaccattataatttcatcaagagaatttgaattgctactgtaaaatattttttgctaagtcaataagaaggagtcattggcagttttgatttccctatcagtttgaactgataacattcctttaagttctaatctatactattacaatgctaaaatatgacttaatcaaccctgactaaatgagagagatttagctaaagctttaaaatattgaaggagatggcatggacataggaaacactgtgtccgttgtggttatttttcagtcgctcagctgtgtctgactctttgcaaccccatggactgcagcacaccagccttccctgtccttcactatctcccggattttgctcaaacacatgtccattgaatagatgatgccatccaaccatctcatcctctgtcacccccttctccttgctcttattgttgatatccactccaaatatataacaagggtttaagtgtaccttggagaaggaaatggcaacccactccagtactcttgcctggaaaatcccatggacggaaggctatagcccatggggtcgcaaagagtccggacatgactgagcaacttcactttcactttggtgggatgcactttgaaaactagtacctatatcttatctgtatctgtttctgtatctgcatgcgattatagaacactcttccaccttgtacttggtgtcaagccataagctgtagcttgcaatggttctcggttgcttggcaactagttaatattatctccttggaactgagttaatattaagctcatatacttgatatctactattttttttttggtcatctactttattcatggaagtaagtcactgagtctcttgaaggtctagaatctctagataatgaaaaggaagtgataatccattgactcatgtctttaacttgttacatacatatggttcctgtttgtccttctgttaaatgccttactgacaattagacttttagagaagttggttttagttcaggttaagaatcttcacaccatctgtgagaaaatgaaacgtaacccctcaagatgtgaggcttaatgggtcttgtccaagtgacagcagaccactgacagtgtatctggatggaggactcagcttcgctggaggtcttgtctgcatccccagaaaaaggttcacagagcactgattctacgggtggaacttcgtgaaaaatgaagactgttatccagtcactaagccacgtccaactctttgtgacctcccgtgaactgcaacatgccaggctcccctgtccttcacgacttcctcccagagtttgctcaagttcatgtccattgagtccactggtgatgctatctaaccatcttatcctctgcacccctctcctccttttgccttcaatatttcccagctttccaaggtcttttccaatgagtcagctgttctcatcaggtggccaaaagtgaggattacctcacccactgccgtataatactttgctgtgtgtgtgttagttgctcagtcgtgtctgactctttgtggccccatggactgcagtgtgtcaggctcctctgtccatgggattctccaggcaagaatactggagggggttgccagttccttctccagggggatcttcctgacccagggattgaacccaggtctcccatattgcaggcaggttttttaccacctgagccaccagcgaaacctatacttattttgttgaaaactgctgaaatgaacaatcctgtagtggtgttggttaagaaatccaggtcatttgttagagcaaagatatatagattatatgtagcttaatttaattaaaatatatagtgagagtagttcctaagttttaagtcttgattttctatttcaccacatggacagaggagccaggcgggctacagcccatggggtcgcaaagagtgagacacacgaacaccttcactttcacttcccattaattaaatgtttaaatgtaagcaaggtgactgctggactaaaactaatctatttagaaagtggcctccggcaatgacactttcatagcagagtcaaacaaaagcaaaagcctgagtgcttttgtggggggtggggtgggggtgg

SEQ ID NO: 37671 - DNA, 874 bp, Bovine  19866881174752
ttattctgaagcacagtagttaatgcatcttatccgagtaagattgtgctgaaaaggggaagaagagggaaaagaaaggtgttctcagtgtctaatagtacatgattaatgtcctaagaaccagcaaggagacttgtcccagctgccaacatgtacctatcattaacgtgactgggtatctgcttggagcatggtatttgtctgctcagatctatgtcttaaaagtgtagtattttgcaaatgagaatattatcaagtcattagtgctgaattttgtacttagtactcagcatggctatacactacaatcagagttagctagtttgaaagctaaattgcaaagaagaaatatagcactgagtaccacatcactgaagataaattaacatttttataagtaatttccttcagcaaactgatacagaatgtattgaataattattacctttttaaaaactgttatgtagataaataaatgaacagcttgaaatggtgaattcttcctttcatctttcacttctagtcagaaagctgttagtaaaaatgaaagtgctatacaaaattcattggaaaagcaatgcagaagacattaacttataacaaaagcctaggactacgtagtagtgtcatttttgccagaaggcttaaaaataccgaaagagaattaaagactacagaattaattgtgttgtcctatttatgttagtatatcttttcaagtagtaggagttgaaacaaaggttaattcaaagccagcagaaaacagaaatttctcaaagccccttattttatttgttcagtatttataagacaaatacaagcaaaactccaaagctctgccttggctaagaatccatttcgcttgcatcaggac

SEQ ID NO: 37672 - DNA, 843 bp, Bovine  19866881233578
tgttctgcagagctgaaggggacatgaggaactttaggggtcactattacaataagctctacttttactgtttttatctcttggagtttcaggtagtgtttctttctttctcactctctttctcccactctctccctccctgtatatgtgtgtgtgtgtgtgtgtgtgtgtgtgtgtgtgttgaagcaggagatggggtagattctgctgcttgaaacttgtttatgagtacactattgatatagacagaagtcttataaaaagtcagagattatggaaatgaagattggctgaactgaagggaagtgaaggaagtgctataacatttgtaataagttgagaatgagagaataagagaaagagatctttaggcaggaaggtgaaaatgaaccagactaagtggattgcaaaaaaatttggattgatcagaaggtatatgtgaaacagcagaagttaaattcaagtagaaaggcatcatgagattatgaagggacttggatttttagcgtgttgtttgaagaaggagaacaattccagtaatataagaagataactctggcagatgtatggaaaattcaatggtgtagaaaaactgaaagaaggttgattccaattagaggttcactgcaataatacagtcacaagacaatgaggtctgctatggttatagtgacagtgtgaaaagataaaagaggccaaatagaacattcttgtacttctattagaaccattataaatgacataataagtaaagtcattcatctgtgacctgatttgataaatattcaagccggcaacatttcaacaatattccattgtgttagaccccaagaatgcaacaaa

SEQ ID NO: 37673 - DNA, 1170 bp, Bovine  19866881236694
gaattgtgtttcctgggtctttggatctacagtgtctgttgaataaggagaacagatgctcatctaaaccaagcatgaacttggtccttcaaactctttttcctgcttctagaaagcttaccaaaaccacacagagttctaaattttaggaggtaataaagtgaacagggaaggaagacatctggaaggtaaggggtcacagctccatcaggacgctggtggcacttagggtggtttactctctgttgttttgataacttccttgttgaaagatttcaaaatggaatttttagaacttccttgttgaaagatttcaaaatggtattctgaaggattagatccagaacttgtaggctcataagcagtttgatttcatggcctttactcaattggattttgctttttaatgcattttggcaaggtatgctccacaatgcatgaggcaggaaggacatttagataagtgccaactgaggctttggtttccattaagaggagattcagaactcttccaaacaaaaaagggctcctggacacggcgcaagaaggacgttgtgagaagagatccagtgttagcaataaggatacaaacatgaaagtaattctttgctggaaagacattttaaaatcccgagatctgcaggccagggcctgccactggaattggcaaaagaagaagaaacaactgactttccctttggcttttgccacaagtacaatcgctttgtgattcttgcctgaagtctctaaatgggatgcttggtgtggattccaaagctcttgccttctgatgctaatgtgcaagacccaactcacttttttccctctctttccagtggaaagagttttagaaaataggcttctttgaacaatatgttgaaaatcgaggttattttccaacataggtggtgacttgatcgtttttgcttaagaaagccacagggatatataaagaccaagcttgaggtacaaaaagccattacagagcagtatttttcctttctcttttctttgttctttttggaattctcctaatgattcttttgagagaatttttacattttttatgatattgagctttttaatattagatggcttccctggtggctcagacagtaaagaatttgcctacaatgcaggagacccaggttctatccctgggttggggaa

SEQ ID NO: 37674 - DNA, 1554 bp, Bovine  19866881246976
atttctacaggtgatagctgttggaagatctccttgaccgccataactggagaatcctgcattgttgatccatttagggtcaatgctggtttaacctagttcaatgagattggaggtgtcgctcctcccataatagctgtgtgtgtgcttatgtaggttattctattggagaaaaacaccttcaaaataacaaattaaaaaatctctgtaaaaattgatctttttgaggactacaacctaaaatgtgtggaatacctttctaattttgattctaacaatactatatcaaatatctataggtgataaaattgagacataatgactactcgttccaaaccactccaaaccacatattctgaatttcttccatatgttttttagctcaactaaaatctcagcatgtaataggccctacaatggtgtgatatttggcatagggctagtctgtcttacatatcattttgaaagcgtcagaggatccttgaaaatatgtatattttttaaataaaaagactctcctgtgtagcggatttttaaaaaggccagcacagtctagaatatttattctaatttctcttgtcataaaacataactggattctttggataggaagtcttaaaaatgtacagactactcctaaatgtcaaataactgtcattatttggttatcttaaatacatagttaaaagctactttcatttccaagtgttaatttgattccacggacttttgttctctgagacactgtgttccatctgttcaatgattccctggtatagctgcagaaactggctataagcataattataacttgggtaaaaattagactttagattaggaagcttggttattttttgagatactctcacatattcagcttatgccttacagaggacatttcagtttatctatatttgcccaagtggaaactagtagcatgtgaaatgccattttggattgacttcattatcataacagacatgcatcgattttatgaactgacaatgaaaataaaagcaaaataagatgaaataacaagtgtcaagctaataatggagatgtattgcctatagaagaaacactcataatgcctggatgtttaacctatcaaggattattctgaatatagatgaggatataacagttgaacaatgtacttattaaggacctaattgggcatacatactaaatgctggaagaatgcatttagaccagtgccaggtaccatgctacctgctgaagcacttagcacagatctttgatacatgattctcaaaaatgtcttttctttatattaagaagcaaatgcttgtgcagaggtgaacagtccagttcttctaacagtagcatttctcactgtaaattaaaaggccgatcatgtgatcttcattaatatcaaattgcctagttggtggcctcagttgtgttttgggctaaacactggctaaaggccggaccgcagacaatgttagttcactagggaagaacagaagccaggatgctaatggccttgagtcaaaaaaaaaaaaaaaaagaccattccacaaagatggg

SEQ ID NO: 37675 - DNA, 1396 bp, Bovine  19866881423951
atattatgagtcctaacagaatcttatatgtggaattaatctctaggccataccattgaggttctgatagaaaagagtcaccttcttttctaagatgtattattataaaatgaagggtccttttcttgacagttcaaattagtgttcttatttgtctagctgatatctccaaacatggtagacatgaagatttttttacagttttctcttaatttgtatagttaatgctctgagttgcaagaaaacattccagctttacctttctgaaccaccctctttagcagtctgtatagagatcagcactccatgctggtagcaacttccatttaaaatgctttcagagtctaaggcaatttagacagcacagctgtctactcaggagtctcattaaacatactttaaaaattcctagaagaaggcatgatttattatacgcaaatggctaccctgggtttttggtatattatacattaacagaattttaaattaaaaaaaaatttaatatacaccttgtttggattatttaaaacttaacttctaaatgtctgtgaaaatgagtgttggcataatcaaatgtgaatcccagctgattaacaaacacatgaacaatgggggaaatggtgcccaaagctctttattctaaggagcatttcccttaagggagaaataccaggagaacacagtccttactgtgcaacaggaaagagtaagcagaggctctcaagtaattgtgacacaaaatagaatgcatctgcaacatttaagtgcatctaatgcccagtgatttcatcacctaccctacatttaaaactgggagacaatccagaaacggaaggaaatcagatatttgtaaaaatatgtttgcaccacactatccaacacttgtactggcaacattactataggtatttcaacatatgttgattttaaagaataagttctggagttaaggcttctaatttatcatattttaattaaggagatgtaacctaccaagttaacaaaagagttaattttcaaaatagtaacccttaaggtgcttgttgtgaaagctacaaataatggtattatcttgccatttatcaccttaaataatttaatgaaaaatatctaacttgatatatttttaagagaataaaagtaatccctactttctatatttttttatgtgaactagagagaggagacctaaagtaaaaatcaaaaattcctccaatctgtttctttgagttatctgaatggccatcttccttcattacaagaaacactacttactctcctctttgataaaaagatgttctgcagtagcataatgtattttattcatagtttttcaaaaaataattagaaacaaatagctcttgctttgatttctcatttaagcgtcacagtccta

SEQ ID NO: 37676 - DNA, 902 bp, Bovine  19866881730819
ttttatttgactgtttttgttgtttttaaaaactcctctgtctctagacctcctaatttctctaggcacttctttaacactagaattctatgacattttaaaatttttgcttagcatcagtaaaaagttgacctattgatgttccttgaaggattttcttggatatagacaagtaaacagggccaaatgtggatatagacaagtaaacggggccaaatgtgtggatcagagcatgaattcaaagcttttcaaagtagttttatgagaaagtatgtattttattttatcttacacttgttaatgtgtctcccactcaggatggaatctgtagcagagttctttacaaactctcacttgtgtagcaagtatactgggacttcatcctcatatgttcagtatgatctactttttacatttttccaagatagcaatttagttgccaatgtgaatttagaaacaatagaattcgttgaaaaatatttaaattaaaatatgggtatactttcttgcagaatcattaatttaggcatgcgttcttcattacacatatcatatacgcatagttgttttgagcaactatccctttttgacagagagcggcatttctcctaggagatgcaaagcataggcttgatcttcattttggttatctttccaacttgtcctccatactatgagcttattttctcaagaggccatttgtcctcaatatgctggctggccattatcttctctccttagcagtgtgctcgttctagggactcttagacttgccctgtgactgattcattgtccagtttgtagatcccaagagctttctcagctaactacaaagagcctcttgttcctaccccagctgtttattgctgtttctctttagcactactttgctgtaatctaca

SEQ ID NO: 37677 - DNA, 592 bp, Bovine  19866881782328
gcttttaatacatgaaaataaaaacttttacatatgtataaaatctttagttcctaatgtacagatatggcggtaaacgagcaagatgatgagggtctttgaagactcagtggtatctaagacttttgatttgaagttataaactccaagtgtgggttccaagtggacagccttcatcctcaggccttacctgtgactggagcatcaatatccagcaagtttttttcctgtcgaagaattgaagccccctctgttattattctcaatgcgacagtctcttcgagcctgccctccttcatgagatgtgcctttaagatatccacacgaggtttcccatcattatcaaacacttcttttgccgtaagccggtgacttggaggaaatgggacagctgaaagagaagaaataaaaggatcatattaattgaaactcaacaacagaagatgtaataatagctaccaaatatctatccctatcactcaccacctattggagcatttttaaagttcatatcaaaatatgatccagggctatcaagaactaaagactgccttcctcaattaatgtgactgctgaaaggaaatgtgtagtt

SEQ ID NO: 37678 - DNA, 4198 bp, Bovine  19866880168870
attgttggagaaggcaatggcaccccactccggtactcttgcctggaaaatcccatggatggaggagcctggtaggctgcagttcatggggtcgctaagagtcggacatgactgagcaacttcactttcacttttcactttcctccattggagaaggaaatggcaacccactccagtattcttgcctggagaatcccagggacgggggagcctggtgggctgccgtctatggggtcacacagagttggacacgactgaagcgacttagcagcagcagcagtaatttgttttccagctatgatctgtaatgagtatgagtgagtgaaagttgctcagtcatgtctgactctttgtgacccggtggactatacagtccatggaattctctaggccagaatactggagtgggtagcctttcccttctccaggggatcttcccaacctacatatttcaaatgctttaaaaataatagtcatgctattaatagctatgctttaaatgctatgcagtcaagtatatttatatatatttatttttagttgttccattttgagtgatatgatttaatatttataagaaccagactgtacctggtgactaagtttaagtattctgttattgctccattttgggtgatatgtaatggataaactataaagtaatgagggccatatactgggattttacattgttttgttgtggcttaatctttaaaccatgtctgactcttttgtaaccccattgatggtagccagccaggctcctttgttcaggagatttcctaggcaagaatacagcactgggttgccatttccttctccgggtcttcaccacccagggattgaaccctcctgcattggcaagggggttctttaccactgagccaccagagaagaccttacattgtttacatgtcacacatatctttatgaaaaagagggcttctttaaaatataaatgccacctatgtttcctttatgaaaataaagtttacaatttggagggaagttcagtgtgagacttttacattcatcttgatggtcctgcggtgaaagcgtgtgaattcttccgcaggcgtaacttggcctcccaactaccagtgcctccctcgtgctttcacgtgtaagagctcactaagacgtgaaaagtgggtgcagcctctcatgcccgcacgcggctccggggtgaattcaggtgcagcaagcggcccaggacataccgatgcgccagagcctcccggggaggtggctcccgtagtaagacaggtcactcacgctgcgggaccgctcccgggcggcgagggagcgggcaggtttgggcctaggtactgtcgatgaggagctgtctactgtcacaaaggagaacaagcctcattcttgtgcttggtcatttgagggcaaacttatgagtctctatgaatctgccgtgtaggggatcattgtcacacccactcatctccacctggcaacctgctataaattcctgtgcagtgctgccccagtgttaacttcactcctgattgctaagtatatgcttttagagccagagcaaacacccagctaaagctaactgaggggtctggggaaagcaaatcaattatatgaaagggttggagctaaacgcatatttggaagagcaggcaatttgagacagtctttccctttgaaacaatgaatgttgacaggtactaacctcggaaacctggggcctgcaagggctttgttccaagttctgtgtggggcatgttatgctgctgtagcttcctttttgcttccaggacagggttttcaaactgtgttcttctatttatgtggctgaaaaataaaatttcaaattagagtattaatggggcaaagtcatttaagagaacaaatggatagctctacagaatgcagctgagtacgagataccttaaatgattatagttgaagccccaccaggcacagagtcaggcctctgctggggcggcttgtgtacaatgcatgtttctgtgacgagagttctcaatagctctttcatatggtcttgtatttcaattatgcatgattcagctaaaagagctagaatatgcacttactttctggtctaccgtgttgatttgagtttggtgcacttaaatgtgtggccaacaaatgaaatttataccaaatggtgctgaagaaaaaagggtaatctaagctttgtaaaattcaacaagataagtataagggcaattcactgattatcgtactcttatagcaactaaagtctacacattttagaaattggcagacctgtaataaagggctcgaatatggggagaaagatccctaatgatatatacatgtggaatttatgttaacaacattaagttgtagaatacctttagaatgactgatgctgagagatcaatcaaaaggagagtatttagtcttcctagtgagataataaacttccagatatcaaatacagagtatctttaagcaagtatggatcagctaaactcagggcttagacttcttatagtatccttagagtatgatccatatttgtataaaatttaaagttctttatccatagaaagggtgggaaccacaaaccctgcctagtaatactcatgtaactattttttctgcatatgcctcaccagaggtttggcatgtacactgattttggttctttgtacaaaaaaactagggttatggtattagagtatgaagaggagagggcttagaaaaggaatgaacaattagtacttaagagacttccctggtggctcagatggtaaagagcctgcctgcaatgtgagagacccgggttcgatccctgagtcaggaagatcccctggagaaggaaatggcaacccactaaagtactcttgcctggaaaatcccatggacagaggagcctggcaggctacagtccatggggtcgtaaagagttagacatgactgaatgactttcactttcattttctgtgccacgtaccatatataaattttctcagttaagtctcatgacaatagtctagaatcctaattatccctattttaaaggtgatgagactgacacacaagagactgaatgacttgctctaaatcacattcctagaagtgaacaggctggaacatgtctctaaaaatgcatcctttatctacataccttctctttctcaatgtatcatttcacactgaaaagtccacacatgatgtgcacacacagtcctctcatcttaggtctataaatattcatgagaaacaaaaggaggtaagagaaaccaaatcttaaccaccaattttctgttaatatggataagataattcctgttgtgaagaagaactaaagagcctcttgatgaaagtgaaagaggagagtgaaaaagttggcttaaagctcaacattcagaaaacgaagatcatggcatctggtcccattacttcatggcaaatagatggggaaacagtagaaacagtgacagactttatttttttgggctcctaaatctctgcagatggtgacaacagccatgaaattaaaagacgcttactccttggaaggaaagttatgagcaacctagacagcacattaaaaagtagagacattacttttgccaacaaaggtccatctagttaaggctatggtttttccagtagtcatgtatggagttggactataaagaaagctgagcactgaagaattgatgcttttgaactgtggtgttggagaagatgtttgagagtcccttggattgcaaggagatccaaccagtccatcctaaaggagatcagtcctgagtatttattggaaggactgatgttgaagctgaaatttcaatactttggcaacctgctatgaagaactgactcattggaaaagaccctgatactgggtaagattgaaggtgggaggagaaggggatgacagaggatgagatggttggatggcatcaccgactcaacggacatgagtctgagtgaactctgggagttggtgatggacagggaggcctggagtactgcagtccacgggatcacaaagagttggacacgattgagtgactgaactgaactgaattcctgttgaggcagaaaagcgattgccagaaacctgccaagatgactgcagtatctaagtacttgctcacaagagctggggcaggggagctgctgccacacaggctctggtgtcagtgagtcctggattcaaaatccagctctg

SEQ ID NO: 37679 - DNA, 827 bp, Bovine  19866880467705
tatagagagaatatgtataagagactgtgcttagtgctttaagtatcatccttcggatgctcctaacaaccctatctgtatgctcagtcgtgtcctgagactccatggactgtagcctgccaggctcctctccatggaatttttctaggcgagaatgctagagtgggttgccatttcttccttgtaggggatactatttaattgcttagagtgcaatgtcacaactaaaattatttttgatgagggtgggaggtggtagtcctggaatcccttggactttaaaagattcatgttgatgtagggcaaaaccaatacaatattgtaaagtaattagcctccaattaaaattaaaaaaaaaaagattcctttctggacagtctttcttgggactcccattgttctaaatgttggtaagaaaatatgaagggaaagatttggcatgtgtgtattcatcttttttgaggaataccccatgactctgaaataattttcacattgctcttcagtaggagtctaagttcaatattttcaaatcctttcatactgcattcccttgttgtgcgatacagtgaatgtcagctttggttggacagaaagatatcaacacacgtatcttagctaacattagagtcataatttaatctttgatatttatgcaataacgaggacattcaaaaacattagaaactttaaacatttttctggcattcacgtgacaagaaaatgtggatgcacttggaagcctattccgctttatttgaattgtaatgccatctgccaaaacttactctgtcaaaaagtactgctctgacaacataggaaagtaa

SEQ ID NO: 37680 - DNA, 2078 bp, Bovine  19866880608312
cagggaaggcctggcgtgctgcgattcatggggtagcaaagagttggacacgactgagcgactgaactgaactgaactaatacattatcactcttttgctctatgttgacatttgcattctggtacaaaagcagtggtgggtatcactgcttctgtcttgtcacaaatcaaggcagtggcacaagtctgtactaatgcattatattctaatttttatgactaaaacagaagaaattgattctcttatagttctgtttgctagatgttagtcattatattatttaccaccaggcaccttccctggtgattcagacgataaagcgtctgcctgcaatgcaggagacccaggttcgatccctgggttgggaagattacatggagaaggaaatggcaacccactccagtactctcgcctggaaaattccatggactgaggagcatggtaggctacagtccatgatgtcgcaaagagtcagacacgattgagctacttcactcactcactcaccaggcactggggggaaaatgctgccttttaagaatgtccttgacttaacattaaaaattttatttaatcacaattcttgagcatgtcttttaatattttgtgtgaaaaaatgagaaatacacatatctcccttctgtctcataccaaagtattatggttatcttaaaaaaaaaaatgcccatgcaattgtgtgagtgcaagctgaactaactacttttttatggagtattatttttacctgaaagaatgactgacaatctactgttactcagacttgggatctggcagacattttcctgaacataaacaaaataagcctgttaattcaaagaaaacaactgacaatgattgttttcagtgataaaatttgaacttttgagctaaaattagtatttggggaaacttcaatcaaccactgtcaatttgacagcttgtcaatacaaaaagtattttctaattagattgatggtgaaattaatgaggtgtcttttcacaatgaaaagtgtcaacatttgaaatatctgtataactcaatgaaacaatgagcaatgtatgcataaaatagtcaaagtacaagttataccaatagaattaaatttaagtattaaaaactcattgatacggtttccaattctacattgcaacaaaactttaaagaactaccacttaacagattttggtaaagcatcattaaagaatattcacaattatctaaaaagatactaaaatacttcttccttttccaactacatatctgtgtcaggacagattttcttcatattcttcaattaacacactgtatcacaacagattgaatgcagaaacagatatgagaatccagctgtctcctattcagccagaaatataagagctttgcaaaaatgttaaagaatataatttttacatgattttgttttggaaaatatagttatctttcattaaaatatttttgttataaaggaacagattatactttttaaaataagaaatatttgtaaaataatttagttttagtttcaaataaaataaatattgataagatataactcacatctagaaaagtttatttggggtcctcaataatttttaatagtgtaaatgggttcggagaccaaagtacttggaactaagtgataatgaaaaaacagtgataatagaaaatctattcaagttctgcctagtttgacccactgcccatgcttttcccacatgactacaatgcattcccttacagatatactacagagattgacatttccgagaaacagaggcattattttctcaattgttgacttgctaagttgtgtatgattctttgtgaccccatgaactgtagcataccaggcttccctgtctgtccttcactatctcccagagtttgctcaagggaaaaaaaaaaaaaaaaggtaccacggtgattcagtgttatttgaaatacatttcaggtttttaggaaccatacactgtgtgcatgactcatctataacataatttaaacaacattattactattatttcagtcacagagacatgaaacaattttccctattaacatgcaatgtgctacctg

SEQ ID NO: 37681 - DNA, 2248 bp, Bovine  19866880634400
aaaagccctcaaagcaacaaaacccccagcacatcccaaaataaagtattttaaaaagtgttcttaaacttaattcattttcaagagaatagagaaaatgaaataacaggcaatattattctgaggataaattctaggaaaaaataatgttctgcgtatgttaatggcccacaagaaatgcacagcttatttctccatcctggggaaaacatatttttcacaaagtgaggtgataagcatttgactttttcacaagtgatacatcaaacaaataactttcctggattttgtcaagtcaattaggatgatacttgaacttttcaaatgaccatactatcctctgaaactttaaaagctactaaaggatgagctagaggcaagtatgtgcattttattctgagttttaatcccattactatcggcccacaggaataattttataaattctttaatacttccataatgcttactataactttgctttacgataaaagcttattatgatttcatatgaatcatagtattatttcagaatattaactggacaaattatccaatattaaaaaaatctaaaatgactatagttaacctggggaaacatacaagaaatctgtcaagtaaagaaatctgttttcagtgcacccagtgttaatccaatgagattcagtaaatctaggtttcaaaatgcatacacatatggtggtagtgaagtaacccaatttgtagtgacatgagcaggtgtctgtaggtaggtcattgaaagtcatcataaactgggacggatttactagcatatgaatcttaatacgtagttacttgtgttaatattacacaatagaagtaggcaagtatagaatttctgtatagatgggagacttgtgccacattcctgagctacagtgcatgaggttcaccttgcacaatatggtttatcaaactgttaacagatgcatttcattatgaaaaatccttaggctgctctctgggagaagttgctgtttcaaacatttagagatgtcccatatggcatggataaggagataatcataataagatgtaaactatcacacacaaaaatttcctctaagttattttgcctgaacctagaaaataatgaagtttcttccagactaccaaggccagagaaatagtttcttttctgaaagatcaatcaagtaactctttacaaaaagagccctaaatgcaaggcataacatgaaataaaaatgtatttcatcccttggttataatttctctgcttagctttcacagttaaaatgtcagccagctccattatcatccagtcaaatcttcaaaccacaccatttcctccttcataatctctctcacttcagattcttatcttgagtggcctactgccattatttctttcctccaactttgtctatgtgactcagacacaaaattatatcctaaatacagttttagataggtgaacttcaaattatttaagtgactcacgctatatacaggatcaacttatacatatttatcccgaccgctttgatgacctactgcaacttggctttgatatctcttaacttcctccctactactcaaagcgtctgtctaggaaaatggactcgattaatacctctaagctgtcatcctatctgaacttcccctttcccattttcccttatctttctgaagagctctagcatcaaatcttatagaaattgttcctgacctgctgtctgatcagcccctgccctgtgcttcccttccactctgagcttaacatgcatcaaactaactgtaatcactgattttactaatcagtaactataatcactttcctccagaaacaactcgttttgtcttcaattctgttccattcagtgttgcactgaaattgcctccactaaggcccaaatgtgaatacaaactgtgaattcagcagatgttttatattcagtcttgggtcaattcaaaattgccccaaagagggaagaaagggtgggtgggtggtgtgtgtgtgtgtgtgggtgtgggtgtgggtgtgtgtgtggtgtgcataggctgaagcgcctataatttaaatgtttacattacatcaaagtataaaaagtattacaaataattaaaacagatagtactataaaaatgaggaattagaaaaagttctctacctgccttttgtgctttaaaataaaatggtgctgaaactggtgggtggtgaggaaaccaggttaggaaataaactgtgtgaagggctagatgggaa

SEQ ID NO: 37682 - DNA, 1302 bp, Bovine  19866880776852
tcgcacagcgtcggacactactgaagtaatttagcagcagcagcaggcagctctagattatctctagtttaggcaaagagatgttaatagtctgtttggacacaaagagaaatctgttctactaaagttgacttatggtcctgcactacagaaacaagggtagagtgggaattctttctttctcagtcagcactgattctagcaagcaatggagacaggataaagaaggatactgtgcccctggctgctttttagcaactaactgagccaatccctaatggtcctataattttacggaagacattttcttagaagaaattactatagtgcccagaaaccatcccacttctgattattaaggattcaacatatcccagcaatcatgtgtaggcaccagagatcctgagaacattcttgaaattattttaaaactcaagattgatgtagcaaggcttatgtagaaactgcagagtctaaaagagacttatctaacatcctcccattaaaaagcttccctcattacatgatgcttcctgtttttccccaggctaagttttgaatcaaggcttatggttttgaacaaatataggaggaaggaaagttgacctatccatgaagatcttctatagatgtgttgaattatgagatcactcacagcccattggtgttttcttttccccaccatcttttaataattatgcatttagttagtaaaatagcaagaaactgtccaggagaccaacattctaacattgtctggctcctggcatttctccatttgagcagattgacgttattgcttttactggttgctacctctttattggcttttctaaaaggggcacaagattaactttgtccaaatcacttggggagcattttaaagatgcagcatcctgtgcccctagacctgctgattccaagtttctggaagtagtgttgggaatttgtgtttatgcaattttaaaacttgtaaaagcaatacacatacatgatacaaaaaaatgaaatatttataatgcattaaaacctcttgtgtcctgcccctgttatctcaattcaacagctctagaaatgacctctatgtactttcttttagaaaaagatgaagctttaactcctgtatccctcacctgctctcctctagtttcccaactgagttttacaactactttcagtaatatttgtacaagttttgcattatcatggctctgtaaacttgttcgctgaccccagtggtggtatatcattaatacatttttttccctgtaaacggcttttgtggagttttactttgtcttt

SEQ ID NO: 37683 - DNA, 1363 bp, Bovine  19866880780414
taataaaaagcccccactgtaatattttatagagtaatttatatgcatattaattaagaactataagcacacataactgtttgttttcaggcagttttctttatgaactccaaattgcatccctttgtattatacaaagtatcttctcccataaatcaagtcccttctcccatttttgaagctagactgctaaatgtcagaattcttattctgaagccttcaagccaactttacacaggaagaaaataatagataggatcccctacttaataatttttaaatcctcatttttcacacctagttttataagttctttcccatacttcaaataattttgaaaaatcttattcttcaaatatttatgaggcaaaaggctaatgatttttcacccgccacacactctaatatggacccaccgttactcctttgagtcctaccattgctactattatagttactactgatgatgatgacagagcaacaacatcaagagcagtcatagtaaaacttaacatttattgagcaccaagcaggtaaggcactctatgtttctattccttataacatcatgcaggataaagaaactgaggtttatctaagaaaacccaaagtttcaaatcagttttatctgattccaaagcctacagtaattctatcaaatatatttgcttaaatattgatacatgattttagtttagtgctagcatagcaaggttggtatttgtaaactacaactcatatataagaaaagatttttattttaattttatgtaacctcatttgcattgtctccttcattattgttaatggagggtgaagaaatttaaactttccaattaaaggtggtctctttttgtttgtttgtttttcttgtcccttttaattcaaaacatttatttgggagacggcaggatggcaatagcctgttaatattaattaggttcagatttcctatcaattttttttcccagtaggtccctcctctcctcttggatccaaagtagtagatgaacatgtatctctatggcaacaagggctggtctgtggtaggcctgctgttctctgctgcaggatgccttgggaaaagtgaaaatgttagtcactcagtcatgtctgattctttgcaaccctgtggactgtagctcaccaggctcctctgtccacgggattttccaggcaagaaaactggagtctgcagccattttcttctccaggggttcttcccaacctatagatcaaatcagggtctcctgcattgcagacatatttttttactgtctgagtcaccagggaagctcaggatggcttatacctgctcaggttacggtccttgcctttgtctagagctccaagaactctaccc

SEQ ID NO: 37684 - DNA, 1642 bp, Bovine  19866880790794
ctttccttgctgtttctgacaccagccttgaaatttctgtaatatataatctgtttgcaatcctctctgaagattaaaattctgttattgaattttagttattttcagtttttcttatatcactgcattcatttctcagtctactttcttctagctgtggactctctcattttcatcctaccatgttttcccctccatggaaatcatgtttaaatgcattttaaggccaaagcatttacaaatctgtttctttaggctgaagtacattatatactataagtatactacaagtgtagcagcacttgtgctgcttcctctatgttttgaggactatgttcttctcttatgttgcaggcacttgttgtaataaaactggaaaaaatattctctacttgtgttaaaatttaattttttaatagtctatttggtttgtgttactttatacatgtttgaaaccacaaacataccccactcatcttccttattgattctttctagaataaccaaatatcaggaaacacctcttatgtttctaatcataaatatttcacaatatcaattttagtttcaaccatttatttctcctcagtgacacttccttttcaggtactcttgactaagcgtcttcactgaaaattccttcttcttacattgttgcttgctgctgctgctgctgctaagtcgctgctgctgctaagactctgtgcgaccccatagacggcagccaaccaggctcccctatccctggggttctccaggcaagaacactggagtgggttgcttgctaggagtccttaattttgttatcataaaccttagaggaaaatcttttttgactaatttttagaagttcacatcttctctcttttgctaaaattatatacttccacttaaagaagagattaaaacaatacctctgccctctatactttgagtttcctacaaaggaattttgtttttcttaagactggagagagattctagataatatactcaagtatattatgtagtgaagcatctgactcttgactgcactggaccctgattaatgacaatctttaacatttttgttgattaaaggtgtattttttttttttaacatttcagtaacagtttcatgttcctgggatacctaagattaaagaaatcccctctccttgaaggcacaggagagataattttgcttatatctttttctttaacttcctgcttttcattgccccttctcttgtcattttcaatgaaatttaaactcccattaaaaatttgaaaagtactaagggaaaagatgaactataagtgtctatcttctaaggacaaaaggcaatgaatgttaaggaaataagatgtgtttagtatcctattttatgacaaccaaaaattatatgagagcaaaatgaaaatgaaataaggtattttttatgaaaattggttaaaattttacatgtgaattccaacctgttattaaaattttctgagccagacagagaactgaatgcagacaaggaacagcactcaatgacagtgacattccctgacagagcaattctttgcatatcagcagggctaattatattcaatctgacagcagtagtttaacccattcactagagaaatgtgcttcttctaagatcaacgatct

SEQ ID NO: 37685 - DNA, 1151 bp, Bovine  19866880791776
tgtgcaaatgccaaaattttaagaaaaaaagcccagacttttggttgaatttagaatctgatgtacattataaatgatatttttaacagaaattcatctttggctatacttcaaaataactcaacacacccagactatattttaacagaaagagaatttaaaacaaaggacacagagggtctacagtgggcacactgaagtagaagaatgacgaatatccaatgatttaggtcaatgtaggtaatgtgaggattaggaggaaaattttgatcttggttttttttccccctatggaagaaagggacaaagcagaaagtttatatcttttgtgtgtctgcctctgtttacttttgttttgtgttgcttgaattatctgaaagcaacttaaaatgttcagcaagattctggaaactctgcattatcagtctttataacagtagacacactaatatgggatcaaaactacttcaaagctcatggaggagctatttccaggatatgcaatgattgatttgaaataacatggtgtgagagattctactaaaaatcttaaaagatgactgagtgtttttcaagcttcatgtaatttgatgaaggtgccttgtcaaggattgctaaaagcttgctcatgagaactccttaaatcaccagtgagaatgcagctgctgctttattgtttttgagtagcttcttggcagaatgaggtgacactatctgtttggatacaaaaaaaaaaaaaaaaacctaagtgactattgtgtgtactgtgcttgttagccagacatgtcatgtcacctcagacagaatagtatttacagctgagtaggatttaattttatttcaatatacctagattgcttttatcttttcattgtgtttgaaatgattaatagccagcagcaatccttagtaaaggaataacaaagactgctgctgaatattgttattgactaaatgataaagatatattctcattataactgctcataaagtaaatttcttaacaaaaccaacttcttctctgcctgtatactcccctgtagatccttcattaaaggctctctcctctaactgttgactcaagagatatttccaggttaaatctcctgatcttaaaagtctgttttgcctggttttagttctttcatttg

SEQ ID NO: 37686 - DNA, 1446 bp, Bovine  19866880872985
acaaacctcctacctggaccctttcagaacaagaggaatggatccacaggtgtctggatgatgttaggctctgtctcttcagccctctttaagcatgagaaagtgagtttagtgagtagacacactgacgacaaactctgtctaaacccaggagctctgtcgtgttttcttggattcttgggccggctctgtgtttgtggcaagtgctcagaggtttgctctcacagtcacacctgcttgcatttgccgtaattaacccgacaattgcacttggggttgctgttcagtggctgactatcgctgtataagaacgtgccttaaccgccatgctttttctttttttaacttttactgaccagtagaaaagccactctttacccgggatgcctcccaattgaagggaacgtttctcagcaccacactcaaaaagagcaacatggggtttggatttaccattattggcggagatgagcctgacgagtttctgcaggtgaaaagtgtgattcccgacgggcctgcagcacaagacgggaaaatggaaacaggtaagtcccttaacactttagaaaatggttttgcaatgtcttttctaagacaaatgtgagaagcttctttttgtgtttttaatttgaaggtcaaaggtcacttcactgaagggaaaccacaaatcatgtctcccctgaatttaataacatcaaattgaagtagtttggaactctaaatatcatttttgtctcatttttctgactgtccctctatttgctggattcaatgaaccctggagattgacacttttctaatttatttctggagtcccttcttagaaatttgattaatatttcatatttttctatcttataaaaagctattgatgttttaaaaatctgtgttaatcttatagtattctcaggctaaattgtccaggttagttatttaaatatgcttgcttatctcataggaaaaaaattattaatggtattcatctttatatattcccataaagtattttaatacataagattttttctctagtccttataaattaattttcatatgcatgtacttgggacgtctatccaattatgattaaaattcatttaacatggaaatgcagagtctaattgttaagggcagggaaatatgaaagatgcacaaaggtagaaaaaatcgtaatgaactaagtttgattttgcagtctggatttttaaattctcctacttggtccatgacctagaattagtcccataattcatgaatactactttccttacctggaaaatagagaagaaatcaaatttgatcttgtgtatttagaatattgattcaagaatttgagagtattgtttttgaaatgtcttcagtacagtccagtccctcagtcgtgtccgactctttgtgaccccatgaaccatagcacgccaggcctccctgtccatcaccaactcc

SEQ ID NO: 37687 - DNA, 1045 bp, Bovine  19866880919232
ttggaagagcacaggctgaaggctctgatactatttcctgagttttgcaaaagaattattttcatcttaaatctgtccttttcataaacagttgttttgttactcttttaactacagagttggcagagggagtacaaaagtgatacaaattatagcatgttcttgggattcctacattttctcaaaaagtgattaatagcaatttcattaacccacatttagctatcttccatctaaatactttcaatccagccagggggtaaaaatgcttgtattctagcatttctgaatggaatttctgggaattaataatttttaatgataattttgtttttaaaaaaatgatctctgggaagtcttgcaaaaatctaaaaaacaaaggagagatgtttttagaacagtgtctttaaaagaggttctggaatgacctgcactggaatcatctggtggatttaatgcatcttctggatcctcatagaactaccaaatcagaatctttgaggtgaagctgtgaaatctccatctttggctagcactccaggtgattcttatacagtctgtgtttgaaaactacattatgaatgaactacattatggttatgaatagctcataagcatacagtggagctaaactatttgctgtgaatagctgtctcaagttatcttatctgtcaatggacaaaatatcaaggaagtgacatctgtgaggactaaaaagaatgatcaaagtcacagatgtagaaaagtgaggtttgtatagaaaaaagttagaatgtaatatgaaagggaaaagtggaaaataggttagaaatataaattaaacccatataacaagatcttcgaacacagatgtaaggaagtcaaaattacaattatgatgtcaattcacacgtattgtctgtttcttcaatgagatttaaatatattttatcatattacagtgttagctaaataatctgatgaatcaatctgcacttaaagcacagttcagaaaagtttcccaggtagcatatttaatagcaaacttctagagattaaatgccta

SEQ ID NO: 37688 - DNA, 1798 bp, Bovine  19866880977341
gcttttgcaaaagctttactcgtgagattttcatatggggttatactttcagatctgtcagagcacataatgtagaaattatagatatagaatatttatttaagaggacatggcctaaggatgtgacactaattttgattaattttctgccttcataaatagtttgccaaaataagaggaccagtgaaatggcctcattacacagcgctgtgtgttagccattgtctattattatactttctggtaactgatttgtaaagcgtgcttttaatgttttgtttaaaaattcattttaggaagattaggaatggagaacattttttggaacagctactggcatgtttagtagaaaaaaataacctatccaattttcccttgcatactataaaagaatgatttattgctagcagcattttgttgccttggtggagataacctctttttacacttcaacatatatgggagatgcttctattctatcctcccattaaaaaacaaaacaaaacaactcagtttggagaaagaatgttatcaagattagcctcattcattccaaatatttactaactgctatgtgctaggcactatgcaaggcattaggaaggtgtttttttgtttttttttttccctataatttttactaatataagcaattttactgtattttaactttaggtttgtgaaaacaactacgatattccctagaggaagttttatatcttctttatctctctatattaagagcctggctcacagaaggtgtggcccatagtaagtaaggacccaagtgctcagtaaacgagcagatggagaataaataacacaaccttccccacgtcttccagaatagcccagaagatagtctagcttcatgttcctgcaatgttaaccttcccaaagtatatttctaaagcgtgtcctttttcctactaaggtaattcaatggctctccactcctccttaaataaaatctaaacctcttagcttggccatttatatttctaaaatctggctccaaactacccttccaaatttatttccctcttgaatataatgtatgcccttttagttctgaaataataaagggtgtaaaaatacctggggagctggttaaaagttcgcattcctggtcctacatcccctgagtttctgggacaatagttctagggtaggttcattgcctttcattttgtggacattctccaggtgactttgatgcacgtgtttagcataccatacgtgagcaacactgttatgttttgttaaaactagttttccctggaaggcacaccttttcttgctgactctttggatgtgtcgctgttgctctcacaccaactgttttcattcattcactcattcaaacaaagcctacttgtaattgtgctgcaaataactgccccattcagttaaagaaaagttctcattttctttttgtaaacatttgctcaggcagcaaatatttcatacacggtgatactcacttattagttagttatggtttgtatataaccaagaagaaaaaactcaagaaattccttttgtcaaatccttcaggtatctaggaaattcatccgcttcccccgtgcagacatttggatgggtttgaaatcttttttaattttcactagttgcactattttagtgcaaaattgctttacacagtttctaagtttaatattttaaaattttactttatgaacagatgtttatagtaagaggtcatacaaggaattcaacagtgtacacaggtgtgagttagcaagaatctctgaactctactgcaatagcccattat

SEQ ID NO: 37689 - DNA, 1262 bp, Bovine  19866880988823
tattgagctgcaaaaatggaattgggtccctcaaatttaaactttgcatcatgtatagttaagtgactgcatagcagcatcctgcacatgaccgtgattattaaatgaatgacagtttaaaatcttcctggtgtgctgaaggctttgcagaaaacaaaggggtctcagaaggtctgttaggattgctgcaaaagcacactgtatgatcacccacattgggtcttgatatgaagtcacagctgggaatattacaattattttcatacttatgagaatataattgtattttatgatctcttatgtgataatatagacccaaaaagtcagtgaaggaactaaagaaagaaatgctgtaaattatcacagagttgtagtctgtcctcctagagtagggctttaggttgatttcaatgtttccaacattttgcagagtcaaaagagatgattttcattgcctcatttgctaaaagcacatttaaaaactaactttaaaagtgagccttaaagttcatttttctttttggcaattgtaaattttttaagaaaggtgttatcatcatgaatgatgctaaagaaatacttgaaagacctaaaactgtaaaactcttgtaagaaaacatagacaaagctccttgacattggtcttggcaatgattttggggggggtatgacaccaaatgtacaagcaacaaaagcaagaataaacaaatgaaactacatcaaacttcttcatagcaaaataaatgaccaacaaagtgaaaaacaaccccctgaatgggagaaaatatttgcaaatcatatttttgataaagggttaatatccaaactgtatatggaagtcatattaatacaacagcagcaataacaataacaacagcaaaaaaaaaaaaaaaaactgattaaaaagtgagcaaaggaactgaataggtattttttttccaaagaagatatataactgggtaacaggtacttgagaggcgttcacatcactagtgatcaagaaaatgcaaattagaattacggtaagctatcatctcatagctgttagaatggctgttatcaaaaatcaagaaataacaagtgtttgtaagaatgtggagttaacagtttctacactgttggtggaaatgtcaattggtttacccactaaggaaaataatagagtggatcctcaaaaattaaaaatagaactaatatttttacttaaaaaaccaaaggaactttttggccagctatgtatatgtacacacacacacaaaaat

SEQ ID NO: 37690 - DNA, 1840 bp, Bovine  19866880993284
ttatagtactcagttattcaattaaacagtaatcttggcattactgtgaaggtattttgtagatgggattagcatctataatcagctgactttaaggagataatccttaataattagggtggacctcatgcaatcagctgaagggctttaagagcaaaactgaggtttccctgaagaagatattctgcctcaagactgaagcattagctcctgtcccagagtttccagcctggccaacagccctattaatttccaatctgtgaggcctcacgattttcataagccaatttctactgattctgtttctctggagaacattgattgatacagagaccaaagctcaaactttcctgaaaaagagtggctctgatctcctatttctgacactatacagtgttatctatcaaactaaatttcatttattaaacttattgaaggaaaataaagatttgttaaatattaaacatttattgtggggtttcctaggtggtgatgttctgggtggggaatatcccctggaggagggcatgtggcaactcactccagtattcttgcctggagaatcccatggacagaggagcctggtgggctacagaacatggggttgcaaagagttggacgtgactgagtacacacacaaatgtttattgcattgtggggttgaggaatttatttaaaattgggtcaagcacctggttacctttaggtgaaaggtaaaaaataaataaaagaaaaaaatcacttttgagttttagtattgagaaaggatataattttcatcaatttcccctattcatattctactaatatgaattaaatagataggcactggctttcaaaatatcactttgaaatctttggagttactttgctggaacaaatttattgtttttaggccaattacagatactacaaactatagcaataaccattttggaatagtcgtgcatactataaaagactccaatccatgatttaattgtttatctgagtaaaactcaagatttcatagctattctcttccatgcaatctgaaatttaaaatatcctttcagagaaacacaaaattgaaagtcatttactatagtcatgaaatgctaatgagaacatttaaaacagtggtctggctactcagccaccatgcacttcataatttataggtatattttatttattcaggttattaaaggatgtgtttgacatattatcagactgaccttgcttcttggcaaatgctatctgaaagtctctagagttaattccattgccagccattcttttcaaggacagcttcttattattctcttggaaacaattaacagactgtcgtacagaataacatgtactaggtcctgaaattctttattgaaaaaggcccagaaaacaaagtggtttcaaactttgactcttgagactcttaatttaggataactttttctctgcacttaaattttagaaccttcaactattatgaaaacacattagctaggaaaattattttaaaaagaaagccagaacatggcttaagttaaagctgggattcagcctaacctgctttattatttccactaatatttactttgctagacaatgtgattttatgctcagtttgacattaaattaatttaaattaattaatttaaattaatttaataaattaatttaattgacattaaattaatgaacattaaattatcattaaagatatgtttttatttaataaataagatatgtttttatttatctggaacttattaaggttgaaaatcaagcagaaacattatggattctcctttcatgttgatttttttttttaatcaataagattgaaatcaacagt

SEQ ID NO: 37691 - DNA, 1846 bp, Bovine  19866881040027
caactgtacttctcttctcttttctttctgtctaatatgggcatgtggaatgtgtggggcattggaaaagaccctgatgctgggaaagactgagggtgggaggtaaagggaatgacagaggataagatggttggatggcatcaccgactcaatggacatgagttgagtaaactctgggagttggtgatggacagggaggcctggcctgctgcagtccatggggttgcaaagagttggacacgactgaatgatgaactgaaccaaatatatggggcatgtaaagtgatgagatcctttctggcagcctgggaaaatgctaactgaagaacaacagatgtagtctgtccactaaagtaggctagaatcattcgcctaatataacatggataaactcacattttgtagtccaagatgagtcttggcttctgaaaatacattatcaatttaaaccagttcttctactacaaaagtaccacgttagcagtcacaacaaaagaacctcttgattaaggtgaaagaccacggtgaaaaagctggcttaaaactaaacattcaaaaaactaagatcatggactccggtcccattacttcatggcaaatacacggggaaacaagggaaacagtgaaagactttattttcttgggcttcaaaatccctgcagatggtaattgcagtcatgaaattaaaagatgcatgctccttggaagaaaagctatgacaaacctagcagcgtattcaaaagcagagacatcactttcccaacaaaggccagtatagtcaaaactatggtttttccagtaacaatgtacagatgtgagagttggaacataaagaagggtgagtgctgaagaattgatgcttttgaactgtggtgctggagaagactcttgagagtcccttggacagcaaggatatcaaaccactcaatcctaaaggaaataaaccctgactattcattggaaggactgatgctgaagcttcaatactttggtcacctgataggaagagccaactcattggaaaagacactgatgctgggaaagattgagggcaggaggagaagggggcaacagtgaataagacggttggatggcatcaccaactcaacggatatgagtttgagcaaactctgggagatagtgaagggcagggaagcctggtatgctgtagtctacagggtcgcaaagagtcagacacaactgagcaactgaacaacaacaagttgtctcaaagtttacttacctaagaaaacaataacaaaaatggttgtctattcattcagggactggctctatcttttttttccatggaaaaatctgcagaagtttctgagaattaatataaattttcttccattaactaaaatgaattgtcacatttgttttggaagggctttcttggcctcatatttcactaatactttatcatccttcacaatttatcatagcatctttcagataaggcaattttattggtatttacccactatccttattatgaaaaattctgctggttgcctacccaatattttgtctattcttttttatttagaaccagtttagtttcaggcctatcacatggatttcagacccagaacatggatccatggatctagtcccctacctcctgagctgcccttgcaacttccagcatctctgtcctggccattgagacctaacacagaaggagggggtttctttattcattaaactaaaacttatatctgatatcaagaccctttgcatccatttcattttggctagactgggtattcctgtttgggacttacatggactcttcgctctctgggagacttgatattctgatcacaaaccacaaagagag

SEQ ID NO: 37692 - DNA, 2465 bp, Bovine  19866881051036
aagtccttaaaaaaaaaaagatacctagcctccaaaatagaagctttcaggtttctaatgacctcattatgtaaagataaatagggtttgaaagagcttgaaccaccttctgtcccctgcagaggacaaataaatcatgttgatgtctcctagacccacttaggaactcggtggatctggtttgctttctgaagactcactggtgctgtgggctcacgctcacccctggtcctgctttagtggggagtggaaaggctgaaagatttttcataatggaattaagcagtgcagaaccatgttttacggtacgagatacccctccctggctggtaacgtgctcctgctgaacctggtacttcatcacagccgacatttcatcttcctctatcttcatctgcctcccacatgaaggagaaccagaatatcatcttccttctgtgtggatgaaggtcaaactgtggctacagccgctgctcctgctgatgggctgctctgactaatgatgactaatgttttacagagaagcttgaagaacctgcagcgtctaccttttcaatgagatcagtgttcactcctaagtccttattttctgcctttacacctgttcccttggggtctccttcactctcatggctttagtttccgtctgcgtgagaataattggtagtgttgtctttctcactctgacctctactgtctccacttctcagtcccatgggtcccttgtttctctctcaactgttactcactcgttcattcacttactcgtcattaaaccaacagctgttggatgcgagctgcaggaacagcacagtgtctgtctggacagccgagctgctaaaacaaggtaatagttgatgctgctgaattggtcacacctgtttcctctgtccttgccccctttctcctcttactgtcacactcccctgaggtgagcttatttatccccagggcttcccctgttgtttaagatttctaaatctacttctaaattagcccatccttccccggaggccaagcccaagtgtcccatctgcatctgcactggccattctataggactccaataatgctagtctctctcctgtaaagcctgctttacctccaacagtccctgaatctataaaaggcacgaacaatcacccaagctggcaatcttggacttgtcccatattaaccttttcctcctcctccatagtctatcattgccgaaggtgccacataacttcctgcctacactactgtaaattatctctaaaacagtcattcctttcctttactcttgtcctctctaaccattctctctattgaacaaggacataagaaagaccataaaaagtttatgattcaaactcagagaaaggactcccaggttttcctcaggtcagtacagaggctatgatgaaatcagagccctgggtctgtcagataccacagtctactctgtgctgactggaatatcagaatataagtctcttaagggcatgggtcatattattactctggattgaagaaataatcagacagaaaaaaagcctaccccatgaaacatgatcatgaacaacacaaatgttgaaagctttgcagatcatcaataacccagtcactgcctggagagttaaggatgtgaagcagatacccctcccccttctctcacccttcacagcatttctgggtgtgcagctgccacacctgggatttgtgagtcctcaacctatattttttaatgacatcattctctctataggaagattagaaaaacatgtatactttctcactctgatccctagaccatttattatgtcacctttaggtaaaatgttttcccctttcaagaatcttttgtacttaaaaaaatgctctcccatacttgacctagtaagtctggagaaccatgcagagaggtgtgttttctttctttatttctttttaaagagagtcagttttgagatttctggaaataggaactcttttcttaaagtacttataaacagggaagttataaattgtggtatcacattccgatttagaagaaaagataactttcaaaaggtctgagactttgaagaaatagtaacaaagaatttaaggaatatattatcaaacagtttaaggaatattaatcaagtgaaagaggaaagtgaaaaagttggcttaaaggtcaacattcagaaaactaagatcatggcatctggtcccatcacttcatggcaaatagatggggaaacagtggaaataatggctgactttatttttctgggctccaaaatcactgcagatggtgactgcagccatgaaattaaaagacgcttactccttggaaggaaagttacgacctagatagcatattcaaaagcagagacattactttgccaacaaaggtccgtctagtcaaggctatggtttttccagtagtcatgtatggatgtgagagtggactatagagaaagttgagcgccaaagaa

SEQ ID NO: 37693 - DNA, 2193 bp, Bovine  19866881063610
agataatgaaggacagggaagtctggcatgctgcagtccaaaggggacagaaagagtcagacataacttagcaactaaccaacaaaaggaaaaaaaaatgttggtatcagaaacaatatggcataacctttgctaaccatccataaccttaaatggcctggcttttctgggaactgacaattcaagcagaaaaatcacatttaggacattgaatcaggaggtataaaatatctcttacaaatggactgatgtggtaacaaagatcgtacatgtttgttgaacagagtggaagcggatgttaatgcagcctagcaaagacttgaaaggcttctccttagttaactgtaaagccaattaggaggtctttctaagggcacatgagcccaagtaagacttttcttttatttcctcatccaaacacttctttccctctaataattagtaatgtaatatgaatgatgaactcaagcaaagtgtgccttatagtagaataagggttgcattatcttttccttcagggtggcatttaaaataacagcacttcgataagttcattgtttctccaatttagatccattttaacttggctactgcttcactagttgacactgatttcttatccacattccaactatgggcataaaatacaatattatctagagtgttcttgccttggaaactgtcatcaagtcatttaaataaaagagatactgccaaatattaatgaagattagaaaaatgctatgatgtagagatccctagggtataaaattatggttttatgcacaaatttcagtaccaaatgactgtatttcttttactgaaatactcagtgatactctaaatattgcaaattctgagaaagtagactgaaagtgagctgtccatttgctatataatcacatgttcacaatggccttttctattggtcattgagaccagttcaatcttgaatcaacaactcagttcaggttcctgaaaatcatagtatggttttaagaaaaatgtttacattaagacaacaatttaatagtcaattccaagtaaactgtaactgagaaatttttgaataatttcacaaaagagttttaaatcctatttaaaatagtcaagtgaatagagaaacatatatgtccaattcaggttcaaatgttttgactatcattagtattctttccagagcataaagtatataaaggaaaaataaattttgcttcatcttcataatttatctattcaagaggtaatgccaacagagctgtctgagtattattcccacataaaaggagtatttatacttaaaagtcagtcataggttcaccctttgtcaattttataattttagaccagtttgcattcaaaggacaacatttgtaaaataaagggtaatgctatttatgcttgcagaaggattttatacattttcacctatgttactatcatgtaagctgttaattatgaagacagttattaaaaattgagatgtcttctgattctttgggtaatgaatttaagtatagacatatgctttttagcactaaagtgataatattatttattcatttctagacacaatactccttttttgtcaagtagtggtaagataactcataaggtttagatgtacagattttctattgtgaaaaaaagacataaaattacttttttgatatacagaaataggcattcttctgttggtgcaaaaatagaaaagtcaaaaggaaatcagtggaagacaaagtgttcatgttttgaattatcacgtggccagtaggtcatggtttgcttacttttctgcatttaaggctgtatccatatatgttaagcaagacttttttcagacataaaagaaatgatatgcttatttgccattgtgttgatttaaatacccctgacactacaatgattttttgagaatgacttaaaaaattattgcacttatgattaaaaactacagagagaaacttatgggactaggagctttggagacatgaattagcatggagacaggagtcaacctatactaggttaactcatgctaagatgctgtttactttgaaaggcttctcctccatttaccttagaaaaattaatcaaacttaatgtttctatctaggagatggcaatggcaacccactccagtattcttgcctggaaaatcccatggacggaggagcctggtgggctgcagtc

SEQ ID NO: 37694 - DNA, 751 bp, Bovine  19866881079054
acctaaatgccgccaccggtttaattccgagagaattcttttccacactaaaggaaaaaacagcaatgttgtttcagtatgctagtctccaacatgacatgatgctgagggatttttaggataattctgactctatccaatttttcacttcatgtgctaacttcagaacttagtctaagatatggctccaaagtatgtggtgatacagactggtagcatgagacaatttgtagttcattcacaagaaacctaacatatttaatccagacagagattaataaactgtacaagctaactatttcacaaattacggaatgatgacaataatttacttgttattataacattaccttggcaagagccaaacagaattatccagtgaaagatggtggcagttttctctgggtctggcctagcaatgacctacacagaacagaaataggcgatccctcctccatcaggagagacagcacatctcacaacaccctaggacctctcagtgaaaaaatgacactccccacatctacctgctcacactcctctcagagcattgcctgaaactcccttgagcaacaaggcccaattgcagactgtcctcccttccttcaccatggccattctccagttctcatggtcctacagaaaagatggaatagaaggagagagcatggtccctccctgggagcacgcaatggtgtttccagttatgaccattctcgtcatctctccttgggataataagggctcaggg

SEQ ID NO: 37695 - DNA, 847 bp, Bovine  19866881102886
ttctaaggatattgttttcactaattctaagtcactagtgacctgcaagctatggacaaggtcaatgtcaatatcaaggccacatattcagtaataagtatatgcaattgaataaaaaattagaaaagaaaagtaatattatcacaaaatcccattataaaaactgaggtaatttctctttgaaatgattgtatggtccaaaagttataatgccattatagaaacacatttaaacaaacataaagctaaatgaattcataatatgctgcttctgctatggcagaatgatacaaaaggagaataagaggggggaaaaagtcctaatgctcaagacttgaacaaataagaatgtctagattttcatactactttttattggtgattcaggcctttcctaagcctggcatgcggcagtcatggggctgcaaagacaaacatggcttagcaactgaacaataataacacctcatatttttgagtgcttgttattctgtattatcaggaattattctttttatttcaaaaacttttgtattggaaaagccaacttacaaaatcaattattctctaagaccatcttttattttttaaagtatgtatctgtattcattatttctaaatgcttaaaaagcaagatttaaaataaaaaccacagagattgtttcattccaatctagtgtcacaatttagcacatagaaagtatttactgatacatttttaaaaaacaggtgtttttgttttttcacaaggtggatatgtattatccttaatcattcctagtatccttagagaaatagattttgtgaaaaccatgagtattacacaaatactagagtcaatgtgttt

SEQ ID NO: 37696 - DNA, 1318 bp, Bovine  19866881129707
taggatactgactcacaaaatgattatttctctgcactaaaataatgtacttttcacatttcaaatagcaagtaaaccctactaaaatttaaaattctgaagttatttttttatagagaggcatagttattgcttcctttatataatcatttctatgcactatatttctagtcttgcaaatatttattctttagaaacttaaaagtcactactctgagaaaagagttttaaggtagcaattacctcaatcattactctcaattactttggaaatttaatagtgtattcttgcttttattattacctcagtatctttctctatatttattaatttgtttaactactagatctatcaaatgcttttaatttagcagactcaatcatactatttagcagaattcttaagttgagaacattttgatctatagataatcctttaacatatttataatatcgatttccagtattttagttgttttattgatatctttaaagaaccaaaaaataaaaaagttaaatcaagcaatagagtgttagctaactgtaggataggagatgtagaatttcaccacttaaagagggttatcttcataacttaggcagtaaaatatatatatatttatatatttaatatttattttaatatatatgatttatatatactccatgattcaatagtaagacacttaactttgtttaaactaagactaaacttttaaatctacatttgatgaatactagagtggttttgcccacagtactaggaaaccctataatcctggaacccccaataaaatattcatcttttgaatcatggcaaaataatgaggaaaggctatgacagcttgctggatatatatttacttttaattctgatttgtagaacagttaatgcctgtacacagcaaggtcatatttgttaattagactgcatacatatgtagagataacccatagaaggttttcaggtaatgctttcccgtgcagctcaataagtcttcggcgagggcagttaacagttcacctggttactgcatcacttgagggccttccaggtggttcagccataaacaatctgcctgcaaatgcaggagatgcaggagatgtgaattcaatccctaggctgaaaatccctggaagaaaaaaatggcagcccattccagtattcctgcctgaagaatcccatgaacagaggagcctggcaggctacagagttgcaaagagttggacgtgacataatatgcacgcagatgcaccacttgaggaaagtttcataactcaggccataaaattgtccctttttgcttgattagcatta

SEQ ID NO: 37697 - DNA, 2027 bp, Bovine  19866881297063
tttggaacacagggtgttacaaatattcataagtatgcagttatacattgtattaagttggataaagaagaataaaaagggaatatgagagagattgacttcagcaactgaaaattagattggtgagtcaaggataatctctcttaggaagtgatagttaagatctgagatgtggaagagtccagaaaagagcattgcagagaaggggaaagtttgtgaaagagcttgagaaaagaaagaacttgaattggagaagcagaaagctcttgaagatggatgatccaaaatgaaccctataatgtagtaagatgatatgtgcaattttattagtcatgtcattttttgttcctcagcatttcctctatgcatttcacagtgtttggtgtatattaggtcactagtaaacatttaatgataaagcacataagcaagtttaatggtaacaataactaaaagacagaagggtaattgtagtatctactgcttacgattgtgagtcataaataagatcactaatagaaggggctgatctcagagcctggcacatagaaaatgcttgataattctaccttaaaaaaaatgaagttcctatttttctcttgatttgttctaaaaaactattacatgaaatgttggatgacaaactttacaacttttagtgaaataacccctatgtaatatcacaacattcttactaatcacttgaattgagtgtgtatcaattgtatcaatgtgttttcctctctggttcctacatggttgacagaggtaaatgtctttcctttctcatccatacttctggttgttgctaaacagtgaatcatcaataattgttagggggaaagtgatggcctcaaagcttgtatctccctttgagtatcaaaaatgtgcattattttcagtagcaaaagccaagttacaaatctagttttaaatacagttttgtctcaactcaattttcttgtctctgctctggaaaaccaaacctagcaattcttatatgtggacatagagtccataccttctgattaggagctctgtacttcaaaccaggcaatttgctatttccttgtttctaaataaaactatgaagattcctgttgctgcgagaaagtctattttggaattattattcttcctacttaaatttcctgtcaaattggaaacaaagtactcagaaagatacattcatttttcttagttattagtataatgacccaaatatgatcatattatcaattgcttagattcctcaaaagtaaaacattgaatcccatagataaaatcaaaatatgctccatggttgttgtgaaattatattcttataggtcattgtatattttaaaatataaaatttttgtacattttatattttaacatccttaaatacagctcttaagtttaatgccattagctagatcataccattcatgggaaggtaagttcagttttctctgttgcttcagtttaaacttgaaaaccaataaacatcttgtaaatgactgttcttgattgcaaacactgagcaaggaaatatgggtgggtcagtgtgaactctttattcttactaagaaaatgacataaagtccaattgcatagaactcaatagaatcattttcatgtattatctatggataaatgttatattatcacttatatgtgtaaatatgaatacaaaattcagtgttaaagataagataaaaagtgaagatatactagacaaagcaattctttcatttttgtccagggacgtgatggtaaatcattctatctctgggaatgagtgctgctgctgctactgctgctaagtcacttcagtcgtgtcctactctgtgtgaccccagagacggcagcccaccaggctcccctgtccctgggattctccaggcaagaacactggagtgggttgccatttccttctccaatgcatgaaagtgaaaagtgaaaggggaagtcgctcagtagtgtcccactcttcgcgaccccatggactgcagcctaccaggctcctccgtccatggcaagag

SEQ ID NO: 37698 - DNA, 1085 bp, Bovine  19866881316771
gactataaagcacatgaaactctgctcaatactctataataatctaagttgaaagataatttgaaaaagtacagatacacatatgctgctgctgccgcttcgttgcttcactcatgtccgattctgtgtgactatggactgcagtctgttgggctcctctgtctatgggattctataggcaagagtattggagtgggtttccacaccctcttccagggatcttcctgacccagggatcggacccagctctcctgcattgcaggcagattctttaccactgagccagcaggtaaacccagacacaagtatatgtataactgaattactctgttgtacacctgaaactaacacaatatcattaatcaactatacttcaatataaaataagcataaacaataaaggaactagcatgacaagcattagtggggtgtgaaatgctactctgggaaatagcagagagattgatgttactagagcaggctcctggtgtgagcaaagaggactgacagaagataaaactacattagattaagggtagatggtaggtattttgtatgtgactaagaacttagactttatcttacaggcaactggaaatcgtcaaaggtgtacctatacaaaaaagatcacttcaaaaatatttgggaacggtttgttatctgagagagaaaacagtcttctcaaactttttaaacttaagtcattttacaagaccacccatttgcagaaatgccacacttaagaacttaagtcccatctttctcttgatcattcacaaatttccaattttcgaagcctaaaatatgaacatgtaaatgtttttaaaaggttgttaaccaccatcccacattgtcttcctttagagactgaaaaccgtctcaagtaataagaacattttaatatctcaataattttaatctgcacacagaaggaagcagggttcacaggaaaaaccacagttatctggattagggtatgtcttttggtgaaagactgccaacagggagctgtatggttttgacaaaatcagtcttgctctatgggcctcagtggtcttatacatgacatgagaaaaaccaaaatg

SEQ ID NO: 37699 - DNA, 938 bp, Bovine  19866881352156
cacacacgtttgtcaactgaacttggaataccttatgatcaccttttgatcgattacctctggcctgtataattccaactttccaccttccttttgctctcttttctgatctttcttatagttcaaaaagtcatcattaaggtaaggtttgaactcatgaccttgcttagtattagttaagtcatatttcaactttgttaaatcaggttacatggccaaggtctgaacagtacttctgggtaaaattttggtataagtgataattagaactgagccatcagacttaagaaaagaagaaaatacatgtcccaaagctatctttatattgtactattcattcccagagaataggaaaggatcagtgaaataggactttcaatcaatatacccttttccagaaaaggtaaactttttcatttcaacctttgtaggttgttatcatccagtgtggtttcaggtttcattttaaatggagagctcttaaaagagactgggtatattattaaactttatttgctttttatttctcaagggaacagttgtttgttctgatgactctcccatttttaaaatttacatatttttttattggaagcattcctcaaaattttcagttcatgggagtagttctttacttcttgttccttacttcctgccaagaacctttggtgtgtactgtttggtaattgccgctgttgagccctctgaaggacggttattcaagtgttagatttagtgatcctagttactgttgttctggtagcaataaaaaggcaaatgatgagcagactttcaacaaacagtcctttattagggccaaaactaccctggactaactccaccctaaatcatcatggcagactactatagaaactcaaaaaggtttgaataacaacaggaactctaaagtaacaaaacagctagcatgtccccgtgtc

SEQ ID NO: 37700 - DNA, 1163 bp, Bovine  19866881366226
ataatttaatcaactcaaataaatgttctataattttgcatttgttaataagatgactaagttggatacagcatgcaaaaagcacatgcttcattatgatgaaagtgcttttcagacaggatgctgaggcctctaggagtttaaaaagaaacattcttagggagattgtatctgggtgattaaaacaggtctttattaacttgaggatgacaagaacatttttcattttctccatttacttttttttggcactttttgtactttttttggcgcagacagcaaatagagtctcagagttggaaggagaagaatttccacaaggcagcaaagtgattagcgatgcagctggggttagaactaaggtcaccctaacttttcatgactgtgttttctaccaaaggtggtcatttagtcatttactaattcattcaacacctgctctggcacaagttcaggtaatggtgaggtgactaatggtctggagattcatgctcttatccttgaatcataataaatataatagtaatatgattttcacataatgatagagtacaacaagaaaaaaattattccagtggtgggcagtagtactgaaaaggtgacatcaaggttatttctagaagtgtttctttatgcactgggcacctaatttttttttttttttaattaatttagttcccattgttgacttggaggagttccagtgttaaatattgattttgtgcagaaaaagcacctatttttgtggccttcttgttctttacacctgaatgtgtgtgacttcagaagctttatgaaaggtttcctagcatttctaatattgtactggaataagaaggtttcttataatgtttagaatggaaaggaaagatacaaaggaagcaaagggaagctgttttataatctataaaatttaacaaacatttattgagcatattaaagtggtgttggcttccagagtttacagtttcttttggtaggcactgaaaatggaactagttactctgaaagcatcctgggaggatgatagaaacaatatatggagtgggattaagagaacagactctggagcctacttggatctggatttttatcctgactttgtctcttaagtagttgagggatcttgggcatgttcctactataggaaacagcctcagttt

SEQ ID NO: 37701 - DNA, 1023 bp, Bovine  19866881405459
acattttgtttgcattcacaagggatttctgcaaattcactatccaattaatgtcaatctgtgacaatgacaaaataagcagattcttaaatgagtcccatttcttttcagttttagatttgcaaagcatgaaaggattatatggtgtagtagagaaatttactcttctgatttataatgaagccatttttcctctatgaagatgacatcactggcatcaccaggcactcgtgtcaggtaagtctctagtaacggcagtgaattcataccaggttatccttgactggttctcattgtgatgtgaagcccgtacctttgtacaatgattagcagaatttacctggagttacagactatggaaaaggccaaaacaaagtttcagatcctaaattccaagatcttaaatgccttggaagtgtgtggtgagagctgaaactggcagacatctgctcagctgtcccacaaatacatagtatatattctgtttttaacacgttaggtatggcagaggagacagcagaagataagatcctggtctcggaataatttacaatctacatggaaaggtaaaaacatctacatttaaaaacagaaaaagatccacaaagagtatttatgaatgaaggtgcaggtgtgaattgatatacataaatactgtgtaatttcataataaataatgtgccttcatgtagcccttcatgactctcattgattcttaagtagaatcacaaagcaagcaaagaacagaagtggggtgctacttgggggttaaaaataagatgacttcaggcatgggcaatggagaggtatgtggaatgatgactagtttttcagagaatggacataggaaagtacataaattgtaagttaattatcatagttggaaaagagtatttatgctagctaatgagaaaaggttatatgtgtaattatataaattgatagaatatttttgatttctaggttaattggaaacttctgtagtgtctaagaggaggaacaccatatagatgtaatgggaaa

SEQ ID NO: 37702 - DNA, 942 bp, Bovine  19866881407385
tgatgccatccaaccatctcatcctctgtcgttcccttcttcctcctgacctcaatctttcccagcatcagggtcttttcaaatgagtccgctcttcgcatcaggtggccaaagtattggagtttcagcctcaacatcagtccttccaatgaacacccaggactaatttcctttaggatggactggttggatctcataaacataaatagagtcaaaaactatattggctcatgaaagcttcacactttctctttgtagaaagatatttttatgtataaacactatttatgtttaccaccatttccccagtttagtttattctctgaagaaatgtcacatttacagacattctgttcacatattccacaaacactttattatgaatccattaggatatatatttgcaaatattttagtttcactctgctttatcccttaggcagtgtcatgcacgtagtgctgcaaacagagtagtgaagcaagaatggaatggcattatcttgctagttaccaagtctgtcgattgttcctttgtcagttcctctcaattcctctcaagaaagagtcctttcttcactctgcattatcactgtcacaaaacaggctcctagtcatttcttgcttgagatacctttatcaaagttcttgagtgcaaacaatagaaaatgattctcatgatttaggtagaaaatgaatttattgagactgtttggtagcttacagaatgacaaggaaattgggaaaaccaggcttggaaaataagaaagtgagttttcatagccagaacgccaaccctgagtcatcacacatgaacaggccaaggaagacactgttctctggccaaactgccgtggctgccccgacaaccagtggtgacagtttcgtccatcactagaataaattcttcacggttgctgcttctttgcaccactagttccaaat

SEQ ID NO: 37703 - DNA, 1090 bp, Bovine  19866881506335
tgtttataaaataggacagtcccaccaagatattcccactacagtcataattaaggtggatatgaatttctaagtgggcaaggcaaaggcaggagagtaacaaatgctgttctctaaggctctccgtaactctaatcacagttaaactccccagcctccacgttgctttcttcttccctctactatgccagaaagtcacaggaaaaaaagaactaaggataatattctaagctctcacggttccctgccaggtctaaaagcagttacttgaattatagtgattaatgttatctatttttgagttttaatgtgatcttgctatttagaaatagaatgagaactacttgtggtttttagtgagactgccttctaaaatttatggatattttccactcagagcaatttttcaagtcatcaagcaaaaccctgcaacaatatctttatggagctacccagaagatttctaaatataaaagatcagtggtcagttatcacatctaataacctgacactacttaactgctcgtttaaaaaagtaaatggatgcctagatatggtgtcatgccaaagctgttgttgatggagatgtaagcaaacctttgcttactcaaatagaactgattgggtaatatttatagatcatgctgtatgaatgtcatttacatattgtgaaataaaaatatgagccacctggtatgtgccttctgatggtgccatgctaagtcctgagacagactgggcttacgagcgcagacatggacatcattaggaaaactggctccagatctaaccctgttggcctacttaaacgggagaattgcaaaagagtcacttgtttgttccatctctcaatttattcttttataaaatgagaattaaaatatctccttcatttcctctttcacaggactactgtgagaatgagatcatgcttgtgaaaatacttttaattttaccaaaggaaagttctccataaaaaatatgatgatgtatttcttttgagagccaagcacacatttttatcgccatatcgcctgtgaggttaactgttttccatgtggccattcgcttcaggccctattgaggccag

SEQ ID NO: 37704 - DNA, 932 bp, Bovine  19866881621879
tacctgtccatgacattttctacctaggaaaaatattcctcaagtattcaaggtgaaatacaaacattcctaaacatacaaaaatgaaaggaaaccgtcacccatagtgtctaaacctatgccacaagaagcagtaaaggaagctcttcagtcaaacagagttggtatttggcagaaacttagatatttaggaagaaatgaagagcacacagaatggcaaataggcaggtaaatatgaaaagaaaactgaaaattaataatcaagtagttattgatagtaaacccaaagaaaacaaatgatatttcaaatgtccactgtgaactacatggacctgctgatcacttctatgttaaattaaaatgatttcgagtaatacacctcacactcttcaggacttgtcaaagctctaaaatggtgtgatatttagcagtgagcattggttttaagggcatcacttgttggtattactatattagatattcttgacacaaaacagggagcacacttgggcaatcattataaaaagcatctcctttgtgaaattaattggaaaattcgatctaatgtttaaatataaatctaagtccatcaataaacagattaaaacagctttaaaactaatcaattctgttccctgtgttagcttccatcactacattcatcttcctttttgaaaaacaaatttaaagaaaccacagaatgaaggtaaataccctgatatttcacataagctcacctgaagtgacaacatccatccagttatactggaattaccaagttactttctgtaatgcccctcattgctctaacatgctttttttgcaccttgattgatggtctcttttatgaaaaatgtattttgcgacacctaatatgcttttacatgtgctgaaattcaacctttggagacaaaggcaatatcatttatatt

SEQ ID NO: 37705 - DNA, 1573 bp, Bovine  19866881949458
gtcatctcttttgaacgttaaagaacaggaattcaaatggcttgaatgcataatctatgaaggaaattcacaatatgatatgaacttgagtaatggcttgagaaaactagcctagagagcggtgcttggttcctggtgctcctgtttacagtctgctgatttcctttgtttcggttttccaccagtgtcttcttcccacctttatcatctgaagcatgaatagcaagttttaaattgtgtgtgatctcagaggatctcaaatctgcttactctttgatgagctcaggggctgagaattatatgcccagctggtcagggagaaagtagacataataccctttccccatcctctacaactctctgtaaaagtaattttacttgatgaactagttaggacagcaagccattgagaaatcactctcatcaaaatgaacctcccccctgccactaacacccctgccacccttttaaaaataattggctgtgtcagggctagtgtatttcacttttctccttctggctgaacaactaaaatgttttcaaagggctctgtagttagaatgtctttgctctgatagaataaattttttcactgtgtaatacagagtatgaattcatggtgttaacggtcattatactgaaaaaataggaatgatttcagcacagttcttaataccttttctacttcagtaatcaagtatttattaaatacctacttgacctttagcaccatgaggagacacccaagttgagttctatgttctgctctcactaactgggagataagaaaactaagtgtaaatgagtagagatcaggatacagcagaagtcctaactcagaaggtggaacataccctcctgtccttgcttgctggattttgtggttacatttagggaatgtcaagagatgcttcctcctgtttttggcccttctttagtcatttgcttccatccttttgtggtttcctgaccaatgcaagctttattacccaagacaaaggcagcattgctgtttattctgtcttttctttatggtgtctaatactctttgtggaaaggaatggtttatgacctttttttaaccctgaacaaattctgatttctttatccagcccctgcaatgctccttctgttcattgcctttccactcctcacctgtgacaaacctcgcaaagcaatctgccttaacctccgtgactttctttttcggtcctcctccgggagctctgtacccctttgtgtctgcagccacttgaacgacaaacatcccgactgcccgccccatgcccctgcacttccgtcagcccagcccgtgcctctgctgggacctcttttcattgctcctcgcccccacttccccaccgcgttggtcttgttttctcagctctctctaatgtttccaaggacacaatgatgttttcggggtcacaactcttaggagccaaaagagccattttctttcccattcttctctctctgtcctgttattttgtaacactaaatggagtgtgaatgaaacacagaaatcatgtcaaggaaagaaaagctctgctctgaagattaaggaaacaaa

SEQ ID NO: 37706 - DNA, 915 bp, Bovine  19866881975596
aaggagtcaaacatgactcagcaactaagtacagcagcagaaggaactaagataccacatgcagtgtggtatgtcccaaacaaactatatataaatatatgtgtacacacacatacacacacgcacaaaatctagtccctaactgtgaaagtctggagaatcatcactttggtcaatacgaaaggaaatcaagcactgataacacacatcataataaaaattgggaagcccatgtactaatttacaatgaaaaattactctcacaattataagctcaatgatcttgggctacttattaacctgctgaacctcaccaccctttcttcataatgaagagaaagtcaggaactgataggccatgtgcttgatatcagctttaggcttcctggacaaggatggatcattacaaaagtctctctcattacctgagcctctcttatccaccaggcttacactgaagaagccattgatcctttgttcccagcctaagggctttgtttagagattctggaagattgagatttatcctctggacaaaaatgcgtgtctctaactagaaatgattaactaagtgtactatcaaaaggtaatccaagaaaacctgtagtacttcagggattggccatgatttttggttttcctttcttcttattcctgctttcttctcttgatctgtgttttagtcatttcatattcccagtacccagctggtcatacatacattacagctctcaatgttagttgaattaaaataagttacaatacatgaaagtttataaatttttactctctttaattttaataggttatcaggtatgttgatgacactttgaattaacaatcacacttttacaactaatgaatcggaagataatttttgtgaatagagccatattcagaaggaaaaaacatcca

SEQ ID NO: 37707 - DNA, 912 bp, Bovine  19866882270120
tggccttttaaacctcctgacacatttcttagcatggttttattgttaaatccaaacattaattttttggatatgttaatgaatttcccccaagacgcttgctgctcaagtgaacagactttatcaaacactggcagttttgagcatttcattttgagtttctaggtccattagatgccttgcaaaccagaggagggggttatttttgccctaacaatagaaacaaaaatcatttcaataaagaatgaatatctatttttagagaatgacaataattttaaaaaatttccctttgactaggactgttgtatgtcctagaaattctgtggaaactttgagatagcataagtgttgataatatacagtcttaaaagcaatgacctataaaaaacaagatttgtgtataattttatttctgtgaagaattaaatataatttctttggattcagcaagcaatttccttcttcccataagatattcagaagagctcaaagatctgtacacagtatagggactaaaaaacatttaatgggaagagagttaaatgaatgcatttttgcactcagtacagttcacataaattctacaattctggtccagtcaaaggttttgatattacatatgtatagtagtcattccatttacttacatgtttattgctctagcagtatctaacacattgcctttaggatgcaaggctaacaataaatcagaataccatggctttgaatgtccctactgagttttattaaaggataatcagaaaccaagataaaacatttcaagaagattgcctattttataccttatccatattttcatttgacatggtctgtgcatatagttaatgttaagctttctgtaattgccttcctttaaataagggaacaaatatttcaaagccagatagg

SEQ ID NO: 37708 - DNA, 744 bp, Bovine  19866880791803
tgggtctcccgtgttagcaggcagattctttacccctgagccaccaggaagcccagatcatcatcattatcgggcagtagtagtggcaacttccgccctccccccagcgtttgggtgcaggtcacaggaagtgctcagtaggtgtttgttgattgactgaaggatgttagtaactgcctccttctgtctcccctaagccatgcatgggacatttgtgattctgctgccgctcagcctgatccttatggttttcgggggcatgacgggctttctgagcttcctcctgcgagcctcctgcctccttctgctcacggggaccctcttcctctttggaggtaggtgcccgcctggcatggagccccaggtgccgagagggtctgtgcacggtcccccagaaggaaggagggtggaggagactgcattgcctctggggctcggtttgccccgctgtgatctcctagctggaaggggtgaacagatttcctgcccagggtccctgggtctgtggtcccaggagagaagcctgagggtgagagcaggttctgagaatcatcttcattgtttcataaaagaagccgagtcccgagagcttcagggtcagggtcacgggctggcgggagaccctcgctgtctcatgcacacctgccatcctgacacattgctttgctttgattgattaaaatcaggcaagtcaggcaatggctgggtttcaaagatgggatctaacacttgctgctgctgctg

SEQ ID NO: 37709 - DNA, 1558 bp, Bovine  19866880595713
ataagaacagatagaattaaaagaaaaaattgaaaattccacaaccttagatattttatcaatcctctttcagcaattactggaacaacagaccaaaaaatcagcaaagacatagaagatctgacaaatacactaccaaccacataaatatataaaggaaagaagagttgttagccttggaacattctttcctgctttctgcaattttcctggtgtcctcaattacagtcttggtcttttttctgatatgcaacatatttactctatttccccctcaaatttgtggctgcaaatgtttttattttactttttaaaaaatatctttcatcttacatcatttatgcagcatttctttttactctttcttcttggtcaactattttaaaagttctcttttcatatcttctacccatttctcctttttgttctgttttaaatttatacttcctcttgcagatttctggttttcttaaaataatagtggcaaacatttccaaatgctctaaatatattgtcttttaatcattttaccacaaccctatgaagtctgtactattataaccattgtatagatgagggcattgaggcacagggaagtttatttattccaggtcacacagccagtaaatgatggagccagattctaaccaggcagtcaaattccagcatctgttctcttaactattaggctatgaagtctgtctccctagactgccaaattaaatattttagttcttattttataataactctccttgtatttcctctttatctacttcctcattttcaaaggttttgttcattctatgacatattattattcataaattacttcttcttcttaaagtctttggttatgaaaaaaaaaaaattttccaagcctcctgtggtagactgaaaaatggcccctcaaaagatatccatgtcctaacccctggaacttgaggaaattattttatatggtaaactctctgtagatgtgattaagaatcttcagatgggaaggttatcctgtatagcccgccaggctcctctgtccatgggattctccaggcaagaacactggagtgggttgccatttcctgatcttcctgacccagggatcaaacccaagttttctgtactgcaggcagtttctttactgtttgagccaccagggaagccctggatcacttgggtgggccttgaatgtaatcacatgtatccttaagagagaagcagaggcagatttgacacacagagggaggagaaagcaatgtgaagtcagcagatggagatttgaagatgcaggcctcgaagatgagagtgatacagtcacaagccaaagaatgctaacaatctccagaagctgggaaagcagggaagagtctcccctatggcttctgaaggaaggaaagccctgctgacaccttgattttccagtgatactgatttcaagtttatagactccagaatgtgaaagaacaaatttctattcttttaagtctcccagtttattacagcagccacaggaaacacatccttttctctcagttttcttgctgcttctttcaggaaa

SEQ ID NO: 37710 - DNA, 935 bp, Bovine  19866880796223
aatgtcagctgagaaatgcacacacgtctctgaaggggacaggcagagcggcattgttcttgttcaagagaccttctggcactcttgtcttccaagagggttatgaactacaggccaaaacagctctgctgattcatcaggtctctgaccgttgtacaatgtgagggcacaacaaataagctggatggtctcaagaaggctaatatgttcttcacttaataataaacacgttagtcaggggaagtactgaatttcacttttctactgcaaactctgactcatcgcagagagaaacaaagaaaaattcaaagtcaacttttacctccatctaatctgcttagggtcatcaaaagctagatgttctgtgagccagatcatccattttcactgcccacactatccatttgttttcttcaaacagcattttacacgaaatgggaacaatagtgaagacaggaagagggtaaaccaaaccagtcaattactctcgagtgggcagatctgcttacacaggcacaaaagtctgcaaacgacagcttttcttcctgatcctttaagcaccgctttctgctacttcaactgttgacaacaggtcattcacaccctgctgaaatccattcacaccctgctgaaatgtctacagacaacttcagatgggttcctactacaactgaatatcaaagccgggaggaagactgactcaagagaaaagagtttctgctgaaaaccaaagtgaaggcaaaggaaaatgccacagtggggttttgacactcactgtgcatttaaatatccatccaatcctggtctatggcacagggtcccatcctcctaacatgtacatcacacaagaacacaagacccaccatagtgagaagagcgtgcatgctaagtcgcttcagttgtgtctgactttttgcaacccttatgaactgaag

SEQ ID NO: 37711 - DNA, 2028 bp, Bovine  19866880838544
tagcgtcctggtctttgggaaattggctgagagtgcgtgttgttctggctttgtgcttattctggacccagctctgacggctgtaatggatgatggggttcccctggaagttagagctctgtttgttcccggaggactggtgacatatcccagagcgagaagagttccggatctgcccgtccccggtcctgctgctcataggtactacatacaatgacccagtagactcccaggagatcttagcgaaccaggcacaaatttcaaaggcatcctgggtggctttaaagcttatgggtagggcttggtctctggctgtgagagggaaggcggagatcctccgccgagggacgagcggtgccgactgagttcctgagcagaagggaaaatgagcttgaagatgaggcttggagaagaaagaagggctggggagaaatatggtttttagtcagtcagttcagtcactcagtcatgcccgactctcttcgacctgatggactgcatcacggcaggcttccctgtccatcaccaactcctggagcttgctcaaactcatgtccaccgagttggtgatgccatcactttataggttattgcaagatattgaatacagcttcctgtgcaatacactgccaaaggtcatctgacataatagctgatgaattcaaccccagtggatttcatttgcaattttcaatttactgaggcctccaaaccccaaggtgataaaagtttcccctatcatggcctgtcacaaacatcaagaaatctcaaaaaaccacaagaaagacaaaagagaaagctgtgcttcctcgcaggtacagataaggagaataggaaggaatggtatcatgcaggaaggtacggagcagcttgttctctaaatgcaaattgaaaggaaaagacttacttgacatgtcctcaaacaaaaatgtgagtgtaaatatttagtccctgaaaagacagtatactctctatgttgtatttaccatagttttgatttacgaaatgcaggcttgtccaggctcttctatcgtggaagtgtcggttagcactaagaaatcatttgttttgttacagaaaagtggtagatcctttgtctgatttgcaaaggcagtcaaaggactggctagcaactacttgtaagtggatctaggcagtgtatatcaatgtagtagcaagaagaagaaagctagtttccccttgtcaagctatttacagtgaacttaggcaagatcagggactgaatcctgctcccagcagttgttcaaattgaggagaccatattcatgttccttggagaatggcaagtttaaaagccaagcagtccatcttcatcctatgctactcaactcctactacagccaatgaaaagagagcagagagatggaccgctctttgagaggcaactgctgggagaatttaatttcagacgtggatgtctggatcccatttctaccaaatagattcagaaagccttatgaaattggtctaatgaggcaagaggacttggcagtgggcatctaccaaatctgcctaatgacaggatttctcatgacagttgacaagaaaacctgagcatgacatcaacaggactaggatatttacttcatttgtgtgttgataactgtgagacaatcagagtttggacaggaaagaagataattcctggttgaactgatatgactgagaaagattgcctcttacagaatcattatttaaattgtcacagtaaaaaataagaacatgggttattcatcataattgaatccttagttctttgaaatttagctattaggattttctattagcaaaagtttaatgaccttttaattcttcaaactctcaaaatagaaaatatggtttcctcagcagttaaagatggcaggaattaacatttcaaaataagggatgtaaaattttattcttaagctgcagaaaatatggaaagtaaccatattttaatatttttttggtcaggatgctacttttcaaaggttatttaccccttgcccctcccccccctttttt

SEQ ID NO: 37712 - DNA, 1286 bp, Bovine  19866880854067
tttagactcctctttatctttcaatgactatttggacattggctgtcatgatattttatgtatttcctgtatgtattctgaatgcagctgtgctaagactctgagggcttattttagcacacaagaacagcttgggatagtcagaaatgcacgatatgtgggatcagcaagccggagttcaggttttggctattcacttagcagctgtgaagctttaatcccaaacatctcaagtaaagtatgcctaccctagaggtttgggacattatgctgtaaggtctcagagatgcaggataaatgcaatgccttcattcattcattaagcaaatattcactgaatgccagccattgaattataagtgaaatgaataagatggataaggtcactgttctcatggagactgagattcttcaaagagagacatgtaataaataagataatttaaaatacagattaatgctatcttttgaaaaaaaagataacatgaagttatttttaaaaggcttagtagaaagtttaagagggctggtgatggaatattattagttgtctacccagaatcctctttcccctttctaatagtctgttgttttcaatttgatgtctgttattaccacataccacccatgggatgggtactgattgacttaagctaaacatattcaactccccagtggtttaagggagctacataacctaaatagtccagttgggattctagcaagcaatcttggtatcaaagttgctttctctgcttttcctctcagaatcagaggataaagatataaagacagggattgttggagccgtcttgcccctaaaatggaaagaacttgaggatgcagataaggagaaagagcacagtgggtgaatcccaccgggaggtaagctaactgtgaggttggccttatctctgaacctcgaggttacaaaagcaaataaattcctttattgcttaagcaaatttgaaccagcttttctgtttattccacaagaggattcataatggatacagaatttgattccaggagtgggatgcagtaaaatacaaacctaaaacatggacttgtctgagcagaggtgatgaggtgaagagcaatggtctgctgggactcaggcttgtgcctacaaagtgcatcaggaaaaatggaaggaaaaattcaagatttgggattctagtaaggtcctacaatgaagcaacaatgttcagatgaaatgtcccatctgacaacagaagaaagtatggttttacttagaaggctctctcggatatgcaggcaagaaa

SEQ ID NO: 37713 - DNA, 1804 bp, Bovine  19866881236859
aatattaaaaagggaactatttgtggaggcatggccaggagtagggagtcagaaggaatggtgaaacaccacaagatgatgatggggagtggccactgctgcccttaagcttgaaggggcaagcttgaattcaatcgaattgactcaaatttaatcagacccataatgtgggaaaggagccgtctgagaggagtttgaccgtcagtcgagaaggaggaccagaacaacagagactgaggtcacaaacaccctgatctttctgccactccctctcctccttccagtgccttccatggactgaacccagcaggagcccactgatgcagttcttccaggccagcctgctggggtgcatggtagagtgaagaaggatgaaaatggatctggaggaacaaatggaaaaaaccctgcctgcccagacagtgagtacaggaaaggcctaaaaacattttttccctaaattttccctacattgtaatagctatatgactaatttacacttactgatggaaaaaagtatctgtcatatacttataccagatcatattcaacatagtggttggaaggttcagctcaattctatcaaggggctgaattctctcaacagggaggatgcctcgtatttaagctgtaggaagatccccaggactgacgttctccactgttgctgtcgttcagttgctaagtcctgtccgactctttgtgaccccaaggaaggcggcgtgccaggcctccctgtccttcaccatctcctggagttcgcccaagttcaaaatgttctccatagtcttctgtatatgttggagtgttaaggggtccagaactgacagtcctgttttttgtttaacacggacatgaaaaataggcagatggagattttttaaagtcagacttagcattgataaagctgatattcgaaagcagagcttagtagaaagtcccagtggatttcctaagagggtgctgcagaacacaacttaccttcctggtcagaagcaaagtgacaaaaatgcaagtctgacccagggccagggtcttgactgatgataaactcttgagcagatgaaaatgcctatttcatgcaaatggacagactccaaaagagacaagacagaaactgaggcacgttccttaattccttctcccaaattcaggggattaaacctgtccccatcccttggtaggacgagtttcaacagcatctaaggaagtacaaaaagagaccaatcagacagacctggggtttacccacccactgcttccagggatgttccatgggataaggggtttcagttgtcccccagtctctccaggaatgcattggtgcccatacctgacttcctgaaacccctgttggactgatgatactatttgtacagcttcgtggggaaagcagttccttgtttctccctgaggagcatctgtgtccccgcgttatggggacggaagcaggaggaccaggctacgtccctgcttctgtcctgcaggtggcaggagcaccatctggactgttgtgcacccggggcagcctcagaccaagccaaagataacactgtgtccacacacaggaacacgctgtgcttttccaggttcccaggaaaccaaatcacatcagaggtcaacagtgttgttagactatgggtactcagagtacgaaggaccaatatgaggccccagaacttccttctgtcaaggactcaagagccccctcctaggtctcctctgatcctttgctaactgggttctttcaagccctctttactccatatcagaagttctcgagcagcctaactcaaggacccgg

SEQ ID NO: 37714 - DNA, 1281 bp, Bovine  19866881350727
tggttgttgaggctcttctttcgctttgaggttaaaaacctctgaagtagtgttataaacatgaagaaaaaagtggaagggccaaagatccccttctaataccagcaattacagaacatccccattgtgctaagaggatgcagcctcaaagacactgattcctggcttccaaaattagttaacaaacaaggcatctttatatttaccctaaaaaaggaattcagaaataacggtgtgtagggtgcttctgcataccgtactgttccactgttgttatgctcttaaaatgaaaagtagaaaacccatgtaggtactcagtgcttgaatcttgcatacaatggtaactaaaactcttaaaactgtggtaatgaataatgaacccccaatggggctccacagagggtagaggaagttgttttggttagggaagtccgcagttccaactgttcatgtaccagtaattgctggaacagcgtatagaagatactcctgtctttgctgcccagtcagtcggcttttttgaggcttttagaagtccacaaatatgaatatatatatatatagtctacatctatatacatcataaatatgaggtcaggattcagcagatgtatcgactatagtttgctttggtggtgttgccaagacagcctctgcttcttcatgcatctagggaagaagtggtaaattattaatgactttctagtctatcaacagatataatctcaaaacttttagtttaattcaaacaaatatttttgaaagataaagttcagaagtacaaatcctacttacttgtaaaaactgtacatcctgaaataattcttgtatgaacctccgacatggaagtctaaatgtgcagtgtgacagcaaatgggaaacctcagagtaaaggcatatgtcatcaaatgtttgaggatacttctctttaattctaaaatgaaagaaaagactaggatgtgataaaaattataataatgacttgcctattttctttcaaaatatcattttaaaatatctttttcctctggatatatagatcaagtgacatatctggagtgagggcataagaatataaaatagtaaatattcctagctcacacttaaactataactattttaagtttcggctatctcttaaaatgataaaaacccaaatacttcttagaaagtgagaaatattctttttcactggcctgagacattacaaaatgtatttactggcccagaataactcagtattttaaagttgcaggatataaaatcatcacacagaaatcc

SEQ ID NO: 37715 - DNA, 798 bp, Bovine  19866881675834
cactttggctgcagctttaaaaggcttgtatgttaatgtgtaccccctatcttccagagataaagtgctgtttcattggcattactcaccatgtcaaggctttctggtaaattctttagtccctcaccttgcgggaaaaggcatcagtttaccacttcccaagaaatgggctgttcataatgctatgttgtaatttgattcttgtgaggcattggtggaagacagtaatggcccagagtcgatgatgatatctagaggctgacccttaagagatgctccttaagataagacccgttttcatttgactgtagtgtcaattcagttgacgaataatgtctgactcttaatcatattactatgattcagaaaaagcaccactttcaaactgtctaggtgtttaatccaaaattgtggttgtggtttagtttctaagttgtgtccaactgttgctatctcgtggactgtagcccacagtcatggctttttccaggcaagaatactggagtgggttgccatttccttctccaggggaatcttccagacccagagattgagccgggtcccctgtgctgcaggtggtctcctgcattacaggtggatcttcaccaactgagccaccagggaattatataacagtttttagttgtttgggggcatagaatgaccaggcaggatttttgcacttaagaaacttacaaactaataaatgaaagaaagccttatatggccataggactgttcaggaaagttcactgaatcaacctgagatggtactgtgatttggagagggataataat

SEQ ID NO: 37716 - DNA, 701 bp, Bovine  19866881802322
ggacaggactgaggcgatttccttttactttctacctattgccgagagtgaggcaaatgtttttcttttttcttttttttaaaagtgcactttccccaggtctacgatgctagttttcctggtggaaaatgatccctttcttccaggaggaagtgtatagattttctatgtgggagaatggtgctgattcaccacaagcttttatttgcaaactctcattatgggcaaaattattattatttctctttggtggctctgaggtttttctaagaaccataatgaggatactcttagaaaaggaagacagtaactcaagcaatcatttttctggtttgcttttatggtccagtctagaaactgcggctctcgccatatttctatgtgagcccagctgactttctgcagaaggaggtcctcatttaaacagcaccttgatacaatcatagctcagcaaaacctccaccaggagagactgggacactaattatgtctgagtcaaagatgtcacaaaatgtttaaatgccacaaagttctgtcagctattagtgttagactgtgttgatcacagcaagggccagctacaaggggggtggtctctcttggaacatctcaagtcttgacctatggggtgaattcctccaccttttggaatacatgggatgttctggaatgtcgtgggatgccctccatgcctggcagtt

SEQ ID NO: 37717 - DNA, 903 bp, Bovine  19866880362545
gtgatgacacagggccaagctgggccacggcctgctctcgggggagtattccaagccagcaccagagtcgggtgatggggagcaggtaacggagcagaaggtgggtctggacctccgtccctctcaggctctggaatggtggggaaactaagatccatctgggaggtgtctaaagaaggccacttggtggcctcttgggccctggctgaatggctgccccaactctgcctaggaagtccaagatggcatcgcccctcggatgttcaaggccctcattggcaagggtcaccccgagttctccaccaaccggcagcaggatgcccaagagttcttcctgcaccttatcaacatggtggaggtgaggacagggaagatggggcgatcttcactctcctcctgtctacctgcacttcagttcactcccttcttcccgctgctcacttgttcctcctcctctgtcagccccagcccagccccaccccagtgaccccgagcactgagcctttcctgagagtggcgtttgcacctgaggacacttgttacgcttgcagcctgatgaaggatgctcccaaagaaaatgataggcgagcacttggtgcttagaaagaaagtacaggggacttccctggtggtccagtggttaagacttcgccttccagcacaggggggtgcaggatcaatccctggtcgggaacccaggatcctccaggccaagaaacctgaaacaaccgatattataacaaattcaataaatttttttttttttttaatatttagtgctggtcttagttttggcgcacgggatctttaatctgtcatcgtggcacgtgaactcttactcgtttccacaagtggcatccagctccccgaccagggatcgaacctgggcccctgcattgggag

SEQ ID NO: 37718 - DNA, 1656 bp, Bovine  19866880585982
taaaacaaggcaacgtgttaattttagtttaggactacccagtgttgttgaccctgttcgctaagcaacccttggctgtgcatcctcagttcacggccatcaagagatcccctgtagttcagtcgtaaccctgggaccataccttgaatcgtggcttcagaagatatttttccagcatacctaaatggatttactagcttgggcagtgcccagacctcaagtgtgtgaagagtacccaccctactaactgctgtgcagctgtgtatgccaacagcaaaccccatctgtagccagggaccatttgtatttatcctgttaataatgtgactgacagtactctgctagtaatggaattataatagatcatcaaggtataaaatggcatttctgggcacagttgggcactctcagccccttatatcatctaagaaaaatgcaagagaaagttcctagcaatatttaataagcggtaaaggaaatgtggtcataggacccagtttgtattgcctcaatataaaattaatatctcccatgttaaatttgtatttacaaagaggcttcttttgataattaggggtgctgttgctgtctttgtagacatccttagtttgcatgttttcgttcctctctgggctgggtgttatgccagatcaacttccagaacaaacccgggagggcaccaggcacgagtaaccctctattgctctttctccccatccaggttaccccttcgctttattttatcggcgttaccttttctacaaggacagctacctcatccaccttttccacacctttacgggcctctcaatcgcttattataattttggtgagtgaacctagttagcaccacaattacagggagcctgagaaggaacagacccagacaaaacgtcctggagggaatctaatggagagggaagttgtgatgctctgggagcaaagagagggttttatgggcaggaacacagcttagcttctcccttcatgtacatttctctcccagataaaagcattttgagaatggttacccttaccagagggacttccctggtggctcagcggtaaagaacccacctgccattgcaggggacaagggttccatccctgggtcaggaagatcccctggagaaggaaatggcaacccactccagtattcttgcctgggaagtcccatggacagagcctggcgggctacactccatagggttagtcgcaagagtcggacacgacttagtgacgaaaacaacaaagcaacccttacgagtcgccatccacagagaggcaccggttgtctctgctggggctagaactggccaacagacccaagcagttccgccaggagcatcccttaggcccaacatccagaaatacaagcgctccctggcagtcctgtatttttatacagttaatttccttctcttcctccaaatcaggagactccttaaaaagaagaaagatccaaataccaaagttttttttttttttttctgtatatattcttgtgttcagaagtgtcaggaagggtggaaatgcaaggggggtggggggaaaacaggcaacagtgtgctttctgctccacacccaggaacccagctctaccattccctgctctgcatcgtgctgcagttcctcatcctccggcgagggccgaac

SEQ ID NO: 37719 - DNA, 1947 bp, Bovine  19866880729419
tgtctagttggccgaggctacactgttgctcccttcagggggtcgtggaggagaaagagggcacacaggcccgactacgtacacctgggtgctgaagtcctgggtggggtccgttggggcgttctggaagatcttttccagcttatccacgtacctgagccaagggaaggatcactgaaggggctgtggccaggcccagaggaaaagggaaaggagtggtcatctaccagttcagggaagaggtccctccagagtggggagacatgtgtttgacacttggggtccacgtctttccagcaacacgccttccctccccttcccaaaccggtcagcatgcagggtacacaagcctctgccccgagacggagctacgggatgggagaagacactcagaaggataaatacagttcatattctttgaatagaacgtgtcaatatgttctaaattttcacatgtgtctcaggccttcctatttagacaggatgctcacttccctaaccctaacttgcctttcttctgtctccatgtcccagccctcccctctcccccattaggtgctcatctgatgtcactggcccaaaataaagagcacctgttggcccttgagcccatcaggaggcctggaagagccctgggactgagcatctggccctaccagtgggctcgtatataaacaacttcacaacctgctccctggcatgtaccaagaaccaagactgagctagaacagaggtcctgagggcaccagaggtgggcgcccagaggctggccgctaggagagagctgggggtcagggcacagagccaggggcctggctgcggagagagggcctgggggcgggggctggcggcgggggtaaggaggactcacttcctctggaagtcggggatgctgaagagcacctggaccaccgagttgaggtagcagctgttgcccaggttgcggatgcccggtgtagccgggcccggacagcggcttgagcggcaccgccgactcctggatcagctcccactcgccgatgcgctggttcatgtctatctccagctccgtcatcgtcttgtccgtctgcacgggaggaggcacttcagacctgcgtctttttttctttttaatttagctgagccaggtcttagctggggcatgtggaatctactttcctgacctgggattgaacccaggccctctgcactggaagcacgggcttttagccactggaccaccagggaagccctagacctgtgtcctttatgttctaaaacatagtctaggatgagagccagctggagagagcctggaacgtgatgaattatggacccagacatggaaggcctattgggcatcccccagtgcaagttctggaaggccacaggcaaccaaccgtccaggggcccatcaggcaacaggcctccacccacatgaggggatgaaacgaacatgacatcccctagctgaaatgttcctccaccctgaagccaccccttctcactcagatccccatcccagcatcgcttcctcggtcccctgggcccggcgacccctgctagaaactgcgcacagtcatggtcattccctgctgcacaagcagacaagggacgcctgcgtctcacctggtagaagcctacaagccaaggaccacccctgcctcattcagagtgaccagcacacagtaggcgctcagtaatagttgctgaatgatgaaatgattctacaaggcttttcacaggcagcccacgaatcctgggaactggggttaccgtggcatctctccccaccttgtcgcctcaccctcagccttgggcaaggaaggcaggcctgacgggcagggatgagagaatcctgagcggagggcggtctcaccttctgcatcttcagcatgtcgataccaaagtgggacaggtgctcagccaggttgggatccaggaccatgtcatcctcgtcatacgaga

SEQ ID NO: 37720 - DNA, 2561 bp, Bovine  19866880799841
cacagacttgttcctcttattcttcgtccctccagccggctccagtaagacctatagtctcacctgaggccctgaccaggaggagtttctcacctgcaacctccccaccatgctccaccgcccccccaaccccacccctgccacatctcctatcgggcccctgggcctggggaccagatgaatgtagccggggcctgtggccgcctccctccctcctggtcgagggggccttgggtctgctcctccagatgctctcctcctcgtccccattttctactccaaccctaacccttctctgatgacttcttctctctcgattctctccctcaccactggctcagatcccgggcagcacgagggaccagcccagcctggcctggagggtgaggctgggtgtctgcagcacgaagctcaagactgtcattgtacggggagaggaccctgggaccagagagggcagggactagcccaggatcacacagctagtcaaggacagattcagatccaaagttcctcctgactgccagccagcagcatttcattctgcctgcatctcactctgccttggcagaaccacagactcacatcctgacctgggcacaatcaggcaccctgggcacactcgtgcacagacatgattccttatcacctcagcagcacggctctgtttacaaaccagttcctttgggcttgtttgtctatgggcttccctggtggctcaaacgccagagaatctgcttgcagtgcaggagaccggggtttgatccctaggttgggaagatcccctggagaagaaaatggcaacccactccagtactcttgcctggagaatcccacggacagaggagcctggcgggctactgtccatggggtctcaaaaagtcggacatgactaacaatgtctatttcagcctcacgaaaatcctgcaaggctgggtagtgacaagaccaagactagcatctccagtgtatcgaccagaaacagaaggcagagaggtacatgatagtttagcttcacacagctagtacgtggactagcccaggtctcttggctgctagtcccactgctatgtcttgaatagagggacaaataccatgcaggtctctgccgctggctggtcacagatgcccggtatgtcccttgtccctccatgggagcccttcttggcaggagtttgcctcagagagttcaggatcaggcaggagggcctccctgcctagaatccctccttggtcccctgctggctgcagaatcctgttaccagggaacaaaacctgcagttctcctaatcagggcacaggccctgtgggagagagtgtccagtgaccgccactcaccctctcagaaccttctggaaggtgagttttgcccggggcgggggagaggtggggagctggctggaaactgaaccctctgagggcacctcctgtgaagggtgatacccctgggcctcagtctccccaccctgcacccccttctttcttcttccaaatgactcaggatacagaaaatctcggggttacaagttttcttcttcctcttcttgatccatttctcccaagatccccagccttctctgccccactctcctcccttccctttctcatcacctcccgcaatccccaccctttccccttcttttctttccaatttgcctctttcaggaagaacacccagctgtcgccaggggtccccatggcttgcttgtattcctgacctatccccacccctgcctccctgagctgatagaaaaatacaacagacttaactttaaggaagatgctcttcatttgtgcgtatgtgtgtgagagagagagagagagagagagaagggtgggggagacattgtgtgtcaagtctcttcagtcgtgtccgactctttgcgaccccacggactgtagcccaccaggctcctctgtccatgggattctccaggcaagaatactggagtgggttgctatgcccttctccaggggatcttcccgacccagggatggaatctttgagggggaggcagaggtggactctttcctggggatctggaatcttctgatttgtggggtcagacccagaggacaggttgccaggtttgcccccaagaagcagatcaagtttccctggggagggaaaaatcctctggaggtggttagccacctccccaccccaaagggccctgagtgtgcgcgtgtatgtgttctactgaaggggagagactgcagggaccgtgtgtgcgcgcgccacgtgagaaactgcgatgtgtgcgtgagaactgtgtgtgtcccccacacaagtgtgagtttgtgtttcaggaggaggcagcagtgtattggggggaggtgcatccttctagccccttgtatcccacaagcagccccagcatggccaccgcccctcactcctgcagcctccagcacacgctcgcgtgagccttcatcctgggagcagcccttacagatacactggggaacacacgcgtcctcctccccgggccataccagcggcctcttggagcctgagttcgcggggaaaaccgggtgggtggggcaggactcgagccagg

SEQ ID NO: 37721 - DNA, 1227 bp, Bovine  19866881094564
tgccctgccatggacaggtgacaggagtccaactacgggcttcttactgagacctgagagtcccgtatgatttgttttcgtttatttctggctgtgccgggtcttcactgttgctcaggctttttgggggttactctaagttgtggtgtgtgggctcctcattgcggtggcttctcttgttgtggagcacgggctctagggtgcacaggcttcggtagttgtggcacgtgggctcagcagttgcagctcccaggctctagagcatggagtcggtagctgtggtgcacgggcttagctgctctggggcctgtgggatctgcccaatcagggactgaacctgtgtctcccgcattggcaggcgggttctctaccactgagccaccagggaagccctcctgtggttttgatgcaaaaattgaagtttactatcaactcttcccctacaatcctatgaggtggaggtaaacaggctgaactcagagttccccgagagcagggacagtgaccaccattttgcatctccagctgcgcacacgctggtgcccagcaagcgccctcggctcctgaatgaatgccgacatactgagcaatctgttcaaagttcaacggcctaggatctaggtctccaggcacccagtgggcttcggcacagtatttggttctcctgtttttctggcacttcgctttagagtgagctgggaaagagccttctgtgcgtccacaaataccaaagacagaagacaccccctgcagggctggtgagatagtttgtagatagacttctcatagatttatttgtgtgtcatgttatgtatagatatatgtatatatactctttttatacaatctatatcccctcccgttccccaccaaactcacaagaggaagtataaatccttccaggatggccgtcaggctttcgaggacagccagggccaagaaagaaccatctcatgacagcttgagaacagctgtcttgaggctctggggtcactggagcagcagtgctcccaggacctgacgtggggagagatgggaatggctgcagagggacaagattctaggctgcgagtgtccagcgactcctagaatggcaggctggctcccagagctctcggcatgggaataaaagtgggagccctatggctctttggatgctgcctgaacaggctggggggtggggggcaggcggggagaggcatgcaaagcgtgggcggcaggaaagga

SEQ ID NO: 37722 - DNA, 862 bp, Bovine  19866881151974
cctcgccaccaggcaggccatccgtcatcatccattgtaccaagcagggcccccagctgagccttcgttcaatctgttctctaaactgtgactcatcagcttggctgcctttcattctaaagtgaccagagcacactgctttcctgccccactgggggcgccaggaggcaggatggatctgaggctcatcctctctcacccttctctctagctacttcttcaaacgactcaagttcctcggaaataaagttctatcccagggtctctcgttgctattcttggcgctctggcatggcctccactcagggtacctggtctgcttccagatggagttcctcattgttattgtggagagacaggtgagccttcaggatggcgggcagagggggcctgagcagaggagcaaggttgagtgagcccgttccctcctccccaggctgccagcttgattcgagacagcccagtcctgagcaggttggcctccatcaccgtcctgcagcccctctactatctggcgcagcagaccatccactggctcttcatgggttactcgatgaccgctttctgcctcttcacgtgggacaagtggatgaaggtagccaggggcctacccgccaggaggggaagggactgctgagaggtcagacaggcggcggggacggggacagttccaggctgtcatctaccgcggaggctgcgtgtccccacaggtgtacaagtccatctatttccttggccacgtcttcttcttgagtctactattcatattgccttaccgtccgtaaagtgatggtgccgaggaaagagaagttaaagaaaatggagtaattcctggtaagtacacctccctacaacttgagcg

SEQ ID NO: 37723 - DNA, 988 bp, Bovine  19866881704255
ggccccagtgtatcccctatgcagtgctgctggaggcgctggccctgcgcaacgtgaggcagctagaagacctggtcatcgaggccgtgtacgccgacgtgctgcgcggctccctggaccagcgccaccagcggctggaggtcgactacagcatcgggcgagacatccagcgccaggacctcagcgccatcgcccggaccctgcaggagtggtgagaccccaggaagggaggggtgctttggagagggaggagggctgggcagggcagaggatgtgagtttgaaagggaaggaggaggggtaggggccggagggagaagcatgcctggagtacctggtgtgggagggggtggtaaccttgagtcgtggtcccctggggggtgggtcacccgtctcaggctggatgcagctcccccgctctgtgaccagcactgtccacaggccactggcctctcccacgtctgttttctttgtgttcttgtgtgacttcggtttgttaacgtgccttcctttttccctctgtaacctttgccaccctgtttctgttttagctcctactcccattttgggggggcttccaaggaaggtaaagaacctgtctgcaatacaggagacctgggttcagtccctgggttgagaagatcccctggagaagggcatggcaacccactacagtattcttgcctggagaatcccatggacagaggagcctggtgggctacagtccatagggtcgcaaagactcggacaggactgagcagctaacactttccctttcccgtcttgcacatcgctccaggcactgcctgtctcctccctcttcctccctgagtgtccttctgtcctgggaattttgtcataggcggtctctacgtgccctggcgaagcttctagctcagacagggttcccgacaccaggactgaggggtctccctgagtcttttcctcggaatctgtggtcaacgccctcccacgcgacctcctccccg

SEQ ID NO: 37724 - DNA, 851 bp, Bovine  19866881787506
agggaggagattggaacctggggaaaccgggactcgctccgagaggccgcctttgagaagaaaaacccggcgtattctggggtagaagtgggaaggtgatgcctttgtgactcagttttctttccccaactccgggtcacctctgaccctgtttttccaattccaggcgtaggtacttcttggagaggggcatgtggggccccagcagtgtggttcctcctgcaagtgatgaggaagacaggacccctggagggagacttggagggaaacggtttctgggagggtggcttggagtgaactgggcaatcttacaggcactccaaacaagttgtgacccccaccccacagatccccagagcacccactgcccctctagctgtggtttctttaagagggggtggatcttgatttctgttttgtgctcaaagatttccctttgtgcacgcacttctctctactggggtaggtactctaagctcccttccctgagggtgccatcggaggactggagttgctttggcaactggaaggggagtggctgacagatggacccctgggatggactcttgaggggtagggtctgccattttgttgccatggcaatgatccagtgggatgtccaagagatgggggctcagaatcttgacgggggcctcaggtttttactgtgtccttgggactcttggctgagttctggaggatgtttctggtgctgctggtggagaggaggttcctcggggcctccaccatcctccatccaggtgtctttgggaacaagtagacatattccttgcagatcatgtgtgtttgttcaagtccttcctcttaggcagggggaggatagaaacgct

SEQ ID NO: 37725 - DNA, 1397 bp, Bovine  19866880661157
caaactagccaggtctttttaccattattttaggggtaagaaaatggaccagagaaataatgtaaagtacccaaataacccatctcctacatagggagctagattttgaacctagaattgaatgcctctaatgaaatttctaaaggaaaacccactaatattcatgtcttataaagaagagaaataatatttagctaaggagttcatgttaaaatgtctttcaaatataagatcttttaaaccatgaaaaaattatcaggtggaaaaaatgtgtaggatcctggttttgaagagattcataactaaggcataaaagttaaaatctatatcctaaggtgaaaatgttttactgcttagcagttttgtgacatggttatgtttgtacaaattgacatattgattttaagatgtaaaaaaaaaaattcagtatttttcaaaccaaatttctgtttaagaaagacagaatcacaatttgccttaaaatgcagtaaactgagactgagaatttgaatgtttaaaagctgaactttctgagaaatgccagaaatacaattatttagaatttgactgttgctgcctcacattgagcagtatttagtcccttctcccttctctgtgtgtgtgtgtgtgtgtgtgtgtgtgtgtgtgtgtgtgtgtgtctgatgtgagagaatatttgaaatgtgaaaaataacctttttctttcccctatccctgatggtgttaccatatggctttagcagttggtctcatccttttcaccctcctactatttatttattttaatcactacttgtgattagtaaaatgaagggctctatgtgtctattcctggctgtattcttgctccgtagtttggcccctgatcattcaatttcccttagctgcagagactgccatctttaaatgagcataatgttactcaccagttgaatgaaatccttaaaaatgatatttccttatattttaaaagcgtttctattatctgtggggttttttcctcctaaatttcaaaaccatctgtgccttctcatttatgaccaagacttttttgagtttcaaatttgcttagagctgacaaaacacaacatctggatttcaattcaaggaggaaggctcatttgaaagctttttaatgcccctggaccacaatgagatcaaattgaagaaatttttttatgagttgagtgcaaatgaattagaaacatgtggattaaatttctcttaaacctcaaagggaatttaaatattaagggaacgtgcttttctaactgcttcttgacttctgccaaagtcagaacacttgaaaaaagagttggtgatatctactgaattcaaatgtacccagattttcttctctaatgtataaagaacattggatctttaataaaggggaa

SEQ ID NO: 37726 - DNA, 2068 bp, Bovine  19866880723416
aggatttaaaacaaaacaaaacaaaagaaaccaacccagaaggtactcatggaaaacagagaacttggggatctaggaactcttatgcctctgcctgggagcaataaccaacgatgttttctcttggtcatttttttcagtaaaaatgatatgccacagaataaaagcagctaatccacaactaaacaaccaaatgggggctttcctggaaatcaaccatcataccttggtataccttcaatcatactgaaatcaatcaatcataccttggtatacaggacaggtgctggatgtgaatttgcctttttatcacacagaatattggaaaaatgtgttccagaaatgagaattaatcagatcagtaattttctgccattgccttgatttgcggtaaagtaccagtgatttggggagaaggccatggctatgcaccttcaatgcaaatatcaacacactacaaaaggtgaataacctcttggtattataaaaatagtttcccttctgcagatccccaaaagggtctcagggactcctcacagtctgcagaccacactttgagaatcaccacactgtgctgctgctaagtcgcttcagtcatgttcaactctgtgcgacccaagagacggcagcccatcaggctcccccgtccctgggattctccaggcaagaacactggagtgggttgccatttccttctccaaagcatgaaagtgaaaagtgaaagtgaagtcgctcagtcgtgtccgactcttagcgaccccacgggcgacagcccaccaggctcctccatccatgggattttccaggcaagagtactggagtggggtgccactgccttctctgcacagtgaggtttacatgcacctaattcttagggccatgttctttagaatttttattttattttttattatttttaaaggttttattttttagagcagttttatattgacagagacattcagcagaatgtagttttcccatgtatctcctcccttcacatgttcagcctccccacaatcaacaccagcgttcttttatgcattatagccttaagtttttatttaaaaattagtaagttttttcaaccataaacataagccaatttaattcaaattggccttgttccttttcagaaatttccctctatacaatcactgcctctgaattctagaaaataaagagaaatttgaatgcatcaaacattacttcaaagtttttggtggatattagatcgtgcttacagagcagggcagggcaaatagtctaatattggagaataagaggcacaaagcttaagacattgttgagatttctttgtagccaaggaggggatgaataaattataaaggagatgtaaaagaaaggcttgaaaaattaatggaggtgtaagtgatcaaactagctgtgatctgatgtgaagtcatttaattctgattatatcagagaagcagcaaccatttatgtcaccaaaaggtgccaggcaacagttttttatggtaatgccacttcaaagcacccatatttatggcatgttttgcaactgtatgttgaatgtatgaacatatacaaggtatattttaaaaaataaagcttctagttcattagttttattaattataaaatgactttctccacactaaatttataacctcctgatattcttagtaacaaaaaaaatcagtgaaaaatacccagtgaaaaataagtaaatggaaatttatagatcttcagtgtttggtgattcaaacaaagctcagtattaatcttgatgtttttcatggaacgctcatgtaggttagatgatgcataggtattggtgttcccctcagctctgcctcctccaacaaataattcaatgaaattagaattgaatttttattttagtgaagcagaatgtcaatgccatttacgtaaggatccaataaatatcttgagtttccaaaatatggtgctggtattttggatgcttgcagtaagccaataagtggttacaagttctgattccatccatgctgaaacatgcataaagtctcatttgctcagggcctctcagctccaatttaga

SEQ ID NO: 37727 - DNA, 1090 bp, Bovine  19866880783852
aattatataattaatcactgattaagtttaaagacaccttaaagtcccctgtctctaacatcaaggaattaaaggaaattttctaagatcacccagggaattcagtgttaaaggggaattttaggataccgttcttttaatttttggatgtactttattaaacattaaactctattctgcaaagattttcataaaatttggggtgaattttccagattagtaccctctaagctccctttctgaactaaaatagtaaatgtttagtaatttgctctatttttaaaagaaactaatatttttttccccctatgtaccagtcattttatcagtggggaaaatattttaactaagagtttaggcatttttattcaatatcttgatctggatataatgtgaatatctgatgtagctttaataaaatgatttagaaaagcattttttaatttaattcaagtgatttgctcatcagaaatttatcatgagatttgtttctctgagttacccttattgagtgatgatggttaacaatgcttttaaaacattcatctattgatggtttctttgagagctggtttatttaataaatttcaaattctctcctccagtgtttcccctgaagcatttcttaaaaccagcttgtagtctcattattctccagctcatcttattatagtaagaaagcaaatattattgaattggaaaaggggactgaaaataagcagtgagaaaagtcaacaaatgtctcctttgaattagagctaaaaaataatgaaatatatgaatactgggatcaaaattgttaaaacaatgttattcatgtttttgatagcaccagaatcttgaatcccttatgatggaggctggtctctccaggtaactgggatcatgggccagtttcactgggcagcatttagagcaccatacgcctttccatatgaataagagattgttaagacaatggagttagccaaagcaaaggctataaaggaaaggcaaggtccacctttgagggtcatttagggtgatgaaccatcttgtctcacctgagactgatggagttctctggatacagaagtttcagttttaaaac

SEQ ID NO: 37728 - DNA, 1589 bp, Bovine  19866880802774
ttaacgacactgaaaagcttgggaatgggaaaaaaacactctgctaattgccatcacatgtctagcaatgtcagcaggctacagaaaaactgttctaagaatcagcacttttattattgagtcagcatttgagacagtgatattagctatattatttccatagctttataactaagcaatgagagaaagctctaatatcagtcataacatgttattagaatttgcttatattaattgaagacaaggaggtatactttgcttgaaaagtatactgtactgcaaactggagaacagcttttattcacattgcaaattgtgtgtgtgggccatatattaaaaatctcataactgagttagtcacatatgcatgaaaactgttttcattgttattgtgtgtgtgagtgtgtgtgtgttttggaaaatttgtcctctcactgcagagtttaggcctgcgctctttaatttgcatttgtatgatcaagattaaattcagcagatggctttgttaatactaaaacaaaatataaaatcacctatttttgatgccaacttctttctgcatttgagtagaataaaaaagtgatagaattctacacggtggcaaacaggtcatcttggggtgaatctttgctttgatagtcagtactacctttcaatttgatcctattcacaactctctttcagacattttatctgcttttaccaaccctgtgttatttagctattcactgttactcagaatttcaagaatgccttagtagaaaaaccaaagtcatccatgcattggttcatcatataagcgtaaagtgataaaatgaactatctcatctgtatataatataaatgcaaattggaaggaattatgaaaagcttaaaggttgtctaaaaatcacatcccatttatatggcaatgattagttaataatttcctactgattaaaggaaatttcaaaaaaaaaaagtctccacattcattcactcattagttgcttaaatgttggaatgtttcatgtctgtcccttgcacacagtgccaaaacctgtgtggcctcagtttctatatcttttcagaggattagagtctctgaatttctatatgtgcacacatattacaaaaagatcaaagaaagtttatacttaccattgagctaacttaacaggaaaactatgtatttaatttcaaaacatttacttaaatatactaaagtatatgtaccatattcaacacatttctagtggcaaaatatgaaggaaaacacatatttatgtaatgtgaccctcttcaagtagcttcttctaaaaattcacatataaaatttccagacttcctgtcacagatgagttatcaaaataagtcttatttttatatcttctacccaaaaattatactactataagtaacttcaaatacttctgaatgttaaattaatagcatagcaaatgaaatgtttataattctgggaaacgtaaagaagaaagcttcttcaagaattattaacatctgatggggtagaaacagactaacatttagggccagaaataactgaaaaagaatcctattactttctctgctgcttggtactactggga

SEQ ID NO: 37729 - DNA, 1436 bp, Bovine  19866880811258
ggatggcagaaaaaaactgtcccatgattatgagatgcaaactgcaacacaaaaatatgctcacacaaggatgggcatttgttttctctgtttacattaggtcaaagggagcaatccacggaagactgctttgtttgttgctcactcacatccaactctttgtgaccgcatggcctgtggctcaccaagctcctctatccatgggagtctccaggcaagaatactggagtgggttgccaattccttctgcagtgcatcttccccacccagtgattgaacctgggtctcctgcattgcaagcagactctttaccatctgagtcatcaggaaagccccaaagactgctttggggtttgcttgtttaaatgaacaaaaaagggaaataaaaaatgcaaagaagtaacccaattcactgcataagcaggaacataatcacattggaataagttagggtaccttctttaaagggattataaaggcacttggaaaccctagaagcatactcctgtagaagaccaataattgcactgtctgagcaaaggagtatgatattatcttttaaattttaagatattaaaagaaaatgatgaccatttactggaaagaaaaaggggcagtgactctggatctatcagatggaaaaggcttgaactggtcctgtgcaatccctcctggtatcagctgcacccttaggaatgagttctgcttgggaacacacataactgaactctgatattgctgaaagtgagatacgagcttaaaaatgagggtgtgcaattcctctcatcaaaaacaaacaaacaaacaacaacaacaaaaagacagagcagattggtcaaaatgctggagcagcaataaagtacaaccaaatggattggaccttggtcaaactgtagggtccacagaaaaaaagaaatagttattctggaaagggcagtgcttccagaagtgatgaaatacctgaggcgcagcatatgtcatctgtcaattatttttaaaataagagctttgaagagagataagttgattatatttgctgtcatctgattggaaggctacacttgctttcaaatggctcttaactttgctccaaatactttcagaacttccctctgaaatgagtttcattactttttccttcaaatttgtaggatccagtttgatcatccatcacttctacatatatggcaccccatggctagtctttatttccaaaagtcatgtcttcctcagggaactaaagctctttctcccaaaacactcaaaataatagactgcagtctccaaagtgaattggtcttcattttgtccttcacatataaagcaattagatgctaaaatgatccagtgtagaagataattgttatcattttacaattattagaatgaggttttcaaatcttaatctttaaaagcaaaactcttgaaaacatggg

SEQ ID NO: 37730 - DNA, 1133 bp, Bovine  19866880824542
aatgaattgaaagacataagaagcaattgactttctgtgaatttacccttaaatcccttcttctttcctaatgtccatgcatttgagcttccagaaccaagtgtcaggaaagatttttttcactgcctggtatttacactctgtctgcattttcactgtaccccaccctcaaagaaaacatttggacttagttcagagttctgaaaggatatttgcattgtagattcccttttaacatttgcagtggaaataacaagagacaactcattccctaatgttcccattaccaagtatttgcctaaaattaattagaaaagaattaatattgtatatgctccatttatagacccaaataccttcttggaattgatgtgatatcatgtaactgtgcataaagtcatgcttttttttcaaaatatagtcagtatgatgaaaatatttattttatttttatttatttgtattaacaaaataggcttttttttgccctatcaaaaaatctggacataatatatttcatatagaaataaagcacatacatttatgtataagaatccctagatagacaaattatacatggtccatgatcgtatagagtttatcatctaatatggtattgagtaattaattggagataagcatattcagaatatgctattcaactatacaacctataattgtaacctagtctgtggcagcatgaggacttctagagaaaataaccttaaagttaagacctgacagatgaatagactctttccaccttccctaaaagaagggaagggctatgcagatcagacagttgtcattgtcagcactgcaggtaggtaggtgtactacccaaatgccaccttcactaaaaagtgtcagccagaaggaaaaacataaatacagtatactaacgcatatatatggtatttagaaagatggtaacaataacccggtgtacgagacagcaaaagagacactgatgtatagaacagtcttatggactctgtgggagagggagagggtgggaagatttgggagaatggcaatgaaacatgtaaaatatcatgtaggaaacgagttgccagtccaggttcgatgcacgatgctggatgcttggggctggtgcactgggacggcccaga

SEQ ID NO: 37731 - DNA, 910 bp, Bovine  19866880899851
ttaaaatttgtgtaataacacttgaacatgtttataaatagttgtcttgactcctgttaaacatatattgctgctatcacaatatttccatatctataaaactatttttcaaatgcaactctggtgtttcatatgcatttttcagtacagtaacttactggctacatggaaacatatggtaattcaggtgtaagcttacctggaaaactgcccaagcagctgaatccccacctagcattctgcttttgtctgataatcaaactcttccccaaactggaccattttggaagctgaggaatacataactgtgctaaggctcttacttagtgcttctcagatctggattataagaacaatttgagatatgaaggagaagactataaaaagaaaataaaaagtaaaaaatagattatttgtgtcacttacagacatttctgggctatatgcttattctattgaattggagttgcaatttcaaaatatgtccaagtaggttgacaacctaagcccttactaggcatctagaatagtattgtttctatgctatggatgcctttcaagtaagcagtgctttttctatttccagaaaaataatatattatttaaccagtgttccatctccttaagttttcatccaagaattgatactaattctgtgccctgtgttctaatcttcaatttacagcaaagaggaagaagaatatagtgtttggaggaaatatcagggtccaaccacaaaaagtatttcacctatatttactttaattcttctcattttaaaaatggagtgaaagtagttctcttacaaggcagatgtttgaggatttaatgaaactggacaatcccatagttaccctacaacacacattaaatgatagtctcttttctctgtggcaaccagagtttcaaa

SEQ ID NO: 37732 - DNA, 2388 bp, Bovine  19866880920056
ttctctgcagcactttttacagtaaccaagacaaggaggcaacctaaatgtccacggacagaggaatgaataaagaagagacatctacataatccaatggattatcactcagccatagaaagaaacgaaatgggtcacttgaagaaatgtggatggaattagagagagtcatatagagggaagtaagtcagaaagtggccttcgagtagaatcagtggtagagtggaatcactgtttgtgtctccttggtgcttgacatctcctctgtggatgctgccccctggctggctctgcctgtgctgctgttaaggtggataactgttcattctactccctttatcaggaaagaaattggtgcactctgtaccatgagtggcagaagccaagtgccatagaacttcctttacaaaaccattacaagtcaaactctctggaacaacccaggaggaaattgcttgctcatcgtatgcttaataagaaagaaaataacaatgacatgttaaaaaatcctcagtttaaagacaggatataatcacatcctgatccaaacccctggtttaaccagccaatcaagacaagtatcattaccatgttcacatcgtttgtctcccaaatcagggctatttccattacatcatgctaagggacagtacggttcttattttaagcaataaattagcagacaggttcaccacctaaaatttcattgagtatccaaaccacagtggtgtataaatatctataaggtgctggattaaacctgacaattagcattcaattaacatcatattcaaatatttctttctttaaagtgttgcatataaaaatgtagggaacaaaggtaaacctctgtgcaaaccaaaggccagtttggtattttgttttgatgaaaatgaagggcggtggaggtagttcagcataaataacacaaatcggttgtctcctccagcctttgttttaattagcattacaaaagagaaacattgcatttattaggcataatttctaacctcagaaagagaatgttaccttcagttccacagtgagtgcaagctgaattactgtttcagctcaggggaggatatatttaggcttgtttgtaaagtgtaaattagagtaagcgttctggtgccataagttagctggattacctgccttgaacctggtgtagctcctctccttctgaataattaagagtttattactgattaaaagtgattggaaagtacatgtaggtccatatacacaaccatacaagtgtgagtgtgaatctgtctcattctgcatgcataaaggataaatgcatttggacagatgtacatgtttaatacattcaagctctaacttcttcagtaaatttgatctcttagtcttttctggtggtgataaaaagaataataacagtaacaataattatagacctcttgagacttggagcctagggagagggttattgttgttcagtcactaagttgtgtctgactctttatgacctcatggaatgtagtactccaggatcctctgccctccacaatctcccagaatttgctcaaattaataaccactgagtcagtgatgctatctaaccatctcatcctctgctaaccccttctcaactctcacatctgtacatgactgctggaaaaaccatagctttgactgtatggacttttgtcagcaaagtaatgtctctgctttttaatatgctgtctaagtttgtcattggagaaggaaatggcaacccagtccagtattcttgctgggagaatccccatggacacaggaagtctggtgggctgctgtccatggggttgcacagagttggatgtgactgaaagcaactttgcatgcatgcatgcattagagaagaaaatagcaacacactctagtgttcttgcctggagaatcccagggatggaggagcgtggtgggctgctgtctatggggtcacacagagttggacacaactgaagtgacttagcagcagctaggtttgtcatagcttttcttccaagaagcaaacatttttgaatttcatggctacagtcaccatctgcagtgattttggagcccaagaaaataaagtctgtcactgtttccattggtttctcatctatttgctatgaagtgatgggactggatgccatggtcttgcatcgtgcatcgtacctggactggcaactcgtctcatacatgataaagccaactttttcactctcctctttcacattcatcaagaggctgttttaataatatcaataacctcagatatgcagatctgagtatctaaactttattgatctaaactttattctaaaagactaccaagaaagcagggatagaagcccccctctgtgtcaaaactcttactgtggtaggaattcggtt

SEQ ID NO: 37733 - DNA, 784 bp, Bovine  19866881011953
taactattatttgtatgcaaacagcagcatctagttaattagtggtgctacttagaaattatgggtttctcaaaaaactgcagggtgtaataaaatagaatagatgatcattagctttcagtaatgaagttcatggaaaaaaagcacagccctgcctttgtttaacctacaagagcaaaattaaaatatatagcctgaatataagcatgttacacttaataatattaaatgtaatatgcattttagcttacatttaaacacataagtatatttaaattttcaatcaaacatactaatcaaatatcttagcattctcagttttatttatcaccatacttgtaattggtggccatcaatgtagctaagggaaagtaatttatatgacttgaaacaactgaactgtgctgatgtgctatttagcaagactccaataagcttgtcttattttattcttcccacaggtaataattatgcataatatatgtaaatatgtgtgtgtatacacacacacacacatacacatcttttctcctccaggaaatagagaacattgatagtggacatttctttctttaagatttaaaaatctgttctctttccaagctctcaataaaagaaatttaaaaagcactgtgtaccagagttttgtaacccagtgccaattcttggaagacaagtctcttgtcatcattgttcactaatcctactatgctgacaccctactaggtatgtaaccctggagcatattactgaatttcttatggcttagttttctcacctccag

SEQ ID NO: 37734 - DNA, 2291 bp, Bovine  19866881052130
cctctaggggctcaaggttggttttaatcatgcttttttgtgctgaccggagcccctctcatatactcttatcaccttgttcctgaaaagtcctaaggtacctgttggctacctgcatatctgttttaaaggagagcaaactgtcttccagagccagatgagcactcaagcacaggactgaggtcaggacaccgttgtctgaaggcagacactgataagttctcccagggcaggtacaggtttcagtcacaagcatgcagtccctggctctgccagaacactgtcatcccatagagagctatttggtgtctgtctgttgaggtcttcaatgccatggacctgggcctgcacagagggtatcttgacacacaccagacacgcagtgctcacgagaggattcccaatgtgagcagtaactgccagcgcctcaataggcactgtggataaggttgtttgcaataaggctatttgtttcctgttagtttgcaatagccaggtagaaacaggtaatgaaaaagaaaagaggagaaaaattcaaaagattgagtttcttggatctcccagaaaattcttggaacatggacatttttatcttggcccagcatcaaaagattaggtcacatagcagcaagacaaaatttttaaaaccaaaggaccctcaatcaaaggatgtctcacttgacactcggtaatatagtcatagactagatgtcaatgtaaaaaaattcagtttaagaaacaaacaaaaattacagatttatattgtcaatgcccctatatagagaaccctcatcattatatttctattgattactttttacatccccttttaaaaatgtgtttatcagttatacttcctgcagcaaataattaaagcaatagaaatagacaaattcataatcaaaatatggcttgaagaggatattatccagaaagggggactgggagaatccttagcagaactttgcttcatcagtggtggtgtcaaagggattgtgagggcaatgaggtgttcacccctgtgctggtaaaggcaggaagagtttttggtgttagaatctcagtaggcaagagtgtttcatggctgagtaatattccatcatatatattactcagccgtaaaaaggaacacgattgggtaattcgtagagatgtggatggacctgagtctgtcatataaagtgaagtaagtcagaaagagaaaaacaaatattatatattgatgcctatttgtggaatccagaaaagtggtacagatgaacccatttgcagggcaagaatagagctatgcacatgtagagaataaacttgtgaacacagtagggggaagaaaagtaagactgatatgtaaaccttaccatgagtaacatagctagctagtgagaacctgctgtacagcacagagagctcagcccggtgctctgtgatgacctagatgggtgggataggaggtgcggggagggagtttaagagggagggaaaatatgcatgcatatgactgagtcaattcattgtacagcagaaactaacatattataaagtaattatacttcagttttgttttgtttttttaataaggaaaaaaaaatttttttttcttgttttacaagattatttctgtaaagggaatcccctttctctctcctggtttgctgatgtgaggaaattccttccagcacactccgctcagttccttctagccacagtttctaaaaatctctacgtaaggtgacatttctcctctcaacacttctgggaatgcctgccatatatagcatcagattatgtatcaacactttggattacatcattttcttgaacacaatttcctatgccaataacacagaggctactgccttgcataattcctattctcattgaaaatggagatattagcattaatacacaccaagcagttattttttttgcaaaaatagaagtgtaggattgaaagatttttatttatattttctttttctaataccaaatgcctctgtttccctctctgctgggctgccacctgtccccagcagatgccttctgtattaatccttcgacagtgaccattgccagctgattccttgaactctcagtgttcttagcaggaaaacttttctttcctggagttattctctctctctttttcaccttctctgctattttagttcccttgttatacccatcacctatttttccttttccagactacattggaagaaggaaatgaaattataaaatacttggtaatctgtaaaattggtttatatgcttccaaaaaatactaccttctc

SEQ ID NO: 37735 - DNA, 563 bp, Bovine  19866881064092
tgaaaggtgaaatgcacaaatgactccaaatagatcaaaaggccttgcttgctccagaatggcactcccctcagtgcacttggcgtggaatgaagcgtcatttgaacataattgatggagccgagtgagagagaatttcacaaagagatctggataaataacaggctcagctccaaagtgaggtgaagaatgaaaggcagtttgttatgaagtttagggcatttgggtttaattagtgagataaattgtgaccaaatcacctaacctcttaacctttaaaaagaaaggccaagcttgaaaattttatataccctgaccttgaagaattaaatacattttttaaaaatctctttaggttatagttctcactgagtagtgaataacattctgtgattgggacagcttttaacacaggagtggtgttatcatagctatgctatcattgtgccaaactacatattttaaagtgttattcatagaaagaattagaagataacttagaaataataaatctaatatcttaccaaagggtccaagcttctttctttgcctcattggaaggg

SEQ ID NO: 37736 - DNA, 862 bp, Bovine  19866881179817
aggagtgaatgcacaacctgaatttctgcagacagtgctgtaatcagccaccccaaactttatgaagtagacatatatttctgcaatatttcaaaataatcaataaggtagtaaagcttttccaaacaatgcttacacttaagacatgttgtcaagtctccataaaggtgtcttatgagagctcattctctacttcaagcttgaaaaacagcatgttcttttgtcttctctttgtcttctttctgaaacattctgtactgtgcaccttcagagaaaaaataaaaagcctcgattttatttaagccactgttattcttggcaccaaatcctaatgtatgcagaaaaagatgatgttctattcccaactgatttgagttgaatgtcagtttgaaactataatatgtggtgtcaggatccaggccatttctcctcctataactgatgggattttcttttttttcaccactaatcattgctaaattttattgaatgcttactatgtgtcatgcactattctaagtccttgcacaataatttcataaaaaccttagatgcaaccctatggaacagctattacaattgctcccaattcattatacaaagccttcatcacagagaaattaaatatttttcccaaggtcaaaagggccactaaatgttgagactggtatgaaccatgtggactcatgaggcaatatccactttgttaatcattaatggttaagatatgaccagcatagttttacatggggtggcggattcagctaaaatacagagaggcctttagcctgactctataaagaccaagtctgcacagcatcttagaatttatttttaatatactttaagcttgatttatatt

SEQ ID NO: 37737 - DNA, 867 bp, Bovine  19866881180305
cgttgtgtttttacatttagaggtgatgaatagcaacctcatttttcacataggattaattttctgagattcctttattgcctctgcccaaagaatcaagtagttaatattttctaattatccttccaagatccttttcacattagtctttgtgtcccactatgagacacacagggatttaggcctactatgtaaccctctacaggtattaaagaaggtttagttgagaggcattgggacatatgttgaaatgcctcctgaccacacatgaaggctattttatttcaatattctgagaaagcaaataaagcacagaatgattcaccaactagaccgggtctcagagttcctttgttgggaatttagactcatactcagcttgtcagatttaaaggcctatgttttatatgtaatatcacacagtccctggaagttgcagaattccaaccataatggggtaaaatcacagacacatgtcagatttagcatttatcatcataatgttcagcacaaaaatttatccccctctgcatgcaagacactgccattaatcattttgcctttttctcacacaacacagcacatgactcaagaagtctaacatgagaatggaatttacacttcccatgataggtccatttttgaactgtatagaacagattcacctctaatgctacccacctcatgtgaagagttgactcattgggaaaagactctgatactggggagggattgggggcaggaggagaaggggatgacagagggtgagatggctggatggcatcactgactcaatggacatgagtctgagtaactccgggagttggtgaggacagggaggccggcctgctgcgattcaggggtcga

SEQ ID NO: 37738 - DNA, 1214 bp, Bovine  19866881270681
aaatgtagggggtctcatgttctatattaccctggttttggtttaaaagactgtttaaaactctaacaccgaaaaaatgatacaaaatttttaaaataagtgtagaaaaactatgagatgcagataaagatagaagaaaaagagcagccttgtcacttttttcttccttgataaatactaattagtaccgattgggaaaaggtgaaattattggtgtgcccaggagtaggaaaaagtagatcttcttttcatttgactttgaatgtaacagaggaaaatatggcaaggccacacctgggaattgaaattatattcattaggagggctgatggagatggaagagggtataactgggagcaatgctgtgctgagtaataagcagacagctcccctgaatctcttctttaaagcattcgcattgctgtgatagggtctggaaataggactttagtgtccttaaatgttcaaacctttgtatttcaaacctgccactttctttcagtataatacaggcaaagagtgtaataggtagattggccgatcatttttctccataaatcatcctgctattccaagattttactggtttatcctctaacccattgaaattttggcagagaacatgatgctgaatttaaagttttcaaagagaaagtagataggggtcccagctgctgttggagaacctgcaggttcctctaaagcaaagaagactgcatttgaatgacttcaaattgtgctgataatggtgtgagaaatgctatttcacatccaggatattaaaaaatatatatcacagctttttctctcttttctctctcccattgatttattcatttttctatattaaagtattattgaatttgttatttagttcctctgagtctgcactcttatcttctttgtctaaaattgatataaagaataaactggatactaaatagtaaatattatttgatttagccaggaattatattaaaatcatagagctctctggacatataggtgtttttatttgactagtacaataacctgaatgtggaaaggaaaaggagcagtgaattattggagctaatagtaatcagcttatattatttaatagcctgcatttaaaaagcttttctctttttaactattctatgatatatattattgattgatcatcttaaaaacaccaagtttaatatctcccatgtaaatactatgttggcagc

SEQ ID NO: 37739 - DNA, 1267 bp, Bovine  19866881297407
atttttacacaccaaaaaaaaacatctttaacatgaaatctaaagttaatgcaaaatagttcaagctgatagaattttaaaggatttaattatgaccattagaagttagaattggaaatagacccagtattccagtgacaactgatagaaaagtatgtcagagaccatttaatattttgctgacatccgcacaatttgttggttctatttatgtagatatggaccaattgaatcaccaacagagtagagttgaatccgaatgttccctttcacctaactgtgtaagcagtatgctatgttttgctaacacttttgagtttggatgacgaaggacctcagattgatgtttttatcctggtgggttttttttttttttttgcccttattttaatagaaatactgagctaatgcagcatatctgctttgggaaccactgtttttcactttgtttataggcttgaattcactgggcagctgataatatccacattatgaacaagtatctactgcagtttctcttacttgatttttcactggtttaactgaacatcacaaaacacagcccaacaaagcacctttgttgcaaggtattttgttaaagatagagatactttactattacccttttacttaccattacccctatgaccttctggcatatgctaaccataaagggtctgtgtcctaccagtccatcttttatacttttattcatctacgtgaatctaagaataatatgtaaatgaataacatgaaccacttatctaaattaaacaaaaggttatattacatcattgggacaaagaatgtcatagtcaagggtaagggttatttaatgtaacaagatgttggttttatttaaataagttcaaaagttgttgagacagctactgacttgaatggtggaaattgatacattacctcaacaaatatataaagcaggcaagaaataattatttatttacattattcagctgataaaaatttagcccaggaactttctcctaatcacatttagcaaataaaaacagaaaatccttgtttaaatttgaattttagagaaacaatgaataatttctaatgtaagcatgtcctataccatttggaatattcttacagtaaaacaaaaagtaatatctaatgttatataaggtttaaatatagctggggattctgtatattatctggcagatatacccagaatcaaaatagagctataagattaaaaagcatgtcttttgatgtcaaattcatgaatttacaaatt

SEQ ID NO: 37740 - DNA, 1490 bp, Bovine  19866881297568
acagattcttacagagttataagagtgaaatcatagtttgcatttttactcatatacatgtattttttctattaaataatgtggggcatataaaaaacaaattctctatatttaaaatgtaaagaattccccaaaagtctgaaacatatgcttcctcctcctgtctttcctaatggtgccaagccacatataattttaagttaagatgcttggttgccaacaccttaaggaaagagcttcttttgctcatcatgttgttcccaaacccaacattggtcaataaaaatatgtttgaataaataaatagaaagtatcacagctagtagataagtggtatattgtaatactaaatataggactgtaacatacagtagtatttaaaacctaagtttcatgaaagtagtgagggaagctggctagaaattaaatatgtaactgatatatataaaactgtgaaaatcttcttatggatgaaacaatgtatgtacatgtgggtaggtgtgaattatacatttccatctaataccttgttgtaacaagataacaattagattagtagcatattgtaagatctcatgctaagaaaaaaacttcacaaaaattctatctttccatattgctctgttatataagccagctagaggagactgctatcgttttaatatgaaatactagtattgttggtgtggcagtaaactcagtgctatttatgacttcagatttagatataagatgattgctgaactttagtttctatgacttctacaagcattaagcttgattgaacctcatgctattagtactgacaaatgaatcaacaaaaaatgttgatgtaaatcaaaattatagtatttaagacagtatctgactctacatttagtctagcattcacaaagtacttttgctttaatttagaaatgatatttagtaccaaaacatacaaagtaatcttggtaattacttgtaaaagtgttcagtcatattacaggtctttactgttcattgactataattatgttagatatacacaataaatatctgacaagtaccataagacaggtgtatttttcattctttctgtcactgaaacaacaattttgaaaatgtttagttgtatgtaggtaagcaaagtataagaacacatttacttaaagatttggaataaagattaaaactcacaatgctcagttgaatatgttgagaataaagaatttcagcttgggagttgctaacaatcattacattttctgtatttctgtagcacaaaactggaggataaaatttaccattcataatagatcaaaaaataaaatgtatcctggaaaatttcaatgaagaacatgcaaatcttttctgaataaaagtataaaacattaaggagggatataaaagaagacaaataaatgaagaaatattgttaatgaataagaaaaagtggtggtgttaagatgacaattaagttacactattttttcattcctaaaaaaatc

SEQ ID NO: 37741 - DNA, 1434 bp, Bovine  19866881327754
agggatctagccagggaccccctacagtggaagctggagacttaaccaccagactaccagggaatttccagtttggtttgcttttggtttggatgtataaaaatgggctggagtaaattacagcatgacaagtgcaggggaaatgaatgattcttccttatttagtaagaagagatactaactccctggcagtccacgtgtgagtgtggaaagaagagaaatgaggaaaaacgaaaaggaaggtcatcttgagagaatatgaaataggcagttatgaccaaaaaatagtttttcttttttttatggccttttttaaaggccagaaatttaatatgcatttttaaactgttgtggttgttattaaaccaatttcctattatgccccacctcccacaatcccagcagaagcccattctatattttataaaatacagtgctttctgtgaaacaagatttctaagggatccaagaaaatgatttcatctcatacttttcagaacagagagagcacacacagatgctggttcagaaccagagtcaacaggggatggcaactctctactctcccttgttcgccatccaacatttgttggctgaaatctgcctaccagagggctttggattcccattgggatggaagagtggatttaatgatatctatttgaaaggctctagaaaactccagctgacatatctgtaagttatataggtaatacaagtatcatgaaaatacatatcagcacttaaaagagaaaaatatgtaaataattagaaattcatcttttctcttttgcctgtactatcatgaacattagccactgctacatgtaatgaagtgtggaagggaaagggtagagccatagactcagagttagaaagagactagtctagtaattttcaagattattgctgtttttgaaaaaggattatacagtttttgggatcttatatagattatcccccacttcccccaaaataggataacctgctctacttcatcaccccttgtgactttaaggaactcagtttgagaattgtaagtgcagttcagaattcacattttacatatgaagaaatggagtgaatagagctctttattgccttggctgcaaaccaactgctgcataaggcattatgacaacccagagaatagcgaaatgtccatgaattatttttatagacattatgagataggttacatttaataacactgtcttgtccatggctggtttttaatccctttcataatgccataggaaattctagaacaatatttgagagtgtgctgcaaacccaaaagtttgaatcttaaattgccaaagacaatcagtaatctcagattctcttgaaactgtctcagaatcagtctctttggctttgtcctgttccaagactagacagaaaacatgcttattgagaaagtatcagtcatta

SEQ ID NO: 37742 - DNA, 1373 bp, Bovine  19866881430609
agaaagtgatgtgtttttgccaggcaaggatactacacaagcaggtaatgggtcttaaaaatgttgcaaatgttaatggtgttagatcaataatattactaccacaggtaaaatgctattacatatattattaagacattgctcaaaatggagtgactcaaaggacttggagaatgtatgagtaattgcggcaccatttatataataaaatgctaatggaagtttcgtcatacaacatgctgtgtatattctttccccaagattttacaaatggcagttttgcattaatgcatgatacagacccccaattgctccatcacatttcattttcctcctaaacatgctgctgctgctgctgctaagttgtttcagtcgtgtccaactctgtgcgaccccatagatggcagcccactaggctccccctgtccctgggattctccaggcaagaacactggagtgggttgccatttccttctccaatacatgaaagtgagacatgagtcaactcagaatgcagaagatcagagtctttctctactcattcattcaatttccccagaatctcttatgaaataaaaggtaaaatagtacagtataacttatatgtttaatttttctaaatatttaatgcattgcctaaataaaactggccttaatactgtcatctgagcagagtatatcaaatggtagctccagagagcattaaaaaaaaacaaactttctatttactagttagtcccaaagataagtgattatgtttaatctttaacataatctttctttatttgctagctggtcccaaagataagtgattatgttctttcaatgaagtcaggaaaacatgagctagagctaaattacttcaatgtgttaagagttttattcaaatgctattttttttaattaactttgtccttacatgttttatacagataatatgtatacatagatgataaaaaattaaatagatgaatggagagctggacagatatgtaaagatctttgattcaaactctgtagctctctttcccaaaatttttacacagttgcttacttttctctattgatttaaatatgtaccattagatttattttagctgaaattctgtctgttgaaggaaaaagtaaagataaaaaaagaagacagaagagaaggaaaagaggaaggatgaatggaagaatgaaggtgcaaagagaaagaaaaaaaaaaagaaaaatgaaagaatgaaagaaggaagtcagataaccatttaaataaggggtgaaaattccttagccaaaatatgcaaacaaaggccagatatgggtgagatcatgttataagctttcaggaagactctttccccataacttatactcaattctatttctag

SEQ ID NO: 37743 - DNA, 1116 bp, Bovine  19866881506236
ttctttataagaactctatcatttaatgtcttcaaccctgcatgtacctctgtctcttttatacacatagaaacattatcagataattatcatcatatgatattatgttgcattatgataatcctgcaacatggctaggatgtaggagggaaagaatgccacatagtttttacagacatattttctgagttattaacagtcatggcttttatagcagatcacaactcaacatttgaaaactttttatgcttggaatagtaaatcataaacagacatttttgaaggtccctctgggcacctaagagcacttctagtggattgaaagcaactatatttgtatgtactctcaatttctctaatttaagtgacaggaaaattgtcaaggcagatgtaaagtcaatcatgctgcagttggtgatgatggcctttgtcaaaaagaggctccaaattcagagactaaatccatgagaatgttttgttgttgttttgtcttacaaaattttgaattttgggctctcaactaagaaaataaatgagtcttatttatccatagttgtcagtttgaacattctccatgggtggcttagacactgtctcaaccaagagtcccaattgtgacaattaggtatcactttgaacttgaattatagtcccagtagtgaaaagtcagagctttatccacttaacagttaatcttctttgttctactcattcaacattattaggcaaggagaagcctttctatgcctgctgccttcttcctttcctggataccaccccccaccactcaccatacagaccttacacacatgtacctgtatgaaccagtgtgcaaagattccccatttgaagctaaaattttcatgcatgaaattcttttttgattaaatctctaatgctgtgagaatcagagaatatccttagtatttctcaattggaaaaatgaacctaccactttcaaaaaagggtgaagtttatttgttagaggaatgtggtgagcctcaaactaacatttcgttagtatcatgtggcaggtctagtgatacgtgctctgtataaattgcctatataaccttcaaaaattatattgaagttagtatcattagttctcctcta

SEQ ID NO: 37744 - DNA, 1584 bp, Bovine  19866881545136
attcaggtttattatactccaggggctttgcttcttaactataattccacatggtaaaaacgaatgcagctatgaatttttgactgatgtactgacactaaagctgtcgctaatcatatttatgactttttcaataaaatctttaaaaattttttctcagagttgagtgataccccgacacatcagaaaacacaaatttgagagatgactatagccatcattggattagatataaattaagcctaattactggagtctagtaagatcggaatgcagacctgcagaatgataatgggattcagtagacatacattctgggctccagagaatggggtgataggtggcaattatcattagtgacttttgaataaagatgttagagtcttctcactcattagaccaaacagtttaatggttattagaagtggctgtaaaaggcactgaaataccatcagaaagaggggtaatgattattattgcagcaacctattatttctataatggccctgtgattaagaaatcaacatcagacttttttcccatcagctgtggcttttaaaagctggtggcagtggtcacaaatcaaacttagaacagtttctatacctttggtggaactcacatggcatacaccactttcttttccaactgtgacattaatttgaatattatcaggggaaggtcaaaacaggtcttcaataaatcacttcaaaagtttggtcagagttggaggcatacacacagcattcactatgaaaagaagactgcagttttacattcacaatttgttaacaaatctcttaggaacaaggatatatacatggctgtcatttttttttttttttccctacacactggttgtaaatacaagacatgggaatttgttgaagagttacacatcataccatgagaaaaacaacacccaaattctatgctaggagagggaaccgtgtagactacatagtaaattaaaagaggtaaaaactatactagaggacattatgcttaaggaaacaaattctaattattttgaataagactttgaattcttaaagtctgacctaaatgacaattttaattggatatttacaatgaaaaataagtagaaaacctacaagcaataagtcaatgattatacacttgctaaaaacatgtgctcggcattttttaaattctctaattaaatcctaattaggatgagcactggagtgttaatttttgctagctatacctctggggcattttttacaccttcaggagcctaggcttattcagatatgtaagagataattattaataaaaaggaccactgtgttgttggctcagagagttgcttatttgtgttttccgcctctgcctgaacagcctaggggacccctgtgtgactatgaagagtaacaccttcctcagctaaccaataggtaaagtatgactttttctgcatccttgagccatggcttttcttccaaaaaaagagaagtctgtttagatgctcagaaaatctgaacataaggtgaagagtcaaacaggagtattcaaattttggttccacttaacaacttagcgtgctaacattaggttcag

SEQ ID NO: 37745 - DNA, 1650 bp, Bovine  19866881825682
tagtgggttgccttcccttctccggggatcttcctgactcagggatcaaactctggtctcctgcattgaaggaagactcttgattgtctgagccaccagaaaagctctcaaataatataataatatccaaattatgaaaagttatcggagaaggcgatggcaccccactccagtactcttgcctggaaaatcccacagacggaggagtctggtaggctgcagtccatggagtcacgaagagtcggacacgactgagcgacttcactttccctatgaaaagttatatgaatggaacagaatgtaaattattttctaaaataaccaggatattttgctataaactttctggaaagtcaataaattattttaatgttattcatgtgtctgcataaataattaaaatatgtatacatctagaaataaaatgaaattcaactaaaatggcaaataaggggaatgatagttatataaatgacaaagcaatgaataattcttacaaaagaataattaacaaatgtttgtaattctgaaaatgtctttgttgtttaaaaaaaagtattatatgtcaagatgctaaacagtagctatttttgtccttttcaaaacagttctctgtttttctgcagccaggaaatgttctccacttttaaggactgctgtaattagattaaaatgttggaaaattgcaaggattttctattattgtcataacaaatgaccacacatttagtggcttaaaataaagcagatttattaccttacagttctggggagcggaagtctgaaataggctaaaatcaaggtgtcggcatgtctgccatcctcctgatggtccaaggagcatgtttccttcccttttcagtttctaaaggccataggcattctgtggtcaacagaagatagaggcgatcttcaaattcagaagtttataatcttcacttccctctctgactcacttcctcttctgcatccttcactcactttaaaggaccctctttattatattgagtccaccctgataattcaggacagtctcttcatctcacagtccttaaccctgaccccatctggaaagtcacttttaccatataagtaacataaacaaaagttcctatgactagagaatgaatatctttaggggatccattattctgtcttgcataatgtgttaaacttattagtgagcttaaggggacttttggtatgtttttcgtcttttcattttctgaaaagaatacacaattatttagttatacaactaaaaaataaaaaaaaaaagataggaagaaatccaaattgaaaataatgccctagattaggtgtccagagattcacattcataacggtgcctattctggtaactctttgtatatctgtgagcaagttactttcaaggttccgctatttaatttcttaatgtaaaattaccgagtttaaaatgaaaagatgtacaactttcatctgaggactgaaaacctggactaggactccgcaactttatgagatagctctgactggaatggccatgtaggcagaaaagcaagcgaatgttctccagcagaacactaaaggcactattaaagttgttgctaagtctgttgggtgttatttggaatgctttctctgtgttttccatgttcacttgtattg

SEQ ID NO: 37746 - DNA, 1495 bp, Bovine  19866881843171
attttttttttaatctcatgctgaaccatttcattctcttcacctttgtaacctccagcaggtagttaaaacctataattacagctccagcagcaaagaacattcaaattcattccactccttaccaaattctaaatgtgatttctttggtttcctatggttgcttggttacatttcctgtttgtccaaatgaattctgataaagcagaacaatgtaagcatgctcaagtatttgtaaagcaagacctttaaccataggggtgtatatccttaccccttatctttgttttcaaaactagaagctgacaaatattgtacgtttaacacatatattttgagtctaggaaatggtatagattatcttatatcaaaagcagaaataaagacacagatgtagagaacaaatatatggataccaagagggaaggggaagtgggaggaattggaagattaagattgatacacacacacagaaagtgaaagtcactcagtcgtatctgacttcttgcgaccccatggactatataatccgtggaattctctaggacagaatactggagtgggtagccgaaaccttccccaggagatcttcccaacccaaggatagaacccaggtctcccacactgcaggtgaattctttgccagctgagccacaagggaagcccaagaatactgaagtggtggcctgtcccttcttcagcagatctttctgacccaggaattgaaccgggtctcctgcaatgcaggcagatactttaccaactgaactatcaggaaagccctgatagtgatactctattttactatatataaaatggattactaattagaacatactgttatagcacagggaactcaatgcactgtggtgacctgaatgagaaggaaatccaaaaaagtacatatgtttatatatggttgactcattttgctgcatagcagaaactaatgcaacactgtaatacagctatactccagtaaaagccaattaaaaaatagaatccaaaataaacatttatatcttttttaatttcattgactatcaaaatagagattcctattctgtgagtctagaaatagttgataattgacactgtgcatcctagttcccttccattctttcctgtctccttcatctccttgtttccttctctcttctctccttacctattcccttcacctccatcctagtcaccagcagcagctcctgggtgtgttgtttaatttgtatatgcacgttttttctcatattaaactcaacataacaataagagtaacttcacagtattactataaggtctaaatgagttaatatatacctggtacttagaacagtgcaacagaaaaagcatggaatcagcactgacattaagattaccttcattatcacaataagtatcctctgctatacttctcctatttattgcaacatgagtgccatgtgtgcataagtaaccgctttctacactatcttatttaatcataataaaaatt

SEQ ID NO: 37747 - DNA, 1367 bp, Bovine  19866881980256
ttcttgacttgtttataatgtatttctttacatatttgtctgttaatgggtatgcaaatgatataaacacaaaataaagcttggtgtttcccccataagattagagcctatcaggagaaataaatttgatattaaaaaacatctaaagtataatatgtgtaatatcgtcactggataagaacaacagaaatgttctatctcatcacgagatgttcttatctcatcacaactatgagatgaagtaagagaggagagatttggaaaacctgaatgagaaatgaatagtcctctagtcactttctaaagtgagattaaggaagatctgtattagcaattttgaaaccaaagtcagaattgatcatacaaccattctagaagaaggatcctcttaatttagcccatggtgatataagaaaatgttaatagttcagtcttcatctgcaaaaatatttgagtaatattagtaatgatttttttgagggggtggtcatttgcagactctgaattccccagccagggactgaacttgggtcacagcaatgaaagcccagaatcctaacaactaggtcaccaggaaacatttaatcatgacttctgaaatttactttaggcttaatattttttaaaaaatgccttgcctgagaaattttggaataaaaacaaaaataattggaatggttcttaatgtgtttgatattttgaactacttggaagaatctttacaataatttgcatattatattccattctatatagaaactacatttgaaaaaaatgttaattatataatgtctaagaaatacagtttcagtgattcccctacttgttaataggatgtttactctcttgattgtactaacttggtatttttaaaaggataaattttggggagttattcacctatttaatccctgccttttctacttacttggctttgtctgtaaatcttctaaaactattttttcatttacaaaaagagggtttatgttctggggattagtggattaaataaaatgtattcattaaaaagtagcctggtttctaggacctagcaaacacttaacaaatgttccttttccttggataaaatacctgctattatgtctggttgatagtggttattcagaactcatggccttcctgtgaaagtgaaggtcactcagtcacatccaactctttgtgaccccatggactatacagttcatggaattctccaggccagaatactggagtgggtagctattcccttctccagggtatctttccaacccagggatcaaacccagatctcccacattgcattgcaggtggatagccttcctaagtctccccaaaattatagataatagataactaatagaatatat

SEQ ID NO: 37748 - DNA, 1719 bp, Bovine  19866880521934
caaagagctggtcttagaattatttttccccgaggaatttaaatacattagtgtttgggttttgacagtaaatttgagactctggacggtgtcacaggatgcagccttctgtacctaatggggctggggtcccacatctccctagaggcgacaactctggcctcagaatgcaaagggccctgtaaacagagaaggggacaatccagtaggggacacaggctccttgtcatcagaacaggtggcacagctgggctgagctggagcctgtgtttctagattctcagccccgagtctaacattcccactctttgttgtcgttcttgttcagtctctaaatcatgtccagttctttttcaaccccacggaatatagcccaccaggctcctttgtccgtggatttcccgggcaagaatattggaatgggttgccacttccttctcaaagagatcttctcaatccaaggatcaaactcacatcccctgcattggcaggtggattctttaccgtgagccccctgggaagcccacgctcaccctttgggtaaacataagctgattcatcgggctcaactctaggccatttctacattctgaataatatttgtaaatgacctgttcccgtggattgttcagaaagctagcacttagattttgctgtatttctttgccatgaaaaaagcacttacggtcagtgagttttgtttgttgagctacttctttcttggtcacttgctgcaagcccacagatgatcggcagaaacacgggacttgggaaaaatggcttaagggcagtttcacatcataaaaacttcttgctattatagaacagaaaaaaaaaaccctgaagtcaaagaagagggaacggccttagtgacattggagggggcgtttctagcgagtaggtcagtaggtcagagccatatgaactatctgccttccctgtttctctccactacttccctgagtaggtcagactgttgtctcctctcccaggtaaaccatcactaagtgtcctccatggagtggagattcaaggggtcaggagtttctcagcacagcacggggaacgctgctgaaataaggcggttctgattcttgcttggccccagcagccttcactgtggcttccttagggctgctgtggccccccgggaaatcagaggcttcaggaccgctgtgctcatctcagactcctggtcgccatggcagcccctcagctcacagcactgtaaccttcacagaggttgcaggcagtgctggggagctaccaacctatcctgcctgtgcccatagggcagggggttgtaagaccaaataactcagactgaaacttgagccaactatctttaattgagatcatacacctggtctcagggcttagcgaagcacaggttcttgacgtctcagtgcagaaagaatttagtgagaggcaaagtaataggttttgttatttgttgttcagttgctaagtcatgtcaaactctttgcaaccccataaactacaacacaccaggcttccctgtccttctgtccttcaccatcttctggagtttgctcaaactcatgtccattgagttggggatgccatgcaaccatctcatcctctgctgtccttctcctcctgccctctattttcccagcatcagggtcttttccagtgagtcagctctttgtgtcaggggtaaagtttggagcttcagcttcagcatcagtccttcca

SEQ ID NO: 37749 - DNA, 3422 bp, Bovine  19866880635197
aaaaaggagcaaggcctgcctggtagaagaaggttatgctttcactgggtcctacaatcccaatttacaatacctgttgccttgagttcaggagatatttttaaggaaaacctcagacccctgagttccagattagcctccaatattgacttaaggtatgatttttccccctctatccagagacatgaaaacccctgtctagatattctagtccatgtccccaaggttcaaggggttaaacaggctttcaccacattagcagattacccggcatatattcacgtacacaagtgtactgtgagattcatcattaaacatccttaacaaagtgttcgctaagtaatacacagcgcaagacaccaacattctctctgcctcggtgtttctcctctagaaaacaggaataataagaacatgatgaggatgaaatgtgaatagcatttccccaaatgaaccagctactcagtgacgtcaaactatcatcatcaatggtccgaaaaaaatttctcagaagtcacttagggcaatgttcagaaacagaaattctaaatgtagcaacattttgctcgagaggatgttttcagcaaaaaaaaaaaaaaatggggaatgtttgtggcaactgtgagtgctggtgagtattttaaactgttgcgtatttagtaatcgttttttagggttattatggttgtggattagtagaaggattctaagtgtttcagtaaggggcacagagatgtccgtgccacatttcgttaattactagaagtactaatattttgcagaatctttaaaagaggctctgaagattaacttataacttctgccaggcttgttttattttcctaccaatacttccaaacagaagatacactcttgctcactgtaatccaagcagtcatagtgagtacagctataaagccagaattcatgtctcggacttggacaactaagtaaatttctcatcactcgggtcttttttcttttttggctatgccttatggcatgtgtgatcttagttccccaaccaaggttcaaactcgggcccctgcagtggaagtatggagtcttaaccactggaccaccagggaagtccccttatcagtcagttctatatattaaatattgtagccctcattatgttctgaagtgtcacagctcactaggctttttgagaagcagcagaaacatatttgaaaaggagagaaatctttatatgtgtgtgtgtaaatctgaattttattcttctttgtactctaaacgatgactgtagccatgaaattaaaagatgcttctccttgggaaggaaagctatgacaaacctagacaacatattaaaaagcagagacatcattttgccaacaaaggtctgtatagtcaaagctacagtttttccagtagtcacgtacagatgtgagagttggaccataaggaaggctgagcaccaaagaattgatgctttcgaagtgtggtgccagagaagactcttgagagtctcttggacagcaaggagatcaaaccagttaatcctaaagtcaaaccagtcaaaccagtcaatcctgaatattcattggaaggactgatgctgaagctgaagcttcaatactttggccacctgatgggaagagctgactcattggagtagactcaggtgctgggaaaggttgaaggcaaaaggaaaagggggtgacagatgatgagatggttggatggcatcgtcaagacaaaggacatgaatttgagcaactccaggagcgaaggacaggcaagcctgaagtactacagttcacggggttgcaaagagttggacatgactgaacaacaagtgctgggtatctgatacacgagttagtgatgtaaagtaagcttctggttttcccatgtccgcttattcgatcatgacgatttcattctacttttcttccctggatgaccctaagagataccatcctgtgcccacaagcagcaatgcagggacatgcagctaagaataaaattatgacaggccatcattaaaaagtctacaagtaacaaatgctggagagggcgccgagaaaagggaaccctcctacacggttggtgggaatgtaaattcacgcagccactctggaaaacagcatggaggttcctgaaaacactaaaaatagagctaccatatgatccagcaatcccactcctaggcatatatccagagaaaatgataattcaaagagatacatgcctccctatgttcactaccgcactatttacagtcaccaaagcatggaaataacctaaatgtccattaacagatgaatggataaagaagatgtgatatagacatatatatatatatatacacacacacccacagtggaatatgactgagtcatcaagaagaacgaaataatgccatctgcagcaacgtggacctagagattaacatgctaagtgaagtcagaaagagacaggcaaatatcatatgatatcatatgatatcacccggaatctaaaatacggcacaggcgaactcatccgcaaaacagaaacggggtcagacatagagaagagacttgtggttgccagagggggagagggagggctggaccgggagattgggattagcagacacgagctatgacgtaagaacaaggtccttctgttcagcatggagaactctactcaatatcctgtgataaaccataatgggaaaatgtgaacaagaatgtctatatatgtatacctgaatcacttccctgtacagcaggcattaaacacatcataaatcaactctactgcaataaaatacaatttgaaagtgaaacttttagtggctcagtcatgtcaaactctctgcaaccccatggactgcagcctgcccggctcctctgtccatgggattctccagagctgggcagccctgtgtttgggtgctggccctaggtcacctcaggcctcgggtcctaactcattagactaacggaaaatgggacaaccagattaaatcaccttcctctgaagattgccatctgtacgactcagaaagctccttgctccgcctggcccctctggacagtgctaaacaggcttagccttctgcaggcaaacaggaaaagtaggtcagctcagcaacacggttcttgaccggtgacgaaccagtggcgcgaaggcagggcagcagtgagagaggggcagcgcctccccagccctcctgtgcccaggccatccgctcccgtggaggctctgggcactgcccagggggctcagacagccgtcggggacagacagagactcagggagtgaggaaaactcaaaggaagtgtagagaaagtggttcttgaaaaaaaccaaactgcaggaggaacaacccactccagtgttcttgcctggagaatcccagggacggggagcctggtgggctgccgctcggggtcgcacagagtcgg

SEQ ID NO: 37750 - DNA, 1953 bp, Bovine  19866880719435
aacttttggagacaccctaccccagacctatagccttggtatggactgggcctggtacgtgaattttaaaatattccccaggtgattctgaagggcccggcactaaacaagaaaattcttcaagattcccagaacccttgtccacaagaagaggagacttagaaatttagctctctacattaacaattcttccatctgctgaaggacaggcactggagtcagtctcatccatgttcaaatcccagcccctgctgtgtggctcttagtgaatttattaacatctctgagcctcagtccacccatctgtaaaatgggcacactttacagagtggaaatgaaacttaaatgaacaaatataaagtgcctaacagagcacaaacagaaaccagcattttgtcactctatcattttactctagcctccaactgcaaatttttactagatagttttctagtaaaaaactgttctctagacagttttcaggctttctttcggcaggggggaggtgaggagtggatttcattttgcaacaacctactcactgcacttgggtattttaaaagcattttaaatataactaagtaaaaagaattttatttgcaagttattttagagaataagttggcttccctggtggctcagatggtaagaatctgcctgcaagggcaggagacccaggctcagtccctgggttgggaatatccactggaggagggcatggcaacccactttagtattcttgcttagagaattccatggaccagagcagcctagcaggctacagtccatgggtttgcaaagagttggacacaactgagcgactaacactttcacactttctttaccactgagccaccaaggaagcccttcatatacataccttcatttccttacctgtaaattgaggataaaaacacttaccttgtaagggatttatgacagccaaatgcttagatctcagcatcatgcctggcaaagagacatgctccatgaaggtgagccagccccactcagactctgtgaactgggggtcaatcactaacaaatgctcttctgtctcttaccatgcatgtggcaagcttgagttgttttgtttattcaagcattttgaggcaataactcttggcgagtcccaggtgttattaatatctctgaatcaccatgtagttctataaatacctctcctagctgttatttttccccttatctcactaaatgtaagtcagcaatgaagttatgaattaccagctcccttattctctgctctataattaaggaagtgttaggtgagagtcctcgctgaggatgggggtgggttagtgcagcaagtagcatgaatgcaagaggctgtctattacccgggcactacttggggggagagtgccatgggaacatctcaacccagaggagcagagctgggttcccaaaagctgaagggcatatgaagtatcagtccacgggaattctccctgttggggctttagtttttgaaaacccagcttcccagctttgccagaactttgttttatgcctcactgtttcacaggcatctctttttttgcttccccgtgcctactaggggcttccctcatagctcagctggtaacgaatctgccagcaatgcaggagactctggtttgattcctgggtcaggaagatcccctagatcagagactggctacccactccagtattcttgggcctctctggtggctcagatggtaaagaatccacctgcaatgtgggagacctgggttcgatccctgggttgggaagatccactggaggagggcatagcaacccattccagttttcttgcctggagaatcctcatggacagaggagcgtggtaggctacagttcatggagtcacaaagagttggacatgactgagtgactaagcacagcacacatgcctaccagaatcaaccagcaagccattccagctgtatc

SEQ ID NO: 37751 - DNA, 1399 bp, Bovine  19866880799852
gtttggactgaaacaatgtaagcagttttcatgattttccagcacaggatgagaaagaactggcagagtccctgaagctgggaagttgtgttcagaggcagatggtctcccgggcctggacaccaacagggggacaggaggctggaaccgtgctgggccccaggggctgcttaggggccagcctcacctcatctgggctgtagcccttgacctcagctgtgaggcttgctccttttgggtggtttgtgaggagcttcagagactctaggcctgggaccttctctctctgagccaagaatctcccttcacacttgggggaaatactccagctcttgaccctgggcttgcctcctgcatgcccccagcttggagaagagagccccaagtttcctgctctaagtccacccacccaccgccacatgctgaagtctgggggcgcagggcggcccccgctctgcctacagacccctgggtggtggcagtggcagctcatcccctgacccatcgcgaggtgctctggagcatgatctggaagctctccctggaggctctccgcttccttggcccactccgatggcttctgcccccctctagatcccagtgaccaagctcaagcgggcggtgtcctcacagcggtcgcacctgcagctgctgctcctggcctccggcgggaggcgagcttcacgggggcctcggacccctccccagcttttctgcacactgacgccagtcaggaaagcaggcacacatgccttcccacggtcttactccttctgaaaaaaatctctttattactacgtttgaacagaatttactagtgtttcaaactgatgatgctaaaagttttcacctcagattctattaataagtgatgactctgggcagaggccaaatcagcatcaggtggaccccagaactgaccaccccggccctgccctgttccagggtcccaggtggggctgctggacacagggtttgtaccgtgacacggcctgggccacaggacagtggttatacccacagaaggcgtgttctgtgtcacagcctccccacccgcaaagctgactcaaagcaaggaggaaaaagatgctttgagctgcaagatgcaatctctctgcctccctgacctcccccgcacccccctccccaggaaatggggacccttccttgagataagaagcagtaacgcactgacactgttctcagaccaagcgtggtgagccaggggccagctggatgcaccagtgtctgaagggggatctggtgaggatgggtcctcagccaacccctctctgtgaccccacttgccctggggaaccagggggagagagatcccactggggagtccagacgaagcagtcctcctcctgcaaatttgcagacagccgagggcaaggag

SEQ ID NO: 37752 - DNA, 1245 bp, Bovine  19866880811358
ccttccagcccccaagcagagccaggctggatgttccagccatctgacggcaggcctatgagagactcccacgcaagacaaacagaagacacttctgcaggcccagtcaaccctctgaatcatgagaaatcataaatggttattttcagccaataaatctgagtgggttctctcatacagcaggaggtcacggacagaatccacatatgtgtgactgcgtaggtctctgggtggaggtgggaggtcactaaaaattcgcaggcgagctggagcttgagaacaaaacttgtacaactactgagagcatgatttgctcttagcacagggtcagatttacaatagccctctcacacataggtggtgctaaagaacccacctgccaatacaggagatgtaagagatatgggtttgatccctgggttgggaagatcccctggaagaagaaatgtaagcccactctagtattcttgcctggggaatcccatggacagaggagcctggtgggctacagtctatggggttgcaaagagtcggacatgactgagcaactaacactttcactttctcacacataacttttctggaacacagttatggttgcccaagagatggcactcccagaggtgcatggaggaggtgatgctggaaagatctgaggataatgggcactaacctaacgggttaacacgactggccttggtgtctcaggagaataagacactacagggtggtcggccctggcctgctcagcccacttcacagagcgatgagagtggctcgtgctacagaggcaagaaacccagggccagacgcaaaggacactgtggagggttcgggagcaggacccgatgagtcggcctctggacgtcaggtcggggggctgaggagctgatggggatgggcccgagagccccaccaggggctgtgctgcagcacgcgcaacacccacagcagggcccccaccacagaaggaaaagccaaggagaacaggcgcccctaaagctctgctcgatgggcactgcattcctgtcccgactacagtctcttccccagtgcgtgaaatgactctagctcactgcagtggggccaaacagaccctgcccaccatttcctgggcgtgggcgctgcgggcagatgccaggaggaatttaaaagaagctggctattttgggtgttagaacttgccagaatgccaaggcagcaatatgtctgcctgagtgcaattcctgctctccagacatggag

SEQ ID NO: 37753 - DNA, 841 bp, Bovine  19866880845611
ccttgcattgggagcatggagtcttaaccactagaccatcagggaagtccctggttttcagattttaatagaagtttcctaattagtagagcatcagtttaaaccagactgtttggtgtagaatctttctgacagtctctcactcctgcctgggtagaaaaaatatatcacttgattttgcttcacagtgtctcacaccaatgtggattttcactgattataagagggtcaaatataggatacttttgccacctgatgcgaagagctgactcattggaaaagaccctgatgctgggaaagattgagggcaggaagagaaggggaccacagaggatgagatggttggatggcatcaccgactcaatggacgtgggtttgggcggactccgggagttggtgatggacagggaggcctggtgtgctgcggttcatggggtcacaaagaatcggacatgactgagcgactgaacttaactaaactgaaaatataggagctaagcctttaatcactgattcttttttttctgacacttttaagaattattactacttggaacaaatgtatcaatcctagcatgtcatcatacattgagcctttgactctaataggttgagatattggacattaggtttaagaatttccttttgctaaataaaattggatttaataattacattgccagcaagactgtgaaaagtattttcttaatatatttcatgctgatttctttcctgggacattgtgtaagccaagaagctagctgtgagaagatgggtttagtccttgggtttttattagttatcctggaggttcaaatgtatgtaatatttcatctcattt

SEQ ID NO: 37754 - DNA, 2323 bp, Bovine  19866880923967
accccgtgtgctctgaccacgtggggttatttacattcaattagaatatttaaatacaattaaaaattctgtctttgggggatttccctggtggtctggtagttaggacttagtactttcattgccagagccccaattcaatccctgattggggaactaagctcccaaggggtggctacaaaaatgtcttcagtcacactagccccatttcaagtgctcagaggccatgtggctcgtggcttccctagcagccagcgcaggttacagaccacttccatcatcacagaccactctggtggacagcactgggtccaggctctattggatttgtgtccacgggtgcccaggtcttcagaagaaaaggtacaattccttagattcgctgcctttgagaaggcagctgtttgctggcctgaaggtcagaggaggagccctgcactcttcaaagtgcttcacgggagtggctggcctcatgctggggctccgcgtcagccacatggccccagctagagctcgggagtctcggcacacgaggctcctcttcatgtttgtctggccgaagtctgaattctctctcgggcccatgggcaatcgcgcgtttgcatttcagcgagtaaacccttctggatgacaattcatgaccacagagtctccacagagaatcagatctggagcttctcatttcaggagtcagttctgagtcgtcaggaaggttcagtttttgctcttgcttttgttttccatcttcgtggagtgtgtacctttgttcttttcttttccagtcggatgtcatggatcagaatttgttaaatttccttccagagcaagaacactcggaagtctataaaatgctctcttcccatatgcttgtgacggacgccccttccccagaatacttaaaatgtaagtttaccttcactggttttatgagagagaaagataaggatcttatattagaaaggaaagttaagagtctacagccataccacccttaaggcgcccgatctagtctgatctcagaagctaagcagggttgggcctcgttagcactttgatgggagaaaggaagttagaatgaattaagaagggaggactaattttaaaaataattttccttgtgactcagaacatatccaagatccttagaggtatattttaagtttaaagctaaaaccggagtttggaatatgtaagactttgaacttttatgtggaaattttgaaaaccacagagctttagaataataactttgttttgcatgtgataacaagagatttctcttgttatcctttttttcatatgagagccttttagtaataaaggatacaaaaatcactgaataatctgtttgttttggaggacgctagaaaactagatttgtatgatactaagtaaccaactaaaaactgaataattaggtcaaaactctcttctgaggctgtcgtctgattatttatatacatttgcagattttgcggaattttacagtttttatcaaaatcagcaacttggatagaaagctggcctggtcacttaatgaagcgcgttctttgatgatggtagcaacagtgccttatacttattcaagccttagttccttttccatgaataatttgtcctgttgtacatctgattttccttcaaagcaaagtggaaagattaaattaaagagagcagctctatgtgagcagctttattttaacataccatatgaaaacgaccagaactaatcaatgccgacagaaccaaccgcagacatctgtgattaaattaagactaattggctccgagtacgggatgcaaactatctataaactatgggagcagaaaaacctatgttgtcaaggttataaaaccatgtccgaaagtcagctgtacggagacagctagcccggccatgtgttgaccaaactctgtgtgtttcccacaatgccgcttgtttagtctagaatcattggcgtaatgcttttattccctttctctcctttttttcctctaacggcccagctgacaacgatttagagttttattgccatcttctcagaggcagcttgaacccaaaggaatttccaacttatgaatacataaaatttgtaggaaattttcgctcttacaacaatggtaagcattcattgtcatacaattgcggggacctgcccggggggcaagagtttcgcagttgcggggagcagggagaagatgtgccttccacatttgcatgtggatttctgtgctccaaagatgtgcttttgttgctcgtaaatgggtatcgcccattcgggaagaacactcccccacacctgtttatgccagcgcagtaagt

SEQ ID NO: 37755 - DNA, 1242 bp, Bovine  19866881055060
tagcagcacacactaccgctatctgcaaagccatcactctcaaatgacttaatgagtaaaaggaaataaaaagcagaggagtaacatattaaggagaaataatgggaattagaagatttatgcggttcagctctttttaatcagccagccagcttgctagcaacaagagatggtttccactgaggaaggtcctgtggagtggaatgtagtcaccagtgacctctgtcttatctggggttgcagtaggaagttgcttgttcttcattttgctttagccatgttgtaatccccagaatcaaaatatttttaccctttatgcaatcgtttacttaaaaaatctgaacctccaggattttgtcccagatgaggatatcttgcttttaacttttgcttcttcagctttctctggactaatcactttatcttccatttccttctgctcctctgcggaggctgcctgggggacttccgcagacatactgctccctctgcggacaagaggctgagaagagacgtgcccgagatagtggaatttttttaatgtgtcacctggcatcatggaatagtggcagtcctgtgtgatgtccctactgggttttccttgattttgaattccaaatgtttcagaaccactgtcatacaagaacagttcaatccccacctcacccctggggtcttccctgtcttttagggctcccacttttcctttcttttaaaaaaatatcagttaggatattttccctgtaaagtcattagtatataggtgcaggacaattggtaaatataaaaactcacaaagaaaaaaaaaaactcacaaagaagaaaatagtaatcttctatagtctcacttctcaagtgaaaataaatattgtctaagagatgcccttctatcctgctttctgagtttatcacttaactttttaacattctgtataagttgtgtggtaatttcataatatcctatcctcctcctcctatacaattaagtgctgacttggtctagctcctggggtaagcatttacatgtatgagccacttaatccacaaacaaccttgtaaagtgagtactgttattatttcctctttgtaactgaggttcagacagtttaagatatacacccattttaccgagctgctaagtagtggagtctttctgaccaggggagcctggctctggagcccagactccaaaatagtctgatccagtgcacttccgtcataggaggaataaataaaccacag

SEQ ID NO: 37756 - DNA, 1099 bp, Bovine  19866881063948
tgatattttgccgaatttgaatagcaaccagtaaagaaggtcaagttttaaaagaagcaacatgggaggggattgtaattaaattcgctctgggctgggtacggatgattcatcccacacaacatactggaaagcacgtgaccgaaggtatttttctaaataacctcaagtgctagtcgagttattctttaaattgcatgccagcgacatctccaaactggtatttcgcttggcaggcgctgagcctctgccatagcccagattttcctgcagcgagaacccagccttggtttggcagttgtttctgctgccttccacttctgcctggaaggatggcacagctcacgggtctggggagggaggtgcatggtggactccacacgggcagagcacctctgcgtgggtccatggagctgcgcagtgccctcagatgggcaggatgaaggcttaggtcttttccgaatgatggcgctgctgaaattcctctctggggaagattctatggggcacaggtagcacacttggtaacgactccgcctgccactgcaggagacccaagagacctgggctccatccctgggttggaaagagcccctggagtaggaaatggtcaacatgttccagtgttcttgcctaggaaatcccatggagagaggagcctggagggctacagtccacgtggtcgcacagagtcagacacgactgagcacacacaggcacacaggaaggttccgtcgacccaggacccccaggccagagtgtgccccaaacctcctccaccaggaggtgtccccccaccacaccactcctaccattcccagcttactctggttagtacccgtgatacagctgcatgcgggtcctgaccctcgagcctgacccgagctgagcccaccggagcccttcctttttttcagaaattgaagtgtagttgatttacaatgtcgtgtcaggttctggtatacaataaagcgattcagttatacatccatataactactccttttcgtgttcttttccattatggtttattaataggacattgaatgtagtggcctgtgctgcacagtgagaccttgttgtttacctgttttataca

SEQ ID NO: 37757 - DNA, 595 bp, Bovine  19866881126955
atgccgcctgcagtcccgtggcctggcaggccccctgcagtgctgtagcgcagtctagggggaaagtttggggtcacacacataccggcatcgcggctgcctggccgagtcctggcactgggagctcttgggccgatctgggcaaagccggggtgctggcctctgccctcagcttgcttggagtggctgcaagaaaacacggccccttgcagacttgcacacacttaacagctctcttatcaaaagagggagagagaacttccctggtggtccagtggttaagaatccacctgccaaggcaggggacacgagttccatccctggtctgggacgattccacatgctgcggggcagctgtacccatgcgccacagcctctgggctcacgtgctgcagctactgaagcccacgagccttagagcccgtgctctgcaacaagagaggccaccacagtgagaagcccacgcaccgcaactggacacgagtttccgctggccacagctagagaaagcctgcacacagcagtgaagacccagcacagccataaataagtaaatagataaaaattttaaaaagagggggagggtgaccacagg

SEQ ID NO: 37758 - DNA, 945 bp, Bovine  19866881298556
ccccctgcccctaggggagggaggtgacgggcgaggaccccttcgtccctgtccaccttcccatctcaagcctcggcacatcacttggacacaacaacctccttctggcgtgagagtcctttgattcaatgttactgctcattcgggcaggtactcaggagcagtatcactgcaaggtctgaattcgccaaatccattccacgaggtggtgcacctaccgtcaggatctttgaaggtcagcgtgatgaacttgctggccaccatgaacatgagaatcacccaaaagcacgcggccaacagaagccactggtggtgcatgttgtcaaacatcagccattcagcgattcttcctggaaaacacaagccaaatggccctgctgcttacacacaaatcagttacgccaaagacaataaaaagaacaggcaatttcagttaacagcctcgatacaaatgttttaaaatttttttctactgataccatgggtatttgaacttggtaacattatatttttaattactaacaatttataaagttgatgggtttcccaggtggtgctagcagtaaaagatccgcctgccaatgcaggagacgcaagagatacacgtttgatccctgggtcaggaagatcccccaagaaggacatggcaacacactccagtattcctgcgtgggaaatcccatggacagaggagcctggcaggctacagtgcatgactttgcagagtcaggtatgattgtgcaggcgtgcaatataaagttcataataaatcaaattttaatggaaggagccatttctatttggttttagaacacatgataagcctttactcgtgcagttgagcctgctgactctttctggcccaggcacctaccaatgcctggaagccagggcatgagggcgctcactttggcctggacttttgctgtagccaattctaagaag

SEQ ID NO: 37759 - DNA, 959 bp, Bovine  19866881524859
aatgtggatgagaactaattgctgatggtccaataaagttattgaaccgcctttgcatcttgattttccttttctagttggaggtaaagaaggcttgtgtatcttataacatttcccagttacagggtcatctggagagcatttcccagctgccatgcctgggccccttctcccaggagttttaaaagactaaactggtaagcttttgagggtcttagatttaatgaaagaggtacagtttgtcgttcttagctccatttggtaatccgatgaggtgttttcacttctgatttgtgctcagttgttcagttctgtctgactccttgcaaccccaccgggctcctctgtgcttagaatgttccaggcaagaatactggagtgggttgccatttcctcatgtagctaaaggtcagaggtaacctttcttaaaagaacaaacgttatgttaaatttagcctgaaaccaaggtgttgcggggattatgtttcatcactgatgtggattaaatggcataaagaggtgcccttttgaaaccctattgatgagggtagtggggttggaggctacctggagtgtatgctgtgaacatcatcgttgggggggcggggtgggtctccaggtatccagtccaaaccttagacactgaataagatacagacacaaaccaagtcagtacaaaattttgttttttaaaaaaacttggaggccaacattgaaagcgtggtttgtacacattttttggaaggacacaaagtgaatacaaccaaatacattaacatggtttcaattaccagcattgaaacaaaattagtgcaaaaaaagccaaatacaattgcacagatagtggctctcaaatcttaaaagtgaactctgtccctcccgttcaagtgaaggatgagtgcttgggcttctctcaacttggttagtatcagacatctctcactttttttagcttccaa

SEQ ID NO: 37760 - DNA, 1169 bp, Bovine  19866881771299
ttagaatatcatataggttattttatgcagtcttgcaggaaacccattaggaatgtgtttctttcctaattttatgaatggagaaattgaggctgggaaagagtaaggaacttgccaagatcactaagccatcaaggatgcaaaccagggatttggactcaaggtacatgtcactaaaagtgtgggattttagtcgatgtgttatttttttctaaaaagagcctccttgagattggatatgagatagaagaagaatgaaatcagcgagcttgcaaaaagtgtaacatacatggcagatacgaaatagctttaggatttttttcaccatgcatatctttaatttttgctttgaaggattagaagagtatgttttggtggaagctgctcagcatgaactatttatttatgacttaaaatgtgatattttgtcaaaaaatttccaattcataacaaagtagaattataaactatagccataatattttgcctccttttttgatccaataagaaatatagatttctatttattacagtatttaccactttggttcaaggagaataaccaaggtctttaaacaccacagagatgaagatgtcttttgtattaaaatacagttgaacagcaagtctactgaatgaaagaaaaaaaatgaatgattgctttttgaacataaacctcttatctgtatcatattgaatacaatagcttatggacattatagacacaacacacacacataatagcaaagatttgtgttctataaattctataaaagaaagttctataaagcatcagtcaacaattacttttcaaacatctggtctgtgtctaccagtcaactgggtactctatgcacaaacatacatttttcaaataaacctataggataactgacttgtatcaaatttgtttccgttgcatattttgaattcattgtttctcatattcaggatgaaaaattatttttaataataattcagaaatgggaaaaggaaaaactgagaaaaaatctgcattgatattattcaaaaacattggtgtagactgagttgtgttcaagccttgacccctcaaggtgactttatttggaaacagcttttaaggagctaactaaggttaaatgaggtataaggatggagccctaagccaataggactggtgtccttta

SEQ ID NO: 37761 - DNA, 4556 bp, Bovine  19866880813115
aatgaaccgagtgcttctggtgcttttcctggcctttttctttttattatcttttgacctcttaatgcaggatgctcttggtgagttgtggatgaacacctttagagaacctgaaaggaacatgactttgcatttagatgcaagtaaaattttctatcttaaaagccttattcttctcagattgacatatgttatcccttttcttctctccttggcttctttcctgcttttctttctttccctggtgagacacatcaagaatttccaagtcaacttgaaccactcgagagacttcagcacagaggccgataaaagggccacgaaaatggtgacaacatttctccacctcgtcatcgtttactttatttccattctaattggagaatggatcttctttaagctacactggtatgaggtcatgatgtttgtcatggtgattccaactctcttttcatccggccactcgtttgttataattttgggaaacagcaagctaaggcagattgctttcagactattgtggggtcttaagttctctaaaaactaatcaaaacctttagcttaatagacattaaaaaaactttctgtattctacatggaaataccttaatagaagactttgtatgttcatttttaattcctagtttttcttttattaatccttttaagtgttattaaactgcactggtttgccttacaacatgctgttacctaattatattttctcaaagtcatctgatataatgttcaattaaggaaattgcttctgctgtaacatttgctcttaacaaaggattatttggaacctgaagaagaaagcttataaaactgtacaatgaaatctaataagcatatatgttcaacacaattacatatgaataaatgtatatgaaatcacagtcatagaaagagaaaagagtaatgcaattttaaactaaacgtaaatttaaaattagaatagtaaaatatttttttaaaatttagagtgtaataagtgcaataaatgtttatataaatataaaagtataaatattactctgatgttactaattttggaaaggatctgaaacagttgaaaatttcatacaccattcatagaattacacatatgtaaaacaactttatgcaatagtgtgactttaagtagttagggtgaacacgctaaacctaagacagttcagttcagttcagttgctcagtcgtgtccgactctttgtgaccccatgaaccgcagcatgccaggcctccctgtccattaccaactcccagagtccacccaaacccatgcccatagagtcagtgatgccatccaaccatcttatcctctgtcatccccttctcctcctgtcctcaatctttcccagcatcagggtcttttcaaatgagtcagctcttctcatcaggtggacaaagtattggagtttcagcttcaacgtcagtccctccaatgaatacccaggactgatctccctaaggatggactggttggatctcctttcagtccaagggactctcaagagtcttctccaacaccacagttcaaaagcatcaattcttcagtgctcagccttctttatagtccaactcatatccatacatgaccactggaaaaaccatagccttgactagatggacctttgttggcaatgtctctgctttttaatatgctgtctaaacctaagacagtaatttcactcttatttttatacacaaagaaatctttgatatatatgcaccaatatatatatgcaaaaatgtgcatattactctttttcttagctgaaattgagaagtttaataacagtccatcagtacaaaatgaataagtatattgtggcatacgaatacaaatatactgtggcaactgatacaacaatgaaaaggaacaaattagatccataacattttttagttctttgttaaagaagaaaagacatacatgtagagaagcaaatttgcaaagcatagtacatattttgtgtaatgtttgtatatatttgtgtttatgtattgatgcttttactactgtaataaaatactccagattcattcataagtcagaacacaaataagcagatgggagaattttgcttgctaatggtgctattaaatatgaaagaagtatacagactgtattatcaagcagagtatatagacatatccatataaaatgcaataaaagtaaagtattgttttgtttgccataaatttagagtaagcagagaaaaaataacaagtaaatcattttaagtatgttagttttaatgttcttgatgaagtcatgagtgaaagtattctttcaaattagccctggtgctgagaatgatgtaagtatcctaagaccatagagaagattgcagtgttctctgacaattagaaaactagacaaatacatatctatcagttagaattctccaatttagttgtgtcataattatatttaatgatttatatttgaaatatttaataaaaagtttaaaaatgtctaaataattttctaaagatcactgtagataatttaaccttagtgaaaatagtaaagtttaactcaagttgaatacattagaaattgagtagtctttagtttgtgtattacctgagctaattattgataggtaatcttaaaattacagggttaagtccccaaaccttctttctaacattagaggtagtgaataaagactactgaaaaataaaagccatggaatagaatggtgtctctgtgataatgtattacattttgcttatttgaatggcatttgggatgaagttctgttccttgactttcctgagtgagagcctgtagtaacaaccgagcagtagacaagctgccatccaacttggtgaagaatgactagatcatgattttacttacactgtgactaaattttggaaacagaagggaatgcttcctatttttccttaacactactaaaattaaaaggctttctttaagatgttggtatccttttttttttttttccagtttccccaccaaagacaatggatagaagagtaagagactgttcttatcaattgaaacaacaggactggtaaaatgaatattcaaaattaaaagctcaacagacatatttaataaccaattagacattgttgaaaaacaaattagtgaattagatgattactacccagaatgaggcataaagagacagagatgcacaatacaggttagaggggaggagatatgaaggttatagactgaaattctgacacatttctgtatttctgagaagtgggagagaaaatattggagtggaaccaatgttgtccagattttttcaaaatgttcaaggcattaattaaaaaaaaattattgaatttcagacagtatgatggagacaatttaacttaacaccattagaaaccaggaggaaatctctcaagtaaccagagagaaagagtagattatattaaaagaaacagctgttcaaatgatttttaaatgagaaatgtatctgggagccagttacagtttggctgattgtcagtttgcatgcgtgctcagttattcagtagtgtctgggtctctgtgactccaagggctgtagcctgctaagctcctgtgtccatcagattatcccagcaagaatactggttgccattttcttctccagatggtcttcctgaccagggatcaaactcatgtctcctgtggctcctgcattgacaggcaaattctttaccactgaatcacctgggaagaccctgattgtaagtttaggttaaatctttctggaaagaaagattaggttaaatctttctggaaaagcttgattcaatgattcacttattctccttttgggaccagggtacttgcctgggcatgttttcatggtgattaaagatgagcaagcccggggcagccccagtgtggaaaccatttaaaacctatatgatgtgcctgtagtggaggatgtgcatgtgtgtgcatgcatgctcagttgtgtcccactcctagtgaccccatgaactgtagcccacgaggctcctctgtccatgggaatgtccatgcaaaaatactggagtgcctagccatttccttctctgggggatcttcccaacccaaggattgaatctgcgtttcctgcaaaggcaggcagatttactactgtgccactgtgccacctgggaaacccatggtaaggatacaacaaaattatttcccaaaggtataggtacagtgaggattaaagaatttcatgaaaatgaggcaatctatttcagtatatcctcttgattttttcacacttctctcatatacaaaacatgctcatttctatctgagcatgtccaaagtttcgttcagttacagcattattcttgaattccaggatcttattatctatatcttatttagctatgtcttctcttcatctggtaatcaggaaactaaaaagataagttatctacttgacaaagatctgtaaactgattctgtcatgcttgatggtgacccacaggtctcttaacaatcttcactcctttcattcgcctttctttttgcccctctgattggatgatctctactgctttgt

SEQ ID NO: 37762 - DNA, 1511 bp, Bovine  19866880869237
tcagctttacaaattgcacaagggcatgttatttgtaccagtcttatcatcagtaggctgtacaaaaaaacagaggtccttcagggtacataaattgtgctttgaacagttgctacaattattcagtgcagggtgaattctgagatattgaaagaacgcttttcggaactagaccataatctgagttataatcagttacatgtctgaataagtcacgaatgtagaggtggtctatgaggaaaaatacagtgcttactagttaaaatagattatataagttaatgaaatgggcatcacttaaacaccagaagaatatggacgatccattaagatgttaccttaagggtattcggggcttggaagtaatgtcagtaatattctaagccttccccgcctaaccacatatttcacaggtgcccatgaagaaaattatagaagccttcatacataatctgaacgtttcatgggtttacatgagggaaaatttgatatttgcatgtaatatgtacctcaaaaaataattaatctgtgtttgctttacatgtgttaatttccggcacttccaactgaaacagtcctaatacataggaaaatcattgcctgagattgtgactctttaagttttaatagtatgttgtgaatacagagactctgccctaactggcttatttaaacagattaatgttatgaaatcgaacgggaacagttcagagcagactaacccgagttttaacgcgagctttggacggggctctagggcaaataacagaattttacttagtttcctttcttcattttaaagtgaaacgagtatctgtaaggctgtttgtaatggctatataaaataactgtgtggcatatatgtaaataagtaacccgttccggacctaccaagagttaaactctaaacgctgaatgtcactttaagcagcagacaggaaggggaggagcgccagccgcagccccagcctcaccgccgctcggagagaagcggtgtctgcgtgaggcgggagtgctagcccggaggccgctaagtccccggcccctccaggtcatcgccatcagttgggggtccgcggggtctgcggtcaccctcggttccaggcaccgcaccgggctagcggcaacatcgcgtccatggccaccacggcggctccgtcatctttggccctcagggcctcgagcccggccgcgacccccagctcgtacggggtcttctgcaaggggctttcccgcaccctgctcgccttcttcgagctggcctggcagctgcgcatgaacttcccgtatttctacatcgcgggctccgtcgttctcaacatccgcttgcaggtacatttttagagccctggggatgccgccggcgttccgggcctgcgttgtggccgactcccaggaggcgccgcggcaccgtggagcttggggcgagcagtcccgctgtctcgcgagagtgcttggtctccctccaccgctgcgctctcgcctctccgccgtctgctctcctccgatcc

SEQ ID NO: 37763 - DNA, 1462 bp, Bovine  19866881070185
tggggctttcttggtgttactgctgtgcaggctttgctctagatgcggagagtgggcttctcattgtgctggcttccctggttgcagaacacgggctctagggtgcacaggcttcagcagttgcagcacaggggttcagaagttgcggcttccaggctccaggacacaggctcaatagttgtgtgcaagggcccagttgctccatgacatgtgggaccttcccctgtcagggactcaacccgtgtctcctgcattggcaggcagactctccaccactgagccaccagggaagcccccttgatttatttatagcttaatattatacaaatatttaacctgctctaccttgcaaaggatgggcatgtccaaatgattgtgtatttgtccttatatattcagtggtaaacatacacccattttttgattagtagaactgttaagatgaccatgatgcttgctttgtaaaacatcgattcacctctgtgagtagattgttagtttataggccattctagggaaagtttctgatgctcagtggaatttaccaatacaatattataaagttaaaaaataaaataaaataaaaaattttttaaaggaatccagtaagaaaaacagaagttaaaaatgagtctttactgtctcttgattaattcaatgctcttggactatagaaaattctggataaatctatgaagctaaagatttcactcttttcgggtggcagttaagataccacagtagtcgtaaggcattctgtctcagcttgctatttcccaaaattaggataaaggagtggcttgaaggaaaaacagtcgaagttaacacaaccaccaattgggccagacgtccctgcagtttaaggaaaacccaagctattaataggatggaagagacatgaatgatgaagaggaagaggaaagacatcacgattttcatggctcttttatgggcctctgtgctgagatcctttgagctggggttgaactgcaaattcctgatgtgtctcatcaaggagagaactaagaggagcagtgaggtcagggacagaagaaaggggattaagttgatgaagttaaaaacaatcaactggtgaagataatgagtttcacttacatctgaggaccacgttgagtttcttacatatattttgtagctgttagttaagatatgactaagtgtatatattgattcataattcaaaaacagtaaggacaaagaccccaagagaagcaccagtaccacactacgaattcgccaccgcagccaagtgaagcaggggtgggagaagttggctactttaaagaagtagaaaacacttagacaggtggcaaaccaggtagctaggtgattggacaatatccaaaaactactaacaacttttgttagtttatcaatggcatataggtgggccatagtaccaataaaaatgagtcacatagtattacccaaagtgactatt

SEQ ID NO: 37764 - DNA, 1160 bp, Bovine  19866881155942
tttatttgatggatgaaaaaaggggggttagtgagaaatcagtgttaatctccctcttaccccaacattttttgtcacagggtaggttattatctggagaaggaaatggcaacacagtccagtatccttgcctagagagtcctgtgaacagaggagcctggtgggctgctgtccatagggtcacacagagtcggacatgattgaagcaacttagcagcagcagcagcaggttattatcattcagtctttcttctccagattgcatgggaccagcaacatacatattgggagtggctgttcttgtattgtggcttgtctgccactgagtcacccacagaggctcttttcacagggctgccaagcttgatctcatctgctgttcaagcatactgcttataatatctatacatcaattgtaattactctagcctatggcctggtcttttattagtcctttggtatacttcttttacaaaaatagggctctgttccttataattccatcttcctaaggttgctgcagaagtatgggcttactcctagttagacatttacactgaaggttcacttattagaagcaaagtttgcttattatttgatatactttaccaaagagaaatttagtaactaaaaaaacaaaggtaaaacttagatgttacttttggttattatcttataaagagtgcaagattatctttaagtaatttatatgaaaggctatccaagacaaaacaaactcagctaaatgtattcagcttgatttgtacattactttttaccaatccaagataactacaatgataatctttggtaaaatactaagttagtgtccaaaacaatgtatgtacattttattttgtaaaatgaaagttactttttataacagacactctatttttttttaaactttattttgttagagtatagccgattaatgttgtgatagtttcaggcagatggcaaagtaactcagtcatacatatacatgtatccattttcccccaaactttcctcctatccagtctgctacatagcattgagcaagacactctatttcttatcattaaaaccatcatcagaatcattattgtaactgatacataaaagcaccacagagtctagatgtgctagccgtttcagttcatttcaattcagttcag

SEQ ID NO: 37765 - DNA, 893 bp, Bovine  19866880142341
cttggaagaaaagttatgaccaacctagatagcatattcaaaagcagagatgttactttgccaacaaaggtccatctagtcaaggctatggtttttccagtggtcatgtatggatgtgagagttggactgtgaagaaagctgagcactgaagaattgatgtttttgaactgtggttttggagaagactcttgagagtcccttggactgcaaggagatcaaaccagtccatcctaaaggagatcagccctgggtgttcattggaaggactgagctgaagctgaaactccaatactttggccacttcatgcaaagagttgactcattggaaaagaccctgatgctgggagggattgggggcaggaggagaaggggatgacagaggatgagatggctggatggcatcatcgactcgatgcacatgagtttgggtgaactccaggagttggtgatggacagggaggcctggcgtgctgcgattcatggggtcacaaagagttggacacgactgattgactgaactgaactgaacttagctatctagggccagtatcctacttttctccatcctgaatcccctcagggtgcacatttggaagtggctgccgtggttgttggcttgatggtcacaacatattttgcttactggtatggcaggcagtatttctcattcatgtgactatacccgggtcctctgcactgcagacagattctttaccctctgagccaccagggaagccctatacaacagtaggacaatcctactacacaagtgtaggtgttacctggattcagtggcctgagtgctttcccctcccctttaaagtttcttttggtttcacattttaagggtctatcattttacaaataagtcataaaaaatagaaaacagatt

SEQ ID NO: 37766 - DNA, 923 bp, Bovine  19866880355880
tgtacttttcctctgaagctcttaaatatatatttgaattgattgcagatatacttttgagagatcatgttccactgagcatcatttattaatggtccttgctgctgctgctgctgctgctaaatcgattcagtcgtgtccgactctttgcgaccccatagatggcagcccagcaggctccccagtccctgggattctccaggcaagaacactggagtgggttgccatttcctcctccaatgcatgaaagtgaaaagtgaaagtgaagtcactcagtcgtgtctgactcttagcgaccccatggactgcagcctaccaggctcctccgtccatgggattttccgggcaagagtactggagtggggtgccattgccttctccgattaatggtccttaagccaccaataatttgaaatgaacaatatgcagagtattggatgtttattaaatttttttaaggggaatttttacttactcagagactcagttgcctcttctgtgatggtttattttggcaaacattaacccaccccattttccaacagctttggttcctgctgtccatcctgtgagcactgcccacccacatcagggacattattgaattgtcttgaattgcttggtgccagtacttctcagggaaacataataggaagatttttgtttgtttttctgtttcatagtgttttcatgttttaaaaaatagacccctgtgtaaaagacaaaattatgtttactgtctgctagaatgcttacttcaaacttgtcgtaataacttgttcccttcgtttcaataattcagtacaacttcaaaaatatgtgttttcttcttacaggtggttgatagtaaaagattcctttttactgtatatgaaaccagacagtggtgctattgccttcgtcctgctggtggataaagaatt

SEQ ID NO: 37767 - DNA, 1874 bp, Bovine  19866880403761
aattgatgcttttgaactgtggtgttggagaagactcctgagagtcccttagactgcaaggagatcaaaccagtcaatcctaaaggaaatcaatcctgaatattcattggaaggactgatgctgaagttgaaactccaatactttggccacctgatgcaaagagccaactcattagaaaagaccctgatgttgggaaagattgaaggcaggaggagaaggggacaacagaggatgagatggttggggcatcaccgaatcaatggacttgagtttgagcaagctccgggaaatggtgaaggacagggaagcctggcatgctgcagtccatggggtcgcaaagagtcaaacacaactgagtgactgaacaacaattataactagacttattttggtgatcatttcataatatacatacatatctcatcattatgttgtacactaaaactaactcaacaattttatgtcaattttacctcaaaaaaaaaaaagcaagaaaagcaagttgcagagaagtgtgtaaattttttaaacttatgtactgtttcccactgtaattaataataatacacaggatgcatctttgaagtgaaatgaatgtattgttttccaaataattttcatccagatttgcatccttgcctaattcaattttaacttcaagtggttgcaaatgaatcttttattattaagataaactttgttgaagtatattgaatcatttaaaaaaaacccattttgtttcatagcatgttttaaaggctgaatgatctacataatggtttcctttctccttaacttggcctatgtcgacccaaaataaataggcttacctcatgcttggtcattgtctccatgaatacagctgacgttttctgttttcttttagaccatctgacacttccagaaaaaaatttttataacaaattagccaatgagacaagtaagttacacttttgattttggcatcggcatcagcagcattgattagcaatacttatcagaataaaattttattaatctggtctctagttttctgcacttgacagttgctttttgaattttctgccaaggctggttcagtggtattagctacaagtagtatttttgtgagtacaacattcaaaatctgactccataaaacagattagaaaatttcacaatactgcatttttttactgtctggtttttgatgttaaatacatagattagttgaaaataaactagactgttttgagtacaagtgactagtgcaatataaatttatctcagtttgaattgcatcatctaaaatcattcttcaaaaaaaatcaccaagcacatgaaagagcattaaagtttgttcaaatgattaagtttatgttttattgtttattaaagccttaactgagaagaaacaagcaaggaaattttttgtttgggatgagaagaattaatcctaaatcccgtactcctctatttcagtaaaatgaaacttttaccacaacgtagactccttagtaaccaatgaaaatagagaattaaacagtaaacttttaaaattaattttttattgaagtatatttgattcacagtgctgtgttaattactgctatacaccaaagtgattgctatacacatacatacattaaaaaaatttttttcattatggtttatcataggatattgaacatagttctttgtgccataagtagaaccttgctgctaaaaattaaacttttaattagaaagtttcatacaaaaaaaaaagtttcatacgcttttatctatttagaagcattaagagatctcactgaggaattaggtgagtaactatttgtacattcagaaaaaacttctcacctttgaacttaaggtgattttatagttacataaa

SEQ ID NO: 37768 - DNA, 909 bp, Bovine  19866880444240
agctgcattcctgcactgcccccccgccccccgcccccgggccacacttctttgcacctgtgcattactcattctgcatgccattctctccataattacgaacagaaatccttgttctcttcaatgtcattgtgtccttggcatcctgctcagggtctggcaactagatcgggttcagcaaaggtttgttgaacagaacaaagcagcacccagaatttctaaaatcaggagttgaaggctgtattaccggcctctctcttgatatctaatctctttaacagtcttagagcttgtatttctgtagccctgactgtatttatttttgaatttattttgtactggggtatagccaggtaagaatgttgtgatagtttcaggtgaacagtaaagggactcagtcatacatatttgttgttgttgtttagttgctaagttgtgttcgactctttgtgactccatggactgtagcctgccaggctcccctgtctgtggggtttcccaggctagaatactggagtgggttgccatttcctcctcctccagggggatcttccccacccagggatctaaccgaggtctcctgcattgcaggctgattcctcaccgctgagccaccgggaaagcccccagccacacatacacatgtatctattgtcccacaaacttcactcccatccagcgtagccctgaatttaaatcaagttctttttaaaactgtgttagccatcgtgcttgttgtgaatggattcactaacttcctttaccattcatgccagtcactgggagttttaaatatgctccttctacccgccgtggatgattattgtctagctccagtgctcttggcctctaataaaacaattgctgcttgttatgtagtagttagtaacatttctgttataaagtctc

SEQ ID NO: 37769 - DNA, 2718 bp, Bovine  19866880497168
tgaagttgctattcgtgtccgactgttcgcaaccccatggactgcagcctaccaggctcctccatccatgggattttctaggcaaaagtactggagtcactcagtcgtgtccaattctttgggaccccacagactgtagcctgccaaagtcctctatccatgggattctccaggcaagaatactggagtgggttgccgtttccttctccagaggatcttcccctgacccagggatcgaacccaggtctcctgtgttgcaggcagattctttacagtctgagctacaattctgacaaaaggaaagaaccgacaatggtttaatcttaggcactcagacgggcagtctgagaaacttagggatggtttccctggctcctctcacaccacaagcaactccctgacactcaaaactgacctctgtgcatatagatgtatgtctagtgtgtaacaggaagtttgctttggctggtctcagagggatccatttgtctagggaggtctgcacggccaatgaagccactgcctcccttgccatcttagcagctttaagagggtggagtatttttctttgaggccaagtttggcccagagaacttcctcactgaaattttctgccaggttggggttgcttttcttgcataagtccaccccttactctcaccccatccccctatttgcctttggtcaaatttctggaattttggcctatgtttgtggggttaggtctattccttcctggtgcagtggatgtaaagatatgctttctcttgggtgaaatttacaagcacattttcctctttgacaggaacaaagagccacaaatatttcctaaggggagaaaaaagcttccagatgcaggactccaaataaatgtgagggttcccccccccgccactttttcctttggcattttttaagcttaataattgcactggacatatttatccagaagaaggcccacagttttcccaacttcactgaaatttccaagttacaaatacatccacctctcccttgcttgggctccaggccatttatctctttcttaaggcagtcaccacagatgtcttgagtttcaaccctgtctagggactgaggaagataggagaaggcccctttttcctcttagtctcctgagctctggtaacacagaataatcaaggtgggagggacacttctaaactcttgaaccatcagtaaactaattttaaattatctctacttagagggttactgaaaagaaaattataaatgtcaagaagacctttcaacaaacttttacaatctgtagcatatttctatattttttaaactaattaaagcattctaattggtatcattttctatttttagtttataatcttaaaatttttctcttaccatgatcagaataattgtgggagatacttaactcacatgtggaaaatcattatcacccacacgttttttaaaaggtttttgaagaaataaggtacttatatttgattagaaaaacagctctccttttaagcgttggcaaagaatgcactaagtcctaagaaatcattttggttctatgtcttaacatttacttataagcaatcatggagacatttaatgcagctaaatggctttaaagaaggctgagcaccaaaaaattgatgctttcaaactctggtgctggagaagacgcttgagagtcccttggacagcaaggagatcaaaccagtcaatcctaaaggaaatcaaccctgaatattcattagaaggatcaatgctgaagctgaagctccagtactttggccacctgatgtgaagagctgactcattggaaaagaccctgatgctggggaagattgagggcagcaagagaaggggacgacataggacgaaatgcttggatggcatcaccaactcaatggacatgagtttgagcaaactccaggagatagtgaaggacatggaagcctgtcatgctgcagtccatggggtcacgaagagtcagacatgatttagcaactgaaccacaacaacaaatggctttagccagtttttattctaacaggaatgaaattaaagtgcctaggaatcagattctgcttcaggaggtctggggctagagaaatattccacatctctaataacaaattctcaggagatgcagacactgcaggtccatggagctgagaggacgtagagtacagtacatcttcctatccctaagctgccactcatgggtgaaatacatatgtggacacgggtatcatacagcctcaagaatacaggggaatggactgctccctccagaggttcccttggtatgttttttacagtggattgaaaagtgatttaatctatgctgttcaaaaaataagcgaatcccttctaaattctaagccctaggctagtcactatctaacataaagttgcataatactgcataatataaaatataaagaccttattaaatttgacatctgtactctgattatcacctctttcaagactaaagaattctctattgctccttccacccttgcagcactttttattttgaaaattttcaaatctatagaaacactgaaagtgtaaaataactaacaaatttaaacctagatttaccaatctttaacatgctgctatactctctttctgtctgtgcatacacatctatatacaattaaatatacactgagcttattttaatgtttgaggtcaaactgttgacaataagttgca

SEQ ID NO: 37770 - DNA, 1607 bp, Bovine  19866880511306
ctgagtgaaaaatgttatccacatttcctttctaattttgaaggaaaatagaatcctagagctatctattagacacttattggtagaatggtagaagtatttgattcctggtttttatttgtgaagagattagaaggagctttaacaaaataagaccaattagagaacttttagaggaggaaatggcaacccacttcagtattcttgcctggagaatacaatggacaaaggagcctggaatcacaaagagtcggacatgactgaagcaacttagcagcagcagcagcagacaaattttaagtaacttagtaaacgaagaaaacaattttgtggaatagagatacacaggacttttacataggacaataaagctacataggacttcttttttttttttacttctgtatccaagtagtcaagagctcatgctaaatgctaacagtaaaattctcctttgctaaacacttttaaacattccattatgttcgagataattttatgctttgagaaaaggggagatgggatcacactgctgatatgggggtagagattactggtgagggtgaccagttcttccatgaactcagtttccagtggggaacaccaagaccccatcctatggacttaccactcctgaattcagtgagtgatctggaatgacctggcactttagatttttttcttctctagatccatctaggtgacttgtagacgcttctttccacacaaccaaagaaagccatttgggaatgctatttttctctgaataggcctcttgtgttgtgattggctttgctcttgggagatggactgtaaatggagacttgcaattgttaaaaataaagatttttacccaagttcattgctacctctgctcatatatgcttggttttcaatttgttactcacttgcaggtggagcagggttatatgcctctaacttaaacatcattgattaagcaatatagcaatcttctgtcagtatttaagtacagagctaaggaatccactcctttttaggcccacttgccaggaatcaccttgaccaggcttcagaggaatgccctctttggtgaggctctggaaaagctggatggagagtaactcatatcctccttctacttctctgtgagtgagaaatgctttaaaagaaagagagatttacatacctaggaaggtcaccatggctcagatattcttggcctcatctttgaaattgctcatcaaatagaggttaggaactctgacatatttggagaaaaaaagagatcaaatcaagcaaacaaagttttcaaaagttacttctagagaaaagaaaagtgttcttacctgaagtagccaatctccttcattctctgagaaaagatgctttggctaccttagttcacagtaattcttagatttatttggaataaaagagtaaaatgaattttcggcccctctgatagctacaatcattttatgagttcataaagccaagtctttagaagaaatatggccttcagtccctgttaatatatcaaagtctaaaagtctgtatagtgttctattgacttatttttgaggactatattcttttttccccccaacatatcattaagggcaggg

SEQ ID NO: 37771 - DNA, 1959 bp, Bovine  19866880524889
tatatttatttatttttaattggaatataattgctttacaatattgtgttggtttctgccatatatcaacatgaatcagccataggtatacatatgtagtctccctcttgaacctcccctcccacctctcaccccttcccacacctctaaattgtcacagaacactggtttgagttccttgagtcatacagcaaattcccactggctatctattttacatacggtaatgtgtatatttccttaattcgtcccaccctactctctcaactcatcccacgctctccctcccctactgtgtccacaatctgttctctgtgtcttcatctccatagtgaaaagggaaagtgaagttgctcagtcgtgtccgactcttagcgaccccatggactgcagcccaccaggctcctctgcccatgggattttccaggcaagagtactggagtgggttgtcatctccattactgccctgcaaataagatcattagtaccatcttttagattccatatacatgtgtcagtatacagtatttgtttctctctttctgacttactccaatctatataataagctctaggttcatctaccacattagaactgactccaaacgcattcctttttatggctgaataatattccattgtatatatgtaccgttgcttctttatcccttcatctattgatggacatctaggttgcttccatgtcctagctattgtaaatagtgctgcagtgaacatcgggggtacatgctgtctttttccctcgtagacacacacttagtcttaatggcttcttttgatttcctttttttttttttttaaataggcttgtatggttgagtgcctgaattactgtaccatttgaaacagtgcctgcaaacaaactgcttttgtctcagttactcattcaggaggacatttatatttcagggttgttctcggctatctttctgacccgagtgaagacattcaggatccagtgagtgataaattcttcaaggaggtgtgggtttcaacagcagctcgaaatgctacaatttatgataaggtgagattttcgtatccttctcctttttaaattgaattacatcacaaaagtatatcattatttctgcatattattggtacagagtattcttaacgagtgtaaaaacacaacatacctccaaattataatcaaataattctttgtagacattaagaaaacagagtcaaaaagagccatggattatggtttagaagagacttgagtggcattctggtctcagattccagaatcccatcatgagcatccttagcaagtggttacccagactttgtacatgtctagagataaaaagaaaaagctgctgctgctaagtcacttcagttgtgtccaactctgtgtgaccccatagatgtcagcccaccaggctctcctgcccctgggattctccaggcaagaacactggagtgggttgccatttccttctccagtgcatgaaagtgaaaaagtgaaagtgaagtcactcagtcgtgtctgactcttagcgaccccaaggactgcagcccaccaggctcctccatccacgggattttccagacaagagtactggagtggggtgccattgccttctccaaaagaaaaagcagatgggatcaaaaaatgagtcagacctgggttcagcccagctcacacagttgctggtcgtatgagtatgtgtatagtaatttcatgttctgagccttcctttctttcctctcttataaattggagggaatattcatgaggtggtcatgaggataaaaaataatctgttaaatgtatttagtacaagtagattatatccattctaatgacgaagcttattaatagtgagaaacttcctcatttggacagttaaatgtatttagcacatagtagattatatccattctaatgatgaagcttattaataatgacacttcctcattttggca

SEQ ID NO: 37772 - DNA, 1350 bp, Bovine  19866880557435
gtattgggacatgtattgattctttgtggtatcacacaaggtactgtgaagaaagatcttctcttgaccttgatggaatgattttaaagacttggaacctgcatattttttaatggtttgcaatttaattccctaacagaaattaaacatgctatgactgtctattttcataaaggttcaaatccaaagcaaagtaagaatagatcaagatgggaatatttaaaagctattatttgtcttactgactctcaacactttgtaggtttataggtccctttaagtatctgatgaaggatatgaccccccccccaccttctaccagaaaaatattcatgcatacatccattttaaattgcatataaaacaaatgtatactcagtttcctggaattctggtataggacccctgattcattgagaaactcaggtgctctgtacagtgagggctgcctggcatataacagaatggcagaatctgtgctctcagagcttccagtcccattggggtggaaacagcatgcccccaagacgcagttcggtaatagtgcccttcgcgtcctctttggctcaggagcaacagttcctgcccagcactgcaccctccacagaggaatcctgcaggttagtaaatgcccacttcagcaaggggcccaggaaggtcacgtctgccttttgtagtcatgtggtattggaggacttattcacctctctgagccttgctgtcttgtcaaagtggagatgctaattctccttttcagggttactgtggacatcagctctgttcagtcttgagagggtgctgtgcagatggtgatgctgggcagttatatctccttttcttgggagaattagtaaaagagatttcaaggatttcaactacacagcatgttactctgaattgagggtcacagattctttgttttgattatctgggtattactttaaatcctctcacttggagtaaacatgtcaaaattacttaaatatagattgcacaccaaatcaaggacagaaatatctttgtaaaaataatattgcatgtatacttactgtgatattatgattggttacttcaataaagataatcttagatggagctatgccttttaaattgggttgaggcaggaggaagagcccataatggtgcccctgtcaaaatgaatgaaaacaaagggagaagaggcacagcctgctgcagagagaggcacagtcccatgaaaagtcccctgaactgtgccgcaggcctgatgacctactgactgtgtgatcctatggctgtgattattctcacaaaaacaactcagttgtctcaaacctgtggaaccagagtcctcaggaaatggagtattgg

SEQ ID NO: 37773 - DNA, 1360 bp, Bovine  19866880736965
ttgagatggttggggttctctccggctgagtctgagagtccccttcagttgacagttggtactgttatgtacacatttatctgtgtatctgtctattcagtttgcttgcttctttacttacttttatgtaattactttgaagaagtgataagatattttggaattttatttgtaagttaaccttaccattttccagatcctgaatgacatgatttaaaggaatctaatttgctagtccagaaaaaatgataatgccaaataggaaagtttatttctgatttatggtggaagtagacataataattcttgaattgttgtttgtacatgactatgagacccaaatccaaaacctgttttatttttgaaactggtgttgttgactaatacgtgatttttctttgcagtggagaagaattagaatgtaacctgaaagatcttaggccagcaaccgattatcatgtgaggtgagtattggggacctcggattgctaaaataaatggtttgctcctttttaaaagtatttggttaacagcacttgcctagctaaaagtttcagcacctttgctcattggccattcctcagtgccctacactttctggcatcaagattgggagtccacagaagtgcttctggtcatagaaaagtagatgataccctgaacagaattttaaaattatttttataaagtaacttttatttcacatattcttctaagatctattggaacatgtggcttaatgtatgatattttctatcagttatttcattatagaccttccatgcaaaccatatgttcagcacgaatgactaaataaagtccttttcatgtttcaagtttggaccataaaaggcaataggttttgaatttgaagtctagtaatgcaaatatgaacattatctctaacaagagctaatgcagtttgccaaagcaactcacatagtttggtttgtagtctgaaatctcttctgtgattttttttcaatctcttccatgactgctctggaaggcagggcctgctaattttaggaagaaacccagccaaccaccaacctgcaaagagaaaagtatcagagctcatctgattatccaaagatatatcaatttgcgaacaggcagatttcttaatctgaatgtgatccataatatcttttaagttttcattaaaactttcattttgtataatttttaatttatccagaaattcttattttatctaacctggtgaacaacaacaaattctctctcctttcttcaattgtgcatgtgtatatcaagatgatgtaataaaattgcaagcatcctttgttacactttacaaggttagttcacacaacatgtttctgtggtggtggtgtag

SEQ ID NO: 37774 - DNA, 743 bp, Bovine  19866880767539
atggattgtgagttatactagatcctgagaagacaagcagggagctcagacaattagtgaaaagatcctaaaacaacatttaaaggctgtgtccaaattcaagctaaaagactgtgccctattcacatgtacgttatcataaaacatttaatactgaaagaaaatcttattcaaagaggcagtgtgtaattgtggagtctgttaatagttcaagctatagattaattttcattctttacactttcattgcgccacctttagttagccatttaacagagctcagaggtctggggatacctggcctccccgaagccctgagaaagcactcaacgggcggtctaaactgtaaccggtaggcctggcaagtaaagtaagggaactcctcatttcggggaaaaacttagggataatgaaacgcagaaacgtttgtggtccttaagaatctacttgcctttagtactttacaaagacagtaaagataaaatacaggcgtggtgatagttctggactgactctacaagttctgaagggcctcacacaattctatcctaagcttgaagctccactttcttggatctgagacctaagtcccacatacctgaagctggagcccctttatacacacccaggtccttgggcccttatccctgccccgccccggcgtcatcacttcgtgggcgccacagctggtagctttgtggccacacgcccaggacggtgcatctggcgggctgggcgctcag

SEQ ID NO: 37775 - DNA, 1218 bp, Bovine  19866880811697
gggttgcgaagagttggactgagcacgcacgtacttgaactgtttgcaaggtacagccaatgagaagcaggtccctagtcacaagcttacccagagggggattgtttatggtgtgggtttagagtcaaggatctgtctctggagaccagaggtttgtgggggtaggggttggaacccatagaggagagggggaagttgggaggtttttaaaccaccaagaataaatccagtaagctaagactatagtgatcatctattacaggtggggaagtttcttaatttaaaaatgtatcaatccttgaatctcttttattggtccctagttgagatataaaaacacctggattataatttcattggctaatgaaaggtccttgccagaactcacccgtcggttcagtcactggctcctctcatcttttgtttgtgtaatattactactacttgtcagttttcatatagttggagggagaagattttaatggtgttgagccaaagctagcataatttgccattctagtaagtttctgtttaaaatgtgtcttgtattaaatgattatgtttgagtttaaaatataattatgtaattttatttcatttacttgtttattactcaggaggcagttattgagttctaaactaggtgcttaatgaaatattctatgttgttctgactttttttgcaaattcaagacatttttctgtttacttcaggggtcttttgctcatatttttgagatgttgtagagggagctgtgtttgccaccagactcctagggcaggatgtgacaatttagtcctttgctcctatctgaaatctgaaaaatgttaacaattggagcacctataggctatgtttaaaactaaatttatataagaattaaaggcttttgatacaaaccttgttttaactttttggaagatgaacttttttttataaaggcaaccaatcagaaaaatttgtttaaattaagttgatataatacagactcaaagtgttcaattatgaaaagctttctgttaaaataactatctggaaaattgtcttcatacatgagcaaatgtagtatgtttgagacataatggaagattctaaaatcccaggaaataacacgatttaatttattcttaaggggctcagtcagtttctccacagctggtgggagagggtctctgttaaaaataaattcattgttcggatgtaactaattaggaatt

SEQ ID NO: 37776 - DNA, 1369 bp, Bovine  19866880815285
tgggggagttttaagagcctttactagaagaaagaggagcaggtgtgcctcaggcctctctgccctcaatcagcgccatctgttttgcacagtggatgtccatatcagatgaactgaataaaaggttctacaataacctttaaaagcaagcgaggccactgaaggtctacgtcagaattaaagtcccatctcagtctaaaattccatgatagcttgacttttatggctccattagaaggtaacaagcagctatacctggacctttgcaaaaacgcaaattcaaagaaacaggcgatggttgaaacataagccaatacatagcatccaatgggatgctgataacacagatgggaaaaccgcgcaacagcatttgctcctaaacagttgctctcaagagtccctttctccagttcctaccatgtggagagagctttttccaccaagacacaaacgagttttgtttttttggaatgtctgtctgcaggatatgacagggagtccatactcccaccgacctctgtaggagtgtggcttgagcaggctgcagcccagtctggccttctaaagcctcctttcagatgtctgcagcagactgggtctcaccccagaagtgaactcctgctgataagaaatccttcctatggccaaacaaatcactgttggattctcgttgcattcttcacttctgtttttcttcctcctcctcccttcctataaaaaaaggtgtcttttaagtatatctagaaggaaacctgaacagctaggcgctttcccctcttaatgtgttccttatcccactggtgattcaagccctgggccgctccttgctcagcacactgagacggctctgttctgctcagtggtgggaggccacgtcagcaggaaacagcgctggctgccaggtcacattcaagactgtctggagcaagccagcgtgcagcacccgcaggacagaggctgctctatggtttccctcaggcaaagggaacgctcagcctggaaaaaaaaaagcctggcctctgtgcaccacaccaacccaggcttaagggagactccaaatactacaggttagagtttccccattttgaaatgttccccaaatatttccagttacagagttattggtttcccttctcctctttttcttagaggacgtactgtactgcatccaaactcatatttggaaaaggctgccacaagccaaatcaaacttcatcgtggctttctggctcctcagtccgacagaggaaattctgcacacccaacccaccagtctccgcagccctgacacgcgttgagtcaggacggaaaacctgacctaaaggggctgacacacagagaggatcactacaggccttttttccccccg

SEQ ID NO: 37777 - DNA, 2625 bp, Bovine  19866880893049
tgttgttaaatatttacaacccacactcagtgggatgcctagaaacaaggaggttgatactgctttcttttgtgttatttgtttggttatctttaaaatacatagtcacagtgagggaaagaaatagctaatagataagggaacaagagtgaggaagcaggttgaaatacagaggcatgccttagcctagaggaaaacatgggactacctcagataatgtgtgtggtaaaactatgctgacttatttactggtattgcaggttatttttggaaaatttacagctttataaaatgattacccaacatgttgttctcagctaaaatccttttttaataacatttacactccaaaattaaatgattttttaaaatataaactgttctagaataatttcatacatttttagagctcagggagttggatatgcttttgagacaaaaacatctttaaggtgccttcatttgttttttaaaaaattgaggtaaaattagtgtataatattatatatcttgcagatgtacaaactttcactcatttttaattacatgatgatgatatgtttgtgtgtgtagatagtgaataattcagcatttcataatttatgtcccttgggagatagttacacatatacctggcagtcagacagctaagctagattgctcagggttttccccgctcttaccttgatgtagaagtttacttgtgccagtgtcatgttttttgagcatctccccagaatgtatcactgcttccctcacaagcccatagcagctcccgtcgacatttctgttccggggcaccttgagcacttgtgggacactgagagctgcatctcttctggcagaggtgcgcggcagccctttagaggagccgcccaaggggttgcctgagcagggctcggggatgttgtgcagccttcggctccatacacattgctcagattgaggtccacctgtagaaccaagccagagggcacatttgggggtggagggatggggtctggtgcttgtgtgtgctcacaaactggttactaagtattaaagtagatgcaggggttaaatcctccctaaaaagatgtttttcaagccggatggttgtgtttactgcagggattgcacatttgttggaaataacatcaagtacagtggagatgagtcatttatttcctagccacttggccaatatcaaacaattaaaaaccatttcatggataaggccatgcagccagaaatacctacagggactgacttcatgatacacttattgaaaagagcaggctgaacttaacttgtcctcactagggagcgtgccatgtgactctgaatgatgaaagtagcgcacgtgccaagtagattgttctggtccagtcacttctactgggtgagttactttgttctctgcactataagctaactgttaacatttctgttttaatagcactttatgaaaattctcatagtatcttcacattttatgtgtgccacaaagaaggaaattcagtacttaattaaatttaaaaacagccattttaaaaactaggtgactgtgaaaggctgacttcaacacatcaatttaaagccattgtggtcagtttccatcctgcctctgaggttttacacaaaactggcttcctgtcaaggtccactatttaccttccttcaagaagggtttttaacactcagatctaactttggggtttaaattttattatctttgttacttaattgctatgtttaagaattttagccaagttctcttccacttccccccttactgacttttattgaaagtagaaacgcaagtttagaggggatgattatttcctaattccatagattcctgtagaattttcctcctaaggaactggccgtaccttcgttgtcactcttgagttgggtgtagaatgttcaggattgtggacaagtcagatatttgttgtccccgtacgccacacaagtgaacaaaccacagctaccccacagaagactggtgagtcaggacagataccacaacttcagctttgctgtgctggtgattggggttaggaggtaataagcaaagttatgattcattgcttacaagtgaattgtttctaactaggctgtagttgccttcagtctccattccaggagggctcccgtggctgatggggagagaggaaggaaggatacgatgacttgttccctccgtccttgctctgagagcctgggaggcttggtgaagaatgtgaggaagccaagcctccagtgcgtggagatggttgggaatgttatacagaaacctgctgtgtatcgttactactcctttcccttggtctcctctgactccctgggtgaaacaggagagctcagatggcacattttgtaaatataattttcagcagagagtcagacacaactgaacacacaaacacagctttcagctaaatgaaacatgcctttcccatggttgacttttttttttttaatagtttttgagttcaaaccaagacaatagaatttcattatgcaaatctttgaaccacttttatagcatcactgtcttagtgttgctctaatgtttaaagtcttttctgtttactgtaagataaaacctttgtgtttggttggaaaagaaagggactc

SEQ ID NO: 37778 - DNA, 1852 bp, Bovine  19866880902823
catcaggtgaccaaagaattagagcttcagtatcagtccttccaatgactattcaggattgacttcctttaggattgactggtttgatctccttgctgtccaagggactctcaagagtcttttccagcagcacagttcaaaagcatcaattctttggaactcagccttctttatggtccaactctcacatccatacatgactactggaaaacccatagctttgaccacatggaactttgttggcaatgtgctatctctgctttttaacacactgtctaggtttgtcatagtttttcttccaagaagcaaacatcttttaatttcatgactgcagttaccatccacagtgatttttgagcccaagaaaataaaagctatcactgtttccactttttccccaactatttgcatgaagtgatgggaccagatgccatgatcttcattttttgaatgttgagtcttaagccagctttttcactctcctcttttacctttgtcagaaggttctttagttcctcttcactttctgccattagggtggtaaaggaattacttttggggtctgtctttccttatagagccttaatctaggctctataagggcaagatctgacacagagtaagggcttgagaaatatttttactgaatgaatgaaagttataaaacttatggaaaaccactgcaaccattactttgagaaattaagctttcataacatgcaatgttaaaagtcaactttatttactgtggtggtggcggtttagtggctcagtcatgtccgactctttgcaactccatagattgtagcctgccaggctcctctgtccatggggattctccaggcaagaatattggagtgggttaccatttccttctccaggggttcttcctgacccagggatagaacctatgtcttcgccttggcaggcagattctttaccactgggccacctgggcaccccatatagaccataattcatgtattttaaaaaactatttattaagatcaaaaccattttatctttaaaagctaaatctttaaagtctatgtattttgcttatactaataattccaggaaacactgttaggatattaaaacatttttaatctggaaatacattaactagaaaaaacaagaccattcaaggaaaagcagtacaagtttcatccctggtgcttcttgttatcttgaattataatagttatttcaaggcaatttatttttcctgtacagtaactgtgtcaataatttttcagtcttcagcattcaaatcctccccaatgtacacactgtgtgattttaagaactcaaaaggaaatccttcccaatctctatggagtgattaagacattttcattgctttcttgaaactgaatttttaaagtcattcctaacatgaaaatatttttgacttaactttatttctatgtacacatagaatataactcaactacaggggaataaaacagtccaagaaagaaaattacccatgtttttttttaaaaatccttaaaccaattctaacatcactgaaacagagcagaaggcatctgctttgtgtttaagcctctagagataggtctataagatatgcctgtccaattattcaggcaggaaaaaaaaaaaaatcagtgaacactaagactctgacccagatattctttgacaatcttaaatgcatatactctcttccactacactcataactgtcagacaatgtgtcctaaatactagttctaaaagtacaattcaccaatattatggggaagtcccaggcaagaaaagggatatctgaattgaaacatgttccaggttctatcacattatctgcttatcatattgcatgaaa

SEQ ID NO: 37779 - DNA, 1504 bp, Bovine  19866881016597
accatccacccaccccattattaaggagattgcacaaatcttttcatattatcagacagtgaatcctcatcatagtttttcttttttcattctggcttcacatcaacacttctaaaacaataccaacagacaaccttactttcctactcagaatatatgatgaagaggctacaatactggttaaaaacaaggggatttcagttacaaaattatatccctctgagtaacttcctttataccatgcactttggtttttaccaaggataaaataaaaggatgaaacttacctctcactcaatgaagagcaacagaaacttctttagtttctgtgataaaaggaacatgacaattttaactgggtttggaccacagaagaagctgagctcttcttgtacaactctctgcacacaaggacagcttgtttcattcctgttctggaccaactatggacatggaacccaagcactgatctaaaatcaaatgttagttaaggaaaagaaaaaggaggggaaaattcttgaaatactttctcctagtcaatttgcccttgctatgccttgggagacaggcaggcttaacagaagaggtgatatttgacctagctcttgaagatctgagttggagtacgctaggcagaaggactggaagaaaaagaagagagaatgaggcatattcttgaaatagggcaaaaacttggacatctggtgaggaaatctaaagtacttgggaaggcgagaatcaagcagcttagacaatggggatcaccacagaggttccataaggagaggggcagggcatgttcaaatctgatggacctgcagccataatcagaggatgggatggagaggaagctggataaggacgtatcttaaaatataaggtggtccttctcaggctgagcacagggactcctaactcaggtgtctaaaaaatgtatgaggagatgccaaagacagggcccattagaaaggattccccaggagggagccgagagttctcactcacttggaactttaggtgttcctagtggggcaaagcctttgactgagtggatcccaataaactatggaaaattctgaaagagatgggaataccacaccacctgacctgcctcttgagaaacctatatgtaggtcaggaagcaacaattagaactggacatggaacaacagactggttccaaataggaaaaggagtatgtcaaggctgtatattgtcactctgcttatttaacttctatgcagagtacagtatgagaaatgctgggctggaaggagcacaagctggaatcaagattgccaggagaaatatcaataacctcagatatgcagatgacaccacccttatggcagaaagtgaagaggaactaaaaagcctcttgatgaaagctcaacattcagaaaactaagatcatggcatccggtcccatcacttcatggcaaatagatggggaaacagggaaacagtgtcagactttatttttgggggctccaaaatcactgca

SEQ ID NO: 37780 - DNA, 2057 bp, Bovine  19866881046449
agggcagtgatgtcccgtcactggagtgtgggtctgggagaatcagactaaaggtgattctgtaaaaacagttgagaccatgtgcatgtgtgctcagtcccaccaggtttctctgtccatgaaatttcccaggcaagaatactagagtgggttgccctttccttctccaaagacgtctgtaactggctgtgattaatgataaacaccattgcactcagaccagcttgttgaggccagatggtgtcaattttcaagggtaaaattcatttggacttttaaataccgtggctcagactgtaaagcatctgcctacagtgcaggagaccctggttcaatccctgggtcgggaagatcctctggagaaggaaatggcaacccactcccaggactcttgcctggaaaatcccatggatggaggagcgtggtgggctacagtccatggggtcgcagagtcggacacgactgagcgacttcacttggtgggacagtagcttaggtattctttctgttcttcccattttctagcttaatatctaggaatgtgagcttcttacccttatctgacagagaacttttaacacttcatattttttaaaaaaaattttccaactcaaactgtgtttgccatctagtgattaattcatgccattacagtaccctagttcagatttcctcatttttggctctgcagttaagctcaaaggcctctagactctgtcctgttggctgtggcttctgtctcaagccacactttccctagtcttcatttggtaagctgacctcagtaatgaagtctgacccctctgagagtagtaataatattcacccaaaagaaatatgtagcagttttttttaaaaaaaaaaaaaaaaagaaaaatgtagcggtttaaaagaaaatgcactttaggaattatgtattatgaaaagtttcggtagattccaatttgaaaattaacccgcagcagcatctttgtgagaatgtagacctctcagataaatgggtgagattctgaccatagtagataccatggccacctccagacttgcccttcttcctgtgtgtcttccagagataaggacattaacagtctcgcctccaaagaggcagtatctatttgaacataattctccaaatttccgactttctgaatgcagatcaaagtaaggacccacactttcttcttctaaacatttgttacatccttgagttagcaaaagcagctcaaaggcttttctttcaaaggctgttgttaatcagttgggagagtgagctaagaaatattttgtatatgcaggagatttaaaactcaacgtcagttacttaaaattcttgacggacccacggtaatattttgcatttgaagcagagttttcaggggtgaagcagagcttctgaacgatgatttctgcactagaaaatatcctgggtctaataccttgtctttcccctgagatttaggctgtgggaactcatttactcagtgattgctaactgaatgcctactgtccacaggaaatggttaggataatatcttttcaaatatctttgctgtcacctctctaacttccatggggtccacgcaaggccttcttacaaggaattttgtcctaggaaggattgtgctgtagagagatagtggatacagttcccactttactgccaagtgcagcttatttttcaggttgttacgaatggttagcctgaccgccacttctggcttccagtctagcaacatgcccttctccgccaaagcctggaacgtgatagagggtattgtgggaagccattcgctcagtctccaaaaccgtgaactgcttggctgtcaattttaactgttactgtgtcttttttcccttgtgatgaaactctctatgtctgatttttgcaggggaagccagagataccgggtgtatgttgtgataccacttctgccaggttttgaaggagacatttcaaccggcggaggaaatgctctacaggcaataatgcacttcaactacaggtaccgaagttctgaaatcctctgttttcagactttcagtcagtcatgcatgta

SEQ ID NO: 37781 - DNA, 977 bp, Bovine  19866881085423
aaaattatgttagtttggctatagagtgattaattctgttattcttaacagatctagcacagatccaaatgtctttgtttcctttatatgcaagaaaaacatatatccaaaagtaaacattttcataatactgcattaacctaatacagggattagaataacaagatcagctcatgcattttaagagtataatgttgtaatgatgattttgaagctgcatctgtctgtgttactgaaacaaaatgttgatgctgccctaacagaatttgagttgatgctgactctcatcctgaccctgtgggaccctgttcctgatgattgtacacagcactgaggcaagaggaacttaagttccaggaatgcatttatggttaatctgttgttcaggttactcagacagccaatgtattttaaagcaaggctccagccaagtggggaatggggagagggctctaacagaactggataattgccgcttgctctccatttaaatcagcccttgtgcccatgacacttttccctttagccagcaaaattggcggcgggggcttgtaatgtgtgcagtataactgccagttcactgttagagagggacaaaaagtaacctgcatgaagaaaccgtaaaaaaatacacactgggcaacaaataaaagtggccacagtatatgagcactccaggagtgagcacacgcctattatagaacaaactcctgcttgtatttctcagagaatattgttgaattaaatgaaatagatgttaactaactcagggcctacaaaagacccttggtgttcatttccttttgcttctctggatcagtctccaattcacatgaccatccttgctgggtaaatggcatttttataaccctcaatcaccggaaggcagtttgtagttctggacagggatgtcaattctctgttgtaatcccacatccgttactgaatttctaaatgactagaggcatgtcccttaa

SEQ ID NO: 37782 - DNA, 1067 bp, Bovine  19866881123407
cactactatatataaaatagataaaaaaggatgctactatagagtgtgggaaactatgttcaatatcttataataacctatgatggaaaagaatctgaaaaagtatgtaactgaagcactttgttatatacttaaactaaaatacaacattgtatatcaactatacttcagtttttaaaaaagactgtattttagagaagttttaggttcacagcaaacctgagcagagagtacaaagattttctgcagattccctgcccccccacattactaacatcccaccagagaggtatacttattataattgatgaacctacatcttaggatttattcttggcattgacttttttttttaaagagcttttttggaattgtgttagtatttttttaaagagattgcattttaaggtattgcattttaaaagcaattttgtttcccccaaggcggggcttcaggaggcaagagctgtttttcaaacctttcccctcatgcaaaaatattctgggactgctttggatgagcagtacagatgtcacaggtttcctgttgctcccaggatgataaatagctatgaagagaataagaataacaacaagaaagtataatatgcttactctgagctaagagtaagcatattatactctgagtaagagtatattaagcatattatactctgtatagtaagtatagtaagcatattaagcttactctgagtaagagtaagctcattgtataagagtgcactgtttaatgagccattcacttttacatttttatacatgaggaaattgaggtccagagaagttacttgtccgaagtcacacaattaagaagggcaaaaccttaaaaaacagagtggaaatatttcaatatgattttttttttaattttgctttcaacagcttgcatataggccattctaagagtgcaggcttgcttacttccacagatgtttattgaaaccctaccatgagctgttcagagaaggatggccagatcacagttcctgggctgtgatttcagcactggatagaggcatgccacgtctcaagaaagtctttacaat

SEQ ID NO: 37783 - DNA, 2001 bp, Bovine  19866881149111
acatgggcaagattaaaacttggatggatgatcattaatgttagttggttttatggccttttattccttacttatgtctattttaggtggaaaagtctcattcatctctatggttctcaatcctgactgcatattcaatcttttatgaaacttcaaaaaagaaaaaaagagaacaggtgtcctggtctcctttctagagattttaatttagttagtttgtattatatccaaggaatctgtgcccagggaaactctgatacataactgtggctgcatacaaccacattatctcatataggtttgatctaacacatatataatagtggactattgagactagattgtcgagttactagagtcaacatgtcaactcaagcacaaaattactaaagtagttgttaaatagaaatgattggaaagcttagtgaaaatggttgaactgttggtccaaacagagtcaatcttggttaaaatataggaatggggaagagcaaaacatgatatttttctgaagtcaattgtcataccacacataatcaaaacaagtccatgtcttcaaaagagattgtggtttgctatgacatatcctgaactgacattctctttctcattgtcttttcagctgtagtggtttttgctttcatcctctgctggctgcccttccacgtaggacgatatttattttccaaatccttcgagcctggctctgtggagatcgcgcagatcagccaatactgcaacctcgtctctttcgtcctcttctacctcagtgccgccatcaaccctattctctacaacatcatgtccaagaagtaccgggtggcagtgttcaaacttctgggatttgaacccttctcccagaggaagctctccactctaaaggatgaaagttctcgggcctggacagaatctagtattaatacatgatcaagcacattgctcagtaaagtcaacgttcattattctataccagaagccatagtacagcggaacttgggaggaagtttgaaggttaattttggaattagggacacataggtctgaagacaattgggagcaagaaaagatagactttgtagtgtgtgagcagtttgatttgattgcacactcatcagtgctatcatacacgatttctgcatatctcactgcctatcatttttgcattgtgctgttggtgctagcaagggctctgcagttcggagaagggaggtagtgtagagagggcaattaggtcactttttactagacggattctaactctaatttctttttcataatgagaattttttagtaaaataataaaaaacttaaaacatgactttcagaagctagcaaatttcatggggtcccagatcagtgctgtccaggagaaatataatgcaaagtacttaagcaatcaatataaaattgttaatagaattttatgctttttatgttaaagtctttaaaatctggtttgttttttaaattttaagttcaccttaatttggacattgggtgttcatcagcaatacttgatttattgcaatttcataaattttgccgaagaaaaagtagagtcattaacctaagttgtctaaacatacttaaaatttctctaataactaaaacaactataagttcttaactttaaaattaattgaaagtagaaattcagttctttgagttgcaatagtcacatttcaagtgtttcaatagccaaatgtggctaatggctaccatattgcacaatgcagctctaggttatatggaaaattattgttaatctcataaaaatgctaaaaataaatactcatttcctaaaatgtttttatagtgaaattagcataggagaatgttagagtgataaattctaaggattatacctgaatgccctgtaatttctgcttgggagaaaatggatatgaactataatatgcatgcatttttaatcaagttgggttgcacgtgttagtaatcaggaaatgagactttttaaaaactgtagaaaatcacaaatta

SEQ ID NO: 37784 - DNA, 1341 bp, Bovine  19866881191903
tgccaccatctccctctctctccctctgtctctctctgttacgtacaagcacacacacacgagcgtgtgcaccgtgagagcaggtagaattagtgtgctgctgtgcttggggtgggagatacaggcacttgtcatccacatggcttttctcattctcacctgaactctggctattcagtcccaggctcctgctttctcaccatcttggaacttctaagacctgtgcccccctggccagcccaggcctacgggattacagttgatggacatgaggcccagcaacctgtgtttcattgggctctccaggtggtgatcgggtgcagtaatgtttgaaaaccaactgaccctgtgaatgccaaacaatgtttaaggaagattttaaatgagcagtatgggaggcattccattaaaacactgaacttaagctgaagcatattccttttgtggtacctgtgtatatatatatatatgtgaggggtagtgaggggaagttccttttttgtctctagcatgtaaatagtaacttatggcaaaacctctagaacttacagggccatatggggagaaactgaaacaaaatggtaagaatgtctaatatagaagaagatgaagatacagtgtacttttggcatttgacctttggaattgttgataatccagagattcagctacacatttgataaaattccatcacatagaatcataatttctaatcataacattgaaagctggtgacaaaagcatcattcttgtgcttttctccttcaaggtcatgaactgtcttctcatccccaggagcagtataccaagtttttgtatcctgatcccttctcagatggccctccctgacattttcttcttttcctacatttggctattactgttcagacaacagaatctgaccccaatatctctttactgataattagcacgaatgctcattcattctgcagataagaactgctgttctaaggatgtggacagcctttccctctggagctctgagatgatgagcatctctgggttcttggaggctctgtcttgctgggtggcttcgctctgggaggagggggctgcatccacctgtgcagggctgacagtggttccctttgtctggaaggaggagcctgatgttaataaggtctggaatgtggggagtccaggcagatttttcttttggaatttttttggtcctggctccccttaagagatagcactggtgcttttctgtttgagatgtttagtgcggcttttgcacttcatgagtggctgatttcttctttcacttgtagcctttttatctcatgagcacatacctcttaggcatactcagactgggtg

SEQ ID NO: 37785 - DNA, 984 bp, Bovine  19866881213730
gactgtactagaattttaggattctagaaacaaaggcgtgaggtttaaatagcattacactgaaatgttatattcgataacccaaatccacattgggcacttctgacaaaacccatcaacagaccaccatgctctatgaaaactttcatctgagataagcttcacagtctaactctggtttcccagctgtggcatctttcctagtattaggtgtgccagaagaggaatttgtctcaaaacatgcccccttcctcaaccttcatttctgattagccagaagaatactaaaattttttccttaatcagctcatatagaacccagtcatgcttatttatgcaacaacaaactcagttttgtcgaattgatgttataaaacactcatgacaaggatgagctctaaagctgttacttcagtctcatagaagcatcgttggtgttttattcagtttataattaaatatgcatttcaaatatttctaacactttattactaattttagatgttggttccaatatttcctcctctcctatatggggggagatggggtggtggagaaacaaacaagaatagtatatgatacactgaaaatcagtttacaaacacgttttttaaaacaaactatttctttaagagtccacaactgatgacgtcctcataagcagctctgtatttcacctgatgggactaaacacaccacaaataccaggtgttccttagaacttacaaggtactgaaacagaaaattcacatgaaacgatgcttataaagacacgaattagcaggtgcaaagacacaccgtgcaagggagtgtctatctactgtttcagattttagaccattacaacaaaattttaacatgaatatgcactttactaattcagactgatatttttgaagactccaaaatgtggaatttttcaggaaaaaaagatttttttcctttcttttaaggaaaaaagaaaaaaaaactgcagagatttgt

SEQ ID NO: 37786 - DNA, 1197 bp, Bovine  19866881255948
ctgactttatgatgtttaactattctacctaaacagtaagtcaatctcctttgaatggtgatacaagtggtgattgccagttacaaaattattggacaaggcccaatgtgacatttgtttcagcgctagagatataaaagagtctactgtgaaggttactattgtaagtctgtatagaaattacttaaaccgctttgaagtatctctgaaggactcataaaaaccactatttacttctcaatgattacacactgattagagatcatttctgttatgtatttattaaatatagatgtgaacttgagaacagctgctagctaaaggcatatatatatttatactcatgttcacaaatgataagattgcattatcttgcagctatttcatatgtaatcctcagtgttctctttctccctttaacctcctgttcatcctggtatttttattctgtgaaagtttactgtcttaattttcagactatcttatatgcaaatgatattcattatttggatccaaaacaccacttactctcataaagttactacactgttactcccatgttcaaaaatattctgtgtaagttaatagcttctaaatttggtctggtctttggatttaactatgcgggaggcctgctgatccaatctagggagtatgttaagaaaatatttccatagcaatactggcttcacttctaaagtaccatcacaaaaaatacaaacataaaggaaaatttaaaaggaaaaggtcaaagagatcattattcacagaaaaaggatattcaaatttagggatttcagaatcatctgttactataattccttaagtgcgaagacccttgaatctgtctccagatctatggctatttatctgtcaacggattgtttcttgtagggactgttgttctccttaggtcgtttactcatgtctggagccaacaaatccattgtttctacaagctaaacattagcggatagaaacgatgcagaacctcaattcctggttacatttatttacatactgaaaacgaactgtccagcagttcaggggagacttcatcgagcatcaccatcagagcagactaaaccatgtcaggttggaactggctgggactgcagaagttaattcctaaaacacttagaatagtatccagcttatctctctggtatagcagtggtttatgagtatagtccccaa

SEQ ID NO: 37787 - DNA, 842 bp, Bovine  19866881261054
ttgtgatttgctttctgacttgtattttttttttttagataattgcctcaattctgtttatcctgatgctgtttatatagctttggaaggaagtactgggatctctgttttcatacttacctttctctccaagtaggaaaggctagataaactaggataggcaggcttccaacatgagaaaaggagacagggtggaagctggtaggacttactatctctccccaagtgagccttcagaaaacatctggatgcaatgccacactggagtgtgtatggactagttattccataaattcagcttctgtaactacatgtgtttggtacaagtaatacaaagtgtgttcacagccaagtgaaattttaattctacttgcttttttcaaaaccagaatctttacattttattatttggacattgtagtcaacattttgtacttatttgcatatttagtgcttcttagaagtcattccaggatgattttgcattgtaattttacaattcctgaaatcctgtatattaaagtgaaagagtttatccaaagaatgtcaggtttgtttgtttgtttgtttttaagaccagtgattctcataatatgactagattgaaatctgctggtgctcctcaagggactctaaattcatgttgatgctggggcagtcagttgctgctatgcaacttagttttgagagtacatttaataatttcctctaattttatttttgaactgttaattatcctcactggtgtctcaacaccaatgctaattttgttttgccttgacaactggaagggaatcaatcacttagtgattccctaaagtggtacaaggaccagaatattt

SEQ ID NO: 37788 - DNA, 810 bp, Bovine  19866881269954
ataaggctttacaaagggaaaagaaaatatttacccaagtcaataaaatgaaagcaaacctatgactgctgtcgctcttgggggttaggctaggagccgattgctctttgtgttattctgtctggacacccaagtggaagcttacggatagccagaccttgatggtggtcactgagaggtgggaggagggtcctacaatcaaatgcagactgtccgaactactctcctgttggtttctggctccagttaacatctggaatgggaagttgtaaaggttttttgccttttgtctaagtggctttcccagcgaaatgtgcatcttggaaaactcagacaaaaggcatcttccctaaggagctgtgcccactttgccttggactcgatcccgtattcaatgaattaagcagcagacacaaggcaagggcggtgaggagtacagtggagacgattcggattttgttcccatgtttcaggacctctcagagaagcaaaaatgaattgtaaaatgccaaaatgattgcatctatttttatttaaaaggactctttttcccataacacccttcctgatgtcctccatcatgagcctttgagtaagtttcccaaagagtctttcaggggaacaccagtatttgtgagtaacggccgcacagtatcagcctacctgtaatcggcagcaatactgtgcagcaggtaacaggtccctcatttcgaagccggtgtctgtcccatgataaacgagttctaaggattcttcatcttctccccactccaacctgtacctctgagatgtcggcaccagagctttcag

SEQ ID NO: 37789 - DNA, 1045 bp, Bovine  19866881317149
tattaaaattttatagcctgtaagtgctttgctgcaaactaatataatttcactttaaaccggaatgatgagtccagtaggtagaaaattaaaataaacaaatgtaagataacttttgcaggcttacctcaaatgccacctgctcctcaaacctttcttagacccttacatgaacgtgacctccctcccctggaaccaatgttttctttgtatctctcattctcatctggcctacattatgtctgcttatctttgtttcatacctttctctctgcttcccttaactacatcttaatttccttgaaagtagtgtctagttttgcaaaatacctaacacaggacttaatcatagaaggttctcattagccttaagaaaaaaaaaaaaaaaaaaacacgagaatgcaagccaggtcaagcagttattaataggacagtgagcaaaggactcttggccagtggcttgaatgccttctcttggtaaagggtgccctgatagatttctagggggctagacatataaactcccctcgcagggcaggcacaagcacactccccctctctcaggtcctcactaatattactgaaatactgaccgtttatatgatactttgaatttttgaccgtggatgtgtggatttgtatttcagcacctcgaagtaacacagttagaaggaaatgcgtgtgaaattttatgggagacggtaccacccatgaaaggcgaccctgtcaactacatcctgcaggtgttggttggaagagaatctgagtacaaacaggtgagcaccagcatgtggcacatgtgtggcctgtcggtctggttggctcctggcctctgcctgttgctgtgaggattcagtggcaagtgaactacatttttcttaaaattgatcgtggaaactgattcacacgcacccattacctgactctctaggatataatagctctagcttatgttcttacattttcagtttcttaagcatggtctcatgggttttaagttctatatttgtatttgatattgcctgtgatattcacaagtatcaaa

SEQ ID NO: 37790 - DNA, 769 bp, Bovine  19866881328428
gcacttaacttacgagtattaggtcaaattcttataagtaatgaagtcatcttatgaaagaagacaaaatctggaggaaagaagtaggtccatcttctcacattgctcactttgctcagaactgcctctcagaagcctgtgccaacatggatccagggcagtgccaggactgcaaggacttgaaagctgcagctctcacctgaacaagggtcccatccccgctacagtagctcagcagccctccacgtgactatccacccaggcaagatgcttaaactgggagtcccaggttaatggttaaaccatagtctgtgatactagcaccattcctctgccctctgaattctttgtggaggaaaagttcaggaactgtttttattttctcttttacccagagtcccaggtgctctgacaaccggccactcaacagtgggtagagtggcacagctgtggccacatcagccccttctcgcctcctcttcctggcctgtccctctacacgtggactgaatcatgctaaaaccacccacgtaccttcgtgaagttccagcgctggatgaagtgacgggccgcatcgcgagctgccttcccgtggactgcagaggctatgtcatgccatggcatccgggggggtggagtgcctgtcaatgaaatctgcccaggtgcaccaggcaaggatccacactaaattctgcgcccacaaggcacacaagccatctgaccctagctctgaccccaactatgatacataaaaaaaaaaaaaaaaaac

SEQ ID NO: 37791 - DNA, 1564 bp, Bovine  19866881350019
cctgtttccctgttggtaaaatggagacaaccccctccctcacatgttgaaaaatgaaatgatatagttactattaagagcctcacactgagcatagtatttgacaagtcctcacgcgtttgctttcttcccctcgattctaatcaaatttaaattcttggctcagtcaagatttcagaacgtgccctttagccttctgtaattatcaaaaaaacccaaagcagacaaaataaacaacaaatgaccaaaagagacaatgaacagagagagtccccactccatagacaaccctgcccacaaaagtagtggttcttccagaccgtttcatgcgtatgccagatattttatgacacacgtagttctttttttatatttctctgccatgcccctccaccagtatcaccaattttgttctctctagtgattcctcttaaatccttaagcggtaccatgatgctgttacttgagtcattcttcactgggttcctgtgacataaaaaaggctaaattaaatgtcagaaatgacactctattttctttgataaattgtagaaataaacagtattgtatttttttcttcctagggtcaaaagaatggacaataaatttgaagcaatgttcctcttaaatttgtcatatttgtgaccattattttgagatatttctaaaattattttggtctttaaacttttttcctctatgttcttataaagtaaaaattgaaataattgtacactttagccctttgatgcttaacctttttctgatttatatgctatgatacaaaaagtgaaattatgtcattgttgtcatagaattttaaaatttgaaatagaaatagaagtgaataaatgttttaagttcctcttgttctttgtgtgatgttccgttaaactgtaatttcatattatccaaattaaggaaatgcttttcagcctttcttcattgccattacggaagtgattctaaatcttcaaagcacaattgaattgtgggcataatgagaaaggtctcctgcaggaggcctatggccctccctcctgacctctctatagctggtctttggcacttaggacaaacagtttaattaattagaaaggactttagttggggcttccctggtggctcagacagtaaagaatctgcctgtaatatgggagaccagggtttgatcgctgggtcaggaagatttcttggagaagggaatgactactcactccactattcttggctggagaattctatggacagaagagcctgatgggctacagtctgctgctgctgctgctaagtcacggcagttgtgtctgactctgtgcgaccccatagatggcagcccaacaggcttctccgtccctgggattctccaggcaagaatactggagtggattgccgtttccttctccaatgcatgaaagtgaaaagtgaaagtgaagtcgctcagtagtgtccaactcttcgagaccccatggactgcaggctaccaggctcttcggtctatggggtcacaaagagttggaaacgacttagcaactaacactttggtagaggactttagaccaaa

SEQ ID NO: 37792 - DNA, 944 bp, Bovine  19866881371953
aacactgtgaatatactgaaaacttctgaattgtacactttaaataagtgaaaattatggcttgtaaattatatccctaagaagctgtttttaataaaatctgccaagacaggaataataagtagagttgtaaaaatcaatcaacacatagcaatactcaaagaaagaacaagtaattttccttgatcctacagaataaccagcaacaaaagtcatttttatatttcttgtaacaaaaataggcaaactactacttataaccaaaaaaaaaaaaaggtgaaaagatattgtcaaaacacttaaagaaagcaatctgtcaattcctactttgaatattgctttaatttcactgttttcactaccagaagactctgctcagtgagattattatgttttcacaaacagaataatcacatcccagaagtttctgccaaactagtatccatgaaattataatatgtatcacaaagagaactattacaagctcagaaaaggcatgcaagtttcaatgactagggaaacaattcgataaagacaagacaaattctcagtcagtgatcatttccttttcaagatggggtttgaaagaaaggcacgaaagataaatgaaaagtggcaacactcagctccttgtacgcacacttgctgggtgctttttgggaaagaggcagggtgtaatgtttttagttgctctcagaaagacaagttcgttcatgcaaagacagaaggtagataccactcatggctgagtctctgctgaacacctgaactgtcacagcattgttaatcagcgacgcttcaatacaaagtaaaaagtttaagaattaataaaatacaataaaaggcagataccaaagtggaaggtaggtgtatgctcagaatatgatccactggaatagaaattaactaggcctatcctctgatctcactcagttttagctgat

SEQ ID NO: 37793 - DNA, 2393 bp, Bovine  19866881376500
aagggattgcattacatcctttgggtagttatgacattttaataatattaagtcttccaatccatgaatatggcatgtctttcctttatttataccttctttaatttttcccagcaaagttttgtagttttcactgtatgcttttacctctctggttaagctaattacctagtattttattattttgatgttactatatgtgaaattgtttttttaattttcttttcacattgttcatgtatagaaacagcttatttttgtgtgttgacttagtatcctataactttgctaaataaatgttcattggttctaacagctttttttgaggagtattcagggttttctacatatgagatcatatcacatgcaaacagatcattttacttcttcttttccaacttgtatgccttttatatctttttcttacttaactgttttggctaaaatttctggtactatgttaaacagaatggtgaaagtgggcatccttgccttgttcctgatcttagaggaaaagctttcaggctttcaccattgtgtatgatgcttgttgtttcatgtatgaaacatggcttttcatacatggttgacaggaacaacatgggtttggactgtatgtgtttagacatacagttgttgtttgaactcttatttctgtagagtcaatagtaatctctgatttagtaatttgggtcttcctctttttatccttaattctgctagttttgtcaattttgttgatctttttaaagaaccagcaattagtttaattgattttatctattgttcttttattcactatttcacttacctttgctctaacctttattatttttttcctactgctggctttgggtttattttgttatttactagttccttaagttaggttgttgatttgagatcagaaaatatctgtgttttttcttagcatttacagtagccaaaaatgagagctctgtgcctactcgacaaaagccctaaacattaaaaagcagctttcaaaaaacatttagagaaattttcacgtgattgaatagcaagagactcttcaaggaaggttcctggacttttctaaccctctaaagcatagatagaaaagttaaaaagagggaactaaaatcaaaagaagaattttatttaaaaggctcaagctctgattaagaggagactcatgacaaatactaagttccacttcgaaagactattttataaagcaatggttggaatgcgaaataggaggaaaagagacgaaatcattagagatgcaaaaagaaagcagaagtattgaatttctactttagctttgtctttatcagagggtgtaacataaagctaaaaaactgaaagcaatcacaagggttaaggctaagataagtgaagaatcagatgggaagagaactcttagttcctctgtttcggtttctaaacacagatgtttgacataccatgaccctaaaaatactgtaggtggaattgtggaatctgtgctttgtagcaattgcagagtcatggagaagataaagatcaccagaagactggagcgaaaaaaactgatatccaagttttcagcaaggaagagaatacaactcaagaaagaaagtgtgccttggcacattgattctacttgatattatagatctggtttccatctcttaaccattttagaatatctgcaactggctcataaaaaatatttctattaatttaacaaatatttattatgggctgccttttttcccccaccttgtaacatttgcatgtaatccatactcataaacaggagggccacaaatatttttaaactaaggatgaaatcatatcaaagcgttgttggcaaaaagaaggataagctttgatgatctgaagatgcttccccaaacaccacagtggcttccttccagcaggctgctctgcatgggctttgctggtggctcagagggtaaagaatctgccctcactgcaggagacctgagttcaattcctgggtcaggaagatcccctggagaagggaatggctactcactcccctattcttgcctggagaattctcatggacagggagctggtgggttatagtccatggggtcacaaagagtcggacacgactgagcaactaacactttcttccacatttcatgtctctgcaggtcatctgccccctttctttcagcttcatgcccccattttgtgtattactcagtatcccagatattaggacctggaaaactacatttcctggtcacactttccagctgtcttctgcttaggtcagcccatgggaggtaccggtgggagactaaaggagaggaggaaggaaaacaaacttcctcttggcttcaggaggtgccaccagcgtggcaggcagctacatgttccagcaaccttcagaa

SEQ ID NO: 37794 - DNA, 753 bp, Bovine  19866881388426
ggaaaaccccttctctgagatggctgtagtttggatgctattagagtggaagctttttccccctcctgctttgctctccctaagccttcttcagctctgtgtctgactccgcccgccccaccgagtgtgggaaccgtatcattgatgaacagcacgctctgctcacaggctctgtgaatgacaccattgagagcctttccgcatctctgaatctccttgtttgtctccctcgcaccccctcaccccgccatattcggaatccagaatgccacagggacattcaagttacttttttttttttcttacttggtactttaagtgcacttattagacttgtttggcacattaaagcaccaacctgacattctttctaagaattttaagacacgtcctagggagctctcattgtctcctgctttgttaattgagaaatgacaggagtgatgtcactgggagggcttacaagctgaggtagactatcatttcacgagcaaatctatatggtctgtgcctttaaagcagactgactgaaaatgaggtattcctgctttactggcttaaaaccaaggaaggggacctgctgtaaatgaagtcggtcttctaagattgattgcacccttccttgtcctggcgtaaatttgcaaacaagattttcatcaaaactatttgggtggtttgaaagtgaaattactgcatatgactgcctttaaatctttgagaatctttgcgagctttcattacactgaatatcta

SEQ ID NO: 37795 - DNA, 1467 bp, Bovine  19866881404349
cccactccagtgttcttgcctggagaatcccagggacgggggagcctggtgggctgccgtctacggggtcacgcagaatcggacacgactgaagcgacttagcagcagcagcagcagtagaagtcatctgttttccattggtttattctgattagttttgtagcacatttattgactctatatttgtaaaggggacttccctggtggctcagatggtaaaccgtctgcctacaatgcaggagacctgggtttaatctctgggtttggaagatctcctggagaaggaaatggcaacccactccagtattcttgcctggaaaatccaagaatgaatttattgcgaaaactcggtggtgtgtgaggacagtgtggatgtggaagagccttgagtaaaatgcatgagttctgtgattgctttggcctactcagatacacatctgtctagggcagaaggaacccagaccaggataatgagggttttgtcaggatgatttctcttgagactttctgactgacatgaaaagcggttacagctcagtcatccagggatcacggatgcagggcacagagtggagcttctgagaccccagaaaccactcctctatgtgtatagaactaacaacctggcttcccagcccaaggaagattaagatagcaaattgagtatgattctcagagttgaggaggtgtggtttgaggtataacctaatgaggaagagaggaaaaaacataatttaaacataagaactcaaagcaggggtgaatttctctgagtaggtaaggtcaaaatgcctaggaactccctactatatcaccttgtgactgagcatagtattataaacagtgaccctacatccctaataaaaaataaagttatggccagcctgctctataatgaagttagaaaatgtataatttccacccacaatcttggcaaataaagtttttggtccttaaagttaactgtttggatagtaagccttctacattcattgcttcattttaaaaattccatttaaaaagttcagtcatctttcttaggcatgtcacattctccgggtctcctcagagcagtggggctgaggcacacctgtttaaattgagtacatgtgtagttttgtgtggattaccaaccaaaacagaggagactcactttttggggggagtggtcaccatttaattattgatgcatggcaagccttccccagactcttaaccttctttaattgtcaatggctagggccgagtggttttcccaatttgcagcctgaacatttgactttgtatttggaaaagtcattacttcctcccaacctatctccatccctaggaaataaccaaaactaggtactaaccatagtacagtattgctttataccctaagtcttatgttttgcatctatggttttcattcttttataattcttcttcctgccttttctcttgacctttcgacagtccatggca

SEQ ID NO: 37796 - DNA, 834 bp, Bovine  19866881467267
ctttccttatggtctgtttgttttgccatttaccgactcactgccgttttcgaaaagtcctgcttttgcttgtaccttttcttctggttcagaatctttcagttgattcctcttctacttctttcctctcagcagtttcctttgatggtgaaacctgccttggaatttgtacttgagcttcttaaaccctttaggaaaggtagttctgtcagcattcacttctctttctcttctattccaaaaggctaaggacaaagaatccttacacattcctgtgctgaggaatctggggtttctgctatcctgtttttaccagggtgtgaattccctgggaaggtacctgataagatctcccatctcttccctaagctccgggtaggacacaagcattgcgtttggaattggctccagacactcagataccattaatttagtaatgattacatgaggctttgaaggcaaacaaaacagcttctctaaaaggtgaactgggtaaaatcagaatgggatgacctctaatgacttctctagctctcttttctcaatctgtgaattcatcctcaaggaagagttcatcagaaggggagaaccatcattcccctttttaggcttttttatttgtactctgtctgcagtttaattttgtaatcagagcttagctactatttgctcatctgtaaaattccttttaacttatctttgtaagaaagtctgctaccagataaaatttcagattgttcagttttaaaatgttttacttaaaaagagaagatagttcttcagtggaaattgtgacttcagagataactttcatgtctttgaaatctgggaaaa

SEQ ID NO: 37797 - DNA, 1042 bp, Bovine  19866881733836
atgcctgtatttctatttttccccagtacttcttgtttcccagatagatatttggtttttctctgttcttttcctgagttgattatctgtgtgataattctgccacctagaagatgtacattaccttcccacacatgcaagaatcccgaagcttcttgtatgtatatccacactgagttctattataagaattgtcaaatggttgtcaaatgccactcataaaaaggaaaatgacactaggtttacccctgaaaaaggagccccttgcattcaggatcccgaatttcaaatcagccgtggtatttttgttgttgttaacttaagccaacctcgactcttctttctattgttgtaagcagtgagccctgtcttacctgatttcattttttaaaatgtatttgcaaaataacgtgtgtattagtaagatacctggccgtttttagaagtcaaagaggtatagatggcagaagcattctctttgatgctttcataggtcagagaaagctacaacaaatgcagtggtctctgaaaggatgttttattgcaaatagaaaatgatcattattaacaactctgacattatactgcatgaaacatttacatgttaagtattctttctgcttctgctagtctgtgacccttgaatttttcacacatgaagacatggatgcatatcaaataaaagattaaagatcatggataatagtaatacaatggggaaccaaatgttcatgtttcattaggaaaaataaaaagaaagagagaaacttaccactgccatttttttatttattgatgcaaaaatgctgttcagtacaaatgtagcccttaccatccaaagtgagatacagatgagtattgagagtctgaggggaaagcaaaggccttgagagtttctcccatcacatagaccagtgaaataaattattgaaccatacctgagcccaaaagcaaactactttcgatttaattctccgcccttcattcttatgctaagataagcatatgatggaccattaacagcctcctatgggaaacctgc

SEQ ID NO: 37798 - DNA, 831 bp, Bovine  19866881936673
gtgtgtgtgtgtgtgtgtgtgtatgtatgtatgtgtattcatctagttagcctcttcctcacttcttttgagtgcatgttcgtaactggtatactctgcagggtattttgcaagtatattgctctgtccacaatgggagctttgtatttattctgatgctacttggagataagtgacaagtgacactaacacccctttcagtgatttaaaaaaaatgctgttgactaaagaagaattgtggagccatttatctttggcttcctccgagtcttcagtctttattctcttctgaacacccagatactgtggttatctttatttgggacatattggtaccgggcccagctaattgaaatgacacagaacaggatgagagggacaaggacctggaaccccaagtggtttgctagggcttgggaggcactgggacaacaggatcaactgcaggaactggaaggaaccctagtccagacccattgttggccattcatgtgtaataggcagtcactcaggccaggtgtcctcactgaccccttcatttgcattccagtgtgagtgagtgagtgcttcactccagatgggtagaacatatcaatatagaatgtgggaataggcagtatatttataaattcgttgtgattaacatccttatcattgctaatatatatttttttcaacttttaggcttatgtattctctcattgcgtgggtatgacagatacatatgaagctgagacctggtagaggttaacacacagctacagtcacatagggagaaagagcagggctcttgtttttcaaataattttatttattttttggttgtgctgg

SEQ ID NO: 37799 - DNA, 1114 bp, Bovine  19866882168480
accctcctcttaggtatgctgggacaatcatatgagaaatggaattgaaagcccttaccacagtgctgcatacatgcaaactattatcatttctgaaatgtaccgatttcctatcctccaacatttgggtttttcaggttttcactatcacaaataagaggcaaggaacactattacatatagatctttgtggtcctccataattatgtcttaatgtgaaattactgcatcaaaaggtatgcagagtgtacgtgcatttgatacacattgtcaaactattctttaaaagatgtgtgttgatttatagttaattcgatggccccttggaagaggtggctatgaaatcaggaaccgatgatgagttataagtagggaagcaagaagcagtcggcatttgtagactgagcccagcacataatacctaccaaatcctgggcaggcctgctggcctctcttcttctaccttgaatcaggtccagggtctgccataggagggaacctgagagaacgcgatgggcactgaatggccctagactgaaggagaggttagatggaagagattagaagacagtggcaaaatccttatcagatcaataaaaacaaatcccatgattttcttctttggattactttagtgttattaattaccacatttttagacactacttccaagttgtaattaactcatattaacagcatatgtatagaattttgtgggatattgaatatgttgaatttttacactgtggtgatcctttattctgagattatgtccttgttactttttttctttttaaagttcttttaaaattgaaataatggtaatggtggtagggtattttaaagtcttttaattggcaaataaaagttggccacctttactggtcttctaattttagtcttacattttatcggtacctggaatccatatatctggaagctaatgtccaagtgacacataagctagtcttgaaactttcatttgtccaaccagtattcagtgagtggatgctgtgtgcaagatgaacagaaatctctgggtcacacattagtataacaccatgaagctgcaacaccattgtctctggggatgacaggctgtaaacgacagaaa

SEQ ID NO: 37800 - DNA, 838 bp, Bovine  19866880812247
tagatttcatttaagcagcatgtgatctgatgacccatgagttgtcagggctcccattcttccctgtctagagcagcccaaagggctgctgactaagggaagctgaaaaaaatgagctgacctatttattccttcacattgcccctcccccacagccttatcaaaagagaatatcattgctaaagataattaccctgttctcgccaaccttgcggtgtattccaggtgaaaaatcacttgcctctaggtcacagcccttttttttcccttctggaggcatttatccccactgaagccagaggaattatgctaagaatagtaatagccagaaaagaaagggccattatagccttttccaggtgtgaccactgggtagcatctggtcaagaatagaccctcagacacgggtgcaaaattctagcctatgctgcattcctaatctttgtgcaagggacttagctgaaaaatagacaatgctaattttaggtgtttaatcattttggggatccattcattcaaaactagtacaccaaaaggaaagtctaggaactttaaggaagatgcttatgtattttattttatattccacacaccttatctcccaattctgattgcattttcataggagacttggaaggaaatgctgttttccagctgcacagtctggtactcttcagatgcacaatttaagccctttttggcagcttctcttcctcagtaaggtctgtccatattttatgactgcttttcttttccttatgctcgtttgaaaagtgaaagtggaagttgctcagtcatgtcagactctgcgaacccacggagtatacagtccatggga

SEQ ID NO: 37801 - DNA, 947 bp, Bovine  19866881076270
ggattgagaagaattggggagtgactgttaatgggcacagggcttcattttggcgtgatgaagaaattctaaaatcaattgtgatgatgggtgcacaactctgattatactaaaaaccactgaattgtacattttgcccagatgaattttatagtattgaattatatctcaacaaagtaactgtttaaaacaacaaaaacaaaatgttctggtggatgacagtaggagaggtgtttggtaggcagcatgtccagtcctagcggctgccataaacaccaggtgcgatctcaaagtcaaatgtactctcctaaccaaagctgttagagcaggaagagtcctcagtctggcattctcattttattgctccatcaaatttaatttgggtttgtatggtaataaaagccaattccatctactaatatcgctaaaagaattctctctgttcgctgctttattaattgctcaattgaaataccatggattatttccaagcacacagtttgaaacactcagaattagcctgtgcactctattgtaaagcgacctccaaggtgccttctacctttaagaatcttgtacgagcctctcagtgcaggaacgggatatctgtaatgtcaaaagccccaagcagctcagcaaaattggaatggtaacaagcttctgtgctcacaccctgggtaggatagtagtgtcaacacctccagcagagctgatagagctgtctttcagtctgtctgcaggctctgtttacattctgcaggttagctggaaacactctcaccacctccaccccctgaaaaagatctctgggtcaacttgacatctcctagatgctccatgtactatatttcttcctgtaacaagctctcctgctatgttgctttatatgatttctttgcaaagaataaattaggctgagtgtgtaaacaacatataactctagagat

SEQ ID NO: 37802 - DNA, 1283 bp, Bovine  19866881544138
gttgcttgctttaatagtatttgcaggggcatatattcttatagcaaatgatcatcaaacttctaagtcaaagactggtaaagaaattagaactggaaccttatagctgaatcacaagcatttagccatctcgtgaatttatgaaattgtctaagacagtactgatttacaagaaatctcacagatgaaagaatctcaacagatcacctgcttccccatagaaccttcagacagatccaggattataattcccattttactgaaaggcattaacaccataggtgttaagagggtagaaaaatttaaattgtcttactgttaatagtaatattggtagtgccatatttaattgatttatgtaaattttaggataaagcaaacaaatatgctatcactatgcaccaagatcgtcaacataagaaaaaaagggacacagtaagtaaaatcaaagaacttatgtaaaaattcggaagtcttacatgtacattggaaatatcaaaatgaacttatgatttattattttctttctatagagacttccctggtggctcagacggtaaagcgtctgtctacaatgcaggagacctgggtttgatccctgggtcgggaagattccctggagaaggaaatggcaacccactccagtgctcttgcttggagaatcccatggacggaggagcttggtgcaggctactgtccatggggtggcaaagagtcagcacgactgagcgacttcaccttcactttctataaagtacatatttcctggctttgtccactgaaaagtctagaagcagtgaccacccagtagcaatgagtagtgccaagactgtgatttctaagtaatatttcccagcaaaaggaaccagaactttctggaggaatgactgattctaggtttgggggacaaaatgtacaaaaaggtcctggaataccttgttgtaccagggaacaaatttgctttcaaagatcactgggacatgagagccaaatgcagctcccacaggcccaaaatggaacaatgaaagcatcaaaaagatttactataatctatggaagcaagaatatatttaaaaatctacaagagtttttttaaatttttttttactataggtatcaacttttattcacactacaatgaaaaccacacatttatatccagaacattcaaaggacagaggatctaatcaagccaagagctatctgtgggtacatggagcttactaagtaacaagtactaagttcttggagccaagatagtggtgcctaaaatttgatcttgc

SEQ ID NO: 37803 - DNA, 1694 bp, Bovine  19866880123066
ctggagccgattatacagagtgaagtaagccagaaagaaaaacaccaatacagtatactaatgcatatatatggaatttagaaagatggtaacgataaccctgtatgcgagacagcaaaagagacacagatgtatagcacagtcttttggactctgtgggagagggagagggtgggatgatttgggagaatggcattgaaacatgtataatatcatatgagaaacgaatcgccagtccaggttcgatgcatgatacaggatgcttggggctggtgcactgggatgacccagagggatggtatggggagggaggtaggaggagggttcaggatggggaacacgtgtacacctgtggcggattcattttgatgtatggcaaaaccaatacaatattgtaaagtaattagcttccaattaaaataaataaaaaaaaataaaaaataaagataaaatcattaacttatcctagcccctataaacagcaatgatacaaaattaacatttgacttccaggaaaaatgcattcttgggtgctcttaaaaaacacacggtctcaaaagcctaggcttaattttttaaaaaaattagttttcaaactcagcctccttattcaaaattgcatgttttttgttttttgttttttttttggttaacaatttcaaacatacacacaacaaaaccagtgcagtgtttatttttactaacagtttctgagaaggcaagtgtgaataacatactgtttaactgctatgatttgagctcaacagtctgggtgtctgacaacgctattcctgagcttgtctcagatttcagaagtgactgcagtgatagcaaagagcctgtgcaggacagaaagtttcgcagatacctgcaagtaccaggtatccattgtaagtttcctgactgaacttttgtattaatacagtgtaactcgagtttttagcatttctattttatcgtttatatgaatatactgagattgtttttagagacccaatcaaccatgtcatcatagctgtaaacatatacatggcatttcctttgttccaggtgttattccaagtaggttctattccttaacttcatcagcttaccacaatcatatgaggaaacaactcttgtatttctgttttacagctggctaaactatggcacagagaagttaacaaatttccaatatcactcagctagtaagttgttgtgttaggatatgaattccatacgttttatccccagggcctcaccataacactgctggcctctctatacaaaggagggtgtgtttgcaataaaagcaaagtgaggaataagaagggaaaaaatgaaccttcatctttaattttttaccaagcaatgctacaatggaaatttaacttattagctggcaattttaaatttaaaatgggtaggtttaaatttctaaaatatcttttcctcagtatttttcatacgttgccaataacatagccgtttgtttttcagtactcaaaaacattatgcacatctgattttgtctaagtttcagccttcttttctgaatgtacaatcttccacaaatacatgctttgacccccgtctttcattgtaaacaagagaactattcataatggaaattatttgaagcctgttacattataaaatacaactgtcaccttctgttgggtaactgaacctcacttttttcccatttataa

SEQ ID NO: 37804 - DNA, 1276 bp, Bovine  19866880510915
gcaaaacctagggacatggtgctgtgtctgctttgagccagtcccttctccagtgtctgctctggctcacagtgactgcttcatttccctcctatcctgctgaggcggggtccctagcagccatgttgactgccttgcttccctctcatcccactgaggctgggtccctggcagccatggtgagaactataaccttatctttcaaataaagcttttattatctttacagtgctgactgcaacatggtggaaagctatatttctccatgcatattaaaggagcagatgaaatgaatgacaaaagaggggaaaaaaatgatacaacacagagtgaaggagaggtggggagagcaggatgatggattttctccagattcccttttacagtactcagtatccttgtcttcccttgaattccgagaatccccttgaattcccctgaattctgttgaatcattacacccttgtaatacagtcctctttatttttgttttttaaaagctagctatgattggcttcagatgccagcgagcagagtcctagggagcctactgtgtatatcttggtcttcacaactgtagaacatggaactatgtgctggcagggagaaagctgttcattcttctgttagaagtcacgctgaacacccaaatgtggcctctgcttggcttaactcagcagtcacaatttccccaccaggtctttcacatacctgttcgtagtctgtgtgattgataagattgtagttgctaaagggctgaagtcgctgacttcatcctgatgacagttacattttagtgtatcacatggccagacccttactctctgtgattaaacaattgtattgctttgaatgtgtctgtagttctgtgggagcatttttccagtgaaactgtgggctcttgggattctttttttttttttcctgcagaagttgaggaatggagatttgacagtggccaggcttgaagatcataagggtttcttctctgatgaggtcatgatcataggtgatgatagcaccctcagaggagcaccctcagaggagcaataagttccttaagggcaactgggaactcaacttaggtgtgacttgggtgcataggaaattactttgtagtcagaatggtgagctctgaacatactggttacacttctgcaaataagaaactctgcttaactcatcagcagacagctgctcacataatttgatttgaagaatactgcaaagtttctctctccaaaaaaaaatttcctcaaggaggacatcacccacc

SEQ ID NO: 37805 - DNA, 1007 bp, Bovine  19866880519013
ccctcccctcttttcctccctagtaacaataagctttttttcttacatctgtgactctatttttgttctataaataggttcatttgtaccagtttttcttagagtccacatataagtgataccatatgatacttgtttttgtctgacttacttcactcagtatgacaaactctaggtccatccatttgctgcaaatgaattcgttccttcttttttatggctgggtaatattccattgtatataagtactacattttctttatccattcctctgttgatggacatttatattgcctccatgtcctggctattgtaaatagcgctgtagtgaacatttgaaagcatgcatctaaggctggaatttttatctgctttcttctcactctatccctggtgcccagaacagtgcctgattcatggttggtgctgagtaaagatttcttgaatgaaacaatatcagttgtttttaatgtgagtttaaaaacaactacaacagtccagcagttttgaggctatgttgggcacaactgaagtgatttagcagcagcagcagcagcataatatatcactgtgcttctgctgctgccactaagtcgcatcagtcatgtcccgactctgtgcgaccccatagacagcagcctaccaggctcctccgtccatgggattttccaggcgagagtactggagtgggtcaccagtgccttctccgatatcaccatgggagacactttttgagtgaattttctttgtctccctgatttatatgagttataagtgcatgatgctcaataaattatacatatgtgtacatataatttatgtgcatggtatcccaaatggtatatttaaaattgttatattattaacattttgaaatggttttaaactagtaaattttgaataatcatatttagaaaaagaattttctgcacgagcattttctgtatattaacataattcaaatcattaaatcatctttatttcatatgtgcctgatgttgctgagg

SEQ ID NO: 37806 - DNA, 1780 bp, Bovine  19866880549488
gtgataatgatgactgcagacagccctcctgaggagatgtcaactttctgagacacatgaactctagacttctatatccacctccacttggattctaacaagcagcgaaaacttcgtacccagtgtggaacttctgatcttcttccaaactctggtgctacatataatctccatctcaaataatcaggtcatcctctgcttgttcaggccccaaaccctggaatcactttcaattcctctctttctggtataccccatatccatgccatcacattcttttaagtctattaaaatatacatctagaattgaaccactaaacaccacctttaccacaaacatctcctctaacatcatcctctcttccttgaattatttttctacctcgtttccccgcttccacctttgtctccctgcagtctattctcaacacagtagtcacagtgatgctggaaccatcaccagagtcagatcatattgctctctgctcaacaacagctctttattctaacactaggaaaatcgaaggtatttacaaagccactctatttaaattgcaaaatctccagagtcactccacatggttgtgcaggatgtttattctatacaggtgcctggtcaagggaaataaagtgaagcctgaattctacctgaggctttgcttgccaaatcatgtgccttggtataaggctctgtctgtacaatgtttcgtagaggttgttaacacacctggatacatctacacatgtactccctccttcttactttgctatattttctctttatttcctagctccctcttgtacattatttgtttacttattttgtttattatctgtgttcaccaactaaaagatgagttccatgagagtggtggttttgtcttttgttcattactagatcctcagcacatagtaggtattcagtaagtatttctgaaattgaattgggtttttttggaaaaggtagtgggaaaatgcatcagtagatagaaaggtatgtgggccaaaagagggaaaatttttcatgtgggagagaaaaggaaaaattgctgacataatgtcctcaggtaagtgaaagtgataagctctgctaaatcatggagacaatgactgtacaaagcaaaataaaacttccatcacaaaaaccacaggaaagacatagcatatgaatgcagatgcaggtgtgttggtaaatgtttaggtaggagctgtagaagctatcattttcccctcaaatgtttatttggaaagctttcagacatacagaaaagctgaaagaatagtgtaacagacatctctacattcatcaccaagtgtcagcaattgcaaatattctgttctatatgttttatctgtttgtctttctgtgtatatttcactgactcatgttattcctggagacctcataacgtatcatccctacataaataatatattcacaaagaagatacttctctcataccaacaaatacgtaatccatatttaaacctcagagatttcaatggtcaaggctttttatacatcttatacgtttcacacatgcaactgattatattccttgaaattttcaggagaagagaatgtgaatgatttttttcccctaatgctattcaatgtctagcatttgttgtaaactggacattaaatgtggagaaggcaatggcaccccactctagtactcttgcctggaaaatcccatggatggagcagcctggtaggctgtagtccatggggtcgctaagagtcggacagacttagcgacttccctttcacttttca

SEQ ID NO: 37807 - DNA, 1597 bp, Bovine  19866880582977
caagagggcatcagagggcagacacactgaaaccataatcacagaaaactggccaatctgatcacatggaccacagcctgtctaactcaatgaaactaagccatgccgtgtgaggccacccaagacaggtgggtcatggtggagaggtctgacagaatgtggtccactggagaagggaatggcaaaccacttcagtattcttgccttgagaaccccatgaacagtatgaaaaaggcaaataccattagagatttcaaacattaaatttgaacgcaatcaggaaaggatgggtaagaaaaaaattattgattaaatcatggatccttcgagaaaatagggtatttatccaggaaggaggagagagttgggttaaatatattgataatggtgaactttgagtatctagtggattattttacagaagggaaacaaatcttattcttatagctccagagagaataccaaggaatggaaatttccagggatagatttcaccttacaatgagaaagaatagcctaatgattcaagttatttgaaaacagaatgacatgccctttaagatagtgattttcttattactgaaagcatttagggaaaagctatttgacatccatgaagcaagttgtataagggattcctgcaaactcactaggcattttaactatgcgaaaattctgtgctgtgtccctgcactgcctgttcctttagtaaatcaatgaagtatagtactgcttatggtaagaaagattttctttgtgtagttcatatcctgaagcctccctgctataatctgtaagtaatgggtatgcaaaataggtgcttgtctacatcttgaaattattaaaacaattcatgtatttaaaatcatttaagtcaccattcagacatcaaatcagggattctaaattctcactttttaaataaatcctgtttttaagcctctactcactttcctcgagattattttgaccatttagacaaatgacctggatttttctatcatgttaaattggagcttcattatcatatattttcagcactcctccttttagcagattttgctcagagcattctgcaaacgtcaccatgactgaataggtaaaaagtctcccatcccatatgacagacatcaatatttccaaagcagaggaaattacattccaacgagtttattaaaaaaaaaaaaaaaaaaacacacaaaacccagcccatctcaacagatcccaaatcaacactgcagagaatgctgtattcttttctctcttagcctagagagagcagcatgacctcaacacttcctggctgcttcactgtggaccaccaagccactgaaaatggagacaaaagtaaagtcttctgccctccaagatgaacacaattcaccaaactaagtggtggctttttgcccactgattaaaagggagaaggaaatggaaacccacaccaagattcttgcctgggaaatcccatggacagaggagcctgggggtggtcacaaaagagtcagacattacttagtgaccaaacagcaacaacagtaaaagggcagaacaaaggcatcttggggactgccggagggcgacaccatctgttgca

SEQ ID NO: 37808 - DNA, 1784 bp, Bovine  19866880723679
caaatagatggggaaatgtggaaactgtgacagatttaattttgggggctccaaaatcactgcagacagtgactgcagccatgaaattaaaagatactcactccttggaagaaaagctatgataaacctagacagcatatttaaaaagcagagacatcacactgccaacaaaggtccatatagttacagatatggtttctccagtagtcatgtatgaatgtgagaggtggaccataaagaaggccataaaactgatgctttcaaactgtggtgctggagaagactcttgagagtcccttggacttcaaggagatcaaaccagtcaatcctgaaggaaatcaaccctgaatatttgttggaaggactgatgttgaagcagaatctccaatactttggccacctgatgggaagagttgactcattggcaaagatcctaatactgagaaagactgagggtaggagaagagggtgacagaggatgagatggttggatggcatcattgactcaatggacaggagtttgagcaactctgggagatggtgaaggacagggaagcctggtgtggtgcagtccatagggtcacaaagagtcagacacaacttagtgactgaacagcaacaatatgattttattaataataaacacaaaattactttaagttctgatattttagaagcactgtctttttatctagaatcatttaagatttcatgtcttttagaagttttatttttgatagttcctattatctttatattaaggctactcttggaaaattttagaatacttgatgcctcccatctggtctttctattagaaactggaaaacctgaaccatggatctgacttaaagaatagaggtaaaaaaaaagctggaagagccatgcgtagtgggagttactgtgaaaccttgagagccactccatgtggtggcttaattgttctctggaatcaatcttttttatgagactgcacagtttccagctcgacttttcagttttctcaacatttaaaattagatactgaaaaacacccgttgcagactcttacccagaaaaagacagcactggcacagagggttacacgtatacactttccccatgtggtaaagggaacacgctcttcttcctaattaaaaaagaaaaaaaagtcaatcaaggatttcaacaaaatcatttttctcctaattggtttgctgtatcctaggtttaattttttgtatgtaaatgttcacagaaatttattcataataacacaaactagaagaatcccaattgcccatcatcaatctattcaaaggataaacaaattgtagtatatgtatgtaatgataagttacttagtaaaaggagaactaagaatacaccaagcagtttgggtgaatttcacaaggattgtgataattaaaagaaactagacacagaagactatatcctagtcattttcatttatataaaaattccacaaaaaaacaagactataggaaaaatcactttttcctatggctataggaaaaaatgatcagtgcttgtcaaggtgaggatttcagggaggatctagaatccaaaattattaatatacaaggggacacttggcataaaagaattgctctatgtttatgtttgtggtggtggttaccttcctgtatatgtacacgtttcaaaatttatcatattgtacatttaaagttgataaacacacatacatacacatataaacatatacacacacacagtgagtgtggagaatccttaaaaaactggaaatagaactgccttatgat

SEQ ID NO: 37809 - DNA, 1476 bp, Bovine  19866880759930
ctttaaacacgctgtggctcctcggggcctttgtgaattctccccacactataaggaatcctctgaattctttcacacaaggcagtcacctgttctatgcataccagtgttgcccttggaaaatacaactaatcattatgtttctgaaggtcacttgacttggggtaactgatgggggcgtgtgggtactcccgagacagatccaagtgtgaccaagagtgccctccacgtctgcttccattgtaacctttgtcctttcctttgcttcatcattatcaacagtgttcagcaagctgatagcttctgagattgtatcagattcaacaatgcatcaaatctcttccttcaagagcagtcttatctatgcagaagatctgctctctttcttatcatctctttttcttcagtgcctcacagggcaaaggaggaaaggaaccaggcaaagataatggagatcttcagttgttcaggttttcctttgtgcaggctaaactctgaaccctactaccctcaggctagaaagctcaagtgcattctctcaataaacacgtcctgggcctagcactaaaacctgggcattcaaaaagaagctagtcttgacttgtggaagaaaagagtattaccaagttcaccacagtacgacatgttctacaacagaggtatgcccagggtgttactatagctgaaaggagcaggagaggaggacactgggcctgcccggacagacttctaggagtcaggcaattcacacacctctttactggctgctaagcaatgaaggagctgaccctacagtgtctctggggggttaatgatgttgcagtctgttaatgcagtctgtttaacaccactgtcactgaactgctttggttactgcatatacatgcacattctcctcacatattcacctctttattttcagaataaaacatatggtgcttccattcccttccgaggctttcaacctcatcgtgcttcctgccctggagagttgctttgactatcaggaaaagaacactgtaatgacttggatggagcaaacaaagagggaagaatggcctgcttgctgaaaggaactagaaaagcgggtgtggagccactaccagaagtgccgatggtgaccaggccctcggtggtcccagctggtgagtgactgccctgtgggtgcccacatgcatccccatcagctgcagctaggtgcagtttatcttctgatcatttttcatcccccacccctggcctcacccatttctagtggtaggatactcatcaagaatggtttttaacctttcacaggccaagcaactctttggaaaaatggtgaatttctaggatcccgtctccagaaaatttctcagaagcacataaacataaaatattatacacacattttggagattcacaaacctcctgaagcccatacatggattatgaggaggggcatactgttcagtttgaatggttttgaatttctat

SEQ ID NO: 37810 - DNA, 749 bp, Bovine  19866880798467
tagatacgtgaggaagtagaaagttgttctataaaaaaagattttaaaattccactgtgccttctgaaattatataaaaaaaaaaaaaaaaaactttgacatttcccgctagaatagtagagccttcttgacagggaattgtctgctctgttctttggcactttagttattccaggttatacatttgacaatctctatattttttaaaatttgaaatcctatcattctttctagagtatccagagctcaagtctaattttaactaatccagtgtatagatgcttgcttgcttttttttgtttttgtcttttttttttaggattctttcctcataataaacatctgggaagtggttaacattgtgtagcattctcataaatttttataaagcacaatgaaaagaaaagcaagtcaaagtttctctttctttatatgatctaaaaagatctttccacagaccacgttttcttatcttccctgaagagtgaaccataaaacacgccactggccactaagagcaattttccgatgatcctcacgagaaagggaaaaccttccatatatttatgacttttcacaatctatttccttcatgttcaaaatcatgtcagatgtcttattgccatgacacacaatgcccagtagagacagtttgatatggctcccatcacttccgataacacatcactcagagcaattatatattggcttcacatgctttttaaaaagcagtctcaggaagacctttt

SEQ ID NO: 37811 - DNA, 1093 bp, Bovine  19866880812679
aatgatggtggactgcaatagatggctccaagagcctctatatttaataaaatttctttgctttcatttcctatttcctgggcttctagtaaaagttgtggttaacattaaaacctggtttcccagaaatcccactactgggcatataccctgagaaaaccataattcaaaagacacatgtaccccagtgttcattgcagtcctacttaaaatagccaggacacggaagcaacctaaatatccacgtataggtgaatgaataaagaagttgtggtacatatacacaatagaatattactcaaccttaaaaaggaacaaatttgagtcagttgaaccaaggtagatgaaactagagcctgttatacagagtgaagcaagtgagaaagagaaaacaatatcatctattaacaatatcatctatggaatctaggaaaatggtattggtgaacctactttcagggaaggaatggaggcacagacatggagaacagacttgtcgacacaacagggaaggcaacggtgggacgaactgagagaagagcattgaaacatttacattaaccatatgtcaagtggatagctagtggggagttgataacacaaggagctcaacccggtgctctgtgacaacctagaggggtaggttgggtggggtgggagggacattcaagagagaagggtgtatgtccacttatggctgatccacattgccatacagcgggaaccaacacaacattgtgaaacaattatcctccaattaaaagaaaaaaaaaaaaaacaagcagaaatctggtttcagtgtaactgggaggaattaagtaaaaggtctgtgtctgtgcttcatctggtaataaaggagtaactcaccttgaagtcagcatggcaggggtggcatcaatccatgtccaggacagggataaacgggttgcaactgaaggacagcagaggacaagcagagggctgggagcccatgtaaagcactcctgaagaccccctggaagaaattagaaggaacctgagaagggcaacctgccctcacacaggtggagactatcaatcaggaggcactaggttaaaccagaccccatttaca

SEQ ID NO: 37812 - DNA, 1484 bp, Bovine  19866880850271
tggtgacacacgggggctgacggcaattgggagaatgggaaaagcccaggtgctacagatgaaaataccatcttacacttatgagtcatttatcgggagcccacaaagtgtcagctgttggaatcttttgctaagattccctgaaagagattccccctgaaataggtttcctggaatctgaagaacattatcatcccatctgaagatcagtaaggatataggaaaacacatagtaattatctctttgcagaaaccacatgctattcttcaactcttttatctttaagtacatgtgtctgcagcacagccacggtcatgatctcccttaacctgacacttagtgggcagttcctgcacgcataatgtgacacagacagcggggaaggacttggggctctccgaggttaagagcagccgttcctatgactgctgttaaggaaaagaattcattatgatggtgatattgtaactgccactcaggtaatatgagtgaaaatgccctatacccagcaccgttggggcttcccaggcggcactagtggtaaagaacccgcatgccaacgcaggagacatgagacgtgggggagatccccgggaggagggtatggcaacccactccagtattcttgcctagagaatcccatggacagagggcctggctggctgcaatccatagagttgcaaatagtcggacacaactgaagcaacttagcacaccagcagtataccagcctccttgcctcttcttagcaaccccacaaggccgaaaacacaggctgtgaagtcaagaaacttgctctggttgatagattctagggggccaaagccaaccgcaaattcatgtcttctgactataggcctgtcttccctcctcacgactctgtattagcacaggcttcataggctctttcttccttttgctttaaactgtcctctttagggaataactcaccccaatgaacccaagaggctctgtctttaaaatcttctactttccctaaggagcatctatgatcagtgagcttacactctttcttcactatctgtattacttagaaacaaaggtgggtttgatttgttggtttttctttttttgcttgttggctttagaaaaataaaagtatcttatgttttacatagattgagcattcaggacttgtttaataagtaacagcagaaggaaataaaacaatacaacaaatgaatgcaattgtttaaaatcataatataaattataacaaaacatttaaaataatgttaagggtttatatgtggggaggttgtattatttttgttttaaacttagtggggaataacttctattagaaactttgcacaaatcagaaaaaagtaaaaataaaaacatgttttagtttatgtccatgtgatgccacaagaaaaatctcaccatcatcttgtctgtgccaagtcaaagattatttttcaaacatctagatagaatgtcgaagaaatcataaaaaata

SEQ ID NO: 37813 - DNA, 1349 bp, Bovine  19866880863901
ttgaaaagaaagagagagatccaggttacagtgccagagaatttactctcctagagacagaggaacttacaacataatctcgcatatgactgggcttttttcagagccagtcagtctggtttaatcattttgtgctgccgaatacacaccatagactataaacataggtttagattcttacctgtaaggtttccaataaggtacatagataatttttagttaaaaaccgtgtggcctcagatactcatttattcagcaaatatttattaagaaatgagtatgtcattcaatatgcaatattaattttctttcatttttaacatggaagacagctctaccctaattttttttaaatgtcaggaacacggttacttatccaagtataaattctacactgcagtaaagctgatgatctcatattaaatagatttaagcaatcttttcttaagtaagcagtcttttcctgatgtattcctgtttgacaaatatagcacatatgctaatttactttagcaacctgacaaaccaagaaaactggtttgatcaattttttaaatattccactagttctttgtgaactgccatgccaaagggaaataacaagaactgtcttattaaagtaacaccaaggtgatatattaacatgtttaagcaaataaaaatgccctttccttggttcaactatttaagtatttatagttagtaataaaacagagggcattataaaccaactccaagatctgccagttatcaagagatatcaggtaaatatcttacaaggtctttgtaaagaaccaaataagaactaaaattgcatacgctatagtataactttttctcagtggcagtacagcaatatctattaaagaagtttaagttgtatgcacttttcaacaattctgcatctaggactttattctgaggaggatacacaaaacttattctacaagaattttcgtaattatgaaaaattagaaacaactaaaacattcaacaatttgtgaataaatagtttgttttgtatatgtattcacttatagtttagattcctcgtataaatggtattatgtagcagttgtctttgacttatttcactacgcctaataatctctgggtctatccatgttgttgcaaatggaaatatgtcattctttttacagctgagtagcattccactgtgtgtgtgtgtgtgtgtgtgtgtgtgtgtgtgtgtgtgtgtgtacctgagctcacaagtgtgtgtgtatcacatcttcttaagacaatcactggattgtgtccacatcttggctcttgtatatagtactgctatgaacattggggtgcatgtatcttttcaaattagagtt

SEQ ID NO: 37814 - DNA, 1113 bp, Bovine  19866881022799
ttatacagactttgacatgtttaattgatgtgaatgttctaccataggagaaaaaaatgttcatttttgaagataatgcatttccaatttcattgtgtgagtctgggataaaacagttcagggtgtagctaggtgggggaggaaacagaaccaagtttcttattttggagaagacagcctgtcaacacatgctccttacatacagacaccattgtttataggtgtccctggtggtatttcccttttgcagcggttgtgcctatgaagggtccccaaatgaatcacaaaacaggcaggccaattactttggacacttttaagagatattagttgccactcctgcatgaagtaaactgtaagatagccaaatgtacctaataagtcacattgtcattcagacatttagcatgttttggctggagaccaaacagtagctaatatttgccacacggaagaataaagatcaagttcatatattaagattctctgtctccttcactgtgaaatacacctttcattttttttatccttgtaagagggtgagtgctgaacatgtgggcagaggcagttttaactaaactgcccaaacctcagtctcaacactaattcataatctataaaattcaaacacatctattgaactccgtatattaatagagctgatagccctaattaaaagagacttcttaaatgaagcaaaaattactttgacacaaaagaaaagcttcaaatttcctaaccagctctgctttctgtgatcattaaactacacccatgtttatagaagtgacaggcatattgagctgctgattttatttcatcagattttagaatgcagaaaacatttcagccctgctcacggcacccatatgtgtatctttaaggatatgtgtgtgtatgatgaagtttttattttaaatgccttattgcttttcttgttacctctgcctgatgagaactactgctgggaacctcattacagaaagcctgcaattgcaaaactgaagttttcatatcaccatcatcatactcctgtaccatctcttgtgcccagatgtatgttgcagagtatttttcttctccctggaaactataaaagtgaaaggagaaaac

SEQ ID NO: 37815 - DNA, 759 bp, Bovine  19866881054316
taaagtatttaactaataatttttatattgaatatacacgttgaaatgataatctaggtatatcaggttaaataaatcttattgctaaaaataatttacctattatttttcttaatgtagctactagaacattttgtttggctcccagtatatttctattagatagtgcttttcagcagattttgaaattgctaccctaaaatgatttcacatcagcttcctgagacatagtagaggaaaaaaggacatcagtaggctaaagttttcctgaactagaattgtataacatttagttgccgtgtccttacatgtagaagctaaatgattttccatggtagatctagcccagagcattttaagacctaatataaacatggcattgtccaatagatgaaacagctgctgaagattttgagtgtcctggtacctgaaagcattaaataatgtcaatttgtaagtgtgccagaggcacggttgttaatctgatgctgctgacttaaagtgaaaaaaaaaatgtatgtaagtcaatgaaagttcatgctcatttatttttccgtttgtttcttttcagccttggaaaaccttgaacagacaaatgtctctggttttggatcattgaaaagtcagcaggacttccgaaccccagagtttgtgagtactacttactctatcttaaatttgtatcagttacctagagaaagagggtttgtttgtcttaaactgagttcttggtttcaggggctctaggtctggcacagg

SEQ ID NO: 37816 - DNA, 4545 bp, Bovine  19866881072749
atcgggaaaggagtttgtcaaggactgtgtattatcactctgcttatctaacttatatgcagagtacatcatgataaaccgtgaactggatgaagcacaagctggaatcaagattgctggaagaaatataaataacctcagatatgcagatgaccacacttatggcagaaattgaagaactaaagagcctcttgatgaaagtgaaagaggagagtgaaaaagttggcttaaaactcaacattcagaaaactaagatcatggcatccagtcccatcacttcatgggaaatagatggggaaacagtggaaacagtgacagactttattttcttgagcttcaaaatcactgcagatggtgactgcagccatgagattaaaagatgcttgctccttggaagaaaagttatgaccaacctagatagcatattaaaaagcagagacatcactttgccaacaaaggtctgtctagtcaaagctatggtttttccagtattcgtgtatggatgtgagaattggaccataaagatgtctaagtgccaaagaattgatgcttttgaactgtagtgttggagaaaactgttgagagtcctttggactccaaggagatccaaccagtctatcctaaaggaaatcaatcctgaatattcattgaaaggactgatgctgaagctgaaactccaatactttggccacctgacgcaaagaactgacttatttgaaaagaccctgatgctgggaaagattgaaggcgggagaaggagggagcgacagaggatgagatggttggatggcattaccgactcgatagacatgagtttgagtaagcttcaggagtcggtgatggacagggaggcctggcgtgctgcagtccatggagtcacagagtccaacacgactgagtgactgaactgagctgatagactttcacatgtctgatgctcattacctgctgcatcttttgtagcatgtgtatagctgttcatgttttctcctcagtatcagtctagcccatggtctcccagttccacggtaaacatctattccccaaactgcggtctccatggtaaacaaacaggagatatagaagccaccttgagaatagggttctcaggggaacccggtgtgatatttaagggaagcctcttttgtagacagaaagttacagcatcagtaagaatgggtggctctcgttgggtagggaggccgattgggaacatgccaggacagagtcgggtaagttgacccaaaccaaaatcttaaattaggacagtgacagcagtgcaaatttgggagcaaaatgagcccaaagacaaagcaaaactgaaagcagaaaaggcagagtagaataaaaggaactgaggaatccgtattctgttcttctcagggtggcattttggaaggtccagcttgtagtttgctgagttgaactgaaataaagtaagtcttagaccatgtttactcaggccttatcctcaaatagttcagattttagaaggctccagagccgtgtttttatacagtggaatgtatttatatcgtttgaccaagggggagcacagaattattatcgctattactttgtttccttcagctgttgtctttctttcatttgaaacaagtcctgaaaacagtgctccttgcggcatgataaggacattaaaaggtttccttcccagcccaggtgtctgtaatgtgactagtcgaacaaagtaccactgtattgtctgtgtaaatcgtgggtaggaaatgctctcgtgaacccctcctgtgcctgcagacaacggccaccttgtagggccgtgatctcatgatcacgtgttgtctcgtgatctcgtgctgctcgtccctacctcccactccactctgcaggttgaagtgggtgaggttagctgaaccatgctgacataaggggtaagtggagatgtggacactggtgcatgagttgttgccaccccaaacttgtgaggagctgggaacatgttgaaactggacatcgagccactctgaggtgagatgcatgtgtgggtgatggtcaaagtgaaagagtcttggctaaagactgacctttcagagagtcccttggtgacctcacagtggtggaaaaccacctcagttgtggtttggttttttgttcaagcacaataaaaatctgcattatgactgctttgttaacttaatattttatcccaaatattttcccattctgttctttccccagttttcatggcggtataatcgacgtgtagcatagtgtacatttgagctgtacagctccatgctggttttttgtctctgacattgctatctttgctgacattttctgttcactgtgtcagtaaactataattcatcacattaggaattttcaaagcagttagttccagaggaatctcatcgagtaaatggtggcatggttggatgctctgtgaccatgtgattggtgactatcattttgggacccggaccctgaatgtagatggggtgcaagatgacaggtatcagagtctgaagaaggggatcaaccaaagtgaggctggggactgagtaccagagacccagataaacgtgtagagttcacactgagaagtggagactacagcactaggcagtctggttagaaccagggatggggaaccattcacatggtgacggagcagataagggtggccctgcagaatggcagcacagacatggggcatcccaggctcccactagtgtccccattcccagatatagttgagagcaaaggcgatatgatgtttcagtgcagggatgcagcaggcatgactgcccagcagaccccaggttgattccaaaccccaaggagtaggaaaaaacctgggggttgggggctaataggcagaaagtttgggtagtggtcaaggctctgtgtagaaaccctgcctctgttggcactaacccaggaactcacatgggcctgattgcttgagtatacatggggtgaaggatagggtatggagaggaattctcatctagcaatcacggatctatccagcagcaagctggatagaaaccaggctgcagtcaatatggaagcacatggaatgaaataacagggctaaaaaattacattttaagatttaagtcttgagaataagagcctcttttttgagtttttcaagtttttcaagtttcaaatagttcaagtttttccagaacttgagatttctgtctgactctctggatgttttagaggcaggacttccctgacagctcagctggtaaagaatctacccacaatgtgggagacctgggttgggaagattccctggaaaagggaaatgtcacccactacagtattttggcctggagaattccaagggctgtatagaattccatggggtcacaaaaaagtcagacacaactgaaggactttcactttcaggcttcttattatcccttatctcatgtcagttgatgatgtttcctttgtttagcttctatgagatttggcataagtaatacgaaaaagtctagactggcaaaagagtataggattataacaggataaatcagggaagatgatgagaaaccacagaatttagaaaagacagactcaggaagatgagaattaaagtggagcaggtatgttcccttagttcagcactcatgattatgcagagagaaggatgtgggaagagtacttacgctatttggaattttgtttaactgcattctctttttgagagaggatactaccactagggcttccctggaggctcagtggttaaagaatacacctgcaatgcaggagacacaggttcgatccctgggtggggaagattccctggggaaggaagtggcaacctactccagcattcttgcctggagaattccatggacagaggagcctgatgggctacagtccatgcagttgcaaagattcaaccatggctgagcatgcctgtactacttaatagaaaatacaattgatttcctgaaattcaaatttgattgtctttaactaggtgaagatagatgtgaccctgaagagttaagatattaactcattaaacaaatatttacttggtatctactgttttaaggcctatggtggacaaacagaaagcattctgcatgtgtggagcttgcgttttggtagtgcagatataaaacacaaaataaaatacacaggatgatattaaatccttcagagaaggaaggattatttgtgtgtgttgtgcagggagttggttatggttttcagcaaggtgtacaagcatatctccctgagaaggtgaggagtggaaaggcctgaagcaggggtgctggagcagactctttggaaatctagatgaagagcatcccaggcacacagaagaacatgcacaaaggtcttgatgtgggagttggtgaaatgtttgaggaaatggaaggaggccagtgtgactggagtagagtgaagggtggtgagaatagtagctagtggggactttacaggtgattgcaaacactttgattttactctgagttgggaacttatttgaggatgttgtgcgggaaaaaaaatgcacaacctaacagt

SEQ ID NO: 37817 - DNA, 1426 bp, Bovine  19866881133278
tcggaagcccaatattgaatagctgataaaaatttatttcctgccaaagattaacattttccaaggcctgtaacttaatgccatgtctatttatgttaggatgcctgaagtaattggtttagtataggcagaatatcctaaatatccaaggcttcccttgtggctcagctggtaaagaatccacctgcaatgcaggagacctgggttcaatccctgggttgggaagatcccctggagaagggaaaggctacccactccagtattgtggcttggagaattccatggactatacagtccatggggtcacaaagagtaggacacaactgagtgactttcactaaatctgaatctaaaaggcagaatattgcttaatactttatgagtgggtagaataagagtactaatatttaagtaattatgagtaaatgtcttaacaactctggatggagttgatggatattgggtactcattgataaatggctcagttctgtaaatgttgcacttcaatgagagaaagtgaaagtgttagtcactgagtggtgtccgactctttgctacctcatggactgtagcctgccaggctcctctgtccatggacttctccaggcaagcatactgactgaaatggattgtcagtcctttctccagggatcgaatctggatctcctggattgcaggcatattctttaacatctgagccaccagggaagctccttaaaaggattttgttagtggattggttgtgaggtagagaaaggatgtgaggtagagaaaggaggaggtcaagggtgacactaaagtcctgacctgagcagctattaaaatggcattgccagttgctgagttggggaaggctgttagagtgtttggggtgatataataaagaattgtcttttggacaagtagagatgctctgaaaaaatatggatgtttgtatgccatgtgcaaacaagattttttcatctttagattgttttagtataattggttcatgttcatgtgtgaatttgttcttggcttctaagtctaattgatggtttcttccagttttcatttcttttcccactcttgaattgaggcaaaaatgttaaagactatgatcagaaataagactggagaggaagattgaagatgtcatagggagttgagcaataaagctgaaatttctgcatattatcttatacagagtaattttttaaaataattttatttatttttgacgatcttggattttcattgccatgcaggcttttctgtagttgccacaagtggggactacactctagttgctgttgataggcttctcattgcagtggcttctctcattgcagaacatgggctctagagcgtgtgggcttcagtagttgccgtgcatgggctcagtagttgcggcttccaggctgtagagcacagcgagctgtgtgc

SEQ ID NO: 37818 - DNA, 1194 bp, Bovine  19866881228583
gaaacagaccttgcacagaaaaaaaaaaaaaaagcaagtttcctataacactcactcagagtgctaagagaatacatgatatccacaatacaaaaacagggttctagtttaaagaaaagtaaagaaaggatcattctgagagtaacatgtagctcttaggaatcaaaaatgagcagaatggggggaaaaaaaccagcagcagtattaaaaaatgatgttgaagaaattgtaccaaacatgaagtcaaaatatgaagacacaggggaaaagataaaaatttaaaaatcagtccaggatgcacaatgaacaaaaaataagaatgctaaaaataagaccagagaaaatgtgaggaggaaatgagagaaatatttcaagacaaatatctgaactgaaaaactgagcaccctgagtctctgcgtggacacagcatgcagagcacccagcttggagaatggacagggagccatcaagtcactgaaatgtgacttctcaaacactggagcagagagaaggtcctgcaagcttccagaaagaaaatcaggcttcatacaaaggagcaagactcagaatagctttgaatttctcagcatcaacacttcaaggtacaagaaaagagagcaacagtttcatattgccaaggaagatgatttttttttttaactcactgtcccatatatggccaaattcttcattcagtgtgaggaaattttcataatttaaatgtgcaaagtaatgcaggaagtacagaggtactccactcagaaagagaaatacatgggttcaataaatgggggttcccagtctaaaagaggggcatggagagcccaggtaacagctctgtggcaggactactagcaagccattaatccaggtggcaggagactgaagagattaattcaaggagatgaaattgatagactgacttatgtgttagaaagcagtgagaaagttacacctgaaaggaaagtctggggctgaattgttgctaagtacacagaaaactaaacagtgaaccaccaagacaattattaactccagagaaaacgagatattgtgcagaaaagagaaagtaagcacagcagatgacttgatgccagctgtgaacagtctttatggcatcttaataatgcaaagcaaggctattactctaaccaaaattatattgtaactatgtcaagaggatgcaggaaagga

SEQ ID NO: 37819 - DNA, 3043 bp, Bovine  19866881458375
catggagataaaaggaggatgaggcacagattctgacaggagcttcagaataacaaaaaacaggatcagcattaatccctgtcaggaatatacttacagtaagaatattagtaacatattgacctattctgtttttaaatcttaccttgacattctttaactttcctctagaattctaaaaaattcagttacgatttgtattatttgtatggaataatcacttttttccatttgttatgtcctactttaattaaatccattaaaagcacatgtatatgtttaatatggacaaattctgcattttgtctcactcaggcaatatttgtaacataaatctttcaaatatacatgatccagcacatccctgaatttgcaatgccatcatcacaagtaagacaatactttcctaacagtaccgagcactcacatgctagcaaagtaacactcaaaattctccaagccaggcttcatcagtgaattgtgaacttccagatgttcaagatggatttagaaaaggcagaggaaccagagatcaaattgccagcattcgctggatcatcaaaaaagcaagagagtttcagaaaaacatctacttctgctttactgactaaaccaaagcctttgactgtgtagatcacaacaaactgtggaaaattcttcaagagatgggaataccagaccaccatgcctgcctcctgagacatctgtatgccagtcaagaagcaacagtaagaactggacatggaaaacagactggttccaaattgggaaaggagtacatcaagcctatatattgtcaccttgcttattttactcatatgcagagtacatcacacgaaatgccaggctggatgaagcacaagctggaatcaagattgccaggagaaatatcaataacctcagatacgcagatgataccacccctatggcagaaagcgaagaggaactaaagagcctcttaatgaaagtgaaagtgaagagtgaaaaagttggcttaaaattcaacattcaaaaaaagaagatcatggcattcagttccatcacttcatggaaaatagataggcgaacaatggaaacggtgacaaactttattttcttggggtccataatcactgcagatggtgactgcagccatgaaattaaaagacacttgctacttggaagaaaagctatgacgaacctagacagcataatacaaagcagagacacaactttgctgacaaaggtccatctagtcaaagctatgatttttccaatagtcatgtatggatgtaagagttggactataaagaaagctgattgccgaagaattgatgcttttgaactgtggagaagttggagaagactcttcagagttccttggacagcaaggagatccaaccagtcaatcctaaaggaaattagtcctgaatattcattggaaggattgttgctgaagctgaaactccaatacttcagccacctgatataaacaactccttgaatgctgagaactcctgatgctgggaaagactgaaggcaggagaagaagggaatgacagagaatgagacggttggatggcattgctgactcaatggacatgagtttaagcaagctccaggagctggtgatggacaggaaagcctggcgtgctgcagtccgtggggtcaccaagagtcagacacgatggtacactgaactgacagggatggaatgtaaacatgattaatataattaacactgctgttaattatacatgagagttgttaagagagtcaatctaaatcctaagagttctcatcagaagggaaaaaatttttgtctatttttttaatgttgtatctatatgagatgatgaatgctcactaaacttaccgcagcaatcattttatgatgtgtcatgtgtgtaagtcaaatcattatgctgaccactttaaactggtgttgtatatgtcaattatatcttgataagtaggaaggaaaaagttaactattgaactggtttagacggttcactgaaaacttgtttagtattccatattctgaatagcaaaacaaaactcaaatctaaatgaatcaaagattcttataaatggccttcactatactcaagcactataggtctaagatttgcctatgtttctctctctctaaaaataagcccaggccagagacgcagacttcaagaaaattactgcagtcttaaaactaagattatcatagtaagagtgcactacactacctagagaaaatctgtaacatcatttaatcttcctcagcagtaaattttatatttgattctagagctaccaaacaaaaggctattcaataaaaaacaatgctaatctatagcaattacccagaaaaacaaagaagttttgatatctaaagttctttaactaaagaaaaatgtttatctaaccattaaagttcttttagtgaaatttcactttaagagtaaattattaaagacatatatttattaatctgtaaatcaggggttatctgtaattctgagagaccatgttaattcaaattaaaaaaacagtaacaacacccaaacatggtattcaaatgtataaaaaatgaagttgattaccatttagttttaagagcaatgaattcattaattctatctataaatagaaattaatcgtaacctagcatggaaaatgaatgctcacctctccctgcttacaattagctcatagtaaggtgttctttagaaaaaagataaacagcttaagtttcaaagaggaggcacaaagcacttgaagtgacattttcctcatgtcctgctgcaaagctttcttgtattagagaaccataacactagacaacaacaaaagacaggcatattctcaaacagatatgtgggcttcccaggtggatcagtggtaaagaatccaccctgccaatgcaggaaccacaggagacacgagttcaatccttgggtctggaagatcctctgaaggaggaaatggcaacccactccagtactcttgactaaaaaaccccatggacagaagagcctaggggggctaccgcacatggggtcacaga

SEQ ID NO: 37820 - DNA, 1839 bp, Bovine  19866880051342
ccaccacttgatgggaaatagatggggaaccagtggaaccagtatcagactttatttttctgagctccaaaatcgctgcagatggtgattgcagccatgaaattaaaagacgcttactccttggaaggaaagttatgaccaacctagatagcatattcaaaagcagagacattactttgccaacaaaggttcgtctagtcaaggctatggtttttcctgtggtcatgtatggatgtgagagttggactgtgaagaaagctgagtgccgaagaattgatgcttttgaactgtggtgttggagaagactcttgagagtcccttggactgcaaggagatccaaccagtcccttctgaaggaaatcagccctgggatttctttggaaggactgatgctaaagctgaaactccagtactttggccacctcatgcgaagagttgactcattggaacagactctgatgctgggagggattgggggcaggaggagaaggggacgacagagagtgagatggctggatggcatcactgacttgatggacatgagtctgagtgaactctgggagttggtgatggacagggaggcctggcgtgctgagattcatggggtcccaaagagtcggacatgactgagcaactgatctgatctgatctgatcctctcttcaataagttttcctgaagttcttcctctaaattctcatctagtatacatttactatgagttatttttcagtggattaagaacacaggctatcctcaaaagattagtaatctttatccttaattctaactcaaatcatgaatataattaattcctcctacagttatactttgccttttacatttagaaatactgcaacaagcctctttttttggaaactggaaaacataattaaatatctctaagtagtgaagagtcagttggcaaaacagaacatatcactgtgtggtattaatgccatttatgtgagcagccattaattccaatttgaggcccctttcaaaatcttgcagagattaaaatggtctctggattttagaagatttattatcaatattcttaacttctggaacaaaattattccacccatccctacttccacattttccacccatctagtccatgctatacttacatacatacaagcagcatttcctaaatgagaaatgagagagtccccataagctctgtataaagtaacttcagatgactgcatacaacatccctcttggagcttcactaaacattggattactgaagattctgagaaggcctatggcaaagaaacctgtttaactttgttaaatttactacccgagacctctgagaaaagttgagatagatatgagtgtcttgagaggtcagtggggtgtcagagaacttttaagattgtcaaataatcagccatcaaaagtgaaagtgttagtcactcagtcatgtctgactctttgcaaccctgtgaacttgtagcctaccagactcttctgtccatggaattctccaggtgagaatactggagtgggttgcctttcccttcttcaggagatctgcctgacccagggatcgaaccctttcttctgcactgtagacagattcttcaccatctaagccaccagaattagcagttgaggggagcctctttttccaggtgaacatgaaaaaaacctagattgctcttctctcaccattcaccatgtttctttctctacccaactttacagatgaactacttttaaaagagggcttgcagcagtggcagactagaattacctgaggaacatctagaaaatacaaatgcccagattttatctaagaccaattaaagtagaatctttatag

SEQ ID NO: 37821 - DNA, 3657 bp, Bovine  19866880433618
tggtaaagaatctgcctgcaatgcaggagacctgggttcaatccctggttgggaagatcccctggtctggtgaattccaaggactacagtccatggggtcccaaagagtgggatacaactgagagactttcacttttatttacacagcagttctagcattggctactgaggcctcatgaggtagctccacagtcttagggacccagattgcttctgtcttttgttatcactcctactttcttggccatattaatgttgtgaaattgagcacaattccatgtccatattccctccaataagagggagaaccagaggacatgaaaagcatgacctttccaggatgcagcctagaggaaaaacaatgccgcattcaagataaaggtgctccattttaaagatgcttggaagaaacaaacgtgtcgagttctttatctgtagtaagttttaatataaaagatagtggagattcaagagagaatatttacttttgggtaaatgtcctacaagatcttcattcacataaagtttcaactattggtgtacatgggtaaggttagtaatcttgagtttaagagtacaatctaaattttttttctaaaaaataaaagtaaaatttgaggaaactctcaaccatgtgctgtaaatggaaataaagtaagtttttacattagaatatttttttaaaaaaaggatgcagcctggaaatcgcacatgtgagtattcacatgctattggtagaaattagttacctggctgcaccttgctgcaggggaagctgagacacatacctttcaaatttttattcagctgaaatttgaggttctataactaaaggaagaagtgaagaatatatggaggtgagatgagtggataagggtggctggccatatcaggtataagtgtaagagaaattttttggaaagtcaggtggttctagcaggagagaagggaaagagttgggtccattctatattttataattttcctgtcttcctacagtcttgtttttcctcttctgacctttctcagccttgactctgatatgtgcttcttttcttatcctaatttggttcttctaaagtatctccagatcatctaatagctctacaattcactgctgctgttgctgctaagtcgctttccaggcaagagtactggagtgggttgccattgctttctctgctacaattcactaaattaagtgatacctgatgagagtagagaatttagttgttggaacccaccctgtgccacagacataatgccgggtttggagatacagcagagtaaaagcagacctgattccttctctctaggagtgtagattacagcaggaggaaatggcacaaatatatatcaaattgaagctatgtttctgtttatggccatgatggagcaataggacctggatttatcttatctttctgcatgaaataattaaagaactggataacatatatgaaataattcttcagatattaggcatcaagcaaaagaggcacactaatccctgaaagatgggaaatgaaaagcaagtcccataaatattttagggtgaaaaaagtctttatttctcttttgtttctgaaagattatcttccaggtttagagtttagaacaggagggtttgttctcaacattataagatgtttctccactgttatctcatttgaattatttctgaggagaaatctgctgtcatccttatttttatttctctgttcattcaatgtacttatttttcttctggctgcttctgagactttctttttattactggctttgagcactttgattatgacatgacttggtgtagatatttttaaaatactgtgtgtgtgtgcttgggagttgtagagcttcttagactggtaggtttatgcttttcatcaatttttttttcaatttttttctgtcctgaaagaattaatccccagtgaactcacatcacaagaaatgttacaggaagtttttatgttagaggagaaataatggtggatagaaatatggatctcacaaaggaatgaagagcactggacacagtaattatgcagggaaatacaaaatagtttctgttatttaaatctctgaaaaaaaaccattgaccatttgaaggctagtaacaacaatgtaaagttgggcttataacatatgtagaagtaaagtgtatgaccgcaacaacttaaaagggagagaaggaagtatactggtgcatgcatgcatgctaagtcgcttcagtcatgtccaactctgtgtgactactgtggactgtagcctgtcaggctcctctgtccatgagattctccaggtaagaatactggaggtgttgctatgcctttctctaggggaccttcccccacccagggatcaaacctgtgtctcttatgtcttctacattggtagatggattctttaccaacagcgctacctgggaagcccatactagtacagtgctttatattatatgcagtgctatattgatactatcaccagaaggtacatggtggtaagttaagatatatactataaatctcaaaacaacactaaaatgccaaaacaagatattagtaataagccaacaaagaagataaaatagaatcagaaaaagtgcccagttatccaaaaagaaagcagataaagaagaaaaaagtgaacaaagagcagacttgacaagtagaaaaagaagagcaaggttatatgtaaaaactaaccattttaacaaccatgttaagtgtaaattctctaaacacctccttaaatgtggagattgtctgattagataaaaaagcaagagtgaattatatggtgctcaaaaaaactctttaaatattaagatacagataggctaaaagtaaaataatggaaaactatgtcatgttaagaataatcaataaaaagctggagtggctatgttaatattagagtaaatgtcagagcagagaatactaccagggataaaaagagtcatttcataatgataaagctgtcaattcaccaagggaaaataggagtcctgaatatttgtgcacctgaaagcaagtttcaaaataatgaagcaaaaatgaatagaactgcagagagaaataggcaaatccataattataatggaagatttaaatatcactctcacagtaattgatggaataaatagacagaaagtaaataagagtataaaagatttttacagcactatcaaacaatttgatctaactgacatttataaaactctctactcaataatggaaggatacatattattttcaactacatacagaacatttaccaagatggattaataaagtctcaaaaattttaaaggattctaattatacaaagtatattatctgttcataatattaaaaaagtagaactctatagtagaaagatatctggaaaatctcccaaatatttggaaactaaataatgcacctccaaacaactcacatgttaaagaatgaatcaatagggaaatagaaaatattttgaactgaattaaaatgaaaacttatattaaaatgtattacatgccattatagcagcatttagggaagaatttatagcactagacgcctacattataaataagaaaggtctagcatcaatgactttagcttccatctcaagaagatgggaagagcaaattaagctcaaaataaa

SEQ ID NO: 37822 - DNA, 2037 bp, Bovine  19866880441031
aaagctgagcactgaagaagtgatgcttttgaacagtggtgttggagaagactcttgagagtcccttggactgcaaggagatccaaccagtccatcctaaaggagatcagtcctgaatgttcattggaaggactgatgttgaagctgaaactccaatactttggccacctcatgtgaagagttgactcattggaaaagactctgatgctgggagggattcggggcaggaggagaaggggacgacagaggatgagatgggtggatggcatcactgactcgatggacgtgagtctgagtgaactccgggaattggtgatggacagggaggcctggtgtgctgcagtccatggggtcgcaaggagtcggacacgactgagcgactgaactgaactacttcacagcatgagaactatattcaatatcctatgataaactataatgaaaaagaatataaaaagagaatgtataaaagtgcataactgaaacactttacaacagtagtttataaaacattgtaaataaactatattcaattaaaaaaagaagacacttgttaggatattttcaaaaatagagatggtacagacatacttgtgtaacctacactttctgtttatgcagtaagcaatgatcgatgtttcttattccctgtattaaagatctggaccatccactgtgtactatggctcttgcttcttggatgtgccttgaggaggtgtcagctttcccactgattgctttgttccacttccttgctttctgagagaacttagcacaggttagctttctgactaaactcaaggagataaacttttagaaacttatccttcttagaaattactgtaatcaactcagaaattaccatacatacttgttatttagatcttcttattcagatctatttttaggtcttgttagtcagtccatggggtcgcaaagagtcgggcacgactgagcgacttcactttcacttctcacttttcatgcattggagaaggaaatggcaacccactccagtgttcctgcctggagaatcccagggacagaggagcctggtgggctgctatctatggggtcacacaagagtcggacacgactgaagcaacttagcagcagcagcagcagtcagcatatttataaacatatcactatatcactttttaaatatattttgtatttgtctaaaattggtttcctttgtgattttacatattttattttatatatttaaagaccttctgagaaagtggtcataggtctcaccagaatgccaaaggggccatgacacacgaaaggttaaggactctgagagactttttttgcaatttccctttgtctgaagatgttttcctcttgtctttgtttttggaattttattttttttctggatgctaaactctaagtgggctattattttctttcagcatgtttaatatatctatccatttgtgttctggctttaatgattgctattgagaagtcaatgctaatctaattgttatgactttgaagatagtcttctttttaaaaccactattacggtttctttcttttttcattttcagtgaattgggtttagatgtgttcttttctcttttataaatctgtttgacttcttgaagctatggctttattctttccatagttgtggaaaaaattgttgaaaattctctgcaaattttgcctcagctccattatcttatttctttccgggaccttctcactctgtgccctgtctttcactctcttctgtattttatatcctttagtgtgtgtgtgggcatgctaagtcattttagtcatgtctgactctttgtgaccctgtggattgtagcccactaggatcctctgtccatgacattctccaggcaagaatacaggagtgggttgccatgcccttctccaatcctttagtctaacttgtattatttggttatttttctggtctatctcccagttgtctgattatttcttcagctgtgactaattttctactaccattggcattgaattcttaatttgggatataatatttta

SEQ ID NO: 37823 - DNA, 1809 bp, Bovine  19866880461238
agggtgccctgtagcctctgtggtcagagcaaatctgatgtcacaggttttattgattttctgcgtaaaccagttataatgagcctctaatctctgctttgctatcctttaatcgccaacgccgtcctcccgagggaatccctggatccaaccggggctggaccccgacaggtttgaatgagtcagttctcctggcatggctttggaccatgagctgcttctgttcaagtttcctcagtgtgtgttcctcgggtttccttcagcccctaaatcataattacaacgtgatctgcacatatgatttactcccttactggaacaattccacttgagcacacattgttataaagtctggatcagcagaaccagttttctcatgcaagagcccacatttacaatatggcgctgactgctctttcagaagtctgtcttcattcagcattcttgtacccgcgtaatctcagggcagtgaactggcacatttcatgtaatgtgcaaatacaatatagtgaaggagtatagaaaagcagattttcatacagagctttgggcaattgtgatctgagaactgctcaagtaatcttagcaatctcatggggctccagctcacaaatcagagtttctcccataaacttgaaacctatcacaagttgactcttagaatcacttaatcctttctattcgcttatgtcaagacaaataggtgcttctttacaatgagcattttgcttagttcccagtggggcaaacagctgtgttcattgattcaagctcttgcctctgctctctcaaacttttttttcactcttcttaccgcaagtgagattgtggtatctgaagcctgtaactatgcacaaaagaataacaagcagggatctgtgttatccttaggacactgtccacaacttcagtaatttatttaactgggtttaatcaggaacacagtttacctttagttattcatttatgccaggttcaacagtttaaagaaaaatataatcacctaagttcaattaattatcttttttttggagacagatgagagatggcaccaaatgacaaacaatttgcctaaagcccatcatttctgttcttggcttatgaacatcaagtctctacattcttttttgacatgatcctaatcagatataacacccacttttccttaattatacaatgggacaagagaaattagagtattccaaatcaatgactaaagcaaaggcattcataaaaaagggaccctaattatattatagcaatttccaatgggagcattaaattacatatttcaaagaaaatctagaacaaacattaacattgtgatgtccagttcagtgggaaagcacttgaattggaaaatatggcctcagtgtctcaaagtttattagaagcccattttgcaacaccaagctgtatcatgctctgaggaaaaatagtaagcaagatcatatttgagactgacaaagggattagaaaaagcaggaggggaagataaaataaaattaagagaacattttataaatgttaactctcacagctgtagtacaatcctgaagcaaagttgaaagaaatgtaatgaaatgatggctggacttggttttggtccaagacagagtgattagtcttgcaaataatattttaaatatatttgctccagagcaaggggaaacagtacccaaagcactgcaagaaaaataagtttacttaagagcaagaatatttaaagttttaaccaggataaatgtctagtactaggaaaaagaataatacatttcatgagggctaattcacattcatcaaaaccac

SEQ ID NO: 37824 - DNA, 890 bp, Bovine  19866880518347
ctctgacgtcctaaggtatttggagaggccaggtcaacatcagcaattctgagtttcagagaaagtttatttctctaatggtttgtgtttagagaagatttcagcagaattactgcatcttgactttaccctgaacccttcattgatcatctgccttcttgctctcattctttccaccagttctgtttttacagactgatttagagagaagcaagtggtgaggcaaatcatcagtgtcaatgtattcatctactcaggctgctattaaaaaagcatagcctggggacttaaaacaacagacatttatttcccacagtgctggaggctgagaagtccaaggtcaatgtcctggctgattcctgttcctggtgggagccctcttcctggcttgcggttgatggtctcgctgtgttcttgcatgatggttagggagaggtgagttctctgatctcgtcttataagggcagcacgaatcccaccatgaggcttccgctcttgtggcctcagccgaacctagtgacttccaaaggccccaactccaaataccattacattgggggttagagcttcaatatatgaacttcagggggcacaaatattcagtccataacaggaaaaccttgattagttagaaattatcaaactaactctcaatgtgtcactgtaagagaaagagacaaatcacaaattaacttggctaaaaggtatcttgaatagcctgaagatgctcatccacccagcttcaggtatcgttttgtgtttggtatcaagccatcatgatcagtgggaacattgctcaaaacactgaaaaaaatcccaagattcaacagtcaatatgaagtatgttttctaaacacattcataaacccagacttaaccacaaaagtttt

SEQ ID NO: 37825 - DNA, 2429 bp, Bovine  19866880588771
cctgcttattaactcgtatgcagagtacatcatgagaaacgctgggctggaagaagcacaagctggaatcaacctcagtagcctccaaatgctttccttcccccacatccactcgcagacttctggtcattatgatgggacctttccgtcgtcccttccccctccccctctctctttctccctctccccctttccttctttctttcctttcttcctcaccctaacccttcctcccttcctctgtccctcactctgttagttcctctccctccctcactgcctcctccccctttcccttttctttctttttttcccctcccttccaaaaacaaggcatgcaactatttttaaaaaactttttattttgtattggagtatagctgattagcaatgttgttagtttcaggtgaacagggagcgggactcagccacgcgtatgcatatttccattctccccaaactcccctcccatccaggctgcacataacattgagcagcattcactgtgctatacagtcggtcctagttggtgatccatttcaaatatagcagtgtgttcatgtccatcccaactccctaactattcctttctcccatccttccccctgggcaaccattacttcgttttctaagtctgtgagtttcttcctgttttgttagtaagttcatttgtatcatttctttttatattctacatataagagatgtcatgcgatacttacatttcccaagaaccgcgaaattctaaatctgcccaagtcattaaggactgtcaaatctagctgcttcctaattgaggacaatgagcttcaggaaagtttagccactcaccccacacacatgattgagtgtgtttgtggtagaaaggaggcatctttcaagccccagaactctccacctgttcttttttttaatttatgctgttttctaggcttttccgcttgcagcattttagttattaacagtatctctaatgagtgataaagatttaaaaatttttatttctttgtaagttgattctagatactctatttttgctcactagattgcccatttctgatcagtgttgtggcaggaattcatgtcctcttggttctaggatttgatatttactgttgtagctgagaggcgcagtgtcacacatgaatttttaatgattttgtgaggaccattaagaagttagttggtttctgtgcaaagttcagcccagcaacaacagacccagtgcagccgaatcctgcactgtgggattgataccaaacatagaaacagagcagctctgactgctccagggcccaagggaatgcattctctctggatgtatgtaaaccacctgcaagtgacaggcagctcacaaggtccgcggaaggtggagctaagtcattgtctcaaggaggtgataagggcaaattttattttataacagtatatacttagtaattagaaatagttgtggaatgagacattgtgcttttgaaactataaatatctgctgatttcagtgtcagcaaacagttttctggcccaatcttagcaatggatgacttttgagttattttttccagtgtgattggtagttggtacattttactaagtttcgtttgcccgtatttgtgagctctgtcgggagagggctgggagaaggaaagagaaaggcagaaaagacaagggaggacatgactagaagatttttctttgtcactactgagcaaaataaaattcaaaattgcttcataattggattttacccaggttttatctagctagctaatactggcttcattaacaacatgctctaagctgaaagttcttaatctttttttttttttcctctaagccatgcaggatgggtgatggctgggctgtggaattttcccatcgtgtgccagggttatgagcaattctcagtggaagagctacagcaactccaccccttaaacctcccctgaagaatgcagttgggaatgcatgggagacagagtgatgccattatagaaaaaagcttggatctgctctaatttattatctagaaattcagctattcgtgaatgtcaatatttgagaaatgacttgtaagttgcaacatgccaggagttcagataacactggtgaggactattgcttgtagtagctaaattaggtagccagacttttgttccttgagaataccaggaatcttgcctctcttcttaacagcaatatcgtgtgtgtgtatatatgatatatcccaaaagtatagattacttgaaatgagaagtgtaactatctgctgtcaagattttaaggataaggaagtcaacaatcagtgtaaatgtctctggcagattaaagatagatacaaattctttgatgctcctcccctaaggaggtgggttcattatcctgccttcgaatctgagctgactcatacctgctttgagcgacagagt

SEQ ID NO: 37826 - DNA, 1155 bp, Bovine  19866880593896
tatttttaatgtttgtaaaatttaggtttttattattactttttccttattctgtatctggaatttttttggttgcactacatgtagaatcttagttccctgaccaagggttgaacctgcaccccctgccttggaagtgcagagtcttaacccctggaacatcagggaaacctctttattttgtaatctggcagcaactgccagatagaaagagccttcttaagttttgaattactcatcagccctcttccccacagtcatcagtgtgtgtattttctatggcttgctgccctgctctgtgacccagcccccactggagaaccctgtggaactgttggctgctgccggttcatctccctttcctgtttctcttgcaggagacagagcatgtggtatccagccagtcggagtgtcgagggaaaccgggaacaccggctcaggagagtgcacacaaccccacctccaggtgccaggaaactgtgcgagttcaaccaaggtgggccctttgttgtcagaagttgcaatgggcctggggttcctttcccaaacatgggagcacctgtgcttgctacccccacgcaagaggcaaggctttctctctttcattggcatcactatgaagtcagagaaactccgtaatggggcctagaaggagaatcattgagtctaagagaaatataaataacctactttctctcccttcagtcagaacataatcagccttaaggctcagagaagagtacagaccttcctgccctgagaaagagaaatgctggtatcattttgtcctctttctttccatgctagagatgattagcgtttcttctgtgatcatggtaattagtaataatagtgtaggcatcaagccaattgcttctcatatattctgtcatttagctctcgtcccttccctgatgcgacttagcagcagcagcagccttccccagaaagtggatactcttagcctcattttatggagaaggaccctgaggctgagacattaaggcacttgcctgatattgtacaagtgaaaaaggctgaaccagaatttgaacctacgaatgtctgattgcagcatagcaggtgtggcttctttgctgatccaagagatgtctctaagcccctgaagtggccctgggctggcctctctggtct

SEQ ID NO: 37827 - DNA, 3885 bp, Bovine  19866880617814
gttaaaaacctgcttttaagtttatgttcttaaagtagaggtgacttacaatgttgtgttaatttcttctgtacagcaaagtgattaacttatacatatatatatatatatatatatatatatatatacacattcctttcacattcttttccatcatatcataagatgttgaatgtagtttgctgtgctatacagtcggaccttgttgtttatctatcctatacaaaagtgttcgtgaatgcatgccatatgctcagtctagtctctttgcgactcctctgtccatggaattttctaggcaaaaatactggagtgagctgccatttcctcctccaggggatctccctggcccagggattgaatctgcgactcttgtgtcttctgaattgtacatgcattctttacccactgagctactagggaaatctggggtataagagtttacatttgttaacccaaaactgtggaaggaaagctatgacaaacctaaacagcatattaaaaagcagagacatcactttgccaaaaaaggtccatatatagtcaaagctatggtttttctagtagtcatgtatggagggatgtgagagtctgatcataaagaaggctgagagccaagaattgatgctttcaaattgtggtgtcggagaagactcttaagagtcccttggactgcaaggaggtcaagccaataaatcctaaaggaaatcaaccctgaatattcattggaagaactgatgctgaagctgaagctccagtaattgggccttctgatgcaaagagccaactcattggaaaagattctgatgctgggaaagactgaaggcaaaagggggtgacagaagatgagatggttagataacatctctgactcagtggacataaagctgagtaaactctgggagatagtgaaggacagaggagcctggagtgctacagtccgtgaggttgcaaagtcttggacgtgacttagtgaatgaacaacaacaaccccaaacccccaatccatccccttttacctcccccttggcaaccacaagtctgtattctaggtgagtatgtttctgtttcacagataacttcctttgtgtcatattttagattccatatgtaagtgacaccatatggtatttaagatgctgaatttcttcatttccattccatcagcattcttatgcacccatggggtggaggcaggatgggggctgaggagaccctcaatacatgactaccattctatgcagtataaataaagaaagctatttttagaatccatgattacccaactatgtaccagactctcaaaattctgtcaagacaagttaatttttttttgtaatctctatcatatccctttaaaaaacgaaaaagaaatcctaaaaacacactatcaagaagagtacgctgataatacacagatctctgctttagtacagtctaaaaaggcacattttatgttctttactattaaaaaactctgggtgctcattcccttactcattctttctccttttagcagagcccatttagactctgcctacttctacaaaaaaacatttgaacaagaaacaagtagctattaaaacacacacaagttgtctatctcaaaaacaaaagatgaaaggatttatcccccaaggaagttgctgccaacaaaacttcctccttccataaagcaacaaagctttttcttttatctgaaatgttacaaaaatagtcaaagccatcaaaggccattatccttgctaataccccaatcttcaagcccctctaactggggacttccagatgaagagtctaatgaactccagttcgcaaatgtaaccaccaacttaattggtagtaacacattgctatagaatagctcctgtttatacaggcaaggtctttaacgacattaaaaggcttaatgctgtcataaattttaatacaatattttaaacacaagtgagtttatcactctcaaaagtaaatttacttagctgggtaagaaatccacaacttcattagtattctcctacaaccataaattcccctttgtcatatctgagcatttacagaattggcactggctttagctataaaaatcaatcaaactgatgcatattcatcaactaactgctctaaacagactgatgtgtcttggttctattgcaagggaagccagggcttaagcaaattacagccttgctgggtgtcaaactaggaaatgagagggttgtattaagtgattactaaagcttcattcttgctctaactgaatgcagttctgtaactatgagttttaaaaagctccagatactaaggaacatgccagagtagggcaatatgcagccccaccactcagatgtactgaaaatccaaatgaaaatgtaaacacatcatctttcagaaggaagcattaaggtatttatcagccatcaccttattagggcttagctcctaaggatgagcagttgctgggaagaaaaggattgaagtaggcatttaaatcaaacagcctataagagctaggcaaagagcatacatagagatctgagtgggaattgtgggaaaacgaagagctgctcctcagttccaactaattattgccttgcaagaatgtacaccctgggttatcccatttttacatattacaaaagaatgcaaaaatccataaaacctctgatatttaaacattgaatcccgaattgatgcttttgaactgtggtgctggagaagacttgacagtcccttggagagcaaggagatcaaaccagtccatcctaaaggaaatcaaccctggatattctttggaaggactgatgctgaagctgaagatccaatactttggccactgatgcgaagagctgactcactggaaaagaccctcatgctgagaaagattgaaagcaggaggagaagagggcaacagaagatgagatggttggatggcatcaccagctcaatggatgtgagtttgagcaaactccaggagatagtgaaagacaggaaagcctggcatgctgcagtccatggggtcacaaagaattgaaccggatttagcaactgaacaacacaaatgtttaaaacagtctagaagccaattatatctccacattagatacacttgcaggacaccaaatttgagatctcagatgtgggacactataccactaaggaataaaatagaaagatggggggagatgctgaataggaggaaggatgcaaagaaagaggatagaatgggctaagtcaatatctgaagttggctctgttgagggcattcagaagaacaagcaaacttggaggcaggaagagattaagacggtgagtctaaaccttttgggtggtcatgggtagcatatgagattctcataaatgctttagggatttcccctggaaaaataaacctaaggagtaagaataaagctgcccaccaagatatctgtatgtttgttccttgttttcctccccttgttaccttacatggcaaaagggattctgtaggagtccttaagttaaggaacttgacatggagtgattacagtgagttatctcagtggatccaatctaatcacatgaatccttaaaatcagaacctctctcctgcccaaagctgtaacagagaatgacctgtcctcacaccggatctattcttttagctctgaactttgtgctctgtcatctgtgttcagtcatgcttgctctgcacctttttgtaaaagaatgtttcccacagcctgaaatataacatggtagcccattctcaaggctctgacctttaaaggtttaacacttttccattcacacacagagaaaaaagagaatgacctttgtcctgttgtaggtttataggaacattgtaattagacctacatagacagctgcaagaacaaacaatcc

SEQ ID NO: 37828 - DNA, 1923 bp, Bovine  19866880623291
tattttgaaaggccttatatccccaaaggaagagatgacaaaaaggcgagacattacagtgaatgttgatgatctttgtttaggaacatgacagtctcaagccctctgtggcttctgagatgcgatgatttatcttatttcctcagaccctgcgcctgtgcacaaagatgggcagaatgaggcagacagcacaccagaagacatgcagtctgttgagactagcaggctgctctatcacatcaccgacggcgacaacccactgctgtcaccacgatgctccatcttcagccaaagccagagattcaacttggaccccgaatcagccccttctccacccagcactcagcagtttatgatgtaaaaaaatcttgttcttatcttcacttcatacagtttttaaatactccatttataaactacagtaaagtgtgtgtccaaaatagagcaagcatgcctaccaaaagcagctgcgggccctgaaccatacatggcaaaaaatcagtgtgctttcgagttaagaatgccgtttgaagctttcttgtgtcagaaggaaatggtctcaagacacaagctgccctatggctcacaggtttgaatgttttttatgaaatgaccagaatcctaagaaatgtgcatatgtaaataccagaaatgccattcttggtgagctcacgaaagtattatttctgtgtccaggagtggcctcaatggatggattgtggcaatgcttggcaagtcgttcatctcaatttcttcttagattcttgaaaagtggtagcttataatagctccccctcaaagaataaagtgaaactatgtgtgttttttttaagttccattagtagttttgatgcatagttaaaatgagtcttcccttgactaaatgtatgtgctgggattcctacattctctttaatacctcctgctgtcactcatgaatttatccagaccttgttccatggactgtctactgatgaacttgagggagttagtgaattattactattttaaagtatgttaggtgagaaaataaacatattttctagagagggaatccatttcttttatgattcataaaggctctattatataaagaaaactactcatctgaatcctttttgaaaatattgttagtctgggctcaatccctgatgactcagatgtaaagaatccacctgccaacgcaggagatgtaagtttgatccctgaatcaggaagatcccctggaaaaggaaacggcaatccactccagtattcttgcctggaaaatcccatggacagaggagcctgaatggggtacagtccttggggctgcaaaggactgagcacaagcatgcatgcatgccatttattgaggataacgctgtctcattagtctgaagttggcgtcctccaagatttatgaaatgcatttcctagactaatactctgacctttgtagacaaaagtccttgataacatttgcctataacagagttctgtgaatcaggggtctccaatacccagcagatgctaccatagaagcctcatcaaatgaggaactggcctctgaactctgataatccagaaagctgggtttgtagacaagcagcagtgtttactggaagaccattgttttgttcttttaatttgttttttaattggaagaatattgctttacaatattgtattaatttccgctgtttaacaaggtgaaccagccataattgttttaagttatatcttttaaaaaacattttcttggagtatagttgatttacaaagttgtgttagtttcagatgtacagtaaagtgagtcagttatacatacacgtgtatccactctttttagattcttttcccatataggccattatacagtattaagtaggattccctatgctgtacagcaggaccgtattagttatctgttttatacgcgca

SEQ ID NO: 37829 - DNA, 1493 bp, Bovine  19866880688484
cctatgtagtcagcaatgttaaaatccatttgagtgcagtggttttctagtggttttgtttattcaaatattacagagcaattctcaaggccagaagtggttgttgagtcagagcttctaacgactgtaaatttgagctacataacatcatcgatgttacaatacaattcgagagagaattgggtgtttagaaaaatgagaggatttttagagatcctatgggcattttcctttagcttaggaagaatttcgggaaacaaaatgttaatcattataaaagtcacagctctaattctgctgagataaaaatcctagaaaaagagtcatcaggaaatttctgtggttatatttaagggaacactataaatcaggatttcagggaaggatttttgagctgtgtttgaggggaacagactggagatcctgtttgtcaataatgtaaatacataagtgaacagcaaaaaactcaaaactagaaagatacatctgtgaaggcaaacacaacctacaactgtggcaaactggttgtgactatatacctataggtctctactcacgatacagaatctattttcaatattccctgacatgacacttagggaaagctgtggagctgaatgcattctgaaattattctgctgtaatacatactaaacagaacaggacagaacacagaagagaaaggcattccatcaaagtggttcaaggtacagaaaagttttttctcatctattcctcccaagatttcttccttcaacaccaaatccttttatattttaactagtgacagcagaggggattctaagacatgtttctctgagagtcatttttaattgagctttcgttatttacaaatatagaataagggctagatgttgctttagtttttaagattaatctacttgtgtatcactggcaaataactattgggtttaaagacggaagaagtatgttcaatacatttgcttcatgtgtcatatgatgctgtactgtaaaattaacagttataatatatagccatcattcatatgagcaaacaatttaatgttttaagcaaaatattgaagaacctctccattctataatttaaaaaaataatctcagaaaacaatagcatacaagcactctgtcaaatccattgcttcctttacattcccaattttactatcttggtctgtaatatgttatatttttgcctggactataataatctcctaaaattctgtcttcctccattccactcatcctatgaaacatggaagattaacattataaaacactgctttgtaactgtcatatacctgccttaaaaacttcagtaactcaccattaaatctagaacaaaaaacaggtagccactgtaatttattgagcaagttctgatcaacaaagtgctttagtgtgttgatcttagtatcagtctgatgaaaaagggagataggaagactatacacaggtaatttcaataatcggtcaaaagacaagaacttaat

SEQ ID NO: 37830 - DNA, 1486 bp, Bovine  19866880711858
aaaaaggctgcacattccaggctttctattgacctttgagatgtaaaagtttctcatgagggaaagaaagcatccctgacttaaatgtggactcacaaaatacctgaggcttgtggaggaaacaaatgactctgggttcttttcaactcacagcacacagaaaagcagcaatctgagatttcagtgagtctcaaaagataatgtttgtaggtggagctggcagccaaaggtattcgtgaaatattagtgctgcaagtttaaaattttatttcccaggatttgaaaaaaaaataagcagccacagtttattaaatctgggctatcaatggaattttgaaatatctttcaatctgatggacttccctggtggttcagtggctaagactctgggctcacaatgagggggggcctgggttcattctctggtcagggcaccagaccctacatgccacaattaagagtttgcctgctgtactaaagatctcacatgccataatgaagattctgagtgctacaactaagaccctgagcagccaaaggaataatttttttaaattgccaatttgagggttttacccttgttttaatttggcagagagagatcaccaattgcacacattcataaagaattctagagaaatgaatgtcatgctgtaaaggagagggagcacaacagtgcagagatcatccgcttggaaggaagtcagacttctgtctgagctgacgattaaacacttaataattctgtcttcttgggagagtcatttaacaccatcactgttcctgaattagcacaactgactcctaatttgttttcctccttctgctcttaactgtcacgatcatgcgtgctaagctgcttcatttgagtccaactctgtatgaccctatggactgaggcttgccaggcttgtctgtccatgggattctccaagcaagaatagtggagtgagttgccatgccctcctttaggggactgtcctcacccagggatcaaacctgtgtctcttacttctcctgcattggcagacaggttctttacacttttgattaaagttaaatattaagtcctttctatgacccacaaggattgacctctctcaccttactcctgattagtacccactctccctctgctctggccacactggcttccttgttctttatgcataccaagcccagatccaccttggggctgtggacttgctatttcctctgcctgtaacttttacttggctggctccctcattacattttgttctcttctcaatatcctcccaataaccaggcttccctaaattatttatctaaaaaaagtaccccatgtcattcttgattaccttactttatttttctgctagctcttgtctctgtctgtagctgtatacatttacacggttgccagtctccccaactacactataaacttcacatgggcgtatttccagtcggttctgatcactctatcccagaagtcccaagcagt

SEQ ID NO: 37831 - DNA, 752 bp, Bovine  19866880731768
ttagctgtaatctgtggagaaggcaagggcaccccaggaactcttgcctggaaaatcccatggacggaggagcctggtaggctgcactccatggggtcgctaagagttggacacgactgagcttattcactttcacttttcagtttcatgcattggagaaggaaatggcaacccactccagtgttcttgcctggagaatcccagggacgggagacctggtgggctgccatctatgggttcgcacgtagtctgacacaactgaagcgacttagcagcagcagcagctgtaatctgaatggcacactggaacaagagctgagctgaggaaaaccttccatactctccactcctcatttttactttatttacttacttatcattatttttaaacatttatttatttacttgactattgtcgggtcttagttgcaatgtgcaggctctctagttggtcctgctggctacagagcactgagttggtttgctgtgttccacagagcttagttgcctctgccacatgtggggtattagttcactgaccagggatcgaaccacgtcctgcactggaagccagattccttttttttttttttttttttaagagctttttattgaatgtgttactaaagaagtttagtcaaaaagaccaaagcccatgtcatcatcagactcttcagattcttctttctttgcttctacttttttctcctcagctggggcagcagtggtggacaggataggtccaccagccc

SEQ ID NO: 37832 - DNA, 2838 bp, Bovine  19866880731960
atagatatgttaaggaagcagaagggccaaaagaaccgaacaatcgctgaggtgctgcactccatagtctagattacagtccatgagcctagactgagaaaagtcttcactgaatgaagcaaatgctcaaatatatgttttcttttggagttattgatatttctctgttatcatcatcatctaacactgatgatagaaaatagttccctgcagaaccactgttggttagttttaactcgttataggacccaggaccctcaaggccctggagacaacataatgagatgtattaggaagtttagcctgtattgcaccagaacccactgctactcccgatacactacctcactgaggtccagtgctcttaagtggagttgcttctgattgtcaacttgctattggcacaaattctgctgtttcctgtgatgcccatttctttgattacgtcctccagtcaccatcagactactatttcacactcaattttagaattacaccagagtataacccacgcttgtagttactcagttcaactcctgtttattgagcacatattatgagccaagtattgtggttagctgtttattaaatgtttctcctcgttcaacaattattccttgggcaccttaaggtaggatattttgcaagactttcaaagcactctctcacacacacacatacacacacacacacacactttctctctctctcttcttattcagtactgtctcaccctcctgccactcagagcctattattttattctaaccatgtttttatcccaggtctggtaagaatgtccatctccaaaagatcagctcctcccagtcaagaggtttgcgaccactcaaatttatggtcaacactgaaagttttgttcatcccttattccttctgaaaatatctctttttttcttgacaatttctatggaagctgttatattctcaagtgaaccaaccacactcttacctcagccaggactgaggagaacttggagatacaggcacctaagccaagttaggtcaaaaagtcccttccctatttggactcagaacctgagggactatcagacaatccttcctcaaaaactgaaattataaggtgtaaaacatagggactttcaacagttgtgtggggaaagtccacttgtggagaaagagaatgacactcaggtgcaaggaaaaccagatatgggagctgataaaagaacattctggcaacatcaggattcaggggttctctacttggaggtcttactggatccctgccctttcctttttcctcatttttctacccttctattggcaaattccactttttgcttaagatagctcaagatagtttatgaaaagaatccatcgttagtatatatttgtttcctacacatgcagaccaggaaatgaacccaaccaatgttcatccagatcatgaacctaattttataggttaaaattaaaaacaacagtaatagttattatttactggacccctgccatgtggtagtattttaatacatgatttgtaatgcaataggcatccaagatacatgttcctacctccaatttatagagtttacagataagcaattaaaccccaaagaggttcattatccataagtcataagggaaatttggggaaattaagaagcctcaagagttttcatgggtgatttttctctgttggtttatgtgaaatgatgaagatctatgatgagatctggaaaagtcaagtgatttttcacaagagcacataaaattcaccataaaaactctaggtacactaacatttaaaaaattattaactctacatcaaggtataaatttacacctattacatttcaaaacacaacaaaacaaaattttgcatgaacacagacagtgttatgggggaaatgttaccctcagacattgctcgttgctgtagaaactggtaaaagcttttctggagagccatttggaaaaacattttaatagccattatgcgatcatctcttttgacccatgcaattttacttctggaaaaaccatcttaggaaataacccgaaaccctattcatcaagatttttaccaaacctaaatttataacaaaacaaattggacacctctgaaatgtgaaaaatcaagatttgtttaaggatgaaattgtggattgattaaactcatttaatcagtgaacaatgaaatgttcattgcatgccagatgctatgctagacacagagggaaagcagatgcatggtcctgccgtgtgtgaacactgttaatttgtgtgaacagaaagagaactagaatgaaaaatatttttatatttttaaaactttttttcttcctcaaagaatgagaagaggcttataaaatagaaaaaacaaggaaaaattcattttgagatagaaaatcaagttcaggaagaaagtgtatagatactacttggttattaaagttgacgctcaaatttgtttctgagcttccagacaggcaaaggagatgaagtattaagagtgactgatttaagttgttagtgaaaagaaaacacaggagtttctcaagacaaatcagttattcttcaaattttaatctaaaaaatatcattttgtaaatgtccaatgtgtgatattattggcatttgttggggtttagaaaattcttagaaataaaatatttcaagcatttggaagtgtatataaaacaatataatgagcatatgtgtatcctacacatagcttaagaattaaaatattataattaacacctttttgtacctttctacaattctgtttcttggtatctctacccagaattaatcattctccgaatttagtgtctctcatcttcaatttaa

SEQ ID NO: 37833 - DNA, 1210 bp, Bovine  19866880746135
tatgattataagaaaacttgctcaagaaaagaactgggcatgtccgaaagcagtcaaggtgctacaaaatgagaagaaaagtaagacaggtcactagagaggtaaagaatgcagaagattgggaattcccgtgggggacagagaggacaagcagaaccatctaagacatcagtcatagttaataggagaaaataaggggcaagccagaaattgtctgtcatccaatgaagtaagtcagcaaaaagctggaaagcccttacgttgtgattttatgcctgaacagatatgaaagtcgatattggggaggacactcgcaccctgactaaatgaaaatagcctacttgacattaattgttataattaaattcactgtgtcagaggaaatatcagtcatttttttgaataggggtttctgtaaaaaacagttgacttaactttttttttttttttttacttttaaagtaaatgcttggtattatatagacagaattatataggttttatagaaataatttcctgacttttctactccacctcctcaaaaagtaatatttaaatgtcactctcttaaccacaaaaaccaggccaaccacattctgattttgtcatggttaccatcagagtccaatgcacagtttggtcctgcatcacatccacagaggaaataagtccagagatgtttcggaatttatccagaaacaagacttgaactaatgttcccacagtaggttcttgttatcaactagtcttttattcctccaagccaagcaaataaatgcttaaggatattagataatagtaaggatttggattattctgtgaaaatctttttaatataaataataaatgcagctgaagacaaccttattataaatgtgcttcatgtaggggatagtgattcatagctcatttgtgtcatgactcatagctcttggaaaagaacaagattccaagaaaataaagatttttattcagatctggtcagttacttaaccactttcatctccatctttttgaaaaacagcaacaacaaaaatactgcagccaggtagagtgcttataaaaacaacaatataaaaatcttcattacgtgaatcacatgataatagaatttctctgctgtattaataaaatatgagaaatttgataatagctatttcggaaagaatagctatcgagagaggactttaaaaagtaagaattaggagag

SEQ ID NO: 37834 - DNA, 1615 bp, Bovine  19866880813017
actcaagttcttccaaatctgactcaagaggttatgtaatccctctaaacttttgtttttccatttgtaaaaaaagataatcataaccatttcatgaggttgtcataaaaatggtacatgcctggaacatagaaaatgcttaaataggtgttagctgattttattaataatatcatttattgatgctcagttcttgatctgtactcaatgttaaatgtatctctccaaagtaaatgtgaagaatgaaatctgtttcacgtttctctaaaatatggaagacctaaaattatattactgaagttttcttcgttattaggggggaaaaaaatctcattgtgtacacagagatcttaggaatgaattggaaattctacctgcagtccaggattccaacgctgtattatcagagaagactacacaagtctctctttctcctagagtcttcctgtgggtgagcaacaaacttggaatgacgtgccgttagcaccttattacaaacgacaattgggtaatttctaccaggccagactataggatgacaagaaagagggcattcaaggagagatggctgggtactcaaagcccacagtgttgaaggtgatccttagtaggagattcaaggtcggaggttacccagaaccagactctgccggcagccctttgagcgcctgtgtcctccgcggcaccacacgcctaaacaaacaagtggtgtgtgtgcccagcagtgggcagggtctcaagttcaccgtaactccaatggtatctcacgcttaaccttgccctacaactcaactcaaattcagaaaatcaccacagtttcatgaatgcagagggcatttcatctcaccgcaaaactgactaaataagaggtcacaatgccaaaaaagaaaagagataaaaatcacaaggccaataagaaaagtacaagatcaaatgaagtgccccgccaaagttgttctaacagagatcacctggagcctatttgctaggtaggactggacttcaagttattgtatacttaatgtattacactgagagcctcccacatcatattcaatgtcaatagcttagtgttaaaaaaaaacaaaggtcacattaatgaagcacttatgtctccaaaactgcgttaggcgcattacaagtacaatcttaaggctgggcccactaacctcccagtaagattaaaatgggttatattcatctctttttataagagagaataagttatttgaggggttttaagagttttaaaaatcatatttttttgctacctccctttacaactagaaaaatgaactaaataaacaaatatgtgtatgtagataaaacaaattacttgaatcaagttggacagatgcttcattcataaatgtaaatatttgctgacctcaaagaaccagattctccacacatattaaaacagccacatacattgcttcagtgtttttccaaagccactaaactgcagcctaagaagaatggctctagataaccctgggacttttgatctactgagaagagtctccaagtttggggccattgtttcctgtcctgggtaagtgaagatcctggagatcctcctccactctccctggcaaagacagcagcagctcct

SEQ ID NO: 37835 - DNA, 856 bp, Bovine  19866880816695
tttgaatgcctgacttatctttgtctggtgtttgtgggaggtgtctgtgaaccctgaataagaaacaccatctgtagttcatttctttggcataagggtccatttagagagatttttggcatttaaaaccaaactgttgtgctgccctctggctgcttctgacaaaaaaaaaaaaaatctaacagaagaaactggtaccatgctcccctgcaggtctttctccatgtggaatttcgtggttgtcctacagcctagctgaaattctactcctcttatcagattggcatgtcttatttctcagacagggctgcaaacacatttgaaataaattagggagatcctgctttctgttaaagacctttgtatgtgcacacttgtaattttccagccagtaagcttgagagaattttctaacagttcagatatactattattttccattttcacttctctcttttttttgatgcctgcaggttgggaaaggctcaggggacatgccactttatttgctccacattttgtcaaaggtggaaggtttttaatggttcctccctgcaagcttccagagggggataaatgactcatgcagtgacacttatcatctaattaagacaaaacatcacatctttccaattaattcacttcagattcagaagacccaaatgtaatctatactgagggcacatctttatcaagcccacacagacagcagaaaagagataccctctttcatcattcaaacagcaataccattcctcctttttcaagatgacagtctatcaaatttacaaaattttaacaataattgtaccttagattcatagaggatcacttaggaaagtctcttgctgaagaa

SEQ ID NO: 37836 - DNA, 2293 bp, Bovine  19866880882946
gaaactctgcctggagcccccaccccaatgcagcatccagcacttggctgtcctttgactctactctgtcatttaccctgtcaaagacaaagcttactcagccccacacctaaatctctactgatcatcaggtctatgttggtttcaaatagaaacaaaagcaaaaattcttacagcagtgataaccatggcaaaagttagtttcttgattttctataaatgcttgcagaaaaaatgcagaagaggatcactgtctataataaaaaatttaaaagatgattacatccatttatctgtttttttaatgaaaagagaacgtgctataagaaagtatatcaaacaatgcgaaaaataaataaacatgcctaccatgctaatgcacctaagtgacttgaaagttatagaaaagtcagcatctctctccaaagaatcaaaagtttaccaaacaagagagcagaataattggaccatctcaggacagcatgactttcattttcctaaagccccctggagtgtagaagaaggaaaatgaaggaatgaatggttgcaagctccctcttcacttgtgacatctgggcgctgtccccactggcggtggcaacactattaatcccaccctttgatgtggcaagtgcccaaaacctgttggctggtttctggccagagaaggagcaatttcaccctgacggctccagagagggcaaacacacacactgccagatagaagagggaagaatcttttcccatctctcccactgtcccagatggccaagtctgggtgcactgcctctagagcatcacttcaccacccataatgccgtcctgctgctgcagagcagtgcagggaaagacctggaaaaagcagcttcaagaatctccaggcaggggcttccctggtggctcagatggtaaagaatccacctgccaatgtaggagacctgggtttgatccctgggtcgagaagattcccctggaggaggaaatggcaacccactacagaattgttgtctggagaatttcatggacagaggagcctggcgcactacagtccatggggtcacaatgactgagtgactttctttcttttctttcttggctgtattccttcccagcacctcccctggctgagttcaccctccgtttctgtatccccttccagcatgttgactttggaagccatgggtaaagggacaggaggggagatacatatgcccgtgagtctccacccagagaaggctgcctcccaacaggaagctgcgtggggcttcctgtgagtggaaaataaacacgtgtggggcttggatatcatacttgacctaaccctctggtcagggatcccatgccagccctgaaagtctattaagagttgctcaagcttctgggattgggggctgggtgccagagatttccttccaaaaggtagtttgaatggttaacctaaaacaataaaaagccagtcattttatcagcaaaaaggaattattcaggacaggcaaagaacttcaatttggaacatgcagtttatgactaaccacatgcaagtttggcgaaggaaaaactctttcttagagagaaggggaagcgggagggctgttctaaacaaagagtccattggaggaaactgggagttggaagtgtggtggcttttcattggctgtgctgtgctggtctctcattggctgagctgttgccaggtggggagaaaatcttcctttctctgctgggcagttaagtagtaactttcttcctgatggagactcaaggtaggtctctacctgttgggatctgtatctacattgagtggtatgtgcatgagagctccattttattgaggtttccctttattaattttcacagatcatgttgttcttttgctttaaaaatctagcaatgctgagaaaccattacaaaaacattaataacatgggagacatgctcattgtaaagttcagtgaaaaatgcaagacatctttaaagaataaaagaattctgtataaaagaactctgtgagggcagaggactaggtgggaggcaggttgttcagtcgctcagtcgtgtctgaatctgcaaccccatgggctgcagcacgcaggcttctctgtccactatctcctggagcttactcaaacccaagtccattgagtcagtgatgccatccaaccatttcatcctctgtcgtccccttctcctcctgccttccatctttcccagcatcagggtcctttccaatgagtcagctcttcacaccaggtgctaatgtatggagcctcagcttcagcaacagtccttccaa

SEQ ID NO: 37837 - DNA, 928 bp, Bovine  19866880966208
ctgtttttcagtaatgaaaacatatggttttcatcatgtaaggtatttttgatccttagtacaaaaagctgaggggaggagggggtcacaatttaaaaatcctatattaccattataaataatgataatgagttgacctactgttcctgtatctaaacttagctgatagttatatgatcagaacatcaatgtatgagattcatgtttggtacaacttcatgagcaaatggccgaaatttctctatgttacttaggaagctagatatactcaagatacactaataaccatattttctaaataagagaataaaaacaggatatagttgcagccaatgggtttcttaacagcctagagcaaaagtaaacaatacattgcaattttcattagtatttcataaagcacaactaaattgtcctttgctttacacagtactttatgtttttaaaccttggttacatctgaaacctcaaatcaaattattctcacccataattacctctgagtcatgagataatagagaaatgtaaaaaaaaaatagggacaactccactgggatcctgtatatttaattatgcagtatctattaaataaagactcatagttctttaatggcatttaaaaatatataagcactatacacctctgagcaatgtgccctttggggttttgatcccaagtaggtcatcccaagggggctttatctacatatggccaaagacccacctgcttgcataggacattatctagcaggctctcttaatgattcaaataggtcactgcacaattgatttgtatgcggcacattcaaatagactgaataaatttgccagttccattatgtttgttcatttttcaactgccaaaagcttgcacaatatgtgcatatttaaaaagtggcaaataacagtttaggacacacttgcccca

SEQ ID NO: 37838 - DNA, 1124 bp, Bovine  19866880973138
tgaccctgaactctaaaaatagacttaattccctcaccatatttatacttttaggaatgactcatacatttaggaaattctattttttcaaaagttgtttctgcctaatccttaggtaatcagaaaatctgattagcatgaacattttattattgttaagtattttagttaatgttttccttttatcttttgtcctttagcctggaccacagttgtgtagaagtctgtcatattcaagggtatttcagaacatagcattcggcctatgaaaaaagtaggtcaacatcaagataaattctctttagtttatagcaacataacgagtttaaaccaagctaacaatcctattgcatcattctataatcatgagctattgtagaggaagagacttgatctataaatacacaggtaatttttttctgaaccctaaatcagggtatatggtaatacctttggggagaatgatcaattatttaaaatgttggtctctgctagaaaattcaggatcaagagtcattgtatccaccattattcttttccactgacttggaaaatttcagagattgtgaagaaattgtcaaatccattcattcattcatttaaagttcagcctttccagatgccctgttcaaatacagcagaaagtctttaggtttgtgttgcttgatttctgcttgagacgtgctaagcacttttcttaaatggaaaatgggcctgttctcacatgtcactcttgtggagaagcgtgttttcctattctggtagatgcagcacttatgtctgggtttcaggccttgtcccaaatgaagtttttgaccagtctagaatctttaattaacaaaagcaaaaagcttttttgcctctgatttatgttaaggtcaactggtggaaataagttctctaggccaatttattggagaaggaaatggcaacccactccagtgttcttgcctggagaattccagggacggaggagcctggtaggttgccgtctatggggtcgcacagagttggacacgactaaagtgacttagtagcagcagcagcagcagcaggccgatttatgagtgccctagaatatccatagttattcattttgaaacacggaacaaataagataacag

SEQ ID NO: 37839 - DNA, 1064 bp, Bovine  19866880977939
atgtaggcttcctgacagaatcaggctcttttttgttctgggtgctgacagcagcacatctggtcaacaatgctgactttttcaaaaagaaataaaacaattaaaattttttgcaagttacatgccaggaatctcttaccccattatagaaagtttctcaaattccaaaagcagaaaatgtgatgttctgctttctgtccatagatatcctggatctcaggtcagttgtatgggatcatgtggaaagactcaactcacagaacttgaaatttcacaccaataagggaggcaaagatacagagcaggatgtgtgttgcgtgctgttggatcgcctgtcatcagcaatacttgaggggattagaaacacaccagaagtttttgttctgagaagccgtgatctttaatggaaaaactgacaaaccataactgaaaattctagaaactgccaccctaatcagaatagacagaattggtatagaaccttccagaaagccccatctgtgagcctggcagaattggctacagaagccttcggttttccaacaaattttttagataccccatgggactgtatctgaccatagtcatctttttattaaagtgtggtttgcatgaaaacacttccctctgtagctcagacggtaaagcgtctgcctgcaatgcaggagacctaggttcgatccctgggtcgggaacatcctctgaagaaggaaatggcaacccactccagtgctgttgcttgaaaaatcccatggatggagtagcctattaggctatcgtccatggggccacaaagagttagacatgactgagcgacttctctatctattgcatgaaaacatgcctctcaacatccctagaatcagtgcagagcaaaaacaaaccaaacatctcagtacctgccaggaagagttttgtctttcccaaaagattctcagaaccaagcaattcagggactaggcttttaaaacaaatggaaaaaaaaaaagttgtggctgtctggaagttctcactgggtactttggaaaaatttctacgtagctctttggctctgaatgtatttt

SEQ ID NO: 37840 - DNA, 1747 bp, Bovine  19866880994734
tctgttctcttggccttctctagtttcccctcggtgctttggaattgtgaacgtctctccctacttgcttctgcctgagaatggatgcaatcccaagtccaggcctcctgatctctggtcttgttttgtatctcatcctggctccaactctccccaaacctcagcctcaggcttcaagccagggacacttccattctctcagccagacaggcttcccaagggaagggaatatttttctttgttgcctctgaaggcccccacagagctcttctaattttgcctccctccactgttgatttcatctcaatttgttgtcagcaccaaggacacgtttctctactttgagctttggcagcactgttagctaaactccacaagccacattcgggtctcacttaagtcacttttcttttccttcagattgtagtaagttttcagttagtttcttcctaacttatttcacatctttctcagctttctttgaccacttctgtgccaatatacactgtggattatttactgaaagttacttaagtccaatcctaaattgagggccctactgttgagtgaatgattagtacagtaagaaagcttctgttttccatttgcttcaattatagggtcatttctctggttcactgcatcaggaaggtactttggagtcaattattttgatctattcattctggaaataagagataatattctttaagaggaaggatggcctgagagaatttatgacaaaagcttggcactttaagcacagataggttctaattctgttgctaactcacgacaggacttcaaaaataccgttcagaggtatgctgcctattaagtaaggatgaaatgcctctcaggtttcagctgaggaataaatcgctaaatcacttttctaacatattgtgttttgcagatcatccactgtcaggaacctgagctaaagagcagagaaatggctctctggacatcatcacacatcactcataggtgagtcaactcttctaggcaacagaactcactcatggaacctagaaaaaaaagtttttaactaaaacataaatgagtcaattctttctgccaatggaatttacacatagaaactaaaaaaaaagtttatctaaaatgtgttagctaaactttagtttagcataatttatgatgttgcaaagctgggttactttagtctggaatccacaggtcaaaagaacttaaggacgtttctccttgtatcactgagtgacattctaacctaatgaaatgatttaatacctatcttcctagtatcttgtaagttccatcagagtagagtcagtatcctgttgtgttccatccacatatgttaaataactaagaagtaaaaaaaaaagatttttaattaaacagccaaaatattatttaaaagtgaacctgatatcaggattttgttttgtcagggattccaaaatactcaggagttgaacattaaatcccacttgtcacacgttactggcacagttcacaattaccatttggtgtgtgctagcaggcagaatttttagaggaggttgatctaatttttagcgatatggaaggtttctaggtttctttgttgagggtatttttttttttttttttttttttggtgttaagtgttctaagtggaatttatttagcctacaaatgttgaacccgaggcataaaaacaaataaaagactatttacataggctaattagattggaggtctaaatgggttagcatcacag

SEQ ID NO: 37841 - DNA, 1871 bp, Bovine  19866881007958
actgctgttgtgtcttgcccgctcagctctgtcgaggtgatggagtattattgctccatgatcttttgcttctgacttgtaagattccctatccaataaaccaagaatgttgttatcactgtctctgtgttcttttttcacttttgtggctgggtaattatgaggctctgcttcagagtacagctcaatactatgcaagcttagcaagttatttatactttctggccttcagtttcctcatctgcaaagtaaggattataaaacatgtttcaatggatcaaattagataagacatggaaattcctttgtaaactatagaaccctgtgtgatacaggatgtaggggcagaaacgctaaagagagcctagcatgtgtggaactgacagaagaaagacaatttgcttataatgagaaataaacagtcaaaaaacaaagattaatttggtcttcagtgtttggcatagaattttcaacttaaagcagaagtttcactattcattagagtattgacaatattcatatataacagctatgatcaggtacattttaaaaatcgggttcctactgcagtgatactaaatgctttgcctatgttatttataatcctcaaaataaccccacaaaatcttattatcatttgacaaatgaggatgcacctcaggtatcttatcatttaaaggttgttgctgctgctgctgctaagtcgcttcagttgcgtccaactctgtgtgaccccatagacggcaagcccaccaggctcccccgtccctgggattctccaggcaagaacactggagtgggttgccagttccctctccaatgcatgaaagtgaaaagtgaaagtgaagtcgctcagtcatgtctgactctttgcaaccccatggactgcaccctaccaggctcctccacccatttaaaggttacctagtgcataaagagcagaatcaagatttgaactcaggtctttctgactgactcctgtcccctttgcatatgtgaggacacaagaatggcaactcagttctggtttggtcaacagtgactctaacgccttattttgtaagctaagttgtcagctcttagaagagcaaaatgtctcttaagccaaatcatgcaagctaggtgaaaatatgacctgcagatggacccagccctggagtttgctgaggccaaggtttacaggatagagctgacctcgatcggttaatcctcccattaggaggattttctccatctcattctcatgagttgcactagcaaataaaacaaaataagaggttgtttggcagcagttcaaatatgcccctttcaggtgtacttgtgttttaacagggaatttgtcaatctagaaatacattcaggacccaaacgtgaatcacctattcttcaattttagaaaccatggtcagaagctgtggaagatattttaggacaaaacacgtttattcagagcctctggaactacaatcctgaaatgtacaggaaaatgcacaatgtatttctattaatatgttttattagaaggaaaaaggcaagaaagatgagaaacgtttcagtactgagcagtcaggtttcagtgaaagcaagggtgtcatcaccccaatttaagatataagagtagtcacaggagtctgaagccagtggtggtctaaacacaactcaaacagtgcttgatactcaagagttaaccattcaatctctctctccacaagctgcttcttcctgttctgctgccagctaccttccttgactctctctacttgtactggtgaccttctctttctgagatttcctacttggtactacttcagtttctgcttactctcactgtaaattccattcaaaatttccaaaatatgatcagattgatt

SEQ ID NO: 37842 - DNA, 754 bp, Bovine  19866881074860
ctcctctgtccatgggaatctctaggcaagaatactggagtgggtggccattcccttctccaaggaatcttctcaacccatggatccatgtctcctgccttgcaggtggattcttaaccagctgagcagccagggaagcctgatatactcaagtatatccagtgacaatagtttctgtctaccttcagagttttgttgttctgtgccagtggaactaaacaggaattgaactgaagctactaagagctctctctggacatagctgaggctgtgtcgaaggtgggtcaattaagctcaaaggtcaaagctagactttatctcattactggaatagtcactgctttgctggctcagaaataacttcttctgtggtaacctgcaatggcagtcctacatcaaggccgaatgttcacttttctatgaactaatctccaagacattctctcaccttcctcaaatgcctttgaggcaggtggctcagattttccctctgccaccatcatcccattcatcttcataataaaatttgataactcttccaactctctcgtctaaaccatctaaattgtaatccccaatttagagatcaaaaccacttaaaactgtttcagatcctgaacctcaaactcaagcacgtgaaatgaagaggtgtcattcatattgagatgcaaagaatgagtaaaatcagaggcaaatggaagaacaattgaaggaaaggaatctgcatctccaaaggatcaactataaatagaag

SEQ ID NO: 37843 - DNA, 1160 bp, Bovine  19866881079571
tgctcagattaatattctgtgacaaattgctgcctgggttgggggagagattttttgacattagattgcatcctttattgttttgggcttccctggcagctcagatggtaaagaatccacctgcaatgcaggaaactcaggtttgatccctgggttgggaagatcccctggagaaggaaatggctacccactccatccagtattcttgcctggagaattccatggacagaggagactggcaggctatggtccatggggtcgcaaacagatggacacaactgagcgatttctctttattattttaatttacttaagagcacaagtataacactaaaaaaaagggaagaaggaggctctttgaaataaaagtggcagcagttgaaaacatattggagagatttccctggtagtccagtggttaaaaatccaccctgcaatgcaggggacgcaggtttgatccgtggtcggggaactaagatcccacatgctgtggagcaactaagcccgtgtaccacaactcctgagcccgtgtaccacaactcctgagcccgtataccacaactcctgagcccgtgtaccacaactatggagcccgcgcaccacaactagagaatccttgtgcagtgaaaagtcacgcatgatgcagcaaagatcctgcgtgccacaactgagaatggtgcagccaatatttaaaaaaaacatattggaggaaaacacatctaatatttaaagaaaactatgcaaaaagtttaaaagttttaagacagaaattcatttttctaaaaccagtagatatcatttaagcttagcattcataaactattttagggcaaagataaggtcttaactatagatttcactcccttctgcctctactgtgcaggtggaagacacaccacacaggtgatttttgtagaatgcaagagtcagatgaagatgtacttgttctgctttttttccctcataactgatgcctgtcccattgggagtctttgtgtctgaaatgctgagaactgttctcagtctctgaccattcctcttagttcttttaattactgcttgatcttccagaacctgaattttaatgagctagctaaaaatagacttgtcactgtaagcacctcttcacatctgcttgctttctgagtccctgcaaggtt

SEQ ID NO: 37844 - DNA, 795 bp, Bovine  19866881101950
acctctggtcttcttcctctgaaatctaaaccttctgatccttctacttctatgagatccttgcctcaagagccctctattttcacatctgatggggagtgtgtgctgctagccttggttattaaggctgcccttgccctgtggaaagccatggtcagcactgttcatttccactcggcatcaggggagaaattcctgaaaggctctctggtcttattagaccaatgagtctgcgtgctcatggtaactcatcacatttctcttagaactaaagctgaagctgtcggaagagcaagggagtgctcccaaaggcccacctaggatcccgccctgtgagcaacccacagtcccaagagagaatgggaagccagaggccgtgggccctgagccgagctcctcgggagaggagactccagatgctgtgctgagctgcctgaaggagaaaagagagcagcttccttcccaggaggatcctaaggtacctcaccagccttcacagggccccagcactccacatggtgccagtaagaccatggttttgaccagtttgtacacataaacatctttgtgagactggctctgaaatttcagtcagatgagttcctagtgggctgttagctatgacctacagtattgccacatggttcttgggtgttgccattctgaaggttatagtgttgcatgttgatgacagaaaaatgggaaagacgctagcgtatatcatatcttgttctcccttacgttcccctgataagttagcaaatgaacccaatactaggattatagcctcatttt

SEQ ID NO: 37845 - DNA, 2511 bp, Bovine  19866881147368
gtagggtgatccaccactgcaggggttaataatcagctgcctgttgctctggctaagccatgagaaaaacaccatgggaaaagaataaaagcaaaatatagcagtacagtataatctaaaccaaaatatatcaggttattaattggggtcgtcatgccctgctaagctaaggaaaacatagtatggaccttggaacaccggatcagcaccaggttcagaacactgcttgtgcacacaccaagatgttttcccaaggcatatgtgggtatatgacccccagctgggtgataccccttgtacaagaaaatagcagatagttcaaagtaatgaataaaatgagagaagtgtcatagcaaaacagatactttctgcatgccaagatactaaataaaagtgatgtggctccaaggaacagggctcttgatccaagaggtcttgagttccctggtcccatctttaaaaccttaattctgtctctagtttctttttcccaaactgtgtgttgaccactttcaatccctacctgctgcgctggccgcagcataccgtcttagttcaccagggactaggggacttccaggagcacagactctgagtgctaaagccatgacagttggttgctcttcattcatgttagggtcagcaagaacccctaggatttttcttcattccagtgcattccactcatgccaagctgtgctactcacacaccatccagtcatgcaaatgaattctgactgtgagccttttattttgactcccacttcagttattactgctgtaaccccagcacccatttccttagaatggttgctgttattcactgacctggtctgcttaaatcagatgggattattttcactagctgctgcctcccagccagaggggatgtaaagcttcctggcttatttagaatgtaaccctgtctctttcagctgctaactgtctgaactggtcaccagataggctgctgtcaacctgggataaagatgccagacatgaagagtgatgcatttcactgtttgaaaacttcttggttacaaaggagtaactgcaactggccccactgaagttttgactagttgtttttcattaagtctttcaatcccttacctaattagcttctcagaagcatgtgtctttttttgtcgttgttttggtcgcttcgcgtcttagtcgtggcatgcagaatctagtttcctggaaagtgaaagtgttagtcactcagttgtgtccaactctttgcagccccatggactgtagccctagttctctgactaaggatcaaatccatggccccctgcgttgggagcatcaagtcttagccccctggaccaccaggagggaagtcccagaagcatgtgtcttgtgggcagtactacccaatattcccttagaaacctgaagatgccctatgagtgcatgagcctttaaagtgcagtcattcccatttaaaattccccattagaagtaaagctgagcattagtgacaggcacagcccctacttttaagagatggtgcagtctaattagggaactgtgctcacacacacacacaaacacacacacacacatacacccctgcaagccccagggattacagatgtcaggagctgttagtacagaaacccatttctgactgaggaggaggggaaccaggtgtgagttcaagcaccagagtctctgccatctgcagctgtttccttcccaactgacctcctgactgtctcctacacctcaggaaggcatctgggtgccctgggattgtcccttatggaggagaggctgactcaggtctggaaggtgtgtgcaacaacccccccgcctcaatcttctcttctctgttcacatccacccgcgcaggtctggcagaggtgcctgccagagcccccacgatctctgattattctaacaggatccgtccctgaacagatggccacctcagtcacagtggacttcatatctggccaagatagggcattatatatctaatgagcaatctagcaaatgaagttgaacaggcatgcctcgttcttcatttaatcatcccagctgttggctcctaggccatggactggtgggcaggctgaattgggcctgagtataaaggtgcaggcatgggaagagcctctcagagaccaacaggacaccagatggagttagatagcattacatacatttagagtatgaacctcttatgaacaaagagctggctggccaacttgcaccagagtgatgccattatagaggcaatgtttaggaaatagcaatttccatgctgatgagagcagtgtttgttcatttttattgtctgctgcagtcattctctttttttatttttaatttaactggaatatagttgatctacagtgttatattagtttcatgttacagcaaagtgattcagttatacatacattcatcctattttagactctcttctcatgtaggttatcaccgaatattgagtagagctccctgtgctgtacagtagggccttatctgtctcat

SEQ ID NO: 37846 - DNA, 2771 bp, Bovine  19866881156301
tcagctttcttcacagtccaactctcacatccatacatgaccactggaaaaaccataaccttgactagatggacctttgttggcaaagtaatgtctctgcttttgaatatgctatctaggttggtcataactttctttccaaggagcaagcgtcttttaatttcatggctgcagttaccatctgcagtgattttggagcccccccctaaataaaatctgacactgtttccactgtttcccatctatttgccatgaagtgatgggactatgcatccttccattttaaataccctacttctttatttcagttaatcacataggtccttggaattatcttctatttttagtggaagcaattttacctcatattctctttttaaatcaaacttccattttcatcatttaacggttgactttgtcctttacatgactgagttcaatattcacttatatctttgtcatcatcatttaataaatactcaagtgaacaaactaatgcagtgatcttagcttcaggctagtctgaattggctgtcatgtgaactcaggtaaatgtttgtgacttccattccctttgactttctcctgcagtattttctgggttcttggactcatgtgggtgaagtctctgagggcaaggcctccacaatgatgtccaaatttgccttggatggttgatgatagagatagaagcactactcacagacaagacagcagagtgttctcaaacgtttgtcctgcactgagttatgaataaccacatactatttagcccaaggttgtacatgttgaggggcacagcagaagaaacatttatgtccctcttgttaccaccacctttaataattgatttccctgagagaaatcactggtctggacagaaaaagtattcctctcattctccctatctaggacacaatgttgtgagccagatagattcaatgtttattaatcattctctatgatctctactgccttccaaagttataacccttaagatctcagcacctcatcccaactctgagttcaagttttctctagggtctaagattgaggatacccttttgactaggtccctaatcaaaacattgcctttggtggatcacagtccatgatatctctagtaaacaataattcccatcttcaagaaatgttaactttgtttggtttttaatctaaattcttgggttgtacatggtttggattcatgacaactctaccaaaacaactagcaatttcaactttctattactagctaatagctatccatccctcatctgaaaatgcttcttaattataaaagttgtgtttagatcttagcaccttataggttcgtcacattatgtataaaaatgaggttttaaaatcccattgtaagtcttgaaaccataaaactcttagaagaaaacgtaggcagaatactctttgacataaacatcgtaatattttttagaactctgctgtaaagcaaaagatgatgaaaatttctcagtcgtgtccgactctttgcgaccccatggagtccatggaattctccaggccagaatactggagtggatagcctttcccttctccaggggatctccccaacccagggatcaaactcaggtcttccacattgcaggcggattctttaccagctgagccacaagggaagccttttttttttttttttaaagagtttgactaaagattataaaatgaagaaccagatgttaaaattcaattttacccaaatagaataggcagagctgaatataatttagcaagactccactgaaaaatataaatcaccgaagacagaatttcaggaaaatatcatacagcaaaagggtactactaacatttgaaagaacctcactccattgatagttttcaggactagattgagcaaattactcaggaatatatgctcagtaacttctttttgatatcactgttccatcctactatcagaactgcttcttatgaagatgacatattctattactattactctcaaaaaggtacaaaatccccaagattttttccctgctaacaggctaataagtttatctgatactgtttcacaagtaccagcagaagacataagattcctggatcacggatcagagacaaaggactttattactcatgacaaaacagtaaccataacttcccattggtttgctttggctcaccatgcccttccaaatcccacaggaataatataagtgggcctaatggatgtcttcataaacagcgggctacatttcaagaaaggaacactgagcttggggaatttactacttttatagtagtaaacttgttctctgtatgaagaaaatacatcacctcatccctcaaggttgttcaccgcaaacacaaaactgagcaatggcccaagcaaaatgcagtcagggtcttgcattcttgccataccaaggcagaaagtataccaatcttcatggcccatggtagatggctctcctaacaatctcaatgttctagtcataaactcagtctcaccaaatcttgacatttatgagactgctttcttccctgagtttaatgtttagattcacttttggataggcctttaaaaataggcattattttaaaagttttttgaagccctttatatacatttacattaataactatagttattgagcacctattaaatctggaaacatgggacatcttaactagccttgttcccaactctcacctttattattttccagtaagaactactagatatggagtatgcttgatatttaccaaagtgt

SEQ ID NO: 37847 - DNA, 1413 bp, Bovine  19866881171403
attgtggctactatttacttggccccaattatgtgccagacacttgacatcacctcacttaatcttctgatgtagatacagccattagcccggttttacacacgagcagccaaggctgggcagagatgaatttcctgttcaagatcacacagctaggatgtggtggatcagggttcaagtacaggccacttggctctggagtccacaggcttgtccatcatgctctcctgccttcactagacaggagtggtggagtcgtgagaagtcaagcttcacatgcttgattcagtgatcccaaccaccatgctcatcctcaggaatccatgattccagatcctgctctgtcaccagatggatatagagactctgagtcttttcccaggatcttgtctccattttccatagaactagaaatcagaggagccttaaacatgttagctgctaaattcttcaaacaaaatcttgctgaagcccagtgattacatcagatgaaatcagggctgccctgattgaagctgagacagagctcattcagcccagtttagaacacacagctgacaccaccaccaccctccctccgcccccgccaagagtttcctcctgtggttgctcctgaggtccccgctctgcacctctagattctactaaacaaatttgaaaaccactgggctggattgtttctaggatgtcttccaagtgcaagattcatagatagatgacctacatatcatcaaagtcacgaaacttgggcaaattaaagttggctcttcggtgttcagagtaagctccatgagtataacttggaaaggttgctccctcccttctttcaagagcctggggagaaatctctcactttgttatgagagatacttggaaaaaaaactgttttgcatcctcaaaaggggatttattggaagagcagccagttatcaggaattcatgacaatgaaacattattattaataaaacacatgaccaaaagataacattcacttctttgattatagtgcacagagttgttgtttagtagctaagtcctgtctgactttgagaccccatggagattgtagcccaccagactcctcagtccatgggatttcccagacaagaatactggaatgggttgccacttccttctccagggaatcttcccaacccaaggatcattgaacctgcatctcctgcacagcagtgcagattgtttaccactaagccaccatggaaacccaagtgtacagaattgttgctgttggtagtttgttgtttagttactaagttgtattctactcttttgtgaccccatggactgtaggagtaggccaattacaacccaatgccttttttttggtaacagctttattgagatagaattcacataccatacaatccacctatttaaatgtacaattcaat

SEQ ID NO: 37848 - DNA, 803 bp, Bovine  19866881357388
ctgattttccttgtctgctgctggagtgttgctggatctgcaatgccctcgtactagaaactgtagcaaagcagctagggcctccatccccaggggcctgttatagttcttacctggcagttcttgaatcagactgatctggatttgaatccaagcacagccacttatgaactctgcgacctgggtcttgttactttatgttcctgagtctcattctatccatctgaacagtggagttaatagtgacttcttaaggtttgtattaaatgagggagtccatatgtattgcttcttacagttttagcaccagggaagtaagtggtcctagatattactaactttttcatctgtttgagtgatacttgaacaggctatcccatggcaacctctgccttgttgaagaataaaggaaaattatagaccttaattttccactagatttttctgcctgcagctacagactctagattgtggagagtctgtatatataacaggtcacccggcagttggctattttagaaaagaatttcgcctggcacctcctgcctttgtctggagaaactttagggccaaagcagacacttgcctacacatttaaacatgcagattgatggatttgggggcagtgaaagaagtcttcatggtcacgacttctctgtgtgtgaaagtctttgatgtaatcagaccttcagtgtctcaggaaacagggcttcccctcacccttcctgtctggatgccaggctgtggttagaggtttgacatgtcactggacttgaattggttgctgtctgtaggctttcctt

SEQ ID NO: 37849 - DNA, 1675 bp, Bovine  19866881567054
ccagagggatactattttgttcgctctcatacactgagatccttagtcagcttcctcacagaacaaaaaaggttgaagataaaatcacaataattaagcattaaaacttcatccattctacatatccacatgggaaattttatactgagtttgaaattaagaaaaaaaaaaaaagatattgagataaagcagtagctaagcacatcctgagtctgaagtaaatctactgtgaggctatggggaaaaaatagctgatttatctgaaggatgcctcagctggggaagttgctaagcaacctgcaataggtgaggcaagtgtctaagactttctacaagctcctttgtgtggaaacaaacatttagcctctttctacagttttatagaggaaacaatcacctagacaaagaggaaacaaagccctattctaagagacagaaagaatggatgacagatgtattcaggtagctatgtctttgtgtcccttcaccatctatttaagtgctcaataaatatttgtttcttgactgaatgaataaacaggtatataaatatacgatatgaatggttatggtaaccttttcaacccattgggctattaagatacaattcaagatcaagagggacgggctttctacattagacaccccaatgccaaatggctatgaggtactttcatgaagcagagacacacaaactcacacgacacgagtttagagagagatgatcagcattcaagtgaaaagtccaataacatttctgttaagtaaagtcattgtgatctgccttcatttccttaaattagagaatgatgtttctggcttccttctttcaagagtgtgaaaataaatgaaaaaaaggaagaaaaaagatctctctccctctcaaaatgaatctcaaaatatgctgaatatattttcatactgcatcaatttttatttgtaaagcctttactttgaaaaatcaaactgtgcatgtagcacagaaataatttaatgccattacccagcttttgctgagaacctccactctctctatcagtttgttctgtcacacagtgctactggcaatgtaaaaatgaccaatgcaataaatatcacttaataattacaaaaatatactttctgtaattagctttccaggaactattaaataagcatcccccccccatatttgtacccagttctcttacctgctgtgcagaattctataatttcactccactcagacacaacataatcaccatcaacttgttttgaggcagtctgcactgctactgtatactcagttcttgggctcaaaaaccagtgtccacggacagtcatcggcaagggaacagcttttgccaccagttttgttggaacatcctaagaaaggaaaggaggaagagaggtacgggtgggtggaagaagatgaattaatgtagcacgtataacttgagtcacctgtaaacagtgtggaagaacttattaaattcctagctaaaatgtttaaagatatttagcaattactatcttcaaatctcttattcttcagatgtaaaaaaaaaaaaaaaaggcccgatttgatcaagaaacatgcaaagattacacagctagctaatggcataagtgtacatggattcatcttcttgacttctagtataatgttcttctttgtacattccttaatatgctc

SEQ ID NO: 37850 - DNA, 1551 bp, Bovine  19866880421444
ttctccttctcctgagaatttaaatttagggcttggtgttttgggaagccatcaccatgtgctttacaactgtaactttatcttcatatccagtggcacctgtgtggtcttcttttttaaatacgatctaaaagttttgttttgagtgtgtgagctcgcgtagggcatacagctagagaaccaaatgggaaatttctgaggcaaatggccctttgtttataagaggaaaggatcagactcaataaacagatctccagctcttgaataaatcacgctaagggttgctgttgaacccaaggtggaagactggattaaaccacattgatacagcagtgatactgaaatactctctcccattccccctttctcttgtgctatctcctttcatccgttcgttcactgattaaacaaatatttattaatattccagagaaccaggcaccagccagtcagatgccaaatacaccaggtctaaaaactattcatcacccataaggtaataaataggtatgtaatccttaccatttcccaagtctaccacctaaaaacatgtccaaaatacctggttttagctttgagtaaattcactcagcccacaattttgcagtcacacttaagagagacaaacccagtaatactgtctggaaaaacaagttccccttctcaccctttctgatctaagattttatgacccagagcttagatagtaaggtatagtcattttatcagatgggcttccctggtggctcagaggttaaagcgtctgctcgtgatgtgggagacctgggttcaatccctgggtcgggaagatcccctggaggaggaaatggcaacccactccagtattcttgcctggagaatcccatggacggaggaacctggtaggctacagtccaccgggtcgcaaagagtcagacacgactgagcgaccacttcacttcacttcattttatcagacagagtacttacgacagcaaataatagaaaatgcacttaaatggcaaagggtatatatttactcatgggaataaaatgcccaaagataggtttggcttcaggcatagattttcaaccaggtccctcagagacactgtatgtttagagaaatgtatgagaatataatttcacaacatttttgttatataacctacagtgtccacgcttagctctttcttgcatttcagaacctaaacaaaagaaaaccaacaattaataataattataaaagtaaatataactcagaaattcaattggaaaaagtagaatcaagctaaatcattaataaaatattaaactgatggtgttatttgtaaagactgcgcatgtgtggtgtgttataatttcaggaataatccatgtgaactatacactctatggaaattatctatatcacaacttgctagatggattaatggtttataaaaaaaatccgttagttttacttcccaaagttcatttttccttgtgctgtcatataatagttcatcttcaataagtatctggtaatgtgggataagaagctctgagggccaggcacataatttataacca

SEQ ID NO: 37851 - DNA, 2471 bp, Bovine  19866880519592
cgccttgctgtttaatggagggaggtggcccgtggaacctgcatgaggtggtttttaattccaatccgatttgttcctgatttcttggtttcctggtctcagcaggatgccccgcaatgtgggcggtagcctggccgcctcaccctcacccttgcaggccatgcgggcggctttcgcggcgcccggtgtgtgctgcccagggctggccgcggccgcggggccggggtgcggggggctcctgctgcccagtgtgggaacttggcccgcctgccttcccgcgctgcatctgacgtggaagtgaagtctttataacctttccagggcgatctggcggtttctgactctgggtgcctgggtggaattgctgtatgtatgccagctggataaatactgagggctggacgtggttttctgtttatgaagtgccaatcccagccttttctgtccactggtgaagagtttgttaggttctgctgctataaagcaatgagcttttacaaggatgagcaataagtcctgccaagctttaatgcctcattgtgtcctaatactggatgtcaacaatctagttgagctttaatatatttagtttatctctaggtgtttcagtctgacttgcagaagtaagaccagaaagaaaaaaagaagaagaagaagaagataattttaaagttattctgaaaacatgtgcaatcccataaatgtttacaaacatggttggattttcccatctggaaatggtggtggccaagttcccttctagcttcagctccaacatggctttcacattccaagtacaggtatttcctttacgtgggtattaaacacccaccactgtgtaggagactggggttctcagaaccactcacaccatatctagccctagggcagccctgtaccttagaaataaaacataagccgtgaatacaagccccataggtcattttaaatgtctagtagccacctaaacacggtaaaaagaaacaggtgaagttgattttagtaatatatcctacatacctagaaacacgattttaacatgtcaatataaaaatgactgaggttatttatgttctttcttttcatacaaagtcttcaaaatccagcgtgtgtttggcactgcagtggccaaaccatcatggaagccacagagcttgggagcctgttgatgtcagctctccaggtgagcctcctggagcagaagcagggggtgacatggatctggatgagcaagcagccaatgtcctgcatgtggggaaacacaggccttaggggcgtgtaatctcaatgagacaaaacatgcacacactctttagaatgcaacagtgcactgtattccagtgagtgactgacagtgctacccactcaccagattcatatccagctcctggatatgccctgaaagatggccaagatttcccaaagtaagtggaattgaagaaggaccttgttgaagatcgagtaagattgttgcaggtggagatgagcatagtggtatttccagactgagaaacaagcaaaattattataaaaccatatttagaagtgttttttccactgtttttgttgttgcttagtcactaagtcctgcctgacttgttctcgaccctgtggtctgtagactaccctgcttttctatccatgggatttcccaaacaagaatactggagtggattgctgtttccttctccaggggatcttcctgacccatgaactgaacctgtgtctcctgcattggcaggcgaattcttcactgctgagccaccagggaagctgtcttactgctgatagtggccagtattagtctctgaagtttggaaaagaaaggatgatgagggagagagactaatgatatttactaaaggccaggtaggagctggggcttgctcctagcaggtcttcctctgagtggatgctcaagccttttcttgccatttccagtgttgaaagaggccagagtttccccagctacatcccgaatcctggcgggtgttccatagcaaagtattctgcaatagaataaattcgaaagactgtaccctcttgagcattcccaatagacattagcatgttacagtctctgagatgacgttttagtaaagataccagttaaatttgcttcgtccaatgttttccaagcctcttggaccatggactcctcttacccacgtcctatcccataacattcattgttctcagaacacacttcaagaaatgtaatcctaaactttataaaggctcgctgttgtcaggaacttcagaggacaaatgttttctgaacagacagcagcctcagctgcagatagtgagggctggctttacattgagaccaggtgggggacattccacccatgtatctggaattttctttgttctatttctccagggacccacctcccctgagggataggactttaaggtcttgacaaatggtcactttcatgaattattgatttggcaaaaaaaaataa

SEQ ID NO: 37852 - DNA, 1094 bp, Bovine  19866880542089
aaaagaaccccccccacaatgcaggagatgggggtttgatccctggtctgggaagatcccctggagaaggaaagggcaacccatgtggctcggtggtaaagaacttgcctaccaatgcaagagacacaggttcgatccctaagtcaggacgatccactggagttgcagctggcaacccactccagtattcttgcctagaaaactccatggacagaggagcccgtgggctacagttcatggggtcgcagagtcggacatgactgagagactgagcacacacaaacgttatcagttttttaagatatatcaggagatgatttgttgaccagagtagctatggagccgttttaatattaataaactttggtctatcagataagtattgggccaaatgactcgggaggtcatttccaatgctaatatgagattttacgatcatgtacttttttcttaataattgattttgggataagtacaaacaagttcagtttctagggagagctttagtacaaactctgtgaaattcaaacaggaattaaatacaataaaagtaaattcagtcacactgttctgagcctaaatttttcaagttttcaaaaaaaatatttacaacatattttttatttagttgcagctgtgtctaataaagctgcaactgtgtcttatttccatcctttttacatgatctggtgctgttaaacagtctgcattatttttctgtgataatagattcctctttaattaacgtctcagcatttcggtgccaatagaatacaaccccccagactcagatttgtgaacatcgcctgcgaacgatatggaaaccaacttgaaattttcctctgattttcaacttaccttgacttcagaaaacagacacatacacacgaaaaggcctttcctgggaaacagtctgtcctgcgggacacttccccttctgatggatgtgataaacggggaaacgacttgtttggcaaagtataggacatcattactcaagtctgagttcaacagttcagatctgtaaggccttggggaggaatgaaaagtactttctttacggaaaatgattttgcccacgctttcaaaaactg

SEQ ID NO: 37853 - DNA, 920 bp, Bovine  19866880566560
ctgactctaatctggctcccgtccctgtcactctcatcaaggttgcaaactgcctcctgttgccaaatcctttggtgcttctctaagttcagcagctcatctcagcggtgtgttgtaccatcaatctgcctcggctcagagcccttcatcccagcctttccttttcttcagtggcctttacttcttaaactgaggtctgctgttgcctgcctccgagcttggttgattcctcttttcttccctgggttggttgttcttaactctgcttgcccatcagcaccatctggaaaggtttctacatgccttggtgctgggaccccagacaagggggattagactctccaggtgacccttctgtgcactcagttccatagatttgcatattatcctcaagagaccaaactgctactgtgtgtgtgtgtgtgttagttgctcggttgtgtccgactctttgcaaccccatgaactgtagccctccagtttcctctgtccatggaattctccaggcaagcatactggagtcggttgtcattcccttctccgggggatcttcccgactcagggattgaacctgggtcgcctgcattgcaggcagattctttaccatctgagtcatcagggaaacccattgaaagattatgtgcattagtcacttcccattcactcaggagggaagcatatttggggaagctcatccgcccatgttactgatttctctcagaatcagtttatgacctgtgcccagaaaaatcaatctcgaaggcacacttgtttattacccaaaaagcatcgccctgcttgatcacccttctttcaccatgcttggcaatgaatagctctcagctagtttccaaaataaaatccatcctaagcaaataaggactcgcccccagtaacacttttgcagggacgtgttgcag

SEQ ID NO: 37854 - DNA, 1540 bp, Bovine  19866880621232
tccacccgcccatccatccacccatacacccatccatccatccacccattcaactgtcttctcttcattcattgtcttatctggggctctgggcacaatcctatttcatattccactctaagttattgtttcctctgttggataagaatagttattcccaatgctgtcatcatatctgctataagatttgtatggttgggctggaggaattaagaaacacaagaggaaagggaagtagcactccacattttccaatcccctgatgccagcatagcagcagcagaaccacctgaaggagggtgacagtctcagagtttccggtaccagctggaagtgcagtgagagttgtccaagaggcagcagaaagcagcggagaggaatatgcaacccagagaagcagctgcccgttggagcaagaaaccgttttaagacaaatccccctctcccaaaatatggaggaaggtaagcccagtacttgggttacacatggattatgtcagataatatatattctgcacatagtaagcactggatatatggtagctattaaaataataataataaatctaaacaaattccacctgtgggactatttatctgcggaggaatctggagagaggtatagcagatctgggggcctctgggaatggagtaacattatttaaaacatcaacaaatactggaaacatagaaacattgaatgccagagctgggaaacctgaagaagcattttaggtcaacactctcattttacaaatgtatagactgagtccctgagaagtcaagtgactggcttgaaaccatccaacatctgtagcaactgagctggacacgctgacttccaattgactgggactttttaaaaattgtttttcaaaaaaatcatccaaatctaaggtccataaataaattcaagaaaattctggataatggctttcttagatttagcttaatgggaagttattggcagatatcgtcccagaaaagtggaaccattcagtgggaaagaaagtgtattagggtttcagtgatagacatgaattcttaaaggaatgaaaattcttccccagaaaatgctgtaaagatgcccattttgtgggtgtcttgaaaacttgattttctgttttccatcttcatacagtcaggaaatcttgctgagatgctaacaagggtctgtagaccttctccaccctacagacatgggagcatgcgcaaggaaaatggacagaagcccagtgtcatcaggctcgtggtccatgggataaggagggagccccaggccagcaggtcctgagatcagctccagggagagaggctggtcttgtgtgtccatcaaaatcctcctatctccacttggaacctttcaactaggaccatcttttgtcaataaacattcatcctgggaagcaaccttacaaatagagtaacaccatcactgtcaggaagtccttgacctcaagtttcagaaccaagactagcacataatttttttatttctagatcttcttggaagggcatgatgttatagcatcattgtcaa

SEQ ID NO: 37855 - DNA, 2029 bp, Bovine  19866880644038
actataagaattaccaacttttaatgagtccactgaagcagataatcaatgaggcttctaaaaggcagttttctcctccaggtcttagcatcattacaagctcctgaaggatggaagttgttctgaaagacttaaaaaggatgatatgtacacatactccttttaaaaagctgtttttctatgtttttaaaaaataaagttcaaaaatactggaaaactttctctcaacatttattcttttagcctgcctttgcttaacttttaaggagaggcagaaggtacatagaacactagcaatcagaactgtgtttaagtcttaattctgccccttattatctacatgtttgaggataagttgtctaacctctttacatttgaaggcatttattagaaaatattaatagaaatatttgtgcagcctacttcctatgacttaaatgcagaaaacacagaactggttacagcagagtctcagaggtctacattcacgctttttgtttaatttgaggtttcgatgtacacactggcagtagcatggcctcgtagctatgtgaggtattcagaatgtaattggttatcattttaatacctgcacgtgttgggtggtctgagatgatgaaagaattcaggcttctcacaagttcaaaggtgtttagtggtagacagaaaatgaacccacataacttgagaagatctaaagaaacagaaaatcaaatgaggtaatccgcctaggttcaagttgtagatgtggatgagaaggaaaaagaattaggtcatgcatgagacatgacttgagaagtcctgtgtgtgtgaaaaccccctttgagttatagagtcattgacgtaatcagttaccaatacaaactaatgcatcccatcaaagttgctgacaagatgcaattagtgtcctgggtaaaatttttctttttgcaaccccaggcatactgagaaagcaacccatgttacacatggcataacataacagtgtccttaattgctggaaaattgtcctgaaatcatctaacactcaccagaaattgcttgtcaaaattcacatcagttacttgaaagggtaaatatctttctcaggggtaagtatctcataactcctaggggagttagaattcagcttttaaatgtggaagacaagaaataccagggtttttaatatttggtggctgagaactcaatgactgagcttgttcttaaaatttggttcatgtttatgaaaaattggcatattagagtgacaataactgaaaattaaaatgtgaattagatattttaatgtggtctcatgactttagttttaaatctttccaagtttatatcctctattgggacatttaagagaatttgaagtttgttatatttatatttgcttattagatttattaggaatggtttgttagacaatcaaagcacttaagaaggaaatcaaatacatcaaatttgaatatgcagtctaaaatatttgaaggaattgaattagctaagtttataatcgagaccaagcattatgaaaagaattctaagagcaaatgttaaaatttgctaagagaataaagagaataccatttataagcagaatttaaaagcataaggaagaactagggttttatctttgtattgtatctaatattaattttagaaactaaataaactctgtatagtctcttctatgcagaaaaacctacaccctcaagttaatttaaaaaaatttaaatgaacaacaataactcaagaaaatgggttctgtcaattgaatggactggattcaatggagtgtgggttgaaacccactgaattcttttctcaccactttctattaaacttttctgtggaaaagttcttaatctattcctctctctcatctcacatgactcttttctgccactctcataaaaataaagaaccaaatctctttaatgaacacataattccctttcagagtaattttaaaaccccaaattccattcatgcttaaaacttttctcctccctcagcctggattgcttcaggcctggag

SEQ ID NO: 37856 - DNA, 2709 bp, Bovine  19866880741216
atgagagtatttacactgtggaaattagcaaacactacatatatggcctttcttttctttttttcctgagagagctagtttaccaagttccactgaagcaagtccatctctgcttctaaagacaaatataaaacaggatacctgcccacaggggtattatctcatttctcctaaaacagaaactgtatcctatctctgcgaggccaagtccatatgaggaagctgaggcttgcagctgacttctccaagggaaagaacactgaatggagccccaaaatcatcttgatcagcatcttagttccacccaggtctgacgttatggtaccacattttttctgccccagagtcagatgaagctaagcaagacgagggggaaaagtcaaatggactgtttaactttataaatgattttgttgtttttctgtttctaagtcctgtctgactttttgtgaccccatggattgcagcacatcaggctcctccgtcctctactgtctcatgtccattgagttggtgatgctctctaaccatcttatactctgctgcccccttcttttgccttcaatcttttcccagcattggggtcttttccagtgagtaggctcttcacatcaggtggccagtgttttagagcttcagcttcagcctcagtattcagcttctaatgaatattcagggttgatttcctttaggattgactggtttgatctccttgcagtccaagggactctcaagagtcttctccagcaccacagttcaaatgaagtcaatgaatgcttaggatagaaggagctgcttccaccccagcctcttgtacatttccacgtcatgccggccctaatggggagtgacagctgatgaaagctgctattcatggtcatctgaaacagcttttcctcccagatgaaattcggtgtggcatgagtctaaacatgcagaccaaaggccgggcgagtgtattccccaggtctctaagggctggcagaggcaactcagtttgtgaagggggcttcctgagagggcatcacacagccccagtgtaaacaataggagtctttgtgccccacccccccggccctgagcttagtcccgagagggtggtcctggccctggactctgcccatctcaggctctcctctttgtttataatcagcagcaggcactagggtgactttcgagttcggtgactcatacttcccatcaccctgtggaacaaagctgggatttttcctcactgcctcctaggtgaaccacatctctgcagggagtcatgttgggtgggcgacatgatgcttcaaatccgagatggctattctgactccttgtctggaagaaccaagagcgaatgcatgtccagccaaagggctttttgtgtggagtttggggacactgggttattccagcaaactgtagatggacctttaccagcctaaggcaagcagccaccccttggaacaagaagccagagcttctactctgagtcttgccatctgacactgacgtgaagttacaaacatatggtttccatcaaaacagagttggctctattccatcagcctctgggatccagggacttagaaactaggggcagtgtggtttctcatagtgagaggttgggcacttagaaggtgtctggacatcggggccaggagttgagtccatttggaagaaccaatgcacaagctccaagagagtaagcatggaccgaagtggcaagatcaagagaatataaaagaatgaaatcctgccatttgtagcaacactgacagacctagagattgtcataactagctaaagtaagtcagacacaggaagacaaaatacgatgtcacttatatgtggaatctaaaaaaaaatggtacaaatgaacagatttacaaaacagagagtcacagatgtagaaaacaaatttattgttaccaagggtaaggtaggaggaaggataaattgggagatttggattgacatatacatactactacatataagatgtatgtgtgttagttgctcagttgtgtctgactctttgcgaccccacggtctgtagcccaccaggctcccctgtccatggaattctccaagcaagaatactggagtgggttgccataggggatcttcctgattcagggattgaacccaggtatcctgcattgcagacagattctttaccccatctgaccaccagggaagcccaattaaagatggagtgaggctaaagtgtacagacttacttcccattctacataatgaatgtatctcattggaaaatgcctctcacaaactttcattgcagccctagcatgtgccaatcctggagcgatgtgtgaatgaacacatttgggcgaattactttcccagaaagatgcactacagtaaagagaatatccctcagtcatgtctgacttggtgatcccatggactgaagcccgccaggctcctctgtccatggaattctccaggcaagaatactggagtgggtagtcattcccttctctaggggatcttcccaatccagggatcaatccttcattgaaggcagattctttaccatgtgagccacaatgtatgtaaagagaatatgctgctgctgctgctaagtcgcttcagtcgtgtccgactctgtgcaaccctatggaaagcagcccactaggatcttctgtccaggaattttctaggcaagaatactggagtggttgccatttccttctc

SEQ ID NO: 37857 - DNA, 1454 bp, Bovine  19866880813217
ggggagagaaaaatccgaaatgaaagctccgccgtgatgataagcaaaccatggggtgggttactggggaaagtgctccctggagccagcacagggtccatgtctccattcattcattgtcccctggtctcattacctggacactctctggtgtcattaagatatcagcgtgatgtaggcatatctgcatgggcagtttaatgatgtctggggaaggcacggtgtttattcatgggtgatcttgggcagttgtcagactccagcctggagataaagacgccgggtctcagggatgttaatcctcccgctggcacttgacaaacacgggagccggctattaccaaactgattatttccatcattaacaacccatccatcagtctcctttgcccgacatggccacatgcattcatctcatcataaacaattatctgacgagtgccgagaattggtgctcagggtggaattgcccaacctggtctgccacaagatgtagcaagctgacccccttgctagcatcctcatttcattaatcagattaagacaacaagcctcagagggagcgtcttgttaaacaacaatatccaatcagggtccctttgtgttgcccgcctctgcggctgcgtttcctttcagaagatgaggctttgcaggtccccttggaaaacccgcatctttgctctccgatcacccacccatttataataattactcgtgttctgaggagcagggtgtgctgaagggctggagtgatggaggcaccatctgctccttatcgctcacctgagtcagagtctcctgacatctcttctccccggcaacatgagccaagcggagccagtgaagaggctggggctgtgccagagaaatgatggatggaagcaggggagacagcagctctgcttccgggcagacagccctttcctccaaagggtgactcatggcaaaggcagttttgccccagttacaaaggtcgtcccagacctaatcacgaagggctgatgtttgtttctgtgcgcctacagcttagacagatcccgttacacctaggggaaatagaaccctctgtcctacttcccctctgctttttcttctcgtgtcatgcaaggtttcagggtttggtttgtcaaggagtttagatgaccgccttttcaataaacacttgtttatgtttttaaagcaaacctagaacaaggaataaaaacattcatccattggtatccacgggggattgattccaggaccctccgtgggtaccaaatctgaagacgctaaagtcccatctcagccttccgtatcctcatctccatatccatggattcaaccagctgagtattgcataatattaattgaaaaaaactccctttgaatccacacaattgaagcccatgttgttcagggtcagctgtataaacatgcaggcaggacataagattcatctaactctttaggat

SEQ ID NO: 37858 - DNA, 805 bp, Bovine  19866880850165
gtccagtggttaagactttgagcttttaatgcaggggtctctggtttggtcagggagctaagatcctacttactgcacagtgtggtcaaaaggggggaaaaaaaagaaggagaggaggaaagacgatggtttgcaagtttaaaatatattgagttttcaagtgataactttaggggaaaaaaagcctgatgaaagaagataactcatatactggtaagggtattgttcaacctctccaaatataaactaggttaatcaaattgagaagttgtatttatcagactgttttgaggtcatggaattaattcatgattacaattgcaaaacctcaacatgacgtaaatgctctttagtagcacttctataaaatgaagatatttaccatgaaataggacttatgtgctatgaaataaaactttacaaggctcccagctttacagactagaactattagcattttatatatctatcaaattggttaaagagttttagcttctctgccttttctgaaataaaaagttgtaatttttcgagggtatgtctaggcttcctagggctttttgcaaatatatgaaggttcataaaaaacaagcaaattcatcgtttgccttgatggttgggtttcattaaagccgatggcatgtgtttatttactttcttccccctggattgcaagggcaactgaaaggagaccattggtggtagtgggtgttgattcaatgtaatttattttctcatatttgttgaagtagaaattatatttacatatatgctatattaagagggcactctatttaagttccaa

SEQ ID NO: 37859 - DNA, 1211 bp, Bovine  19866880860461
actggactcagaaggcatttgtatggctacacaagaggcaagaagcagtgtcctcatttctaaaaggttatcaatggtgattctctcagttgtaaaggattcacagagtgaggttctgtttctttctttctcgagcaggcaatggatggtgcagttggtagaaaaagtcagagtaaaaaaatccacagaaaatagcatatgtcagtggaaaatcatggtctgtctggaccagatcaaagtgatgatggaggcaatgattaacgccagaatgaataagtttcttcatagctatattttactgttcaaggtgggaggtagtcctgtaaattaaagggccaaaaatggatggattaagagagtctcagtttagaaactgttattaaggacttttttttaacagattttttttccagaatctagaaaagatatggctgtagagtcaaggattgagaacaccggggcagcagaaaaaataggaagcaactcacagttcaagggtagtcgtggctcctctgacattgacatatgtggccaagaaagagaggaagggaatgtctggcgcccagctagcactgatgcttattaataaaagcaaatttcattcacaattttaaaaaatctttggtgagttggacaaatgattgaacagatatagaaactgtattttatttttattattttttgacagtgctgtgcagcatgtgggatctaaattccctagccagggattgaacccatgccccttgcagtggtagcccagagttttaacccctggacttccaagaagtccaattggtgacagttttcagtggactatggcaaatagataaagtgatggaaatgataatcattttaagagacagaagaaaaatcgttgtgacagccccagccataaaatgcttccagacatttcagctggaatgaacttgacagtacagtttatcctgtgcatttaaaaagaaaatgagaaaaattgaggtttagtggtactgaatgattcatgcaaggtttcatcctttctggtcaaatcaagactattcacaaaattatccacaagacctggggtttcatcatgaaggcacagaaagagctgacgaattggaacatcattttaaaaagaagagagagagaaagaagatagggttaagaaaatggatggattggacaaaccatggattcctttcatggtctatttaagaaggaagtgttcc

SEQ ID NO: 37860 - DNA, 994 bp, Bovine  19866880877592
ggggtttgtttgttgagcatgaaatcagaaaaagggaagctggttgggtgtttgatggaatcgagttaatatagcctcaggtgtacatttcccacaaaatggagaacctggcaacgaaccaagattcctcccgattcattggtcgagtttctccttttcccctgacagctcttgtttatctctgggtccctcttttgtctgaacttctgtggctgatctgtacctttatcccaggacactgttatttagtcagaacatcaattaacatgaacatgattgcatgttgtgctgatctaaacactattctctctttttcttgtaacttttaatttctacttgagtcctgtaaaattcattaacagtttaattctaaaagataaatcttatttcattaaaatcttagagagggtgtcccaaacaaggaccacagtatcgacacctctctgagttgaaagataaagtgggataacatatgtaagcttctggcacttacttgataagcattaaaaagttctttcgtttccttccccttacttaatgaaaacaggtgttgaagaaaacacatccattttttccttgtgtgttccccacatgagaatcgtttttgtaagttttttgctggccagaaaagcaagggtcctgaaagcatttttcaatcacaagcctggatggagattaaaagacaaaataaaacaaaaacattaaggctttcaatgaccaattctcgttcacaagaccctggtaaatcagaacctgactcccccaaattaatatcagtgttaggacatcatgcattctgccttccatccatcacaaggagatccaagccaaggatcttgggctttatcctggtggtgaattcagaaactgggctgccaattttctgtgtaaaacaaaaaaattttttaacattttttaacgaagtgatacaggaataggggatgaaggaggagaaagtatgtggggaagatttataagtttcagaaaaggatca

SEQ ID NO: 37861 - DNA, 1058 bp, Bovine  19866881323431
attacttgtcccacgttaccgcaaaaatcaatcatatcgtaacaccaatctatcatgtaaaattcagcctccaggctcgtgttttcaggaaagaaactggcagttaatactcccatccccatttacttattcagaagaaaaaaaaaaaagatctgcccaatgagatccaaaataacttccttaagactgctatcaaattctaacaatgaagttcatccatcctgacaaagttttcattttataaattacaatttgtttcaataaaaaacagaacagcagacgtccctggtggcacagtggataagaacccacctgccaatgcaggggacacaggaagatcccacatgccatgggcaactaaagcccatgagctacaactactgagcccctgtgagctgcagctactgaagcccacatgccctgagcctgtgctctgcaacaagagaagccacaacgacgagaaggccaagctctgcaacaaagagtagcccccactcgccgcaactagacaaagcccatgcagcaatgaagtcccagttcaaccaaaaataaataattaaaaaaaaaaccaaaacaaaccacgaaacagcatttcccaaacttcatttgcgaaaacccaagaaacacatagtcctttgggttttcattgtcgcaggggaaacactgtgcatgacaaatttcacttacttttcacagcaaatcctagaaacataaccctttaaaagtccaccactaaagtccatttaagttggttgaatccatttcccactcatatttgaccataagatcctcctgccctcataacacccacaaacactagagaagtaccattacagggaatatattttgctggcagacttcaaggatttcaaaagcctttcctgttggaatgtgatagtagcaaacaaaaccattgctttcacaaaattccatcttttatttttgaatttggtgcctttggactcaaggataaagttaaataggcttcattctcagctaggtatgtggagggtccttccaacggtcatggtgggaaagtccagggaaggtcgaaccag

SEQ ID NO: 37862 - DNA, 1113 bp, Bovine  19866881338098
tctctgtgcttagcccttcttctgtttaaaaaatgaatacagccacaacctcacgaaagtctaggaagaattacacaagatcatgctatatacaagaaatctctcaattccttcctctctccctccccacaacctttacatgcaagtgtgtgcatgactgttgctgccttcttcgtgaccaggttatttctagggcaataacactggagcccaaggagaaatgaaaaagtgagaaacagaaaatgtagatcagataatacgtttccctcagtcattaggaccttgtgtatctttctgtgccttttttgcccacttggaaaatagaaaacggttgctaagatcttccctatgatgtcttctcctacagaaatatcatggcaagttgttgttgaagctcatatctataaggaaggttaaaatgcagtctgaagtagtataggggggcttccctggtggctcagacggtaaagcgtctgcctgcagtgcaggagacctgggttcgatccctgagttgggaagatcccctggagaagaaaatggcaacccactccagtattcttgcctggaaaattccatggactgaggagcctggtaggctacagtccatagggtcgcaaagagtcagacaccactgagtgatttcactttctttcactttaagtagtgtagtgagcctgaatattaaacacagttattataatcatcttagagccagggggaaaaaattgattccacatttgaaaggcttttataaaacccaaatttgtactaatttagtaaaaagtcaactatcccaaagtatgtatttattgcaaaccattataatgtttcaactgaaaagtgtattttctattaaaagcaaaaaaaataaaaaataaaaaagccaaggcaattaaaataaggctttgtcagcctgtacaaatgtaagggtgaatgcgtaattttcctgacatgttcatgaacataaagtagttcagagagcttaccacctttgtgctcctcttgaggttagagaaccccaagttgagagccatttgcctattaaaaccctgagtcagtgctgatcaagcaatagtaggttggtccgaaaatgtataagcaataatgatatta

SEQ ID NO: 37863 - DNA, 1734 bp, Bovine  19866881378700
actcccaagatcatcagcaagagctagaaatatttgttgaatgatgttgaatgaatgggaagactgtgtggcaattagcagcctaattaattgaagggttgccaacccagctggactggtcctcagctctgctacacagaaggctggctatgtcattttctcgtaggatatagcaaatgagatgaattctgtaaataaaggggaggctctgcttcccagaaagggaaaaataataggaaagcagctctgtagttgagggaaatgtcctaaaactctctgctccaagaggaatagttgcttggcttgctccaactcattgagatgagctcttaacctgcacatggactctctacttgcccaacctgaaaagaagtctgtttgtggcaatacccccacccatccacccaaagaggactgaagcatgcttccatttggggcagggatctggggtaggaatggtaccttccacaatttctcgggagtcagtggagtgacccacagtgatcactctcatctttgaatcataattataggtggacaagcaggccttgaggaaaaacagaccattaaaaagaagcatctacatagacagtggagcagatgatctctaagatattaacaaaggcacgagaggataacttaacaactcaagtagaatcagcaaaaatacatgatgaatagtgaataaatagataagtagatagatgatggatgatagatgaataggtagatggatataaagatagataggaaagcttattttgaaaataaatcaaatgatagaatctgagaaatttaaaaattaatttaaaaattgcttaaactgttacagtcatgggaatactacttagagctgaacttagtaaactctgataatcaattttcctttcctgcacaactctttacactgcctggaagcaataattatctttttgttcattttttttttttttttgctcagttttccacatatttattgccagtttaatccatattctctagcaatgatctggatctcttctcaaccaatttctacgtattaggcattgtaatgctttcttttttttgggataaatttctccgtgacttgttgcagtgtggaaagattatcttctgcaagggttatcctagcttctctgatcttcttcaccccctggagattttttttcacttctctcttgctggatactccgttccttcaggctcctgtcttctttctgagtttactcctttgttttggtgcagcacttccctcccagtgactttccttggaaggatgtataagaggtaaatgttttgagaccttcaatttctgaaactgtttatatattttacccatcacttgattgacagttgagctaggtttccagttttaaggagagaaataggaattggaaaatattgtttgcttttcttatagttttcaatatttgctattatgaaatctgaaatcactgggattcttgatctttggtataaaactggtatttcattttcttcctgtctaggagactataaggtgtcttctttgttcccagtcttttgagacaacacagtgaaaggcttgaagtgtgtctcttttccttctttctcttagtcactcagacaataggtctttgaatctggaagttcatgtattctgtcctgccagatattctttaattatcttgatcatttcctcccctccattttatttgttctttctttctagaattctcatgatagattattgga

SEQ ID NO: 37864 - DNA, 1955 bp, Bovine  19866881383666
ttaaaggttgatttgcttctataatcgtccagccttctaacagctcattcggaggagtaaatggacatcatgaagaaatttacagcttcggaaacgttgagataagcatgcatcccatcccttgaaaatgactcatccagtgagggctgagctgcctggaaacgatggaaatcttgaactgcgctggttacaaactgtggttggtatcaaccctgaaatgttaacatggggactggaagggaatttcatgttcaacagatgctacctgcattatggactagggtgggctatgcttgactgggaaggcttgtccacgtttctgagaaaatgcccttaaaatcatttgctccgattcctctcagactgctgggtttgatttcgcatgatggtttactgactttctccattggaatgacttaagctcattttaaatgtaactctctgctcaatgctgctattattttacttgaggctgttattaatttgccctggagtgatgtgtggtttggattgtgttgtgctgatgtggtttgtcatatttgattcgaaatgtaggacagaagcttggaaagaaggaaaatgagaatgtggaaaaagagtcagtgaatgtgactgtggctttgaggaatgtgtcataggctgctactttttggatgggttgtgtccattttttaaggtgacatggtccaaaaagtgggatataatagagaaatggggcttcccaggtggcccagtggtaaagaatctgcctgccagtgcaggagatgtgggttcaatccctgggtcggaaagatcccctggaggaggaaatggcaaccctctcccagtattcttgcctggaaaatcccatggaccgaggagcctggtgggctatagtccatagggttgcaagagtcaggcatgactgagagcacgtgcgtgcacgcacacacacacacacacacacacacacgggaatagtcagctggcctgtatcaagctgcatcttcgtgacacggttccacttataagaggctgtggtcttggaggcaccacggtaatcctgtctactacaataccctccagttaggaaactgtacaggacataatacaacaaaatgctaaattttgttaatatataagtgccaagaactataaagaatctgggagtctatcctacttgtaggctcttaggcaaacccatgattagttcatggatgttggcagaagacacgagattcttgggtcagagacaaaggtcttaaccatagtctagcaagcagcatgagcttcctgtcatgtccattcccctggctccctagtctcatgggagggtcacacggatgaacctagaaggatgccttcatacccagtgggttgcataaaagaagaggaaccctgagcttggtgtgagtggtaagcacagtcgctctctggccaggagggattgatacttcattgctcaagcttacctgttgcaaacacaatcttgagaaatggattaccaggcagagagtggtcgggatgctgctttttaggtagacagagttagagcatgcaggaacactgagcccggggagtggtgaattgcctctcccagaaagaaattactctcagccaatgattcaggatcaaatcccagtccttctcttctgggtggtttctcagtcttctatggaatatacttggcaattccaggtgcaaagatcatcttcttcggctggaaggcaggtcactttccaggggttgctctcaaactggactggtggtagagctttcctgcgtgcatgctaagtcacttcagtcaggtgtgactctttacgaccccatggactgtagcctgccagaatcctttgtccatgggattctccaggcaagaattctggagtgggttgtcattcccttttccaggggatcttcctgacccagggatcgaacccacgtctcttatgcttcctgcactggcaggcggggtt

SEQ ID NO: 37865 - DNA, 1475 bp, Bovine  19866881391241
atgaatgcaggcagtggcccgtataaacatggcgaccgatggtggaaaagtctcaaaaagtaaaacccacttcataaggggatggccgtctggtcttctgatcagtatggccctgaatttccaatctgtttgcaggaggactgtgcttcatgtggaaaagccagcacttgtctttctcaattccgttcttcatagttaaggaataatccttcaagtttcaggcattgtgttgcttatagatttcagacatcctgtttcttgtcatttttagtatgattgcaaattttttttttatttctgagttttcagctattttggtgggttctcttgaaatattatttcaaattgaaaatctcaagaaatgcttattgaactgattctaaaagtaacacatcattaacctcttttatctaaaatgtaaatcagaaaagagggagaagaaagagaggcacaaagttagttttatattagagtattattttggataatatggtaacttttccacttgtcatggagctattaccaaagatgggggtgggggagggtagaattaatttcctctaaaatatctcttactttgatttttttaagtaccagtgaactgggctacaaattcattccaccaacattcagagctctttgctctcacaactgtcctgctggaatcaataagctgttgattaaaaaccttgttacttaatacatttagtaagcttaatctgttttttagaaacctaagcactttcatgtcactagctgcaggggtagagacaaaagctgtggctaattattaacaacttcacaaagctgatattgaatttctaatgtatcccaaatgccccttcctcccacccccacccccattagttcctgtgtcccaccagctcacacattgtaagcttggtgaatgactttcagtttaagatcctaaagtttcagaaaaacttgaaacaataacaaattctctggtcattttgaaacagtcctgtaccgcagcaacatctggatacaaaggggagtcattgctggctggaagagggccaatggcatccttccgctccacctgcttcaagatgggtgactcccagctgctgagtaaagaggaggaatggggtcaggatggccttgtaaaacaggccaagctgggttagacgtgtttcagttctcagatccctattccttcccctgcaacctctcctgagcttcagaattgcatttccaactgccaaatatacaaacatttcctgacttgcagaagacaatagctaaggactatactgagagttggggaccagagacagatttcaaaccgaaaactagtcctcggtttgtccctggggggtgtgtcctggtagggaaggtgacataattaaggcacccaatgaagctggggcttagtctgtggggtcactgtgagttggacatgactgaaatgccttaacaatgaagctggcatttattggtcagggctctga

SEQ ID NO: 37866 - DNA, 1356 bp, Bovine  19866881466711
tttaaaagatttttttccccctgggacattctaggtaatacagcaagtcaagaaaaatagaaacgatattactattggaaaaagagagacaaaaacattgttggatgtaaattatattattttccacctaaaaatagaaggttttgaaaaggaagttttgataaatgggtcagttactgaaaaattgtacaaaaatcattaaattaaaaaattaactgtaaaaatcaactttcttttatgcagcaattagcaattaaaataaaacaacaaaatatactccatttacaatagcatacaggaatgcttaaaaaacatgcatatggcaaatactacaaaactttcttgaatgacataaaaatctattaaaaaagaaaagattactttcctcctggatggggacaaaaatacattaaatgtattagttcttcccctaattaattaaaaaaaatttttttaaattttaatgatagtttaacaagtgtcacaccagggtaattttctttccaaatttgaagactaagtggaggaaaagaggcaagaaaataagaatgagagactctttcattgttaagtagtctgtttataatttatcatgaacctacagtaattacaaaagtatagcactaactactcaaggaggatcataagaattcatatataatatatttttaactagatattaatgtgtgtgtgtgctcagtcctgtccaactctgggactctgtggactgtagcctgccaggctcctctgtccatggggattctccaggcaagagtactggagtgggttgccgtgccctcctccaggggatcttcctgacccagggactgaacttgtgtctgttgcgtctcttgcattggcagatgggtgctttaccactagcaccacttgggaagccctaaaatattaatgcatgtgctgtattatttatacattcatatataatatactataagatattattgtatatatgacttagtacttaataagctagctctctaaattattgaataaagaatggatttactcccaaattatgtttatttaatatttctttaaaaattaacatagtttcctacaatgaactctattgaaaaatataatacaggtagattatagacagaaatgatgaaacataaatatgtaagaaaactaaaagtatcaacttaaacatttacataataaaaacataaagaaagtttttaagtaattgaagggggaagtattcatatacatgattgaaagtgaaaagtgttcttccggttgtgtcctactctttgtgaccccatggactgtagcctaccaggctcctttgtccatggggattctccaggcaagaatgctgcagcggggttg

SEQ ID NO: 37867 - DNA, 743 bp, Bovine  19866881522355
accaacccacctctcctgcattagcaggtggattctttaccgctgagtcaccagagaagcctactaagtatatagatgagcctaatcaattcacttactttcactgagccttatagtcatcagctgtgaaatataaaagctaaggattttaaccacccagttagttccatccccattctctcttctgggcagaggagaagggacagcccccacagggccctgggtaaacaaaggacccttatgagagatgagtctcagcttcctctcatcccaggagcatcccagtctctggcccgttagcctggtgtttcaggtcagggttattttatcctcaggaataactgcagccttcggatgatgaacgctaagtctttaggggccatttttaaatccactgttaatatggagtgacactgaattccctgataatcggattagtgtatattgctcaagctgtcattcagaactcaaacccctttatctctttgctgatatgaagctaagcttcttgactcactttgctgctgtctcttcggagtcatcaagaatctgacttcttcgagccaacaattttatttgcttaatcttgggtgaagagattagggatttagagaagatttttcaacatccctgccattcctagagagaaggcaaattccttcctcctgcacctttctctctctgccaccagtgcacacacagcaactagagcaatgcaaacacccaacacacgcaacgctaca

SEQ ID NO: 37868 - DNA, 724 bp, Bovine  19866881881528
tgagtgactaacaacagtgatgtatatacacactcacttgtacacacataattattattactaattgtaataataacctgaggtactgaggaaagaaaaggtcgagcttccaaaaacacaacgtgtggatgttgagagcaccattagctgaaaggaaaaaacacatttactctcatattttcaccaagttttttagagtcttgaatagcagaaaccattcttattgattaaatttcataattctgaatttgatcaaatcataaaagacccatcagactgcagtttttataaccattatagataatgaggggaaaatggaattagtaagtgaggggtcactgagtattcaattatcccagctttatcttgttaagaaaaattagaaattgtgcacgcatgtgtgtgtttgcaatcacaggaagcatttcttctaaactcacagaagctgtttccagctctctatggcagcatcttacaggcaagcagcagatactcttttttttttttttttcatatatatggacacttgttggtgaatagatggagaaaaaatgggaacagtgacagactgttttcttgggctccaaaatcactgtggatggtgacagcagccttgaaattaaaagacgcttgctccttggaagaaaagctatgacaaacctagatagtatattaaaaagcagagacatgtctttgttgacaaaggtctgtatattgaaagcta

SEQ ID NO: 37869 - DNA, 952 bp, Bovine  19866881906949
agaaacccttcatagaatcgtaaccttgtaagtcggttacctgttgatggtcaaatatatatgtgtatatatttatatatatatataattttaacagtgcccattacacacaggcttccattataacactatttccactcggtcatggttttatgaaaaattcccctattggctcaaactttccaagcttaatcacactcttgaggtgaactttttcaattaaactccacttaagccaattttgagctctttgaatgaaggaaaaatatatatgccagactcttaaaaataactgtcaagcaggttcctttttaaaatatttatttaacacactaacattcacacttcacaagagcactaacctgcccacctcataatttccagatgatggaggcagaggtgctttttttgcttagaaatccccagtaagtcttttaattatctcctttgccacagggaattatagatagtctgtaaagcaggttattttgttttaaacttgtgaggccacttaacatatatgaagctgaattcagttactacacagcatcttccctccttgtgagtttggccaagttttccattttgggattaatgagaagaaaagtcatttggattattgatccagtgtgagtcatacagaatggggaagaatgggcaatcaccactattttgaatgtcctccatttactgtctctaaactttattttggaaggtgcagactttgattgtattatttctatagggaaaacaacctctgatctctctctcagaacaactggaaggcaaagtttcctgggtttgggtaatggctctgatctggttggttttctttccctactaaatcgtttgtgtcccctctgtatatcttcatctggttgattgggaacagggagcctgccaggacacacacagccatactactggggtacagccagccaagggcaggaca

SEQ ID NO: 37870 - DNA, 1787 bp, Bovine  19866881917721
tgggggtgaagaaagagaggcgggctgggctatggacctgccagcagccgatgaccatctagtgcagcggaagccagcagaggtttctcttgggcatgcctgctttactttctttttccacaccttcctcaaaggatcaagttttaatagtatggggacagcctggaataatgggaaaacagcatctcaggcagcccagggcccaggacaatgggcacccccccaccccgctcttgggtgcgggcaccctgctttcagatgcaggcagcccaggcggggaccccggcctattctgaggatggccaagcctcagagaaaaagaacaatcagagggtaaaaggattggaaaacagggagtttccagcggccatttctttgccttgcgtgtgatgcattttgacaaagtgtgaagcagggaaaaagtcgcgggattgcaggaccgcctggccgggcccgtgcagtggccgacagagctcgcccgcttcagagagtgggctctcgcctccggttttgaatttggaactgaggcatgcaaaaagagattacggtttagcattcactgcatgcattcagtgaaaaaataagactgtcatgaagctgggactcaatctaccagaggatgtgtggatgagggagccctggcttctgagcggacggtgggcagaaaatgcccaggctggaggcttagggtttccatagctttgagtcagaatttcttctttctggctattaatgccatccttccttgtggctactccacgatatttcttttcctttttctaccttcagttttttctcctttgaaaaatctattacctggttataaactaggtaaccgaaatgaaggaggcccttacaggtctgggtcaggaggaagagaaagacatcaaataaattcgaaccaagacagtaccttaaaattatgttttgttttggttttttttggaggggggactttaagactgcttcagaaatagacatagagaacaaacatatggacaccaaaggggaagggattaagggatgaaatgagatcaggattgacacatacacaccactatatgtataatagataactaacgagaacctactgtgtagcacggggaactctactcagtgctctgtggtgacctgaatgggaaggaaatccaaaaaagaggggatatatgtgtacatatgggctttcctggtggctcggacagtaaagaatttcttgcaatgcagggcacctgggttcaatccctgggctgggaagatcccctggaggagaagtggcaacctacttcagtattcttgcctggagaatcccatggacagaggagcctgccagctacagtctatggggtcacaaagagtcaggtaaaactgaatgactttcactcactcgctcatgtgtatgtatatgattcactgtggtacagcaggaactaacacagcatcgtaaagcaactatacccccccccaaaaaaaaaataaaagaaagaaagaaaagaaaaatgataaataacccaaaagactgccccattccagaccatccttctagagactagagagcagagcctagaagagtcgagtggcttcctccggttcccacggcatcccggttggcagaaccgcgatcagagcctaagcctgtgaacttctgtgccaagattctttctgtgacccccacagacttattgtcctgctttatttgtggggacgctcgagttactggcagagtttattcagagcacagactgctggagcctttggtgtgctaccaagctttgctccttcccagatgc

SEQ ID NO: 37871 - DNA, 976 bp, Bovine  19866881942252
catcatctttacatataggccaagttcactgtcatttacaccaactggttcaagcctcgcctcatagccagccctactggaatttgaacaaaacccaggccagtggcaagaggtggtccctgttgtttatctggtcaggtgtaacagcaggggctggacaccacctctgccttaggaaggttcacaagaagaggaagtctgaggtcacattaatacaacctcgtgtcctcaggggtccctctgccctggtcctcacccaggctatgaatagctgccggctgatgttaggtggctttctggtcactgttctttgggatagctctcctcctgtgtcccactgctgcccaatcactgtcattatctctagacaccatcctgacttctttccaaaccttgtgggaaagtttctcactgagccctctttcactgcatcatctgctcctctcttcacaggtgttaaagtggcctgataaagacaatatggaggaaaacacaggggcaactatcggctctgattttcttgttgaggtcttgtcccttctgtggtgtgggctgtgctctcacaatctttgagtttgtttttctatggaagactagctgggcatctccaggctgccatataacctccaatccttcctcttgcattgtcctaatatacaggataaaattacaaattgtctttttgaataaccttaaatatctcatggttcaccagggaaattagaagaaaagtatttctgctaacattacagacttaattacgactgtgcaattggggaagatgactcagaaaccctaagaattgtcttagattatccatcaatctaatcatgttgacatcactgaaatagcccataatgaggaccaatgtgctatttgtaaacctaaaaatgaaaatgtagagaatattgatctgagaataagcaaaaccatccaaagtttgaatgcactatacctggaattacacaattgatat

SEQ ID NO: 37872 - DNA, 1810 bp, Bovine  19866880369973
cttctctagactgctcctcttcatagggtttaagaccctcctccctgggacctgcccctgcttcccacccctccacctgattgagatgtttcttcctggaccacggtgaccaccaccaaaccgtcttcctgggccaagcctctattctaaactggctgcccaagtggccttaccctccatcctggtggtgctggtccccagcttaaacccttccgtcacaccccagcctggcagtagggaccttgcctggcgactcattgctttgtccctggactcccttccggctccttgaccccatgtttctgttcactcatttgcctggagggtctgattctcctttcaaagcccagcgtgacttcacctgctctgggcagccctccctgaccgcacagaacaaacctaaccccactgaggtctgtggtctttctcccctacaccccgggtgtcctccgccctgtcctcaggtccgtggagtgttgcagagggagggacacaactcaccgcctccagctcctggttccgggcccggaagcgctccctctggctggagatgatggacagcagcgagtccacctggccctcggggagggagctggcaggcgctgagggacctaggatggagggacagtggcttgggggtaggggaggcccagcccagcggcgggccctcaggtcaccagctccgagggggctctggtcgagtgccatggggcggaagcaaagggacactgaggggactgggtggctctgccaccgccaacttgtcctggcctcaacacctggggggcacctctgttccagcccttggctgcctctcatggctgggcctcacccccaccagggagctgatcaacacccaccagcctgcgacaggcccctggcagggctgagggggtcagggttcccacggtgggggtgtcagactgaggtctagaggggcaagtggggggctcacccttcttgtgagtttctgctgccttgctggcccgggggcctggctcctctgatggaggtgtgtgctctttagggcccaggtgaccccacctctgctcctgtccccctctcctgccagcccatcacagcatgggcccctcctcaccatagaacagggcggtggcctccttgatgggctcgggaatcttctccaggccgagctcggctgcgccctgcaagtgggagggcgaggtcagcggggcgcctccacacttggcagtgaacacagccatccagggggccaagcacacagagggcaagaagcgggtggggtggtctggcggcaggggctggacacagcagtggccacaggagggcccggagagggtgccctacgtgggccaccaaagcgaaggtggttcaccccgaggctggagttcagcgtggggctcccacccagccacttggccctgacaggcctcggaggctgggtgaccccaggcctaccagccagcctgccatgtcaccccagtccagcccgtttctctccctgggctccgtttctttgtctgtaaaatgaggtgggcgatgtgataataacccctgaggatcctgggactccagccttccctaatctcagggcccgaggtcctctagctgtgagatgggtgggcagtcctggccttgcttctgcccagagctcccagggccgagggccaagccagcgcctggaggcagggggctttgtgcccttagcctgtggcctggtgccccgaatagaggctttgtggtgaagtgagcagacagaccctggaggttgtaggtgacagtccctgtcaggcttagtgtgggcccagaggacaccggctgcccaagg

SEQ ID NO: 37873 - DNA, 1216 bp, Bovine  19866880479959
cctctgtgtcgggcatctttcactgagcatgttctccgggttcatcgctttgcaccctgtatcaggacttcattgctttttgtgactcagcattattccatcgcatgaatagaccactctcggtttaccattcaccggctggtggacacggattgtttccactttctgactttttaaatttgcctgtaccgagtcttaattgcagcatatgaacttagttgcggcatgtggggtctagttccctgaccggggatggaacgcgggccccctgcattgggagctcgcagtcgcagccactggaccagcagggaggcgcactgtttgactttgtcagtagtgctgctgggaacattcgagtacaggtttctgtgtggactgtgtttccattctcttcagtgaggctagaagtggaaccacttctgggtcctaggggaactcctcctccgtggtcttgaagcccagtgttgaccagctgggtaacactgccttgggcgggcccgccctcccgcgctcccgcctgccctgcctggccgctcctccttcacagctcctgactcctggccacggcggccaggggatgccacccacacacgggcctcctgtctccagctctgcttcctgcggtgcctgggcggagacgtcctccgacactccacatccccttccctgctctgtttttctcggtggcgtttgctgccagctggtgtgtgctgttcgtatttctctctctggtgtctgtctccttctgccaaaatgtcagatccacgaagtcaggcatcgtggattgtcttggtctctgtgattggattcttccgctctggcgtgtgatgccatttccgtaaactcagccaatcccccacttccttttcatcctcatcctccaggactacggccccaaagtcaacttccggaaacagaagctaaagagggccggcttccgaggcctccccagcttcagccgagaggtggtgcggcgaatgggcctgtaccccatcctggaggacttccggcccgtggagcagtgcaacctggactactccccggagcgcggctcggccatcgacccgcacctggacgacgcctggctgtggggggagcggctggtgagcctcaacctgctgtcccccaccgtgctgtccatgtcacgggaggcgcccggcagcctgctgctctgcctggccccatccggcttcccggaggcccggcggacagcgcg

SEQ ID NO: 37874 - DNA, 2947 bp, Bovine  19866880590987
atcctctgttgcccccttctcttgccctcaatctttcccagcatcagggtcttttacagtgaggcggttgttcgcatcaggtgcccaaagtattggaccttcagcaccagtccttccaatgaatattcaggttgatttcttttaggattgactggtttgatctccctgtagtccaaaggactctcaagagtcttctccagcaccacagtttgaaagaatcaattctttggcactcagccttctttatgatccaactctcacatccatacatgactactgaaaaaaccatagctttgagtatgaggacctttgttggcaaagtgatgtctctgctttttaatacgctgtctaggtttgtcataggtattcttccaaggagcaagcatcttttaattttgtggctgcagtcactgtctgcattgattttggagcccaagaaaatgaaatctgacacagtttccatattttctttatctatttaccatgaagtgataggaccggatgccataatctttgttttttgaatgttgagttttaagccagctttttcactctcctctttcacctttatcaacaggctctttagttcctcttcactttctgccattaaagggatatcatctccatatcttcatatgcatatcggcatatcttcattatttctatactttttaaatttttgttccttccagattacagtgacacttgtgttcatgcctgctcaggaaatagtaatccacccactctcacaagggaacaaatgcttttgtaaaccagcaagattataggatatggttatcttgtttggggaacaaggtctatctgcttctcccaaagtattaaaaccccaaatttccttttcatagttaagctttgtttgttgtgtcagtaagatttttttaagtccatatctttcatttaaagtttggtaacaaagtgctctccctgccagcaagaatagaaggcgacatgcagtctgatacttcggtgtaagaagtaaaagggaagggggacacagtgtatttgctcacattcttttcaaaaataacaatggggagacacactaaaagctactaaaattggttacctagagaaagggatggaatagagtagatacagaggctggaaaggaaacagtacttccttgaatactcattttattgctttgattttgccatcatgtgatgttagaaataattgaaaaagcataattatagcaaagaaagaaaagatgaccatcaacacaaacaattattattttaaataacaaaaaagtattattttaatgaaaataccaggtaggatatacacatcttcaaagcaaaaagaactgagtaattttcttaaactgctttccatagttctatggttagtggtcttcttgtatagttatttcaaaaccattatataggtattgtaggatgacactaataaccaattagttaatgtctttaagaatcaagattcattaaaagtgggtcaagcagaccatgggcgcctccggatacaatgcactggacagaacccaacgtccactctgcagtattcttgttaccagagaacaaaaggaaaaacaaacctgaatatcacgtttgtagatctaccttcagacttgcaggaaatacaagaaacaaaacaaatgaaaggaattagaggaaacaagaatgtgggaccttttacatgacagatgatctgttttcttcaataaattagtggcatggggaaaaaagaagaaagaactattgctgattactagagatattagatattagtatggaacaaccaagtataatatgtgaaccctgtatggatatcaacttaacagagccatatgtaaaaaggcatttttgaggcaatttggaaaacccaaatatggagtaaatatggagtctatatatatatctgaatgtagtcagtcctagacgatattcaggagttattgctcatttcattatgtttcataggcatttgcactgtgctgtgttctctgtcaggggctttccaggtggcgcagtggtaaagaatctgcttccaatgcaggagatgtggattctgtccccgggtacagaagatccccttgagctgttgttgttgctgttcagttgcctcagtggtgtccaccccctgggagtaggaaatggcaacccactctggtattcttgcctgtgaaatcccaaggacagaagagcgtggtgggctccagtccactgggctggacacgactgagtgactgagtacaatattctctaaaaatgccgtttcttgttaaagatgcacagtgaagtatttaccagtaaaagtaatgcaactcccgagatttactttctaatactcccaaccaaaggtggagaggagaataattaagaaaattggcaaaatattcattattgtttaagctgaataaggggaattattatatactctcacttttgagttatgtgtaagttttttctataataaaaatgttttaatgctataaatgccttttcttcttgtaattagtaggcccatctagagatttcatttcctaagaaatgagaatcaagtctgtgaagttatttttccttcttaacaatagacaattctttcatcttggaacacacagttagactgtctatctactgttatgagaacaatttctctgtctttttataattgtttggcttatggtttcttgtattcattcttctcttggcaaagaataacaaacaaatgcttattattaaaatgggcatgtaaacaggctgtccttgctgggcaggactgcgtagtatgaagccatgatgactgcaccataaaaaaatgctgaaaccatgcaaagccctcttaactatcaatgaggaaaattgcgattgtttgtgatctataaaacatttttatcaaaacattaaaatctctctgactagcagttataactataggaaagaaaaataaagggggaacacaa

SEQ ID NO: 37875 - DNA, 1665 bp, Bovine  19866880791258
ctgatggtgctgtgcctgaaatgtcgcaatacccacccacccagcaaaaccaaagagccaacaccaagtggccttactctctctcgaagagagagctacactggccgccagggcgaccgaggaattatcaaagtaccctctgatgctaaatgtctttgggttcaggtcttgaggcagaaaaaacacaaatctctccagtccttttaggtacttatctgcagatgactgtcaaaatatcctgcaccctgccacacagccccttggtcactgatcagtatccttcatcagctcagtgtgaagatcagtgtccctcatcagcaacagtgggtttataaatgagaaagcaacgggctggggcgggggcgggaagttacctttcttttccatccgtttcatgtccatcagcttctccacattgttggggtcattcagccacagctgcatccggacaaagggctcccgtcccttcagactgagcttgtgccagggcttggggcgagcaaggaggtcagagacagagccttgggtgagccccaggatggtctccccaaataagcgctgacctggagaaagaacagaaccaagagagatgtcatcgctgagactcagggagctggcaggacaagtaggtgtcagagtgcaatcagaaacgggggttcgagacccagagtcttatcagtcctgggtttagcaaaagcaggttttgtttttttttttgccaagctgtgtggcatgcaggatcttagatctccaaccagtcatctaacccatgcccctgcattgggaactctgagtcttaaccgttggaccactgaggaagtcctaagcaagcacttcttagaagcacttcctcaaccagacttgtcacgacctccgtgggtgatggagtcagtactcctcttacgttctgcttacgcacaaggtttctctagaaagagtctttgggttttggatgaaccaaggcccgcacaacacctgctgcgtctatcagaggtggctaatcccaaacctgagctcgggaggttaagtagctcatggggcgacctctctttcagagcctcaaaccgggccgtctgcactggctcctttcacgattagcaaggttatcaggtcttgctgagaaaacaggccacttgacccaaggtcacagcagggaagagaaggagaaagagctcctcagctttattttcctgacaagcaggccatttccagctctgaagtctgtccctgcagttcaagtagcctgctccctgggctgatcagagggtactgcgctctggagagcacagtggcgttaggtctgcagtgttcatcagaggcttgaaaggaagatttctcttctctgagagccattcagttgcaggtgaagaggggccagcactttgaaaggcacaaatgagaaccaggcacaactggaaggatctgacgggaggactgaaaggcaccggacttcgagtggaggtggagaccgggatcagaggccggcgtctggtaccatgaagcctccggaccgcgacactggctctgcccctcagtgtggggtgacccagagtgcgagctcactcgtgttcgactctgcgaccccacagactgtagcccgccaggctcctctataccgtgggattttccaggcaagaatactgagggattgccatttcctcctcc

SEQ ID NO: 37876 - DNA, 1795 bp, Bovine  19866880803754
ctgtgtattaggggctgcacagtgttgtgggtgacacactgcttgaggcctggaggttcaaagacaaaagctagtgaaagaaaagaggccacaggttctgaacagagacccaaaaagggcactgtggctttacttccatgaaccacttcctttaagatctttgtttcctatgactaagtcacattaacagtatttgataatcatcacaaattttcactttaatttcaggaaaacaggtctctggtaagagaccatctttgctaactagactaaccccgaagcttggtgtggggtgctccaggtgctcccgtgagccaggcacccctatctagcagggaacactgggggaccagccactgtcacatcaccaagtccatggactaaatggcttactgtttctgctcatttatttgccagccttatcagcctctttctgtaggaggtaagttcctctctcagcaactgactgtgctcctaacaaatgcagctcacagtactgggcgacgtgaaccctctcatctaatttcccaaccccagagggtgacaacgatagacagacatcaccctgacggacgtgtgcccggcattctcctagtgcagcgttatagagagcactgctgtgttgagactgcaccaccatcctgggcttcccaagtgacccagtggttaaagaacccacctgccaagcagaagacacggtttgatccctggattatgaagatcccctggaaaaggaaatggcaacccactccagtgttcttgcctgggaaacgccatgaacagagaggatcctggtgggctacatacagtccatggtgtcacaagagtcggacacgactgagagactaaacaacaccgtcccaggaggtactttcttagacaaggaccccagttcagatatattgagcaccaggccctgggccccacagccagagcccagccaccagctcaggaccaacctctccattccccattggcctgcctcccgggagggcagggacagggctgtcagggcagagatgctggtctgagctggattcggtgtgctgtgtgtcagtgtttcccttcagaggtccatccagcccagatgagagcaggtcactggcccatctcccttcccattacagggggcctctccccagcacagggctgacaccagggactgaggcacacacccacatggggggtggccaggggacagccaagggtgctattacctcagtggtcccttcttccccagcgcactgtcccaggataggtgcttggcctttcaaggggaaatgagcttcatttgattcagtctgtgacttggctctggtatgacaggatgactcagccatcctatagatgtgtagggctgagccaagattattattcctccctccttcctcaaaaaccaccccctgcaaggaagtttctggatgcccaaacaacagagccctcatccctccttctctgcctgcagaagaccctctcagaggatgcagtggggtccaacaggttctgtcaaatcgctggaaaggcagggaaaattcttgacaaatcggcggcgtcagaaaatcaattcccaaatgccatgtaattcaccgacaagcccaccggggcatttggattgaatgggaaaggatttctttccttaaaaaggaccaagataagagcaagaaaacatatttacattttgtctgccgacccgagctcttgagctggcgagcaggagtaatgagaacagcgcgtcacaaacaacccgggcctgccagcgatgaaaattaatgggaaggtaaagagcttcttttga

SEQ ID NO: 37877 - DNA, 662 bp, Bovine  19866880813554
tgcagactccccaagagtgtaaatcactttattttataaagtaatttgatctcttacaaatatcatttacgttcctctgaggagccctgtgagtttttcccatgttggaaatgggactgtcatatgaatgttccagcacagtagcgagggcttgctataacaataaaaagtaaaaagccactcttgaagaatttgttcagacacagagaaagttttggcatcgatcataaccgacctggaactgtaggcgatttcttgttttatttaggaacaagggagtttgatctaaaacccgtcagattctgccaagttgggtactgactctgatggggcagcaaatacttggagagtttaacaggaggccggctttctgttcaagcaagaggcaggcctaattttccatgcaaacgtccgggaaactcttagcacaaacaactgtgtccattatttccctaatgtgtcttgaatttgagccagggctgtgttaaggtctccagcacttgctaattagattggccaacccagaaaggcagggaggaggaagtacacctgatccttctcagagggccaaccgctcctttcagaggtgcagcgaaggaagccaagagcctgggttagacacagccttccacccctcaagaggaacaccccaaacagaagaa

SEQ ID NO: 37878 - DNA, 1608 bp, Bovine  19866880815567
catccataaaatgggttttcacacggattctggaaattactctgagtaaggccagtcctgccacataatccgtcatctgacagacaaccttagtggcgagtcttctgtggtcagcatcagtgctctggtccaggagccccggtttccaagccagctccatcactatttcacgtccagtgatgtaaactcaggtggtaacacttaccaggcctgagtttcctggcatgcggagtaaggaggaagtgatcctgaggacctctcagctttgacggcctgtgatgggtgaatcacacttgtcggagtccttttatttatttagtttttcttaagtgtttttttttctgacttagactagttttaaagttttcattgactttcttacaacattgcttctgttgttgtttttttttgttttttttttttttttgcttctgttgtttttatgttctggttttttggccacaaggcatgtgggatcttaggtcgccaaccaaggattgaacccacgccctctgcactgggaggcaaagtcttagcccctggaccaccagggaagcccctgtccttttacttaacagacagttggagagcccttgctgtgagccgggacccgcagtggatactgggagagccaggagggacgagcgaggccctccccagagagaggacgatccagtgggagacgtcctgctgtaaaaaggtgacacatcactctgacagcatctctgccacccagcccatgaagggcattgtcatttctttatatagatgaggaaatggaagctccctagacgtaaaccccttgtcccagaatgttcggccccagtgtccaagccagggctcgagcgggggccacctcccgccccagaccagagctttaaaattattccccaggaacagatccaaagcaaagctttagtgtgaggaccccttgtaagacgagatttttgtgttctttctttaagttcacatttaactaaaacatgacttaagcgtttcaggatacagagaaaagttttccatttaaggcaccatcacagcctttgtacttaatggactctggtattaattttgtccaaaacgtcctctcgtccaagttcacctggatgggacccagccccacggccatggcgggaggagctgtcgaggatggcgtctacacggcttctcatggcttctgtggtcgcttggggtccttgagagaaggccatgcatcctgtgtccacatggggctcctgagctacaagttgtgattgagagggtttctggcaccgtcctggactgtagcaaccaaaacatttcggaaggaaatgagtgtttgtgcaggtagagtaagttgtggatcctcggggtgcttaaacacttcatcatcggctaagtgcagtgtttacatggcactgcttcagtctcccgctagcaaccctgccagggctcccctcgggggtgcgttcccacgtagctcggcagctccagccccagccagtcggggagcgaatgagcaaacataggaaaccgggccagcggcacaagtctgttaggcttggctggcagaacccagcagagaaacagtcgaggctatagatccagcaaaagccaaagatcccgggc

SEQ ID NO: 37879 - DNA, 1403 bp, Bovine  19866880841552
caagagtactggagtggggtggcattgccttctctgatatagaacatttctagaacccaattcttgaagtctcttccattctttccttgttttctttttttttttttaattgagataaaattcacataccacagaattatttcttgtttttaatcttttctcaccttctactgtttgaaggcctttgtagtacaaggctcacccttgaaggagcaacacctctgacagtagagaaataaagaccaacagagcacttaaaatggtgataatgacagtcaagaactgacctgctacttattggagaattgggaagtcacttcttattcaaagagctgggattcttagaaaagttatatactgtgtctcttcttggttatgtatataaatcattaaaaacatccatgggaaataaaaagagacaggctttccctttgaatattttttcaacaaagaagaagggaaactgcaacttccctggtggcccagtggtgaagacacggcttttcaatgcaggggggcttgggtttgatccctagtcagggaactaagatcctgcgtcctactgggcatgaaacagaagcaatattgtaacaaacttaataaagacattaaaaaacagtatacataaaataagtctttcggacatttaaattaaaaaagaaaaagaagagaaattgaacttagggtattgtagcagctttagaaggaaataacatacaatgttctgtctcacaaatgaaagcaagttggatcatcaaattgcctgagtcacctgagaagccacctttcgatacccagagctcctatctccaaatcaaattaagcagaaaaacaagtttaaaaaaaaaaatccttaaataattatggaagtgggcagagtttctttttcatgatcgaaacggctgataacgcttgtatgaggagtgaaaaacatctcgtataaaaatttaatctgagtgtttttgttgttaaaaatctcatgtgaatcatgaattatgaaaaacacgactggggagagctgtgaacaagttgattcaagtatttcaggcatccgatgatctcacgccccagtccggcttggcttctgggatcgtcaggattttatcaggttcagagcttgttgatggcctcatgttggctccaagccttggctggctcctttcacaggctcagggaatcatggaggaccagagctcaggctggtcaccagtgaccatggtggttggtggctggtattcctctgctactgttaaatatgaagaaagcgaaaccctggaaatgaagggcatggtaagatggacttagacctcatgacccttgacctttgactcttaactcgggagtaagccaggctcattccttccttcatcatacattcattcaacccctactatagtcaggcc

SEQ ID NO: 37880 - DNA, 1263 bp, Bovine  19866880841795
atgtataaatgagggaacaggagcctcttgtctcattaatagcaacaggccaatggtttctgttctcactcaagagatattaaatgtccttgcacttcatgaaccagtaactgaagtcctcaatagccccagctggtgcagacttcaggctatctgcttgtatgtataacatcagaagatgcttatttcacaatcactgagcagttttctctgtaaaaaattggtggggttgcttaatttcctggggtcactctcttaggtcagcaacaaacttgggaacaaatcaagtgtctttgtccccatccccctggttctgacccttggtacccctttccgtgagtattttctaccgaaactggggcccatgggaggggtcaggctcccagcccggcctgcaaaagccaaaactaccgagttgctgtgcaaaggacccagggggttgaaaggtcacagcttcggaggctcaggaagggcttgggaggggcctgtgggtgcctgtgggctgggcaggggcaggaagagggagggccccatcgcacctgtgctgctgctgccgctgccgcctggggactccagggtctccaggaaggtctccagcgggacgtggaccagggattcgccaacggcctctcgagcgcggctatgtgggggctgtcaccacggctgccagttgtctctgggggccggggcaggtccactgctggagaagcagcaggttagaaacacgcgtgtctgtctggccaccttggagcgaccgcagtctccagccctgccctccactgctccagccagttctgtgtccacctaccctccgtcaggagctcacagctgcaggaggccacgcggctggccagacagcctccccgagcacaggacggctccgtgtcttcctcgctgtccctgcgaaggcaagaaagcccaactgtgttcggccgtgcgactcggaccctgaccgcggtctgctcacgcagccaggcagaggctgactgtcccgcggccagcatctgctctgtctggctcgcctgggtccctctgcctccgtgtccctgcgatcacaccctcagcttgctcagtggccaccacgtgagtgactgggccatatggataggtctccaagtgcgtgcagccctccctgaggtcacacgaccccttacccgctaacccccaaaaggggctggcctcctctgaggatcccacggaggaccccttctgggggcgggacacggggtgggtggggcctgggccggcccctcccctcccctc

SEQ ID NO: 37881 - DNA, 1681 bp, Bovine  19866880871737
atggcttgctcacaataactactttatgacttcctatctatcagtcaacaccaagtctaggaaatttacttctcatgagttcttaaattaccatttgagcatacaatcatttatcttatccaattacttatctcatgctttccatcctggcaaagtatactaccaattatgtttgaataacttagtccctaatggttaagtacctggtataatttttcagactcccccaattttcatggttagatgatataacatttctttctacagaacatttctgttatattgatatgagaagacttttaccacattgcagttcattattctccaaataaaatgtcagcctatccctgtctatcctatgagtctgacatctggaagggagagagcagacaggaaaacaagggaaagcaaatcctctcaatcacctcaggctgtggagacctgactaaaggccgagttgatcctggctcaaccaagatcacatacgtattattagtttcattccgcttcttttttttcctattgttacccacaaaggttattcaatttgcacttaattttcaatcttaattctttaacagcaacaacaaaaaacataattgtcttacctggattccaaaatcggtgattttatcacactcagacacagaaagttcctttaattttctatgtctggaaagtgtcatcaaaccctaaaaatgtttaatataaagattatttgataatacattagtatagaaggtgtatttccaataagataacaacagtttatgcaactaaaaatatttagcttctgttttatatttctttagacttaatcatacaatcactttggttaggcaacattattcaataaaattttcaggttatctctaatgttttacaaaaagtattacaaatcctagaaccagaaaacttcttatcttgcctcctgttttcaggtaaatgttacatgaatcaatgtaaagaaatcttcagttgcctaagtttacagctttattttatttgaagacacttcatgtggctaatgaatctatttatcaataaattcttatttatgcttagcctaaaatctgaaaatctttagctcattttattatatttaattgcttggagggagaagaaacacatctttaggtaaaggcccatagacagataattattcactagtagttcatttcttttttcaggctaaaagttttgtttctttttatttaaaaaaaatggatttcactttcagctcttcacttttttaatgtgtggttttgttggtgctcaaatgataaagaatctgcctgcaattcaggagacccaggttcaatccctgggtcagggagatcccttggaaaatactggcaacccactccagttttcttgcctggagaattccatggacagagaggcatgatgggctgtagtccatggggtggcaaagagtcagacacaactgagcaactcactttcgctttcactttcgtcggttggcccatttctcagtacctattctcctaagctggtacaacattcagttaaggaactgactgttgtgccttataaatgccatccttctgttttgcattcaggatcatgttacttttctatttcctgtatatgcttcctagactatatagactaagagcagtttctcctccttttatggtcccagagctggctggcaggg

SEQ ID NO: 37882 - DNA, 779 bp, Bovine  19866880876034
ttttcagctttaggattttgtgtttctataagatgattaactaagataactaaagaaggagtatgagtggggaaaaagaataatgaattttattttggaaaagctgaattttagctttctgtgatacatctagttgtcaatgacaagaactgcttgaaagtggaagtccagtccttgcagcagagctgggaatggaggtacagatttggtagtttatcaatagagggtaattggaacagtaagagttatgtgaccagctaagccagctgtgaataaagagataatgtaccaaaatgaattggtaacagctaaattaaaaatttggagaaggcaatggcaccccactccagtactcctgcctggaaaatcccatggatggaggagcctggtaggctgcagtccatggagtcgctaagacctcactttcacttttcattttcatgcatgaaatggcaactcactccagtgttttcgccttgagaatcccagggatgggggagcctggtggctgccgtctgtgggatcacacagagtcggacatgactgaagtgacttagcagcagcagcagaaaattaaaaattataatttacttatattttaccttattctatattttaatgaatggtgactttatttaatccctggtgactcactggtaaaaaaattctgcctgctaatgcagggtttaatccctgggttgggaagattccctggagaaggaaatggcaacccattccagtattcttgcctgggaaatctcatggacagaggacagaag

SEQ ID NO: 37883 - DNA, 1028 bp, Bovine  19866880912868
ttaatatctgatgctaaagtgagctgtgaggtgcctgtgcccttgaagcctgccctacagattaattagagctgatcctgagggctgctgcagggccagtcccttgggccacacaagaccgccaatcccctatttggattagtggagatttgagtttaaattcacaaatctcgacagatcagcccttctgatcttcatcctgtgttactgtcaaaccacatgtgtactgggatgactcgaggggtctccagcctccatttcttgaaaagaataaacccccaaaccatgttcgtgtcaattgagcaatttttcattttgctaaaggtttccactgcaccttggatgtagcttcagcaagctataagtcagttattttcagggtgaactgtgctgatttaaattgaagtgagatttgagaaattagcagctgcgtggaaacactgatttcatggttggcacctggccgttggaaagcaatttggggtttttgggctccattgtcttgtttaagaccccaatagggtggagaaggcaatggcaacccactccaggattcttgcctggagaatcccatggacagaggagcctggcgagctacggtccatggggtcgcagagagttggacacaactgagcaactaacagggtgggcatgtctccacgtgaagatgaacaagttggaaaagtcaggtgttgtgtttagaatcgcacagctgggtcaaatccagaagtatcaggtcctagaagcttccaaaacgctacaactcccttctccttgaagataggcgtttaggtgctttcagccagccttggaattctgttcacccaagagccacgctcagttggagctttgagctcaggagaggagaccagataccagctttgtggagaaacactggacgctgcggtgggtcctgaagatgcacccgcttgagccctttcccacaaggtggtccctgcattcctgtgtggggacaagcctcggaggccaggcccaccctcgtgcaccctggatcctgtggccctggt

SEQ ID NO: 37884 - DNA, 1205 bp, Bovine  19866880958739
ccttgagtgagtggcagaatggggtatctggaggactccgagaggggccacagcggccttgagaccctaccctgacccagggctctgatcttggctgtggtgcttggcctcttgttcttgtgcaggcaggcgatgttgagacgctttcgtggtgacactgcgctgggccagcttttcccttcgggggctgtttctccctgtggctcacttgggtttgtgcagccgagaaggctgtggttcctggaggcttcccagaggcgatgagggcgacgcctctgatccctagagacagaggcgccacagaaggtccaggagagctgggctggcctgagcctaaacctggtccctcttgtgccaggtcgcaactcactggaagaagttcatggccgcactgagcccagaggagcaggcacaggcccaggcagactttgtgaagtcggctgtcaggaacgtccgctacgggcccatgtcgctcagcgaattcacccagtggcgggtatgccctcatgctgctgtgctgcccatcggccctgccagctccctcctccctggctcccacagcccaagccgccctggaggtcgctggccacaagaggacgtggggagtagggcaggtcagggaaggtggcctgggggctggaaagacgcttccccagctcttactggctgtctgggagaggcttgaggccctaggactatgcctggcttcctgatggcctgctcccacccaggtgcggatgatctctgaggagctggtggcctctggtggaacccacgcacgtgagacagacatgccagagggatcccacaaagccacagctacccagcagcccagggtgagtggggctcccaggctccctgggcctgccttggctcttcctgcctcaagaggcattagggaagcaggggaccttgagatatgcccaggagatggtctcctgtgcttgagtgggttctctctgaccctggtacctcttgcctcccataccccaggaggggtgaagttgagtctgtgacagggaggaggtaagccctaggcagatgggtgcctggtcaccatgcctcagcctgcccctgccctctcctccacaggccaggccggtggccttgaggcggccaggtgataccctactcagcctctctccccagaagcggatgtgcacctccctgttggcgccggtggagggcagccttgtgggctctga

SEQ ID NO: 37885 - DNA, 2051 bp, Bovine  19866881053715
ttcgcttttatgggacaggcttttgtgcacccttttttaccatgccccagatcctcttttgagaggtcaggaagtggacccagaagaggacaagtggcttgaccaaagcctagccacagcgcccggtcccctcaaatccacacacagcacactttgatctccaccctgcccctgcctttcattctctgtcttttacagattgttaggaagtgggatagcatattaatatttccaaaacttcttatgaaattggaagtgttgtgcagtgatgaagatagaaactaggaaacaagagcttttaatcccagcttacaggaaattctaactagtaggaaatctaattcaggccgtcctgggaaacgtcacacactcagagatgaaagtcagctaaattgggatctaattctataatctaaatatagatgtagatatattacaggttggccttttccgcttgggagaggatcattcactctaaaaagtaccttttgtgtcacagagcgtggccggccagggcgacagcacaaaaagccaaggagggactttgactttttcattccttagtcttcattgtcttaaatttcataagaagaatgtattggtacattacatgtgtagtacatgaatttaacaggccaaagggaagactctttacagagcgtcttccaagcggacaggagttttgcgtgtagcgtttgccttttctaccacggtgaccacggaccgtgaaggtgccagcttctgtcatccatcccggggacacagagaccctgtgtcagaagttgactagctcattagcctttgtgtggcaagggttcttttattttaaatacgtttgattacagaataaacatgcctataaaagttcaaccattgaagacgtgcaagacgtaaaatgtaaaattccaccagcccctccccccgcccccatcagattgggcttctctggtagctcagctggtaaggaatccaccagcaatgcgggatacttgggttcaatccctgggttttgaagatcccctggggaagggaaaggctacccacttcagtattctggcctgaagaattccacgggctatatagtccatggggtcgcagagtcggactttgattttcccatcaaatttcagaggtaaccactgttaacttacatagtatgtgattttttatttatttgtttttcttttttcttggttgcaccacttgcaagatctaagatacccaactagggattgaccccaggtcatcagcagtgaaagcgcagagtcctaactgctggaccagtaatttgtaattgttttgattcttgtttttccctattgcaacctaagggtgggcatatgctctctgtcttattaactgacatatctcaagcatggagaatggtattcttcttgaagtaggtggctcgtcaatgtctgtggggtgtgtggacacttaggcagatgtctgcacgagtccctgaccattcatgcaagagttactgcagaacggattcttaggcgtggtgttgccgggccaaagggtatgtgcgtgttttcctttcctggttctgccaatttagcatcccaaatggcagctcacttgtcactcagtcttccttgggggacagaaaggacagtgggactgtccttttcctcaccaacactgaataagttagttactgaatcttccactggtttttttaaaaagtgtgtattcctttaaattcagacttcctcaatcaacagtgaaattgaacgtcttttagtatatttattagccaatagtgtctcttgtgtaaattgtcgacgtcctttgctagttttttttactgggttgcttgcttcaccttcttggttctgctgggttttttgtgcatgtagtaataattctttctctcttatgtgttgcagatattttccccaaatctgtcatctgtcttgcaaatataaacatgtctttctacatccattctcttatagtattaaggttttcatttggcttttttccctctgacagcagtgttgtatatacggtttgaggtttgggatctaacaattttcccctag

SEQ ID NO: 37886 - DNA, 1027 bp, Bovine  19866881074508
ccccaattacttggtgtgacagatggaaccaatgaaagtactcctttgaaatccaagtttgggtaatcttaactaaagcagttcaggaagaatgagacccagctgaggtatggcagtccctagattgcaaaaggaaaaaaaatagagacatttgtgaacattgcaactgactaataaaatcaaattttcaagttttttttttttctaaactatgaaagtatgataacacatttacaggagacttggaaaatacagagcaaagttacatatagttctactatatattacaatattttaaagtacgcaaattaagatttttttagttggggtttcaatatcaaactctcaaaacttaatagaatagacagaaaagtagaaggaaagagtagacctgaaagacactatgaaccaattcaacataatcaagatttatacaattttcacccaacagcaggatacaaattctattcaagttcccataaactctaaaccaggagacatggaactcaagttattttttattttaaggcaaaagcattccaattattataataaaggtacatgtagaaagtggtgtacaaagctcgacaccctcctgcttgcctggtttcatggctaaatgtttgggctctgaatgtgaatcacggctcttctacttgctggactgtgtgatctcaggctaattacttaacatcatcttcagcatctgtgaagggggactgatgatacctctagtatttggggggaagatgaaacaggctcaccgcaatgaatacttcacagttcctggtccaggggaagaactcagttaaactgttaggatttagcattatgaaaactgaaactggattcaagaagttaaagggattcttctcacagctttgagatgtgcaaacaagagtaggactccaacggatgttctgctgaacttatttttctgtttcctttgctgtctcacaatcatgaatcatgttgaatgtgggctctagaaatgctcagagtaaattgccagctgtccttgccatct

SEQ ID NO: 37887 - DNA, 1335 bp, Bovine  19866881112374
aaatagtttgaagctgaatttttaagcttcttttggcgggatcaaaagaaaccccaaacttctaaaaataccaaattagctttttaagcacagtttctatctttagttgaaaaatgtgtgcagtgtgggctcctggaacctccttaaatgtacccattgatatcagcatttaccttgaaaaatgaggtctttggcctgcgctaataattaagtcactttctctgcccttgaccttccccctcagtgtcaggattgcaccacgtagacagagcctcctcccttccctttctgacttcagccccctgtcttcttgcagtttgttgtggtccaagttatattcttgcaaaccatgatgaatagacgtgagattgaactttgagttcccatgtcagaaattaaagtggatattcctactcagggcataatctgaaatgtttgtgtttggttgaaaatgtgttatatgatgctctctgtagcagattggcctttctaattgctgagcttgttaaaatttaaattggttttcactttcttagcaaatgttgactgacagtcacagaaagtggcccagaatcctggtgagtgatgggaggctgggtggcctggggtaggaaacttgaggcagaccatttgaagtagttagatttgactttcagtgcttccacgatggccagagctccaggccatacccagctggccatggggagcataggagaggcaactcttcctgctgtggtccttgagggaagccccatctcagaaaccggcttcacgtgggcaggctagacctcagccaggcaggggacaagggaagcgtggaccacacacccagagtggtagagcccaagttccatgagtaggccacggtcccccaggcccctccttggagtgtcgaggtgcccaggactgtctagggactttgggtgggatctctgccagttttgttaagaggagaggagacaagggaacagtaccagggaaaggaggagaaatgacttttctttttttttttaattaatttattttaataggaggctaattactttacaatattgtagtggtttttgccatgaagtgacttttcttaaaccccaacttggtgccagacaccaggctgagcgtgttcacacgcatcagatacttttatcctcacagcatccctgaaaagatactttcccgttttgcatctaaggaaactgaggctcagagagtttcctggcctgcccggggtggtgtagccagtaagtggaagtgttagttgcttagtcgtgtctaactctttgtgactccatggactgtggcccaccaggttcctctgtccatgggatttcccag

SEQ ID NO: 37888 - DNA, 1001 bp, Bovine  19866881152812
atggaagggcggttggggggggccggctggtgatgctgcattctgggtgtttttcaacactgaagccgggcataaaagagtcgagtgtttacaatgcccccacgtgtgacccttaaaccggcataactaaggaagcctaacttgctcttcgctgttagaagtctcctcgttaactgagagcagaatccccagactcctaataaatggcctcttgtcctctcctggctgtgttaatccagcacgcccaggagtggccgagccttcaaggtgtcaaatcacaggtgtctaatgtggaatgatgtggagttccatcctatcactcaagaggacagagatgggcagaggaagtctgacaccccactgaaaataaaaatgaaacccagacagtgccctacatggtttacttggtatggattcagaggaagacccagaagcacaagaggcaatcgggtgggtgcacggggggaaaggaggctgccctctgggtaccacataccccccacacagcagcatgggtgtgacctgctttgtaccacaggcagctcagagtcctccacggagcctggtggcatctcatttggcatctcattcctcacgtggaccaaaggctggccttaggcataaaggacaataccgacagctcatgagagatcagtgccggtgggtcatggcttgtggtctggtgtgaatgagtactttctccccgtaaagacaaagaggcaaacagaccctctgaaatggggagggaaaaaaaaaaaaaaacatattcagcttgttagggacaggctccaaatttccggcacaaacatttatttttaatcgagccaattttttttccccccattttaaacctgttaattccatgactgagaattcatcaagtttcagactggaattaattttagcaacggctttataccaaaaatattagtcgacagagatgtggtaagtggcctcgcttcacacactgtcactggaaagtctgcatgttcttgttcctt

SEQ ID NO: 37889 - DNA, 750 bp, Bovine  19866881213939
ccctgggcggcgtgtggttagtcgggcaggttcctgtgcgcagccccccgtggccctggggtgcggcccagccctctggcgtgaaggcgccaagaagtatgagttgttccttctacagtctcggtgaccgcagcctttggccttgataagtagatgatgttgattcatgacctcggacttctagtcacaaaaccacagtctggctcaggatatttcaccagggacgggagagatagctgatcaaaatgcacctgtgaatctctctagtctaggataggaatttgggattttttttgaggggaggaggagcatgtgggatcttagttccctacagtggaagtcttagccgctgtaccaccagggaagtcctttgaatctccctagtctgaatcgtgagaaactctgtccagttggtactgggttggttcagcctgagagtgctgtttttctgcttggcttattgggagcaagtaacttttgcagggaaagagcggctgctggaggcaggagtggagctggttgggctgagcgggtatgtggaggcctcttcctcccctgaggctgcaagagcgttgctgctattgtgtgtgttttatttttcaaataattttatttatttatttttgtctttgctgggtctttgttgctctgtgggcttttctctagttgcaaagggcagggcttactttgtagttgtggtgtgggtcttcttgttgactcctcttgttgaagagcacaggccctaggtgt

SEQ ID NO: 37890 - DNA, 1767 bp, Bovine  19866881239985
ctaacctatgggtaaaattccttagtgatagaaaaccaattatgttagcaggaatttgaatattactgaactgttaagtggtgtctgagtatcttttgttataaggagattttggacttaatggcttctttgtttgcaacaaaatgtaacacatctacatctcaagagctgaaatgcatactaaataaacttccacggggtaagaccggcataaaatttgaataaagactaagaaaaagaaaaaaaaagaaaaccactaactttggaatttcttgcaggtattctgcaaaggctcactgaccttggaacatctggatgtctcttattgcccccaactatcagatataattattaaagcattggccatttattgtattaatctcacatctctcagtgttgctggctgtccaaaggtatgtgcaggagttagagctcagacatgtcagattgaagtactgccaaagaacacaggcagggtagcaattaggtgttggactcataatagaacttttctttgccatatctgaggtattcatcaagagttctccttccccaaactgtaagtagctttatgatttcatttgtgtaaaagtagtacctggaaaaagttaaagacaattctcatacaaatataaaaatgtgtcaaatatttatttaattcactaatgagagaaccagcaaaatgataagggtcagttcactcagcatttgatcaaactgagcatttacaggaactgaagaaagaatgttggaacatgattgttaggttaaatcccaaatcggttaaagtcctacaaggtaacaaatcaataaccttggagctatagtttctaccagaaataatctgcatctctcttagacaaaaatacaacagggagaatttgagccctaatcgataataaatagtatgtccaaaaagcggcataattccttgtataattttctcagttggacctgttaaaataatgttccagtaaacgtgaaagggtaggcaaccgtcttttgtcttatttttcaagtgtttgacaatttttcttgacgtctgtttttgaaaggaatatatactcattacaaaatctttgtactgcatatattaaaagtatgaaagtaaaaattcaaagtcataccaccatccaggacgtagaattcttttctatgtacagagattacagttaaagaaggtttgtcttgctttttaaagaatagaatcatactttctaaaatgcactgtaacctactttcttttctcttaatatactacagataatatcaccaggtcaagaaatagaggtctctggttctgggttaatttggcatattaaatataccctgataattttgttccctcttgaaacgctaccaaaactgcagaagaaggataagggcccacaatgatagggaaaacagtaggagacaaaagcaacaaaattttggaaacctgaaaatagatgaattaatttagcataccagagacaactttgaatcctaaaccaatagtagagaaagctggggaaagaatggatttacaccataaccttcaacttggcaatactgtatacttctgtaactgggttaagaggatggctaaagtaaggaagactgggttaaaagttcttgagaagtaggtacatcaatagatctccttccctattctatgctttcaggcaactacccctcgtcatcctcaccagatttgagatatatttcctagagccagatttctcaaccgtggcattactgacatttggacaagatcattctttacag

SEQ ID NO: 37891 - DNA, 1347 bp, Bovine  19866881322217
tcctagggagagaggggcaggcaaatggaggggaggggccccctccccccagggtcttgatcctgccaagcctgcagggttgtcgccctgacaacccgaggaggaagcactgaaaccacgttgctctttgcctggtggcgccaggaaaggccagggtgctgggggccaaggaccccttcagataaaccaggagcaacggatgctggcgggactcgggcgtctgtctcctgtgctgacgccgggccagcttggcatttagaaaggtcggctctctctgatcacatcgctccatggtaggggcccagaggtgagctggtggcgacagaggagccagcctgggagtggagctcagtgccgacggtcgacaagttgcacgtacatacccgacttttcttatgctcacatatggccatacatatgtatgggcacaaacaccccccacaggacacagatgcagcccagagatatttaggggctgcatccgatcactctttgaaaagttctcaagttccagaataaactgcgctcatgggccaaacaagttcaatgctattaagtctctgctaaatttaaggcatgagcacaaatgtctatttaaatgttctcaaatgatatttttacaacactgaactagaaatttcaagggactttaaattctcatcctcattcctattcaccccatcaccttttgcaagatcgtgatgaagagttcacaactgtatcgaaaggatgcatgacacggtatattgcaaacactgaactcaaggcaggacctgggaaggtggtggaggaggcccccacgggcctctcggaggccagggctgacccagccctgtgcccctcaggaagactgtcttgtatgggactggagcgcttctcattctgcttagccagtcgttatttaatctaagactatcctggagtattatgtttatcttacattttgcaggcctggtaaatccccattaaccagaatcttagtgaccaggaagcaccccgaacagaaagtgtctgggagctcatccacagactgggcttttcatgagccaagaagaacgatgagaaaatgagggccttcagggccggtcctgggcacagcctgggccctgaacagctctgcccgtgccacctctagctgtgcatccctgggcaagttgctttgcccctctggccggacaacaccctagcaccttctgactgctgtctctaccaagtgcctttggctctctctgggcaggtcatctctctctgtgatcagatcctttttggccaaaacagcctacagaaggtggtgcctctgggctccgcttggccacagggacagggcttgacttagtcatctgctag

SEQ ID NO: 37892 - DNA, 1015 bp, Bovine  19866881373055
ctcagggatgtcagagagagggtcccacgtcagcctatgaccctgaaacacaggagggcagatcaggctgccgttcacctttgacacagagaagctcgttatttctaaagagggctgtcagccataaaccctcaagtcgagggttcctttggagaggagccacatgaaccttgagtgagtcctcacgtttcaattcgggttccgtgtccccagcacgattccacatctgaactcggccgggaagcgttctgggctggtggtcaccctgcggtggcttctgaagctgtcaccactgtcagctggaagggccctgaagctgggcagggtcctcctatgccaaggctcccattgcccctccagctccgtctccaccctgtgcctccctggcacccctcttcctctgctctttgatttctgccctcactcaaccacgtttccatgcgccaggccatgaccttactgctcccccaaccttctccttccctctcccatcttccatacttgtctttctagtcacttggaatttcctggcttggcgcgggctcaaagcctaaactatggacataatgaaaagtggtgcatcagaccagccgccagttaaataatgtttgggttcttgtcagaatgtcacagagtaccctgtcattttgtttcagcaacttgtccttctgaatgcacagttcgccttatggcatgccagcagtaaaaatgtcacttacaataattactttttggtgaagaatgcttgctgacttcctaccttcaagctgttttttacacagtggggagataataagaaatgactttatcctgactgctcaaatgaacactaaatggaatttgggttattattactgcagatagagggctgggtatggaaatttaaacagtggatcgtgtaaactgcagagagatttgtctctgaaaattatggcgggtgtgcattttcaattggcttccattgaaaacttaaggcagctgttgtttgcctgctgttttggaatataatattttt

SEQ ID NO: 37893 - DNA, 758 bp, Bovine  19866881495873
gttcctgggaactggagggacctcctcacatagtacacagcaagtcagggacagagctgggatggacattggtctcccacctccaagctctgaagtggggtgagctctgctctggccacccttccgcccagcacacccaccagatctgtggtttttacatttttcaccttgacctatagtaagaaatacatttgacatggtgacccagtacacacacctaggtaaaaatatctctgaaacacacgtttcaccagataatatttactctgactgtgtgtgatagagtgtgacactttctattctagttcattaaaaaaaaaaaaaaatgctcgtctcctccttcagattagatttaccacaatacagggttggagaccctgatgcagaatgggattcctggaattgggcagggccgtgttgccaggtggaagaaaagaggccagtgtgggatttgacagaggtaagctggcaggactctctgggagggccgctctgtgcctgcccccctactctgccccagagttcctggccctggcctgaaggcccccgggctggcttgagactgagattcctggcagagcttgagctctgggacagggactttcttaggaggaaagggaagggccccacgttgagtgggcaggcgggtgggggttcctggcagcactggctgccatccagcaggcgtccggctgggcttggggtggtgactgcgggcttgctgaccacggcaggcccttgtgccagccagccaggcg

SEQ ID NO: 37894 - DNA, 850 bp, Bovine  19866881545257
cgggatgtgtgcgtgccagtcttagttgtgtctgagtctttgtgacgccatggactgtagcccatcaggctcctctgcccactggattctccaggcaagaacattggagtgggttgccatgtcctcctccaggggatcttcccgacccagggactgaacctgtgtctcttatgtctcctgcactggcaggcgggttctttactattaccaccacctgggagccccgtttagaggatactgtgtgcctattctgtgtgggacacagtgctgggggtactttccacaaagcaatgtgacgactaagaatcagatgagagggccccttggctggaagccttctccagagcaagtggctcaacccattagaaggtggaggcacagactttgctgcagggttaacatgttggtataaactctgctgcataacagctgtcacgggagcagtgtagagacttaagagatggatgaaggaaaagaaaaagcatcaccatggggtgcctgggatgcagggaccgtatcagagactttcgcaaggaaatcacacctgggactgcttatgtatacctcgtggcatcagaaaaagcatcaacctgacttagagagaagcctcttccgtgaggaccgaaagggctatgctcttgtgattttatgtctgaagccatcaaacatcctacctggtttgctctttcaaggtccgtcatgatcatttcaatttcgtcggccctggggaggtgagagggagagagcaggttagtcgatgggcgaggcaggctcaggggccaccactgttcccaacttggcagcatggcccatgggcacgcaggccaggccagtgtccggggcgggaggc

SEQ ID NO: 37895 - DNA, 645 bp, Bovine  19866880362183
cagaaaaaacaacagcagatggaccacaatatttaaaaatgttttctacctggtcctttatagaaaaggtttacacagctttcgtgtagagtatattatgtaaaattcttattcttgggttgacatgatgaatacatgccatctctctccttacgaatagatgtgaagtgtcaggatgattaccgaaaattcacacgtgatatgttaaccagtaagtcttatcaagtacatgctgttgctactataatttacactattattgttactggtgaatgttattggacatttatggtgtgccaagcactctgtatgtagtatcttatttataccaaaaaagaaccttgggaggtaggtactattcaaatttcaatttttgaaatgctgacattgaagtgaatttgtccaaacttactcacaggattaggtagggcaagagttggaaacagatctattcaactctgtcactcacattttaaacaactgtattcactgcacaccaccagaaactagggcaatagtagactcagtactactgcatcgagcttctaaccacgttgcaggcaaaacattcacaccatgaacacctggacagtgtttgtggtggggtgcgggccctcaaacctttacatgtgttatctcattcaa

SEQ ID NO: 37896 - DNA, 1937 bp, Bovine  19866880608404
tagcagaccctctgtaactggagttttatgtcatctaatgtggcacctcaaaccctcatgtatatgttacaattgtactctgggggattcagcaattctgcttattgaacatgaggctacatgcctatgaatgtaattaatgactaacatgattgttttgttcttatttagaaaatacgcaggttcttaataatcgcagtctataataagtcaaaaataagtcaaaggcatataaagtgacacaggaatcccttgtaacattacagactggattaaaaatatccaaacatggtactcagtatttctctctctctctctctcttttttttttttttttggtttttctacagattgctgcaaattcctggggaaagtcctggggagagaatggctattttaggattcttcgtggagtaaatgagtctgacattgaaaagttgattatcgcagcttggggccagctgacaagtgcagatgaaccatagcatatcattaaatttccatcaggccaagcattcaagtcaccctttaaattggaattaagccatgtgaggttctctgtgacagtgcaatctttgccttgtcaccttgttatcacaaccttcttgttttcttgtttcaccccaggccctaagctcccatttcctttatgtcaccgaatatgtaaaaccactaacagaggactgcagagggactaaatgccttttaaattccctggtagtcttcatttcccttgcatgacaatgttccttttgactttgatcatttgcaaacagtgtgatggcatttgttttaaaagttcatagcatttgtttgtggaaatgatctggtctctgtctttgaacaatgaggatgtcagacaacaaaaagcactgaaaacaccagtttgcaatcatttgcaatttttttccacccaataatgctttcttaattccgacattgcttatgatttgctaaaaagcagtggaaatatattgtttctctcagtaagctgacattttggttcttttcattcttctaaactgaacttgcaatctaactcaaagggagagtcactatcataggaaagaactactctttaccctacaatgtaattgcttatgatgcggggaagatggtaagtaacaaaaacacttagatgctggcaatggaagtaccgtcttaatgtgtatgtaggacacacactcctgtttttggaaaccagtgcacttggtggaaagtctattaaaatgagctgcaaagctgtattgggtgagatcacatatttaccccccaaaacagctcagatgtcacaaatttgcatctgatttcagttctcaatagtcagagaaacaaaaatagcctccgcatccttgttgggaaaggatgcaatcttctaataattcactgacatcttaaatgacaaattaataaataaagaagcgaagctgatctgtcagtgagcctggcagattataatgacgatggtgggacacccatgcccttcacttctgggctctctgttgtctggatttccagtgtagagctcttttatgtggtcgcacccaataataccctggctaaatgagccagatgtgtggaaaatgtgagaaaacagagtacgaaaatgtgaagtgctgctgcaatggttgttttctccattaatctctgctgtgttatcagaagaagcatctattcacttagttctcccctagaaaccatacaggaatctcattcaccttgttgtggttggttgatacatatatgtgtatgtacatatgtgtgtatgtacaaatgctgtgctgctgctaagtcgcttcagtcgtgtctgactctgtgtgaccccatagacggcagcccaccaggctcccccgtccctgggattctccaggcaagaacactggagtgggttgccatttccttctccaatgcatgaaggtgaaaagtgaaagtgaagt

SEQ ID NO: 37897 - DNA, 2182 bp, Bovine  19866880632635
tctaaatgaccctgtatagtctacctgggttttcttggcattgctgaaaaaagaaaaaaaaaaaaaaaaaaaaacactttatctgttttgttgttgtgaaggaagggtctgaacttcagacccagtcttgggaaagttcactccccctgacctggaatacctgaagttcatatgaatgcaatatatgtaaggaacaatttggaaatccatgctgcaggtcatttgagtgtattatgggagctaatattttctttcatcttttcaagttcttctctgcatgaccaaacaagtgatctgggtgtgatgctgataattatttctggagtttagagccaagacagagagacatgtgatattgaaacctgactttcttctctgcttctaaaagaatgagagagaggtgccaatttcactaagatttagcccaaggagtcttgcaaaacaacacattacagatgtctgcttttttaaaagagcatcacttgtagaatgtgctttcaagttgatgtcagtagtttcataaatttaggaaaactaagcttattttctctgaagccttatggaaatttgacattggaaatgtttagaagataatatttttaggtcatcagagtatttgttctgaacatttctcaaggaaaaatgattgtccattgttgaatatctttattatctatatgtctttgctttggttgaaatttgtgtcaggtattttcatcacaagattttccatacctctatcctgatgctgctgctgctgctaagtcacttcagtcatgtctgactctgtgcgaccccatagccggcagcccaccaggctcccccgtccctgggattctccaggcaagaacactggagtgggttgccataacctctatcctaggaatgagtaaattttatatgtggatgacaaagtgtcttgttattaatactacttttatgtatacattaaactatgtcaagttatcaatccacaatgcaattctactttctcccctttcctctcattttaaaattgaacttggcatattaatagaaaacagcagctacactaaactccttagaaagcttttcatacctcttgaaccaaaaccctgctttctccaagctgagggtggtgagtgtggctggcattaagtcaatgtattgcaagctgaagttctttttccaaaacacaaacctagtatggaaagctgtggctaagacttcaggactccgctctaccgaggtgcctcaaaccatagtcatggggagccttcttcagcagtcatgagtttctgctgttacagaatcttcagactttcatctgtgattgtcacaacgttatttctattggttacacacaggggcccttcaaacacacaagcaaaatgagttgcagcatttttgcccagactactgcggacagaacatcgctgaactacaacacttttgattcccactgactcagatcagaatatatattggcaacctgtttcagccttaaggtctcaataccaggccatcatccaatcccaacctactactcattatgaagaataacctggtgagggaattatataacactgaaaataaagcctattttaaaactgtttaaacaagtatttgcatgagagattcttgacccagaaggttattcactctgttgtaggctcattcctttgagggagagacaagcatcattaggcagaatctgtaaagacatgtttagaattctatctcaaattcgtcaggatgagtcttcccccaatttcatctagttattcttctattctggaatgttccatccagttctgagggagcttacctgctttgtccacttgctgccaggaaattgcaaatgaaactgaaaacattgctccgaagactccatgtaaaaaaaaaaaaaaaagaacatccttggttcactatattagtatgctcagttcataaactgtaggtcgtgtccttttcattaatatttctaaagagcatggacaaaggtgtcatgatttatataatcacattgacgaaaaattgcagagctgagtagatttgagacttttagagttggaaatatatgttaaaaatctctggggaagctttaggtcttaatttattatttgtatgaccttggggagtcacataacctctctaagttaaatttttctcttccatcatgggtaatttataataagtttca

SEQ ID NO: 37898 - DNA, 772 bp, Bovine  19866880813927
tgcttttataagaagaatataatctttatagcatttcaaggattcatagatttgtatttattaattttatttttgccagttgtcacttacaagttgttcagaaagatgttttcttttctttttcttttgcaaatttgattatttgagaagtttcctatgagaaaatccagttgtaggtagtaccttgtgccctaagaggatcttatttttatttattggctctttgttaacctccttctatttatgttactgtatggttgacataattatatttggttcaactttataaagtctgatagtgtctagcaagacttttcccaggtaattatttggctctcaagaagtgttcccaagatgatatctgcatttattcctaattaccatgaatacctcttatgaaaatgtctcctctaattactttgaaaagtcatctttcattaaagtcacttttcttctagccactcagtggtagatatccataaagtcatcatttttgatcatcttgaatatgtaaatgtttaagcagatactgctggtttttgtttcctaattctagcctagtgtcttctgtgggatgtgactcttactcttgtgaaatatggagaagtcacataagcaaaaatctagtgagaattaggccagcgtgatccccaaggtgctcagacctgcatctcctgagttaagtcttggttgctccctgagtcaccgttcctgggtgtgtctgttaggcctcaggatccttaatacaacagaaactaagtaccgggggccc

SEQ ID NO: 37899 - DNA, 1462 bp, Bovine  19866880837565
aactggcagcctgagggtcaaatcttgccaactatctggttttataagtaaagttttattggaatgtagctacatccattcatttatatattgtctaaggctgcttcccctggaggaggaaatggcaacccactccagtattcttgcctggagaattccatggacagaggaacctggtgggctgtacagtccatggggtcgcaaagagtcagacacgactgagcgactaatgcaacacaaggctgcttccatattaaaaaaacagatctgagtagctgtgtcagaaaccacgtgaccagcaaagtctaagatgtttgttctctggcatttggcagaaaagtttgcccacctggatgtaatcttaaaattcttcttcctcctgggtatacactctggagaaactctcataaacactttccaggagacaactaggaaaatgtttacagtaaaacaatctgtaatagcaaaatcctggaaactgtctacatatcatcaaacaggagaactgatcaaatgtggtgtatgcctacagtacatattatacagcagtgaagatgaatagcagttggagaggttagcatgggtgagtctcttgtaatgttgaataacaaagcgtcataaaaatacatgcaatatagctccatttgtagaaaagatcaaacaataagtgtgggaacacacgttcactaaatgtgtaaaggaaaaacaaggacatgataaacaacaaattcacaacagtggacttctataaggtgaaaagaacggagggatggcctgggaggtacatatgaaagcttcaacagagtgggggattgttctattatacaaagaaggggtgtccatgggggatgtattattgggtgtattttttatttttatttaaaaaataattccattcattatttctagctgtgctgggtttttgttgttgcacaggcttttctctagttgctgtgggcaggggctactctctagttgcgggcttctcattgcagtggcttctctagttgaggagcatgggctctagggtaccgacttcagcagacttcagcagttgcggtacgagggctcagtagttgtggctccaaggttctaaagcacgggctcagtagttgtggtgcacagacttagctactccgtggcatgtgggatcttcccaaatcagggatcaaacccatgtctcctgcattggcaggtgaattcttcaccattgagacaccagggaacccctgtgtatattctattttagtatctctgatatcaggatggtttttatattgctgtcagccaggtggcagtaactaccttaaaaatattttaaccaatgtatttcacgtatgtttcccttttaatatatgtgcaagagataacaaaatatctaagtctggaaaataatctttcaataagtataaaatttaaaaaatctaagtgacatactcactatccaggaacacaggaaagg

SEQ ID NO: 37900 - DNA, 1019 bp, Bovine  19866880838917
tagagatatatggaatctgttacattctttgaaatttctaaatgttagtttattagggaacaaagtgtttgtccttgtctgactttctcaaggattttaaacctcattaaaagaactatccaatgctttgctctaaacaagttttaaatattctttttgacaatgtgactcagagaattcagtcagtttagaaattctacagactctagaactcctctttgtaagactcactaaatctttactcttgtgcatctgacaacattttttcagttctagctcttatataattcaacacttcagtcttatgtgaactcatgccaattcatcccacacatatttactgacaacctaccatgtatctgggactgcgtgagcaactagggatgaactgtcctaatacttgagtctggaactgaatttccatgggccttccctcatggctgagtgggtgaagaatctgggagacacagtagatgtgagtttgatctgtggattgggaaaaagccctggaaaagggaatggcaatccactccagtatatttgcctgggaaatcccatggagacaggaacctggctggctcctccatgggttcagaaacagtcagatatgactaagcagctagctcaaggattaaatttttgaaagaattactcattccaattcttatcacattctcttctgctaccttttattcttcaacattcttcaaaaagaacttaaaataattaatattagatgctaatcagtcagtctagtatgaggaaataaacagcaaatggtaattacagacgcagaatcaaatgccagtaacttaagttcacatagagataaaaataattatgtatgtaaatatagaagagagtataaatgtatttttgtttgaaattattttcttctcctattgggcttgagataacattgtaaagcaataattataaaactgtgaatctttagcttatcatgtatgaagatgtaattcaaatgaaggagggaatgaagctatatggaacaaagtttt

SEQ ID NO: 37901 - DNA, 1142 bp, Bovine  19866881127044
ctttattatttctgaatttctacaaatttatgacaatattgatatttgaattcatttgttcttggcaaaaagatgactctcagtttctgaagatggcttctaaattctccaaggctgggaacgtttcttgggtattaaatagctgttataaatcatggataaattaattacaaacgtgttaggcacaataatattgaacttcactcccagtgcacattgttttcatgaagataaaggaaaatatacttataagatgtaatctgaatgtatataaacttgaatgacaacatcagaatgacaaacttcagagataactttggacacaaattgtgaggacagctattactattttaatactagcgcaataatagatgtttttgcacttgatataaataataataatcaattgtatttcaaaaaatctgggcagccattaacatttagaaagctttgcaattccagttaattttacaacagaagacttttctacttcctacaagttacaagtcaaaaaaaaaaattctgttaggttatgtacattagctttcaaatggcatggagcaaaattatagatttcttttcagaaacaatatatgtaaacacagaaaatactgtcaatttaagtctactctgttacattacgtacatagtaaatgaagtgcaaaggcgtgaaaaatacttacctccccaaattcaagggggtctcttttctagagaactattgcaattaaagagggagtgaattactctgtccactttgccacatatttctataatctcaaaatttctttgtaagttttggagttataatgctttttaagtttttcatgaaatgtatttctagaattgttgtatgccacatgtgtaacatcatgtcacgtgtttaacagttattttatacatttaaagcgtcttcatgaagaaatttcttatccaatctgatgtgattgtgtcccaactaccatgaatgatgctgcttaggtagtttttaagtaaaaaccatactgagaattctataatcacattcacaccatcctctccattgtatgaaagatattggttgttggtcattagataagttggatattcactcataactactgtcaaatctctgcagttaaggattgaattaagccctctgg

SEQ ID NO: 37902 - DNA, 2330 bp, Bovine  19866881153438
ttgtaccgcatttttaagattcccaaataggtgatatcatatatttgtgtctgtctgacttaaagttcatatacaaaagacacaatgaagaaactgtggtacatccatacaattaataccatgtagccattaaaataatttgtggtagaatagctagtaaaatgaaaagatattcaagaagctacagtgaaaaagtcagctcacaaaagaatgtatgtgctgtgcgtgtgctaaattgtttcagtcgtgcccgactctttgcaaccatatggactgtagcccaccaggttcctctgtccatgggattctccaggaaaggaatactggaatgggttgccatttccttctccatgtctttagaaactttagttaaagaatgaatttagttaaaggaatgagaaaatacaaaaagaaaggaaaacagtgaagcaagacaaaataatactttatgccattaaacaaaatccatggaaagcaagggagatcgaaccagtcaatcttaaagggaagtcaaccctgaatactcactgaaaagacctgatgttgaagcttgaagttctaatattttggccacctgatgagaagagctgactcattggaaaagaccctggatgctgggaaagattgggggcaagagaagaaaggggtgacacgggatgggacggttagatggcatcaccgattcaatggacatgaactagggcaaactccaggagatggtgagggacagggaagcttggcatgctgcagtccgtggggctgtgaagagttgggcatgacttggtgactgaccaacaatgtactcagacgaactgaaaaatggtttctactgcattgctattttcagctcacggaagacatagctggcaattgaagttaagttagcaatgagacagccataagtaagcagatgtatcctccggaatatctctaagagtaaaagttttaaactacaccttggtagatctaacatgatacatctacgaaaatgttgataaataaatagaaatagaagcatagaagtaatgtaatattaggagatagaacttgataaaaaatatcttttaccaacaaaattcaagtagaatataaaagcttccagagcaaaaaacaacaacaacaaaaaaacctgtttcttagaaacaaatgataattgatttgttgttaagcttttcatcagtggcgtttcacattatgaggcaaaggacggatgcctttaaaagtgtgaaagaaatggaacattatttgatctttaaaaggaaattctgacacctgctctgacatggattaatcttgaaattgtcatactcagtgaaatatgctagtcacaagggaacagatacagtatgatctcacctagatgaggaactagagcagacaaattcacagagacagaaagcaaaatggggcattttatgggtctgggaggggggaattgggggttacataggtgcagtattaaaattttgcgacatgaagacattctgaatatggataatggtgatagttgcttaacaatgtgcctgtgcttaatgccactgaactgtataaatgcttaaaatggtaaatattttttattccccctcaagacagtaaattttgcatcatttatattttaccaccattaaaaaaataaaataaaataaaaatctgaggaaaaaacaaacaaaaaatttatcatgaaacttgaagacatgaattaattgtcactctcctcctgaaatatctaagtttagtgaatcatagaacccaaggaattatacgagacatattactgcaaacaaatctgttcagaataatcaggaataaataactcatctgtgatgcagcagatgtctggggcatcctctatgacactcatttttaccaaaaataaactttgaagctgctggacttgcttccagttccccaaagaagagcccagtgaagaactgcattgattttttttttttttaagagcctgttgtagagtcagatcaatgtcaggaagaataaaaactgatctcaccttgaatgtcaaggaaagcattagtcctgaaataaataggccttataaacatccttaacacccataggcatttttcttactaaatatgggtctaaatatatgaagccaactcaagtattaatgatgagaatacttgctttgtcagccaaggatggagtgttatgttctgaactacttactcttcctgaaattcttacggtatatttatcccagttggtttattctattctgtttctgctagtgattgactttttggctcaatattaaaatatacaataggcttttttggtttttctgttacgccaggcagtctggcagaaaa

SEQ ID NO: 37903 - DNA, 1363 bp, Bovine  19866881167197
ttacacctctgcacaatttttgagggttgggcggggggagtgcagtggcgagatggtggctgtggtgatggagtttattagggcagctggaagccgacttttttaaaaaagcagctttggaagggagggtggactacacatgaattgtgaatggaaggagcgtctaccttgatgaatggagagagactggaggtgtttaagtgcagagggcagtgtggagggaatctctgtggaaaatgacaagagagaagctaagctaggagaagatgctcttgattacaaaaaggcggagaaggtgagtgaggtggaataggctgggaggcactgaaatccaaaacatagactttgtaactgcaatggaggctgataagagacttactaggctctcagcaccagcttgattttaaccttctctccccaagggtgtcagtctggtaagaagcatccaatgtagtccctcacctactcaggggcagagtagctgataggtgactgaaaggcattcctcagagctggtagattattatttgataagaaagataagaaccccctgaaaactttagttgaccccgtctacatgttctttcagcctgttttaattttgctgctgtttttaaaggcaaacataaaggaaatcttttgaggatgcaagttaggtggatggaagtggaaatacacattattagggctatctgttgtaaggataaatctgttaatcataatgctatgcttttcttgtttcccttcttattatctatccttaaaactacaacaattaggatatatggctactagcagagcaacattttactgcattatgctaacacttaatgataagtgaataatcaaaattgaacatctattgagtacctactgtgtgccagacaccttcacatatactgtctcacttaaagctaagagtaacctgcatttgacagaagaagcaagacttagagaaatgaaatgagtttttaaggaacttgattcagatttggtttcattccttctgacctcggtccagaattctccactgttattctactctagatttagaaaccatatagagaatgaattctttgctcctggtatctgcaaacttattgaatgcatttcctgttctcctctgcatttaagtccactattaataaattaccatgaagggttaattattctgtcattctctccaacagaaacccacccggagaggaactttattgcattgcagtaaaattttgacgttttgcagaatggctacaaatcacaactaattttctttcaggcttaacctctgtggtaaaatttgctcctttttgctgttatgttactctagcttgcacagacctgtgatgcattatctttgtat

SEQ ID NO: 37904 - DNA, 789 bp, Bovine  19866881187892
tgtcctttatcgagccgacccaaagggatggtatggggagggaggagggaggagggttcaaggatgggaacacatgtatacctgtgacagattcattttaatatatggcaaaaccaatgcaatattgtaaagttaaattaaattaagttaaaaaaaaataaagccagagccgctcaaaaaaaaaaagaaagaaaataaatgttcccttggtatctctaattttcttgaagagatctctaatctttcccattctgttgtttagaaataacagaactttagaaatatgttaatgtctgagatttcagttaaatagctgagcaaaaatcaaagcttttgactgagtgtacatgcattattgattacacctacatctgtttttaatcaaatattctaagagaatcacacagcacttcaaatactgattggcccataatttaatgcttctgcttgtagcatcaaatataaccttaattttaaaatgttgtacaaattatatatttgaaatttcaaagtgcttgtagctaaataaatgctatctttttctacccaagaagattggaacagagaacctaaaaaattcactgtgaaatgtatgatcttgttttagaaaaagagttaccttctaaattttcttgattaagaaaatattaagttttgcattgcattgcctgaatatgcagtttctggagaagtcatgcatctcatttgcattgactaagtggtctatgtgacagaatttcatttagcttcatgaaacagaaaaacagcttgaagtatttaaccaagtgt

SEQ ID NO: 37905 - DNA, 1426 bp, Bovine  19866881240383
ggcactttttaaactttgactaacaaaatttaaatataagttttcagtgttttaatttatggtaacaaaattagacatgtatggagagagaaatacacttaaaaaatttttttattggaatatagttgctttacaatgctatgttagtttctgctgtacaatgaactgaatcatcaatatgtatacatatatcccctcttttccaggtttccttcccatttcagtcaccacagagcactgagcagagtctcctgtgctatgtagtaggctctcgttagttatctattttatacataatagtgtaagtaagaagaaaagcgaggaaaaaatattcatataaaagtatacagtggaccatcttcattttaatgagtaacaaaattaaaagaaactcccattttcatgactataagtgtcagggttgttgatttctaaacaaatgtctacttcctggcttttcagttagacatgcatgaccctgttacagcatgttttataaagtattgtttgaacaacaacaataacatgaatgaaaggaaaagaagaaaaagtaaagatcgcagccattacgggagattgccaagacttgcaaaattgtgagctggtgaatgataaaccaaagacaagccaacgtgagcaattttgacgagacttccctttagtaaatgctgcctcatcttaggcaagtttgtccatttaatcatgcattctgttctcgtggctctaaatttaaccacacagcatatttctgatggatgttccttaagcacatcacatttaacctgttccaaatggaactcataatttcctcacctccactctgctcttcctactgattaatttctccatctttgttaattgtccaccctcttccatagaacagatgtgtcctaacccattttgcatatcaaattatttcctttttacttcaaagagctattctgacggaaacatttggcctcagcatataattaaaaacttaacaatactaatagctgttttaaagagcatcttctctttgtcagtgtgcaagtatttacaataatttgcatgtaattcactttcatatccattcaccagggtatgaatattacttagtcaaatagacaattaattaatataatctttacatagtcacttattaaaatgcactacacaactgctgtttacttgggacttctcactggatccatgggcatgtgaatattgaacaactgccggctgtttataacattggtcttcttgtctaaaggagccaggtacacattaaaaaaaaaatttttttttctctgaattgagaataaaagtctcacattcttcaatgtgttattgataaagatgtccccttaccttattcagtgtgaaccctaaaactaggaaatgtttattgatcattgattacaggttaagtttatctaatgagtaa

SEQ ID NO: 37906 - DNA, 1596 bp, Bovine  19866881342659
agcatagcatgaaaagtgataggggtgggggaaaataagtcagagtaggggcagaaaacatgtttgaaaattttatttaagagttcaaagaagaaagttaaagcctggagaactaataattctcagtcaaaattttaaaggatatgagttttacaagcaaaaattaaaatgtaaaagttcactatgtagtattacaggatttggtcactcggagcttgtgaattcagtctgtgagtgctgtttcacagcatatttaactcacaatgtagatgaaaatgtacggtgtcctgcaccttatagtccatgactgctgagaattcagggtctaaatatttattatatctattcttttccattggaaccatagcgacttcctcagtaaatggctaattataacttgataaacattataaatgaacattataggtgtcacttttttgcaatgacaagttccattgttttgcagccatcagacaaatggcccttgagatctcatctacatttcatttttctgtcgagatctagttcaacttgctgtatgaagtggaaacaactttcttagacaataagttcttttgtattcttaaaccattttggattaaacacttcaatttctttatctttttttctaaaataactttctttaacaataaaatagccgaacacttttcaggttttcttcattcgaagttctgtagtatttagatctagatgtaaacaagtactaagatttaacaaacataaacttaataaatgatttgtttttataggtggtatttgcactaatatctctaataatactatttacaatgaagtcaacaacagaaaggaacttgagatccttgcaacctcattactattggtttatagaccagcagtagtaattacctaatacagaaacgtcaaaatatttttcaaaatatataatatgaatttaaaaagagttcttgcatgaatttaaatgaaatccctgtaaatgaattaaaatgaatttataatgtctaatataagttaacaaaaaaatgagttaggggaattatttctcctggattgatctattccagaatgtggagggggcaagtattgcaggaatgacatcagaacattttcccatcaactaccatagtgactgacatctattacttctttgtaagtttctacttaatatgaatgtgtgcaagatatacggaagcagatgaaaatctaaactgcaatacatagttttgtattttttcacaaaatgaacaattgtatgttaaaacatgtaacttatttttgtaaacaaaacttaccttcaataagtatatattgaaagaatgaattaatgagtacaaattcaggcaaaaactcaagtgtggctcagtcatctcagtgtcaccatccaaagaaacatctcaaaggattcctttctagttcatgcctagccagccagcccaaggtccatactacctagtagcctgtgtacttgccctgtttcagaaccagctcactgcttacccaccttcagaaggtatgcctggaatgacaggaaattcacttctgcacagcatcttttattgggggttgagtcagtgaggaagaatcggtcttttaata

SEQ ID NO: 37907 - DNA, 677 bp, Bovine  19866881426704
gaagcccatttctcacctttattcagtgaattctcattattgacatttattgtgccttttctttttgctatcataaataataatgtgatgaccttccttatatgagagtcttggttgaaaggaaagatattccaataatgaaaatgtgaagtagaagaaaaaataaattcatacatggaaagagttggcttgagaaaatatgtgaaacagcagcaacctaggcatgatcaacatactctatgaagttgggtttatcagaccagggtcccctgggagagaagttcgccatcaggccacagtggtgagaccgggtttgtcctgtgagcctgagggctgcagagtctgtattcacttgagagttggtagattgaaagtttccctccagacattttttttttccacctgcctctcagtaacatctagcatgatacttctgattttttagcgtgattgccagggaggtttagatatacaaaaatatttatgaaaatagtactattataaaagatttggtttctaaaaaaacaagattatttactaggtttttgcaaaaaaattgcagtgacctcatttcggtctggaatggtgaatagtgaaattttgacctttaacgagctgagaaccagctgaaagaaagggccaaaaatagatctaataccatcattgacgctgacagg

SEQ ID NO: 37908 - DNA, 1497 bp, Bovine  19866881580633
aaaatgcatttaatgaaaacataacttaatttccaaaagtgattttaggtgtaataaaataatggtatcacatacaatcaagaaaaatgttaaaaatgtttgcttacactaatattctcatagaatattactatctatcatacatctatctacactaacagtgaaaccaaataacattttaaccagctagggaacactttttttttttaagtaatccatgtaaaaatgccagatgtctccatggtgggtacccagctttacctgattccagtgccaaggcactgaatattctaccttattaccttggagtgatttgtactcaattttctaagcatgacttaactgagcttccctataaaataaaatattttaatgagagtgatggagtctgctgctatagacctttgagaagctctgtgatggattctgaaacatacactcttgcatgcacctcaccttggcatcaacactttctaagattaactggtacagagttgatacttttcctctacaaggaatcctggatttcatgacctctccaaagtgtgtagtgcagggtctagaacatgatggacacatgtacacccctggttgattcatgtcaatgtatggcaaaaaccactacaatattgtaaagtaattagcttccgattaaaataaattaatttttaaaatgtcacctcattcccctccattttaaagtgtcttgtacttaatgtgtataatgctttaatatacagatacatgtctctttttatataatttctatcttttatatattaattcagggattaaggactgtgtatcttctatttcttttcaccgtgtgcaaatagtctcttaatgaatactttatagaggagatggaaatattacacaatattagttgtcaagatgaaaagacaaattctgtcatttgctcaagcagattttgccttagggagatttccagtatttttattaaattatcgttaatgtaattcagatggaaaaaaaaactcccaatgaaaaacaacttcttcagtgagagtgttaagactttatcatatatctttcctgcaaaagtgcttatatctggagcaaagcagaacggttaggttttaaaatacaacttatgtccctgtacaagaatcctcaatttgtgacaggtcttaaaactcctctatttgaaaaggccaaagaaggtgatataaatactatttttttcaattaattttgctcaatacagatatatacactggaaagtgagattatattttgtcaattataagtgtttagggatttataggaaattatgttttttcatatgtataagctccagaaagtagtgaaaaaaatgtttgcttggaagaaatgttacctacttttttagaaacaaaacttcaccataaacatgtttaagtgccagagaatattcacaaaggtttgatatatattaggccataaaagtaaatgtaatacattctatatgcagaaaatcacacaggaccacattct

SEQ ID NO: 37909 - DNA, 970 bp, Bovine  19866881936278
aaggtggctgtcatggcttttggctgaaagctgcaagtcggctcatgaacaacctcaacagtcagacaggggagagagtcaggcagaacgcaacacctaatattctagacttggcagcacgcagggggacaggtggctgaaaccttccatgctgaagagcagtctgaaaggtgacattgaacgtggtaatagaggaaggtttaacagtccaactctccaatttagaaatgcggctgagaaccaaatgttccatagggcagggatcaaaattctcagctaaggagatttgtatgtagaaaagggcattgctataagtatcagggggtttactgcctaccatgccagaaggaagggaatggaggcagtgtcagattctctggggatgaaatgaatctagggtgcatgcctctgctagcatcccagaagtgtggtcatgaaaatataaatgtgggggtctctatggcacctgactccagtactcttgcctggaaaatcccatggatgggggagcctggtaggctgcagtccatggggtcgctaagagtcggacatgactgagcgacttcactttcacttttcactttcatggattggagaaggaagaggcaacccactccagtgttcttgcctggagaatcccagggacagaggagccctggtgagctgccgtcaatggggtcgcacagagttggacacgactgaagtgacttagcttagcttagactatagcactgacaacagcagtttataatatagggaaaatgtccagattctaggacactggtagggatcatctcctggtctccatgttggtgattctgctattcagggactttgaaaagatagctaaggaaactaaaaaaaagaaagctaaagaattggcaccagtgacccaagagagaaaggagggatggggcagaacacagaagtcaaggaaacagactctaatggccaagccatgcagtgtctc

SEQ ID NO: 37910 - DNA, 886 bp, Bovine  19866881943955
tcttgtatgtcatttaaaagaaagacctatcattgtattattgtgtataagtaaaagaaaaatttccagttcagactatgaacatatatgttcttacctttgatgataagatttcccttatcaatggaaaaatgccaaaacaaaatcagtgtatctttattcaaagaatgtcatataaatcaaaacacttggcataaaaaaagaggcagcttcccaagttgtgctagtggtaaagagcccacctgccaatgcctaagaagacttgagttcaaatccaggatcccctggaactattcttgcctggagaattccatgaacagaggagcctagtgggctacagtccatggggttgcaaagagttggactcgaaaagcaacttagcactcagtcatagtacactttttatatttaatgggaaataggtaattctttttattgatacatttctaatattatttgtagccgattttttttcatttttttaatagaaagcacttgaatgaaacgtcttttgacaactttgaatctggttatctgtgtgcctacccttctgaaacagtacaaatattgagagacatccatgtaacagctggcgcttccctgtgctaccttccttctttctttagaccgtgtcggtgtctgtctctgtcctcacgctgagctgcattgccttggaccggtggtatgctatctgtcaccctctgatgtttaagagcacagccaagcgggcccggaacagcatcgtcatcatctggatcgtgtcctgcgtcataatgatccctcaggccattgtcatggagtgcagcaccatgctgcccggcttagccaataaaaccgctctctttaccgtctgtgatgagcgctggggaggcaagtccagtgtggt

SEQ ID NO: 37911 - DNA, 2798 bp, Bovine  19866880395902
cctgggataggatgcctgctagagcacagaaacagacacgacctagcagccccaggctctgctgatcacaaaggctttctgagcaatggcccttcaaagaaacaaatcaagacagacagcctgccaaaaacatgccgacccagcagactcagaatcccttacccactgagaaacagccctcccagcccatccatcacttagacaactcaaattagtgagaacatcaaagaagtagcgaatgcttccgtggctgtgggaaagctctcctgggcaaccttgccccgtgcactcccctccctacctctcagggagcctgaggaataaataccttcctcctcctgtcagatttctatccatcctccaagacccagatccaatgccacccattagtgatgccttcgctcatctccgaatggcttattgttaggtcaagtgtaggttttgatgttgttctgggcaagagtccctgcactgcccaagttctaatcttccgatccctttaccctgaagaggtccatgcaaggagaagctttatggggaacaaacaacccctgtgtaccccaggctctaatgcagagctctctaaatgagcataattgaattacaaaactgagctcaaaactcaaattgggcttccatctcctcccagagctagcatccaagtcctggggtcttagcccctctcaacatggcaaggatgagtgctcagatgtgtggaagggaggaaattttgtcagtctcaagcaggttccgagttcactcatcaatcctgctacatgggaggggtgggcaggagaggggagagattgattgattgattattgcttattttttcaaatcaattgatagcactcataaagatagaactatcatatgacccagatcttccacttctgggtattaccttaagaatttaaaaatagtaatgcaatatatatatatatatatatatatatataatatataacaaagcatatatatatatatatatatatatatatatatatatatatatatggtttcctatgttcattgcagctttatttacaacagccaagatatggaaatagcctaattatccattgatagatgaatggataaagatgtggtatatcagttcagttcagttcagttactcagttgtgtccacctatttgcgaccccatgaactacagcatgctaggcttccctgtccatcaccaactcccagagcttactcaaactcatgtccattgaatcagtgatgccatccaaccatctcatcctctgtcatccccttctcctcctgccttcaatcttccccagcatcagggtcttttccaatgagtaggttctttgtatcagggggccagagtattggagtttcagcttcagcatcagtccttccaatgaatattcaagactgatttcctttaggatgcactggtttggtttccttgcagtccaagggactctcaagagtcttctccaacaccacagtttaaaagcatcaattttttggtgctcagctttccttataatccaattttcacatccatatatgactactggaaaaaccatagctttgactagttggacctttgctggcaaagtaatgtctctgctttttaatatgcagtctaggctggtcataacttttcttccaaggagcaagtgtctcttaatttcatggctgcaatcaccatctgtagtgattttggagccaaagaaaataaaatctgccactgtttgcaatttttccccatctatttgccatgaattgatgggactggatgccaagatcttagtttttaaatgttaagatttaagccagccttttctcattcttctttcaccatcaagaagctctttagttcctcttcactttctgccattagattggtatcatctgcatagctgaggttgttgatatttctctcagcaatcttgattccagcttgtgattcatccaaccaggcattttacatgatgtgctctgcatataagttaaaaagcagggtgataatatacagccttgatgacctcctttcccaatttagaaccagtctgttgttccatgtctggttctaactgttgctttttaacctgcatacaggtttcttgggagacaggtaaggtggtcttgtattccatctcttttaagaatattccacagtttgttgtgatccaaatagtcaaaggctttagtgtagtcaatgaagcagaagtaaatgtttttcaggaatccctttgctttatatttgatccaatagatgttggcaatttgatttctggttcctctgccttttctaaatccagcttgtacatctggaagttctcggttcacataacgaatactagcttgaaggattttgatcatgtgaaatgagctagcatgtgaaataagcacaattgtccaatagtttgaacattctttggcattggctgtctttagaattggaatgaaaactgaccttttctagtcctgcagtcactgctgagttttctagatttgcagacatatcgagtgcagcacattaacagaatcatcctttaggattttaaatagctcaactgggattccaccacctccgctagctttgttcatagtaatgcttcctaaggcctacttgacttcactttccaggatgtctggctctaggtgagtgaccacactatcatttttatccacatcattaagaccttttttgtgtggttcttctgtgtattcttgctacttcttaatatcttctgcttcgattaggtcctcaccatttctatcctttattgtgcccgtctttgcataaactgttgcctta

SEQ ID NO: 37912 - DNA, 1546 bp, Bovine  19866880539254
acgcctttgtgcatgcatggtcagtcatgtccaactctttgtagccccatggactgtagccttccaggctcctctgtccatgggattctccaggcaagaatactggagcgggttgtcattaccttcttcaagggaaccctctgacccaagggtggaacctgcatcacaggcagattctttacccattgagccacctggaaagccctctgatgcccttggcagtcttacagttcaggtaggactgaactgtgggatctgatgccatctccacgtggacagtgttggaactgagttgaattgcaggacacttacctggagctggagaattgcttggacgcccaccccccagagcacacaccttgacatcggcaagcagaatcttaactagccttgagagttgccttaggcattgtttttaggaatctgaatagtcacttaaaacttgccagacccaccgttagttggcaggttgctgagacaaagaaagaaagcagtggtcttaatgacttgggcagttacgcaaaaatgtggattatcaggtattccaagggggccaagggagtcgcagaggccaagcagcaggtctgcttcattctactcactaaagtgtgttgtgaagacagatttctatatggcagcttcttgaatatgagacatgcaggtggtctccttttgcaaagacaggcaccatgaaaaacaaattttttaaaaataaggagacaggattgtgtgggatcctcacagatacttttcgagtttctgtaaagttttatttttaaaacacccaaagcaaatggcaaaatgctaacatttgtcaaatatcagcactgagtacatgaatgtgtgcgctcttctctgggtttgaaatgttctataataaatgatttttaaaaatcaaaaggaaaaaaaaataagtgccccatggagttagtcttggcagttgaaatgagcgagatcaggtaatgaccacagatggaaaccacctcctccctcccattcagagtaagtctctattgtaccagctgtcagaaaaatgaaccatggaactttttgcaaagagttggtataaactggcaagccttgtttttgtcaaccttggggggtttgcttggttcatatgatagttttttttttttttttccttgttttggtctgttctgatttaattctttaaaagtggatgtaacttatctttacaagtacattccctgctagtgcacaattgctatggctggatctgtgatttcattgcatgcatttaaactttatgtattctagttattgggctccccaggtggcgctagtagtaaagaacccatctgctaacgcaggagacataatagacaggggttcgatccctgggaagatcccctggaggagggaatggcaatccactccagtattcttgcctggaaaatcccatggacagaggagtctggtggtctatagccattggggtcacaaagagtcggacatgactgaagcataaacttaattcaagcacacacattccagttactggggcttccctagtggctcctgtctg

SEQ ID NO: 37913 - DNA, 1651 bp, Bovine  19866880566490
caaggagtttgagtgcaacaacagcgagagcggctacctgtactgctgcggcacctgctattaccgcttctgttgcaagaagcgccacgagaagctggatcagcgccagtgcaccaactaccagagcccggtgtgggtgcagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgcccgccgcgggagatgaacatccacaggtgagagcggccgcccggggtgagtggggggccccgccggtccccccagcctctctcccggctgctcacccctcttgtcaggcatccctgtcctcctggcatctcacccaccgccctccccgggctgccttcactctcttaagtcaacttccctcccctgcctctttgacgggcaataaatcagagtcttcggcgccctctgctccatttcttcagaaccgggaacgcacgctttggttggtagggacatttacagggccaaatagatattggtggaatcccagagtttgagtgtaagaattgcgcaccttccaataatcccgggtggggttccagggtgcaggtttcatggcaggtgggcacctcgctgtaggcgcttattgcatttggttttctgaatcaagccagagcagtcatcttggatatggggagctgaacagtgttggaaccttactgaaaagagtgtggactgaatgttcccgggtgtttagagagatgggggtgatagggaaagggagcctcctgggtaagcaggaattcaaatctgtgcattccgtcttgaccaagggcagatggtttctcttcattgcatcctgtcgagtaggatgcttatctgccctgctgagactggaggacttgttcttttaagccctgtgggcagaactcagagtgaatgctgcttgctatgttcaacccggtgggcacctttcactgcttacaccagggaggcagtggggggctgcctcctgccaaaacttacgccaagggctcaagatatggttgtccaacgttccaccctgactgcctcccaccccaccaccctagcttccggagcaccccttgggaggtccaagccgagggaatggggaaaccaggctctctttacaactcaggaaaccatgcacccaggggacacaagctcagctctgataaatggctggacatggttcagcagagtctttcaaggaacgaaccctgccctggaatgtgcctccgtttctggcacatgatgtgggcactgccctagtcatggagaccaccccccagaccagccctccttctgagtttgcctgcaggctcccacccagagtcctagagcttcagctcatctctgcactcggcttgttatccttttagcctgaaaaccttcttccctcactgctgaggacattaatcacctgtaccttgatgaagagagagaaaggcagatagaaatttctgggcatctcttttttttccccctggatactgaagggtgttgagaaaagatgatgctctgtgactgattttgagtcaaaatccacaaagtatgagtacttgaatactg

SEQ ID NO: 37914 - DNA, 1014 bp, Bovine  19866880572975
cagctgatgtggagtagttaatagatattggatgaaagaatgataaattgaagttcaggaacataggtttatcggggcatctaggattaatcatgtgatcagaggtgagtagacagatacacaggagagggtttttttgtaccatgattccagtttatcagtttttcaagggatctctcctgggtccaagaagtggagccagtctttgtccccggtggtctcttcctggtgaatgggatcaggaggatacttggtgaccacacagaaaaggtggaccttctgtatgtgctatttctatacagttctggtgatcccataacctggcctccatttctttaaggctgtttttacgtaaagggtcaaaaatcgaccagccagaatcagagtccctgttggacttcctagtgacacgatgatagattttcctcctccagtttccctttgtgaatattcacacagaccctcaccccgccatttacacttgttaccacaacaacgcctcctgagtgtcgggttgttttgggttgagttgggctgcttgctcacagcatacttgggacaggcgctttaatctcctcagtaagtcgctcagatcaccctgcaagatgggttacttctggaaagccatcctggagacagctaatcctgtccttcttgcaggcttgacttacggagatggcatctgctgatctcgctttctgagagcagtcttattttgagtactgcagtgcttcgtccaccttctacaattactgcgactaaaaatacttcagagggtgaagaatcttcaaggggactttgcaacctggcctgtcctccttgtatcttgatgccatatttcaaggcagtatccttgttgctgtgctaagctgcgtattacccgatagaccaatatttcagatgatagttgattgtaggccagcctttatgctgacctttctgatctttttgccttttccctacaaacgcatccaagactcatgttgctgttattctcctaacccagtacaacca

SEQ ID NO: 37915 - DNA, 1845 bp, Bovine  19866880595576
ttgtgatggttattttctgcatcaacttgacttggtcccgggtccccagatattttcctaaacattatttctgggtgtgtctgtgagggtgtttccagaagagattagagtttgactcagtagactgtgtgaaagaatagaaaataacagaacatatgcatattggactctgtgcccagttcctgtcacagagctcctaaaacccttgtaagttgctaagtgataacaatgctaggagcatctcatattctcacatttgactttgatctcttctctgacacatgggctcctaaaactcttgtaaatttctgagtcataagagcactaggatggtcttttgtcctatggaggtgacttcaggtgggcttctggctgggagctggtcaccaggaagccaagccatgatgaagaatgttcagttttaagtcccatctccacgctccatcttccagagaggggaggggggttggaaatggagttaataattgattgtgctcttgtgaggaagcctccataaaatcccaactgcagagggtttgggagcctccaggttggcacatacttccgccccggaagggagcccccagccctgtggagacagacctcctgtgcctgagaccctcctggatcttgcctgaggtgtctcctcatctcgctgttcatcttcatcctttatgatgctgttgttgctgtttagtcgctcagtcatttccgactctttgcaatgccatggactgtagcctgccaggctcctgtgtccatggcattttcctggcaaaaatactggagtgggcttccatttccttctccagtgggttttcccgacccagggaaggaacctgtatctcttgcactggcaggtggattcttcattgctaagccacctgggaagcccatcctttatgaagccctttaataaactaggaaatgtaagcatttccccaagttcgatgagctgctctagtaaattaatcaaatcttaagaggaggttgtgggaacttctgatttgaaaccagaggttgttattgcccagtcctttcctgatttcaccactagtaacacaagcatctcaaataacatttttcctgaaagttttgtctacaagttcagggaaattgccaccaggagactggtgctgcttgagtgtctgggtgggaaaattcctctgggggacatgggggcatcagacaactctgctaagtcgcttcagtcgtgtccgactcttagcgaccccatggactgcagcccaccaggctcctccgtccacgggattttccaggcaagagtactggagtgcggtgccattgccttctccgacaactgtagcagcatccattattccagcacatgtctatctccagttgttgggactccttactcaccacgcaacttccaagctgaaatttggcttcgtgcggaaatgtcaaagcagagtaaatgtgctcactggtctggaggacacaagtgactatcccctctggcagttatgtttctcatggtaaattaatgaattggtagaattttgttagctcagcctttctgaacttaattaacgttggaacactgaggaactgggctttggggatcttgtaaaactgaggatgagaattcagattctggtgactcaggcaaagtggcaccactctgggaagccccttggcacacttcatactatccgtcccatctccactcacagtgcagaatcagggggagggtctcactgtcaggaaggctagggaaaggatgtccaggatggaaggaagctgccgaggtaaacggggtacacagctggacagctgtggacaagcctgcaggtctggcttgtctggtcacatgctatgcaa

SEQ ID NO: 37916 - DNA, 1773 bp, Bovine  19866880653701
ctaaccctgtgctagcccttccaaccccaggatgtaagaatctaatatgtagttccatgctatcaaatgtatgcagggcaacccattaagagggccaagtgtgaaggacctcttggctttcaaagtagtgcagccatttaagtcaccagaggaagtcaagtggcttaattctgattattctttggaatgcctagaaagtactctagagaggcatgctaaagaacagggaatgagggctctttgggaaaagccccagtagtcaaactgcctgccaagaattggcagcgataactgaaagaccgaagtcattagtctctttctctttatttccagatcatttgccagttttcccaacaccatttgttggataatctaccccttacttactgatctgaaatgccaacttcgtcatgaaacacattctcatatggtcttggatctattactgaggttttgtattttgtttcttgttattctctgtgaagtacagagtttgaaacatattttttaaatcaagtgaattaattacattattcagatcttcaacctccctatttttgcctagtgatctgtcagagatttaaaaaaatatataacagtttcctcaccaccattctaattctgtcaatttcttcatgaatagcaaatattttgcttttatatattttgatgcaacattattgcccggataaaagtttgttatctgcgatgtagtcactgtgagttacaacttttgtcaaagcaaaatgaggcttccggttttaaaatcatagagaaaagatggtttggtttccatttcttttcaaaagcattccaaacaacaaagagaaactgaaaccaaaatttcatctttcatgaaatcagaagacttctacggcaccaagcaatgtagctttatgtgaaaagggagcgtgaatggatgatgctaaatggtgtagcactgagggtaaggttgacatgacttacagcagagcgggagactgaggagaagcaggtgacatttcctggctgagagccggaaagccttaggaattggagaaagcaaatagcaaagaaaccaggggagaggtaaggctgacaaccagaggattatgggaaagtctttataagaagcaattagatccaatgtcccctaccttgcccaccagtatcctgtatactcagcagttattccccaatataatgcaagagacaaataacttttcaaaaattgaatgtgagagccttataactcatatacattgaccacagagtagggccaggtgagatggactttgaccacagggaaataaagtcaaagcctattcatagaatgatgggaacatctcctatcagctgcagaattctgggagataagcgggagaaaccacatccttctatgcacagccaaagaaagaacctgcccacactgacttttggttcccgaagaaaagctccatggccacgtgtttacagtgaagtcagcagcttccttggatgtagatttcagttagttttttagtgctttagtctcagatatgaacagcagagagccaccagacctccaaagaaaactcccgatacaaaaaaaagaatcaaaacaaacaaaatcagcatgactgaaaataacgcagagttttgaagattaatttctttaagctttaaagaaattgtaattagtctcttcagaaatggtaaaatatcgtgcaactgtgaaacaagtatatttataaaagggacagggggcagcagtcagagaaccagaaacagacttggaaattaaaaatgtcaaac

SEQ ID NO: 37917 - DNA, 1182 bp, Bovine  19866880722869
ttctgcagagctccttgttttcctgtttccaaccccctggcttcagaaccccacgctccactgtacctatttaattgtcacattcacattctggcttccttgagtccttggcatcacttagaaagaagagaggatttgctagcagtgaggccctggttcccagaggctccagaggagcaaggggaaagctctagcaaggaggctggagttggcacgtgctcccagccgtgggaaagtgacacaggaggtgctggatagaaggcattgtccccattaccactgacattcaagtgcagttgaaaagtgagcaaggaaagaaacccttggtgtgaatttgaaggaaacaagagaaggactcctcacaggatcatccttctgggctgatgcagcctggcctttatgtggggagaggtgaactttaaggtttcacacgtgtctgcagggctaaggaagatgctgtgtccttagcgggctggattctggggcatctgtccgccccagttgatttggtgcagctggccatcctggcgctgtgcctggttcagagcatctcctggatcctctccagtgtactatggggatcgataaacacttaaatgtcatgcttccaggagccatccgtcatagtaaatgttgttcaataaatgtcaccagagagtaacaaaccctctcctccagaaggccctcaggccatcactccctcttgtgaccctcccactaggatcatcacagggcctctcctggcttcaaatttaatagcaaaagatgagggagggcctgtttctgagcttggaacaaagtggggggtcttcttcctggagtgctggcatccaggagctggcttcctagcctcatgtcctttgtcacatgtcacctctggtgctgtttcctgaacatttctggttctcattacttccagagctggataggattgtagctcctaacctgctctgattggaaacacctaatttaatagttctgacggatacactgtgaacagaagtgacacgtgtcacttttagactgaagcatttaactgctgaaagatcctctgcagatctctcttttgataccatttagtgtactggctcctctgttagcctgggttcctaagtgactccagtgaattgagccctattcagggacacggagcatagacaaaatacacttttacgtttaacc

SEQ ID NO: 37918 - DNA, 1175 bp, Bovine  19866880796489
caaaggctgaaagaggtaacagaattgaacaactttcaaggagaacttagtgtattggaagatgcagagacatggtggggggcagagagagagagatggagagagctaggttgacttcagggtcaccaatggaagtggaaaaggactaggaatagagatttggaagatgtggagaactgagactcagaaaagacaagtgaggcactggccctgggcataaaatgttaggggagccaaaaaattcagtagtcaagacaaattctttctttcttttttttgactgaatcatgtggcatgtgagatttcagttcccgaccagggatggaaccatacccgctgcacaggaagcacagggtcccgaccactggaccacctgggaagtccccagacatctcttttatatcttgcccatcctgggccttccttgacattcaagacctaatcagatcagattttactcagtttaaaaaaaaaaaaaaaggattttgcaagatctccaggtgggggagcagtccttaaaagagtcaggtccatacaaagaattagtactcttatcacattgggatcagatttacacatggccaaatagtttttatttgatttttacactacttcctggaaggagcatatgttgtaaaacttgaagatctcatttgattgtcctacacctagatggaaaatgctaacgatcagccaacttggaagatgttgcaaagaatcagaaaggccaatggatgtaatttagagaccctcctttcataatgtgccaatcaagaaccagagaagggaatttgtttacctagggttacacagctattaatggtacatccaggatgagacctgagatattctgacagacagattagagcatttacctcgacattagaagttctcatagtaggataagggaggtacatctccactgagaaatcctaagtaaatgtcaagttgttttttagagtttagcaacactggtgtatgcaaattgcatgcttctattcagaagatacggcatgtctggattaatcttctttatttgtactttaagtagaaatgactagtcatgtatttcactaactgaaccacattgaatggaaaataaaatccctgccccagagccctttctgacactaatgtatgcatgtttatctttgccttcacattctactagacag

SEQ ID NO: 37919 - DNA, 2234 bp, Bovine  19866880798559
tcggacacgactgaagtgactgagcacaatatgtgaattatgtattcatatacaatatgtagtagtgttagtcactcagtctatacaaccctttgcgaccccatggactgtagcccaccaggctcctctgtccgtgggatcctccaggcaagaatactggagtgggttgccatttccttctccaggggatcttcccaacccagggatcaaacacaggtctcctgcactgcaggcagattctttaccatctgagctacagggaagctatacatatattcatcaagccctttctatctgcattttcttatgctagccttgcaaaagctatctaaggtagcaatgatcacatccacttaacaaatgaaaaaattaaggcacgggagaagttaagtaatttgtgcaaagccaaatataaggatagcaatatacctcacatcccgttcagattctgtgggggaatcagtgaattgctgtacacagaaagtgcttagactggtgcctgatacagaggaaatgctaaataagggttttgtggtttctgatggcggttactccaccgcctgccacaccctgcagagggtggaggaaagcatagaaatctgaaccaggggaaaagaaatgatctgattatttgccttgcaaagtaagtcaccccccggggttcttcaccagccaggctatcgggcttgacaaaccgactgtaggtctgcagaggcagctacagcagagcaagcaacagtctcaaaagcctccaagtccaggcctcctggtcactcaggccctgcacagacaatgctcagcttccaaaggagaccagaagaaaagccccatcagctcaagcacccccggcggctcggtggacagcctgccctccggccctctgcttctcaggccttcatcccacatcaacctctgcagagccttccccctctggaaatttcatctcgccctgacctggtctgcacgtcccaggtccctcctaggagagccttccctataggccacctagggagtcctcacccagtcctgttaccgtagcagggacctctccagtctcaccctggggctcccaaccagtgagaagagaggcttatcctcctggagttggtgtgagaacggagggtcagcctggctttcttgttggcttcagggtacagactcgcattcactcttcatcacctcacacctggcttctgacagcacaacgtgtgtaactgctaacagagatggagaccctgcccctccactgcagtgacattcctcactggctccttatcaccatgataagtaacatgaaaagcacaggggtgccatcgggaaaggggggagaagagaaggtgaacgtgctgctttgcccccagttcaggaacatctgggcccggggctggggtaggcccctctgtgcccctctgaccttcagctgtgggttcctggcctcgggtctcataggatacccacacataggcctcggggtgctcccagaggtacccctgctgtcttggaaccgaggatgctaaaaaaaagtctacacttgctttctcctacatccagaacaaacaggcctcctaggtcccatggccaacacctgccctggactgagctagtgcagactctgagtgatccactttttggcagccaccaccatcacggtcacacactccactgacccagggacccacatctccagatttccgagcctggggttgggaggagtggctctgcccacacaccagcctcatccaaatctccctgaaacctgaagaccaactgcagagaagcttcattaatttttcaccagcttcatctactagaggctgagcagagctgagccaaagccctatcacaagcgcctctgcccgcggcccaccaagggttaacccattagcccacatcctggtgagctcaccccgctggagccagctctgcgctgggattcgctgcacgcggctcctggaggggccagggaggcttcttcctgggggctagggtgcaggacttgagcaggaactcactgcccgcttcctcctggcgccagttgtgtgcgatccccaggactcccccatcttccccgggggacgttgagcacagtaagtaaggaggccactggccctctgcccctccttccacttccccggaggaaggagccagttttaacttcgctttagagcgccttgagtctgtgagccggaggtgggaggtagatgcgcacagccggctaaggggaggagggctgg

SEQ ID NO: 37920 - DNA, 759 bp, Bovine  19866880799023
tgtgcatctacgctcatcaccaagagccttgtggaagctcaaggctgttaagacctgggaaaagatgcgaaccatcctccacttctgattttcaaatctaaaacaggctaaagtgatggaagaagagtgtagggtttatatattagactggattcgattctgcacataatagattctcagtgtgttatagaatgaaagatccaagctttatcatgtttcccccgtgatgggccctctcagggcacatgataatcatagctactttcagccttgtgacagctcttgaaagtatcccattttataaatggataagctgttgctcagaaatgctcaattacatgcccaagttcatatgagcatcagagatggactcaaacccaagtctgtttgattccaaatcccagagtctttccaccaggcaacactgcctccgtggctgttaccgagtaacatggagaggactgttaacgtagccactggaaagcctctctcttctgaaaggccggaaggtagtcactaagaggaaaggccagcagactgtttgccaagatgtctcataaactggtattactgaccttgaggaatttcccatgttcctccatttgactccatctgactcttagacactacagaatctgaagagggatccatctctcagtagagacattttaaccaagcacggagtacctgatgtattaatataaaactcaaatgtctctttcttcgttcacagagattactaacacgaagacctaaaaa

SEQ ID NO: 37921 - DNA, 757 bp, Bovine  19866880808465
tcttgacatggtgttaacattcaagagcaacagtcaaatacctaaacataattaaaaagtaattagaatctttaattggtcttttggaagaaaaagggatctatgaaacgattgtggcatacaacaaattttaaaaattaagagaatttaaaaatttaaaaacttttatctttctcacccttagttccttgtgtatcgtcagaagctgcttcccccagcactctcctttctcataacactcccccaaattcagccaactggcctcggcaggcctccccctgccccctggattctgtaatcagcttacgctgatgtgttctttggattctcttgttctccttttaccaagactttgaacatcaaagtagagttctagaagtgactcactgaggtagaaagtagaagaggggaaggggaagaggacagatggtttggattagatgcagtcttgctgatgtcccatcaccctgcacgcttaccgttgtgacctagcgccagaaatggttgagcatctccccaccccacaagccgagaggcacccgccgagccccattgcaaggagatgctgcctgactcagactccaagtctacaaactggaatttagacatttgctttggttttccccagagccaccttctacaagcttatagaatggagagctcaacacagattttcattaaaaagcagtcctgctgtttatatgtgatttgctccaggacagtctaattggtgtgcaaaaatcattgaatttgaagc

SEQ ID NO: 37922 - DNA, 877 bp, Bovine  19866880813949
taaaaaaaagaaaaaaagaaaatgccagctgaaggcaagaaagaacaatatcaatcatggggccacttagcgtcagctcaaattggcccaactacaactggtccccttatagaacaatacaataactgatgctcccagtgacgactctgagtcataaaggaaggcttaaatggctcccttcattctacagaagatgtcagaaaacgtgaaatgcagttgtcaaagatgttcaatgaaaatgattgaagtaagaaaaggtttccacatttgaagggcaagcttcctaaacaggcccattcaaaacagactagctcctgagacatcgtaattgtggagaattgttagaattataatatttcatctgcacatgttctcttgtgttagaatataaggaacttgagagtggggactggggggtatatttctggcttccgtgatacctaaaatagcctggctttcacagtggcaaccacatgttgtcatcgtcataatcacactcaagtgtcctcagaacaagcctgcagactggtcctgtgcttacccctactctgtggctctatgagctccctcctggctaggcaggactacatttcccagaattcccttcacagagtgtttcctgttgggatgggtcacagggtttgagggcagaagtgaaggagggtctgccattttgtttttacgctcccatctagcactagccttgggggagcctgagggttcttgtggctgctgtgcctttccctggaccttctgccagctctgccatttcctgggattggtgtgtatttagttatgtgatgaagggggacaacttctcctgccggacagccacttcactgaagttggaggcagcttaaacggatatgggttcaag

SEQ ID NO: 37923 - DNA, 1735 bp, Bovine  19866880826645
agcaggactgagacttgtccaagacctgttgggtgcactatgggatgctgtaccaggaaagggaccctacttctgtttctctttaattgtatagggccggcatgagggtgattttgcagacaacaaataaacattatggactcaggaatgaaccaggttggaatttaattggcaaatagagagatgctctcatgtttagaggaagaaacatgctgagagctgggtacccaggtgctgtgcttaatcactcagttttttccgactctttgcaatgttatggactgcatcccgccaggctcctctgtccatggagattctccaggcaagaatagtggggtgggtagcctatcccttctccaggggatctttccaacccaggaattgaaccagggtctcctgcattacaggcagattctttaccagctgagccaccagggaagcccagtgtattcaggtatggcttcccaaagatgtgagccaggagatggaccttgaaaaatgactcacttttattaaggagatgttcagtggatcatagactcaatggaatgagtttgagcaagctctgggagttggtgatagacagggaagtctggcgtcctgcagtccatggggttgcaaagagtcggacacgactgagtgactgaactgaactgaggtggatcatagaatatcaacttcacggaacgttatggggtcattaaaattataattagaaatactgagtagcaacttggaaacatgatattctattaagtgagcatggcagaataaaactctctgctatgatcatgaccatggaaactccacatttatggaagtgggaatgatcacgaccatgcaaactccacacttataaaagtaagatgaaaagaaagctggaaaataaatacaaaggacatgtttttgtggtgcaagtccaggcgaattttctttccaatttccatttcctttgggatttgttgttattattacaaaaccatttttaaagcaatgggggctgggaaggagatgaacattcctagccagaaaaacaaccttgtcccagacttgagaatatgaaggtagttcgcttgtatcctagggttcccgcagttgaatttttgtctgttgaacagctgagcaccactagaccaaaaaccaggatggaatgtgcccgacaggcccaaactcaggcaggcagccactccttgacttagcgatagagacaccagaatcttagcaggtccgttctccctaggaggtgcaggagaaagagcggcttttggtgtgcgaatgttggtgggagggtatttgaggggctgagaggatgcaacctgagtcaaccgtctttgctctgatggttttggcagcagtcaaacccgttgtccagcacccagcaccactttctccagaaaaaactaaggagtggagagctgtctatcaactaagctgttcattttactttaattggtcctgaactggtcaacatggacatggagatgcttgctcttctcacatcctgtgctctggtccatagcatccagtgaaagcccaaacgtcccagcagcccaaacaggggtgcccagctgccttccagacccaagagataagcaactcatttgcaaatgaattatgggccagcagaggctgtgaggcaccctcatttttcttacagagagcaaccttgggagagtatcctgaggggtggaagaatatggaaattcaagaagtctcaggtactgaggctgccttt

SEQ ID NO: 37924 - DNA, 1695 bp, Bovine  19866880837724
tttcctagagaaaaaaataggaagcaaaggaatcagcatttacttctagaaaggttagctttaatgatgagtaagaactccttcaaatagaaccatgaaggaagcaaatataggtaaaaaatacagatggatctgggctttccaagtggcaccaatggtaaagaacccacctgccaatgcaggagacatcagaaatgtgggttcgatccttgggtcatgaagatcccctgcaggagggcatgacaacccactccagtattcttgtctggagaagcccatggacagaggagactggtggactatggtccatggggttgcaacatgactgaagtgacttaagcaagcacacatagatgaatttagaagaccaagggggcacccatgagatagatcatctctgagggcctccattatctctgagccccagctgcccctgaaggtaatgatggtgggttgggtggagtgaatggaggtcaggggcagccgctgaaggaaagtgagagaaggtcgaccggagaattaaaagacgactgagtggcagtggctgccccgcagaggctgaatggttcataaatgtgtaatggaaccaatctgccatggtgatgcaattttccccaagtatcatcctgcagcactgggccaaggagagagaagaacgaatgattgggttgacacagcactggggacagaggcgcagctgcagaaggaagaccaggaaatgagggtgaggaggacttgatgagagggtccttgaagggatgggtgatgaaacccagccaaagaaggggagatgggcaagcccaagtgaggtctgacagcctgcaaaatcaggtgtcaaatatatccagtgtgtagtcagccatgaggctttgtgttagtcaatgtcctctggataaacagaaccaattccttgtaagtctcattacaaggaattgactcacaattccaagattatggaagctaaggagctccaggacctgctgtcctcaagctgcagatccatgaaaacagtgctgtggttccattccaagtccaaaagcccaagaaccaggagagccagacttgtaaggacaagtccacatgtccgggaggagacaaatgtcttagtttaagcagtcaggcagagagaaaaaaggccaccttcctctgcctttttgttctaatcaggccaatgaatcaacacccacgggcactggatgatgcccacccatactgaggaaggccatctgctttaccgagtccacagatacaaatgctgatctcttctgaaaacactctcccagacagaaatgatgtttaaccagatatctgggcatcccacagtccagccaagttagcacatagattaaccatcccaaacttgataacagtagctctgatcctaatccctggcatgtatgcagtgggcactcacaaggagctttacatgtgtggtttcatcgagtcctctctcagtttacagaagagtaactgcagctccaggaagctaagtcactctggacttcactcatgccaaagcttatgctcttaaacatacggccagtgagatttctgagcatgtggtttcatagtttgaggcatcccaagggatgaacaaggaataggaggcggcagtgggtgtggattgcagaagtgaatggaggttgagtcattgaggctgagcacatcagagcagtctgcgactgtgaagttgaa

SEQ ID NO: 37925 - DNA, 1315 bp, Bovine  19866880857248
ggctgagtctgaaaataagatgccatttcgtaaattatagcttttgtttgttcttttaaaggacatcattgttccctgattaaataagaagaagacttggttaaagtcttacttgctcagtcgtgtctgagtctttgcaaccccatggactgtagcccaccaggctcctctgtccatggaattctccaggcaggaatactggagtgggttgccatttccttctccaggggatcttcccgacccagggattgaatccaggtctcctgcattgcagagagattctttaccatctgagccaccagggaattatctctcacatgggggaaaaaaaaaaaccagcttgagaggcttcttatttttgtagatctcatctgcttttccttttgacttcagcactgagagccaggctggagacggatgctgagaacaggaagggtgtgtgaagagtccttgcccttgcttctaaccgttgccggtaccaggagcccaggctctagaagcggtgtccatggaggccctccccaaggccctggaggttgaagagaagtctccagagtccaaggaccttctgcccagccagacagccagctccctgtgcatcagctccagaagtgagtccgtctggaccgccactccccggagtaactgggaaatctaccgcaaacccgtcattatcatgtctgtgggtggtgccatcctcctcttcggtgtggtcatcacctgcttggcctacaccctgaacctgggcgatatgagcctcaaggtcctgaagatggtggggcctgccttcctgtctctgggactcatgatgctggtatgtgggctggtctgggtgcccatcattaagaagaaacagaagcagaaacaaaagtcagtgttcttccagaacctcaagtccttcttcctgaaccgctgatgacaaccttgccctctgtccaccctaccaccccaacaccttgtccaggagaaagtgtgatggccatagtccaacacctctggtcccttgggtggtggagtctgccataaaactgatgcaggcaaaccctcttctgggccccatgggaaaaagcaagctcagggctgcgccctccgtgtggctgggaggcaccgggatgatctcatttagtctctgttgtgtcctacgctcccccgcccagatcctggctgcggccgtcgccttccatggcttcacctcggcctgtgcatccaggtgtcactcatctaatgaatgtgctctgccaagcactatgcatgttgggaaattccttgagatggactatccctcctgcttacacttctgagtgcctgaactgga

SEQ ID NO: 37926 - DNA, 1995 bp, Bovine  19866880859061
ctggatgccatggagtcattcagtgtgatcttttgaagagtatttttattctgcggaaaattctcatgaagtaacattataacatcttcataagaaaataaagtggggtgggggatatgcacggggttgctctcaaaaggtttatggggattatgagtcatttcctatactattctgtgttcccaggtggctggtaaagaatctgtctgcagtgtgggagacccgggttcaatccgtgggtcggcaaggtcctctggagaagggaatggctacccaccccaggggaggcttcccaggtggtactagtggtaaaacaacccgcctgcctgtgcaggtagatgtaagatacgtgggtttgatccctgggtcgggaagagtcccctggaggaggaaatggcaaccgactccagtattcttgcctggagaatcccacggacagaggagcctggggggctacagcccccctcggtcacaaagagttggacatgactgagtgactaacacttctgtgtttttcaaactttctttcatggacaggtattcctcttataatccgaaatactctatattagaaagagagtgcatttcgatgggagggagttactagcaaaaaaagtcgcaatgcaagatgggctcgcccacagcatcatctagccaccttgggcctccaaatctgtgcagcgtctcttctgcttgttctcttcccttctctcacaccagcagagagggaaggcaacaaccctactccagccaggtctctgcagcctccacacccctaaaaccttcttcttgttccacgaagatggctttcctggagtgacatttaaaggaacagaacaagactgacacgagccccaccctcgcccaatagggatgacttctctgcaactttaaggggacaccacgggggcttgcgtaccgaagcagcagctggtgcgccgctctccttgaacgaacaggggctgctgtgagtcagtggctcgcccgcggtggtcctccacccacaggctgcttcaggaccagtggggctggacagatgtacacagaccccacagctgtcagccaaggggaagaggccgcgcgattttctgctcatttaggggcaattagccatcaaccccctcgtctccttgagtgtgaactttaaataagatgttccagctgaagtggggagaggaagcagctctgctgtgactggggagagaatcattgtgttgcgtgtttgcatctgctcaacggcagctctgggagccggcttcacgcaagtgagacagacggaggaggggagtctgggggagccgggctggaggcagctgccttcaccccggctgacggagcagggcttcggttatcccttctaactcacgtgatgtgtgtaacgcagactggtgcctgagcctctgagagccccaagggcagagctgctgttgctttggttgctctgtcgtgtcgggctctttgtgagcccacgtactgtagcccgccaggcttctctgtctgtgcaattttccaggcaagaatactggagtgggttgtcatttccttctccagaggatgttcccgacccagggatggaacctgtgtcccctgcattggcaagtggattctcaatcactgaaccatcagggaagtcccagcctcattttcgaagttaaaaaaaaaaaaaaaggtatattttgggataaaaatagcgaagaccagcaaagagaagcccacacctgggtttccagttgggaagggcctcgatttggtggaaggacgtctcaggataacaaacaagcccatctcaggccttcagggcttgaggacagatgggcctgcaaagggcgctcggctgactctccctaagctctgggtgcagaggcctggaatacaggctctcaaccagtctttctgtgttttaaccctaatgtgttaatacttaagtgcttgatacatgacactctctgtaattatttgcatttaatgggaaataatgcctcgtctaggaatcca

SEQ ID NO: 37927 - DNA, 2583 bp, Bovine  19866880881676
aatctctagtaagaaatgcttcatcgcctttaggacctctgagttagcagccatgagttcggaccaggaaatggccatctttggggaggctgctccttacctccgaaagtctgaaaaggagcgcattgaagcccagaataagccttttgatgccaagacatctgtctttgtggccgagcccaaggaatcttttgtcaaagggactatccagagcagagaaggtgggaaagtgacagtgaagaccgaaggaggagcggtgagtagtccaggagctggccacatgctactgattattttgtttggccacttggttgacataagcagttatccttcctgtttaccagactctgacagtgaaagaggatcaagtcttccccatgaatcctcccaaattcgacaagatcgaggacatggccatgatgacccacttgcacgagcctgctgtgctgtacaacctcaaagagcgttatgcagcctggatgatctacgtgagtgctccccaaaccccaaagtggttttgaccactagaccctgtcagctcactgtactacaaatgggtcacagacagtgattcactgcactttcactagtaatgtaactaactaagaggttcacgattgctactgtaaggcccagcccaacagctggcacataatcttttgtcttcccaggcaaagccactgtccacatggactgggtttgccacagatcccctgaacaaacacggtagcagctactgtttacatctcaaccacatgcctgcgtctcccctcatccccattcctgctgcagaatcatccagaggaaaaacataaacttatgtttcaacacttaaaagtaatgtttttaaagaccaattttcaatccccccaaataacagcaatttgtatctctgtgttctggtcccttctgagtggagcacttccttgatggaatcttgccaacttccccaggcagagttcaaccttgtgtcctggtgtttctgccctgcaataatgctgacaatgttttttcagcatgaatcatttacatgtccatctcctacacagactgggaattcctcaaggaacagtatcatatgttcaaagaaaaataacgtttatatttcattcttagggccttgcagagacttttcacataacacaaactcagtaatactaattgaatttactacgttaggtggacatttctgtacagttttgtggttgctgctttggccccaccacacagcttacaagaccttagttccctgaccagggattgaactcatgccccctgcatcgggaattcaaagacctaaccatgggaccatcagggaattctcatcatttctgaatgctgtagtcactgctgctattcagctggacaacacctaaacaggtgtgcctgtgattagtgtcagaatccattctgtttggttggcagttaccctagaccagatgtcaaaaatattggaaatccagctgttgtaatcgtaatgtattcccatcattctgtgttctgtttcttcacaattcaggagtggtttacaaatatttccccagtattgctgcataccttcatgtttgcctttttaaatgtctgaatcatactatcttaagaagatttttccatagttcacctacctatttcatactgttgagtacttaggtaccataaattcattttcctagatcataaattcattttcatgaatttgaactatcttaaatatactcctattttctaaactatggtaaaaatgtattaaacattttttaaaaaacccacaattttggatctcctactgtgtgaaaatcactgtgacaaatcccaagaggaataagaatctaaactgtatgcctcaccctcaagattttgctatcttgttgaacctttcaactagtttccatgctgataccttgaagatgtgtagaccacttacttagagtgttctttttctgttaaaattcattaaataactgagctgtgcaaataacaggaaaggtgtctggttagttattctttgttattcgcttgcatagacctactcgggcctcttctgcgtcaccgtcaacccctacaagtggctgccggtgtacaaccctgagggtggtgacggcctaccgaggcaaaaagcgccaggaggccccgccccacatcttctccatctctgacaacgcctatcagttcatgctgactggtgagttggatgtttccacgtgcatctttttaggagatgagactctaggagagagagactaaccacaggagaaagagactctactcatctcaacacactctttgaggtggtcctctaaatgccattgcccttttcccagaaccaaccaaaacatactccagagtataaggtgtatctggaattagagcggtcatactatgaatcttcctggaatgctgtctcagctagaccattctaaggcacaatggcaccttggggaaaggactgagagatttcctcttcagagagagcagaacatcaacatgagcctttagttttccctgaaaatacgactaaggctatgtttacttccaaagctaccacctttactatactgactccttctcccacactaaaaatat

SEQ ID NO: 37928 - DNA, 1041 bp, Bovine  19866880926946
tagcaccatttgggaggcccacatgcatatgatgatcaatcgctgtcccttcatctttgacatcctgtctttttctattctccccccctccatccttaagaggtctaaagaattagtgtcttgttagcttctccagtattgttgcctggagaattccatggacagaggagcctggcaggctatagtccacaaagatttgaacatgactgagtgattgacactttccctacctcttccaccttcttccatcttcttttgtacctctgggcttttgtacccttcatggctcagaatgcccttcccaccttgctggcatgatggggaccctcttggctttcagttcacccagaccaggatcagcacttgcagttctaggcaattcttctgcactcttccagcagcccatgagtgtctattatcagccttagtctcttgggcattacttgattttctaatcagtttcgcccactggacgatgagctccttgagagcgggggtggcttgctcacctctcaatctgcatcatcttgcacgctgctcagaacacagcagaagctccaaccatttttattgaaagaatcaatggtttctctatttctttttttttctggtttctctattggattgtataaaatgtacagaaatggatctgtttcagcaagactggcatattcgctcgaactggttcatacccaacgagagtctaattggactgcccaatccttccaaaaccctgccaatcattcttttgtgtgaataggcacaggtgattggttctaatcaaagtcattagggtggctctggaatgatcccactgccatatgtagataattacggcagaagtctaaattttgggtgttagccaatctaaatggcattagcatgaggaattaacatagaacaaaaggagaaggatggttcggtatttggacataaataataacagctagagcttatagagcatttcctatgtgcctggcactcccctaagtggtttacatgtattaattcatttatttaacataacagtgatgggaggag

SEQ ID NO: 37929 - DNA, 1039 bp, Bovine  19866881023822
ctggaccccagggcgggcagagagtggccttggggaccaaaggtggagccgggctctggttctggagagccctggacatcaggcgcctgcctttcccacctggaccccacttcccaccaggatctcagcctcatctggccctttcctttgtacctgcccaggctgagactcaagctgccggaccataggttgtccccgggtccccgctgagctcagtgttcccgaacagctttggcaacgcttccctggggctgtctgttcagtgagggcctgccgaggcctccaggggcaggggctctgcccagaacatggcttcagggaagggctccctgttgacattcagttctgaaccagcccactcacattccaaccggttccttcctcctcctcaccctgtgttgattcattagagtcttggagatgagaatcattctgaggaacagtgtggcttttttttttttttttttaatggctagtgaacagatgggtcaggaagcttttaggatgctgtaggtgcagtgggtgaggccagagatgccgggggtcttcactctgctgcccagggatgaaggatggaggaatttaaggtgcagatgggcatggagaagtgctcagggctatgggaaaaaaaacctgagctgatgtcattagggaaaaagaaacgtattcatgaccccaggtaacctaatcaaaatgggcctacatcttgagttcttctgcttatttctagaaacatcaagggaacactgtgtcctaccttttctgcctacagaaattaattacaaacccaaagagccctgttttgtccgcacaggccacgtaattgcggcagcgggaccactctgccaactgatttagtgagttgtcttcccaggttcctggtcaatgaattgtcaaatcgcttcaaacactccattttttgaggcactgtgggctgactagaatgaattgatctaaaccgagagtcaacttgtattttgtttttatttttttaaacttcaaatatagcagtttgagggaaaggataaaagaaatgcat

SEQ ID NO: 37930 - DNA, 1287 bp, Bovine  19866881061116
caggaggagaagggggtgacggaggaatgagatggttggatggtatcatcgactcaatggacatgagtttaagcaaactccggggagatggtgaaggacagggaaagcctggcgtgctgcagtccatggggttgcaaagagttggacatgacttggcaagtaaacaataccaccaaaacctttgttgagcaaggtcagcgtgagtcctgctttacatgaaaaaaagatccatctgtttgtaggagccacactcagcctgagcctcatatttttccagcttatctccgtgaagctgtgctgtgtccagggtgatttgcccaggtcagctcttctgcatcaggtgcttacactatagacccatctgctgctaactgcagctgtcactcagagtgaaactcaccagctgatcaaagttcccctcttcctgaatagaaaatgaaatctgaaaaggaacgccgtgatgttgtcacctttcgggcaaagccttttatgagcggggaaggtcggcattggtgggtctcattttcatatcccgcctgagccctggcagcccagctggtggctggtggcagctgagaggttccaggaaggtggaagaatcaaagctctctcttgccaccagagagttaagccccaaagggcctgtatggaacgattacttggaatgctgcaaggggctttttattctctttcaggtcagctttgctgatatccaggggctaagtataactgtaagcatgtgaatttcaataaatatgtttccttcaattacccagctggacagtttaatgcaccagagcctgcaatcatacaaaagctgccagggaattgttgtgatttagataatttctaatctccactctgcttaacctgcaggggccatgggcagcctcagacaccagggggtggagagagggaggtagggagtgtctgttctcatcaacccagagatggaggtcctcggctcagcctcagagatggatgctgtgctcagacagagaggctgaaaaatatcgtggagggtgaaagtgtgtgtggtggggagcaagggatagtttaggagtcggggaccatggcgggggggggggggcgggcagtggaagagtggatggcaaagtagaactgctacccagcttgggggctaagaagcagaagacccccagtgaggactcacatctgggtccttgatcttataccctacacctcttctgcaaattccagaggtactgtcccagtcaacagggaccaccattgaatgtatatttgtcagtgcagttggtagaccac

SEQ ID NO: 37931 - DNA, 1155 bp, Bovine  19866881111779
tgtgggagagatttcccctaaatgctgagcccctagatggtaggaacagtgttctctttaccccgggtctctgccgtgactgaggcatgctgagtccttaattaatgcacatttggtgttgagtgaatgaaacctgctcttgtggtactggggcccttgcagagagcgtggacctctccagctatagcagcatctctgtacatgtctctttcctctcgtgtatttttctctctctatgtttatgattgctccatcctctaaactccagctgcattcactgcctgcaccgtccttgtattctgatatttatcattttgtctgtacatcctgcctttgcagctaaagcacccctttatttgaccatgggagctgtgttatgtacttatttgggccacctgtatagatacactctccttggtgtgtgtctttcgatggggaggttgatccccctgatattaattacttgccactgaactgggggccaacagtgaccacttttcactgcagtgacattcctcacggcacctcctgtagtatctgcctggcataggggcctacttggggagcctgcattttgaaagggctcagagttcattggtatgaaatgaatcgcagaaagaaaccacaaccacaatcttttaatacctgtcccgccaggcatggcagcctctcctctatatccccactgggcccaacaccagatgatgctgtggctgtaactgaatactgggtctccatccatcaaagggccagtgaaagtcgcccagccagcttgctcactggtttggtgaatctcactgtgtgatctctttctctttcagggctctggctgacatcctaagacaacagggaccaatccccatagcacactgtgaaagagaaactatctcggccatcgatagctctcccaaagagaacacgccggtccgatcgtcctccaaaaaccactatacccccgtgcgcacggccaagcagactccaggtaagtgagtgctgatcactttgcatctctgctgaggctggtgagagggttctgtggtgtttctgcttcagccaggcaggtcgtggagccctgacgtggtgggcttgtggaagagtctggggactgtcccccctggggagagagtggtgtgggagactgccgccagtgagtgt

SEQ ID NO: 37932 - DNA, 952 bp, Bovine  19866881118578
tacagccttgttaatttttttttttcctcatgagaagagacacattcctggcagaaacatttatagaagggctgttccatgcaggagtgggccacaaatcttagctgtgaatgccacaggaaggtcgtgcttctggaaagctcaccttgcagagcaagcccccctctgatgctggttttgaggactccttgccccactcccgatgtatttttcaagttctgcaccttccgcatctctctggaaacagaacccagggacagctggggctgggtgagaaccttggggcctcctgtggaagcctcttgcttaacagaccccaggagaacgaagtgcccccacccacaactgtgagcagcagaggagagaacacaggagctgacttcactcctggttacaaaagcgtgcctagactcacacagctggaactctcgactcattcaaattcctcttttccctcctgtagcttgtctgtgattctagcttggagccaaattaataatttatttaggatagtaactgaaaaccatgcgtcatcctgacgtagcatctgcaagagggagagaggagccctcccctccttgtctcgagccgggctcagcctccaaatcaatttcctgggtcctctttaggaggcagggaactgatagaattgttccaactgctgggcattttcatccagtgttcacgaggctcgatgacttagcctgggcccctccagaaagcagagtctgaaaccagggtttacatggggtggttcatctggggacatgatcccaacgggtggaggattgagagaataaacaggaaggcgaggaagctaatccagtggttaatgagctggtgataactgtggataatgggaactcagtcctgctgagaacgtgggaaaggaccctgaaattgcctgcctgcgatgccgaaccagggtgcgtttatctcccgaatcccaaat

SEQ ID NO: 37933 - DNA, 1770 bp, Bovine  19866881327028
ataacgcttcagagtatcttacgagctaacacacattgaagccatttatggctatctgttatgcaaatagaatcctaaataacgagactgagtcttggggaatggggggcaaacaaaaccacaaagccaagtcagtctctgtctataaaagtaaacaaaatcagaccaaaaatggaaggaaggcttattccttcctgtaattcataattctgtgtggaactctgcccctcccttccaacatcattttgtcaggatagacgtgaacggtgccaaaggcctggctgtccggagctgtttcgataaccccttctatgttgacgtggtgcacaccgtaagggtcctcagagtagccgccatcgtgagtgtggccagcgaagaagcacaccacgcacttgtgagaccaaatgaccgccagggcgtctctgtaattccaggccaggcacacactgtcagaggcctcggggtaaatgggaagatggcctgtttaagagaagaagagttatgaaccaatcaagaaatacctctttcacaaaaaacaggctaacaacgagtactcaggaaaaagaaaatgtgtactgctactcatcctggactgagaacagagagaatcaacatacgcaaaaaactagatactctacagccacgtctctggagcataaagaaggggggagacggttcatacccaaggggacagcagccgctgtacaggcagaaatcctgagatctacggcctagggtctcaagatgtactaacaccaggggagacagagggcgacctggcgggggcggtcagcaaaggcagccaccggtcaggcagatgccatgctggaatccagtcttgccaactttcctacatgtatatgagtgtcacacacatagaacgagctgctcagaagtaacagaacagtctagggaggcgcccatggattatatgtcatttgtatcctcgatgttttataaagaactgacttgtgtcactttaaacacttccaggtcaagatggtcacagccattgtacacgagaaaactaagttagagcagggaacattcacaccagcttccccaggagacagaggcagaacttcagattctcgatgccaagacacgtgtgaggccacatcacatggcaggtgcggtttcatgcccaaggatgggcactatagctcactggtctttacttcttcccagtaaatcactttctttttttctctgctaccatttatttttattctgaatatttttattctgcttaaaaactattagtttatttaaaaaaaaaaaaagggaggcggtaacagagggttggcacacagacagagacacacacacaccccatcaccaccactctcgagctgtgataagggctgagagtccaaggaggccacgtgactttctagacccactgttatgctggacacatctatcaagtcccagtggtgtctgacacagtcacttgttcccttctccttgaaatacttggctccagaacaccgccatgcccctactcttctcccaaccttgactgctcctgatactcaccctcctttactgcagtctcacttctctgggtcctacccgggctgcctgaatgcttgctcctcgggatacactacactatctacccctaatagcatagtgacctcttagtaatttacgattttaaacatcaggtctattcaacttccacatttagatatccaacccaaacttcgacttccaagtttctgacaagtatgtccacaatgcttactcagtctctctccctgatgt

SEQ ID NO: 37934 - DNA, 1568 bp, Bovine  19866881351287
atctggtagaagatgtggtagcttctctcagccttcagctggaaggtcactcttgacttttcagcagatctaggaacgcaaacacaggagtgtcttccaaactgttgccccaatgtcccaaaacatctgattctaggaatcttacttacatgtttcaatatctgcagaggccagctttcccgtggtaccaaaatggatgcggatgaacttgccctgtcggggaagggagaccaagtaacctgactccaggttgttcctacccacctggggagtgcaacagagcctttttccccaggaacttgcagttaagtgtccttgtcgcctctctccctgctttgctgtgccttcctccatccccttgttccacactgcatccacatgccaccccagtcagcagagtcatattctgttcaagatgcaaatcaaaccatatcacttccctctaacaggatcctgacttctggaatgaaaccagacccttctcctggcctgcatgctcccaggctccaggtcccctcccactgcccctcctcacttccccacctcatctcgcagagcctgccttactccagccactcagaccccctggagatcccttgactccaccagtcccctccctgcctctgaactgtgtcccgcctcaccctgtggatctcgggttcacaggtcagagccccccaggagggctcccctgctggccctgtctaaaggagacccggccccctttactgtcccatttactagggaactgtcagactgttttgtagacttgtttcctcctcctttcattatccacccccggactgcaggttcctggaagcagggatcgtgcctcctcgctggccttggaggacaccccagcttgacccagcacagactcacaaagcgggacgagttgtcgttcctcacggtcttggcattcccgaaggcctccagcagtgggttggcgctgatgatctggtcttccagtgtcccctggagcagggagtcagggcaggaagagccccatgtgagggtgagctccgatgcccctcctgcccagttggtccctcccctgctccctgctttccaacctagggcccaaccacatcatcagcacctcactcagagccctgttgccaagtcacgtttggctctggttgggtatcttgacatgaacctcatttaacccttcagttccttcattctccaggtggtgaggccacctgtgttcacaccatattgctgtgatatattcattttgaaaggcaagtggatgcgacagttctccctgggtggtgtgtgtgactctggtgtatgtcagattgactttcttcagcggagccttagagctcgttttcttggcaatcgccggatctggtcctgtgagatcaccaatgcgctggatcgtctaggagagccggctgtcctgtgcgatttccaaccctgccagcactccttccctgaggagatgggcacctcccaccccacacatgccctatgcctccttactctgaagttaagacaagggttggcagtagaagcagagccagcctgcctcctcttcttaccctcatcttggagtcctt

SEQ ID NO: 37935 - DNA, 3162 bp, Bovine  19866881382176
atgaggtggccaaaggactggagtttcagctttagcatcattcctttccaaagaaatcccagggctgatctcctttcagaatggactggttggctctccttatagtccaagggactctcaagagtcttctcccaacaccacagttcaaaagcatcaattcttcagcactcagccttcttcacagtccaactctcacatccatacatgaccataggaaaaaccctagccttgactagacaaacctttgttggcaaagtgatgtctctgcttttgaatatgctatctaggttggtcataactttccttccaaggagtaagcgtcttttaatttcatggctgcagtcaccatctgcagtgattttggagccccccaaaataaagtctgacactgttttcccatctatttcccatgaagtgatgggaccagatgccatgatcttcgttttctgagtgttgagctttaagacaactttttcactctcctctttcaggggcaggctaaagatgaacaaaggccccctcccttcggggcacaagttccctttgatagggtgtaagaaggggtggctgtaaagggtgagcactggtttctctctaaagccagtctctttctttctccctgtaataaatcttcctctgcctgggtgccctgctcactctcttttcctccgcacttgccttacccctgtgtttttgctttcactcacttttatgtttctatttaaagttcacttcttataagaagcaaagggttgggtcttggttttttagccagtctgacagtctcttcattttaattggaatctttggtcaaattaggtttactgtgactgccaacttggttgtggtcaagtccgtaagcttgctgtttgttttctagttttgccatcttttccttgccccctttctttctttttctgctttcttttcacttaatgacatgcattttaggattccactttattgcctttgttggaaattgttgactataatgcttttaaaaaaaatggcaatgacttcagggtctatagcacacatcttgagctcaccacagtctatctggacgtgatgctgtgccgtttcatgtgacggaagagcttgacgatggcaagctgccatttccctcctgctggcctttaagcttccgtggtcatttatttttcttatatgtatgttataaacctccaatacattatcatcattttgttcaaatgattatcttttaaagagatttaaataataaggaaaagtcttaattatctaccaagttagcaccattcccagggctcctccctcctttctgcaggttttatttccatccagcatcatgtgtattctctaaattcactccagccttcgtatggtcaggggttcaagactggagaaggagcccgtctgcacaggaggcggcggaaaccggaagtggcttggtggtgatagttggggaggaaccatgtgggaggaggctccagcgactagccctgcgtggggcaggaggggacagggcaggctgccccccgagccctggccaggtctgtccgtggactgtgctttctatggagtttaggagagaaatgtcactttgctatctctctgcccagatctttctttttattcatagttaattgctgcatttctttagcttccataatgtcccacttaatccttaagatgttctgccttgaattcgagtttaatgaagttaaatcgctcatgtgcttctcctgctggcttgtgattgccgaaggagacaaggctgagcgttgttctctgtattccagccgctattatgtccccagaacaatgccttgcacacaatgagagattaataaatttgggtgactcctgttaacaaaggcgcttactttcatgtgacacaatctatgtgtgatttaatgctctttcatcacggactacagtgctgagtgtcctctgctctactcttgaggacttcgtaggcatgcagtctcaattttgagatctaaataggtgtgtcaacagtatggggggtcacacaagaaattctcagcttgggtttttttcactgtcataacatttatggttctgttgaagcacaagcaatttcctcaataaagaaggaaagaagggaacagctgcccgggatgataactcggctgcctgagggacactggcagccacagtctgggcagtttggatgctaataaggggcggggggcaggacgtggctggtgatggaccttgtggaaatatgtcttcaacaggcgaggagccgggagctgctgccttgcagaggtttgactgaaagctgtctggaatctcaatctgagagcagagctgggaggcagtttctattaacaggggatgtgcctgctgtttattgctcctgatagagctggcgcccagctagacacctgttgatcacgtgtcaggacatcagggcagaaatatcagctcctggaggaaagtctttcagcagatatatgagaaacccagaaaaatcaatacccctaatacaaagatgtttctggaggtgttccttttagaatgaagagacacaccacgctcttgccaatactttggatattagaaacaatatttctttttaaagaagaagtggatctaaagcacagtgtggcttaaaaaaatacaaacaaaagctctcacctctggctgagggagctccagggtcatcctaagcccccgatgggccctgtggacagaggctccaagagcctcctttccccttctccccgatggtcacctgcgtcatcatggtgatgctctcagggtcccagcttatcgatgcttttcctggtcccccaaccccagatgtgtccagtgagttctggaacatcaactgtccctatttttactttcctacaaagccggcttaaactcaatattaaaagaaaactaagatggcatctggtctcatcacttcatggcacatggaagaggaaaatgtggaagcagtgacagatttcctcttcttgggctctgagatcactgcagatggtgactgcaaccatgaaatcagaagacaactgcttcttggcaggaaagctatgacaaactgagacggtgtattataaagctgagacattgctttgacgacaaaggtctgtatagtcacagctctggtctttccagtagccatgcaccataaaaataggctgcgca

SEQ ID NO: 37936 - DNA, 1066 bp, Bovine  19866881636576
atgtccatcactgactcgatggacatgagtctgagtaagctctgggagttcatgatggatagggaagcctggcatcctgcagtccatggagtcgcaaacagttggacaccagtgagtgcctgaactgaaccaaagaagaaaaagtaacaaatctcagcaaattatctttctagtcccctctacaagccttgtggtgaacaaggtcagcctggaaataaaataaactatatgaaagagagcagagaaggagatagcagcaagcctagggatgatctaaaactcctgtcaaaatgagaaagttcaccctaagaatgcaaacacaggaaaaatgttctggtaggtcagagtactgactacacgcaattcaaagcgacagtcttctgaaatattgcatctgggtgagaagaaggtagaagttaaggaagaatcttgggagattggctgataaaaagaacaaccacagcaaggcgggaatggggccctataagacaaaagaacacaaaaatgtctaaggacattcatctccttcctaataataatatctgttagataaattgcattttctatactagtagaaaagataccatttcaataggaatctgatcacttccaccagtcataaaatagataagagacttccctggtggtccaatggttaagaattcaccttgaaatgcagaggactccaattctacccctggtcagggaactaagatcccacatgccttggagaagtagagcctgcctgccactactaagatccagtgcagccaaacagataaagaaaacagacagaaggaataggaataaacacacaggaatctaccgttaaaaaacataagatgagacttcaaacacctctgctaataacaattttcttccaatcccgcacaaaaataaacatgaagcaaaagaaaagtgaacacgacactctgaactgagttagatttaaaaacgcgtttgtggttatttaaaaaaaaaaaaaaaaaaaaacaccttgaaacagaacttcaaaacattaaaaacaagggcaaaagggagacagaaatttagagagaattcactg

SEQ ID NO: 37937 - DNA, 682 bp, Bovine  19866882085498
tggggctccaagagtctgaacagaagcaagctcacaggttgaagacttttaaggaggcaagggttggggatgagactgtccctgccccttcggggctctgaccaaaagaagtagaaagttctggaagtcctatcttcctggctttctctcacttctgtgggaggggagcaggcacatgtattcctatttgcaagacaaggaacctgcagctcagactttcagtgtcttgcataagatcacaaagacaaacacagggtgaaaatctcatgagctccatgaacggaagctagatcaggttgactggtcagtgatgttcagatagtaaaaccaagactttctcctgggctggacacagcaggacaccacatcagacacggcatctgcccatgtgtggatttcatttttagtggcctgctgcagtttcctttcactcaatgtttgtctaagagtgttttgctgacagctgcctttccagggcttgggttgaggaactggattaggaacactgtatgctaaaggtcagagtcacagtaattagcgcaacaggcttgaagagcggcagcaaccaggacggggagctgctgagtctccggagttcctaaggctctcaatctttgttttggaaaaggtcccagcatagacggaagcccagtgaatgtgtgtgtgtgtgtgtgtgtgtgtg

SEQ ID NO: 37938 - DNA, 694 bp, Bovine  19866880264364
cttttttatttattttttaatttaattttatttttaaactttacataattgtattagttttgccaaatatcaaaatgaatccgtcacaggtatacatgtgttccccatcctgaaccctcctccctcctccctcaccataccatccctcttggtcgtcccagtgcactagccccaagcatccagtatcgtgcatcgaacctggactggcaactcgtttcatacatgatattttacatgtttcaatgccattctcccaaacatacaaattcttgagcctcactggatatttactgaacctgagtctctagggtccaaggcataggtgttttatttcataaggagtacaggtccttgtaagagcagacatgtctgtgaaacacaggaatagtctagaatcttcttccaacagcctttctgacaggagagcctcaaccagtgtaacaattttgaaagctatttcctagttcaaaagaacgttgagtggtttcaggttttaaaaaacttaaaatacaatacaatgggaaagtcatctttgagagaaggatggaattaaatgaaaatggaacacttagcaattattttcaaaagccagatgattttcaaaaaaaacacccagcacggcagagccctgagggcatccattgtgctaataaatttgctaataaagaagacttatttggaattcaaagaaaag

SEQ ID NO: 37939 - DNA, 1589 bp, Bovine  19866880473225
tattcttggggggagaatgccatggacagaggaacctgctgggctatagtccacagggttgcaaagattcggacatgactgaatgactaacactgtcacttttcaaagcacattttcatggtgatgctttcctcaccgatctaacgctcatggcaagatggtgagtcttcagggctgcagtggtggtgagagggtggatggaaggaatgcttataacattgaatccagcatggatgtcctctgaagactttgaattcatccctcctcctcatgcaaaggaacttgcccccttttggtatcatttaacacagtcagtcattcgctgtaggcttctatttgctaaaccagtcaacacacttttagaatcacatgtggtttcctgagccagatcagagaatggcaacacgtgcatcaaaatataagctatctgaaaatactccctcttcaaccgagcaccttcaacatccattttcattaacatggtaaaaaaggttgacgtgaattagtaaattcctgcaattccttatcctgtaatcctcattctctgtgctctggttctatgtttcactctacctgagtttgaattctggtcatcagccaaaccatatggagactcagcacatgactgtcagctttcttctgcaagggaggtaagctttcctagcaaaggcaaggcgaggcgagtatcttggaaggtttgagggcaggacgggcatggattctgcaagtcctctatgtgtcctaataatcattcttctaattgtctgggtcctagtttttcctgattcttgtcctagtcattttacttaaacatagtgaggtcgtgcatttaactaataataaaataaggccgccctagaacttacctctaggcttggttttcagtgaccgcaggctccatccatctggggtttcatactgtgctttgaggaaaacttttggcttagatggtgaagagtctgcctgagatgtgggagacctgggttcgatccctgggtcaggaagattccctggagcagggcatggcaacccactcaagtattcttgcctggaaaatcccatggatggaggagcctggcaggctgcagtccatgagcttgcaaagactcagacatgacttcactttttacttttaaggtttgagagtgctgttagaacaattctcttgcctaataccccagagatttgctccaggtgaacacagatcggagattacctgtctcaccactggataccttgtggtgttggcctcccaacctggaatctgaacttttgttactgcctcagtttgattttttagggaatatgcatgcaagtatactgtaataatcacatgggttggtggggggcttgtgatttttaaaaagttgaacaaaatgctatgttactgggcattatgatatttatgctgattatatgtaagttcttagacttgtctgtaaagtcctgacaaaatgatgttaggccatcccttcagagaatatagctcatcggatagtgtgacaacatgtgctgagaatttcatctaataattacccatcttcaatccactttaaaatagacacacataagtcaaaaaaaaaaaaaaa

SEQ ID NO: 37940 - DNA, 3755 bp, Bovine  19866880481231
tgggagctgctgtataacagggagctcaacccacgctctgtgaccactgagaggggcgcgatgggaaggagagtggcagggaggttccagagggaggggacgtatgtagacctatggctgattcatgttgtatggcagaaaccaacacagcattgtaaagcaagtatcccccaattaaaagaaaacagaagcaatgttgtaacaaattcaataaagacttaaaaaaaatcaatcttatgggaaaactccagtgaactttttggccagctcaatacatgcctcccctaggtactttctcagtaatgcatgtctcctttacaagttgccacttgcccagccccctgggtctctaggtcctggggctgagtttctacacagagttggttccttcaaggactctgcctctctgggcctgccccatagccttgagctagcaggcctgtccctctaccactgcagaaacacccatgagaacagacctccccctgggtcctgctcatggtttgtatcccttaattgcttcccacttgtcttttcaggcctggccccagaactggatttactgtccacgtgcagatagatttacctttagacctgacatgtgaccgtgtctccctggaacgcaagtggatggctcatatgaattttggtttgcactgacccctttcattttgctgtttctggcttctttgagtaaatacgacacccaggaaattccactctctaaaacatacccgctgttataagcttccacgggcgtccatactagcttatggcctggacgtcaagcctcagacagtggtcagtgtatatccagaacgtttttgtgcccaggtcacttcactctcaaggtaaaaaggcctaggggtggctatagccccagggtccaggtggcagacacgtggtagagatacgtgacctattctgtgccttgttacccgtttaccaaagctctcttgagcagccttgacaggaacataggaaaaatgtaaaaaatagcttgttcaatttctattgctttccgtgtgctctgggtggggggaagaaattagaggaagagagaatttctacaacagttctctatgtatcgtccatggaaatagtttttcatcagcaagaatttgcatgaatgaagacttccaagaatgaattcttctgaaaagacagatgtaggtcatttctagaaggtcttctaaccccagaactctgcaccctccttgtctccaagccctggttatctctctgccacatttttatcatgttaggaagttagcacatcctgacagatgataagagcatgggctttaggggctgacagttcagttcaacacacatatgttgcctgcactaggttccaaataagacagaatccctcttgttgtgaccttatagtcgcgtgggcaacactcgaacaggtaatttcaacatgatgggcaagctatgaggaaactacgcagagtgctccagaggcagccatcgcctaccaactgcatgtccttgggcaaatggcaacctctctcagagccccagtgtctacaaatatgaaaccgaatcaaagttcctgctgcctaaggattgctctgagaactaaatgtgataacatttgtaaaacacataacagtgtcttacacacagagggcacgccacaaatggtggccattaggctatcgaacaaggccagaacccagagttcctgttctatctgtgcttggctgagtgggtctcactctcccactacaaactgaattttcacacgacccaatcactgcagtaattctaacaataacccactgtaatacttgcccttgttcacaggagagactggacaagaaatgatgactatattagcacaaatccacaattgcaacttgaaaaacatctcaaagaacattttgtgctcacagtgggcctgggccactgtttaatatgtgaagtgtgaagtgtctacattatcactgtaacttttccctcaacttccccctgtctgctgcaaatcattagactaaaggtcttctctctctttgtctttgtctgtagcagccttcttgtggctttgtctaagggtcacattcagggcagcctcttggtagaagtctccaaggttgtatgctttagaggccactgccaaaataacttcaaagagtcatccatgtactggacactggtccttaattaggtcttaggtgtctcttttttgatgttaacaagtacccaaatacatgacctttggttggttttttcttcctgacgatattcgactatgttagagaaaaggcggcttaaggacatactagtaggctttatttaaagccttactgtaaacttgttttctcagttctttgatttcctcctgtttcttcactgagatagtcatctatcaggtgaccattcctaatgggtgctctttactcctagaagtcatcatcttatgagctcatggcttggggaatgactgacataggtggttaatatcattgtgcttaaaaactggggtgccattttgttagctttataaatgtttgaattatacttactaatataaatttcatgcattcccatgtatctgccatgaattcctcaagatacctgaaatgcagtctacaccaaaaatcaaatcatgactacagtaacattagtctaagaatgacccctagtagcccttactcagagggcagaaccaagagccaagagagtaaaacaaaaagtcaaggagaattattctccggctttcaggcctaatgagttagccaagctggatgtcaaaactgctttggactgataagtcctctgtgttttccgttttcaccccatttgagctggaatccctgaactgtgatctcgtgcctgcccaccattgtatcttgagagtgtgggggcaaactacttgtctctgtagttccacaggaccacagttagagagggagtgtgccctcggagcctcatcagaacctgatttagaagattttttttttttttttggacttttgagttgatattgaaaagggataggttggagcaggtacaggtattttgtgtgtgaaacagatgtggattgttgtgggggagagggtggactgcagtagtcagaattctaccccagtgtctttcaatcttgtataatcaaatcatctgcccctttaagtgctggtggaaactaagaatgtgattacatccctatgattatgttacatgtcaaaacggagattgttcagctgggcctaatcaacgaattacaacgaattgagctgtgtacaagcagagagtggtacctggctgacagcaagaaaaggaagacctctgtccgacctctgtcctataaccagaaggaactgccttctgctaataacacaaatgagcttggaagcaagttcttccttgttcaggcctccataagagcatgccgccggtcagcattttgatttcacctctgtgtggatcccaggagtggaccagctctgctttctagacttctgacagacaaaactgtgagctaataaatgggtgttacttgaagataccaagtttatggtcatttatcacagagcagttggagaagactcttgagagtcccttggactgcaaggagatccaaccagtccatcctaaaggaaatcagtcctgaatattcattggaaggactgatgctgaagctgaagctccaatactttggccacctgatgtgaagagctgactcattagaaaagaccctgatgctgggaaagactgaaggcaggaggagaaggggacaacagagg

SEQ ID NO: 37941 - DNA, 1358 bp, Bovine  19866880528403
gggcaccaggccctctgaggtttttttaaggtccagtgaattccgccttggacaggaaggtctgctaccacttgcctgtccagtaatacactttacaaggccaatattagatctaccataagccagatgctaattataaggcattaagtaagcaaatcggagaaggcaatggcaccccactccagtactcttgcctggaaaatcctatggatggaggagccttgtaggctgcagtccatggggtcgctaagagtcggacacgactgagcgacttcactttcacttttcactttcctctttcctgcattggagaaggaaatggcaattcactccagtgttcttgcctggagaatcccaggaacagaggagcctggtaggctgccatctatggggtcgcacagagtcagacacgactgaagcgacttagcagcagcagcaagtaagcaaatagtgccccgagctactagagaagaaaaatcccactaaagataaaaaggcttatgattttaaagatcaaatcaagctccactcgttttacctgctaaacccatcagaaccatactaggaatgtcagtgatggtttttatagtttttggaaacactttggtctctggattgtaattagcaataaaaaaaggaagatatcaaaccactcaccttgttacttggaaggctaaatgtagatgtcttcaatatactttatatgttcttaatacttgaggagaactttttgaatctgtgcattttatttttccaatcttattttacaaattcatattctataaataatagagtagtagatagataaacttaaggcactttgccatttggtaattaaatgaagggcagaagatttcaaaaagtacgtgtacccaaacccacaacaaactaaaactatgaactcaatttctaatgtatccggtggtcagagactctgtactgctgccagaattgccaaataattttaataaagttgggtttgaacataattcaaagttgtctttctctttagcttgatcagattttcatataattcatgacttcttagatttaggtagactaccaaaaacgctgcagaagatgcttttacgacacaagaatataagaagaccgaaaaccgcattcaagaggaacttacctttgggggtttttatatgtgttcaccaactggccagagatagcaacccaagggtctctggccctagggcagttcatagacatgatccgttttgcctgaaaattgtctgtggggtctgtatgtgtttatatatgaattggatttcaacagttaaaaactgggggtttcgcggaaggaggaatggactttgaagtatctggcaagactggacctgcactgc

SEQ ID NO: 37942 - DNA, 810 bp, Bovine  19866880641847
ggaagcccattgagagattattattatgtattaggcactgacctggagaaggaaatggcaacccactccagtattcttgcctggagaatcccagggaccgaggagtctggtgggctgccgtctatggggtcgcacagagtcagacacgaataaagcgacttagcagcagcagcaggcactgacctagaaaatttctcattattatctcagtttaattccaacaagtcactgagatccacttgaattagagaggtgatttatctgagtaagatcaggaatacatgaaggggagtagaacccctttatgtgggaagcagtagttgagagctcagatctgcagtcaaatgagctagcttcaaatcctcggttggccaatttccatccatctgtaatgtggttaagttacctaaccctttctaagtcttttctaagtcagcttccttacctgtaaatcattgtacttcacacagttattgtgcttacctgctcacaagcaagcactaaataaatggaagctactgctattggtatttcctgatctgaagggacagcgctaacattcacggtcttaacactacaggccttttcactggttggcaatctccaccacccccacccccaaccactcttctctaaaaccaaatgctttagacgtggggaaaatttctacctaacagtacccacatttgaaagtcacttcacttgatgaaagttatatttcatgagataaggtctgccttgtgcatgatatgcagtcaaataatttacagaattaactaacaaataaaggacctgcaatattacatctaa

SEQ ID NO: 37943 - DNA, 1415 bp, Bovine  19866880702237
cataccctccctctgggtcgtcccagtgcaccagccccaagcatccagtatcgtgcatcgaacctggactttctttagttatgaaaagagtatgttccagattggagactgggatggggagccctcccagtacaacatgggtctctgcatccaggtggttcaggggcattcacaagaatggttagaaagcaaagccacttgggagtttaagacaggctgagggccctccacttgtaaagaacaccttggcatcatggaaagtgtggaagagtcaaacttcagctctgccccgagccactgcgtgagccctaagcacctcagtgtccccatctgaagaaatattggagtgacagcatctttgcccaaattatctcatagaatattaccaagaatcaacatagaatagcatctcaaacatacataagaaataaagtgctgttcaaacgttaaggtatctttaaagacatttatcaatgtgtgagaaaattatattaggaattaactatgcagaggaaaaacctaaacactagaagacacttaagacatgaccttttaataaacacacatcttctttcagcacattccaacaaaagaaaaaatgtatgaaataatctcaacccttgataagccggatttctaaagctggtgactcatttatatgcaaatcactgaaaacatctgccagtggtttcaaccaagtttatgttgatcacatttctaattgcggtttcttggtgagctggttgactcatcaagcacatcaataaactgacctatataggaagtaatttggaaattatttgggaacgttctgtgattgatgttcccaaaggtttctaattagcctttagaaatcgcctgaggtattgattgctttgtaatgtcatctaactgactgttggttcattcaagagcacctagttgggactatgagtagaaatgatgtccttgggcagacttttttagttctttggtaaaagtgattatgaagtgatccctggaatgagtgtatataaatacacatatagaacaacccaggctcctaagggggcagccttacgaaaaatgctggaaatcaggacatccctgtgcagccactaagcagccatgtgactttggcctctgttttctcatttatcaactggggtatctggatccagttccatcctcagacctgagcaagaagggccttgctctgggcctgactgtggatctcattggccacaccgtctgttctcctgccttcagtggggtggggagaccacagggtcaaaaaaatctgcctgcctgaagcctaaattctgcactagctagtcatactctggacccctggaatccctgaattcctgtccagggaccgtaactctgggtagacttcttcccctgggcctaccctctcaaaaaggaacacaccc

SEQ ID NO: 37944 - DNA, 827 bp, Bovine  19866880774655
aagaacaaagaaagaagcaaaaattggccattgaagcttggaaaaaacagagaagtatagaaatgtcaatgaaaaacgcttcccagttaaaagaggaagaagagaaagagaaaaagcagcagagagagcgtcagcgccagtgtaaactgaaattgctgctggaaacgtacacccaacagaagaaagaacaggaagaatttttgagacttgaaaaggagatacgggaaaagacagaaaaggcagaaaaaaggaaaactgctgctgatgaaatttccaggtttcaagaaagagtaagtaaatacatttcctgaataatttttcagtgatacacatggaggtattacttccaggctcaattcggcaaaaattaattgaatgcttcttacgtatctggcctggacctagcattagtacaccaaaataagtaggctgtgctccctgctttctagtaggttatagtctagtggggatgagtggtgtgcagataggggacttcgctgtgatacggtaaacagtgtggtgcttgaggtgcggacagacagcttggggaggtggagtgcacggagggaagctcacacagctgcgtgaggcagaaggcgatacttgagtcttgaaagggaaggaaagagctccttcctagcagaagaaacagcgtgaatgggcggcttggaggagcgtaacagtagcttatgggggaaactgtaaacacttcaatattcttagggggagatggaagccagtatcgagggggatacggaagccagcaggagcacgagactggaaaggcagccacagtccaggccatgaaggtcttgtctgctctgcca

SEQ ID NO: 37945 - DNA, 1464 bp, Bovine  19866880814272
agaccggttttcttggataactgttgaatggattaacttcaaatgggagtcctgggagggctgtgaacagcacagcaagtgagcagctgtttctgttaaaatacgttgccagcccggacacgggctccgccgccgattgcttggcccgtcacccttaggcgggctggccaggctctccccagatacacagccgtgggaatgaactcctccgggcccttccttcagtccccagcccatctcccgagcacttctcttaccctgcctgctgctcctctctagctcgtgaccggggcatctcagctcttgcctgcagcttctggcctccccctcacccgtcatcagccctggtgcctggtgagctgcccccgtggccacccctgcactctgcttcgcactcacacttgggtcactctgggtcacacccccggtcctgcgggaccctgagccctcaccccaaggctagtgcacgtgtgtatgtgggtgtacacttgcctcaagagaaaggtactaacagacttgttttacaaacaccttttaatgggttttcagtagatctgaccagttctgcaatagtccttcgttgtacaagttcagcatttttggttattgactcattgactgacatctattaagacctactcagtaggagtgctaggcttcacattcagaagttactggttactttcagtcttgaagtggacgtaagggtgatctgactgtgaggtctgtctccccacacataggtgagttgaccacactttatctccatggttgagatagacattttcccgccaagtccacacgagcatttcctgaagctgtcagaagagaaacgtcattcccagatggatcactgcttcataaagtgcctgcacgttgtcaagtgcaagcactggaagtagagtttggtgtacagtgtatttatgtccattgaaagagcaaaggagaaactaaatatatagaagctctggaagagtgagcaagaaaatgataacgtagaattcttctgaagaagggattctggcagcttgggagtcgggggaagaagggaaatttttcactgtttgtacttttgtaactttggaattttaaattctgtgaatattatggcttaaaaaaaaaagtaaaatctatttttaaatgttaagtccttgaaaaggaggtggggctaagatgctatcacctggaatcttgagcgaactgaatccgctcaaagtgaatccgtgggaaatcatggaagaaagaagtggagctccgcagtagaggattaggtgtggtagctattgttgttgcttcctgaaaatatattgtccaccactcatgaatgtgcacctgctgggtctctggcccatggctgggaaggaagtgggcaggtggatgacaggccaaagtaagatgctcgtgggaagcttcgtgctgtagtgaatctgagactgccagctgcattccttctacctaaacaca

SEQ ID NO: 37946 - DNA, 1116 bp, Bovine  19866880848431
cctgctttctaatttaaaatgctaccagtgtagcaaaggatgaacatattttcaacccctttaattctaaaatgtttgaagaccaaatagctactccttcaccaatatttatcaatggattaagcactgaagtttaagattttgcagatttctctgttggggttcttatattggagttgtcctacagctttttaagtgtccctctatatttagatcggcaaattttaaacagtaatgttaaagttattaacctgagagtaaggtaaatgtccttttctggttgtctgcctactctgttgtgttcagatagttacaccacaattaagccgagttgggtatcatcaaagtgctgagtttggcatagataatgcatttatttaatctgtgcctatcaaaacttcatgatatttaaagactattaccacaaataacctgtgatgaaactattgaaatatattaaaaagttttaaatcaccactgttacttgttgtagaaaataatactgacttaatctagtctgtaacttgttaaagtttgatggcttgtctatgcttaataggtatgtatataaaaattagaaaatacatgtctacctgcatatgattactacgtaaacttttccttctcctatataatttgtagctcatcttttttctttaatccttttataacttgttgcaacagtttgaatttctcaaatgtttatatttggacacttggctgagaatacttatttaaacatcattagctgtatatatttttaaagtagaataaataatgggaagggacttgatatgcaagtttatactaaaattccaactgtgtgaagatacatttaaaaatattacttttctaataatctaaacattctttttattaaagaagcagatggtctggggttcacagctttattcctggtttgatgataatcaactttgaaaacacagtggactgaaaagcaattttattcttttaaaggtttcctttaaatctctatactatccatttttgcttcagtttgtaaatgtgtaacatttttttgttaaataggacaaagcagaccctatgactattgttttcaaaaattaaacaaatttatatatatatatatttatt

SEQ ID NO: 37947 - DNA, 943 bp, Bovine  19866880887216
ctgaagcagttcctgaggcatggccttttatttaaaaaaaaaaaaagaagaagcattcagaatcagatgctgaggacttggtcacaaggcagcctcggggcttctgttaggcccgacagtttgtgtccaaccctgtaggactgcacagtgataacggcagcagtgaggtcctcgaagatcctaaagctcttctaaattgcctgagagagtaaattcattttacttgcttcagtgttcatgcatttcactgtattctagttctctgatggttggtaacctgagtgtaaccgtgataaacagctccagcaaggcacagggattaatcacgacacaccagaactccatcaggccaactaaataagagtttaccagatctagaaatacaccaataatcaccactgccagagatagaggtcttccttcccactgtagaacatgaagcttatagctaatccacacttaaaaaaataagtatctctgtgtttctggtttgttaattcagcagcgtccctctctgcaacacacagttgtgactcgaggccaaacaagagtaaaccaccatctggtgaagtcttgctccggtggaccaaggttaaaccttattatagaacagctgaggtttcgctgactacgtcaaaagtccttatatttagaaaccttgctcagtttgccttggtcgctgtccctctcatcagtcactgctggttagacaccgctgggtgcaatggggagaggcccgctgctctgggtgcttcccacgggggcacgcaccggggctccccatgctggaccccactccacaccccccactgctgagcccacctgattcactcccaggggccacgaccccagggacacacacctctctctactgcctcgggtacccactctcgggcatcactgaagcagccacagtatttattttgatgtaattctcatagat

SEQ ID NO: 37948 - DNA, 1029 bp, Bovine  19866880969145
ctacataaggtgagtttctgtctcatgtatcaccaagataggaaaaaggaactgtcctttaagcgatgtcacagcatctaacgtaagatacatcccaattagaaactacacattggagcaagaaaaagtgcatcttagaatcaatggcatacagtaataatagtaacacaagctaaaatttgtgtgtagttcctatgttccaggcactgtttaagttctttatttgtattgtctcattcagccctcacaagagcttcataaaggcagatgttattagtattattatcccactttttacagaaggaaatgaaagtagagtgagtcagtaacttgcccaaggccacataggtgttagtggaaccaaatgtctgagtctaaattcctactcctgcatcatcgcagctcctctggaaattacacaaaatacacagaaacaacaaaaaagtcacttgtcatcctactgctgaaagacagcatccagatctgacactgttccttccagtcataaaaataacaatacattgtccatgtgatttttaatgatcagtatttttaaagcaatagtgtacagaggaaccaaatggaactatgtatatattaataagtatcaccctcaaatttctatccaacattttagaataaatccaccatgagccctttgacatctcagccattcctctccttgcttcatcccttacggggttaacccaagctttcccaaggttttccccttttccatatggtgtctaagaaggtcaccaagtaatgtgtttctcgtatgagtgccaaatgcctctcttagaccctggacgctgtaacatgattctgctgaattcttgcagaaaatgctcacagacccctcgagataccgtatggcaagcaaccagatgtcatcataaaagcatgactcagatttccaggcagccaacagcctcagaggacaaagctcctccaaggccctggagtgcttgcaacacggctgactggttggaacgggtatctccaggtcagagaacccatcccagaggg

SEQ ID NO: 37949 - DNA, 1874 bp, Bovine  19866881024048
cttccgattgagagaagctcaaggccgaagcagagctgaggatctaaatacaagagtggcctactggtcagtaggagaagccctcattctcctggtggttagcatagggcaggtatttcttttgaaaagcttcttctccgataaaagaaccacaacaactcgtgttggatcgtaatttgagaattgatgcaccattgccgctgtaatattgctgtcctccaattaattttaggtaccgaagaactcaatatggcaacatttttagaaccttactcatacacttgttgggggtgggtgtacaatgcatatcccaagctgtggaaaggacacctttttttatttgtaaaggtagaaaaactttgggacttattttgggctattcataaatattcaacacaatgatttacacttttctgggttgtttctatctactcacacgctaacctttggtaattttgattcctcttatccttttaaaagtacttttcttgtaagcagtggatattttaaacaaagccttcaatttaatgttaatgtggaggaagaaaattaccttttagttgtttatagtaaataaagttttgtttttaagaaaaccaaatgtgattaactgtagcccaagccctattcctgcattgtttaattttatgaggaaaaaaaatctaccatagaaatattagttaatattgatataattttaaattgacacatcatggtttaatttatttctcagtagcttggaaaatgtcatttttgttgtttgggtttattctatgatctaccaccagatatgttattttttttttttcataaagacaggaactagtgtgtttcagtaacagagtttacagacaccttaaaaatcagactgttgttaacaggtagaataatcacagagtaatttaagacactacaatggggagcaaatgacatgagaaaactttcagtgagttatcagcacacattacattttcagtgcttttacaaagaaaaaaggtgatctgtttcattaaacattgaattggctaattcttgctctaatgtggctttaatgtcgggagtcactcctagctttaattgacagttgttaatataaaagtgaaagtgtaacggtgccatatgttttattccagtgggtgtgatgcactgagaagtgagtttctttgggttttttctttctttttcttctttgttttttgggggtttttttgtttgttttttgtcttgcacatacaatttgtacaatccctgatatagcagccctaagatgatttaaaaatttagaatgctgtgtgtgtttcttatttgataatcttcattgattgtactgcatttaatgagtattaaatagtgcattttctgtacactaaaaaaaaaaaaaaaaaaggttatcatgaccctgtgctctaacctctttatctttctttagttcattctcaggttgctcatggtggcaaggtggctgcaagaagccgctggcttacaacccccttccagcttcaagacagtaaggaaaacaaagtacctctactgcaactctaggggaaaagtctcattgcttctcatggtctttgatttcatcacatgctcattcttataccaagcagtgtggtcaaagaattgcacattcagattagaaagacctgagtcccacattcaccccaggaacagttgtgaagccttatgtgaacagatggcttaaattcaggacaaggatgggtatatacagcaaaatcagggtacctgattcatgcttagtcactcagctgtgtctgacattttgcaatcctgtggatggtagaccatcaggctcctctgtccgtggaattctccaggcaagactggagtaggttgccattcccttctccagagaa

SEQ ID NO: 37950 - DNA, 721 bp, Bovine  19866881024381
atgtgtatgtgaagccaccatatataagtacttactgtatacaagaccctgtgttaagtacttcgtgtacattatcgagcctcagtacatggcactagaactatcttacagataagataaagcttacaggtgatgaacttgtctaagatcatacagttattaaatgacaaatctcagatgtaagtccaagccaaaaattcacaataaccactgctactgtgtccatgtgatccacagaattctctgtgagactgagccaaatcagcaggcagtgaacactgtgaaaattcctgcagtcaaaaacacatcaagtatctaatttaaatttatggagtaacagccaaacttacttgctcatggagtcctcccctttcctccatacctttaaactgctcttagacatattaccctttagacaccatgatgtactaacctttacaacatttttaaatgttctctgtcactcaacagttttaggctgtattaagtgaaaatgaaagttgctcagttactaggactctccaagaaggaattcaaatgcttacatgtcaaagttatgggcagaattggtaacccaagaaatcttaccagcaaaataacttctggaatacaaatatttccacttaagtcagatgtgcttaaaaatggagggagcatttaggtacaaagatttcaaatgagtaaaacaaattaaggtgtcatatagcatcttaaaatgccc

SEQ ID NO: 37951 - DNA, 1255 bp, Bovine  19866881050393
tatggtctgtaattcatttaaaaagattgtttttttttacatcacctgtctgggtataggtgctaggatgtattcatgtcagaaagctaattttatgtttgtgcttttgaaataaagactgttgaatatatatgagtttattaaaaccaggatttttaatattcctaattccagtctctaactgttaaactccttaacattcatcctcatagatttcggcttctaaacttgtacaagcttttatttatgtccacagctaagaaaacttgcaaagtatgttttttgtgttatttgttaaaactattatggtgtttactatgaggagaagaggggaggagaaaatagggtgccatggataaaaatgaagccaaaagctgtggctcttattagggtacagtcatttcagtagcccgcatggcaattgaatagttatattgggaagttttcttcactaaatggaaaccggcgattagattttccatagtgagggcctctttaatattgctagacttctcagtgtgagaagtccacatatcatctaacccctctattaaatatctttctcttaagctgtggggaagtgccctgtgaagcagcatctgtcacggtacttttattttttggggggaacatggttgctttacactgccatgtcagcttctgctgtacagcagcatgaaccaggcgtagatatatatatatccccttttctggcttcccttcccatttaggtcaccacagggccctgaacagagctctctgccccacacagcaggccctcattagtcatctcttctttacagagcagtgcatatatgtcaatcccagtctcccagtccatcccacccctccccccattcttcacgcctgtgactctatctctgctctgctaataagatcacctataccattttccttggtggcacttccctggtggctcagaggttaaagcgtctgcctgtaatgcgggagacccgggttcgatccctgggtcgggaagatcccctggagaaggaaatggtaacccacttcagtattcttgcctggagaaatcccatggatggagaagcctggcaggccacagtccatggggtcgcaaagagtcagacacgactgaacgacttcactttcactttcaccataccattttcctagactccacatatatgcatcaatatacaatgtttgtttttctctttctgacttacctcactctgtatgacagactctaggtccatccacgtctccgcaaatg

SEQ ID NO: 37952 - DNA, 1329 bp, Bovine  19866881058427
cctggaaaaacgtctgctagtctctggcccaggtcctcacagaaagctggttctttctgctgctgtgactgtccagataaattcgccctccaactgcggctttgacacggagcgaggggttcatccctctgggatctagtgcccccggtggttttccaagtcgtaattagacttcagaaacgtgactctttttacctcaatctctgaagcaaactttcctacaaatttaacctcaggtcatatcatcaggaactttaaatgtctgaaaaacctttcacttcctgatgctttttatttctccaacctggacacttcacctccattcatgaggctacttcctgctcccaccagccggaagaagaagctgaaagaggcggagtgcttacacccctgggaggtggagccacccgctgactcattgcgtggatacttggaactttcaacgtgggcagcaggccctgaagagacatacataattagtgtatactcgctagcaaaatagccagaaggtcctgtgagcaggtccaattaaatcttcctaaattaggaccctgacctctcaataacctccttatatttgcatgaattcatctgcacagtcatgatgccattttcatgacagggtttgccttaagagaaagaaaaagacatgaatgacagaggcctcaagtgtatcagcgtctagaatacaaggaaggatggaaacatgttgtttttcttcctaacaaacttccttaggtattttctaccccagtcggtcggtgtaaagcacgctgactcacaaatgcagggcagttggggctgggtggggggtggctggggatatacaactgggtatattcctgtactcctgagacacacctcctgcatgagggagataaaggctgatcaagatgaatctcttcatctatagtcttcaaggaggaagtttagggacagtccaggcaagtgggcttgcatctgtgggcaaggcagaagggaaacccagtcagctttacctgtgggctggggtgacatgcctccttctcactcatctgaaacagcccttcatatgggactgctaatgaatgtacaagcatatagggagctcaagaagaccatgctgttaattaaagaaccactcacaatgtcaggggaatttctacaattataactttaaacagatgttcagtattttgaggctaacaaagtatagctgctgctgtgctgtgctcagtcgtgtctctttgcatggactgtatggactgaaggctgccaggctcctctgtccgtgggattttccaggcaggaatactggaatgggttaccatttcctactctggggatctt

SEQ ID NO: 37953 - DNA, 1669 bp, Bovine  19866881145800
ccatatataaattatatataattaaatacatattatatatttattgttttattgtgccatatattaattatgtatctataatttaaattaaaaaataaatgatataccatatacaaaattatatatacatgtataatttactgtacccatatatgtgtgctgctgctgctgctaagtcacttcaatcgtgtccgactctgtgcatccccatagacggcagcccaccagggctcccccatccctgggattctccaggaaagaacactggagtgggttgccatttccttctccaatgcatgaaagtgaaagtgaagccactcagtcatgtctgacgcttcgcgactccatggactactagcccaccaggctcctccatccatgggattttccaggcaagagtactggagtggggtgccattgccttctccatatatactttttatatgtggagtgtatgtgtgtgtatatgtttattctttctcctcagaaggaagttaaaatctgctaactgaaggaaaagtggcccaggaatttggtgtggagagagtcttttatttgtcactgtatatatttttgtacagattgaattttttctctacaatctctctacaatttctttttattagtaatagttatttccaatagcacaatcctccccaagcctgattttctaaattaacagcacaaagagtttgcattcgttaaatttccttcagtatcattatctgaatatttaaagtacagactgacttcagtctgtgttaatttaaatggctgcaataaaggtattatttcccacatcccatctccctgtcactgtccttctctctttcctttccctctcttttacttccacttctcatcttcccctccttccctggctctcctccttccataaatgtggactattaattggctgtccaaggacctggccttcccagggcccatgcagaaaatcagggacaacagaacacagaggatcatctccccaggacccgcggagctagttagggcttctgtccgccagcccctggatgggaactgacactgcctgaacacgcactcctgggaacgggcagtgatctccacgtggtttttgcctggttgtttgcttcttgctgatgggtgaggacacatgtgcaccgacaggagttggcatgtgcccaggagcttatttactcaaggcttcaaatgaaggcaaaggtttattttgactctttcctgtggcatcagaaccctgcttatgagaacaggatgaggacacagcaggaagatagcagcaagaccaccaggtgcctcgaggcagatggtggaagaggtgacattggtttccgagggatctcacggcctgccaagctcacgggagcacagttagggttttccattttaggacagttacttctatgggaaataaccttggttcctgaccacatactttaatgataaaatctgaactggggcaactgtgtgaaccagaaagaattatgtcggatgatccagaaaactcatgtctaaagactagcaagtttcatgggaaagagttagaataaacctttgccttcatttgaaggcaaggcttcctctagagttttgtaggtgattacttgctgccatgggaccctgagcctcagtgacaagagctttcccatttaaggcccttttcatgtat

SEQ ID NO: 37954 - DNA, 1683 bp, Bovine  19866881243614
acattgatttgaatgtattgaaccatccttaagaccctgatgctgggagggatcgggggcaggagaaggggacgacagaggatgagatggctggatagcatcactgactcgatggacgtgagtctgagtgaactccgggagttggtgatggatagggaggcctggcgtgctgtgattcatggcattgcaaagagtcggacacgactgagtgactgaactgactcactgactgggacaaatgccacttgatcgtggtgtatgatccttaactgttgaatttggtttgttagtattttgctgaggatttttgcatctatgttcattcgtgatactggcctgtgatcttctttttttattgtcagacctgtcttgttttttatccttaggaaaaaaggggtgttggaaacattctctggaacagaaaccaacaagatctggccacatgtatatgctttcctacaaacaaaacttccacaaagaagccaggaaacatcaagttactccatgaggaaatgtgcatgtaactaggaagatgagcagaagctccttgtcttgtgcatttacaggttccttgtcctaagactctggcctgtataaattgtttgaaaattatgttagtttcatttctgctgcttttaacctggaaattaaggatgtgccaaaagagtcaattatgaagattcatcttcttaaatgttcagtgtgttttatctagttaccttctaactagatacaattagaatttaattagcacaattataaaacattataaatgtctaactagacctttgaaaattgttgagtgtaactgaaagggcaattggtagtctaagttttgttcagaaaagaagtggtggataaagtttccttatttttctggagaagtagaacaagaaaaaacttccatatcacttgtggaaagtatcttatcagaggcttgtggatagtgatgcaaaaaaaagagacctctagcactgtgatacacagactatgggccactgtctatggaattcctgggggtgggaagcaactaaatttatagattagttgcaggatgcagattcactgctgccttttactgacctcaaacagattgccagatatttctccagcaaaatgggtttattcggaatcagcagataattgcaatttggagtctcaaccatggtgagccaggtgcaagtcctccccacagcatgggaatgacagtacttttatagaggagaaaacgaagttgggagggctgtagtaaacaagtctgtggcttttcgttggctgagtccttgccagaagtcttgccttcttccttttgggctatgctatcttcacaaggcatgagagctccccctcgtggtctcctgattattgaggtttctgggtttttttacactttatactagcagtctttcgatagccatatatcctgtattttgttgttttaaaacacaactttcactctactccagattttcagtttgcaataaaaatgtatcgaatagcacatagcaaaatgtattttcctatcacttttcttttgaaaatcctgtgtactgagggatatgacttgttagaaattgacattgtaaattcttgtaaaagcaccaaagttgaatttccaacagaatatgtaattaaactctcatgttttcagaagttactcaggttgaaaaatgtgcactttag

SEQ ID NO: 37955 - DNA, 1380 bp, Bovine  19866881293898
tggactctgttgtggttcttaaatgtttatactgtatctctaaattctgtgaggcaaattaactatatgtactgtaggttatcttttttaaaaaaattcttcagtacaaaattgtatcatattaaaaatgtacacaaatcttcaaaagaagttaacagcttacacagcattgataaacttcaggtatttgaatacttagtgatcatttaaaaagcctggctgcttatggtagaacactaatataatgaacaaagtatctgggattgttctttgaaaatggaatatcccataatttttaaaaagaagaatgacttactttgtcttattcttacataaaatgtgccaattaaacttttgtggcctatacaaatgaaactaacttcacagcaagaataaacagcttaactaatacaataattttctaaagggagatttttgtgctgtgtggttcatgtatttttagatgctgctggggtaaataatagttatattggattatagttgcaaatcattagttgctttttttttttcctttctgcagagaaaacagtcttatctagaagacatttagtggttttgtttcttgtactgagataaatgatactgtaaattgtacttttataactgagttatttttagccatttgattttttttttagtttgttgcccctctgtgttaactgctctaattcaaactgatggttctttaattttttctaattagataagtaaacatttaagtaagaaaaaaataaaactactcaagtaaatttaatggtacagctccatacacagtcattcgtatatttgtatattcaggaagctggaaggaaatgtaacatttagaggttaagtactggggatttgctttgctttgctttgctttcttcattctgtgacctacttgaattgtaaggaagttagtataaaacttacttttattagtgatcagtttatcaataaatcacatccatcactgttaaaacaaaaaataaaataaaaaagctttactggatgcacagtggtggcatgttgaacagagagagagaggcaaaggacagaggcagggatctgattaataaatttatacaagtgagctttaaagggatctttttaataactcttcagtgtaaactatcacctaaaaattttaataatctttatattaatgccacaatattttatattatggcaatattattctaccacagttaaaaaaaaatgtccccaagtgtacaatgaccgtatataaaatgcattgacaaaaaatacacactgactgcaacaaatcacatttagtacatgtcgttaactcagcttcacaagtcagcaatctttgggcacacagtgtcacacatgactaaaagagaccaagtctac

SEQ ID NO: 37956 - DNA, 1708 bp, Bovine  19866881348877
tgtcacctgtctgtgtttgcaaggtaaagaatgtagttaggtgaccttgctgcctagggaactgagttgctgctgtctgctttcccatagccgtttactcctccttcaggaacattcagtctgttttcagggactctggatccattcttgaaaatggaaaactgaagtttcaggggggaaatgatgggaggaaaaagaagtgggagaggaggatttactggagtgcgataaggaaatgaatgttgtttcttataacccagcatgtcttcacttcctgagccatctggacttattacttaaatggggaatgaaagagtttctaatgactttgagcttttaagatctgcatgctccctttttactaaatgaatgagcttcatttttggttcaggggctgtctggttctggcagaatgaatttgccaaatgataccccaaaagccagtctccccagcattgtccccaactagagagaactggtgaaaagatcagattccagctggaggcaatgcttttttttaaattgatttttgttattttcccctatcatttttatctgtggagctcagttattaaattttgggaccttgtgtccagttcatggctttaaaatcacattacagatttcactaccaggcaagacaagagtatattaattgggatagaacagtaaaaataatgtttctagtctcagcatcaagtgctcatttagtttttaggaaaatgatagagaagtctttctctattcttggcgaggtgtttctgaggggagtagaaggtcctttggtccaatccaccctcacaacaagactttaaaccaagagaagcaaaaagaagttacaaagccataagatagctccagctgcaggaactggagtctatagcttaatttgtttgaatagacatagaaatagaagctcatgttctttgagcataaaacatccagtaggttgaggatctacgaacttcctgtgattttcttgcatttgcagtacccaagctaatggccaaactttctcatcactgactttttgggcagcttgagtgggaatcaaatgcatcactggttatctgagaacagtacagtaatacttgatgaaagtgaagtgtgctgtacttgaagtccaaagatgcttttcacccaccttgggcacaacctgtgctttgcttctctagccaaggtgctgactttgtagaaatccacttatagccggttctgtctgcctcaggaccgacagttcccaaggacagggctgtgagcagggcacagggtagaaggtgccttcccagagcagtgttaagaccagtggctccaaagagactcgccttggtctccaatgaggctatgcaattcagacaacttccgcggtaatctattcaccaccttaagatatcactggaaaatatctatgagtgaagagagaaatatgggtgaatttctacattttaggggcctaggaaagttgatgaaagaaggcaaatatcaaactcaactacagataatgatatcaagtctaagtaacaaatatgccttaatgaaactcccatcacccaaagcttacactttttaaaatttctattttattttttatgagttgctttttgaagtcagaaaacataagcagagtaaaaatatgtctccatgatgtcaaatctgggtaaaaagtggaacaaatcagacaggcagggacacgacaggatctgcttca

SEQ ID NO: 37957 - DNA, 1570 bp, Bovine  19866881355740
ggaaagattgagggcaggaggagaaggggacggcagagcatcctctgtcgttggttggatggcatcaccaactcgatggacatgagtttgagcaggctccgggagttggtgatggacagggaagcctggggtgctgcagtccatgggatcacaaagagtcggacagactgagtgactgaaatgaactgaactgaactgaagtggtgagtgatatcaccacaaactgaatgcagagcagaaaggagaatctagtctttctgtgttaaactagctagatattaaagagattttaaaaaaatataaaacaatgtcacatattatttattttttgtttggaaaaagttttatttttcataaaaccatgttatttatgttaacgtgggatgcaagttttattattttaaaataagttaataaatgtttttaaatcacctaattttaatttcaaatacagtaaatacaagtagatagagattcccttggagaaggcaatggcatcccactctagtactcttgcctggaaaatcccatggacggaggagcctggtgggctgcagtccatggggtcactaagagtcagacacgactgagcggcttcactttcccttttcaccttcatgcattggagaaggaaatggcaacccactctagtgttcttgcctggagaatcccagggaccggggagcctgatgggctgctgtctatggggtcgcacagagttggacacaactgaagcggcttagcagcagcaacgtagattccctggtggctcagagggtgaagaatctgcctgcagtgcaggagacctgagtttgatccctgggtctgaaagatcccctggagaagggaatggctactcattcccttggagaattccatggacagaggggactggtgcgctatagtctatggggtcccaaagagtctggacaggactgagcaacttttacttttcataatttacataaacaaaagctgttcgggatgttcaataatttttaagagagtaaagttctcctgagccaaaaagtttgaaacagctattgagccaaatttatttttcttctataaaagcatccaaggggatctcaatggaaactctttcctggtccctgacccactttgctttctgaacccttgtgatttatgaccaatcaacagcttgaccaggtgaacaaatatactgtagggacttgggtgaagccctttgtctatttgagagtaaacagtggatggcttccatgaagactaagttaaaatctagaaaaaacaagctctcagaattccattcaagtagccaacgctagtcaaatgcggaaagaggaacagatgagacattattaaaacaaagatgttttaggcattcataataagacacagtaaaaacagcattgtccttgaagcaagcattcttggaagttaagattttctttcttgctcttcgacagatcacacctctctgggactcagtttttgcatctgtggtttacactagaatctaatattcattcattcatacacctattcattccttctttctttaattcaacaaatatgtattaaacatctc

SEQ ID NO: 37958 - DNA, 1309 bp, Bovine  19866881437604
atagtcgaggaaaactcctaaacttgttggcatgggaagaactctattttcaggttcattagaagaagtaggtgacttgggaataaagactttcttcatacctatagtaaccaacgtaaagggctgcgaagaatcgacacaggcgtcctcactgccgctgtcgtgcccgctgtcctgctcgtacctaaaacacagcacagacagagcaggatctcacctgcatcatcacccgaaggcctgcaagtcgcttcagaacattttcaccagatgatatacattgagttcaattaaaatcaattgtaactgcttttacatcaaaacctttctgctaaaccataatcagttagaaacgtaaggactacacagtgtcacttagaattacaccacagactcagacccaaattctgtcataaagtatcacccatttttacctatatatatataaacaaacagatgagaagttagaaataattagtaattttggcctatcaaaaataaagcaggggaggatgaaatggaaggggcttgacaaatattgaatatttatagcataaaatcatatataagaaaacagaaaccaacacagatctcctaatccaaaaactttatcagactatgtaaaataaatgggcactacaaaataaagcaggagaaaaaagcatgtttcattctgctgctaagaactgttatttcctggttgggattttctacatggctctatgatgcaagcaagcatcatgaagagttttagtctcctttgattataaaacagtgaaaccttaaagaaaattttgatacaaagttccttccacttttccccgtgcagggtgcttcttatgttagtacacttgtgagcacaggacatcaaccatttccatcaggtcttttcacttctagtatttctcatgttgtaaacttttttaacattgttaataatttaccaagtagacacgccactgtgtttaagaaactatttccgtattgcaattttcactattgtttcaatttctcatcttagggcaacaagtttttcctgtcactcagattgttactctgggatttctgtagaggtaagtgatcaaaaactgtctgtctggactagttcacactacatcatgtaacacaactaaactgtacagaacattaaatagtcactctcaagtaactgaaattctttgccatgggagcatgtttaccgtgaccaaatttttaaagtacttataggactgtttaaagaaactgtatccatttagcaccaattgtgaaatatggcatttagaggcaaggggaatggcaaccaactccagta

SEQ ID NO: 37959 - DNA, 1232 bp, Bovine  19866881668101
ggtgtgcttaaaaacaatccctggtgtttgttctcatctcaggagcgcgggcttggtttttgttacctatcggatttcaggaaggctgacttgagatgcggcgttgccatttcctgggccctcacttattcttttttttccggcgctgtcagccagatcctttgttgtgcctgctctgcattcattctctctgccctcacacctccagacagtgggatggggatttttcccgggccttgcaggaagagctccggacggccaccgtctcaggcatcagataaagggcagctttaaccagccagtgggtgtcggggctgggtcggcgccacgccgggagcagacaggcttttgtgtcggtgtttgtctcggcggccgtccgacccccgggcaggaggcgcgggccgcgacccccaaggaggcggggcctccgagccgggctccgcctggtgtggatttcacggtcgccgccgccgccctcgtttgttccgttacatcgccctgtcctgagctaagaacgccagtcgtggctacccaggagccctccatggccttccttccacccaactctgcattttgcttttccccctcgctttctcgtttttcctcgttaacagcatcctggcagggcgcttggcaaaactcaggctaaaaacagagaaaagagaggaaaaggacaaattcggtgcacctgcctccttcctccagagtttgcgaaggatcttaaccatgtctgagtcgggggaggttagtgaatttggctacatcatggaattgttagccagaggcaaggtaagtgccggggcgcgcggagctgcggcctgggttccgcccccaaccccaccccccgcccccagctccgggcactacttggcctgtggctgcagatgtcccgggccctggcagcccccggggagggcgggactggagtcccaggtccgtgtcctcagccaggacgcccagccgctgctgaaagcaaaccagacgtctgacctcccaccctctccacccccattaatagcgcggcatctctgaaatgagccaaaaaggacttggccagctgggtgacggcgggggctctggggaccgaaaggggcaagggcttagcctgcgaagatgggcaggagggccgggcgttggccagggggcgctcctcgacgcgcccagggctcctaagcgtggttgacatcgtgtggttgacctggtctgtccaggcgcaaagtgcggagggaagg

SEQ ID NO: 37960 - DNA, 1597 bp, Bovine  19866880160489
ccttgactagatggacctttgttggcaaagtaatgtctctgcttttgaatatgctatctaggttggtcataactttccttccaaggagtaagcatcttttaatttcatggctgcagtcaccatctgcagtgactttggagcccccccaaataaagtctgacactgtttccactgtttccccatctatttgccatgaagtgatagaaccggatgccatgatcttaattttctgaatgttgagctttaagccaacttttccactctcctgtttcactttcatcaagaggctttttagttcctcttcactttctgccataagggtggtgtcatctgcatatctgagcttattgatatttctcctggcaatcttgactctagtttgtgcttcctccagcccagcatttctcatgatgtactctgctgcgattacatattattatacaatattatgtattatattgtaatattacccccattttacagatgaggacacagtggtctagagatgtcatgtgacttgcccaaggccttactgctgtaagtggtatacccaaggttagaatggaggtctgactgcaaagtccaggattttaaatactactctccactgccttgtggtgaaagctattgatatccagatatttaccaacctgtaacttgttcattaagaaaggcaggtctctaaagacattgaggccaacattgttagattttacagatgcgtaaaatttttaaaatatttgggagtcaaaggggtgtcaagtttttgctttgctaaatgaacacattcttcttttgtttaaaaaaaaagcctatttcaccatttttcttgaatagtttaaaaatcaaaacattaagaattaaataaacttagaatttaaaagctggataaatataaccccatgaacaaaccactgcacggttcttgcttttctctttttgcttcaaatcactgaaaacagagtcccaacctattgactggcaccagggtaagaattaatactgggagtatctatcctttggccacttattaacaacactttgattttgaatatagcttggaaaaaaataggatggtatttcttagaatcatttataactcagactttccactaacttcatctggtttctatcctcccccaccatacaattagtctgaatatttgaggttttcctattgtctccagtaaggttcttggagacaaggtcaaactaagggcaagtctcacaggtcagagtattgttttgaaccatatgaaggtttctctaaataatttttaaaaaataaaatcactgagtaactgaagttttttcagtgttcaaaccacataggtgactaggttggggccaaaactcaagaccatattttaaagatgatcggtgatttaataatggtaattcatcacagcacaaatgggcaaagagaatccactccagccatgaggaaggcatggatctgatcaatgtttgggtgagcctgatttgtttggggccagtgacctttccctgctctggaattttttcagaccttttttttgaccacagcatcacacagttcttagtttatgagtcacagggtatctccagggcaatgcct

SEQ ID NO: 37961 - DNA, 1969 bp, Bovine  19866880347744
actgatttcctttaggatggactggctggatctccttgcagtccaagggactctcaagagtcttctccaacaccacagttcaaaagcatcaattcttcagcgctcaactttctttatagtccaactctcacatccatacatgacacatggagaaaccatagccttgactagatggcccttcattggcaaagtaacgtctctgctttttcatatgctgtctaggttggttatagcttttcttccaaggagcaagcgtcttttaatttcatggctgcagtcaccatctgcagtgattctggagcccaagaaaataaagtctgtcactgtttccattatttccccatctatttgccatgaagtgatgggaccagatgccatgatcttagttttttttgaatgttgagttttaagccagctttttcactctcctctttcactttcatcaagagattctttagttcttcttcactttcttccataagggtggtgtcatctgcatatctgaggctattgatatttctcctggcaatcttgatcccagcttgtgcttcatccagcctggcatttcgcatgatgtactctgcatatgagttaaataagcagggtgacaatatacagccttgagatacagccttcccaatttgtaaccagtctattgttccatgtccagttataactgttgcttcttgagctgcatacagatttctcaggaggcaggtaagggtgatctagtattcctatctcttgaagaattttcccattttttgtaatccacacagtcaaaggctttggtgcaatcaataaagcagaaatagatgtttttctggaactctcttgctttttggatgatccagtggatgttggcaatttggtctctggtttctctgccttttctaaatccagcttgaacatctggaagttcatggttcaggtactgttgaagcctggcttagagaattttgagaaggatgcctcttctccagggcatcttcccaacccagggatcaaacttggggctcccgcattgcaggaaaattctttaccatataagcctccagggaaacacattcatttactatctctcattaataaattattaagtggtttactattaaagtacttgctacctgtacctatattttgaagattctatctctgaaacacatccaaaaagtttaagaccttcaaactttaaagaataaaacgaggacatatatatatatatagtgtatgtgtgcatggttgtcagaattctcagtctagggtggctctgagttggtacacccgagtggctgagtgtgcgggggctatgggggtcactcaggccatgcaagagcaggctgttcttgaacattcggtgaattcaaagattctttgatcccgagttaacctcaatgagggcaagaatactcagaagagagcagaagagagaaatgctcaaggcattcatcagacccccagtggctgactgcagctaattcagccttgtagaatttctttgcaatgcctcacagtctattttttatcccaatattttcactacttgatgacagctggtttttctatttgatttctgtctgtgtgtaccagggtgtgatcagaaggaaacaactttatcctccagttttccccttagtcttgaaatgcaaccaatctaactaaacccgcatttaccaaaagttaggtgcgtatgacatcacttttggatgccaaacacttcagtttttcagcatagagtaagtccttaggactctgcccagctgcctggggaaatgccatgtggggaacacggccttctttgtaacgctcatgccaggcactgttgttccctccgtgggctgtccttaaaagacgggctgtgaaattagcctctcctttccaatgagcactatcaaaagcgcagcattctcagttgtccaggagtaacatttcagaagaaatgctagttaaataacttcttagggtcata

SEQ ID NO: 37962 - DNA, 1716 bp, Bovine  19866880398487
atagctttgaactagcttagctccaaatatttcattggttaattacaattacttagcatgatatgagtaaacaggacccagaagggcaattacagaaaataatagtaataatcacaaatatcagctgatgggataaatgccatctggttctgtgtatgtggaagagattgcatttctctcacaaactcacagcccatgtgtagtctggtttgcagatgagcttctaggatactggatggatttacagtttgggggcagacactgctccaggttgtgtgctttggaggtaagagggagtacattagccattggaggtggcacatatttggtgaagatttcctccatgggcctgcagccagtgcattcttctttagtaggaaaaaaaaaaaagacttcattgttgctccttctataaatgttacaaggcctatattccacaactgtaaatatctgtgtttatatgactccattcttgcataaacctggtgggttatttaatttttttgctgatggttgttgatattttgaaggttgttgtgtctgtttttcttggttccatcacatttgtgtgttagctgctcagtcatgttcagctctttgcaactccatggactgtagaccaccaggcttctctgtccatggaattttctaggcaagaatactagagtgggttgccattcccttctccaggggatcttcccatatacctattaaaatcaacccaatgtgtgtgtgtgtgtgtgtgtgtgtgtgtgttactcaatcatgttggactctttgcaactgcatggactgtagcctgccagtctcctctgttcatgggattctccaggcaacaacactggagtgggttgccatgccctcctccagcggatcttcctgacccagggattgaacccaggtagcctacgttgcagatagattctttaccatctgagccatgagggaagcccaattgacccaataccatatgtcaaaagtgtaaaatgttgcctctccttttgaactttgacgtcattctaaaggagtccatgtccttgtggatgacccctctacatcattgaccccacccactctaaggacatttacctctattcctctgaaactgcctattttcagggctgccgcttgcattttcttatcatcccaaaatcttacatttcaaaaaaatctgagaatgttactctcttctatattcttttaactgttcagattttccactcccctatcaaattttgctttcctctctgaatggattgtattcctggttcttgacttctggagctcacccaagagtatctctctcttctgttttcacttcaagcttgtctgacccaggtcccacttccttgcctgtatcttcaacttccaatggcctggcggaaccagggctccagccttctctcttcctataagcatgaggtttggagccactgtatccatacatctgcaatgccagcccctctagttggtctcttcagcagtcctggtccaccatgtctcttctctgcggtcagcccacctgcagtccatttgcctggcctggcacaccaggcttgacatgaccctgggccctgcctgcctatcatacctcagcaacatctctatatcctttccaccctcagaatactgcccgtgccccagcccccatgccctagtaacactgtgttaaaggggtctgcccttgcccctctctccaccccaacatttccacaa

SEQ ID NO: 37963 - DNA, 1244 bp, Bovine  19866880421871
tttctccatagcaggcacgggaagctaagctgactcacacagtttgcagtaacagttacagtattgcaccagaaatacaatgatacaacaaaaaaaacaaccaaagaagcattttcaactaattttaaacagagggccatctgagtcatagtttttcacagcagggaatgatggcttccatcagtggtaagcttaatgagctatgaaggtaggtttgttaactgaattattcacagagctttcaatagtcatcttccctcttgactacttttgaaaacaattacctcatcttaaacaaaataatccgttaaccttcatctcaacagaacagaaaacagctaagcacagaaggatactgaaatagacccctggcattggaaagcagttctgcactgcttctctctctcagaatatgggcacgtcctgtgagccaggtgctcatcacagctggtgagcagcctccagtgcccggtcctcagggagctagcaagctggcagggaggctggaactgagcagacgcctagggactaggcgacaaaagaggatataggagcccagggagagtagaacactggtctgggtgtgagcgcagaggacagggagtaggtaaggatgtgacagtgagaccggaaaattgagcaggagctcgctagttaaaaaacgaagtaagatcagtctaagtaagagcagcatcacaggatggggttctgagaagagaacttgagaccttctcaaggaaatgaaaactaatatgaatggagcatgaagatctagtctgatactgccttcagcttatgtcaaattatctaaggcttggtaatccacattagagattgtagacattttttcaagggcaactgaagggtcttcagcaacagactaacctaatcagatctgcattattaaaagaccactctggccccattgttcagaatggatctaaggactgggaaagaggttgctgctcagtacaggcaagaacttaaagcttggactacagtgatttcctaaagctaccagatcatatcattttcctgctcaaaacccttctaagcttcttactactatcacactgaaatttaatttccttattttggccaacaagcttatatacttcagtgcattcctatattttacatcttcatgtctcacttttacccattgggacccagccacactggtctgatttcagccccttgaatgggtcaaagtatgttctcagggctttcgtatttgctattcc

SEQ ID NO: 37964 - DNA, 1772 bp, Bovine  19866880442789
ctaacacagggaggaaacacaggcttagagaggttaagtaatttgcagagtaggattgccgaggtgctcttgactgactacagagctagagtgagctctctcaggtgtgatgtcagaggacttgttttcaggcaaaggctcctgctgctggaaacagcggaaggagagcagggccccggcagccggttgcccctgcctttggggtggagggaaaacactgctctcacttcccttcgaaggaggacgagtgggaagttaggagtgtgggattaatgaactacaatatgtaaaatagatatgcaacaaggatttaacaggaaattatagccattgttttatggcaccccactccagttctcttgcctggagaatcccatggacggaggagcctggtgggctgcagtccatggggtctcgaagagttggacacgactgatcgacttcactttcacttttcactttcatgcattggagaaggaaatggcaactcactccagtgttcttgcctggagaatcccagggacgggggagcctggtgggctgccgtttctggggtcgcacagagtcggacatgactgaagcgacttagtagtagttagggagcatgagggcttcccaggtggcgctaatggtaaagaaccttctgccaatgcaggagatataagagatacggtttcgatccctgggtcaggaagatcccctggagaagggcatggcaacccactccagtattcttgcctggagaatcccatggacagaggagactgcaggctacagtccatggggtcacaaagagtcagacacaactaaaatgataacatgcacccaagggattataatctgctaaagtatggaatcactatgtctacagctgaaactaacaggatactgtaaatccactatactacaataaaaaaaagaaaaatttccacattgctttacttaaaatggataaccaacaaggacctactgtaaagcacagggaactctgttcaatgttatatggcagcctggatgggagaggagtttgaggggagaacagatacatgtacatatatggctgagtccctttgctgttcactatcaatatccctttgctgaaattatcacaacattgttaattggctatactccaatacaaaataagttaaaaaaatttttttaatttttttaaaagattcaactcgagcttaaagctgcaccaagaggaagaattcagcatttgagtttggttggctttgctttaacaatgggcctaataatctatcgtcactgaaagaccgtttcctccgcacctgcattcaaaatgcatacaggggccagtgtttaagggagaattgctcacagcctctcatttgctcaaatgcagcctattctgagccatgtcacagtttaaggatgtcaaggtgtctcaaagtcaggaggtggaaacaagggagaagtgaggctaatcattccttggttcttgaaatttcaaaggaggagttggaaccaaaaattgaaagaaggttaaagattgagctgtgggttttcagttagaatttttgtcatttcttctgggagaaacaagaaaattgacggcctttgatagatctctgcatgggaagttttgtcactgtttggagagtcttcagaaataaactctgattgtaaatcaactacatctcaattaaaaaataaaataaatatgaaaaaaataagttgaatctcctcccaagattcttaagttgagccttgctgcagatcatagcaatgtgatgggcaagatgact

SEQ ID NO: 37965 - DNA, 3704 bp, Bovine  19866880539651
cagctctactgaagcaacctctatggctggtcttcctagcttccccacatttctttccccaaggacagcagaggaagcgcagagtcctaaccactggaccactgtggaattccccagagagtccttctaaaaacatcaatcctatcatgtctctcttctgcttgagtcttcagtatctccccttcacctgaagaaggaaatcaaaactccttagctggacatgagcggatattggttcacatttcccatctcatttcatgcatccttttctcctattgtacccaaactacctgtaggtcccaaacaggcatgttctttacaccattccctctgtttgagtacatttcccttttcttcacctagctagttgctacttatcatttgaaattcagcatgaagttacctctttgagtcagccttcctgatttctgtaagcagatggttttatttttacctctgtgctctcaaaaaaccatacctgcatagcattttctggtttggttttacatgactgtcccattcagtcacctctttattcaaaagatcagttcgtactgagtgaatgctatattctaagctctattctgggcactaaggatatggttaggtataaaaaggcaaaaatatttgttctcaagaagcaaaggggagacaatggaagaaaataagcaaaataaatccagggtagttagatgatgataagtgcagtggaataaaataattcaggagtagccaaacagaggcttgaggtgggaactgcaggactgaacaggcagtcaaggaaggcatctttgaaatgacacctgaagaaggtgaggagtgagcctcctggacctctgctggagaagcatcctggcctatagaatagcaagtggagaactctgaatgtgggagtgggtctgtcctgctctagaaaaggccagaattcttggagcacggtcagcaagagttggagacaggagccagaccagagagcaggaacagagcactaggtggctagaggggatgagctgccgcacatttgaatccctctgccacaggatccctctgtctaatgtttggaggatgaagagccagggtggaggcagggagactggttaggaggcctctgccagtgtccagatgaaaggctgtcccattagcctgggagtgacatgagagctgggacaaaatcccatttatgtttgaaaccccagcatagaaccaaacacataacagcaggcactcaaggacactgactaaatgaatgaatcaagttgttcagtcaagaaaccagagctcctagagtcatcactgtttgtttttctaggacaagataactgcaggattttgtttccagtgggtaggctttattttctgtttttcctaattgaatggcctgtaggccacattttgaggatggtgtgggtgtttgcatgggggccaacaccactgaagtctgacagtgaaattgattttaaattaccttcggacatctgaaatttgtgtcttaaaaagatcagtaaaaaaaaatcacacatttcttcaaggcaggctgccttaggtaatcaagctccccccagccaagaccccaggagcatcttagaatacagacaaaacttgtttggaatttaagtcaggcaagcctggtaggctacagtccacagggtcgcaaagagtcggacacgactgagggatctcacttcacttcacttctgactatcaaaacccatcattctggttctaatttaaggatcaaaaaggaaaatgcattttaaaaatgattccaaaataatatttagataagatcattgagaaggattcatgaacctgtgaattcatttttctaagaaaagggaaatacacagggaggtgtcggaggaacttggtagtaaataattcattagttcggttcagttcagtctctcagtcatgtccaattctttgcgaccccatggactacgagcacaccaggcctccctgtccatcaccaactcccagagttcactcaaactcacgcctatcgagtcagtgatgccatccaaccatcttcatcctctgttgtccccttctcctcctgccttcaatcgtgcatgtagagtctgctcttgtgttgttgcaagaggatgcttgctatgaccagtgtgttctcttgggaaaactctattagcctttgcctgcttcattccgtattccaaggccaaatttgcctgttactccaggtgtttcttgactttctacatttgcattccagtcctctataatgaaaaggacatcttttgggggtgttcgttctagaaggtcttgtagatcttcatagaactattcaacttcagctacttcagcttcttcagccttactggttggggcatagacttggattcagttcaattcagttcagtcacccagtcctctctgactctttgcgaccccatgaactgcagcacaccaggcctccctgtccatcaccaactctcggagtccacccaaacccatgtccatcgagtcagtgatgccatccaaccatttcatcctctgtcatccccttctcctcctgccctcaatctttcccagcattagggtcttttcaaatgagtcagctctttgcatcaggtggccaaagtattggagtttcagcttcaacatcagtccctccaatgaacccccaggactgatctcctttaggatggactggttggatctccttgcagtccaagggacttcaagagttttctccaacaccacagttcaaaagcctcaattcttcagcactcagctttctttatagtccaattctcacatccatacgtgaccactggaaaaaccatagccctgactagacggacctttgttggcaaagtaatgtctctgcttttcgtgatattgaataatttgccttggaaacaaacagagatcattctgtttttgagattgcatccaactactgcatttcgaactcttttgttaactatgatggctactccatttcttttaagggattcttgcccacagtagtatatacaatggtcatctgagtaaaatttgcccattccagtacattttagttcactgattcctaaaatgtcgatgttcactcttgccatctcctgtttgaccacttccaatttaccttgatttgtggacctaacattccaggttcctagccaatatcattcttacagcatctgactttactttcatcaccagtcacatccataactggaccttgtttttgcttcaactctgtctcttcattcttctggagttatttctccactcttctccagtggcatattggacacctatcaacctggggagttcatctttcaggtcatatgtttttgccttttcatacttttcatggggttctcaaggcaagactactaaagtggtttatcaatcccttctccagtggacaagcttttgtcattactctccaccatgtcgcatccatcttgggttatcctacatgctcatcgttcatttagttagataaggccgtggtccatatgatcagtctggttagtattctgtgattgtggtttttattctgcctgccctctgaaggataatgattcaagtcttatggatgcttcctgatggtagagactgactgtgggggaaactgggtcttgttctgatgggtggggctcaagtcaaacaacagggagggaacaccaactccagccttcaacaaatattaaagatttacgagcaggccctgc

SEQ ID NO: 37966 - DNA, 2002 bp, Bovine  19866880548029
taagccagagtacttttaaaagcaatacttacgaaaagactgcttgagccacagctttctttcattagccgcttatgattcttaagatgatctaaattatagcaaactctacagaatatgctgtaatcatatgactctgtggtaaatggtaactgcaaatgtggctttaatcactgcctatattcatctggtatatatattaatgcagccatactgttgtttaaagccagtgcccactctgactgataagagcctgtgtgactgtaccaattgtcaatctgaaaatttctttggtgttacggatacataaatatgttgctaactcaattagctaacacatgtagggaatgtcaggtatacacaggatctctgtgattggcactgcaaggaaacacaaatggaaatggagtgcttatgctctctccaacagctcacaaggagtaatccagatagcctcaacttaacaaatatttggttttaacatgaactagtatctttccctcaccatcacccctagcaaatataccagttagactatgaccacatgcactgatcatcttttagtctcattatttccatattttatctttctcataggacaaaagacccattatgaatcattaagtcttcattattttctctttttatttagttaattctcactatatcaaagatcccaaccaatatatactgcttaaatcagcattagaattcatctgaatttgtattccttaaatgctgacaggatgacacggaaaggtaatataaggataagcatcaaaagaaatctgtacaggtgttaaaaatatggaaagcatgcaattgcaaattaacattaaacagcttaaacaacaaaaaaataatcagtggtactctacagtataattccatagctaatctaaacattttaataatagatttgttatccttataaacagagattatatggcaaagaaatgaaatgatttttaccattttgaaaaagtacacacatccagataatgccactgcctatcaatatcctacagagcttctaaatattcttacaccagtgaggtatttattcctttgttattaatttgtaccactattttctctcacttactttaataacaagtgttgaagaatacctggggatatactgtattaggtagtaaataagaaaattcttttaaatcaactttagtaattaaataagattacaaagcaatttaaagactatgaccatatgcactgatcatcttttagtctcattatttctacattttatctttctcataggacaaaagatccatttatgaatcactaagtcctcattactttctcttatcattagttaattctcaccacatcaaaaatctaataaccacagattgactcttaacttctgaatggtttcagtttcagaacaagcaatttattgtcagaacaagaaattcactgaacttgagaaataatgcagtctggagtaagcaagtcatacctatctaatcttctctttctactttttgagacaacagattccctaaagccaaagtcatgtttcataattttcttatcctttttggaaagcagaatctcagaaggaaatcaaaggtgctgtggttgtggggctggtgcaatagctgaattttagaggaaaaggatgaatattacaaaggattattcagatcccttaaatgcctctgtactctaatcagaactgccaactcttaaagacaactctctggtaaaagcaacgtgagtgagtgaacgtggctctctagtataaactgattttattaataaaaagcaactttttacatatgtggcacatgtagttctggttaggaccagcagctaatttttaacccttattactggagctctccctaggaagaaaataattatctcaatctggttagtttcattaaaaaccggctaagggttataaatattaaaagcctattgtgaataaaataacgaaggctatcagacaaaagttgaaagtatacaattaggg

SEQ ID NO: 37967 - DNA, 1170 bp, Bovine  19866880557159
tacctaacaaggctccctgatggcccaggctgaaggagcctgctcacctccctgtcacttgaataaaagctgactgtggctgaggcatggctggatttgactggaaaccaggaaagaggcttggggaccagggaggtggagaagagaagactaagttctaggcattttccctctacatcccctcccctagccaccagcatcacagcacaggtggatggcggcctacctgccctcttccttcactggcacagttctcagaccatggacaagtcaggtcatgaaaagaggccacggaaagtccatgttcttctccatgagctcagacaatgggagtggagttgttcacttcctgcctctctgcctcttctttcccgtggcctgaaagtcactctcaggaactaggatcttgttttaaaatcttaagcaatgagaacgccaccaatgaaatcagatccctacagttgcctagcccaaactttgtggctttacattcttctattaatatctcaggactctttagaaacgtaggtgtcatcagctgggtggttataatatagatgaatgtttaaaaacagctgctaaagtacagtgcctgttgtaaacatcatggtggatggtgggccagcatgattcatttcacatacatgtagaaaaccctacaaagaaagtttaagtcctttacttcctctccttcatatcaagcttgatcatcacttctgttgctctgcccagtcatcacttacagagttgtctcccctgctcatttgcctatctcgaattccctgatgtttctcatcatatataaagcttgtgtcagaccaggataaaaataacaagcccaggaaacaacagcgaagtaagctgacatgaagaactatggtactagccaactaaactcaattcttggaagaggattttgtaatagctttttctttatactgtaagccccacttatccaaatgaggttatctctgggaactttttgaagcaaaagtcactaaaagataagaagtggcaaacattcaagtcaaaacttcagctgctgagtccaaatatgctctttatcttcagggaaactccaacgttttgaaagatctcagtggtagggtttgtatctaggcccacgtgctgtgccgtgttcaatttggactagcagcagctgcaggccta

SEQ ID NO: 37968 - DNA, 1137 bp, Bovine  19866880814776
tgaacattacacatatgtgagtatacactcaaacacacttttaaaaatgttcatagtcaaagcctaggaaaaagtgaatcattacaagtaaaattcttatggaataactaagagatttaataacgttgtaagcaagagacaattaagtatttcacaaataaaatgtaatgagtattacctttgttactcaaccaaagttaaagtattcaaattaaggcattataatcattagtcacagatatcagaattaagaaactaagacggcagcagaaccagatatgcattataccaaagcctgtcatctcaggttgcaaagtaagaggttgtacggcatgcatcaaatagggtgcaagtaacaggcactggatatataaaaagcttcttcatccgagccttggaactttaagaacaagggtttatactcaataggcaaaagtatttacaaaataccaatctttgtgaataggtaagggacaagcatcaaacctacaggagagtggcacctagaaatatgaattttttacaagatccctgacagactctaatgtgcaaatgtgtttgggaaaaacagaaaaagcaggcaacataatgttatatatttatacttttgaaatccttgctggctaaagcatatcatttgaacagataatccttcctttcattaacttttcctacatttaagtacagtaatttttgtaaggcttatgttgaaaagctattttttaaagtagaaagcagagttattttaagaataagcatggccttttaattgtgggggaaagaaagaggattatcttccagtttaggaataatttacctttaaaggtgctaaaaagaacattcatatgattaatttattaaaagtaataagaatcagaacactttggatattttttaaagtacttagagaaagaaaattaataatgaaaaagtgtggtcaattaacagctgaaaagcttaagttactcaagttcaaacttgagttatccaagctactaataactcatctcctttcatccttttaactgaaaagcatgagatctatttctctcagaaatgtcacattaaataaattatggtacagccacagaataaatctatcaagaaggagattttaaatcaaattgttaagaatat

SEQ ID NO: 37969 - DNA, 3970 bp, Bovine  19866880863418
ttcaactgtcctttatagcattatttacaagcttaatatttcaaaataatatctaaaaataaattgtgaaacacccaaataaaggactatgcaactatttataaagtgttatttatcaaaaaactttattaacctaggaaaacagcttaggttaaggtgaaaaaagaaaagtagaaaaccaaataaattattacaattttgtttcaactcacaagaacaaaaatattgcaaagacaacaaaagtcaggactttgaaagcagatgaaaaaaaagtaactgagcaaaccaaagaatctgaatcctaagtcagcaatgagaaagaaaaagacattgattttcacagcaagacctgcaaagattcaggaactaactctagctcccaaaacatttcaaccagtcaagtataaacataagccctcagacaggagactaatgtcttctctgaaaactcagatttcaaaaacaaaaacccaaaaaagcaaaaagataaagatactgaccatcagagactgaaaaatgcttaaccacagtcaagtatacaatcagcaggttctacccatatgcacagacctctgaattgtcttttcagtggcccacactctcatgaattaataatggccagggatcaacaaatatttgagaagtcaaaggcaaaagacaaaaacaacaaacttaaaagatcaacttggagaaaatagactatgcacaaaaagaaagcctatcaatcaatctaccattaatattaagatattttgagagacagagggagaaaaaaacactgcatcactacatgaataagaataggatgctaggggcatcccaagtggttcaggggttgagaatccgccttgcaatgcaagggaaaccggtttcatccctggtctgagaagatcccacatgccactgagttattaagcccatgagcctagagcctgtgctctgcaacaaaagaagccaccgcactaatggaagagcagcccccgctcgctgcaactaaagaaagcccacacgcaacaacaaagatgtttcaaccacaggtcaaaaataaaaataaatctttttgaaaattttttttaaagaaaagactcgatactacagttaaatactgaagaaaagccttcttatatattcaaaaacgtaacagtagaaataaaaaagtgaatagaagaactctgaagccgaagaatctccagataatggaaaacaaagagataggaaaagaaaaaggaatcagcataaggagatccaatttttgaataagaggtccaaaaggcacatgaagacaaagtaaaaaaaaaaaaaaaaaaaaaaaacaagaaaataccccagaaatgaaggatttatacttccagattaagaaggtacaaataaatgcttggtacaatggataacagaccgacacatcttaagaaattcacaatggtgacaaagctcataaatgcttccacagagctgggggcagggcgggtgggaaacctatgcaggtatgcacacacaaactttaatattttgagagaaggctgtggtcaatttttcttatacatatcacccattcttactagtcacttctttcttgccttcactctcagttatataattgtacaattgttttcatactcaattgactttatactgaagtgtacaaaaagactttaagaatgttaaaacattaataaatcacttgagacactataataaacacatgctggttcatttgtgcagtgaaatggtaacccactccagagagtcccagagagtctacagacttagtgaccaaacaaaaacaacaaatctacttgttagtatgtttgaaaatttaacttaataaaaactttaaaagttattttaaagatgctgattggctgtccctcagataactaaggataaaaaaaaatctttgtattagatataaaaataacttaaaaaacctgttcttctgtccattccccagtatcagtctgagtccttgatcattttgtgcccatagtactccaacagtttcctatctggactctgactcacattccccaccctttatactctgtggcccaccctggttaccaactgttttttctgaaaaccagatttgcttatgctattcttatacccaagaattttcaaatggcttcctattacctatccatacatctgtagggtacttgcacattagtctttcacatcatttctaccatttccaggcttctctcctctatctttcatcgattctcaacacttctttcacactatctgggttttgttcacattgttttctctgcctacaatcttctccactctcctctctcctagtaatgcaaacttaattcatttttcatcacatcccatttgaatccttctagtactctgcaatgtaggataacccactctcccctctgaactccttactgtattttgttaatatacgaatataagactttcacaatacaatatggttatcagtttgtatgtacacatcactcagatcatgagctccctgaacacaaagactgttttactgtagcacagggctgggcacaatgaaggcattcagatatattaataaagttgggtgagtttttttccttctatctccttctcaccaatcctaataattacagttccaaatggtagagaagtggacaagagcttggactttattcagctacaccatacactgccaccaaaacagtattacttgtaactcactgtcctaatcacgaacaggcagtaattcctccaactcatcttcctggtttctaggctttctaaaattaaactacaccctacaaagccatgtcttctattctccaaaaagaactaactctctgattcaataaggctgatttcttaaataatttgactacagctatcaaattcaagtccttattccttcagaagtaaatcagaatggaacaatcaatctcctctcacatgatcaaaagaaacttcaaaataattttttgatagattgtatgtataacttattcactatggctatcttcaataaaagaccagaccctagcagtttcttcttattctttgcttttagaagtttactgcaagaaaacacaaaatatacaaaaactgggaaggttaaaaaggcagttctcatttctgtcggaagaaaatgaaaagcaccattgccaacaaactatttcctcatcaagataacttctctaactattcattccaattgtaaaagacagtatattcaatgtctaaataagtaggtatcatcaaaaataacttgatgaccatttaaaataagagagacatcaaacactttcaaaatatttacagcagaacaagaaccaaatacttacccaaagtaggatgtaaattaaaattaaattctctatacagaactgtgtccagcagagcggctacatctgcggatatagcacatgcattgcataaggcagtattttggaggacagggctataagccccaaaagggacacagaaaagttcctgactataaaaattccctgagtgtatagctccaactaaaaatcactcccagtcactgacatcccagtgtcactccacacaagaatcaagaattaagacttaagataaaggaagaagagtttataatcaggttttgagaaagtttgtgggatgttgtgtatcacacaagtatgaaaatatattattattctttggaatgatcatatggaatagagaagcaaaaagtcagacctgatacccaagtggtatcaacctacaagttcctcactaacatgctccttttaaatattcatttaaaaaatcaatgactttatcctaattttgttgagtctttcttggcgactctcaaagaatacctaagattcttgaggacaccttaaactgtaagagacatcacatcaatgatttcagtgtcacacagataatacagggtatgccatctaccttaccattttttaacagaaaatcaggaaaaataagtctccaattctgataaaaatta

SEQ ID NO: 37970 - DNA, 3497 bp, Bovine  19866880913243
actgattggtcagctagaaaaaaatgcaaggagggctgaatttttcttaacattaagtagcaacagcgaaataataattataagctgtatgtgtacagagatttggaaatttttattcattgctttatccccacaaagtctggcatgaatgtggagtgtgagaattatctattatataaatgaatgaatgaggtgaggtaaataagcagtactcctacaggcttcctgaaaagtatccaaaaggctaaaagaaaggcacaatagacctcttcagtgcatcacaggcaactgacttgatttatggtacacacaggtacttgtgtcttcttgagaacttagtgcatagtgtgtccaataaatatttagactcatggggacatgggtctgaacgcacaactagactccagggaggaaaatcctttcgtatgacactacatcttattttagactcttaattcacttctcatgcccttccttctgatttgaatttgctccctcaaagatgagtattgctgagatgagttgaaatctgcatccgtgtctccaattcaatgaactgtgtgtctgcaacagcacacttgagaaaactgggacaccagcttcccaaggcatggtttgggaaaaggaatcacagacctacatgaccccggccctaaaaatactggtgtggctgctggagtttccaggaacctgggagactcagtccaaacttagaaggtggagtctgcctggacagaatgctatgacatcagtcccctctcccaaattctaacctaatcttagttctctcttctccttggctgtcaagaatctgggtgccaaatctagaccaatcccaacaatacagaaccctatggcttttatcttatgtcttagaattacatgagagattatcttacctttagtttcattttattttctactcttctctttttgctccggcattatcacagtttttacagtgtgtttctctggaaattactttggatatcttttggcttaatatcaataaatgcaactccaagtgccagtctgggaggtttcccaagtgaaacctgaatatggagtgaaacctgtcgtgtgtgagctcttagctcactggctggggcaggtctcaccatgtgaagttaatcatccaagagaaaacttcatccctaacactgagaacacctctctgtttgggtgggagatcatgggtggtggtggcggcggggggaccctgctggtgacaagtcagagctccagagacactgtcattcaaatgaatctgctccgacttggaacctaaactccagagtcagcagcagctctgttctcgggcatctggaaacaactacccagtggaaacctgctgtttgcaagatgtttgctttcattaactatttgtggctgtgtttctaaaagccttatggcaagtcctggtcatcacaaggaaacctgaagacttgaagattcgcttacctcaccagtgtgaaggtttctgggctacatacattctggctccagaaaagtcctctaaagaggtgatggctggctcaattcttctcttattcaactcaaacaggctaataaacattgggaactgaaggcttttttatccagcaagttctaggtgatgaatttaacagaatttaaagccctgtttaaaaatggcatgattgacttggaggaatatattcatacaaaagatgggggaggggtggaaatttgaagaaaagtggtatcaagtaaccagataataagtatttgatgaataaatggtggaatgaataaactggtaggctaagacactatcagttctttataaacccttcatttggcctgttttgaagactggctatctaaagtcttaataaataaaaataaccaaaaaaattccatttttcccctttaatagtattttaatcgaaaggttatttttaatgtctacatccatttcctttgccttcagctactccaagttggttcttagctgatccacagaaggatgttactgctaaagggttcaggtgtctctgcttctgttttattaccaatgcagtaagaaaattgcaacccactccagtattcttggcaacccactccagtactcttgcctggaaaatcccatggacggaggagcctggtagtctgcagtccatggggtcactaagagtaggacacgactgagcaacttcactttcacttttcactttcatgtattggagaaggaaatggcaatccactccagtattcttgcctggagaatcccagggatgggggagcctggtgggctgccgtctatggggtcgcacagagttggacacgactgaagtgacttagcagcagcagcagcagccagtattctttcctggagaatcccatggacagaggagcctggctggctacagtccatgaggtcacaaagagttggactcgatgaagcaactaacacttcagtaatcacaggttggcccagattattccaggcatgagcagtttgaagaagccagtccttggtaacctagaggcattaatacagcttctaaaattgtgaatcttccccacccccagagcatcagcttggactgtgagcatctgttacatctacccactggttatactgtaccttatctattcatggttgaggagtgttatgattgattcaacctcccaagcatctccacagcccctgctgtgttgctctgctgcaagcctctattcttatagttaggaatacaaggaatggaatgaaaagaagtggggggtaggggtggctcagcccttctgggtggccatctcctaaatagaaatctatactcgctcatataaataccactctaagtttttcaaattctccaatcacatttacacattcaaaactatctttatttccatgttgtcctggatgaaacacagatggagatatccgttgtacaacaaaattataaagtcaacgctaaagcaaacattgctgttaatccacaaaacattttttagtttacttgatgccaaatagcattgatacttccaaaccaagcaatatatcaaagaaaaccaaatattctctgggctactaatagagaatgcccagtaagtacaatttagagatcacccctgcaggaggaagacagctcctctccaagctccagcattcacttctaaagccttctcagtggattctattgtggtatcacacctccagcccccactccatcccccagttacttaagggcatcatatttctactataaatgctaaagaatcaagttttgttttttattttttaaagaatttcaaaaagttactcagttcatgaaggagaaactaccacactgtgagctccttaaagacaagactaagtcatcttattcacttttgatggccacgtggcctgctgctgagcccaacagaagatacaaaaatttactaactggagtcatattactgagttcatgggtttaattttgaagtaaaagtctgtcaagacccaacctttgttaaatactaattgttaa

SEQ ID NO: 37971 - DNA, 2537 bp, Bovine  19866881036484
atctcctgtaacgtaaaaagtgaatctttagtttccctaactagacgtttggacagtatatacatattaggtaagaaataaagccccccccccccaaaaaaagaaataaagcccaaaaccctttgcaatgtaatttaaaacaaaactatcacaacacactttggaaaaaacttcatttaggtaaaaagttttattaatgagctaagactagcacatctaacaataatcataatgctaatttttaagtatacttgaaggttttctttaaagtttattattttttagtactctccaactgaatttacctttgtggaaatgaaacaggtaggaaatgctaaacaaatggaaataaaatttattggccactataattgtaatacataccacagttatattacagattaaaaaattcttcaaaagggcctgaaaatatataatgctcattctgagacacaaagaatatttttcttagtaatttattttgagcatcagaaaacaataaaaagggaaccagttctgcattgccattagaaagcttcaaatatttaaataccaggcccacctccaactgtatttacaactattaaagtttgtaagtagatggaaaaagtctatcacaaaataatgctgcaaatttaataggaaaatctaacaagttaaatttaaaaaaataaaataacattaaaagccatttatacatgtaattaaggactttataaaaatgcatatggttaataaaatacaaaagtcacttgtaggcattggcaatgaaaaatggacacaaattagatgaatttctctttatctgtgcttcagttctgaacaactgtgcttttaaaattttagaacaatcaaaatacaataaatccttccacagtcatcaagttaggttccttaaaatgactagtaacaacagctactatttgttgaacaattacattctatacctaaacctcaccataacccttaaagaaaattaacatataccagtcagatgataaagctagagctagagtgatatcactgacctcagtaataactaaatggcaaaactaatttacacatctgagtctttctgatttcaaagcctcagattccttcccttgagccatgctgccttccagcaagatacagcagcccttgaaaaacttaggacttttggaaagcaagaattggtggaaatatgtctcaagtaaaccttgaaatgaccaataaataatcttatgctcagaaaaagagagccctataaaaagcctataatatcatttaaaatgtctttaactactgatcctgcccatgtaagatttctatcaatatatttttttaaatgttcaagccttactgattttatgcctgggtcactgaccctccccaagtttcctcatgatctcaaagatcaaaagtgattttccttcactcgtatcctttagtgtagctgggaaactatcctaacattcacagattaggaaaattcatatacttctgacaaaacaaatactgctgtaattttttcctaaaatttagaatacttataaagctatgaccactataatttcacatgaaatgcacatgccacccgttctcccatataaaaacatatctcagattttaacgtctcagcagataaaggtatatattttctgaggtctggacttctctcaccatttattgtacctagacttcactgtaaaaatccttatttctactctgttttcttttccattctcttctgttctcaatcaccgaattctccccactccactctttttaaatttattcctgtcaagaataaattctaacaaagttgtttgggtttgcaatctgcattacaaatcctccaaattgttaaaagtaacaaaagggaaagattctataactttgaccatggatttctaagcatttgtgctttcagaaattctgggccatatgggagtactcatttaacaaaatttgatcttcagtgtagagaagtctgattatctttttcagctttaaatgaatttctctatcactaaaagggcttccccatggctcagtggtaaagaatctgcccgcatgaaatacaggagctgcaggagacatgtgtcttatcctttggtgggcaagatcccggggaggagggcatggcagccactccagcatttttgcctggagaatcccatggacagaggagcctggtgggatatggtccatacggttacaaagagtcagacatgactgcagtgacttagcaggctatcactaaagattcaaaatgtcaaatactatgtttctaaaaacatacaaatgagaaattagttttaacaaacacatatggctagagggagtctaaaaaattgcaattccttatatttccataatagtaacatctccttgcccaagcactgttaccatacaaattgatttaactgaatcaaaaattttattaggaattagaaattgattagaaattttgttattttagaaaagatacatatgtatcacagtaacatttaccttgacaatatttaatattaacacagaataattaagtatca

SEQ ID NO: 37972 - DNA, 712 bp, Bovine  19866881122599
atgtttggatgttacagcactaaaagatggctcaataggccagactaacctgtgttagcaactagaataatctccagaaaagaaaattactttgggatttaagatgatcaaaactgattacttttcaagaggcttagaaacccaaagctgtaaacacagctggggaaatacttgaatgtgggtccataaaaactccagtgaataatccatccttctgcctcatgacgtggacattacaccacatacatgagcctatggggaagcagtaaatatttttatacaaccttgtttgtgaagagaggagaaaaatgtatagacatgcccacccacatctttgatgtgtgttaatatctttcttgttttattgaagtaaaggctaaaggattacattcagcccagcaagtaaactgtagcacgggaatattataaccaaacttataaaaactggatttatcttctcaaatttagagtgccaataggattatttttattggatgaaaaatcactgttttactattttttgaccaaaagttaatagaactggggccagttttctctatataggataatttgaacctttctgtccccaggaggataaacatctattagtatatattaacaatgaatatctctggtagtaggattaggagtgttggctatttacttctctttgatttttgttgttttttaaatttttcaaaagagcatatat

SEQ ID NO: 37973 - DNA, 703 bp, Bovine  19866881205426
ctggactggcatctcgtttatacatgacattttacatgtttcaatgccattctcccaaatcttcccaccctctccctctccgacagagtccataagactgttctatacttttaattcttattagggaaacaaaagagccaaaaagtgatagacactgaaatcagacgctctccaatgggactagactcataccagagtctgcaacttacaaagaattaagttgctctgaaactaaggtcctttggggtcatctatgacctaagagtaaccattatatgataggaagaatgggaaattgcttgtaagctgtgaatcctaaatgggtctaagtattaatagttcttctgtttgaatcaacagtgacaaacccttaggtcagcagaggtctgagactgtctatctcctgaaaagaacaggagaagggcgaaccgagccacatgcaatgtgtcacctcaggtgccaaggactcacccggagtgtccccttctcatgagccgtctcaggcttccccaaattgctctaatggaatgcactgggggtttgtacctttcctaatcatgtagaagatgggaaaaaggattccacttacttgcctacactttttatgagttaaagtgtgaaaggaactatcaagacctttggaaacttattaagctgaattcttgtcaccagtaacacatttactgctttttaaaacagttat

SEQ ID NO: 37974 - DNA, 1593 bp, Bovine  19866881240212
ggacgggggagcctggtgggctgccgtctatggggtccagagtcggacacaactgaagcgacttagcagcagcagcagcagcaaaggagcaatgagaggctgatctcaaagtatgaaagcatttcctagaatttatccctctaaggggcccttggaacttactggcactctacgtctgcagagcacaggattcttgggtatggaaaatggtgaacgcctcagggaaggtgcagacagactgtacaaactttctctcctactgaaaatgctcaggagagaaaacctgtgcgagagccacacaatgaaatagtacacagcaatgagaatgacctccagtttcataaaacaacaatacagatgaatctcacaaataaaacgttgaatgaaagaatctgtaacaaagaacatattatacgatcctatttatgtaaaatataaaagccagggaaaactatctgtttttagaattcagggaggaagaaaaagcaggacttccagagttgctgctcatattttatttcttgacctaggtgctgattacacagatgttttcagttagtaaaaattcattgagttgtactttcctacaatattatattttacttcaataaaaactctttaaaatgccattataccaggccacatttcctgcatcctgggaagaacagagctatctacttagagttcttattacaaattagcatttacccaaagccagagcaggaccatataagaagcttataggagttatcaaattatctcatttgactacacttaacttcggctaccagtaaaggttagggccttcatttcagagaggctggaaagaacaacttttaaaggctattcattttaaaacacacatatgttttaggggggatagaaactttttttgtaattttttccccccatctcttgagaaatgatgttacttcaaacagaactgccaagtttaagaggcccttttctgtacacaggccagctgggccgtaagttgcatgaaaggagggacaagcagctccttcagagagcagaacagaacaccacagggagctggggaccaggcatccagtgaaatctccagccatttgtctttatctggccaccttttgtgatttaagagccctctctgccatgttatcatcaatcaattatgattgagcagcatctaaaaaaccagagtttttaaaatgcaactatccgtgacctaaatttcctgctggttctgttggccccaggttagaccagtttgtctgtcatcaagggagccaataaaaataataaaaacaggtcagccttgggctttctgaagcctatataaaaaatattcacactcctccaatcagtgccaactcaacatgtccactctttgcttgagttctcagtaaatttcgtctttaataacaaaatatcccataggctgtatacattaactaaaaaccaatatttcccctctgtgcttgcttgttttttaatctagctaagcaacaatttcacaactagcaggccactgaaatgaagtcattttgctgactccagaaaaggagttacattttggtaaattaaaggatatatgagaagatggaaatataa

SEQ ID NO: 37975 - DNA, 1187 bp, Bovine  19866881306228
tgtggtttgagaacactgccctcttgatggtcaggcttgccctaaggatttaattgtacttctgagcaagagttcttaactagcatgcatgggatacagagaaatcaagaagtctctgaacctaaatatgtgcataaatatacatgtattttctaggcaagagtccactgtttgcagcaaattttcaaagggcttactgcttcaaagaaagttgcgaacctctattctaaaaaaaaaaaacaaaaggaatggaacacatatccttgcagaaatctatgaatgtagttttctcacaacagagattctaataagaacaaagcagaagatattttaagactgaaatctctaggaaaacacgtacaatgtgactattttatatttccaaattaaagacagatgtacttggtggtatgattatctaactcaggtcataaactgaatagacggctgtaacaattctgcatgaaaattgatcttacatttttttaagttacttaggaaaaagccttagaagacatgtagaatggatttagccatatcagatgggaaggaaggacattttagatcgagaggagaacaagagtgggagtaaatattatacacctgggatttccaaatatacctatctaccaatctgtttgcaacaggaacagcaggatccaccttttggtagagattaccatattttaagctcagttgcattttttaagtgtatcactgataggaaaagacatgcttctacaggtaatttaaaaaaataaagaccttcatatgtgcaatcacataaaatcttacaagccacacaatatagcaatatgcattcagagtgctcaaatgctttgaagaacaggtacattttttcagtatacaaatctcatttttttcagtatacaaattaagatagaacagtaagtagtgcaagaacaaacgaggaagtcaattttagatttaatgctcatttaacatccacatcaaaagtcttaggtttgtctattataagaaacccaagcaggtttaaatattttagtaattctacactgtaatagaattttattattcctctcaaaagagtttgaattggtttaaaagaattatgacattggaaaaaagcttaaaaaaagaacttcagttcagtcgctcagtcatgtccaactctttgcgaccccaagaaccgcagcatgccaggc

SEQ ID NO: 37976 - DNA, 2681 bp, Bovine  19866881309971
caggacccaatcaaacttgatggacagcatgtgggtcataccagacccttcataacaaggtttcttcctctctttccagctttatctggccacagaccctctggaacccccaaaggacacagctattgcactcctgtttgtctgtatacctgattttctttcttgaaatgctgttttcttctctgacaggtaaatactattcatgcatcacactttgcctgatccctccatgctgagacagttgtcccagagcccacagcatcttcctttattttttcaccaactcttttacatgatgggctttcccgatggctcagcaggtaaagaatctgcctgcaatgcagaaggtgcggaagatgcaggttcgattcctgggtcaggaagatcccctacaggaggaaatggcaacctactccagtagttttgcctgggaaatcctatggacagaggagcctggcgggctatagtccaaagggtcgcaaagagtcggacacgactgagcacacactggacttttacatgatttgtttgcatctgggtctgcctgctggactgtgcgccctttgagagctgagcccaggacctactcattgtagcctggtacttggtcggtgtctggcatccagcagatactcaacaaagtttgcgtaactggactgaattggtgtaaggttggctcagttaataaacatgttttaagaattcaccttcattgtgtgtggtagactggtttaggaatataggcggtggaagaaagaaaacggctcaaaattctggcttgggtgtctgacaatctgaaactgaaaacctgacaacactgtcctgttgatgagaagaggataaaccttgaaaatgcacttttaatacaggatggttggaatgccaatttagataggtacccacatgtaactggtgtgttcaaatagagcctagggagagagcagtaaatttactttgtaaggattaagtctcctgccctgctgtaatttgaggcttttaggcttctcatatggtataaacatccctctattaattgaaaacagtgctggttaacatatacatctcagtttcaaagcactttttattcctgtactatccttggaaaatatgttctgatgcacgtgtggctagcctcttctgctatctcaggatcagtgctttgtagaaggttattaaatgatacattcaagacaactcctgtcttatcaaaggaagtaggaggaacattgctggaaaagaaccaagctcccgcctctcagaggagaaaaccaaggcccaggagactgagtgacgtccccaaatcacacagcctccaggcacaggcagcatcatgtggaaggtcccgagtccgaaagaatttggagagggtgcaggggaggcaggaaagctggcgagggcttggtgggccggcgccagggattgacattgcattcccagcttagtgggcagcagctgaagggttttactcaggagcatgccaggatctgacccatgttttcaaacataaagaccatgttgctgcccggaggagaaaggccacttagaggctctggcagtccacaggtgtgagatgatggcggcccaggtgccggtgtgacgatggagtgaaaaagaagcgaacggatttgaggtttttagaattggaggcatttttagaattagaatctagaggacttgctattgtgggtggtcaggaagaaggcagtcaaggatgattcttatgtttctgggcttatgtggatgcagggactatttgtgagatggggaaaaaaaataagggcgaggaaccaagaatccactgctggccaggtggtcaagtgaggcttgagacggaacagtacaatagatgtggactgccccacatctggcaggagtaagcatggtggcagtgatgttgttggctttttgattggtgttttgtttgtttcttttttaaaccactggtgtattcactaccaccccagtggggttaccaaggccaaagggaaacatcagaattatggtgtagtttctacaaaggctggtttgactacagagagagtggcaaaaacatttgttgggaattgatgcacatgtcttgaatgttccatttaagtcggcattcacagaaatgatgatcagttctgatgactctcctatacgattagtctgtggcctgctttagattacaatgccgctgctgctattaatgatgatggagcttgtacagaagtttttactgaatgtttccacgcctccaaagggaatagtcttaattttaataaataaacagctattcagtaataaatactggcatccttatttgataacttattgtttggatgttacttagccattctttaaaagtggatacatttacaatatagttcaaaagtgtctttcattgtcagtagaaactcaagatcattttaagagaatatgccttgattttgttttacagcctcttgatttttggccagctatgtgctctgacactcttctactgctctctactgttcaaaattattcagcagccagctaagcttgcacacatagcaatccactgctactgctgctgctaagtcacttcagtcgtgtccgactctgtgcaaccccatgtactgctgcctaccaggctcatctgtccacgggattttccaggaaagagtacggagtgggggccatgccttctccgagcaatc

SEQ ID NO: 37977 - DNA, 1692 bp, Bovine  19866881355333
ttcaaatcatccatgtaggagtatattttctcccccgtgctgcggattgaatgttcatgtcccaccccacccccacaaaagtcatgcgttgagaggtgattaggtttaatgtggtcacaagggtggagcccctctgatgggattgtgtgtgtgtatatgctcattcagccatgtccaactctttgctaccccgtggacttcagcctgccaggcttctctgtccatgggattctccaggcaagaatactggagtgggtagcctttcccttctccaggggatcttcccaatccagggactgagcccactgagtctcctgcattggcaggcagattctttaccactgagccaccaaagaagccatgatgggattgtgaagtgaagttgctcagtcgtgtctgactctctgcgaccccatggactctagcctaccaggcttctccgtctatgggattctccaggcaagaatactggagtgggttactatttctttctccaggggatcttcctgacccagggatggaacttgggtctcccacattggaggcaggtgctttaacctctgagccactagggaagcctcttttatgatgggattagtgcccttaaaagaagaggaagagacttgacacctctctctcttcttccctcccctctctctgccatatgaggatacagcaagaaatcacctgcaaactaaaaagagggctctcatcaggaacataattggctgccaccttgaacttggcctctcctgtctccagaaatgtaacaaatcaatttctgttgtttaagacacaggttttattatagcatcttgagctaagataccctacatagtctcttgaaggtttttagtacacaacacagcatgtaggaccttcagtctcagctaactctcaatatacagcacattctcaataaaaacacaaggaataaaagagcccagtgtatcctccctggtcgaaggagaacctactcgggtttactctcaccttgattctcttcctgccccaagatctctctcagcttctcccagactgtatactctaccctagaagttctggcaaagcgtttttaaaactaaatattcctgataaagattttggaacatttcttgatatcttagtgtggcaaagaaatgattccttctcttttataaatgtttttttttttttcctttggaagaatctcagttgatattattggatcccccccaaaaaaatcaacttggcatatataatattaaccagctatgagtctggaagaaattcaaaaaccagacagaagtttttgatttttaaagcatatttaatcatgttttaaagcaaaatgaaagaccacaaatctattcagacattccaaacagtgaaggaataatttttatcaaaatctgtagccttactcacgcagaaagaaattgtccctaagcagtgctgacaactctgtctgagacatgaatctaaaaacactgcacattttttcaattatattttggaagcattgagtgtgctcaatgaaattccagaattaatccactctggttttgcaatagacactgactcatccaaactcctcccctctttccttttggcaaagtctctctcttctactacccgctttaacacacacacacacacacacataacttaagctagaaccaagactggaaacagcaaaatattcagttaacc

SEQ ID NO: 37978 - DNA, 950 bp, Bovine  19866881412103
gtatacctgtgttagttttttaaggctaaattttaactatgtctgaagtactctgtcagcctcaaagtttctgttctctcttgtgtcaggctgaattgattggactattcatgttaaataataacaagctgtatcttctttacatttagtgttaggcttaatgctgttaatagtctgtgttttcagtattaaaaaataaagttactatggaattgcagctaccattatatggtggttgtaattccataataacttaattttttagtactgaaaacacaggctatttaacagtgttaaacctaacactacatggacagaggagcctggcgggctacagtccatggggttgcaaagagtcggacacaactgagcaaccaagaacaaacaaaaacaaacagaacaaattatatggtggttaagtaaaagtcataattctaccttatgttttgcatttgcaccaagctaaaattcagaacttgcaacacgtaaaaatacatttttctttgacagtggacattcctctggttatgatagtcgttctgcacgtgcttttccatatggcaatggtaagtgttattttttaattgctcggattcaatttaaaccagtaaagtacttaaatactttaaaatagtagaaccatgctcccatggtttaaagtactatcttaaaaggaattaaaaaatacttactctagaaataattaatcttacatatattccaggttacttaacagaatatttttcatttctttagtaaggatgtaattgtccctccttccttaggtagctatagtgtcatctccatttgtgtatcaagttccctgcacgcatgtatctatttcttagctttcaagactattcatttggttagtttttaattatccctatgctaatagtgccacacttactataaaactctttaattttagttttatagtaaatctatat

SEQ ID NO: 37979 - DNA, 1183 bp, Bovine  19866881492629
aaatccaaactggcccacttctgtgccaacaaggcaggtattgtgatagacagcccccagtaaaatcaaacagaggacgaggatgagcaattgctcacttaagtttcccgataggaggactagtgtgggccaggcaaaaccacagatggccgcaaaagatcttgcagtcttcgaccatcaggtgtctgcggtcccgtggggtgttgccccagggtaaccagggggaaacaataaaggggacggagttgctgaaagcctagcaaacatgtgctggaggacagcatgaaactctccttcatactccagtcttcgatgctttgggggactcacacagcctgggagactgaagtcacatagcagaaagagggcaagtggactacagacagcccacaattccagaaacaactctaagcttcaaatgcaaatgctgcacttccagaggaacgagaactcagccatcctaggccaggagggttggcgggtgggaggggcccagggtgggctcagcacctccacctgggcaatgcagaggccaccatgacagccagtgtaagaagcacgcacctggatccgtgtgcaagtctattgacacgaataaccctggtgcgccgtgtacacatcagatgaacatgaaagctgcaacatctggaaaaatgtcaccatctgccactcggagaggaacactgaaaggatcagcaggacaggagcagtatggggtccgagtttaaaaaaaaaagtgttggcagcagctgccagctctccactgctgagaacagcagcgatcctcctgacatggcagtttatggactctcacaaatcccggctgacccctcacaaaggcaggggtccacaaaccgagtggctccaatggccatcgctcatcaagcacatttaggagcttttgttcccatctcttctgcagcctcacaatggccagcgcacaccaggtcccactgcaagaaagaaagggaggtggcggctcgtggagatctcagcagaaggattttcctcgtgcctgactcctctgacctgctcatcgtttgattttatccacagagatgagcttgcacgtgcggctcttagtgctggtttagatgaaaccccaaacccagtgggggtcatgtgctcacgtcagaccaaggtgatgcttatatcttcacatgttaatacaaatctaagttaa

SEQ ID NO: 37980 - DNA, 3091 bp, Bovine  19866881522169
aagaaaaagtgggagaaggccaagaagaaaagaaaatttttgattaatgattatgttaaagtgctatttaaatcaaactgagaaaaaaaaataaaaaaaataaatcaaactgagttgacattttctttccaaacatctccaaatgaatttttctccctaggtaacctgtagtggaatttctaggcttcattggtgtgtgtgtgtgtgtgtgtgacacagagaatgtatgtgtacatacatgtatttgtgttttggcaagtgtgtgaatgtgtgtgacacatattctcaacaaaagagaaaaaaatctctgtactatttcaaatgaactgatgtaaatggaagcttctaggctcttttactgaaaggctgggtccctttattaaactgctcaaatgtcctccagctcggcccactcatttgtgccttactaataatctgtgggactgaggctgtgtggggctttctggttttaattactctaggcagacccagcctcaaggcttcggcccccagtggtgatcactgcttgggaagaaaataatttcacagcagcactgcactgttcttaaggaaggaggccccacagaagagaaacaaccttcttgaatttctatggtttgggaagatttctcgcacttggcagccaactgttagaagagtcgcggagtgagattttcccgggcctgcctgcgcgtgcaattgcccgtcctctgctgcatctccagggatgcacggaggctcctttgcacgtggacaaggctcagaacctttgttcaagcgcaggtgagctcaaaggccttgctctgctctgtcaccttatcccatgtccagctttccccatcacacccaggccaagagaaagtcagggtcgcctgctgaacagtcctggcagcttttttgcttgcaagtgccagctgaaggccacaagaatcaaaatgttttccttatgcaaccctcccaggcagcatagcttccatagaactggaggaaagccatatagagtgttgctaattgcatggccaatcatcccctgaggttgacgggccctgcctcgtactccatcttggaggccagtgggaatatcagtgtttctacaataactgcttcaaattctttctcctcttattccaaaaaataagaatttctttgccagagaaatagcacataatgtgttaggagctggcctgtcagcaacccagaaaggataggatgaaactgtcatctgagggtcagacaggaaatatatgaccaagggagggattcttccttatcacttttggcacatgttagacttctgtctgatgaacaactcttcctttgtcctttctcttcatctgaaaattcttcccgagcatccttaccctcggccaagccacagaggacagtaatgcctaaggcgttctgttccaccacctgtctcccctggaatgtctgtgggttggctgaatagcttagggattttttttctttgctgaagggtcattaagctataggaaatttactttaggggagtgtgtgaatgtgagtgattagataaaatacaaaatgttccagtaatctgttctaaaaacaacttaatatgctacagttttatattgtttgatgttattgttacttaaagtaggagaaagggataggagaggaagaatgaggagggagaagaaggaaaagaagactgaagaggtagagaaagttaggggagggggaagacaggagaagaggaaggaggagaacagagacaaaatgatatagagatagtatttatagagagagagaaagaggtcagaagcacaagacagacagaagggttagggacctactgcaaattactaatcttgtatgaagagtcatatcaacctaataactatggaaagtgactgttccacatttatgttagtgttttacttatttgtccaaccactcacccatcataaccctaacccatgcagccaatgatttgctcagaagtgactcttattaagcccattatcatggctccacagccatagtttctacctttaggatgatgtctcctggcaggagccggccatctctggctatcaccccatcacgataaatgtgctggacaatgatatggaccagaggggtttcactgcctcccacaagcctaatgggagaggttttcattgggatccgttcgattgatcttgatgctggtaatttcaccatctggaatcaggtgatacaaccttggaaagactaaaatggacaaagacagtgtttatttaagaacacccaccaacggccatttccaaccacttctcttcttgccaggcttttggttccagccaaactaaactattcatcattctttgtacatgttttccatcttcctgcctctgagccagcataagtttctctgcctggaatgttttccatcctaggcctaaacccaatttttccttcaaggcctgcatgaaatgatcccttccaattaaattctgccctcctccctcctcccccactctctctcaacttcctatttcccacaaagctgtatttctcagggcactgagccttctattactattattattactcatggccatttcttatacctaccattggactctaagatccttgtttcttaggtctgtgcacagacctctgtacacaggagactttgtcccatgtttattgagtaaagaggaatgaatgaacagtcattatggaatgaaccacagtttgctcacttacttaccgaggcgaaaaaacagaacaaacctgttctgctctttctgattattttgaaggtttcctcctgggaggccctgtctttcagtctcactgaaaagcaggctctctccccacccctgctgtcagggaagggaagtcaaacggcctaattcacaatcaggaaccccccgggcccagctggtggtgtcaaggtgttcgtccctgatccgcttgcattgctgaattcagagccagaaggagattcagagatctaggctggggtttccaaaccttacattttcagtgaggacccttaccctggaaagtctttcacaggttaccctgcccccatcccctgagcccacacacagaagatcatttcaggctgtgcagt

SEQ ID NO: 37981 - DNA, 1217 bp, Bovine  19866881570034
aaaacattttatcaagtgaaggctcaaaaaggaatcccggtttgtatttaaggtaaggttgttttttaaaacctcatttaaaaattagaggccaacctattcccacctgccaaatgtactcaaaccaaacatcgtactttgattcatttaatcctttgccagcatattgtcatcagcaatgcccatgtttaacattgaaatcacacatttgggatttttaaggcgctccttcataggccaagagttcacactctgatgcaggtgagcaaacctcaagtttatctgtcctgtgaatatttgatttctgtatctagccctgagcaaggttgctcccaaatcttttcctgaacttctaaaacacttaactggcttccctataaggctctagttacgtctcactagaatgacaacccagccacttcctgaaggcttacacaagaactttacaagagtaggaactaaggagaggtgatctgagccagaccctcaatcacacatgccccagcatctgcgcgaaaggaaaatgtgctgctgtgtcgctttgtgtctagccagggccacccaaaagctgggtgaagaggggaagagaggggaagccacggaagttttgcctctgcaggttcccagtgctgctgctaaccaatttggaaaacgggaccttcccgtggctccagggtgtgtgaacacaagccccttctccctgtccgctgggcttcctgctgcatgtatgacccacaccaccatacatggcagccctgtaagctcctcaacaggagtgcccatattcaggctttcattcctgcctgaggattactgtgttttcagttacaaaagggaaggcgaattatttcaaatagacccacaatcacacatgggtctcattaagattgttagtgcccagaatcagcccgagagagtgaaacagtggtctacgaactataattgtttcctcccacacctccccaaggatgtcacattggaactcaccgcggtaattccagccacatgacccaagaggggaaccagtcgttgggtggggctgtgtcttggtcagagtccagggctgccaggctgctgtcatcttcctggggctcatactctttgacttccaaagctttcagtaccactgaagaaggacgtgcttttcaataaaccaactgcctcactccggctgacttcagtcagttcaatcccattcacattcaacaaaatgtcac

SEQ ID NO: 37982 - DNA, 757 bp, Bovine  19866881658959
gagacatcggagaagccgcaagaattctgcgattattgatatgtttaaatttaaatttcagtgctttaagttatggtagaggttattccttactctttctctacttctccacttctgtttaagttgttttggagttagagcgtttttgactgcaagtatacgtgtgtgtgtttatgatccttcaagacgctactgtgtacgcctcttgaagaatgtgatctgcccctatgcctttcatcaaggtcttctcaactatgagagtttcctttttcaaggcttaacagaaaaactgggtctctaattaccaccaaacttcctccaaattgagctaaacaatgtacatttctgttgccagctgggacataattcttcataattattgtacaaaagagcctgtgacagttgcaacaaagtaattggctaaacaggtatgcatttccttgaaacatctgtttgaaactctgggtcatttgaagtgtatgtaaaattgtctcatcttctaattagtttctcaccagccaaaatatcattgccaaagtcgttttaagtaggatacaggagctaaggttctgttctgtagcaaaacctgatataaccactcagttctccaaaggcaagcatcatttcatctataaatgctgtcatttgtgacaagagaatggagcagcattttccttctaataataatatattttccttattatttaagacatttctcatttacctagtcaaaaagcatccgacaagacacatactt

SEQ ID NO: 37983 - DNA, 1535 bp, Bovine  19866881768093
taatactgtactgcatatttgaaagtccctaagagagtaaacttttaaaattcttatcacaagaaaaaaatctggtgatgaatgtctattatatttgttgtggtgatgatttgctaatacaatcaaatgtcaaatcattatggtctacacctaaaactaaaataatgctgtatgccaattatttctcaatttttttaaagaaacatcaaaaagatattttcaatgacctgattcaatcaattaggggaagtttggcttaaggcaagttactcagtctctttctcttaacttgaactgtggtgttgggagaggactcttgagagtccctcggactgcaaagagatcaaatcaatcaaacctaaaggaaatcaagcctgaatattcattggaagaactgacgctgaagctgaagctccaatactttggccacctgatgcaaagagccaactcattagaaaagaccctgatgctggcaaagactgaaggcagaaggagaagggggtgacagaggaggagatagttggatggcatcaccgacttaatggctgtgagtttgagcaagctccaggagatgaagacagggaagcctggcatgctgcagtccatggggtcacaaagagtcagacatgactgagcgactgaacaacaacaacaaacagttgttttcagagttaaatgaaataatacattttaaatattgagtacaacgtttgaaaaaatttaggcactcattgttaccatccttccttctcactgacctagacaataggtgcatttggtgaaaagtacatagaaaatgcctactctataggaacttacagaagaaattaaaacatatcaatgttagataatgaccctaagtgctaaaatgaaacagttaaggctcttcagggatttatgtcatcatttttttacttggcctcaaatctaataaaatttattcattctttctttatgcgatttattagcacttttgaagtgcctggtgcactactacttttaaggaatttacagtatagtaggggaaatggacggggcttcccaggtgcctcagtgggtaaagaacctgcttgcaatgcagaagacaccagagatatggtttcgattcttgggtcaggaagatcccctggaggagggcacagcaacccactccagcattcttgcctggagaatcccatggaccagaggagcctggagggctacagtcaatagtgcaaagagctggacaggactgaagcaactgagcacagcacaggggaaatggacacacacaaattactggggtataatgttttggcattttgatagaaatattaaaagaaaagtatggttcattgggaatggaagacaagaagctctgtagaggttccaaagtgagagacagcagttttccttcctaagagcacagaatcctaccttaagctagcttaataagggagtagtgtttttatttaaatctaatttgttttctaaatttattttcaattggaggataatggctttacaacgttgtgctggtttctgccacacaagga

SEQ ID NO: 37984 - DNA, 1421 bp, Bovine  19866881833899
cctagaggttttctttcggagagctggccatagagattagtatctcctttgtttaaatgcagtacgagaacacagattttaattgacctgctcaaggtcacacaggaattagcagtcgagccagaagtggggcccagtgctcgaatttcccttctctggccgtatcagcccacactgctgttttatgtacactcagtaaatatttacagccttcaatatcttccccactgcagttaggacaagaagtactttcatatacgtgcatgtgcatgcaaaacagatgtgaaaaatgtaaacttgaattatatggacacaacgccgctgatagttaagtacagagtaaaacccagaaaacctaagattcaagactacagttttgtcctttcccacctcttggtggttcttcaaagttctgaaccgagagtacacctttgactaagagacctaaaatctgtgcccacctagaagagcactgatgagaaaggatgaggaaagccttctctgtgtttcgaccttgccaagttcatgatgccctaaaacagcccattataagatggctgagttttgtgttgaaaagaatattgatcaaatcatgccccacttcctgagacatttgttatgttaaatcacatataactcacaccaagatagtgattctacttctctttatatgtgtgttagttgctcagtcatgtccgactctttgcaaccccccatagactataagctcgtgaaactcctcctgtccgtggaattattcaggcaagaatactggagtgggttgtcatttccttccccttttgttgctagtatataggaataatattgattttgctagtataaccaagttctgtaaccttgctaatctcaacacttagttttaacactttttaaaggggatttcattcatatgtaaatagttaagttatttgtgaataaacactgttttatttctttccaaaccccacagcctttcttcatttttcttgctttgctgcactggtagaacctccagtacaagttgaagggtgatggtataaagggatatttttaccttttttccaacctaattttagggagaaaatattcagtctttcaccattaagtatgtaagtgtgatgttatctttagtttttcttttaataaatgctctttatcagtcaaaaactattttattcttaacttgctaagttttcataaatggctattaaatttttcagattttattgtggtaagaaacacatgaaacttatcatcttaacatttttaagtgtacagctctgttcagttcagttgctcaaatgtcttcaacttgttgcgaccccatggactgcaacacgccaggcctccctgtccatcaccaactgccagagttgagtcggttacgccatccaaccatctatcctctgtgtccctttctc

SEQ ID NO: 37985 - DNA, 1391 bp, Bovine  19866881924576
taaaagttaacttaaaacagagagagagggaagagggagacagaataagaggaaaaatcagaatttcaacatttttttctccttccagggaaaaaatagagtctagctctctgggcaagtaggccatctatctgggagggagaacccacgttttccccaggtagtacattccagagagtgaataaactgtcaagagatgctggactggggccatagaaatacatgacgttaaaatgcaatgatagaagctgttgacaatccttcgaaagatgccagagggtttaagaggcagacgcaatactcgcaggtgctgctgccacaccggctgagttgtagagttcctgtcttttgctgctggaaaagctgaggcaacacaatgacttgcccagggtcacacaccatgcttgggacagaaataaccctgactcccccttcctggctctaatcagctgacaacgccactttattactgtactatcattccaatctgaatcatgtaaattgctcctaattgcaggtctgcggtgaactgtaacctccgtgtgacttctagctgccagaccatcgagctaggaagtgactgaagtttcacaaactcctaaacatgggatgaactgctggggcagggagtgggggagtgtttgaaaacttgactctgaaagttctgagaagcatcatatttggatttttttttaatgaatttgaaatgtcacctctcatttattaaatttgaacaaagaagcacttgggatccaaatggatgacattcagaaaagcattcaggaataaatctcagatattttccaagcattcaatcttcacacagttccttttcatgctcattaagtgactgtttttgtatttaaacatcctaggttatcacatgtgaaatgtaaaagataaatgaacagactagtgatgaccagtgggagagggaaaaggggaggggtaagatggggtaggggaaaaggtgaaagtcactcagttgtgtccaaccagtcacgtccgactctctgcaaccccatggactgtagtcccccaggctcctctgtccatggaattctccaggccagaatactggagtgggtagccattcccttctccaggggatcttcccaacctagggatggaacccaggtctcctacattgcaagtggattctttaccatctgagccaccaaggaagccctaagtgtaggggactaagaggtaaaaaccagtatatataaaataaataagaaaaaaagatatattgtacagcacagggaaatatggctgtgattttgtaagaactttaaatggaataaaatatagagactaaaataacattgcaaatcaactatacttcaattttttgaaagctgtcaaaatgataaaagtaaataaacttt

SEQ ID NO: 37986 - DNA, 884 bp, Bovine  19866882017423
ctgggctgagggagaagttgaattcaggagtggttgtcacagaggcttcgctgagcccatgggaggctctagagtcctaagaagagtcctcaatggaggtaagggagccagccctttgtagtccccactttgagcagccatgggatgcaataagagaatatataactttgggcaagatagtttcattatgcacagcacttcttagaagggaaccgttgagctgtggcctatgagttccagcacagggtcactattatagcattcacaacaccaatgtgatgcttgaaaaattgtacatatttccacttacagtctgtgtggacagtccaaattgttgaactaacctcttcctcagttactacatctgaaaatgaagtacctacaaccataaaggtgttttaagaataaattacagctaaaggaattagaccagattctagcttagagtaagcaattcataaattagttgttattcatttttatagtcagggccttcgaaatatattcaacatggtaaaatatctaataatatggctgtttttcattagtctcagttttcatatttgcaaattcacctgcttgctaaaatttactaataacctccaaagccatattcatggtgcttttgcagtcattcaaggacatgcacaaaggggtggaaaggcacagtggagcccagcatacagagtcccagttgaggtccagcaaggggatgataatataccctcttgtttcagctctcgtactaaaagcaagtgtcctttctgtggtctactgggtccacatttatcatatttttgtgctttttcttggtgatttctctatttaaaatggcctccaaatgtagtgcttacgtattgtctagagttccaagtacaagaagg

SEQ ID NO: 37987 - DNA, 2632 bp, Bovine  19866880441929
cattctgccttgaagatattctaggtcatataatatcctccatcacagcagtccccaactattttggcaccagagactgatttcatggaagacaatttccccatggcctgaggataggggaatggttacaggatgatgtaagggcattgcatttattgtgccttttatttctaatctaatgccactgcagagttggggaagtatcagttcaaggtcttggaggctggagaccccagctcttatgaggaagatccaataccaattaagatggggaactgaaaactctcagctaaaattgatcatggaagtgtattagttgagcaaaatgccaatcaagtgatgtgctccaagatgaagtctgagaggctaatgaggcaagcgagctcatctttggcacgctaacagacagcatattgtcccatggcttccagttcatattttctacttaaaattaaatactcaaacaattcttcggttgtgatccactgagagaccagtggcaagggagccactctgattacaatccagctttatggggctagtctgcaagacagggtgactgacaggaagccaaaccacataccaactgatgagctaaagcagggtgatccaaacaagtcaggcagagaaaacatcacaagaccccattatttggcaagctgaagcactgtgagacattgctgatggctgagaagtgacagcagggaaggagaaacaaactaaaaaaaaaaaaaaaaaaaaaaaaaccctagagaagcacgaatgctattgaataggcagagctcgatttgtgcaaaaatgtcatgtagtccttgaggcagaggcaaaactgcacagtgacaggtcttgtaggcagcggccatagctggagactaacaaacagttcgtaaatattctccacggcttgcagtgcaagtaagaagtttgtgttcaaccaagcttacaggaaaacattgacatcgagtcttttgaaaggtagctctccaatggtattattatctttttgctgagtctcaaagcttagcaatgaattacggagtaatcacttaaattgtaaattatagtttgcttagtataatcactaaattgtaattatgcacaattagtgagatttagcgctgttaattgttgaaatatgtaaatagcattcattctttcttttgtccaggtgtactgccatgagatttccaaacgtaaaatgtcatcgttgtataattgttgacagtaaaatgaaaataaggagaagagaacctttcacatacctgtggtgacatcacttctctgttttgcccttgctgagatccacccacagattcagacaacacatctctgtccctgaaaacattttaattgctttccccaagtagccgcaatgaccaggaggacacccttgattcactgacacatttaggaagcagaaagggcagggctaactatatagccagagctcgagcaagggaaaaggaggatgttagaaaaattttaagatttggtgcttgggcaaatgtttagatggtgaatccacacatagatacagggcaactgtaatctactatttcaaaccgacagtaacaatagcttctaccttcccaatgccagcctgctgctgctttgaattgcatttcaaaacaatctttggtagaatgctgtaagaagtataacagctacaggatgctacaatgtgttacataaaaatctctttcaacagtctgaaattattatgaaaacacaagctatacacatttaagcactttctatagggtatctcaaagacttcatgtgttaatgtgtattatatattgccaaggaatgaatatatgggatgcaacatcttgacatgtccaaaacttatttggttgcatatctcctctatggcattttttacaaactaaaatttcagtgaaataggcttcaatcaatcactttctgttttataatttagaatttgcattaatctgaatgggcttccctgatagctcagttggtaaagaatctacctgcaatgcagcagaccccagttcaattcctgggtcaggaagatcccctagagaagggacaggctacccactccagtaatgttgggcttcccttgtggctcacatggtaaagaatccatcccctggagaagggaatggatatccactccagtattctggcctggagaattgcatggactgtatagttcatggggtcataaaaaatcgcacactactgagcgactttcactttcactttgatctgaatatgtatgtgtctctttttctagactatattttcttttaggagatgagtgggatattgcctctctctctattgctgggatataacacaattcttccccatagtgggaactcaataaatgtttattaaatgatgataattgcattagggtaattataaagctatgccaggtggcccaatggtaaagaatccatctgccaaggcaggaaatgcaggagatgtgagttccttccctgggttgggaagatcccccggagtagaaaatgtcaacccactccagtattcttgcctggaaaggtccatggacgaaagagtggggcaggcatgactgagcatgcacacataattctaaagctactagcaaatacggaatagatccaatgctgatttt

SEQ ID NO: 37988 - DNA, 3589 bp, Bovine  19866880465541
tatttcgtcccctaccagacagttctgatcatgatatgacctagccttctcaaggagtctctcacaaacaggaggtgatggcctgagtttctgcacatctacaagacacctgtctgatcactcctttgcatatcattccatggcaaacaaatattgccttgctgaatatgtgagcaaacagtacaaagtacacatgctttctaaatccaagatctagactccattattgactgaacaggggcctctgaggcccatcagctgtctagaaggccccatgtcaggtatttccaatctatgtttctgaatcactggatgccacgttacgggttctccagagcttccctagtggcttagtggtaaagaatccacctgcaatgcaggagacttgagagacacaggttctatccctggatctggcagatcacctagagaaggaagtggcaacccactccagtactcttgcctggagaatcccacagacagaggatactggcgggctacagtctatgtgactgcagagagtcagacacgactgagtggttaacactaacacttaggcattctccaaacttactgattctctcattccagggatatcatgaatactcctgggtctgtatttcttgtttggaaatcagacattcacttccttctttccttgaaaaacatggtagcttgcacctcaagaatggtcataacagacttaaagaagcaccacaacagaatctttaataaatatggagatctctccaaaacagttctactcttttacctttctttggctgaagtgattaatgctgtttaccttggccatggaattcattcaggttaatcttaattttctgttcatggtttgaacagaggatacaacttccctagattttcttatagtccaaggaaaagtctatgcattgctgacatatactagattaatgcattggaccaaggtaaatattgataagaaaaacttaaaaagaaattcacctggattcctaaggtaggaccaaatgatatgtgatttgtgcagctactttagtttggagactatggggatgagtttaccagataaaatacaggatgtttatttaaatgtgaatatcaggtaaacaacaaataatgtttttcacataggtatgtcccgtgtaacatatgatgcatacttacattaactgttatgtgcaatccttatttttatttactatattcagcaacttaatgtgagaggaagagttgaagtcaacattgtagtatggccacattctgtttctcaaaatcctgttgatatttgtgtaaatttaatactgcatgaataaattcaatgaatttgaactcagcctctttggactgattactcagtaaagcataccaaagccaaagcattgtaggaacaaaagatggatatttttccatcatcacttacattaaagtaagtttttaataaatctctttcaaagtatgcattgatacacatttatttgtgtcttattttatgcactttaccctttacacctaaattccatagaattcagggacacttttgcactcagcttgtagaaagtgcttttaatattatatctgcctaataaatattttggaatgaaggtataaatatattaataaaaaatgaattattacacaagaatactattactgtcacatatataggatatatattttttttaatcaggataatttattcacaattaaaacatctgcatgtaaatacatttactgatgatcaactaaatattttgaaatatgaaactgatggttcatttaagcatgatgaattagagataaaattcaatatgatctggattaatatagtgcaacatctaagtgaggttagttagaaatctcaggaaataacttctaacatatttttgcaatttgacttatattggcttaatataaagggaatcaactctagagtatctgtgcaaatgtgtttttgagaatgaccaacaaaaatggggttagttactcaacagctgtgctttatagtttctatatatattttttctacatagtgattgctaaactatattgtacatttctacatctgtgatgcttttcctcatgtggctgtagagttgctgaaatagagtgagtgcttcattattacatgatctttgttgacaaactctagtcttgggtgatttttactttatcccaaacagtgctattattcagtattataaactccattaaaaaggtgtggtttttatgaattaattgtaaatgaattttctacttccatctttactgacttgagaagttcttctcagggagtgaagtcagcagtgtgtagagtggaaagccacctttttctattccttaaatatatgaacagtaaaacaacaacaacaaaaaaaaaaacaccacagcttaacaaaggttcctctaaacaacacaccaggatgttggagaattccacacatcagtgcctgtaaagatgggtgatttggaacacacagaggagacacaaccaagggaacaatggagtaagtgcctacagtctcgtccctctgaccatgacagctgagcccgcagctttagagaacccaggagcatcaaggtaggcagcacacatgactctggcccccgaccctctgtggcacccacagccacagataactagggcagcagtggcaatggggtctgggatcccatccgctcagatgttgagatgcccacccccaggctcctgaactccatccacagtagcggagccttcaaaccttaaaacaacaggtacagtagaggtttctgaacagcaccggctcccctccaaagatcctccttaccccacaatcagtggcagactgtgcctgcaactcaggggattccagagtcaagggaatatagcccaccatcctggtgtttgacagtggctctggcagaagcaacacagccagaaccccagagggcaagaagtgatggcaaagacacggagtcatacctcttacaaagacagtagtggatgcaaagtgtccctctccaaccaaagacagcacagctaagagaaactaaaaccttatgctatcgcaccatctgctggaaaacaagagaaaaactccaactgccaatagaaacttcaaatcaccagcagagaagtaattcagcaagaaccatgaagaaccacagtaacactgtatcacagcaagaaaatgacaattttccagacaccaaacttaaaatcatagaatactgcagtgtaactgatacggaattcaaaatatgtgtcattaagaaattcagtaagcgaccaataaactcaaaagggcaattcagtgagcactggaataaaattaatgaacaaatggcaacatttattgaagagattaaaaatctaaagccaaacagaaattctggaactgagtaactaatagatgaagaatgcattaaaagcattggaaatagagcatattgtgtaaaagggaattagagagcttgaagagaaagctagaaaggatacatgtagaagaaagataaataagaagtaaaaaaaataaaaaaaatctacaaggtctttctgaaacttttagggaagggaatatctgggtatcttataaggagaagggagggg

SEQ ID NO: 37989 - DNA, 2029 bp, Bovine  19866880674289
tagtttacccctgctgctaagttgcttcagtcgtgtccgactctgtgtgacctcatagacagcagcccaccaggctcccccatccctgggattctccaggcaaaaacactggagtgggttgcccatttccttctccaagtttagccctactgactccatattgaaacattttaaggtataatcatttttaatgataccttctaagttatgcttctttagaatgtgcatcttaaatagtaaacatgaaagtattctagtcacattgaagagtaccaagcagtcagaggaaatataccagtttgtgttagttcctttagggtgacagcatgtgtaaggcaatgcagttcattcactgtcaggactttggagaaggcctctccttccctgcttatataggtagtggaggggatcatcttacaaatgcaatgtgacaaagaccagatgaaagaatattttatcagactgataatgtatatggaacaaagagaatgaaaataccccaagattgctcactggaaaaaggaaaaataaaaataatagtgaaagattttttaattctgtttaggtctagttctacctcagaacatctctccacctttttttgtgccacatttaagtgggaaagtgaagatgtatgtcagatttattttaacttaagaaaatggaaggtttgaagagagaagccttttgtaccaagtgtggtatagtctgcacctgtgtgctcattggtgtctgactttttgtgatcccatgggctgtaaccttcccctctgtctacaggtttatcctttcaagaatactccagtgggttgccatttcctcctccgggggatcttcccatgccaggaatggaacccacgtctcttgaggcttctccattgacaggcagattatgtaccactgagccaccgacaaagctgctggtgtagactgaggcatatttcgatactctgaagttagaatgtataacttggtgaattgtgtataattggtgtgtatatatatatgtgtgtatatatataattgtgtataatgtataattggtgaatctttcaggatgataatactacagatggactttgaatatgtattggtgatttcatacttttaagaaagaatgtaaacattgaggaaagaatttaaagaaattattctaagcaaacatttttaaagtacctatatcattatcataaaagaaaaaacacaatacatatccttgagaaacatattattgtgggctctatctgctctgtactctcagggaattacaatcaaattcatgataatactattgagattgaatattacaaatatttgcaaatgatatctaaatgtatagatatgtagagatcttatacactaattatatacattttatcatttcaaattaagatttctttaaaataataatgaggtaaagtctacttgaaaaaattttacttatatacacaaatgtcattcatagaaaataatagtaaaaaatgttatctatcttatgcaatgccatgttatacagtaaattctgagtttgattcccagatattgaacttaagattctctttcacatttcactggaagagaggccccaaactctttactgtaattacttcttttttggttctgttagaatcagaacataatgattatggataccttcacttctgacaataacatgcaatttagctaaaggaatatgacctttgtatgagggagaatagattttctcacatgttagcagtaacatcttggtatttgaggacatttgcacacattcatgaagaataatgtcttctcagtgaaaagtctatgcatcttagaaaaaattagtatgatagatatactttctaaattgacacatgaaggagtgtttgggaaacttgccttttgcattgaacctttaataaaaaggttcatttgttatttaaatcttaagtttccttcatgctcaatttgatctgagagaaaaggtttaaactaataatgaaattaccttattctaagacaggctttacaataaaacttcctgttt

SEQ ID NO: 37990 - DNA, 1757 bp, Bovine  19866880814846
attgatgttttccatatattccattgggaaatagttttttcataaaagctttagattcctgaatttaataaaaattccagaagagggagatgtttgctctcaaataatttttttttcagtgtgaatgaattgaattttataaaacaaaggaaaagaaaactatatgtcatctttaatatatgagaattatagatggtaaatctctgtggttgttaaaagtgtatcttaactctgtaatatattataggtacttttgctgtatgaggttaagattttgtatcaatttatttgtcttaattatgtttcctaaaacatgttcctatttattcaaacatttttatagtgtcttatcagttcagtctctcagtcatgtccgactctttgcagctgcatggactgcagcatgccaggctgccctgtccatcaccaacgcctggacaaggaagagtttgagagccctccttccttcttattttgtcattatattcttagtcataatcgaagaatagttttacagtgtcaaatatatatccacatctatgtgagaatattcctgaaaagaatatgagaaaagaatgctcaatatagagatgtaaaagttcactccactcatatagttatttcaaagactctcaagtatattcaaatacaacatacttttgaatatattaatcacctagtagtttaatcacctggtcactagctgttacactttaatgtaatactccattactccaacacccataacactggaggacccagcctggctttatcatgatgcctttatgtctcactctgtgtatcccactactttgcaattgtgtttactgcccagaactgacagaacactaggattttccccagaaaccacttatttatcctgaatttatatcttgcgtcttcccctcttgggaacttttctttctcacactgttaattcccatacagtgtgttttatagtgcattttacctgccataatcagagaactgtaatatctttattatactgacaaattttttttccctctactttgtcaattcacggggcctgtatcgctttgtattgtatcttggaatatcacgtagtattcactcaataaatagttaattattttatgagtttgtgctatcctccttacatgtcatatactcctatcttaaagtatccatgcttttgacacactgttatttatgttatgttcatttttcaagtacaagctcacattttcctccatcactgaccacttcaactcattattccaatcatccttgatgattctgtactgtatttttagatgtatctattttaaacattccagtgcttagcatttatacattatcgtctgttgcttggtgactcatattgtccttattattagatttcagctcttcaaatcagtaatacagaattatgcttcttatgaatctctaatggtttccaggtcagaactagatgcaaaatatgtgctcaaaaaatgttgatgggtttattaaaatgatcagagagaatgaagagatgacacatggcaagtcgtattttaaatgattttatacaggggaacaaattttagctgtcttttaaaagtttcaaatattaggagacaaaaatagtgcccttgaacataagtgatagacagctggctgataatgtgatgatgaatcatttgacactcctttcaatttcttcctttctaactcttaatatgggatgtgtgctattaatcagaagcagagtcctgcatagtttgtggggtgga

SEQ ID NO: 37991 - DNA, 1771 bp, Bovine  19866880872355
acttctgaccttattaacatatacatcctttgggttattgtattcctgcttatgattagagagattatgtctaggatgtcctaaatatataatagtacaaaccctcagaaaagtccatcctaaaagacatttgctgttgtttttcagtcactaagttgtgtccgactgtttgatatcccatggactgcagcaccccaggtccccctgtccttcactatcttatggagttcactcaaattcatgtctattggatctgtgatgttatctaaccatctcatcctctgctctctctttctccttttgccttcaatctttgccagcatcactggtaaagaattcacctgcaatgtaggagaccctggtatgattcctgggtcggaaagatccactggagatgggataggctacccacttcagtagtcttgggcttccctgatggctcagctagtaaagaatcctcctacaatgtgggagacctgggtttgaaccctgagttgggaagatacactggacaagggaccagctacccacttcagtattctggtccagaattccatggactgtatggtcatggggttgcaaacaatcagacatgattgagtgacttccactttcactttttttgccagcatcagcgtcttttccaatgagtcagctctttgcaacaagtgggccaagtattggaccttcagcatcagtccttccaatgagtaaccaggtttgatttcctttaggactgactggtttgatctccttgctgtccaagggatactcaagagtcttctccagtactacaattcaaaagcatcaattctttggcacttctttatactctgactctcacacccatacataattactggaaaaatcatagctttgactaaaagatatccctctacttaaaagtacagatgtatcacttcaaacactccagtaagttttagtattactaaatgtcctatctatagctctagatgtatatctcacatatagaatttgaaaccaggaaaatcatttaattcttaaacattgtgaattataaaacacttcccaagattcaaatataaaatgaaatatagctacattaggatgatatgctgttaaaaacaatgattttgtaaaattcatatttacaaattttaataagaaacagtttcagagaaatgtttaataatgtttgagttgtttgtataagaacaaaatctgtaaatatgatacaataaaaagaaagaatattatataagtaaacatgttatatataacatgttttcatttccaggtatgagaattagatcatatttacctcatgggtttgttttttttttgcataaaaatgatagtgtgagtcaacaaatatgaacacacctattattgtaagaatgcccattcttgtatttaaagatctctttagaagtttcaccctgctttgacaatcttcaaaaaatacatattctgagagctgttccagcaatgaggaagcctttcagcatggggctgttatcttggctggcaatactgatagctctgcctgcaataaaaagccactgctgggaaaaaacatgtagtggtccttgaggtttaaatcttactggcaaacagaagcctattttgtgtgaaagcactaggagaaaagattccaggcagtgggtaggaaatggcttaccttaaaatgattgcattttacagagagaacatagaaatctatagtatattgggcttcctctgttgcatgtctagatcaaaactcctaacaatcaacatgacactatat

SEQ ID NO: 37992 - DNA, 1373 bp, Bovine  19866881007316
catcctgctctgcctgatagcctatttgataggttgctctatttcatagcctctgtttgatgacaggattcatctgtgtggtaatcttctctgagattttaaataaagagaacaagctcttattatgtgattttctcccaaataaatctataagttttctccaatggattttgcacaatagggcacagcaaggatacatagatgtcactggttgctttctgtaactgttcagcttatctcttccttttcatgcctacccccttcagaaaatgacttcccccttcctatcctagaactattcttcatctttctttttctaagagttaacatttactctcctacttttactatgaccaaaacagtgaagaaattgtaagaaaaattaaagatatgggaaaagaaaatatcaggaaaacttagccttttttaatataaatttatttatttaacttggaggttaattactttacaatattgtattggttttgccatacatcaacatgaatccgctataaatattatttccactatacaggactcctttatggaaaaagtactttctgagaatacaagtgataacaaaggcatgtggcatagagtctggtaaaaaacaaacacttaaaaatcagatgaaataacagcaatgtataaaaaataagataaacatatagctatacactgtattgtttcatatttttaaaaaattttaaatcctattttattgttttatgtttaaatatttgtttcacaaatcagcttgtatttattctttgattatgtatattctatttttaaaaataaacttgctgttgtttcaatctagataaataatatctcacaacagtgtttagcaatgcagaaataatcctaaaagggcaaatgctgtaactcaaaagttaattacaagtcactcaagctaagtaattctaattaataataataatatgacaagaaatacacttcctttgcaggctaatattaagacacaaacaaaacacgttattctcttttctgatggaagttttattccatgtcaataaaataactgctttataatctgtggggctatttatcaagaagagcacaagatatacttgaagcgtacctcttcttttttaatgatatgatagtagatcatactagccaactttaagcttcacactggatctttcatgcattgcattaaaattgatattttgacaacataaaagcttatctgcattttatagtcacttaataataatatgagaacctgaccaggccaagattttgccttcttcatggagataaatgtcttaataaacctccctttcatcttcatctaagttttacatgtgtgcctggtacttcattgaatgcagagaacagtaaaa

SEQ ID NO: 37993 - DNA, 1791 bp, Bovine  19866881092568
aacaactttatcaaccacaacaaaagtgcagtgagtgtttttttaaaaaggcaatttgagtcctttaatgatcttttcagttaatattaatgttaaatattgaaaaaccatgtcacagaaagagtttagataaaatggcttgtccatgacctctgcccatctctcaggtaaaaattcaacagtaaaaatgaattgtccttggaatgttagtcttgtctccttagtaaaagtcttagtaaagactagtaaaagtcttaaaactaggtcaaataaataaatatgataaatttaaatttgcaatttaaacattatcttagaaaaatagcaagttaaatattattttagataatttgatctattaagagcatccctatttcaaaagacccctaaaaactagcagcttcttggtttgttaaagagacatcaaggaacagaggatcaggtgctttatttaatcacatggaaacataaaattgcagactgctaatggagacagattcagtcaaatgtaaaagcagaaatttaaacttcaggttatttttcattttacttaatatttattttatttttaacaagttgtatgtactttagttatatagaatgatgctttgattacttatactttgtgaaaaggttactacagttaaactaattaacatatccatctcctcacatagttatgttttttgatgggatggtgatagaaactaagatttactttcttagcaaatctaatgggatcgttggatggcattatcaactcaatggacatgagtttgagcaagctctgagagatagtgaaggacagggaagtctggcatgtggcagtccatgggatcacaaaaagttggacatgagttagtaactaacagaagcaacatattaagtcaccatgctgtactttatatctctagatttattcatcctacataactgaaacttcgtactgtttgatgaatctctcctcatatcccccaccttctcattgttgatacccagctataggatgctattatgatttttaattttttatattccacatataaatgagatcatgtggcatttttttctgtgtctggcttatttcacttagcataaactcctccagattcatccaagttgaatccagtgctatgttggtggaaatgtaaattggtataggcattataaaaactagtgtggcggtctcttaaaaaaaaaaaaacaaaacaacaaactattgtatatcttcatagtatacaaaatactgtatatcttcagagtatatccaagggaaacaaagctagtactctaaggtgatatctgcatttccatgtttatcacaacattattcagaatagccaagatatggaaacaacctgagtatgtgtcagtggatgaacagataaagctattcttttcctgggattatagccagatagtttgagacagaaatttgcttgttcttttgacactgttgcgttttgctgtatcaaatatgtcgctacatagactactaattctacttttagcaaagttatcatttttcaaagaccagatgtcctcaattacacactacaacaaactacatacaccttaatttgtggtctggcctctctccagttgttattccctcatttttcctttctgacatttgaagtcttctcaatctaatcaactaactgtaattccagagcccatgcacaaagcatgatgacagtgctaacccaacacccttcacttgtttactccataaaactgagattccatgagtaaaaggctttcatgagaagtttttcatttccaatgact

SEQ ID NO: 37994 - DNA, 910 bp, Bovine  19866881128855
tgcattcatccatccatccttgtcgccatccattcatttatctgcgtgtctacaaacctacacatacattcacttacccccaactcacctatacatttgaccatataccttcccactaatcttatcttttaatgcatctaactatatacccagttggagagctgcagaccatggggtagcgaagagtcggacacgactgagcgacttcactttcacttttccctttcatgcattggagaaggacatggcaacccactccagtgttcttgcctggaaaatcccagggacgggggagcctggtgggctgccgtctatggggtcgcacagagtcagacacgactgaagcgatttagcagcagcagcaggcatatacccagtttattcatttttaaaatacaaaaatgatagctaatttatagtgttgtggtaaataattaagatgggaaatgcatagtaatgtacataaaacattaaaggttaccaaataaatattagctattgttaatgttatcaaaatatttttcaatttttacaagaaatgtatcactctcaccctttattcttatctacaaaacccatattaaatcattttaacacacaaatagtttagttttttcatttctaaataattctcagacctatatttcaaatttttatatttgcttaaagtataaaactgttatgatatatgaagcaaaataaaattagaaggctagtgtgaaaactcacatacttgaaattcagatactggacaactgtatatatgcttaaaatggccaagagtataaaatagtggcagaaaaacttgactgtaacaagttacacagaaatactgtgaaaggatacccttgctcagtgatctgctgtgtgcatgtgagatttatttgaagtagagccttcaaggtaatat

SEQ ID NO: 37995 - DNA, 1167 bp, Bovine  19866881136090
aaattaatttgaacataatccaccaattttaatatcattttcactcaaaactaccttagcctaatccttagatttaatttgaataacattaatttttaacaaaaaatttttgttttattatatttgttcggattcttgaagtgttattatactcgtatgaagttgatgtagtttcgatctcttattctaacatcttttctcaatcttaatctggcatgtatttatcagtagaactttcaaacctttaattagattttgtttacatgccattcttaggaatgttactgaatttccaattttagcctaaacttttacatgataaacctgtctgataacatgagaggtatttgtaaaactttcacgccatatatatttttatactttgataaaataatatatgtcatcttgtttaaaactattttatttcattttcattcagataataaaatatgtttcagggttttagcatatttaaaataaatttattcagaaaatgtatcaagtgacttttcttgccctctataagaagatagataaagcactgttcaaaaataatggaaatatatattaaaaaatcatccaatattgaacacttgaccatagttatgaattcagttgttacagtggatagagtcaatatcagtgggcagagattatcaagaaactgaatcattattagatatcaattataaattaagctcactggtcagagaatgtgtaaaatccagggctataagattccagaaattctaaaatggaaagaataatatcatacttaatatacttataaataatctttcttccaagaaatagatatatcaaagtaaatactactaggatttaatctcaaataatgtattttataatgattcaaatgtttacttgtaggtctgaactttagagtactattcctaattactttcttcattttatacattcatgaaattcatattcagaaactgttattaaagtaccagatacacatacagtctgagattcaaatctatacaaatacctaaggattatttaatgtcatatgagttcagagcagtaaaataaattttttcaataattatgacttattaactcaaaacatacctgtttagaagtcccattaaatagtcttttcaaaaattgttcaatgaaggaatgtaagttaaatgtgga

SEQ ID NO: 37996 - DNA, 900 bp, Bovine  19866882010194
catttttatttcattcaatagttgataatcaattcttcaaacatgattttcatgccacattaatcaacatttattttcattttaataacagaaaaatcatccaaccttaataaaaataaaaaagaaaggtaatttctagagtaacaattataagaacaattgccatttcagtgatgcagggctcagaaggaatctttaatgcacctaaaccttaagtaccagaaactgtgcttctcaggttaagtatcaacacagagaatctgatttccaaacatggatcaaatatccctctgcttttaacatctgggaaactaggaaacagagaggaaacacagatgctaggcaagcacttctttactttgatcaacatcctcattcagagaaaggctgagtatatattccaataatgtctgttgtataaatagtcatgtaatatagggcaaactgagaataagtgaaatagcaaatatggatatgatcaaaagtattctataaaaatgtaacaaatagttattctgaaataagagtttcaattgttatctctattggagaaggaaaaggcaacccactacagttttcttgcctggagaatcccagggatggtgaagcctggtgggctgccatctatggggtcacacagagtcagacacgactgaagtaacttagcagcagcagcaactattgcaggaagacaagattgttttaaaagtaatcttgtagtaaaagaaatatgtctacaggctgtattcataaaaccagtacaggtgattaaaggactgagtatctatgatcttaggatgccctcatgctgccactgaaccaactgcaatgtctacatttctatttcaaaatagaagattaaaaaaaacacacacacacacacacacacacagtgggcca

SEQ ID NO: 37997 - DNA, 1930 bp, Bovine  19866880138062
tccctccccataccctctctctgggtcatcccagtgcaccagccccaagcatccagtatcgtgcatcgaacctggactggtgactcgtttcatatatgatattatccatgtttcaatgccattctcccaaatcattcccaccctctccctctcccacagaggccaaaagactgttctacacatcaagtgtctcttttgctgtctcatatacatggttattgttaccatctttctaaattccatatatatgtgttagtatactgtattggtgtttttctttctggcttacttcactttgtataataggctccagtttcatccacctcattagaactgattcaaatgaattctttttaatggctgagtagtactccattgtgtatatgtaccacagctttcttatccattcatctgctgatggacgtctaggttgcttccatgtcctgtctattataaacagtgctgcgatgaacattggggtacacgttttaattacatttactttattcaagcatgaatcttttgtctccttcacacaaaatctataaagcattgaaaacatttcaatcttaaaactgtggattggaaaactcaaagtagatcaatattaacaatttatacatgaaaaatgggatttttaaacaaaaaccatttctgtgaaattttatctcttcattctatacattttgtaatttggtcttatcaagtaataatcttgtgcctaatattttaagtactgaaaaacaaagggagacacaggagaattagttttgagccacaacttagtgttggactatcaaagcatatgaggttagtgcagagaataatttttaattgcaattggagaattgcatttcccatctgtttgtcagttgtcttatctatgcatggaatgcttttgtctcttagctgcaaaagtcttattaagtcattaaatttcatgattctgtcaaatgtaaggcatattttctgtttaaattatgccttggaaataaagccagttcttcacaaatgcataaaaatattttgccagcacctcttcccatgaacacaggtatcttcaagttgtaaattatttttaggctgaaagtctgaagaaacattggcacagggcacatacatgagattccttataaagtttgatatgaaatataattatggtggataaaatacttttaaaatcatcataaactgaataatactctaaaaaacaaacttgtttaacagagaagcatggccttatctttgaaaacagtattttaagtacaatagtttataaagtcaagaaatgataagtatgtactatgtgcttagctccatagatacaatataggacaatactggcagctcttgttaaaattcatggttctgtatgatttaagatcactttaaggaaaagactggttaaaaagacttaacagtaatgaagtaacctaatgtcagacattaagtttaaggataatcactgtatttagtttggagatcatgtcttactaggttaaatctctactcacttatttcaagactattaaattaaaaagtgaaaaagaaaaaaaaaaaaaccttcttgattctagtaattagtctatgtaaaaactttcattccatacatattgtcagttagatagctatcagtatatactgataaactaaaagtcatttcaaaaaatgctagaatgaattaaaatgatttatgatgaaagtgagatggaacagatgaatttacccaaaaatattgtgtgactcagttttgaataatcatatatttctgtcaatttacaaaaattatcattgaaatattaataagatggttgaaatctttttggaaataacattgtgatcgtctcaaagtagaaattatttgaagatctggaactatttactatgaaggaaagcaactttaaaatacaacattgagtctataatattc

SEQ ID NO: 37998 - DNA, 2476 bp, Bovine  19866880565549
aaaattttaaaatgttcaatttaagtcaataaatagtaaggacatagagtaagcaaatatgataagtatagattatgttatgtcatcttcattcactaagttgtgtctgacgctttttgaccccatggactgtagccccccaggctcctctgtccatgaaattctccaggcaaaaatgctggagtgggttgccatttccttttccaggggatcttcccaacccaaggatcgaactcacatttccttcactggcaagcagattctttaccactgagctacctgagcttcccaagtataggtcaaacatactaccaatggcctctataaataaataacatataaagtaattaaatctgtctctcacaatacgttagcctgtattgtgaagttaaataagatcttgccttgagaagttaaggcctaaaagtggtggtgatggtacaggggacacatatgaagggagtgggaaataattgtctttactgcaataagatatgactttaagataaagtagcattttgcctaatagatttgcagaacttgtttttacttgaatccaatccaaattttattgcaaatttcatttatatttaattggaaagtttccttccatcacagggacattttttttttccctctacattcctgcacccttcccatgcaacttcagaatatagattatacttaggctatttatgaatagttaaatttaatcaacaaggtaaacactcacggagcaattattgcaattagccactttgatgttaatcatttctatttgtgtttttcagccttcacttcttatgtctttaacagaagtcactttactgtccttatgagatgccaactttttgagtcatgaacatcggttaaaaataaaaggggatcaccttgagctccaaaaatgcaaatcaactggaaaaacaccagctggccttaatcattcaacattgcagtttagtctgcatcatgtcagcaggctggcaggtattctgtatatagaaacagaacttagcaaatgtagctgctgttactttcttgtcaaaagtggatttctcccttccctagctgtatccaaacacacacacacacatacacatacacacacccattacacacaaatatacatttggagaatactagtatgttagtgaaagttactaactagactaagggcattagattagaagatctactcttcaattttgtactaaaatagcttaaaaggccaaatgtgctttgctgtattttcaataaattatcagtagcaataaaattttaaaagacaaataaaaatcattaattacatactctttccttaagagaaatgagtgccagatgatggtcatgatatttaacctgaggttatgctccagtttaaaaatattcagctgcaaatcactctggtaaaatctcagtatgttctgattctctccctatccattttttgtgtccttatttttaaagcatataataaatcactgtctccttttctatgttactctgtccccaaaaagataaaacaagataatatatgcaaccccaaacaaccatatcttataataagtaaaggttaaaaccatttatacagtgactcatatagacatcaagtgctgcaaatatatcaggcgtatgatgctatcatttgggaaattgacccactgtaattttccccatgaaatgggacaccatatgaaactaaacatggcagaagcataaaacatatcctgtcatccatgagtaactacctctatcttttatttatccagttatctctcttttctttgtttattccctatattaagtcaccacatgtcatcacctggataatcagattgctgcacagtttcttcttttcacccctaatcttcagttgccccctttgattctgtaataacttgcatgaatattttgactgttgatctctcaaacatttctctataaaagaatagaaatagatgctttttggcattggaaatctctaaatatatgaattggaacaactctgagatgacatcaagatattaattcatatatttaaaccctcactgtagccaggtactgtttctaagtacagtggaaactattggaaatccagaccaattagtatgaagtttattagttttgaagcaccaagtacaattaatggagttactcaatatcaaagagcaaaatatgatcacatgcccttacaagcaaggaaaagatatacgttaaatatctgagtcatttcctgtatatcttatagttgttaatatttctggtgtaactttatattcaaaacagggaaatatcaaagatactgttagtaagtttcacttgattatcacacatcacatgaagtagactacataataacttgccaaagtgtgaaaattggatgtccctagttatttttcttactatatttaaatacatgcaatgtcactttactttgtgtattaagtttaattgtaatatataccaaaaaggaaaa

SEQ ID NO: 37999 - DNA, 1056 bp, Bovine  19866880594629
gagataaagagtttctgtgtaataaaaattatgtggaagttatgagggattaaaaagtctctgacttagcaagtataactgaaaaaattaaagtctcagtcaaattacaaatattaaaaaaataaataaataaaactaaatctactaagggaagctataaggtcccagatcttgatcaaaattcatggatttcataactcatgttctttaaagctgactgttctgaggtggttatcttttccttgttgcttttatagtatcacagcaaagcaaagaaggtatcatgacaaatatttttataaacttattcaaaataatcagtcatatattaaattgcattgtaaatgacttaagatgagctgtgtttaatgaaagttcatatttataaaaattaattttgaactttagtatattgatacatgtacatttaataaattctacataagaatgcattaagcacagaaatgtaggtgattttttccaaatacataacttcttatttattaaagaaaagaacaaaagctcttaaatctttttatacattttatatataattcacacttttagcagtatttgcatagtgattattataatactaatatcttaaaagggatcttttttccaaagcccacttttaaatgttgcaccaaaacttcatatgctgtgataatgctggtttaatatattcctcacctgaattggaggcactcactcattactcccatcacatactctgacatctcttgtctaagaattgcatcttttctgatattcagtatttgacaggataataagagttaaccaaacattttcccatttagctgttgccaaaactcacccctgtctcatttttatgtttgctgtagaaatgaaaggatgaccaatttgctaataaatgagtgctttcccatcaggcacattacaatgtacaactatattgggatcattttttaaaaagaaaaagacttttttttcccccataggacaatgcagtcacagtttatgagctaaaaataagttctaattcagacagagcttttcaagcctttatctgtt

SEQ ID NO: 38000 - DNA, 1169 bp, Bovine  19866880705022
gtgatactgatgattatacaggcaaactacatactcagtaaataatcctgaaaggtataaaatgtgattacattttttgttttattgttaaaggaaaattattgttggaataaaaattatgaaatacctattatttatacgtaaagcaacatttcccatattgtccaaatattgtcttacagataaatcttttctagcttggtgaaaataaatgaaacattaattattgtgtctctgatgcctgaaacaatttagctactttatcaatatgccttttgggcaaatcaccccagtgattctgtgattatcataaatgctgcacacaggcaatttttgcctgaaattgaagattacattattaattccacatagattcttcatcctaaaaatcaacctacccatgttttctcatctcaaaccaagtattcaaaattaatcaactctctgaagcatcatgtttagtgacaggacagtaatgtgtctgccataaccaatcagctgaaacatcattataaggcaggtatttcaaagataagactttaaaaattaatgagcaaagggagtaaaacatgtacatttcaacctttcttttctttgaaggatctaaagaggacagatatgaaaactcagtcttcttcaaaggtagttatttaaatttcaaataaactgttttacattgctaaattctagataaaattaagtatcatgtatcaatgtccttaacagcaataaatattccttctacaatctatttttattctttgtaaatctattttttacattaactccctctaatcctctacatactattttttcacattcaatacactcttcatcctatcaacatccccaaattttcttcatcctatcaacatccccaaattttcttcatcctgtcaacatcctcaaatttgttagctttcaaagactttatatcattagaagcatatgaacatatgctggtagagctaccaaaagcatattttaattattctaacctgttagactgttttctttttattattaacctagttgtatattggtatttgaagttcactttttgtaagctgcatccatttgcagagtacttgtttatccaatctaataagctctacattttggctttcatctttagaccatttacatttagcttaatatggctaggtata

SEQ ID NO: 38001 - DNA, 1455 bp, Bovine  19866880798763
tgataatagttaacctagtgggtacaaaacggtatctcattatggctttgatttgcatttccctgataatggtaacaataagcatcttttatatgtttgctacccatttttatatcaaatgcaaagatattactgtgcacagattttctttcctggattttttctctacttgtaaaaggcatataagatcccttgacattaattgagttataaatttctcagaggcatttctgtcaaagctggtaataatttcacaggtacataattatattaagctctctttcaatctagtgtctaccagggacttgttctatttgtgaaaataaaaataaaaaggtgatgactcaagtaatttctatttcctgttattgaacaattgcgccttaatcttaccctcagctagtggaaaaatctatctacttaattttattagtaaatgattttgtggtatctgatcacatctaatacatctaataagaagatgatagatagcatttacatttccaggaaatatcaagtgtggataccaaccaagtattaattcagataatgtgagaaagaatttataatagtgctctggaagcagctaaaccaacaagcacagttttttactgattatgtcagcaacatgaaaagcaatattgttaaatattcagtagttaaaagaagtgatttctctagcattcttcttcaaaataaaatccaaagctcttaaaagctgaactagtcatataacagcaatggtttcccttatagcatttagatgaatggtggaaagacacatataaaagtcatcttaagagtttgaagcccaagcctttctcattattcttacaaattaaaattgtgtgagatttctactgtttaaaattgtattttaaagagcaaactgtgacatgggttgcttatttttgttgtttccaacatcagctgaatgaagaaaatagaaaaatatcaatatatagcaactccctgtggatcagctcctatagatccaaacaaagggagtcaacagagtacagcactgggaattcactattatccctgtgcttaattccaggcggacaggtccatcacggatacctgcttcagcctgactagtagatgcatgtcagagcaagagagaagcagcctcctctctgctccttggaacaatagacccagggagaagctcctctcaccttcatcgcaccatccagggaagctggaaaaaattcttaatcagctgaaatagcaccttgtacagcacaagaggtagaggcccagaagtcaatgtaccgccaaataaagcattcctggccataattgtacagccccatttttctaaagagtctataataaatgattctactgcttttccctgtatatctcagtcaccataaaattcatcatttatcattttgctcattatatgtcatctgaactaaacctcaccgttttccataaatttatttg

SEQ ID NO: 38002 - DNA, 1484 bp, Bovine  19866880811654
cccttagttgtctgggaaaattaaatgatgcttaacttacaccatgtaacattcatatcatatatttactcatgggtgcgtgtgcgtgctaaggcacgtcagtaatgtctgactctttgtgacactatgcgctgcagcccgccaggctcctctgtccttgggattctccaggcaagaaaactggagtgggttgccatgccctcctccaggggatcttcctgactcagggatcgaacttgcatctcttacgtctttttcattggcaggtgggttctttgccactagcgccacctgggaagcccatatttatacatacattcaatatctaacaaatgtgaagctcacactaattattagacaggttaagtgtggggatgttttagatgcaattcatttcaagggaagagctcttgaaaaatgatacaatttttttaggttaaaaatggatcactgatgtgaaagttttcagtaaaaatgcaaagtatttaagtaacaaaatatttctgtataataaaacagctttcaaaagcacaataaagagatatataatttaatgaaatataaattcatcttcctactagatagcactaagacaacatatttttttctagaaaaagtacaaatatgaaattttaataaactgattaaattcaattgtattatgattcactttcatgtactaactagtcaagataaaccatcttaatgatcagaaatcatgttaaatagagcataagtaataaatttcctatttagccttctctaccattggcattttatcagactagattgctagcactcagttcagttcagttcagtcactcagtcgactctttgtgaccccatgaactgcaacacgtcaggcctccctgtccattaccaactcccggagtccacccaaactcatgtccactgagtcggtgatgccatccagccaccttatcctagttgtccccttctcctcctgccctcaatctttcccaacatcagggtcttttcaaatgagtcagctcttcacatcaggtggccaaaatattggagtttcagtttcaacataagtccttctaatgaacacccaggactgatctcctttaggatggactggttggatctccttgcagtccaaaggaatctcaagagtcttctccaaaaccacaactcaaaagcatcaattcttcagtgctcagcctttctttatagtccaactctaacatccatacttgactactagaaaaaccataaccttaactagacagacctttgttggaaaagtaatgtctttggtttttaatatgctgtctagcttggtcataactttccttccaaggagcaagtgtcttttaattttatgctgcaatcaccatctgcagtgattttggagcccccccaaaaataaagtctgacactgtttgcacaatttccccatctatttcccatgaagtgatgggacggatgccagatcttcattttttgcatgtgagctt

SEQ ID NO: 38003 - DNA, 843 bp, Bovine  19866880815070
ctttattatttaaatttggcatcactgggcaaagctatactttaaagttgtaagctttattatgctggtatatcaggcaaatgagtgtttgatggggtgtgctaatgtgagctaaaaataaaatcccatctgttcatgtttcaaaccacactgcatcaataccctgcatattgggtactacactaatttaatgaaacacaaataaaaatttgcttactttttaactctttctataacagtaaaatcctgctagttttaagaggaaacaattcatgtatgagtttctggaaggcaacatatttgcgtatttgtcaagataagatgaacataaataaaagtaaacaatccaatgtctgttttaaatccaagaaaaataaaatacttaagaatgtataccataaaagttgaatcatttcatcaagtgcttgaataacataatatgttttaagtaagtatatactcaaatatttttcacatatagaatgatttgtcaactggaaaatgcatatcctttgtgaattgttatgcttcctggctaagtaaacactatttcttcttttatttcactttcgcaatcagtcttcatatcctcttaggcatcaaacccgttcctaaaaattttctatgccgtaagtgttctggttggattctactgagtaaactacctgatgataaacagaaaaaattattcttacaaatccattgtgttgtttgctatatttccacaatgtacatttgctaaaagaatttttaaattaacaatatttaatatttgttatgggatattttattttcttatgatcaggagacacatttaaagtgaaatatatcagatcagatcag

SEQ ID NO: 38004 - DNA, 1282 bp, Bovine  19866880986078
atttcagtaccattcagactgtctttcaatgataggctcagctcacaactttatgagtcagttgggaccaatgttgtttagctctaaatctctggccagggccatcatgatgcagccatacatgagcagtaggctgccttatgcttataaactgatgatatatattttcaagtcctgagatactgccttcactattgcctaaacttcgattctctaatgataaaaacagtaactgtccacagggcaaattcttggaagtcttccgtcttcgtccatttcttccattcctttcctctggtcatgactctggtcctgtttctccttttactactccaacctcatcagaacacctgaaactcttgtttccatctgggggctcccatttccatttctcatataacctgctcagttaggttttcatggataatattggcaatctgaattgtgttcttcttgagcatattttgctcattaatctagatgaaattcaataccttcctcactgagtctgattcaggagttccatgtggcaaagtattgactctctgcacattgtgctgtgctgtacttagttgctcagtcatgtctgattctttgtaacctcatggactttagcccaccaggctcctctgtccatggggatgctccaggcaagaatactggagtgggttgccatttccttctccaggggattttcccaacccagggattgaacccaagtctcccacattgcaggcagttgcttaaagacatcaaaccatctttatataattaaaaaagaattaatgacatttaccacgaatattcagttggtgagccagccttatcctataagtgaaaaatgcattttgttgaacataacaattgcctaaatttaccatggcatttcctgctcagctttcaaataaattatacaaagtatgttttttcttcttttcataaatgttgactgattaagctaaattttttttcttagaattctcttttagatactgaaaatagggagagcttaaaatgaaaatgtcactaaataagtgattgaatttgacaacacatatatttgtcaatggaatgaaagtataggaaatactttggaaaagtaaaaacattaggtgaaatcacctcactaaatgaagaccaaagtcattttagaaagtatacaaaaattgttgaaataatgtatgatagattttttttctttttacaaatctaacattaacagtgaaaacatactcttacattggagaagataatgagtaggagtaacattttctgaaatcag

SEQ ID NO: 38005 - DNA, 1612 bp, Bovine  19866881001383
tgttgcccttaacctgttactgaaaccctggtcccttcttcctaaaagaacttttaaatattgattgctttgccactttccattagatagagcatatggattataaattgtccttgttagttatcacttacagttcctgtgcaatcctaatatcgttctcattccaactacctccattaaactcacttctcatcatgattgtctatgaattcctctgttgtaatgagactagacacccggctagaattcagggcagtagttttggttgatagatgtaaaatcagagagaacaaaggatgaggtaaaaattcatgtagcaaagaatgttgatggatgaactgggttacatttaatacaaaaaagaagagattactgaattccaagtattgaactggtaaagggaaaacatttatttcacttacaatttcttctcagtatttctactttaggtttgaatatttaatgtcttctatttcctcttttatcaggaaatcactaatttagaacttgacagaagctatctctgttacttgctactctggctgtgtaaaattgacttttcaagagtgtaatccacttctgaagtaccccatgatattaaagtatctattcagttaatattaattaagtataccttgaaattttgctagaaaaaggattgcttcatagaaatgctgaactcagttcatttaaaaaaaattaattgtcctattaatggtttggggttattctcttgtggaagtgaataaaattagaactgaattatttattaaacaagaatgattcatagagctttaaggacacataattttaagagattccatttttcacagtctttgaaagatataccattctggttctacatttaagatctgcaattttgacactaaaagcacagaaaactttattaatctcaaaaatagacattggtatatagtattaataatattccatcaggccaaagtaatgtgtatatcatgaaagcatttaaaaaatttgtacacagaattaagaagaggtactttatttataaatgtctcatgaaagatacagtgactatttgaatataattttagttacatatttgcagccactttatacatagttttctaatgccactaaactgaaacagcatatggattatatttttagggcaacctaaaaattttaagtaaaaaaaaaaaaatcacaaatctgagtggaaagaataaataacattttctagcaatacagaaggtgttactctgttttaataatcatagtatggaatgtgatgagacaaaaaaaattcagaggaaaatgagaaaattctacatagggagtgtaaatttcaagaaataattcttattcacttacatgatgtcaaattttatactttgagatttatattttccacatgaaagtaaactttttatagtagcctagataattttaattttaaaatctcattacttcagtcctgtacacatattttttatttaatggtttggatatccaatttaaaatcccaacttcattaatatgtgtaaacacaggaagcaaaaatcagtaagtttattcagtgttagtggatgattttagaataaacatctgtttgagagaaagtgcaacc

SEQ ID NO: 38006 - DNA, 1030 bp, Bovine  19866881081748
ttttcccagctttcctgatgcccaatatgtttcaacacctaatatatacctgcagcatgaactgtataattgttgattcttaaaacttagcctagaatattttgagcccctaatttttctttctttatagctctcactccaggcttattttagtacaaagcatagagctggtattcagtaatacaaagtctgaagccagaatgtctgttataaaatcctagctctgacaatagctgtgtaactttcgttaagtctcctaaactctcttagtctctttccatgtatagaaaattgtgataataatagtatgagttcaaataagtaaaggacttagtgtagcgtttggtacattgcacataccacataaaatttacaattattattactattaccaaatagctattcctattaggatgaagaccagatacatatgcagaaatgtggaaccactgtagtcagaataaggaccttgaggttgggtaaaatgaagtatttccttataataaataaaataaagtcaaacaaaaatgtaggttaatttatgaaaaccagatatatgatgcacaattaaatgtaatttttaattgtcaaaaattatgttcatcttcactaccaccgacagaaaaaatacatggtatattaggctgaatcgttcactagtatgacttaacatatcttctgtttcattgtgtcatggctttggtgtagctgctttgacactttggatttagatcattgcaagaacatttagagggtataatgtcacctaatgaatcattaatactgctataacagcatgcttttccattatactttcttcctgaatggtaacctgacttgaccttaaagggttctgggaaataatagaatcatagctcatctggttgtacatatgataatagggacagatgtacatagatcattctttctatttcatcggcagtggaatggatccatttgatgatacccatcaagatgagtagatgtatgctatattcaatcactcttggggctccacacagctttcttc

SEQ ID NO: 38007 - DNA, 1275 bp, Bovine  19866881105076
aaatgactatcatcaaaaagtctccaaataataaatattagaaagtatgtggagaaaaaagaaccctcctacactgttggaaaaacagtatgaaggtgccttaaaaaactcaaaatagaactaccatatgatcctgcaatcccaatatatccaaagaaaaccataattcaaaaagataaatgcaccccaatcttctttgcagcacatttacaatagccaggacatggaagtaaactaaatgtccattggcagaggaatggatgaagaagatgtgttacatatatcaacagaatgactcagccatagtaaagaaagaaataatgccatttgaagcaatatagatgggcctacagattataatattgagtgaagacagtcagacagtgtaagacaaatatcatatcactcatatatggaacctaatttttaaaatgatacaaatgaacttatttacaaaacaaaatcagactcacagactgtgtcaacaaacttatggttgctaaaagagaaagacggagttggggagggataaattaagagtttgggattaacctagaaatactactatatatgaaatagaatatcaatgaggatctattgtatagcacagggaactctactcaatattctgtaataaccctatgggcatagaatctaaacaagaatggatatatgtatatttatagctgaatcactttgctgtatacctgaaactaaaacaacattgtaaatcaactatcctccaatataagacaaaaattaaattaaaaactcaagtaaatccttaagtctccaccagatggtaaagaatccaccttctaagcaggagacaggagatataggtttgatccctaggttgggaagattcccctggaggaggaaatgataacccattccagtattcttgtatggataatcccatggacagaagatcccagtgagctatagtgcatgaggttgcaagagttggacatgcatattcttaagtaccagagagaacatttactattgggctaatgaaaaatcatcacttgcctttgacattttagtctgtacaaaattgaagacattaatttgtcacaacattaatttgaactggattttttaaggactagaccaaactagccttttataaagaaactaggtaaacaattttacctatgaaaaatcaatatgataaggcttcaatcagttcagttgctcagacgtgtctgactctttgcgaccccatggactgcagcatgccaggcctccctgtccatcacaaactcccag

SEQ ID NO: 38008 - DNA, 1575 bp, Bovine  19866881231967
ttcgatgcacgatactggattcttggggctggtgcactgggacgacccagagggagggtacggggagggaggagggaggagcgttcaggatggggaacacaggtatacctgtggtggattcattttgatatttggcaaaactaatacaatattgtaaagtttaaaaataaaataaaataaaaaataataaaataataataaaaaaaaggaagtacaatatgttacattaaggctgattgcctttctaaaatctccctctattttttacaaattcttctctttttcctatttcttaccattcttctgtatttgtctgggactgttttgaaatattttatccttagcaaattatcgctttatactaaatactaggaaacaattactcacccaacaatgctgatgaacagcgaagttacaacccttgctcttctgtggtatttactatattctgtttgtttcaacaggcttgagcgcatttctgattgcatgtcttgctctcagtccaagatgatcatattccaaagttaaactaatgtatttcctgcccaactgattttattctctagttatccctacatagttaattttgcacacttcttctttcttgattattaaaaattagagaccttggcatcattttatttctttcctttcattattttcaggtaataatcttagagaaaattgaaataatgtttttcctttgagcatccttggaattgtaccttatttgtctattttctctttgccctcttagttctcatttttataactgcatccagtggtttttctacaagctctctgatagaattttcttagaccaatttatctgaaaccactagtaagatactttttttttctaaacaagctttaacttatcactttctgtatgaagatgtatgagttttcttgtctgagtctgaaaatgttatttatttattatttggtatttattcaattttggtatttattattggtatttattcacttttattctatactgtaccaaaactgccctaattggaaagattactcagcaaaacaacactgtttctggatatatacattcttcattttcacagattatttacattcttaagactaagtattttcttactttaatgggaactttattttctatgtttcagattaatatctaaattccttatgtactacctcttgcagtcactgttctgttgcatatttgtaaccctcattgcagttataatcagcaccaaattgtattactttgttgtttctagttttacaatatttcatcagattgttgactatatcaaaatagagtaacataatttgtttttggttcccctatagcatgaattgtatagagagactcttgatgttttagcagattaataatctatttatttagaactcatttatatacaccagctattcacaacctatagtggcatcttggaaaattgaatctagaggacagtcactggttatctcaagcagaaaatatatctttgatagtttacaagtgacattcttgtttatataatacactgtcagaggaaaaattgtggggactgtggaaagatcaaaatg

SEQ ID NO: 38009 - DNA, 702 bp, Bovine  19866881233642
atatgtcatattgcatggaactaccttcctgaagatgttttaaaatattttttcagagttgacataagatagcagatggataatctgcttgaaggcagctgaggtcatatatcattaagcatcagggaaattccatatgtaaccaaacatctgcatttgcaaaatggagctgaaagctttccccccccaaaaaaaaagactccaagcccaatttcttgccaatttaacatctggaaaatgtagaaaaggtaatcatgaaaaccgagtcagtgaatttttgagctgaaaggatcctaagagatcaggctttttaactaaataattttgcagatgaaaaaacagagccaaaaaaaaaaattaaacactttgcgtaagttcatgtaactagttactgacaaaagtgaagctgagattcatcttttgccagtgctttattatcatgctgccatccttagtttatccaacttactaaatactgtggacattatatagtttggacattagggctgtattctaaatgtaataccaaagttcccaatcattttaaacaaagtttctgtaattatattggaaaaacgacagtcaaaattatctttcatacatggccagagaatgctttctcctgaaggaaataatattaaattaggataacaagatctttataaaacaaaagtttccatttgcagaattaaatatttagag

SEQ ID NO: 38010 - DNA, 1605 bp, Bovine  19866881380328
atagtttagaaaaatgaatgggttatagcattaaatgggcttccctggtagctcagctggtaaataaccctcctgcaatgcaggagacaccagtttgattcctgggtcaggaagatctgctggagaacggataggctacccaatccagcattcttgtgcttgtctggtggcttagatggtaaagaatcagcctgcaacgtgggagatctgagttcgatcgctggattgggaagatcccctggagaagggaacagctacccatccagtattctggcctggaaaattccatggatgatatagtccatggggtcacaaagagtcagacatttctgagtgacttgcactttcactctcacagtattatataaaagggaataaagccagtacagtcttcccaggtggcacactggtaaagaatctgcctgccagtgcaggagatgcaagagatgcaggtttatcccctgggtcccgggatgatccccttggagtagaaaatggcaaccctctccagtattcttgcctggaatatttcatggacagaggagcctgttggtctacagtccatggggttgcaaaagtgtcagacacaacttagtgagtaaagaataacaactaagaaatcacaacatgagtactgtactcttataagctagtatggaagttttcaatgtatatatatttcttgcagaaaatttcttttgtgacaatttgaattacccaagcaaatatcactactaacttttattttttattagatgtataatatgatacttttccttatcctaagaataagacatattttctcacataattcatctaacaacatgctttaagaaaaagtataactgcttaaaaatgtttttccctgaaggaccagcaccatatgttcataaacaattaaacctgaaaatattttctattttttttctcagtggtttatttgttgatttttttgaagcctaaaatagattgcaattactaaaagaaaatggttttgaaaaataccaatagaagttgtctggcatattggcttttgcttcatcatgagcaagtaccagattaatagtggaaaatacattaaatccttcagatatatttgggaattgacactatgatcccagaaatggtagtaaagggttttaaagagatgcctaatgttttctctgtaattaaaattttgattgtaggtttatatgtcacattgatttcttatggatcaactctttctggaagacatttttattatgataacaaaccaacacattttttatagttcaactcttttagaaaatattagatttcttttaaagcaatcattcaacaaatcacaaagttttcccacccatttactatacttaatgccttgaaatttttcttttctctctgacctttataagaacacaaatttaaagcattaaatagtgaatgtcagagtgctttcctggaggcataaagagctcactcatagtgtggttattacacaactcacatacctttatataatttctgctctaggaaataaaaggttaaacacactttttataatccaaagccaaacagtgaaaaatggaagggctgtttttcaacctctttttattatctgta

SEQ ID NO: 38011 - DNA, 967 bp, Bovine  19866881781468
cacaaagagttcgacgtgatggagtgaataaacccagcacagcaagaaattaatattttaaaatgaatagtcttcttctatgaaaaattaagtcactttagttatcttgctaataaacatttgaaagcaaaagaatattatatatatatatatgagagatatggattgttttaccagaaatgaaaatgtagaagtcatgcataatttagtaaatatgagagtactacagtaatcacagtgatgcctttcatcatcaattttaaaacaaatatgcaagaggtatcttatattaatgtgtttttattatttacaggattttagatgatctggtgtacaaaattctttgctgaatcaggagtgtctctgtagtagcttctcacaattaaactacaaacagataatagttttgaaaccaaatatatgaagaaaaaagtataaacttctcattattattttaaataaaagccaaacacaaggtacttgtgatagacttttaagaaaagtgatcttgccatctgctaccccagtgtggtgcaatattaaacacatcagagacttgaacagaataagaagaaaaatacctgctcagcacatttccctaacacagtcctttcaatagtttagaaatgaaaagcaagttgagaagttttgtaaatttttgagaaatcagcatcatgtaaatcttttcagagtactgaaacactttcatataatgagaaagagtatttacatgacagattaaaaaggaacaacatttcctatatcaaatagttaaatattagtgtaggatttaatgattattacataacataaaatgtacttagaggtttttttttcctaaaaacataaaatttgatgtttgtcagacatattgtagatgttattatttataaagcaagatgtatttatatgctatttaattttatttcactttgcaatcagttcatctacacttaataataagaga

SEQ ID NO: 38012 - DNA, 1439 bp, Bovine  19866880380021
ctatctgtcaccacgtatttaaattgcacgcttgctgactattggtattttttttcttagttttgatactatgattcttttgccacaattttcatctgtattagactactttagcttgacacagaaataaaagttaattagtttctatggtgacctgtgcattaaacatcactgttctttcagatttgtaaatacattccaacttagtattcagaatgcaatgtgtataagcattcagtacaaatagtgggcatttgtttgcagttaagatggaatcggggcttgagccagatgatataattcattggagtatacagtgtcagtggaagatgccctaaatttgacatctctgtgctatatactcgtcacatttaaagctacacgtcttttttaatttttctctgctttaagatttgatacaaccagctacagtcgatttgatcgcaaaggagctggacatgacttagcaactaaacaactactactctacacaaactattttaaccttctgggctcattttaggtgcaaaacgctaaaaacgaacccttcttgttttgcctatagttgatacttcttctaaaatagtaattctcacacttgtgtgtgcagaagaaacacctgtgtgacctctttaaaacatgaatttctcaattccacctgcagagtgtgaaattcagtatatctaggatggaaccaatgaacctatactgtcatcaaccaccttttttaattataatgtttattttgttagggtcatttttctgaaaaaacagagtgtaacctgaaaactcttttatcaaatagaatcaaagagatttaaatgatcgggttatcggcatagcatgattttaatattcttgtgaaaatgattctttatatcacaaattataaaaatcacatttctcacagtattactctaatgttaacttctttggagcaataaatgataatcttcagaaagaaatcttacagaaagaccaaatatatcagttattgattgaaattaataacaggttatatgatcctctgaataaagccctttcacaaaaagccaatgatttacatgaaaaaaagagactaaattttactatccactattttctacagacaatattctttctgtctcatgggaaaggcaagctgtaatacattatgctttgggattctaatcagaaacctataaacaatgtataacttacaaatgcccttcagtgcattagaatacttttagtacagctttaaaattttaaatcaattctgccattcacaccatattatttatcttcaatttctccatattttaaatgtcactgtgtcatattaagtaataaaaagtttaaaagattataacctgaacttgccagatattcacttcattaccaggcctgaaatctttgcctttttctattttcgctgtcaaagagagtcttacttctgg

SEQ ID NO: 38013 - DNA, 1080 bp, Bovine  19866880382521
ttatataatgtgactggttgacagttttgcttttctctttgaaaaattaacaatgaatttgatttctttgaagcttcagactcttatttttatatgcaaagttgtccacagattctatattatgctattctttttgaataaaatcttaaatgaacattacttagctctttattcataaaacctttttatattcttataaaattcttatccagatgatttattcttttgctgattaaagatgaagaagaccataagtttattaattgttagatttatatctgcaaccttaaagtgaatggatcaaatgtaaatcccatatcatatgcaaatgtacaataaacttatgtaatctaataatttattaaggaaacaatggtatgtactaaaaattattttgcaacacacataacataaaatttgcattgtaaaccaaggtactgtcacttatgcatgaaaacatgtttgtagcctcaaagctactctaatcctatacatacacataaagagctttatagtatggagaaagcattgcaatttccttgaatggaaggtattaattttaagccacaaaaccaaaccaaatcccatcacacatcacttaaaaatctagaatccctaatgttcagcaagtttactatcttgagccttgaattaaacttgtagaattcatatcctacatggaagcattcatcctctggcttagacaatgtggtcattctgatattgtattaatatcacttgagggccaatattatcaaaattttactttcaattctcacacttttctttgtcttggtattaattttggttccattaccttagaagtagacacaggtgatcatttattttacatgccacctaacgaaaatcccatggaagtaggagcctggtaggctgcagtccatggggtcgcgaggagtcagacacgactgagcgacttgactttcacttttcaccttcatgcattggagagggaaatggcaacccactccagtgttcttgcctggagaatcccagggatggagaagcctggttggctgccgtctatggagtcgcacagagtcggacacgactgaagcg

SEQ ID NO: 38014 - DNA, 1568 bp, Bovine  19866880405071
tacacagacagaaagcatcatgttattagaaatgtgagtatctgaagaataatactgtaaaatcagacaggcagtggccattaaagatattttccagttcaaggaaagaggttcagattaaagtatgaaagtccggtcttaaggcaggaatgaattccagtgtaaaatgatacatgtcttcctttcacagttgctttttatgttgctttaaaacatgtcaaaataatccccaacagaggagcctaaaaggaatgtcagctctgtggttatgtaaatcgaattgagtgctttacagcaggtttaagatttttataactcagaagttgttaacagccagctggtttgtatctgttttttatggttattcttgtcatatgcagcctccacaatttttaattatattttatggtatgtgttttcctcctcttgaatcccttagccactctttgcttcacaagagattttccactgggaagggaacaagcacagctacgggactccatcactggaaatacagttgtataattacttaccactaacagctctatagtgtgaaattcaagtaactttccattgcaaatacataatcttctattagagcattaaaattgctttaatgtaacaatagctgcttgtaagtttgtgagcagtccttccctagtaagatcaaaaacatgatgattgtgtcactgtttgtatttcaagtttcttaaaaaataataatatagatattatcctttttctttctttttttcttccttccctccctccatcgcttcctctctctttctttccatttctctcactttttgggtattcgtcttgtaaattgatatctgcctcatagttaagttctaaatactttgttttctaattttgattacacagaaagatagtaacttactttatattatggtcccaagaatctcatactctggttgtaagatattgctacagctcctaaggtattaatgaggcatcctgagatttctgataccctaattggagagttgggctaaatttttcttttaaggaaaatgaagagagtaaagaaaaatgtttggaatctggaaaatgtactaaaataatttaaaatgtccacatatatcaaaaaatgggggtgtgttgtttcatagagacattttttagagaaatcaaatctttgaagcaatactttgtttttgtattactcttttgcaaaatgaaaacatgccaatgaaccttattcttcaaatcatagagtttccagatttgggaatacaaagatgtaagttttagacatttaaatatctgaatgagaatatattgctgctaatagttcagacatattaagaatattcagaccaagtgaagattaaaataagtaactgtgatttgatattcatcatataaatatgtactgaatctttattcaaatttcaagtcaatttgattctgtcataggagatccatgatacataatacgcaatggaaactatttactatcttgtccttaggattgattcatataatctgattttattatattacagaccattattaaaccaatattactatcaccaaacagt

SEQ ID NO: 38015 - DNA, 1217 bp, Bovine  19866880420624
aaaagaatcaattaaaatgaattcctatcttatctatatattttacaagaaatcatgacagtttttggcttaaaaaagaaaaaaaagggaagtttatagcttcatacaaaaatgactcacataagagaaatttctccaacttgctactacattatgatataaaagttcacttctattttcacaaatttatatagcttatttctctattcatgacttttctgatactttataacaaggtcctagtcaaacatggagaagttataagtatatacattttgaacatattatgtcaataaaatattcagtgataaaacttttgaaatattttcacttaatatttccattatcaaagtatgtacaaaagtcttcattacttatttactttttatgttatcagttaaaattagagttaaacaccatttggatatagaaataatgcattggaataaatgttatttgaatatgaaaattgcattagaaatttatacataatgaattattttttctttctatttcatgtaaaatatgcaaggattgcattttcacattagatcccagttttgaggttaattaactaataaatgaaagagggaaaaattttcacattcattattttggaccgaatttgagttctgcttatacctattacctacttttgtttctctgttcagttgagccaaattcttttatttacatcttaattactagttaataaatgggaaagagacattttccaaatatacttcagtttccctctcaaatcagtagagaagcacttattttttcacattatcaaggtataaaatataaagttaaaattctgactaaatcttcctgataaaatattatagacaaaatactacctatttccacatctcttttggatcatgggatatcagtccttgggtaagggtaaataccaatcatccatatgagaattttccatagattggattttctcactacataaaatgctcctagccatctccgccaatcatcatttggtaaatactcatgatgttaactcatttgggtaataaatagagcaaacaattaagaaactaagtctgatgaaaaatatacaatatataaccaagtcagctgtaagtgatttttgcataatttataacatcctgctcctctattagcatgaataaataagaattgaaaataggccatttcagaacaagacatgcccatatttattaaaggtataa

SEQ ID NO: 38016 - DNA, 674 bp, Bovine  19866880442573
gtggctcagatggtaaagcgtctgcctgcaatgagggagacccgagtttgatccctgggtcaggaagatcccctggagatctttacaataacttctgagcaatgaagccttgtatttttctctttatagagaagtgattttgaggaatccagggctaagtttcttacaagagggcattcaattgaattgagcatattttctcttaatttccatatttttaagtccaagtgactctgacatagaaactgctactatttgagtgttattgctacagctatgagaattagctaagattgataataacatctataacaatcttatataatacatgtatgtatactatatgcatgcataagatttaaaggaacaaatttaaattagacagcattgtacacaagaagtaaacatttcttgttggaatagattttaaaaattttgcatgcatgacctttatgcttattacaaatatattcagagttaggcaactcatcctttatgtgattgaaaacatatgttttccacaattttttaatttcttgtatgtacttagcttttaacctaggaaaaagaaatgtgtaaatagtttaatgattccttttggagaacaggtttgtacagagtagagtagactgacagccccaggtgatgacacttgcccttctttggaacttggt

SEQ ID NO: 38017 - DNA, 2005 bp, Bovine  19866880521244
gtaaggaaacaggtgctcccaaagagattccagagggagtgtggccccaccgataacttgagatggacgtgtgctgcttgtttttgaatggtggctcagacggtaaagcgtctgtctacaatgtgggagacccgggttcgagccctgggttgagaagatcccctggagaaggaaatggcaatccactgcagtactattgcctggaaaatcccatggacagaggaacctggtaggctacagtctatggggttgcaaagagttggacaagactgagtgacttcactttcactttcagaactgtgacagaattaattttttatttattgtagtcacaatataagtggtaatttgttacagtagccacaggaaactaacagtgttcagtacaagttttaaaattaaacaaattatgtgatgaatttcaaatttaggttaaagtgctcactagtatctgactcttgtgaccccatggacttttccaggggtcacggaattctccaagccagaatagtagagtgggttagccttttccttccccaggggatcttcccaacccagcgaccgaacccaggtctcctgcattgcaggctgattctttaccaactgagctatcagccttccaaaaaggaaaaagaagataaattacttaaagataaattactttcttttcaagaaaaatttaaagggaaaagtacttgaaattctggtagctcagtgataaagaaatgcctgccaatgcaagagatgtgagtttggacccctgggttgggaagatcccataaagaaggaaatggcaacccaccacggtattcttgcctggaaaatcccatggacagaggagcctggcaggctgcttgagtccatggggtctcaacagagtcagataggacttagccactaaacagcaacaacaaacaacatgcatcagatactgataagtcaaatgcattactttcaaaatgtccaatgattaagtttcacaagtatttcctacatacagatgtatgaaaatacatatttatatatactgcataaacattaatgtcttaaatgttttgtatcatatttattctttgagtaaggcattcaaaagatttttatgtttaaattattagtgaagatgatcaactcatttgtgactgttttacttgttattcttacttgggagcctctccagggaatacaatgcatttgttatgataaagttctcaatatggaaaacacatttccacataatgaatttttcccttggaagttggaaagcttaatgaatttaaaatattacaaatgttgatactacaaaaaaaaaaaaaaacaggtagtttggatgctgttgccagttggtaatatttagaaagaaaaataaagcctataaactttgaaaatgtctttgaattataaatccacatgagaatactttcctatttttttaagatgaaaatatttcaacagaattgactcttgctaatactgccctagtatagtattatttccacaatagtaaaactgcatttataggttcttactttttaaccatagtgcctttgtgtttacaattgcttttttttaatcctgaacgcatattatttgcctacaaggccacagtgagagaaaagatgtgtctaagaagcaaaactatgaatcatctattcatttaacttgaatgtatttgggaaaaataggtaatggataactttttttaatgaaaaaggcaaatactgagagtcactgagttatttcttaaaacttacatgaaaattgtgtttcaaaactagtttgcattctgccctaaagataaagtcaagaaattggccaaatatgctatctcaaattgcactcctggcacaggaggggagtatttagaagtcctaagtaaccctttccttaattgtaaaatacacatgattctataaaaagtatgaatgttacggaaattctgttgctaggatgaatttatttcaaactggtatttattatcaaaaatgatttatgatatgtgctcagt

SEQ ID NO: 38018 - DNA, 982 bp, Bovine  19866880522307
acttcactttcacttttcactttaatgcattggagaaggaaatggcaacccactccagtgttcttgcctggagaatcccagggatgggggagcctggtgggctgccgtctatggggtcgcacagagtcaaacacaactgaagcgacttagcagcagtagcagcagcagctagtcaacaaattgcctttctctttaaattagccagctttaaatttgttacttgtaaattggttaaatgaagatcaattaataaaatctctactgaaaaatataaaataactcagtatttcttataatgagtatatttcatttgttaagatatatgtgatctaattcacatacacatattttgataataatccaattcttctgatttaaaagaaatacattactacttcagaagctgttagtgcatatattttcttaaagattcttatttatggattttaacaaattaaaattgtgttagaagatacataatcaatcatggaaataatttcctcagtgatgtagcttattaacagttgaaggtatagattcaagaggagctattaagatacattaaattccatttccttaaatttattgcaaaatgccatgttaaatatgacattgtattaaattcaagcttcaggatttgaagttcagctgattgcaagttgctgaagagctaggatgctacccctcagcttgatagtacagaaatactgacctaaattaaggggctgagaaatgaggtcctatttagataaagcaagttattcaatgggaataacaccatctaggcatttttcatgcatacaactgaaatgatgatcttgtgatccaggaaggggggtcagcaagccaacggtattaataagcttttagaacagcagctgatatttgggaggtttcggctatatttggatgtcaatcaacagaacgagaatgggatttctatggggagggggaaggagtctttgtaggataagagtcaggt

SEQ ID NO: 38019 - DNA, 4925 bp, Bovine  19866880529662
tcctggcctcatatttaagtatttaacttactttgagtttaattttgtgtatggtgtcaggaagtgttctaatttcattcttttacatgtagctgtccagttttaccagaaccatttattgaagaggctgtcttttctccattgtatattcttgcctcctttgtcaaagataaggtattcataggtgtgtgggcttatctctgggctttctatcttgttccattggtctatatttctgttttttcaacctaaagggatgggaagaggtaggaggaaggttcaaaggggagaggacatatgtatacctatggcttattcatattgatgtatcacaaaaaccaacacaatattgtaaagcaattatccttcaataatatatatatataaaataaccatttaagactccagttagtaggctaaatgcaatttttcaaaacaaattaaacactgaagaactgcctttaattaaaatggtctgtacagaaactgactttcctctttggtaaattttgaaatttaattttaaagtcttcttataatgagctacttttcacaaaaaaatctgaattatgttttgcaccttatcataagttgaactatttaacaaaattatgattatggtacagaacagcaatgctgctgctgctgctaagtcgcttcagtcagtcgtgtccgactctgtacgaccccagagacgacagcccaccaggctcccccgtccctgggattctccaggcaagaacactggagtgggttgccatttccttctccaacagaatagcaaaaaacaaaaatataaaaatgacttgtttttaatggcttatttgtgtcaattctataggggattatttggtatatttacatatttttatctactttaagtctaaaaaaaataaagtataagaatttaagaatagaaggcttaatttttaaatatgtcaaatatccttcggctgtgaaattcacttttgaaaattacctccatggtgtgcatttacttgggttaatattaacatgtttaaactctggctttgaaaaagacttcatgttcttatttatccaaaaaaatcaagttaatactgcatattgaaaatcacagaaaagaaatgggaagaaaccatagactattaagattatgatgcagttatatcaaatagaaaaaatataaatagaaaataaattttaaatgtcaatatataatcacataaagagacccaaatgccaaaaaatatggtagacaggaaaggaataaaatattatatgatgagatggttggatggcatcatcaacttgatggacatgaggatgctccaggatttggtgagggacagaaagcctggagtgctgcagtccatggggtcgcaaagacttggatacaactgagtgactgaactgaactgaacagaaaataaaatttatttttctgtatatatttgaatcaaagaatgcgatagtacaaaatagacacaaaagtcattcattttttgttcattatatatcaaacacttataatatgccaggaattcttgtctgctatgacaatatagcagtgaagaaaacagatacaaacatatattcttgggtagtttatattctcattggattgtgtgtagaaaaaataataagcaaataaagtgacaccacatattaaataaaatatctgtcatataaaggcaatagagaatttggcatatacccagtggatgtgtgtacatatggcatgtatgttaggagggtacactggaaagattttgctgatgaggtaacactgtcacacaatcctctctttttacagaagaggaaactgaggttcaggatgattaaatggaatgcttgaggtcacagtaagtctttaggtaaagagctggactcagaacacacttatttgacttggttctcaatgcttcgcaaggtacaacagtacccttttagttgaaaaaactgcctcggctgtgcaacgaagcaaagacaaacatgaacagtgggtgtggacgaaaggtggatagttcaattgaccagaggagaaggtatgcataggaaagcatcaggactcagggagaattaggtaggccgcagcagcagcagcagcagcagggagatgagaatgaaaattctcagatgtcaggatgattagtttggtcatcatcttgggcaggggagagataggattaaaatgatatatatgagatagtcagaaggaggaaaaggaactcatcatggggaataatcatcccaagttctgtcatccaccacattgacactgatatgaccagggcaagaatcctaattctcatatttcatgccactggaaaactgataaaatagaaaaaaaaaaaaaacttgtgtgttttatcattagagttttctaagatgatgactgaagaacaaattggtttccagagatagacatgacaagacaattacgtcgagtgaggatacactgcacactctcccacatatctgaatccagttccttgtaaactcacccttctatatatacagtatcgagttttccgcaattaaaggaaaactatgataatctttttcaaagttttcacctaaaaagatataacttactcattcttaagagaaggcaagaggttaccagtgaatatagctcacgtagagttcttagaaaagcaagggggtgcttggtagattgaccaagaaatacctcctcaagtcatgatataataaggtttctgaaacataacaagtttggctttaatattttattgaaaatctaaatctgggaatgtgttttaatactgctatttctattctatgccaaatatatattactattctgtagcaccttaaataagtgctaccatacagactactatacacatcagcagacagcaaaacagtgtctacggtcctgacattgaaaaacatgaactggtgaaaaacaccccatccttagcctctattcttttttttttattttattttatttttaaactttacataattgtattagttttgccaaatatcaaaatgaatccaccacaggtatacatgtgttccccatcctgaaccctcctctattcttgctattcacttttcttcactactcacaattcttatattcacaagaattcctcattactggccacaaaaataacaatgtatattatataggtaatgatttctacatgatgccataaaagctttgatttctaataccatttagaatgtctgaataaatacatgcaaaaaatacttattttctttagcttgatagtatcacagagcatgataagcctttattttgcctatggagggttttatttttcttatcaaaaccataaaattatatactaagttgcaatatgtaaagtaaacactatatgatttttatttgtgtaagatgtctatatagagcatattatttactttaattatttttggtttcttactccaaaattttcaagctaaattctatttgtatgtggatgatttaaaacctggtaaatgtgttaaaataaattttcaagcagcttagtatgcatagacagcttttaaaaattcaaaacagccctcatagcaaatgtcatttctttcatggttacaaaatgcaaactccaagtgttttatcctaatgaataaatgagtttgtcctttatgtataaaatatagtttgtgtttgttgcacaagtttttaataatagatgaattttaggtttgctccaacgtattcaataaagtgtgattaattttggtttttcaaaaatgcaaactagacattactatacttactttgtaaaatgcacagcttgcaacattattgtctcagtgggatcttaaattgaattgtaaaatgtgtcttatttccagtttgatttatgtaagagatagcagtggataatgtcccttttgaagtttcactgctttgtgtgaacaaacaatataaacctaaaattcataatagagtttattagaaccccaagctaactttccagttatgtttgaccgaaaggaaaacttatgatggattcagaataccacattttcaatgaaacaacatttttgaagtttcctattatgacagattatacgatacattttgacattttctgtgatttttattatgatatttcaagtaattaccaaatcatttttttttcctctaaaaaagctttcctgtgccctgagaattaatctatgataccatttagctttggctttttgaagtaaatatcaccagataaaagccagctggatctgaataataggatacttgaatgaatgtattagtgtttgaaaaagagagtacaaatcttctaaaaagattaatttccataaaaaagatagctcccagatctacaaaagaatgaattcaaaaacataataaactctcagaaagaaagggtagattaaagtcaagccgcagcaccttgttactgcagctgttgcgaagcaatgattctgtatcagttacatttggttggtcctgcagggctcttcaaagctttgtgtgaaaagctgaatatgggacacatgtgacagtgtaataacttccgtgattaattttgatgcaacaccactttcattctgatcttattctcaatatttacagtttgagagaagctacaaaggttctgatgggaatatatgaattgagtaaggacactttttttttctccttcatttattgaagatgtggatatgaatttttctttgtcatgaaaattttgcagctttattacgcgacatagttgctgacatcatcaggtaaaaagacctgagttggccaatggactttattttcaatatcctgtttcaaacatgttctctaaaaagggccatgagttctgttcacactacttttctacctgagtctgtacaattactaataaaagcaaagtttgaccgtgaataatttcctctgggaggcaaaatgtaccagtccatcttggatg

SEQ ID NO: 38020 - DNA, 3000 bp, Bovine  19866880530515
gactatattttctgtgttgtacaccatatgtttgttgcatgtttatttgtacccatagtttggttcctctaacccccttcacctagttgctcctcgcccaaccctcttccctcaggtaaccgctagtttgttttctgttatctgtgaatctatttctgttgtgtttgtttatttgttttattttttaagactctaaataaaagtgaagagacacagtatttgcctctctttgtctgctttatttcactaaatataatactctccagggttatccatattgttaacaaaatggtaaaaaacagtcatagcagatggatatgcacattttttttaatccagtcaattactgaagggcatgttggttgcttccaagatttggcaattttgaaaacaacttctataaatgtccatgtgcaaatttttgtgtaaacatcagtgttcaactcttttgggtaaaaatcatatgattgtatggtaagaacatgtttagtttcattagaaaccaccaaactgtatactaaaatgggcattaaattctgcattccacaagcaacgaataaaaattgtaacaaggccatttatgtaaaacatgctccagagactcccctaaactcacacgttttatattcagaaaaacaggataataattatgtcaaatatggataatgcagtgtgaggtgtcttttacttactttaaaaattaatagtctattctgtcaatgcatttaaagtactttgatttaaaaatacattataaagtaatatgaatgaaaaagtatatacagatacacacccatttaaaaatgtaaacatacctcccacacacatatacagagagagagagtcagagcattgtgtacaatatacatatgtgatgtttgtatgttatcttccaattcctgtttattttttaatctacaaaaaacttccaattttattatttcatttagttttttatatccatatggtattatccatttttaggtatagaaacaatcagaaagatcgagttaaagcaagatgacagagctagttaagtggcagaaacataatttaacccttgtggtcttttgaaaacaaatcagatactaatttccatacctcaaggctcataacaaagcacaaatatgcacacatacccatgaacataaacataaccatactttcaagcacatacacaaaatttgaaatataccatttaattcatctccttcttagtggatataatggagaactttaagttaaccagcctgcttaaatattgtacccatagttctaattactataagtgactttttcttataatctattttctatatcacttagctttttaaagttagaactacttgtgcaataagaaaaatggattgattgagtgatggtgacttaagaggatcttggttttggccaaatcagtcgtataattaaacaattaccttaataacagatgtctcaactctggatgggggactctgaacttgtgctgctgccgccatatttgcaatggtgctaagatggttcatctggctcattgccatggtgacagatgcctggaggtaggctgacaggaattagagggtggggcatcatcataaaaggaagctccagtcctgtaaaaaatgcacatgtatcagcatctctctattcaaatagaatgatgaaatatagtatatctcactaattaaaatggttaagaacataatcattgaaaattgaagcatttaaaaatgttctaataatgacaatcaaaggaaaaatatttgtcctctttgtatgcaacaatgcccatttatcactcagggaaattaaagtaaaaactaaccagtttggtgtcatgttttatcactcaccactcttcattggtttttaatacaaacagttaattttttgctacattattctgatcaatctaattcttgttttaaatactatggttttctttatcataattaactatctaaatgtaatatacatttcaactacgtcctatattttactatctgatcattacttttttttttcttttacagctattatttttagtgctaaaaaatgccatcgtaccatttggcagaaggtggctctgctgaagatggtggagaggatgactaactggaaggctatgcactccaggtatgcgggggtgggtaacagaagccttagatccctggggtggggaagagtacagtgtttctttatcccaagaaccatcactgctgcctgtggggaatgaatataaattatttgtctacagtattattccaaatcttctaatgactaatttgaaatgatgttttaaaaaacatatcacatttggaaagtggctaagtgatttcttgggaaacaagctcaagtagataagtttctcctaaaccatattttccttttgtttttctattttttgaatgtagtttttttttttatattttattccatattttatttttttattttttttttaattttttttctttaatagaaaattatttaactagtatacatgtgttccccatcctgaaccctcctccctcctccctctccacaccatccctctgggtcgtcccagtgcaccagccccaagcatccagcatcgtgcattgaacctggactggcatctcgtttcatacatgacgtttatgaggtaccatttcacaccagtcagaaaggctgcgatccaaaagtctacaagcaagaaatgctggggaagatgtggagaaaactcttacactgttggtgggaatgcaaactagtacagccactatggggaagagtgtggagagtccttaaaaaactggaaataggactgccatacaacccagcaatcccactgctgggcatacacaccgaggaaaccagaagtgaaagagacatgtgtaccccaatgttcattgcagcactgtttataatagccaggacatggaagcaacctagatgtccatcagcagatgaatgggtaagaaagctgtggtacatatacacaatggagtattactcagccat

SEQ ID NO: 38021 - DNA, 1787 bp, Bovine  19866880530922
agcctggtaggctgcagtcctggggtcgctaagagtcgacacgactgagcgacttcgctttcacttttcactttcatgccttggagaaggaaatggcaactccagtattcttgcctggagaatcccagggacgggggtgcctggtgggctgccctctatggggtcgcacagagtcgaacatgactgaagcgacttagcagcagcagcagcagcagcagcagagcatgaggttcaactggggcagagggcccttttacttggatctattgcaagtattgtctattgtttatctcaaatgtaaatatttacggagtacctattatatccaagacatgaagctatagagaaaaccaaagaacgtatttcaaatgatgtacctattgaatagatttttaacatcctaggagtgatgtgaagtaacaagtacgcacacacatcaattgcaccaaaggaaggtagactggaaaaggagctacattgaaaatacaaagatgaattccagttggggatatcatgactaatttgcattttaaatagactttgaagaactggttggatttaaacaaataaggtgaataaggcattctaggaatagtcagcttttgaaaagggataaaggtggatttaggatggtagatggactagagacatttgtattttattctatatgctatgagaggtatggtgaggttttgagaagaggtatggtataatcacttgactaatttgggtatacacttaattgaaacattcctgcttgtttaaataatacctatctagtgatgggcttgtcaaaacacagaatatggatggatttagaggaaattaaatatttagtggcctcaagttcttgtctaacaccatactcatttaaggataggcatttcccagaacaaaagatggattataaaagctgggtatttattccttaattgctacagaagctagtctccagttaaagctctgagctttagctgatgtaagagtgtttcagcaaaagttaagtttaatagaatgcattaattcttccctgtaacaaccagaacatagcacaaattttagaatgcatttacagcatgtcaaaagggcaggcatttataaggatagaacaaaccaccttgctgctttagctagaatataggaatatagatgactatattgtaaaataattgacttcatagctcttttcaagaaataaatgccatatacatttatgaagtaaatggagaaaatgtcaaatagttatggagaaaatatcaaattttatggagaaattttatggagcaaatatcaaaaactgttggctattgggaattgagtcatatttaggattttagtctttacaaactttatttttcaagtgaagaacagaagatagaatcctggaaagaattagtttttccttctaggagaaatattaaataaaagtttaaaactattaggtgagacacacagacacagaaaaagaaccaccaatttccaaatatcctaaaataagaaagtggacaaccttaggtgaaagaatgtgagttatattttcgctggtttgtttttcactgagaacatggttttcttgatatgttcaagaaatacctataagttagcgaacatttgtcacccctccaattaccttcagtactgtagattagctgtctggttgattcctttccaataaactaccattgaaagtgtttacaagttcaatttcaaggagtttggagacagaatagtcccagatggaaatgagagaccctgggtttaagcagctttggactctagggcagtag

SEQ ID NO: 38022 - DNA, 1162 bp, Bovine  19866880611872
cgtggcagacatatccccttaaatgtgcatgtgttaagggtatgtaatgtcaccattcagagaactaacaattcctagtttctcattaccaaaactagacattttacatttcattgtttccatattattattactacttcaagcttgctattgtaaatcaggcattttgctaagtgctttagttatatcattttacttttcttactgtcttcatttttaaagatgaaatgaaagtgttagttgctcagtcaggctagtctgtctcttgtgtttcccaggcaagaatactggagtgggttgccattcctttctccaagggatcttcctgactcaggggttgaacctgggtcaccagaattgcagacagattctttactatctgagccaccagggtacttggtgaggataagaacattgtccaagactacacagttactaagagtagactcagaaactaaactcatgtaattcaaaaaatccatgttcttagccaagatgtgtcctgcctcacatttttgttttctcttaacccttaaatttaaccctcctcagaatcagaccagatttagtactgatgactgtctcatcttagttcatgttattccttctacctgaaatgtcatttcccctcttatgtacagtgcaaatcttagccattactcaaagccccattgttcttttaagactacttataaagcacatatattatatatagaaagtaggatgtggtatacacatgtacaaatatattcagaaaatatatatgactgattctacaaaaaaaaaacattttcaattgtttcctttcacattaaattacattttccccatcatcttaaatccttttcagtcttactattttttctatataattttgaattttctgatgttcactaatagctttctgattaactggctttatgtattcttctgtttgcaagaaatttcttttatgggttctccattattcagaaaattttatagacaaggttataatttatgaaacagggagatcattcttgaaaaaaactgaatagatttttaactacttcattaaagcaacccataaataaaacaaaatacaatgccaagataacttttgtagttgagtttctagcaattaccttttttccctttactggtacgatgtaatataaaagat

SEQ ID NO: 38023 - DNA, 1734 bp, Bovine  19866880660980
ctaccaggtttgtcatgaggaccccagagttctgctgtgatcgttccttgacatggcattcttttggcaattacttgctccaacactatttgtttgtacttgtgaatgtattcaattcaatccagaagacatttattgagcattattatcagactctgggggacatcgagttaaataaggcttgatttttatattcatggcaatgatcaccatgtagattgttttataaacatgattaggttggaatgtaatgctattgttattgttttgcttttctcagtaactaggctgtaggctccttgaaagcaaaaatcttttcttaatgatctttgtgcacagtgttagttgctcagtcatgtccttctctttgccaccccagggactatagcccaccaggctcctctgtccatgtaattctccaggcaagaatactggagtgggttgccattcccttccccaagagatcttcccagcccagggatagaacccgggtctcctgcattgcaggtggagtctttaccatctgagccaccaagggttcagtatctgcagagctcccaggcagggagtcacagtcagactccaggaaagatggatgcatctgccacagtcactttccatcatgaccagagggctcatctactcaccgggaagcgtggcacccagccttggccagtaaggtcaggggaggaaattggaaaaaaagccttaccttctctcaaccccagaaataatgacctttaattaaaaagttgttttttttttcttcagctgactatttttaaaactttctatttaacagtggagcatggctgattaatgatgtgatagcttcaggtatactgtaaagtgattcagttgcacatacatatgtatctattcttttgcaaacccttcctatttaggttattacagaatattgagcagagttccctgttctatacagtagtaggtcctttttggttatctattttaaatacagtaatgcatacttgttaagaatatctttagtttaatattatattttatttgttaaaatgtaagacatcaataaggcttccctggtggctcatcggtaaagaatccacctgcaatgcaggaggcgcgggaactgcaggttcaattcctgggttgggaaggtaccctggaagaggaaatggcaacccactgcagtattcttgcctggagaatcccatggacagaggagcctggaagtctgcagtccacagggtcgcacagagtcgaacacaactggagcaacttagcagagcacacaagacattagtacaacacattgttcttaaccttataaatattaatttattcaatctgaataataagactatgaggtaaattcctattttagaatggggaagaagaggcacagagaggttaagtaacttggtcaaagtcactcagtgttttgaggaacactttaataatgactcaagatttcatcctctggcattaaatatattgacaccaagaaagttaaaagaaaatgtaaagctaaagcaatttcaacgtatgcaaacatttcttgcacactattcttccaggtttttcttacagaaaatttttttaatcactgatttgattccacttggaatatgaattacaccttctgaggattatcatcatcatcctcatgctcaattgtgtctgactctttgcaatcccatggactgtaactcaccaggctcctctgtccgtgggattttcccaagcaagaat

SEQ ID NO: 38024 - DNA, 1474 bp, Bovine  19866880676764
tatggtgtgggagaagactctttagagtcccttggacagcaaggagatcaaaccaatcaatcctaaaggaaatcaactctgagtattcattggaaggactgtgatgctgaatctccaacacctcggccacctcatgcaaaaagccaattcactggaaaagaccctgatgctgggaaagattgaaggcaggaggagaagctgatgacagaggatgagatggttggctggcatcactgactgaatggacatgagtctgagcaaactccaagaaatagtggaggacagggaagcctggcgtgctgcagtccagggggtctcaaagagttgaacacgactgagtgactgaacaacaacaacaacaattctttaagtatttggttgctcgtatgtcaaacactgatgtaactttctggttcctattaatgaagctcgcagtactgtgatcagactctctcctctccttagagcccatcacactgctccatttcttctctgagtccaagtgttttcccactgcctgcctgtctgctaagtggcttcatcatgtccagctctgtgaccacatggactgtagcccaccagtctcctctgtccatacaattctccaggcaataatactagagtgggttgtttttccactaagctcctcatttacatggatcagagcaggtctaacttcacaactttccagatgtagcagatctgcttgaatcttaaggtgaacaccatttatgctctagttttctatatcactttctaaagaggccaagtttccataacactggtaatgcaaagatcataatgaaaatgtatttccttattatgtaaggggtgcttatgaaatcccagtacatttctcacagccagattaaacattttattgcctttatttttcatcaagtatgcaaattctttttagcaggtttcacttttgatttaaaaccatttttcatgaaaaactaaatcatttacggccatatggtctcatgacaatgcatagttaagaaaaactcagtgaattttatacaggaatgccttttggatagcctttcaagtgaaagaaacacacttgctagccacagaatgaggtgctttaaggaaaaactctgacatgtcaataaatataatgtgggcatttgccaaagagaaaagatgtaggtcaatacaatccccttccttttatagagaaaaaaagtgatggcttggttcctagcaggaggagtcaaaacaatgtactcccatatgttattttatatatggaagcaaaaattaaaaaaaaaaaagacatgctagggaaaaatgtaaaatgaagttaaggactgacagcaccaacactcaatctgctggtattctgtgctgacatgttccacatggtttctctcatggatacaaaagagttcaggcaagggaactgccaataataaaagtggctatcatttagtgagaacctactgtgttctttcttcctgggtga

SEQ ID NO: 38025 - DNA, 1182 bp, Bovine  19866880692854
caggcagggcacaaggcagattcaaccagcagatttgctattttagggaaagccatctgtttagatttctctccagtaaaactgcccagtctcagtatattcgcccataaattttgtgtctgagtttcaaagtccatgcaactttgtattgaatagaaggaaaaatcccactaagtgaaaaaattgtggtaacaacagctcaagtcatctggtgacagcaggtctgtctaccctggggctaccctctgagttgggctcggacaccacttgacctgtgctgtcctgggaaatgggtgaacatcaaacaacacgcaagtggtcaaagtagctaccattatacattttgctgcccaaccgaagttgtctgtttagccagatatttttagacccgctctcacaatttttatgttaatagaaagtacaggggaggaaatctacagagatgtcattggtagtagcatattaaaggcagtggcaggttggaacacccttttagtgacatggaaaatcctttcagctacacacatagtctttcaacacagcagcatgggcttagcagactaattcgaagaaacagtattgtagaaagttctgttctgcaatcaggaatgtgaaaaaaattaccactccttggcccactggcagagctactgagattttcaacctagaagagaaagacggctaatgtgcctatctagccttttggaaatggcaactcactccagtgttcttgcctggagaatcctagtgatgggggaacctcatgggcttccatctatggggttgcacagagttggacatgactgaagcgacttagcagcagcagcagccttttcctccagtactcttgcctggaaaatcccatggatggaggagcctggtgggctgcagtccatgaagttgctaagagtcggacacgactgaacgacttcactttcatttttctctctcacttttcactttcacgcattggagaagaaaatggcaacccattccagtgttcttgcctggagaatcccagggacaggggaacctcatgggcttccatctatggggtcgcacggagtcggacacgactaaagcgacttagcagcagcagcagcagcagccttttcctctctctcatatactcttcctgtggtaatggtgggttatttgaattactacataattaaaaagcat

SEQ ID NO: 38026 - DNA, 1237 bp, Bovine  19866880733337
ctaaagatgattgcttacgttgtctctttgaaaagaaacagtaattgctgaattacttatttggattgtttattcgcatggcactagaagctcaatacccagtaccttgccattgactgtttgttttcctcctacatgattgaagcaaatggggttgccatgtttccctcttcaggataacacacggcttccatagacacattcatatagatcattattgatagtcattaactttaacttgttgttcataattaattaaatggtaggttcatgatgttgtctgtgaaacactttgtcctatacgtttagcagttaaaggaataaaacaatgtaaattttccaacagttataaaacaacacaattctgaacatctctcaagtaaccaaaaggttaccttaagaattcagggttttgctttttaagttttgtttgaaaaagacttctccaagtaagaacaaaattgcgacatggctatctcatggaagatggttccaaagaatgaaccgtttgaccatattcattactcagaacatatcccaccatcaacatttaccttgttttgcttactctagtagctaaatctatgtgaagtcacattacttagaacagtgctctacacccagcgtgccagctgcctgaaagcctcatcctgggaactgactaactattgcttcatagtaactaataaaaaacctattagttctgcaagttttgaaagaaagaattattttaaaatgaccacgtcacatatatcagaagaaagtgtggattatttatagtggatatttattaaatgagagaaaaggagcttccccttttaaatattgaagagaactttagagttgaagcagaggggaagttgtttgtaaagaaaatactcttggatgtcatacataaaataagcagacaaatatgaatgaccttcaaaattatctaaacatgcactgtaaagtgtgtaaaaagcagcagttcatagactgataataacattatttttacccaataaaaattcacatcagtttctactctgatgtgtatttgaccttgttggatgaaaatgaggcattcagaaagaaaattatacaaacactcaactttggtcatttgttcagatattcatcagtcttccatttcagttgataaatatctcactaaatctgcttcgcttgaataatcagtatttttctattttagttttatgactttaactcaagcttttcaaagggcaattatgaa

SEQ ID NO: 38027 - DNA, 1190 bp, Bovine  19866880769965
aggatgataaatatatggtctaataattcaggtgaaatagacattcttccatttcagaagcagaatctatgcagagagacacctgcacattttgagaagtatacgaagttataattttatgacagacagcagcatagcattccatttacaatctttttacaaaggtggatgataacagaagctaggacaatacaataaaatactatgtctgcaataaaaagtcagacttcactcttctgaaatgggctcatgcagatcactatatctctgtttacgggggattttaagatagtcacaaaacaaaactgccaagcatgaaagaataattcctttaacagctgttcaggaaggtcaaaaacacagaaactactgaaggttacaaaagtatagctagaactcttgggagttgagctccattgcaatggaaatttcagaatcatcttctggttgtgcccgccagatgtgagcatgcttgttgattgtttgcaagatgtttagagtccagttctgccggctgactttccacctcctgccatcgcgacggaggggacagagttcataaataaaagcacagatgtctctgatgcttcattcaaaagagaaacaaacacagatcaataggaacaatctgacaccaatatcccaatttctgtccagacaccagcaataggaaggcgattgtccacaatcttgaaaatttgttctccaaatgcactattgacagaaaagctggacataataagaaatcaaatgaagctgaataaatacctgtactgagggccagatatgaaaactacatttgatgaaaaataaccaaagggaggcaaaaagtatagatcaaaaggtcatcatatgaaacattgctgtttttgtggttcgtgactctggattgaaatataaaatcagcctaaagtcagacttgttttttctttgctatttaagttgaatagatttctctctacttttgaactgatagagctttgcctgtcttactttaaaaaaaaattctcaatgaaaaccaaattttatgaaatataaggaatgaggtagtgtaattttgactttgaagtcatcttggggaactcccaatgtaaacagtttctgcaattccatttaagagcatagaagtgattaaaagagaaattaatattagtcggtgtactgtgaccatgaacatgtttgtcaaggtg

SEQ ID NO: 38028 - DNA, 1661 bp, Bovine  19866880777991
ctatcagagaagatggtagtcagttgtccaatatgtactggctaaataaattaatatagggagcctctgacacttgacaaatataatacggtaaagattacatttacaatcactgaaatttggactatattttagtgtaaatatcacaagtggaatttggtgacctgcttttaaaacaatgtgattgaaatttatccttagtcttcatggtaaaataatggtacttcaagactaaagtcttaaatttttacacaaacttaaagtaatcatctcctggatgcttgctatttttggctggtataatatttcccaattatcagtaaaatattttcccatgtaatttcatcatctttgtcacatatacccctatgcttagaaaaaataattagtggttaatgaaaacaattggctcattaagaaaggagaaattcccttcaagggagttttaggaaacatggagagatttttaagtctattgaattcacacacttgccttattttcgacttcatgtataattcatttttgacaagaagacattctcgctgctacataaagggcagagagtggggatgggtgggaagaagaggatgcaaaaggaataatttacatataaaatgtagagaaacttcatagcagaagtggttgtgtaccaagtataacagtggttggaaaattatatagaagaaagcacagcattttctaagacatcatgtataatataacatattgtcacgccatcattatgacatcataatgtgattattattacagtaacaaaaactggctttcctatattaaaataatttttttctatggtacttgtattagtttgcttggactttcataacaaagtactatattgctattgctattgctaagtcacttcagtcgtgtccgactctgtgcgaccccatagacggcagcccaccaggcttccccatccctgggattctccaggcaagaacactggagtgggttgccatttccttctccaatgcatgaaagtggaaagtgaaagggaagtcgctcagttgtgtcggacccttagcgaccccatggactgcagccttccaggctcctccatccatgggattttccaggcaacagtactggagtggggtgccattgccttctccgaagtactatattatgggtgacttaagcaagaggaatttatttacccacaattttggagactagaagttcaagatgaaggtgtcagcagggttggtggcttctgagagtattttccttggcttgtaggaaaccatcttttctctatgcttcacaggtcttccctttgtcttcatttcctgtaggattactggtcatatcagattagcatccaccctaactgaccttatttaaccttagttaccttgttaaaaaagaaaaaaagaaacagaaagaaaaaatcaaaatgtacaaacactctgaaaaaagttctgctgctgctgctgctaagtcgcttcagtcatgtccgactctgtgcgaccccagagacggcagcccaccaggctcctccgtccatgggaccctccaggcaagagcactggagtgggttgccatcagcagtttctaaatcaaacatataggtataaaatgatccagcaattctacccctagaaatttctccaggataaataaaaatttatgatta

SEQ ID NO: 38029 - DNA, 1832 bp, Bovine  19866880815354
ttctgcttctgttagggtccataccatttctgaaatggctagtgttggggaaatgtcagatgctggcaaagatatgtagcaacaggaactctcattcattgctgaagggaatgcaaaatggtagtcacttgagaagacagtgtggtggtttcttacaaaactcaacacacttatactgaatgatgcaataactgtatttttggtacttattcaaaagagttgaaaatttgtctccaccaaaacaaacaaacaaacaaaaaaaaaaaacctgcacacagatgtttatatcagatatactcataatgggcaaaacttggaagcggcaaagatgtccttcagtaggtacatcccagaaaatggaatatgattgattcagtgctaaaaagaaatgacatggaggagctgtaagtgcaaattattacttgaaagaagccaatctgaaaaggttacatactgaatgattccaagtatgtgatattctggataaggcaaaattgaaaacagtaaaagatcagcagtttctaggagctgggaagagagatgcaatattgttgaaatttcttttaaagcacctctgtaagtcatatcttctagttatccaaagtcaactagcaaattagcaggtgaaatgaatgttctgaatttaatgatgcctaagatctctccttatatgaactctaattccagatatgaaatcagttctcatcttacaaaacatcatcccttctttcactcttctaggttctcattttgatttggggactaaattaggaaatttctctttaagtgactgagatatatttaatggcttatgagactttgaaaaacagatgttattctagggaagaaaagaaatcctcaagtttaggcattttgcctatgattctaagttttttgaatatcatgaaagtgaaccacagcatttatttatgattatgtcatacacatatggaatatggcatggctgtgttatcaggttctctatgaattcttcttatgatcttgcaactgtatctgattacctaagttagaatggcctacattaagcaggaaagaagtccacgaaagggcagcgagaggagagaaacgtgaagtggcatcttcttgtttaagactgaaattttgtatcactgcactgggtgattgacttattttccacagttataaagtccaagtttagccacttctactccaaggtaaaaattcccaattctgttcactcagattatattttaacccttcagacatctatcattttctttattttctttagattggaagatctctaagatctaaaatgaatattctttatcattactcaatatgtcttctatatcttgttatgaaaccagataataaaagctatttcaaattttggttatgtgtcacaaagtttaatgtgtttataatgatcaactctttgttaaatatattatataaagcatttaatgattgttttaaatatatttgagttcatatttgaataatgacaagaataaaaagtttttgcaaaaagagtttgatctgaaaaaattttagtagtgattaagataagtaaaagctgagtttataaagcaggttgggtaacaaaacaatagacagtactgactgcaaaggaaatctcattctaaacaatgcagccaacctgcagaaaagacacataaaaagaaaggaaattactgaagctgttacacatacaacatgcccagctgggagtccagctgctcaaggaagctggtgattcttgatctttggggagttcctaatcagaatacaagttagaaatataatagaaaacataaaagaaatttaaaattagtcagctcttattt

SEQ ID NO: 38030 - DNA, 1624 bp, Bovine  19866880819092
cccatgtagtgaggtactcatatctcaaaattcttgaattgtgagataatgccatgctttctaatttatgatcatttaaaatagtacctcattttttctttacagcaatcagatatgagattgtttcccctgctttcaacatgagaaatatgcgcttggactgcttaactggcttgcaccaaagcagaacattgttaggtcatgatgctgtcttgtacttggacttctgactcaagttccaagttattaagactctgttctcatccttgtgtcttttgactttttgtgaaaacagtctactagatctctgagagatgaaagactgacaaaggtgattggagtaaaatattttaagaaaaaaattcagaagagacagaacccatatttcatgtcagaggtgggcggactatggctttaggccaaatccagcctgccacttgtcagtggcttctgtgtatcttgtgaacagaaaatggttttgcattttgaaatgattgaaaaaataaaaagatgaataatattttgtgacacctgaaaatcatatgaaattcaaatttcagtgtccataaagttttaatggaacaaagccacaatcatccatttatttataatctatggctactttcacactataacagcacagttgagttgtgtgacagagatcatatggcccctaacgcctaaaatatttactatctggacctttacaataaagtttgctgagtcctgttttaagcaacagagttagtagcatcatttattaagattgtttcaaatagtctagctctgctttttccagagagtctatttaactcataacaaatttatagagtatcactaatgagctaatattattctttcaattagctgtgtcctatatttatgatgttatcctatgggggaaagtgatggctcaaatttcaaacaaagcacaactgaattttggggacatacccgttaatcaaatttgtggctacctgtttcagagatgaatgatgatgttgaaagttgatagaaatgatagttacccatctctatacattattcaattattcttatacttctccctaaggcaggtatttatcattcccattttttaagtttggaaaatgagcattaatgtagctaagttaccaccaaaatttaagagaatcctcactatgaaatggagtaggaagtggaatataaattgtcctgaatctagagttcatgctttcaaccattatgctccactatctacagtacttctcatacataaatattaatttcattcatattttaatacttttattacaaactgggcttctgttcatattttaatacttttataacaaactgggcttccccagtggctcagtggtaaagaatctgccttcagtgcaggagaggcaggatttgtggtttcaattcttggattgggaatatcccctggagaatggcatggtgacccactccagtatgcttgcctggagaatcccatgggcagaggagcctggtgggctccagttcatatagggttgcaaagatttggatacaactgaagcaactgagcacacacacatacattaacaaacatttttaaaaggatgtaaatacaaaacaaagaattttaaagttttcatta

SEQ ID NO: 38031 - DNA, 1263 bp, Bovine  19866880852967
tccgaacaaatgcagaaaatcaagaagttagcttctaaggcagtaaaaattaattgccaaaattaattccatatttaacacattacacaatgatctggtcctgtctctacttcatagaatggagcatttctatcaccaatatgcaaataggcttgaaaatatagcatacagttttctttggatggaaatggctccctgcatttacagtctataaggcactctgcaggtgtcagagtggaagtgatgatgttcttcttttccactacaataaaccaacattttttatgtgggaagcagaaggaacaaacatctcttgactgcatattatacaataaaaaccttgtacattatcccagttggttctgacaccgtatctctgaggaagttacttctacccacagtttacagatgtagaacgttaagttaaaaagctgaataactttgactagttcctgggttaatctaactccaagtcaatgtgctcttgcattagactcagtgttgtctattctagaacacactttccagatacatctccttaaatactctagaaaggcactataacaaatccaacttttcttcagaaaactgtaaggcaggattacatagctagagacaaaatgggtcactataactttcaacaatactaaactgatgatgcatccacctaggccacaattaggaagaccatggtgtctaagtctctaaaaatagtattgccagagcagaagcaatatggaatctgcaccattattcccaccagaagatatggctgaaagatggtgtaaatatgcaaccctcacactgacaaagtacagaacatgaataggtaacaaaatcatcacggggattatgtccatactacaggcaaaccaaataattaagcttgcgacatgaatttaggaaagaaaatggtttttccacttttttcagtctcaggataatcacaaaaaaagtcttacaatatttgtattaaaagtctcaataaatacatatatgaacagacacatacatacacattcatacaaagacatatgtattttagtgatgctatagaaagctgttttctatttatatgtagcatgatcttagttgtgaaatgtgaagtctaaactgaatgtagttgtggcagacttccctttgtggtattaaggctatctgaagatcactacaaaagaaaaggaaaaaatgaagcaacaataggaagtatatagaaaatatttcattatatttttttcattgcagttaaacaaactaagaagt

SEQ ID NO: 38032 - DNA, 965 bp, Bovine  19866880865352
atgctttctttttattcacagtgaatcatttatgttatctattcaaatggctatggaattgacaaaagttaagatcagtttctctttgccaacttactatatttccacctaagattcagttttgtttctgttttttaaatatgtgggtacataaatatgtcagtgtagctatcatggcacaatggttgctttttttggcaaaaactgaaaataatttttgacttattggatttaaattgaaattacttgtcccaaacaaattccctctccaccctctcatttctgccacagtaacctgtatgcaaatggtaaattactccaggaaaatgcaaaatgcttatcatgctgtatagtgactaaaaacaattccaaacacactggtttaaagtcactgtaagagggcagtattttaaagacacactttccacaaaaagaagtgtgcctacaccacagggtgtaaagccgcttctgagatctaaaacttagtgggctcagcacacgaaacctccctcctggtgagtgttaaatgtgttcattgagtggctggactgggcatcattttcaatgtttattttaggaaaataaagcacctctctgcaaagccgcgatagcgtagctgaagaattccatcctattaggaagcgcataacttattctccttcctgttatatgcaaagtctaaaatagaatagtgtctggtttacacaaatatcaacttttgaaacattatccgttggccaattataatcgggataaatgttctaacagctaatattttatatacatttcctattgaaggaagtgctttgtatgttgtaagtaatacattagtccaaaatttgttttaatcaaattaaattatatatgtggcatatgtgatatatatactatgtccactgtaaataaaatttcgaacattatgtgttgtttctttattaaaaaggagaaagaaagcctacttgtat

SEQ ID NO: 38033 - DNA, 1224 bp, Bovine  19866880868047
ctcctctacaaatgccatttctgaaatgcagtggcccaaacctgcattttcagtatgcttccttcagctctgcacattgcagttttgaacatagttaatgcttgctaaagattaaacaaatttggggaccaggttcagagaaaaagaaatatgaattccaggtatccttacttcttgtacagtttggctttgatacttattaagggctaataatctgatttttttatacctcatttctcatctgcaaactggagttaaaatggtgatatactatgtgtgtcttataggattactttatgtatcaaaaaacatgagattattttgaaaactgagcagtctgctacaaacacttggcgatgttactaatctgtatcttctacactgtggataaggctggtgtggtatgtagagtacataagcattgtgtaagcctgcttttgcaaacacagggtggcgggaggaaattggaaccctgggtaaaatacatagtaagttccaaatgaacatgagataataaaaaggcttgtaatatgtatttatcagtcggcttatggaaataagcaagaatgaccatctatgaatgtgaccttaaaaactgttaccaataagtgaatatctctgtgaatatagttaaatatcatcagagaagaagtctgagtcactgtttacccacaaaaatccaaatttatttctcatttactaaaaaagcaatgaactaggtatctttaagacacaaagtgaaatgcagaaacctgtaaattatgttcccaagcatgttaagataacactcatgccagtcaaatagttctacttttttatttcttatcctgcaaaaacatctctttagtataggtggtattttacttctaagatgaaattttaccagcttaacattttttttctttaattttcctcccttgctatgtcttgctaggtacctaagaaggacaaagctggaacactgaaggcctgatcatggcatttatctaggactctgggataaaaggaatcaaatgggtggacccatccacaattaatcatgaatggtgatgtctttattggctactgaccttgcaatgagttgcatgagttataagaaggttctctgttacctcagtccctattctcttgaaggaggatataaatcacttgagcctcatgaatttctcatatttacaaagtagtcttccaaattttccacagaggatgcaggagaaccactca

SEQ ID NO: 38034 - DNA, 1480 bp, Bovine  19866880978147
tttgcttgctaagctattgaaggtagatgtttatttaagcccagaattatttttttgcttcctgtttcagagtactctaagctaatcaagaatataattcattggtggcaaacttttggacatgattttgcaagaaatgtaggtttaaatgcactatgattttcacttcaatttgctaccataaaggtgacatctatatgaaaatgatatgcactttagagttcttttaaattgagaacatatttcatattttccaaagttctttaaatatgaataatttgagttttgcacatgcattccttgtactttgcttgatttttaaaacagaatattataaaatgggattgagtgggaaaacatggattttgtgttgcttcattcacttacagttaaaaatattcttttgataaaaaggaagagaaagaaaaggttaaggcagaaaccaaatcttgcctactgtgtgcacaagtacatacatgtgtgtgggtaaacatatatacttataatttagagttgactgtgttgccagtggcagctctgaagccaaaggggttagattgtggggcaatatcatggcattatggggcttacggggcttccctggtggctcagcggcaaagaatcaacctgcaatgcaggtgatgcaggagacttgggatcagttcctgggttgggaagatttcctggaagaggacatggcaacccactccagtattcttgcctgaagaatcccatggacagaatttatggcatcgccaagagttgaacacaactgatgcgactgaacactgcacaacacagcacatcgtggctcttggtcatcacacagaagattaaatatttctgtaaagttgtggagagcagtaaactggggatttaggctcccattcttcaaacactataaaacagcaagaaatgaacaaacattcacagcttattacgaaatctgaatttttccttatactctcctctttggattactatatgcatcctctttccctatctacacttcatcatctcacacaggagcccttctgatttttacttttatctttatacctcactaaaattttatttctttttatttctatttcatttttatgctatgtatcttcaatttcttctccaaaccctagttactcccttaactaccacacatcaatacccctttcattctatcactatttctcattttcttttatatttgatctttctggattctgtgctttgatgtataagtgatttcacatatatctgaaccaacacttatcaaatagataagcttttgctctaggatacagaatgatatgcatcattatatcctgggaagaccatgtgataagtaagtgggatcatttggggaaagcaactgtgtctatagttacatgccataattataaatgtaataattatattgaattattaaatctcatgtttaaatatatgcatacctatgaaaatatcttgattatgtagtaat

SEQ ID NO: 38035 - DNA, 2204 bp, Bovine  19866881036357
ttataacctaagtatgatttttgcatctgagagtaaaacgtccaatgtactgttgccaatatgatggttctcttgcctattttaaatttgataaattatgggggtgccagtaggctctacataaagagcctactacaaaaggcagcagctttacttgcttagaccatatcaacagtattgtgcccatttatggttactgtgtcttgagaggccacaacagaaagcagtgtgaccagattgaataatcagtactgaaacttattttcttaagattggttgaaggaaatgaagacatatagagaagtcatggggctttagggatgctgtctttggatattaaaaaggatatagattaattgttcattgttctaggagataggacaaaaagtttcacttatgaaaaaaaagatttacagggcaaaaaagaaagtatgaaaattagcctactgagaagctatgtggaccaccaggctttgatatctcactataaatattttgactattgtctcccaggtgtgttatagagtatttttgtttttttacatttaagacaatttcataagcattgttattatgagtagtagtagttctaactttcagcatgaagacaaaataaaaataaataatcccaaggagtcattttatctaaaacattttatttgatattttattttggaaacatgtaacttagcaagtttcacaagtttatattcctttccaatactatacagaaacaatgtaactgatgaattagttttttgaaatctgaaatgcacacatttgattaaatcaaatttagatgtataaatttgggtaattttatacatgattgtctatttgagtaacacttcattaatcattctgttgtgcagaaatggccgtaacattccagggcacagtttaaataacgttcagtcttctttcttggagtttaaattaatcctttggcagatctaggcaacaaaataataaaagcattaaattttacttctaatacattaaatttaaaagatcccagggaatcaattttgctctgtattaacacattttccagtgattaagttcatgtttacttaagacaaaatgatggagccaaagtattactgttatactttataataaacaactatgaaacacttatggagagatttcacaaaactttgtctttttctttttcttttcactgtttattttcagttctgtagtgtctttatattctttttcattattgtcatcattcttattcattatactttccaaaacatttcatatccatcactagttatttgtacttgaattttcagttgtcatttcaaacttgtcagtgattaaaactgagcacattattgtttcttccataccaaactcagctgatttttctgtttatcttaatggtaatttctgttttaaataatcacacaggctaaagagctgggagagttcttataattgctaaggcaatctaatagaacaaaaccagcttacacacaatatggaatattattttacagattcatttaaagttataacttagtttttaagcattcgtatattatattatcttcccaaaatttttatgacatgaaataaaacctcagttcataaatgaggaaattgagagccaaatttgttgctcaagatcagaaaagctagaaaatggcagagtgaaaatttgaatgcatgactacacattcttgatctttgtactgtattcatttaaggggctattattatcacatgacaccaatgcatatgcttactttatctagtaaaaatagaatgactttgttacttattataactgtaaataaaattattactaaaaatgtgtctaataggtaaacctcagttgaatatacatattttatgtcagatctgaaatactgatacgctgtatggtcagagctcttgtttataattataacccttctaacattaagcaggtgactggactaaatgtaagtcagacataaaatgccctgcatgtagcaacatagcgaatcaagcaaattatcaaacagcaaagctcattttgtcctctgggcaatttctgctgccagcacttatacatcaaaacttcactcaatgtacgattgattttattttattttggttatttttaattccctacagcaagctatgttacttttgtagaatgctgtctgcatcattagtttcctaagaaattatagttggtttagtca

SEQ ID NO: 38036 - DNA, 897 bp, Bovine  19866881046806
ggcatctgaaaggaatgtacctggactatattatcttattttctggaaaaatgccttcactgaattatgatttaattttatgccctccacttttataaaaggtcatttttgaagaatagtcattcatccatttgcagagccattctgtatcttttgcaaaagctagtgaaagactttgaatatcacataacccgaagtctctcttaagagcattcatgtgacacatttttcctatcatttagtgacagggaaatatatttttttccctccagttaagtttctattctgcttttggaggagtatttaaaacaatgtaatccaaaatgttcttctttttgactgttttaaaaagtgcaaaattaattttacttctttattgttacaattagttcatcctccaaaaggaaagggtcttttttctgatcttaggataaaatatcatttgcctttcttaaacaatggtttgttcttcacctaatggacactgactcttctcccatcatgtttccgtcttcacattacctgcaagaaaacttgaagacaattttgtgccctagctccactaagtgcatcaggcttaacgggatgccttttgtttagtaatctctgctggatcatctcactccttcttttgttgcctttactgtacttcccttgttaggtttgctgttgcacatctgaccatagagttaatgtctgcataaaccatttttaaatagccccttctttttattggttaaagaaaaatgaataaacaacttggaacagctatcacagatttttggtacatggatattcttatatttattattgcaactccattttttgttttccccctttaaaatcatgcaattgctttctgggagtaggcgtgatatgaggatattttataatatt

SEQ ID NO: 38037 - DNA, 965 bp, Bovine  19866881052836
ttactttactaagtatgataatctctagggtccatctatatgcatatgtgtcagttgctcagtggtgcaactgcaacccccatgggtggtagcccatcaggctcctctgtccatagaattatccaggcaagaatactgaagtgggttgccatttccttctccagggggttttcccaacccagagaccgaacctgggtctccaggcattgcaagcatattccttactgtctgagccacctgggaagcccacatatgactatatctggaacatatattttctcagtttctatatgattttgaaaggaattgaatttaagaatgctgggctaccaaagtggttccagccagctctccccactagaacaccagcaagatgccaataggcttcaccaggagctgtgactcacattggggaaattattttcaacaacagaagggcaggcatttttccaggagagcatttaatcacttctgtagggtggggtacaatttgaaaaatgcctctgaacattcctggtgtacctccccattgaaagagagcatgtagttctctggaaaaatatttcttctctattaaaatctggattggagagggtacaatttgaaaagcccctgagttatttttacacccctataaccaccccttcccacacactctctgggggtaggattcaccctggccagctgaaaaatcatttcagtgaccccttgcaaatacatatattttccactgcagttgaaaaaatcttcatgcctatgatctgcatgataaatgaacatccaaaagtatgtcagcctaatgttgaaacgattacacgatttatatgtggttccatttgaaattcatgtctttgatatcttggcactctagtaatatattccttttcctaaaaccattttacaatcaagttattctaattaattttcaggaaggattttgccatttatatatatatatatatata

SEQ ID NO: 38038 - DNA, 4116 bp, Bovine  19866881138467
cttgggttttttttttctattattttccttatagtttatcacaggatattgatcatacttccctgtgctattaccttgttatttatccatcctatataataatctgtataataatctacatctgcaaattccagactcccagcccttccctccccacctctctcccccttggcaatcacaagtctgtgggacagtgtggagaggcttcttagaaaactatttactaattttttcttgacccttcatcagccacctctcggtgtttggtatttctatgtttaattcttggcaacatctcataaggaaccctttaaaacagttccccaaggatggtcactcttttcctttgacctcttttcttcctctcttgctgtgaaataaaactctcagagctatttgaatacatcagtcaaagaaacaattatcagtaaaattgatgaattataataacaatatcttcccattttgtaatactttttcatttttatcattggaatgaatcattttgtctagtcagtaatgactagatgaccaacatctaaacaattttaataggtatttttggaagaattctttctagaagtttagataacagttgcctacttattggccaatgggggtttttttaaacaattttttaatttttcaaataaataccatttttaaaaattactttccatttgcacttgttacaaaatattggctatattccctgtgttgtacaatatatacttgaacctatcttacacgatagtttgtatctcccaggcaatgttgttttctgaggcttaacttctgtaacctaggagcactgatgaccttcaaaaggctgttgtgaagattaaatgctaaaatggatataatgacatgttgtgaataataacgtgctgtgcacacctgagttactctcactctctcctctgtagaggagacatgctcctctgtagacatgctctcctctgtctgctaacacccttgccaactctctcatcctttctttacctggacaacaccagtgggctgttccggtggtcaagtgctttggaaatcatcagcagttagagctacaatttagaccttactttgctgaaaggatgaaagtaatcagaagggaacttccttagacttcaccacactgacctcctatgggcatcttcatctccaccccctgcttctgtctagagccagccctgccctggtgcctccatcccacccctctcccatctgaataacactctaggaaccctccctctgcttcattagtgtttcattctctactcgatcattaccatcagcaagtaaacatctaatttctctccttccattctcttttaaactcactttgatgatccatctgactttgatcttgcaatgccgcttggttagaggccaggttgctaaagctggtggtcagttctcagcttccatctccctgaactattagctgcatttgacataaccactcactccgtctatcttgatatgctttcctccaatggctttctctacagtgaacaggttttccttccatctgctagccttcttctttgctgattcctttcctcaggacttttaaggatgaagcgaaggtgtttgggactcatcgcttcttcatctacacacactcagtaactccagtttcacagatttagagatcatctggatgtaaagagttggacacagttgctcacaatgcagtggttagatgccaaagacttccagatttctgtttccattccataactctctccagactcataaatccaactgcatccccaacatttccactgggccatacagaaatagctcaaacaccacagcaatttgcaactcttgctgcctgctgacctagcaagtgatggtaactccattcttctaggtatttaggccaaaactcttggatttattctcacctccattctctcactcacgccttattttcagtgagtcaggaaaccctttcgaattgatctttaaaatatttctagaattcagtcacttttcacacctccactgctaccaccctgatgagctgctctcatttcctgcctgataaactgtaatagtctctatctggtctcattacttttcctcttgatcacctaacaaatctgtgaattcctaacacagaagacagagtgatcctataaaacacaagtcatatcatggtgatcccatgctcacaaccccaaaatggctccccgtttcttacaacggccttgttccttacaatggtgcatgagacctggcatcccagctcttctctgaaccttctctgttgcaatgacactgacttccttgaagttcttcaccatgccaggcagagaggggcaatttaggggcatttgacgggttgttccctccacctggtttactcttctcccagataatattaacttcccatctccaatctttgttcagataccctcttgttaacaagacctgttctgacaactgctttcatggctgcccactccactctccttacctcactactttttttttcctttttttttttttttttaagatcttttacttaagtctttgtgtgtgtggagtataattgctttacaatgttgtgttagtttctgctgtatgacaaagctttatgtatacatatatctcctccgtcttgaacttcccttccacactcccatcccatcccattaggtcaacagagtaccaaactgagattcctgcactatgcagcagcttcccacgagctcggacgtgactgaaatgacttagcaggcgtgcaagcattggagaaggaaatggcagcccgctccagtattcttgcctggagaatcccagggacaggggagcctggtgggctgccgtctgtggggtcacacagagtcagacatgactgaagcaacttagcagcagcagcagcagcccacgagctatctatttcacacatggtagtgtatatatattaatgctgctctcccatttcactccaccttccccttccccccacccatgtccacatgttctctacatctgcatctttattcctgccctgcaaataggtttatctctaccatttttctagattccacatatatgtgttaagatatgatatttgtattactctttctgacttaattcactctgtttaatagactctagggccatccacatcactataaatgacccaattttgttccttttatggctaaataatattccattctatgtatgttccacatcttctttattcatccatctctccatggacatttaggttgcttccatgccctggctactgtaaacagtgttgcaatgaacattggggcacaaattctttttgtttttaaaaagcattttcaccttacaatatgcaataaaattatgtatttgttatatttattgtttacagactatttcctcctattagaatataaacatggtgtgaggcagaatctttgttttgttcactgctgtatattaaagatttctgaacagtgcctgacacatggtaagcacacagaaatacttctgcatgaaagaaagcagggatttcttataaaatgcatcctgtgttttaaatggactttagcagttgtcctcaatcactcagttgcaaattcctttaaggacacatttttatctctgtatccgcatgagtaaatgatggactaaaacaagaaaggagggaaggtggatgttgattgctaattacacaactgctcttaactttattcactattcagatgcttctaaaagagaagatttttaagaacagaaacctgaaggaatgaaattcacacatagtcacacaacactgtaaaacagatttgctaagacaaaagtaacacaacattgaaaatatttaggcatttttcatgcttatatggtactagatttatgtttaaatttcttcatcaatagtaataagataattcagtagcgatagatgaaatttcacacaagatagtcattaatttttacagatatcatctcataatgaccttggaaaatttggttctgttgttactagacaaaattttataatgcacaagtattatactatatgtcatgtgagctttcgattaaggttaatattactgaaataactacatctgctttcctctcactgtgatgttatca

SEQ ID NO: 38039 - DNA, 1072 bp, Bovine  19866881144948
ttggggatgagcagatatatactaccatataaaaaatagataaaataggcctgctgtatagcacaggaaactatattcaatattttataataacctataatggaaaagaatctgaaaaagaatatatatatgtataattgaatactttgctatacaccttaaacattgtaaatcaactatacttcaatttaaaaaatcttgaccatagttatttcaagattatgttaaattcaaatatgccactttaaataatctcattaaaattagttgaaggactttttcaacacgttgtcaacattttgtataagaaccccttctcgctctctctccccactccacccccagtggctcagagagagagactcacataaacacactagaagcttggtcaggaaattagacatcttatctttgggtctgttcaataaggaccaataacctaggcctgcagcactcttcatgataactgcctttacaaaatgaaattttgacttcttcacagcttagctacaagaagacaggatcagtggactgcatttctgtaaatatgaggatagtgaaagatttcagcatctgacaggggaataaacaactgataaaaaaaatctttgaaatgttctcttagtgcaagcaacattttttatgtggacttacatttttattattgtttactttcttgatagactgaaggtatactaaacatgaagcacataaactgaatgaagaatacaaatatcaataactacaaaaaaggacatgaaccttttaagaaatacttgttaaggtccaattatccttgatattttaactgtgctcactctgttgaggtttggaatcattgagtaatatttattaccttaataacatcaacaaaaatcataaagaaaaggaaaaaaaatcttgaattatattgaagttttacaattaacaaaaatgtcagcaccagatcttttagcttctaaagagtaaatgatagcttgatagttttcaaagtcaggaattgcagctacgtggacgaaaagaaagaaaaaaacagcatctagattttaaaataatatatcctaaatcttag

SEQ ID NO: 38040 - DNA, 1798 bp, Bovine  19866881172655
cttaatactctaatgatagtatacgaaagcttaaaaaaggaagaaaagaacttgaacatttattgagggcttttgttttgtaccagtaaatatattctaagttcagtatcagagtgtgcatgtgtgtagtcagctaaggtaggtatgttgttaccatcctcaccttacagacacagaccctgatgatgcaaaatgagataaagtgactgcctgagttcacactactggtaagcaactaagtgaggtagtccaacatcatcaaacttgagctcttaactattaaatcttattcaactttttgattatacagtaagctaccctatggcaccccactccagtactcttgcctggaaaactccatggacggaggagcctggtaggctacagtccatggggttgctaagagttggaaacgactgagcaacttcactttcactcttcactttcatgcactggagaaggaaatggcaacccactctagtgttcttgccttgagaatcccagggacggggggaagcctggttgggctgctgtctatggagtcacacagagtcggacccaactgaagcgacttagcagcagcagtagcagcaaattatatatatattattttataatcagttatataaatagatataatttgcttttgccatatactattattatatattggagaaggccatggcaccccactccagtactcttgcctggaaaatcccatgggcagaggagcctggtgggctacagtccatggggtcgcgaagagtcggacacgactgagcaacttcactttcacttttcactttcatgcattggagaaggaaatggcaacccactccagtgttcttgcctggagaatcccagggacagggggagcctggtgagctgccgtctatggggttgcacagagtcagacatgactgaagtgactcagcagcagcagtattatatataccctaaaatgtatcctctgtttagagccattttgatagctttttaaaaaataatgcattactaagccatgaagctttggatcctaatagaagttttgaatccttctattcaataaatttttgaaatctactctacagcaggcactctctgagttttagtacccatagtaccccatgagagaaaatgtctctgcctcagaggacttacatttcagtgaagaagatgcaaaatatgccactaaacaaataaacagatgacaatattacataataaacgacatgaagaattttaaggagggaataaaaagtttgagtttggagggctagtccagacaagatgtgaagagaacggttttccccagtgatgactgaacaaaggtgaaatgaatgtaggagtgagccatgcaaaacctgggaggaaaagcattcaggagggaaacagagagccaagtgcctggtgcagaaacaaattggtgccttaagaaataaatggccactcacgttgtatataatctcagtagggagtggcagagaatgagccctgagagacaggtgagtattgctaacatcacaaggggttacataaactatgtcagataattacacatggaacaaatcagtctaattttcttcacaatatttaattttaagatacacttatgtgttgccctcacgtagtattaaacctagatattctaattagaagcaattgaacctgcatgccaaaaatatttgtcttcctaaatagtttaattaaacatagaaaaattttgctttactttgactatttatcttagtgaatacaaagtgactgcacaacaggaatgaagatatttgataagtgg

SEQ ID NO: 38041 - DNA, 1809 bp, Bovine  19866881200174
cccaagaatactggagtgggtagcctatcccttctctagcagaacttcccaacgcacccaggaatccaaccggggtctcctgcatcgcaggcagattctttaacaactgggcttccccttgtgcctcaggtggtaaagaatccgcctgtgatgcgggagacctgggttcaatccctgggttgggaagatcccctggagaagggaaaagctacccgctgcagtattctggcctagagaattccatggactgtacagcccatgaggttgcaaagagtcggacaggactgagcgactttcactttcagtttctttaccaactgagctatgaaggaagcccattatagggattaaatgagcttacatatgtaaaagaacttactaactgaaatctaataagtgccaatagatggtaacaattactaacactttaatatactgaaaactgtattctcattaatgtgtgagaatgtgcataagtgtgtgtaactaccccaaatgagaaaaatatttatcagaagccaatggaggaattaaaatcagaaagaccagagacaaaaattcaaaaacatcaatcagttatcttttgctaccttgtttctttaatcagacttaagcctttgctaaacacaaggtttcaacaaccttgacaattaaactactttaaataaaattcaagaagacaagggggaagaggaggagaaaacaaaaaaaagggctaggttgaaagaatatcaggttggggagcaaaacttgggttcctatgaaaagcattagcagatctttaatgcagccattaaaagttttctgttcaaagagttattggagaaagtactctagttaacaactgaacaattaaacataaactactatatcacgaaacacaggagcagtcagactcagaaatttaagaaaatgtatttagtggttgaggttaatcagagtcccacattcccttaagaggccagttgtatagattagaactctactaggcttttagagtgaaaacagataagaaataaattttagagacagcagttgttcaacattttaaagaacaattcatcattaatttgctaatgtttgatataatttgcatggccatctcaaaaaatatagccatgtatgtttccaaagactgcaaaacataaagttcattaataatcacataatttttcaactctaaaagggatttaagtgactcacttactggcaacagtacactgaggtttgattctctaatgtaaaatcttaggttgcaaataccaaatgctattgttaaaagtctcctgtgtgaagtagattggtgaatacacgtcaaaaaaaatcatgatcaaacctggcacttttgttgacagactttgtagtgaggtcgaaggtgtaattaggccagaaaattactttctcactactaaaattgttcccttcaggtcttgagttatcagtccagaaaatttcattaaacactaaattcactttaagacaactgtcaaaattaagcagaggtgagtcaagtcaaggtcctaatattcaaatctttcatttggatttgagagtcaatgtaaaataaaaactgctatctattcatttttctatcaagactcaactttttgaaaatttcagaaacaacatgtttttttccctttgaaaaacaaaatgaagtagaataacaaaataaatgtagaatttgaaatgcttaataggcataaattgttgaaattgtttctacttcctgttcattgagatcttaatatgaaactggtaaaaatgccaagtggtcacaagtattggcaaatacaatgcaaagagaaa

SEQ ID NO: 38042 - DNA, 777 bp, Bovine  19866881225102
attttttaagctctataatcatgaaattgtgtcactaaattcatgaaagtgacatgctccagctattctcagtggagagtgatcttctggacaatattcacctagatatcttcccactcaggttagaaactcatattctcggactggactacagagagtatttgggctaatactggaagcttcagttctctattttaaccttgagttaagcagaaagagttgtttaacattcaggtaaatacggaacaatgcagacgacaaattaggcagaagcgatgccttgaataaatgttgcagtatgaatgcatgagaatgatggtaaggttgtagccagtggctgaacctgcatctcctgagtctcctgcattgttaggtggattctttaccacttgagccacttggtaagctttagccagtagccagggatcagtgaagtccagggtgaatgttgggaaagcagtgaaaataaagctaaatgggagatggtgccaaattacaaagagctgtgaatacagggtaaggagtttgcattgtatcttgtaaatcgacatctctgagatttgggggcatgcattttgaattgggcagtctgatatttttaagtatttgctcaaggaaagaaattgagaaaagtatcagatattttgataaaaggtaagttctgtcagaatcccacacggatcaagggaagaattagaagtttgcaggctgcctgtggtatttcagtctgtgtggtttctagccaaatgaatgggatgggcagagaagagggacatg

SEQ ID NO: 38043 - DNA, 1547 bp, Bovine  19866881364195
gtcattcacatccccctccctcctcctcgctcccctttagccaactgggaattcaacaatacaatcttgactggagtcttcagactataccattagcttattgagcaactgcacctgcttttaaattttaatgatgcatttttaatatgataaatagagtatacttgaacagttttatgcaggtcggataaactgatttttgttactcttccaaatatcactttctgaagaatagacttctaatcataagcttgatttagttacagaggtgcctgtggctttcaaacgactccctgttttgtcccagtgaacagaaaaatagagattgggagaaagtgtattaagggttttataaatggaaacattttaacttagaattgatgagttaaaagaaaaataagctttaccaatactctcactgacagtgtttaaggaaacttctgtttactgaaacacgataaaggtgacgtgtagaaattaccatggaagtgattcaagactccattattccattgcttaggaaaacagaattcaagaagatttgctatggaaattgcctgattaagccaagaaatcatctggaaatcagactgatttaaaacctgggctcttctagcacatcctagacacctttaatcttataattccacagggagctgacagtgacccaggagtgacagaaggaaagaattttattgcggaggggaagactacgtaatccgtgaagtaaaatagaatacagaggtggaagatcgaggcaattccccaggtaattttaattaccccagttatctagatatttcacagaaagagaagatacttgatttaaatgaatagaatattaagttagtttctgaagttttactttagtttcttaaaaaacattttttgaaacaccattatctttttaggtgtcatttctttgtaaatataaaaatctatcactggataagaaatattttgtgtttcctgaataagtgacattcctcatttgcttaaattttttttgttgttgttctttctgatatgagtgctattgcacatacatttatctttgtgtggctcttttgaagtgttgcatatatattttttaaaaatacagaagaagctgcatagctgaaatctgaaacaatcatcttaaaatagtcttcatttaaaggtaggtatagaaggtatcagaaagtatcaatgttttctgaaaaggagcattagcaaaattgctttaataaatcttatgcaataatacaatattataaaaatggtccaatttagtcctaaatttctcataaagcataacacaaagtcctatagaactacaaagtagtatcttgaaaacacatacaatatgcatatgcatttatatcaaaataactagcgttcaaacaagattacggacaatgcaggcaattttaaaaggaaaaaaaatcctttttaacatgtatatataggaatagagaaaataaaaatcatatgataagaatctcattttttggatgagacaattcaccagaagagtgtgcatttttttagaccaggaagaagaatca

SEQ ID NO: 38044 - DNA, 694 bp, Bovine  19866881373917
tctttactgataatggagaaggaaaaattaaaacaggtaaacgtccattccctgtagaagacactgcatttcaggatggtttttctgagaggtaacatttttgaaattttgggtttggtgacacacagcttgctgtcttgactgactgacttctctccacctattattaattttgacggggataaatgattctgtgatttgggtttattacttggtgccccttaacggttttactttatctgagcactgcaagtggagttaaaaaactggagacacttctctgaaaaactcttttgaaatgagagtgaaactgttctgtcactttaattaccacgaagttgcacagaggtaccaaatttggcaacagagccttagatagaaggtgggttcgggggaggatgctactattgacattgttctgttacagcaattttagatggacaaattgcagttgagaaaatttcatgactcggtaaaatgagcaatgatgacatctgtggatgcgggtctgttcatatctttgcagagcctttagggaaataaatatctcggaacattcggtgaagtgaagctcactcaataaatcaacctgacacaataacacttctggcacatgagccctacttctccccagcaacacctacccctctgtgttcctgtgctaccaaatggtgtctccccacaggcctctaaa

SEQ ID NO: 38045 - DNA, 1166 bp, Bovine  19866881457027
aattgtcttaactagtgttagaaatacttcacctttattcctctttttccttttggaaagttttagtactaacatagggagacaccctaaatttcacaacccaattcaatttttcagctacaatgaaagaataactattcatgctttaaatattttcatttatgaattatttcctattgaaaggtagcaaaagagccatcaattctgctgcacaataataaatgcatgacgagaatgatctagtcattacatttttatctagaagcctacctttagtttgagtattttgaagcagtgagccttttgatttagtttttaaagcctctggcaggtggcaaaattttgttccaacaacattcatgtgatttagaacaaaggaattctttcaagaggtttgtggttttacctttataccactttcaaagaaaatgagatgatcatttctttcacattaaaattaaaataaacataaggggtaggaaaaattacacattagagcaaataattgcacttaaaaaggggcttttcatagatttattcagaccatactttatactcataaaaacaaagtgttcacctgcataactttttcacaatatgataatttaatccttactttgcatgtcttctatttgatattaaaaattcctactttaaattcaactgtacaagctcattactgctttgtataaaacataacaccttatatgctatgatcttaatataagtgatttaggttatacaattactaacccatgtaattctaaaatactgaatagtttttctaagtgcctgagataaatgcatttctgacataactgttacttgagaaaaagaaagtctataaaaaattatttgactaaagtatacctgactttaaaaaccagctttaatttcaattatcatcgaatatgaataggactcacctcttaaagttttggttactggtgttttaattcttccagaaaaaaacttagtgggcttccagaaaaaaaatattttgataaaatattactctcgaaaaaatactcacggtaaacttattttactaagtatacacaaatattttttaaccagcaataacatatatagccctatttcagggccaggagagaatagtttagacatgataaataagatgccaacaaaattaacagagcttgtca

SEQ ID NO: 38046 - DNA, 684 bp, Bovine  19866881472526
tgtgatttgggggtgtaattgtttcctgagcttacaacattaaagctgtgatagacacagatttcaaaataaggaaactctgatggggctccatcgagcctcaagccccaagtagagaggagacttagcattcttcctaagttgggaagaacagcagcactgtggcagtggtcataggaatcctcctgctattatctctgaaggctccagtatcatggatcggaactagaagaggcccagaggagtctccctagaatttataattttgcattaaaccaaaaagcaaaccaacaaacaaaaaatacaaggaaaaataaaaaaggattcaatttgtctgggagactgatcctagacaggtgaaagataagatttcatctcacaagaggagacaggttgtggttgcgagagaaggcaaggtataccggtattttgagtcctaaatttataattgtggcatcaaaaccctataatttggaaaagtaattgtgatgaagatgtttgcatttctgtgatcattttttcttttctttttttctatttagcatgtggtaagttccttaagaaattacagtgtttcagcagtgagaaagaaccgagggagatttcatttgttttcttttgccacacttggtcaaccaattcattctaggggatgacgtataatggtgtttataatactaaaat

SEQ ID NO: 38047 - DNA, 478 bp, Bovine  19866881647808
gtgaaattgtagtatttattatagctttagcttatttttactttaattgctttttttgtctaggaacaaaggatgcaaagacaatatttaatacttttacttaaagaaatattttaatttatgcaaattttatgcttttaaagcttaagtattcaattgaaagtttctataaactgagacacaacatattcagtcattttacttaatgtataatttcaatctttggaacatgatgtattattctttgaagaatttcattaaagtaaaatccattgagcaagtaagatttgaatacattgttgtacaataaattaatttatttcaacagcttaattcttttatcatatttatatgcttgcctttccagagtatgctataagatggagaataatggagacagtaaagaattgcttaggggagaatctcataattattactgaaacaaaatagataatgagttttattcagacataataag

SEQ ID NO: 38048 - DNA, 1571 bp, Bovine  19866881717626
ccaggtttttgtgaacagttgttaaacatagcccattatgaaaaattaaaagtacatacattccccaattagataaattctatttaaaacaagggtaataagtgatcaacacttatcattctaataatttcactggagtttactattattaattctctggatgttatttctctcttttatctgtatgattgaaatagtttataatgatgtactaccttgaattcctttcaaattctccatttagtgatttcacattggtagcttgaaatcaggtaagactggagtacttatgtcacagaaataagcattctttacaaatcagagcttgggatattttttaaatttttaccagcaccccactgtatacattccatctaaaatcaccatagaagttatataaattttaaatctaaaatgaagtaaggcttgaagggattctttttagagaaatacattgagttgacactttctacatcttcagtaaagatgtttgtggaatattattttctcctttaaaaacatgtctgactttatgggaatactctgatgtgtgaattagaccacgtgaactaaatgcaagtctgttagaactcattcactactcaagaatagagatcagcagaaaataagaggtaaaatttagtaggctaatgagatatgatggaattttctgagagttaattcatttgtaataaggaggaaggtctggactactgaatggggaaacaagcttttactatataggaaggtgtttacattacatatatctattgctacaattttgatctttgtctgaaaaaaaaactaaacctttcacaagctaatcatcttccttatcttcttattctgactaattagtaattataaatcccctattttaaaacaggatctaggacacaagaattgttaaaaagttaaatcaggctgggctgaatgcctaaagaaactaaaaatttagtttaacactcctgggatttttatgtatgtctctgtatctatgattgagtttattagacataactaattgaaaagaaaagataaaatatctggaaattaaacctcacataatgttagtcagagataaggaaatatttttttaaatgaaagtccaatgtacagaaaaaaagtctatcaaggtaacttaattagagggtttttttgttttgttttgttttttgaaacaaatttaaggggttcaaacttacctgcacttaaaattaatacatagagacagaaaacttactccctgaacccaaaactcaagtactttggccacctcatgcgaagagttgactcattggaaaagaccctcatgctgcgagggattggggggcaaggaggaaaaggggacgacagaggatgagatggctggatggcatcaatcgatggacttgagtttgagtgaactccaggagttggtgatggacagggaggcctggcgtgctgcaattcacagggtcgcaaagagtcggacacaactgagcgactgaactgaactgaactgaatggagttcagttcgttgctcagtcatgtctgactttttgtgaccccatgaactacagtacaccag

SEQ ID NO: 38049 - DNA, 1949 bp, Bovine  19866881766176
cactcttttcgctgtgctgcagttctaaggaacttggctttcatcccagtgtgtctccagtgtttgagtgcaggctgcggacactgacccaggccatcacgtcgcctcttccttctaaaaacagttttgaaatataacaaaatgcactctttctcagcgtgatgactgtggaagaaagtcataggattcagttctagaataactgcacagaccaacctggctgaacttgttttgtttaagagctgatcaaatctgtatcatcatacaaacttttctgcttgcttggccttgttttaaaaacaataccttcaagctgttgggactaaatccaatattacacaacacaaaggttaaccttttagaaaatattgctcagtagaaacatgaacagtggaattagtcttccaacactaagcattttcatcctgaagaattgctcaataatttttctgtagtagtcatagttttaattaaaacattttaatcacgcatgtgctcagagacagaggtagaaagcaattctaaacaaatctgaaagagaacaaggtattaaaagttccatggaaggtgcggttcaagggtgttgtttcatggtttattgagataaaaaacactgcaaaagtaaagacaagaagacaatacttttggccttttgacttagaaaattttctagaccaaggctttactttgtaaggtaataatatgaatagggtttgtcattgccagtggttgctctttaaatgtttctgaaagggaagaatttctttttaatgagaaatccttatagaggaactaataattccacttactataatttctagatatactaaaaataaattatgctcataaaacatattttagtcctatggttatctgattaaaaaactccagaaaaaggatgattttagacacaacttttgaattgtccatatatttcatttctttaaaaatctctgtgtataaaaatgaagcctacaaatggcctggtaataaagtaaagaggctgattccagactttcttatcaaataaaactggtttgcctctttgcaatcctatggactgtagcctgcccggctccatttgtccaagggattctccaggcaagaatactggagtgggttgtcatgccctccccaggggatcttcccaacccagggatcgaaactgtgtctcatgtctcctgcactggcaggcaggttctttaccactagtgctacctgggaagcccaaaactggcttgaattctcactaaaccactcgctagtatgacgctgggaaacttaccaaagcactctgtgcttcactgatctcatttaaaaaacagagttaaagagagattaacattaagagatacatagcacagggcttccctgatggctcagtggtaaagaatccccttgcaatgcaggaggcaggggttggattcctgggtcaggaagatcccttggagaagaaatggcaacccactccagtattcttgcctagagaatcccatggacagaggaactgtcaggctacagttcctggggttgcaagagtctgacacaactgagggactaagccaccaccagcagcataatatataacacaatggggctgttctgcagatttaatgaggaaatgtctacaatgagcttggtcaaatgatagtaaatgatcagtattatcttactaatgtttactattattttgatcacttagaatacataatataacagacaaaaaaggcaggattcttaaagtacatgaaaaggctaagtatcttttaataaatgccatattctagttttttaatggagaagctatgtaataaagcaatttctttcaaacctctgcaaaaaaaaaaaaacaacccactatttttcataaaaaacagaaaagctaccctacatgcttaataaaagactttaagctaaatagaatttaacaacctaatgtattcactttt

SEQ ID NO: 38050 - DNA, 1178 bp, Bovine  19866881816205
ctaatgatgttttgtagaaatgtgttgtcaagtacccagtcctcggcccaaacaggtaaagttgcaaaatatctaagaatttagtgtgatctaacgttttaaggctggctttaaagagggtgttcagatgtgaggaaagcttttaactattaaattacactattagatatgaatggatgggaggaataaaaaggaaatatagactttcttttgagaaagctgatttgagccttattgcatctttacaaatggtgggaaaaccttaaagctctcttcatgaaatgaatgtctagtgggtttgattgttttttgttcatgatttttaaattttatttttattgaagtatagttgatttacaatgttctgttagtttcaagtgtatagcaaagtgatttatatatgtatatatatgtgtatctgtgtttgtgtatactttttcagattcttttcccttatagattattacaatacactaagtatagtcctctgtgctatatagtaggttatctattttatatatagtaatgtgtatatgttaatcccaaattcctaacttaccccataattcatgacttatttttgaataagaattttaagaatagttgaagcagaaacttcaaaatgtaaggataaatggtacatgtaaggaacccttaatccttatgtatgatagttgtaatttttaaacttgagaaatttgcctgtttacaatcatgagcaaatgcatgaatttggtgccatgtgaagatttagcacataggatgcattttggtttaaaatctctaaatataaaatgttcaaatagagaaatgaggactcctagttaaaaggacacatagaaagtatatatggacacttgtaaaatttcaccgaactgttagatagggtgtttgttaagaatcaggttgtgaaaggacattgctaaacaggatgtgaaagcaccaccaggcatcttacaaatactcagcatatcagaaaacagacaaagattcaacgcaaattttcaacttgttgaaagatgctctttgatattgaactggtatttttttccccataaatgcttctcattggtgtgcctaagtttaagagagatttcaaaatcatatctaagaacttaccatgaaatgtgctcatacacttgaaattttacttctcaagttattatcagaaacatttt

SEQ ID NO: 38051 - DNA, 736 bp, Bovine  19866882007720
ctgggaaaacgttaattgcaagaggacaaggaaaagggctgaaacaagaaatgcaatcattaagtgtaatgttgcagttgtctatgcctcattataacatgcatacaaggcaataaaatgcatgtttcacaaacaaatcttttgacaactatagttcaagagcctccagctgtcttgcttttttacatctttttctcttggtttagtaatcattactgaagcttaactttggattaccagaatagtccttcatattatgtaagaatcggggagattttagagaggaaaagtttgttttaaaaatttaaaaatatctgtttcccaaagttaaccagaatttctcgctaatgttttgttttgaaaatgacacttaatagaggcaggaacgtgggagggatcaactcaatttcaacaaagacactcctttcacaaaccaatgttgaaaatatttagctcctttagaactcctttccaccaagaaaaagcactgatcgaaaaataaggttcatcttccacctttagatttgttaatggtttccctggactacagatgtcatatcctaatttttgtaagggacaaatatagttaatcagatgagaaggtcatcaagtctaagtacagcttgaaactggtgaactatcagactcatgagtaaggcagccagaaaggggggaaaaaaaaggtaacagattcagcattgtccaaaagttccagaccaggattaatgtgtaagat

SEQ ID NO: 38052 - DNA, 1381 bp, Bovine  19866880464344
tatataagattttattttctgaggataaagaattaatgaaagttatgatgccttcctttagggattttaaatgaggatattagatgacaaagacatgaatacacataattttaattcactgttactttcagaatgatggaaatgtatgtacagtgcaacaataatatgaagaaaggtatatgtgtataaaccacagagtggttcacctatcttgtaggttccagatgtattaagactggaggtttaccacaaatcctaatatcacctggacgaggtgaaaagaatgaacaacagatttcttttctaaggagagtcaaaacttcaagccacatgcttgaggtgttgaatattaaatcagcaatcagtcaatggataaaggaatcatttttttccttctgtcttatatagtagcttcttcctaagcatctgaaatgaagcttggtagacaagtaactacatcataccttgcaaatggaacatgctcctacttgagactccttttttatgacagaactcaatgtttccggctttctcgtttcttatttttcgttccatagccccagtttattcttgcctatgatattctgtgatctccttcttatggccttccactatagaaggctgtccttttgcccactcagacttggcattcaggatattccttttgttttgttctaatgacctccgttctgcttaaatttttttttcagtagattcacgtttgtctacattattacctagattgtgacatataatttttcatgccttgattacctggcccagattctcttcttttcttcttgcatcttgctataaaaactttgggattatattagggatatgtaataattttcttatattgctcaaaaatctgatttgtatttgattatttcatctaagtttgcagattttgagcaaagactttatttttattctcggtgtatccgcagagcccattgtgtctagtcctctccttctcccagggccagtgggaagcatcctgactaagtctgtgattagaggattaacatggagcatatttggaaaatacttccagcagtagtgcaagtgaatgctttggtagaggatgaaagacacaaggtgagtcccttggtgtcaggctttcctctcattgcagtgtgatcttctatgcttaggtacttgactttaataagctccattaaaaatacaggtattatttaggagaataatcccctaagaattattgacacaacctctattgttattatatacgttacacattgttatattctactgacataaccattgagagcacacttggaatacaggacaaaggcacagaaaaatgggaggccctgttagagggaagtgatgaaagcattttattagtaccatacat

SEQ ID NO: 38053 - DNA, 2846 bp, Bovine  19866880493892
aactgtatgctaattaaaagaaaccagccacaaaagggccacatattttaaggttccactcatgtgaaatgtctacattaggcaaatccagatacagaagatagatgagtattttccagggacttgggggaagaagggaaggaaagtgactgctctctgggataatgaaaattttctggagttagagggcggtgattgttgcataactttatgaacatactataaaacactgaattttatactttaaaaaaagataaagtttatggcatgtaatttatactcaataaaaaaggagacccctgagaagatgcagccttctttgacacagtgttatcttagcaggtggtgggtggacctacagtagtcatggatgaaggacaaagaggtggggcaggtgtacagaattggagactagaaatctcaagaccctttctattgtctaaatccctccaatgaacatatattacttttacaattcaaaatgacagagggaaaatattgcatttaggtttgagatgttaaaactaaagaaatgttctgacaaatatagttaggaaaagagcagcaatataaataagctaaaattatatcttaatgtgatatttttcccatgaaaataaactgtagatgcctatgtaatatatacacaacgcattaatgttaggttcagtatgcagtgacagtccttatgaaaagatttgcttctatattttattagttcttgaataatatacattaatagaaagagcaccatgctaataataaatgcctgagttttctctgtttctcttatcagttttaccagatattaaataggaacttgggaaaagtgtgactctaactggcaccacatatgctatccatccacatgctgagcacagagaaagatcctctattataacaatatcatatatacatgtttgagtgggaaatgctctttctgaaaaattattaccattttttgatgactagtttccatgcagtatcttttaaatcaaactattatatgcaggaaaagtctgatcccaaagttctttctcactgggacactgtgctctctgagattttcatgagtttggagtttcaaaaaataaatacttacgcaaagacaatgactatgaaatcaagccagttccatgggtcacgaagaaaagtgaattctcctacacagaatcctcttgcaaggattttcacaagtgactcaaaagtatatattccagtaaaagtgtacctaggtaaaagagtccattgtgatattaatccattgtgaaaagaacatggtaccaggtaagcctttataattatttttctcagatcaaccaaaggaagacactgattagagtatggctgatgattaaggggcccattctaactattagaataaattacaattaagatctttccagaaaatcttgaaatgtatatgtcagaaacactcccagaaagtagaggtattttaaagtaaaggtatttactaagaacacaggtatgagatctgcctagaaaattcctgtattgttcctatctgaaatacatccaaggacgtgacatgtctaagaacaggcagggtatctggtaagatctttttttctagaaaagactgtaacatgtattattcttttctaatgttagcaggttaataaaggagaaaaactaattgaaagtacagtaactatagaacatgggaagataatcaccacaatttttatacatgcaataacttcctggtatgaaaaaggaaggataacaaccatagtaagactatattaaaatgtacttatacccacttactctacattcttggtccagtctggaggattactcatggtcataaatatgcagttcgtcagaatagtgcacatgataagcatgctgaatgcggtagcttagagtcaaggaatatgatcaaagaacacatggtaactttgaatatctgataacgacatttgttgaaatgctgacaattttccttagaaaataattctaaaagagcctatagacttaaaaaaaaaaaaaacctctccgaacaaaagagtaatggataaaagcaatttatcctaaaatactaaaattgccatgatgatgatgatataatgaacgcatgcatgcatgctaagtcacttccgtcacgtccaactctttacaaacctatggactgtagctcaccaggctcctctgtccatggggttctacaggcaagaatattggagtggattgccatgccctcctccaggagatcctcctgacccagggatcaaacctgcatctcttacgtctcttgcattagctggtgggttctttaccactggcaccacctgggaagccccaaattgccaaactcccaatctatgcagagatctgcaccaaattatactgagattgatagacctgagtcttctcaggtaggaaagaaaactctatgtttaaataaaatagccaaaaactacattttaaagaaccactgtaagtaagcattttaaaaaggatatgcatgtactaaaatcttaatagatattcttctgagaggactgaaaggagagagcatgtacaaagcaggtgtggcattgaaacggaagattgctttccctttgttcaacactatgaaagtctgcaggagcaaaaagaaaacagtatgaattgaaattccaaaatttcaatctagtacattaatagctacagtttacctctgcatgtggtagagtcatattaaagaaacactgccatcagactcaagcaatatggttccaaagccattgatggagatattcacgtcatgttagccaatgaactccaagtccattgtccatttcttcaataaaataagaagtgagccatttatgggtatg

SEQ ID NO: 38054 - DNA, 4010 bp, Bovine  19866880513394
cataggtcttcaggcactctgtctatcaaatctaatcccttgaatctatttgtcacttccactgtataatcataaggggtttgatttaggtcataccctgaatggtctagtagttttccctactttcttcaatttcagactgaatttgacaataaggagttcatgatctgagccacagtcagctcccagtcttgattttgctgactatatagagcttctccatctttggctgcaaagaatataatcaatccgatttcagtgttgaccatctggtgatggccacatgtattcttcctttgtgttgttggaagagggtgtttgctatgaccagtgtgttctcttcacaaaactctgctagcctttcactgccctgcttctttttgtactccaaggccaaatttgcctgttactccaggtatttcttgacttcctacttctgcattcccgtcccttctaatgaaaaggacatctgttttgggtgttagttctagaaggtcttgcaggtcttcatagaaactttcaacttcagcttcttcagcattactggttgctgaaacattacattcaagaataacatagacttacataaagatacactgacttataatggttttataatttttatacctgtttctcatatgggaatgctctgaaatgtaaaatgtagatattctgttttaaaaataaatggtgacatcgaggtttacagtttagtatttgcaaagttatattgaaggaaatattggaatcatgactagaggtcaagttctgagctttagtacagtgccttccaccacttcattatgtttaacatgagttactttgatagtagatggaagaattgagcataataagcctacatatatttgctcttttttgaaaaaggaaccagcttagccaataagtctaaatgtgtctctgtttttttatggttctcataaagacacactgataagagttcaagagaatgaaccaggcctttgcgtgaagaaatttttagttcatagtttgtgtggggaaaatgggaaattaaattacaaagtctgagaggtttcctataattagtggctattgtattacttttgcttatgacaatatgaggaaagggaaaaatggaagaggaattgctatttcatttctttattattttcctaattgctttttttaaaaactaaaacagcttattcttcaaagaagccaagccataatcatttcatcaataatattaacctgtcatttcattcaggaaatatgaggcaagttttgatcttaattttaagaaaactaggagattctcatctctcttttattgtcttgtaagcatacttgcagaataatgaggtcaatacacaggaaatgtctcagacttatttctgtggatgttatataaatatctacaaaataataatcaattgagtgatgactgcatatactttccaaaaatcttgtcatgaagattctgttcttgacatctgagaaattatgatatcttacaaacagaaaaaagagcaaataaatatatatcaatatatattagatatattataataatacattatatttactttaaaataatgtagaattattgtgttatttcaaggttgactaggaaacataaatgctttcaatcagtggtgaggccaatctactcagtcaatggcacatagaggtttgtgactaggccaatcatgagccctacaattaattcctacagttagttttcctgcctttccttaagactgtgatacttacaggatcatgtttgcaatccttatcattaagaaaacctcccagactcatttttactagcaaagtaataataacaatagtaataaattgagcatctcccagtacatgaatttataccactgctaaattttaaagcagtggtaaagttagtgtaaactactaacatgtagtttacatgtacaactacaaaatagcatatacattaaaatgtggacataaaagattgaaaatttaaaggcaataatttttcaaaaaatcttcaaacatccttcttagatgtgcataatccacttggagacagcagaatatgcccttcccatgttcaaatcacaatttatttgacttgctcaggcctcaaaaccaccaccaaaacttccctggagaactctggaaagcatgtccctatctattcctgccttcatactgcaaaaatacttttagaacacagaatactttaggttttgaaactagcaatttttttcaacatcaaaattaattgtaatatctgtattacatctttctaggtgtcatgaaattaactattgggttggcaaaaaaattccttcagattttcctggctgtaaatgattattatagtaagcatttataggtatttggaaaagacccaaatgaactttttggccaacccaacacaaaatttagtgcaggtgaaatatgtactaaatttatatttatataaaataattagaagactgattttttttctcagtgtggtgaaaaagaaaacacataaaatttttgtcatatccttcaccagttttacagaaaattacatatttgagataacccatttagaaatataacgtggtgttttattttgaaacaaaaacaagaagtctttacatatggaagccccaagcttttaggagacattacatatgtcgatattttacagaactgggaatgtttgtgtttcaaaaaagaagttatagttgatgcaaaatacctgccgatactttttttgggaaagggaaaaaatggaaataaaactttggttttttttgcccaaagaattactctatatatttcaaaatcagtcaaaagacagccttcgacttgaggaacataggactgtattaggaccaagtcagacaaatgagcttttgaaatccagtcctatcattttctgattgtgtgtaatgaattagtgtcttatctaagatcaagtttgctcatctaagaagtgatgacaacaacagtgcttttcctcataatgttattgtgtgcattacaatagacagtgcatgtaaagccatctatttatatagatggtgctgaaaggagtactgaacataagaaggactcaataaaagagtaaaactcaaaatgctaaggttcaattctgtgcttatgtggataactggctagggtcatggaagactgtctgagagtataatatatctttccatggagaaataaatgctaagtgttcctatatggatccaatccactgcattagctttagaaggatcacatttcaatcaaccaacctaaactagcacagacacatacttaattgaaaaatgatcaaccatatcatattatttagaatcaatgaatcatcattaaaagcatattttgatatgctttataaggcttttaaagctttataaagcttttcagtttatttccgtttagttggtcaatcgtgtctgactctttgcaaacccattgactgcagcatgccaggcttccctatctaacaccaactcccggagcttcctcaaactaatgtccattgagtcagtgatgccatccgaccatctcatcctctgttgtccccttctcctcttactttgaatctttcccagcaacagggtcttttccagtgagtcagttctgtgcaacaggtagccaaagtattgaagtttcagcttcaacatcagttcttccaatgaatattcaggactgatttcctttaggatggactggtttgatctccttgcagtccaagggactctcaagagtcttctccaacagtttgaaagcatcaattcttcagtgctcagctttctttatagtccaactctcacattcatacatgactactggaaaaaccagtctagctttgactagaggaaccttcgttggcaaagtaatgtctctgctttttaatatgctgtctaggttggccataccttttcttccaaggaccaaacctcttttaatttcatggctgcagtcaccatctgcagtacttttcagttcagttcagttcagttcagtcgcctcagttgtgt

SEQ ID NO: 38055 - DNA, 1734 bp, Bovine  19866880546508
cctatttgccatgaagtgatgggaccagatgccatgatctttgttttttgaatgttgagttttaagccagctttttcactctcctctttccatgtctggttctcactgttacttcttgacctgcatacaggtttctcagaaggcaggtaaggtggtctggtattcccatctctttaacaattttctagtttgttgtaattcacacagtgaaaggctttggtgtaatcagtgaagcagaaatagatgttttttctggaattcccttagtttttctatgatccagtgcatgttagcaatttgatctgttgttcctctgccttttctaaatctagcttgtacatctggaagttcttggttcatgtactgttcatgtactgttcaagcctagcttgaaggattttgagcatatggtgtgtataaacaattattaatggtcctttaataagtattttgtgcatgattgaagcaagttatttgaaaaacaggtaaattttttgatgtgcagttattagttttcactaatttacaaagagggttccaagttgatatatgttaatatttctattccatatttctctctttaaaattgcttaacaccccatccttgcaatattctttgagagtcttgggcataagcagacattgctattatgaaaatgtccctctctgtggttacaaatgactgaaccaagggaaaataaatccattggatagactgagtatctttttatttacatttttggaaatagaatttataggtgggagtttaaattgaaaaatcaaataaagttgaagcaggggtagcattttgttctatatacattcttagaagtgagcatagaaagtcattctttagatacctaatgcagtaggaattaaaagaaaagccaagaaaactgtgatgtcatgaaaggtataaggagttgtcccagtgattattttgcatttttatatttcagaattaagaaatggactatgtatcctctccttggatgtctggagattatcatttgtgtagttaaaatatctcttacaagccacttatttaaagctgttactagtttgattctcacaatgatttatactccattattgttaaccaagttatttttttcccttactttccactaatagcaagtaatggattcaactattaaaaaactcaattttacacaacagaggaaaattctggattagtgtatctgtgtgtatgttacatatgtatgtgatttctgtcttatgacataccatatcaataggataaatttacctaaggttggcactataagagacaaaatatatatacagaaaatgctgcaatatcaagtacaaaatttctgatcactgcttgcagtagtagaattgcagtgagggttaaagagaatgtataaagaatagtcagttgtcactgagtagagtcacttgaagagttggttttgacagaaattgggctggaaaaaatcagcaaaagaacatatttctatgtaaaaggaaataatgtttcataaatggagaattgatacatgaaattatatttaatgaaggctaattcaagtggcctgtagaataacttgaaatagataaagactagaattgagaaaaacctgtaaagactactggagcaatccacagatagaattacaaaaatggctaccttgatgtaggtgtatgaacaatggataatatttaaataactgaggaaaactatgtaagaaaattattttttctaaggaa

SEQ ID NO: 38056 - DNA, 1038 bp, Bovine  19866880579831
cctggggagaagtttttaatttgtcaaaatagctgcctatgacttacatttgtttttagatatcttttgtgtacatttgggacagctcccatctgttatgatctaatcaatttatttgtcgtatatatgcataaagcattcacaaatgtgttctatttcccaaagagaaggatacttagagtttgtgctaacttagcatatgttggtgctctaacagtctaaggtatactataaggtaaaaagcagcaaaatatgcctgataaaacacactcactttcttattgatatagtagggatccaggtcctccaggggctctgacaccatctctggagggacgtctccataaataaaaggaaggttctttccggcttccaagtcactatttggctttgggccatgttcatcatcgtctttcttgtctggtttgggattcttagccttttcttctgcaatgcgtctttcaatagccgcaagggattctctggtgaagaagttgaagctgtcaggtcctggtggcacaagcactgtttgctccatcttgtcatcctgcacattttaatcaccatttactctgcatatgaagtcctaaagagaaagaatacagatattttaaggagctttaaagatcttaatatctgcaacctcctgttatgcaatacaaactagaggactgaaaagttcgtttccaattaaattcaaatggaataattaaatataagttctttttttttttttttgtagctagaacatttaacttgagatctttagcatgaccctttaagcaaacttttaaacatgcaagacagtattgtcaactataggcacaaagtcatttagatctctagaacttattcatcttatgcaactgaaatttaatgtcaatgaacagcaactctctattttcccctcccccagcttcttgcaaccaccattccactttctgtttctatgagtttggcttaaccaacatgttttctatctcagcttttttgttataaacgtcccatgtttattaatccaatccttatgctttgctg

SEQ ID NO: 38057 - DNA, 1853 bp, Bovine  19866880588660
tgatcttcgtttctgaatgttgagctttaagccaactttttcactctccactttcactttcatcaagaggtttttgagttcctcttcactttctgccataagggtggtgttaacaccatttttacacagcaagtacaatcttgatagtctttacagatttactgttatgagtgatgcctatataagtctaacttttattcatatccttacacattactataacctatataaaatttttatatacttagagtagacctctgtggtttcctacattatttgcttggtgagaaagatgacagagataaataaaaaagattaaggggagcaacagccaagagaaacttaagaccaacagaataaaatcatcagtatgctgaaaacaacaacattttccctactttctattacttaacaattgatgggcagaaaaagataaatggcaaagtgaaaaagatacaattttctctgaataataatttttttctgtcccatggcaccttctatttgacatctgctcaaagtctcagctttacatccacagataagctctatttttataaattcagaaaataaggtgtactgagatgataaaggctatggcgggcaggggatcccatgactataaatcttctatcacatctattcaccttaataaaccaccttagtcttagatattgtgaccatgtgcccttaaacagtaatatctaaaatgattactttcttcaaggttacattttaaatgttaatttatgggaagcaagagctctgtagaattatcatttgcagtatgtcaatctcttactttgaagtccagggaagatgtttgtaaacagtgaaaactcaactttatttatttatttttttgcaatcattttggtttcaaaatacatcaaaatatacctcagagacaaaagagtcatattataatatttgacatgttcttcaaacaggagtggtttcttatgtttataagacatttttgcacaccttccttagattttgatgacataatttacaattataatacatttccccagtataaggaaaggttcagttttcatatgaaatcaacttaaaaatactttctcactggttcttctgttaatcagatcaataataagcaatcattcaataatataacaaattatttatttatatttgaaaatatatgtgtatcccaaacttaatgcattattttatgactctttttaaatttcaaaataaataaccaaattaacaccacaaagttattgccatgagattaaaagcctaatatggaacgctaaaacgttcttttataaaaatatttataatttttctttaacaatacctagttcaaaattaagtggaattttttgataaatttcagaaaatatgtttacacacttaacaaggtttcctcaacagtcaaaaaacaaaaaaaagacttaatattttacattagaacttcaatattggtcctatgtaaatggaaagtgtcttactgggagcatatgaaaaagctttactataatatcttagactttgtgttaaagacagatacaggcatgaattttgaaagagattctaacaatttatattaaaataataatataccaataaaattcaaaatgtaaataatgcaaaattcaaattcaatactataataaaatacaaataatatgtgcatttgaaattaattgccatcctcaaaaacttagccatacaaaaaaatatactaagtggtgctttgattaataccatatggaggtaacagtcatttggtgcaaataaaactaatgctttttgttgttattgttttttctgcatttagacataatatcctatatcaaataaaaatattaattcaggtt

SEQ ID NO: 38058 - DNA, 3741 bp, Bovine  19866880619825
tccttaatgagctggctgttagttttagagagcgtatttttttatatacccttacaacatctggttataaatttataatttatttaggaccttgattttatatgtattctgtcccctatttaaaggtgagaacctgtgcttatgagttcacctgtttattagtggtacttaatgtaaaaagcattttgcagtgtgtgagtagtatcgccagtatgtccaaaagttttaacacttatttaataatttttgaggcagctctccttctacattttcccacattgcctattaaatataccagccatctggaatcctagttgtagttcaagaattcatttaaataaaatcccgcaatttagttggttgataatccattatgtaccatgttactgaagaaacaatttcactgactaactttttagagaattaggccatatgtaaaatttatccattggccacctagtctgtagatgtatcagaaaacaattgaagtgtctgtacaagtatgtagatatatacttcttattgaaagggagtgtacagtacatataggaacaaagtatagcatgtcatgataagcacagttgagaaaataagaaaaaataaagtataaattagttgtgtaaatcaagcatttaaaaaactataataattattctgccaagatttctgaatgaaaagtcataaattgatagtttaaaataaaatgtataaatcttctttcttgcaaatttgagcttaggaaatacataaattatttcacacatgttaaaatgtccctagctttgattataaatcaaacccaaattgaatatattagtagaattgagttgtaacatgggccttgatattaaaagctgcatgatctttatcattctcagtttctttcagaaatcatttagaaacaagaggatcgggtgaatcagagttcacagaacagtggtctctgtcttttgagtgtgtaggtgctcagttgctcagtcctgtctgaccctttgtgaccccataaactgtagcccaccaggcttctctatccattggcttatcccaggaatactggagtgggttgccatttcctcccccaggggatcttcccgacccagggatcaaacccacttctcctgaagctcctgcattagcaggtggattcttcaccactgagacacctgggaagcccctctctttctagtacgtgaatccaaatatctctatgtggcagccataggtctctatttacttagctcagctgattatcttgaaaatatttgtgtttgtctcttttaggtagataatttcagtggtctctttctaagctagaattttatagaagaaacaggattctggttgcctgaaatttgacagttgtcctatttgtattactagggatatgcatcagccttctctttctccacacaatgatggtcatcatggtggtttccctgtaaatttctgattgattatccttaacatagactttaggcattgtacaggaaaaactgtagctaatgtaaatgttcctttctcctgaataaaaataaccagtgacctctaatggcaactgaggtgggggactttttgcagataagtgattcacccattaacagtatgtcattgataccatttccagacatatgctctctggaatttggtgacttgcagatgtttcaaggggaagctgtcagcagagttgtccttttgatatgcaataattccaggatgtcctgcatgtatcatcacatgatctaatcaaagtcttaaatctagtaggtgaagagtaaatacatatattgtgtctttagtgtcacttcaataaatattgctgatgtgacaatcattatggttttttggtcactaaacataggtgccacaattcaagaatataattaatatcctcattatcaatcattgcaagtcagcagtaacttattgtgactcactacatttatttaaggtgaccatcaggatgtaaactttggatgtattttgatgtatgtatcacattttctagtttctgagtcacttactgaaataaactgaaagcaggttttcatgcctactttgttgtattctggtattacaattttccattttttttcttactgtctgtaccagtatagttgtgaaatatatcttagtctttgtgaaggtaaaacaaaatttttttatctaagattcactgtttgtaaaaggtgtctcattttgcaaattgtttttgctggattgattgatctcatttgatattcatgtcagccctaagaagcaaactgaaatattatcacagttgtataaataaagatatcggtggtcagaatgaacaagtcactcagccatcatcagcttctgtatggcagagcagcctcttcctgatgcgcatcctgaacatctttccatcatgagcatcatctccttaagcaaagcatgtcagtgcaaaccctcacataatacaaatacagagtgactagctctcaaactttaatgtacactgaaatcacctggaggtcttgttaaaaacatatcattatgttctcagcccctacagataatgacttgaataggaactagaattggcactttacataaacacttgtaggtgacaagtggacagaaaatcacactatgtgaaattctgattttaaaaaagtatgccccaaatctttagtggtttatagaataacttagaaccgatgttatttgaacataacagagacacttatgttgggtaagttttatgcctgagtgtctagaatttcttatgtaaaacacaagctgatttagataacagtgcatgctgtttcttgattacattacttcataccctcaagtagtagaagcagtgttcttctgtgtgcatatttttgaatgcctaagattaagatgaatttatttaagccataatttctgttctccttctctctctcctcactccctttccattttactgtgaataagcaggtggtatggagtaggtttatgacaggatttaaaatgaaaagcaattagaagagtaattaaaatggaaactgacaacatgtctcgatgtgcttgctgcataaagtataaatattccaggaactttttattcagttactaaaaaaattatgaatcacagggaagcatagagtgtttgctctcaccagctccctcatcactccattgctttatcagctgtgtcctgagcaagagccaagaagggaaatggaaagtatatttatttagagaaacaactgctactcccagacaatggccaagaaaaaaaatcctccatctattgcaaatattgaatccttcactgtgttaggtgaagaaatgacctttataatggattatttccccatgaattaagcagaactcaaagttctgaagtgttaaaaacagacggtgtgtagagttccactttcatcatgccagactgagctccacaaacctgttctcccatgaaactgatctctggtctaaaaaagaaagaaagaaagaaaaaaaaaacacaatgatttaagatctctggaaatgattataagatcataaggccactgagaaaaacagatttgagagaatctactgaaattagtaaatactgggagaatctgtagtgtttgaaccaagccttttttctcccagctcagcccacactggtgaattgaaaacacagggctcactctccaaccagctttattcaaagggcaattttcccaggagatgcaggctgtctgcatttctcatcctgccaagatatctgttgctgag

SEQ ID NO: 38059 - DNA, 2184 bp, Bovine  19866880691444
tggaaaattcctggatggaggagcctggtaggctacagtccatgggggacaaagagtcagacatgactaagcaactaacacacacatacacacaagcgtttatttcatttaaaggaacttggaaacattacataaatctaaacaacaatttatatctttctgaagttcatcaaatatttataaatttatcattcaccaaatattcatcgaatactgaatttggcaattagcaatatttagcaataattttttattaaatatcagcagactttattaaacaaattttaatctatttattaatatctagctctttcttttattctccaccattgccacattacttttctctgacttctttaaaagaaatctttctttacaaatataaaagcggagcattctagatatatttatcaacaaatacttgttaaataatgctatctttcaagaaagtggtgttaggcatattgagagacaagaaagaaagaaaaggattcataaatcacaagaaacttgttaggttatttaggagaaaaaaaactgatatagcagaaataatacagtgtataagaactgagaattgaaactgagaagcagaatatgtaaagcaaatataaattcagagaaagaggtggttagtgatggtgagaagtcttctgtgaaccagagaggacattagagaatgactcattgccaacttgtttattaagcttttcaaatgtttcttttagaagagacagccattatggacattcgtgtttttaagaccagtacttaacattcaaaacacgtttcaaaacaataaatatataatataaacttaataggatctatgtcttggacttctgtagtattttattgtgaatttgaaatattctccacataaattcttctactattgtactgtgtacaagtcatagtcaaggtaggaaaacagaacccaattattgttaaaacaaaataataagagaattttatagaggaaattagttagtctgatattagaaaacaaaacaaaacaagaatgctaacatggaaagaaatagtaactgtaagaagtgggtaagagccctaactaaggctaggaccaaaaggaagagagggttatcagaagttagcagttcagaggaatgaccctgcagatctagaacaaagaatttgaggggctatgctgtagggttaacattaatctctggaacctcaaagaagacccctgcgtagctgggcccagaccctgagggaggaaggccagctaggatgctgacattgctgccaaggccacttctaagaggagtgaaaaacctgggaactaggggtgattgctactgcacctggtagagggccaaggctggagcaacgccaacaagaacaaacaaacagataaaggaaattcctttctcccctctcctgtttttttgcacttgctctagtgtccctatggcagaacctaaaggggagccaactggcaaagaaaggtggttggcagaggaccagccacagcatcaaaatactccatatggaggatgaactcatagctgacaacagtttaataactaacacaattatgttctaagatgagaactggaatgtaaacatttcacaataaacttaccattttactatgattgaaatccctcccacatgattttattgtactgcatttagcttttgttattgctaaatgtgcatctctcagtaggaaaaagaaaattcttgaaaggtgagtgaatgtaataatatttaatataatcaccaactatttaaagattatcactgaaaggaagaaaacattttactttctttagagttgtgtttagtgaaagcagaattttcactggtaaattaatacagatgagaaggaattagggactacagatcatccatatgtgtgctaatgaataaccactacataccaaatgagaaagacagagtaaaagaaggctaaaagatgatgctaacgagcagcagctgtggaccattcctcatgcttttcctacttttgtaggtgaagcagaaaatcccggtctgtaattaaggtgctggctggattagagttattttaaggctctgctgggggggagatctgctttcaagctcagccctttaagtttaaggacaggctcaggtccttgatggtcactgaccagaaacacaaactcctggctacatgggaatcccttaaggtag

SEQ ID NO: 38060 - DNA, 1729 bp, Bovine  19866880740314
ttggttgtcatggaaacatgacacctatttcttatcatcatgaattgtacttattggctctgacttctgtagacattagtaatttctaactttatagccatatatatgaatattagatactagaagtcttttcatctccaaaatacttggtacctctaatgaaaaataaaatggaagtaaggtattatttcacttaacagttcatcaacttgtttatcaggaaccctatcaaagatttacttctctatatgcatgactcagcaactactcttgagttacatgatcaaatttcttgtgcacataacactgcctatgtgtcttttggcttttcatttcgattctagttgtataattctaattgacttgacaataaaggtacattttctgtttcctctttttccttttggcctcttcctgtaaaaaattattttaccattaccataaaatgtgtgaattaatgatgctctaaaagtgggagaaatctttgctgctagaaatgttagctgctatctcttctgtgagaaaaactaggcaaatttttgtttttgtacattttcccccatatcatttggtatttcttactcctggtcgaggtataggcttttgtggcttttttgatcctaattttttcattgcattatagtatttcttctgttcttctgtcataaagatgtcttgacctccaaagtatagaaaagaaaaataaaaactggttaaaactgtgtaccttccttctttcaatgttaaacttagaaaagggaccattaaaaaaggaaacacaaaattcaaccaattagcattatttgcctaggatttgaaattgaaaaattaaaactagttttagatactataatcttctttatttcaatcatccaaaattgactttatgatttttattattattttatggaggaaaacaatcccacaaactgagaggttaagtattttacccaagactgtaaactcaggaagtagtactatttggttcactgagtcactaaatacttggttccttacactagacacactgtctttcagaattttcagacaatgattttcttattcatatgtagcaaagagttaaagtaggtatattgcgtgatggtttcgagttactcataaagagccactgtcactctgccaagaattggaacaaaaggctagaaaggaaactggagaaattggtagaagagttaggggaaaagtcaaagtcataagtttggcaggtatgtgacaggccagtagttacagacaactggaattcaagctaataagtgaaatgaaatagcttgataatgatgacagagtaatattagtaataacaaaggagggcatgttctataatgaaagagcctcatacaatggaagcaattatataataggaaaacagactgaacaaatgagatgaaggatcagtacatgaaggaagaaatataaatggcaaaaaaaagcccttgaaaacatattcaaacctactaataataaaagacatgaaaatgaaaattaaatacaattttcatatatcaaataccaagtatcaaaaaacagagagaatgcttgatgctagtgtatcagtggtgacctgagcacagccatattggtactatgagtaggaaagcaaaacactttactctggaaatttatcttaaagaaatcgttaaaggctccagtttttttggcacaaagagttttgaccaggcactatttaatccttaaagggtaaaaataa

SEQ ID NO: 38061 - DNA, 838 bp, Bovine  19866880752926
aaacatgattttattttttgatgacttttatttttagattctattacaatgtgcaggtctcaagtataactacaatataatttatgacaaactcaaacattttgagcattcatatattatgaaatttataaagaattctatgtaaacagcattattatattcatggctattcatttatttttatgaagcaactcaattattttcctcaagaatataacataacaaaccacagttattaaaagaaattggtggcctctatacataggtcctaaacccaagccagttacttggccattctaatttagctggcccactttcatcattcccattaacatttctctgaaattgctatttagaactgctttatttacatatgcatttcctcttaacttttgaataaagctatcaaaattctataaaatcatgctgaacatttagagttgaagttttcatcagttagcatttagaaacagccaacaagttacttacatcttttgcaaactacgtaacagtcaaaaagataaaatgagattctcccatgtttatctccattggatgaatggatttgtgttcaaatctgttccctgccactttattccaatttaaattgtacagtgtaactatcattttatatcattagattaaatgtgttcaatgatagtgcgacttaaatattagcatgacagtgctgagaatggtatcttattattagtaccaaacagtaatctgtatgaaaagagaagtctaacttcccttcaagcttgtaatatattaaatgagcacttggttccaaaatattggtattaattgataaaaagttacaattagacattcctgg

SEQ ID NO: 38062 - DNA, 1496 bp, Bovine  19866880764304
aagatgaactactattgaaaaaccaatatatcatagtctattttggtattaatttgacttaatctaactgtcatgaggctattgatatattgtacgtgctgagatagttctttattggcttcatcatacatcaaatctgtgtaccacagaaatctatttgtggatttaaaaacaaaatatctgtctactgaaatattaaaatgcaaaatactcttccagacacagaggaataaagaagttgatatataggaacatgtatgcagaaattagaataagacaaagtcctggccaacaaaaaaagataataggttgatgtagatggtgaggaaaatgatacttaaaaataaaggacaaaagtgtgtctgctttttactatttttgtttgtgtctagctgaatttttaaatttatctttgtatggtttagtacagagacagctagagtcaagagtttgaataggaaaatggtatatattatgtccattttaattaacatcacactgaaatgtgtaacagtgtagtatcctcctagttttgacatataactactaagcttcagaagtaactgtagaaaaacacagaaaataggagactcttttttagttggtgttattttttttttttttgctttaaagagatttaactataattacaaaaaaggggcttcattaacttttctctgattatataaacttcaactctattttacatatatataatgaatataatacatatatgtataactgaatcactttgctatacacttgaaactaacacaacattgtaaattaactatacttcaataaataagtaacatatttaaagcctctctacgtcaggaattattctaaggaccagggatacagcagtaaacaaaacaccatccctactatcatacaacatatactctagctgtggggagacatacaataaaaaataaatataaataaaacaatacagggagtaaataccacaacacagaaaacagaaagaaccaaacagggttaaataaatggagaaaggtacgattcgaactgtgtagttagatatggcctcaggtgaggcagtgtttgaaaaaaacatgtgtagtcatagagcaagaaatatctgggtaaaaagcattccaaggaagaagcatagcaaatgcaaagaccttgatgtggcatcgttaatgttatatccaacaaactgaaacagaaactgaacaactgaaacagagcaactaagagaaggaaagtggtaggagacatagtcagaaaatttgaaagccagaacatgtacagccttttaatggctattgtaaagccactggattttactgtatgtggaaaaggaaggccactgaagtagttttaaagagagtaacatgatctcaatgacatttttgaaaggatttctcctagatgctgtcatggagaaaactataaatttgtaatgaatggaaacaggaagactagctgggagactaacgaaatagtacaagtagggaggtgattgt

SEQ ID NO: 38063 - DNA, 1498 bp, Bovine  19866880781348
aatggaagcacttaatccaaatgaaactggcttgcctataacttttagacagctgagtgcagactgtaaattattaatcattaaatcataattcagtaaaagcatttctgtggggaatttatgaagtatgatccaggcactgtgttttctggtgattgatcttaatatagcacaaatgcctggaaaatatagaaagattaatagttaatctgtccattagactgcttttctaaaaaattgaattgctaaagtaagattttggcaagaattgtatcaaagtcaactcaagtttggactgtaacaagtataattcaaaacatgccacatttataacctgatgatttaaagtggcacagctagaaatatttctacatatgaggacaacagaaatatttctacatgtgaggactgactgaaaggcagctgttagggcagatcaaacatctgatgaaaatagctactgtattcccgtgtgtatataaactctagctgccaaaaactggttcagccttcactccaattgctgcataactaatattcttggatttttcctgtgttggaatatctttactccggtatagctaaaattttctttaatacaactttttcttgcccctgagattatttcaccctttcctgacttaaatgatttgatttttggctcttgtctttatactctctacagttgtgttctgcccagggtttagccaattttggttaattctcctcattgtgtgtgccaaccccttcacagatcactgccttgtcatggtgaaggagcttgtataactcaatgaagctataagccatgctgtgtagggccatccaaaatggacaggtcatagcagagaattctgactaaatgtgatcccctggaggagggaatggctaaatgaagcagcgcaaaggctaactgaattcttccaagataatgcactggtcatagcaaacaccctttttcaacaacacaagagatgactttacacatggacatcaaaaaatggtcaataccaaaatcaaattgattacattctttgtagccaaagattgagaagctgtatacagtcagcaaaaacaagagtaggagctgactgtggctcagatcatcagcttctcatagcaaaattcaggcttaagctaaagaaaaccaggaaaaccactaggccagccaggtatgacttaaatcaaatcccctatgaatatgcagtggaggtaatgaatagatccaaaggattagatctagttaacagtgtgcctgaagaactatggactgaggtccataatattgcacaggaggcagtgaacaaactatcccaaagaaaaagaaaagcatgaagacaaagtggttgtcggaggaggctttacaaatagctggaaaaaagaagagaagtgaaaagcaagggagaaagtgaaaggtacatacaactaaatgcagagttccaaagactagcaaggagagccaagaaggccttcttcaatgaacagtgcataaaacaga

SEQ ID NO: 38064 - DNA, 2147 bp, Bovine  19866880792827
ccataaagtttctatccactctccacagagaatccggaatacattcaggaaggaatggaagaaatcatgcatgtgccagtgtggaagctgacagtcttcatttatgctgcagacatattttttatattttgaaccatacaggttaaggccaaccacagcagaaaagaatataaaggtgaacaacagcaggaccaagtctttcagggccacaattgagttacaaagagtcagcatcagaatcttaaatgttggccagtatcttcccagtctaaaaattcgtaactgatggagcaatgtaaaaaacaacaaaaataagaaaaaaataacaaaaactctagtcactattaattacactgtacatttacaatttttattagcattatacacataaacatgtgtagtctctaatgtaatattcactcgtgagcattattaatactaaacactgaaaattcagtttatatacaatttttaatacacttacatattctacagttttttatactaaattgaagtatactttctattgatctgtcaattccctttttttttcaatattatactattaataattactccagttttgttttaatatctggtaaagcaagtatccattctttattttctttttccaaaatatattgaatattttcccacatttcaacatatagatgatattggaaaagtctcaagggtccgttgaagccccttgatagctctattgtatgcatgagtgctaagttacctcagttgtgtctgactgtgaccccacagactgtagccttgccagactcctctgtccatgggatttccagacaagaatactattgtgtatttacctttaaaattaacatgagagaccaaatgaaacattctaggtttagtctaaatatttcacttaatcactagatttaaaaatttttattcacatggcacaaaatcactttaatatttgagtcatttaaaatccacatattgtttttgtatgtgctataccttccccaactttttctggtatgcagttggcttttgggactcaagggttaggacttaatacttatccatgtaaaacttaatcatcttaggttcaatctgttactagtctttcagatattttgatacaatcttttattatattgtctgtatttcccagtcttgcttcatttataaattcaataaatacaacttttatattttcctcttactcattagataagcctatggataaagacagggttctgaagaattatttggataagattaaatctacctaattgttctcatttctgctacattccttcaacttgttaacagaataagacagtagattatttatcaaatacccaacatttccataaatattattctaataacattatttctttgcttagttttctgatgtttttactaccacctacattttatgcatatattgattctgacttaataaccttcatagcaacattctattagcctgacagtccttcttttataaaattttcaaatttacatttagatatactcacctgattctaattctttagttacacattggcattcagctttttggactctgtattactctgtttctcaaaactgacccagtaatcctgaccctgctttatagaactatatctcaaattcactgtatatatggcttgtttcttttaatgcctgggccaaacagcattagagactacttactcttttctgggttactttctaagcttgttatatatgaattatttcatttaacagttccaacataccatcaggataggtattactattcttcccactttatgcctgagaaaactgaaatgaatttttataaaataaaatttaggtcttgtattctacttaccaccctgaatgatcgtaaaatagccagtccatgaaaatttgttagataaagttctgctaaaccatggaacacaattaggctatcataaatgttccagcctacttggaaatatccatatggatacatggcaattattttaaaaatcatttctgctgtgaaaattccaataaacacctaaataaaacaaaacacagggataagaatatgattccaatagctctatcagaaccctcatacacagaataaattttcactggcactttcttcatattttctctggcaa

SEQ ID NO: 38065 - DNA, 699 bp, Bovine  19866880810363
tcaattaaaaaaaatttttttttaattacagttttaaaaaaagaatttgcccttatcaatatcccaggaatactagtacttaaggcccttgtcagaaactataacatcaaactgtttttgactcatcaaaagtcagagaagtagagttggcaaaggatactttgcagttcagtcttttttgtagtttttacacactccattattggataagcagagagccttatttgggaccacatggaaactcaatagaaacacacaatggtcaaattctagagagacccactgcaggtttgatttgatcataatcatgttgtcttcaacaatgttctatagaatcataagatgctgcagcttaaaaaactaccagtgtttgttaacaggctgactgaacagttgtagtttaaaaccaaacatcatctaaatatgtatctttgggacagtaaagaaggaaaaataccttaagtgaaaattggctttaaatcaaattgagaaagggttttaaatgagatcatgtttttcagatgaaaaatacatgggaattgctacctaaatactgactatgaaacttggcacatattataaattgctaaactagaaagtagttggacaaatactgtatgctatcacttatgtgtgtaatcctaaaaatacaacaaactagtgaatataacacaaaagaagtagacttacagatataga

SEQ ID NO: 38066 - DNA, 1406 bp, Bovine  19866880873740
tggttaccatgttgaggcagatcagaacccatgatggctatatcaaaagcttggtttgttactaggtcaaagatacatccttggaatttgttctgcaaagaaccaaaaatgataggaaattgtacagtaaattttcaaagtagtatccataaatgattacattaacaaaacaaattttaaaggtacctgtcttcaaaacttgcataaattatccttggttataagatcttgctttgtttaaggaatatgattaatgggctagatctaagtcagagtacatgacaacttgctgttgactttcagtgtaccaattcttcaattaaccttgtaaactaacatttgcttttaagtctatccaccctagtatgtcatacaggaattgccaggatcacaaggtaatttttttactaagaaactctcagagacaaaaaaaaaagaaaatctcagttccattacctacagtgtttcaaggtaataaaatgacatctctaaatttctactttgtcaccttattttgactaatgtgttggcatcattgtcttacactggtattactgctataatatcagagatgtatactttcctgtctcttccatgtatagaatatatacttccaaacatatccatatttaacatatcacttttcttatcaatctcactgaacagtactgtgcttttcatgaaactcaatttcaaaatcactttattggttacataagcaagttttaagacactctatcaagatcaagtagggtactgagaaaattaaatactagagctttaaattcatagattatggttctgtaggtctggatgaaacctggccatgtgtccatttaaaaagtgctggataatcctcatgtaggcagctggtactaaacatattcccatttttaggatgctctgtcttcagccacaactttggtctacagtgttatacaaaacagaaattgagatacataaaatgcatttaaatttattttaactattagaggaatacaaactatttaactgctaagactcactatttacacctgagcctattctggtctttgatcttatggcaggataaagtttagattcatgaccagtctgactgcttccctggtgttctgtctgttgtaatatcaaaggtctacaaggttggtttcacctgactgaagacacctatcactacatgctgtgactacatcatacagtcatcaagataatcaaatttcagtcaaaagtacattttattttgattctctatagaacatttgtactaatagtaagatgtacagctaatgtagagtaaaagcatatataattattttttcatttttatagaaaaggaaaatatatgaaagactattaagagctgtgatagtgttcaaaatacatatattcagtttataaggactttt

SEQ ID NO: 38067 - DNA, 1275 bp, Bovine  19866880895847
ctggaattacaatacagtgtgataaggggccaaaggaagtaaaaaccattaatgacaaagaagggaatgagaatgaaacaatgaagtcagctgagttatctaggcagatccagatgatgtgagctatgcaagcctaccaagctgacacatggcccttcaccttatctcatggggccatctgtattaatacaattgaatgaataagtctttattttatacttcactttaaatgtgtggatacacttagatttctttggattcaagatttgaaagctgaaatcaagtttttattcctctccttttccaaatattttgcctaccatccagattaaaaagctgcttctactgtgtatacacaaagcacacattaaaataagcttttattttaaaacctacaccagccagcttaggccatgagcagaacactgattacctatacctatttcttgaattcttttcatatccatctgcaggtcccacatttttcttcaaaactgttctcacctttctcacttctccatcttcacgatcgccatctagttctgacacctgttactaccaacttgtactactgtcttccaattgtctctttcttttaattcatgtaagatgaattaattttcttcaactctcatttaaagttatttaatgactttccactgattatcacgtatttgccttaccttgatgttcaaatcactcctcaatctacatgtctagttttaacttcactagctacctagccttcatgccaatccaactaatgtagtcaccatatgctaataacactaccagagaattgagacaccatttcctctgaaattccttgtccaattcctccccttctgaaacacttttcttctcactagctgtatttcaagcagtacttttggcatgcagcctcacttccactcagtttagcctccaagatagagatgtttcctcttttgaattcaaaaatcagaattctagtactggacaggactatagagatactttactactgcattctcatttggcaaatgagaaaaatgagctaagccagctttggttcagaatgtagactatgagtggcatccagtgcttcttccaccccactgcactgattgtccctagagtcgctcctacttatctgctacccagactgctctgcactagagttaattgcattcccgtaattttgacagatggtaggctttttctttacttcagataaaaaaatatatttgtgaattctccaaggctttgagtacttgaatataggactataaaaat

SEQ ID NO: 38068 - DNA, 1325 bp, Bovine  19866880916120
gctggggtattattcctcttaatacttctttcttgggatgagttaagctgggaaatggctttgctcttgaacttaaagtcactctttcctcaaaacattgatgctctagcacctataatagcttttcactatttggcagtctaccccaaattctatctaaaagaaaatccaatataatgtttctatcttcatttggaagaatagaaagggaattatttaaaaaataaagatatcaacattttatacaaaaaaagttaagctgaatactaattaatccagtcttagactgtaagagaattcttttttctttttttgtaataacttaaagaattcttctttatttaaaaaaaaaacacattatggcagggtatcagattacttttttcctaataaatttaaaaacacagagtgggaaaaaagtgcaaaatcagcaaattgccctccatttagcaaaaaaatgggaagagatttgctagggatgctgcctctgacagaaattaagcactgtataatttgattctatacattcattagaataacaaggagaaagatagcttctctggtggttcagatggtaaagaatctgcctgccaatgaaggagacacaagagacaggggtttgatttcctggagaagaaatccagtattcttatgcctggaaaattccaagacttccagagaagccttgtgggctacagtccatggggtcacaaggagatggtagctgtggacaattcaaggtcaggaattagtagctatgtttaggtcaaggtcagatccagatcttaagcttaatctcatcctctggaagatctatagttcattatctctgaagatatatcactgattatataaggaagatacttgattatgaaattaatgttttatttatttaataagcttcaggtgttgggtgtgcttacagctcaaatatttgtttcaaccacatctgttgcttttattctttgaatgtaagggaattctttagggtatggattcctaacaccctccccaccctgccgcgggaatatttcctgtcagtgttgtttttaaatttgagaacatagaacttttagtttggtggtgtcttaatcgggtcctgtgttcctggtttattaagcacaaaacgtatgtagcctggttttctcaaaagctaactaagatcttccttaccacaaaaggaattcacctgtactttttatctagctggagttttcagatgcaaaacaatgcagaatagagtagttggtctgttttagtccatatttaagaaggagaaggcaaagaagaggaagaggcagagatggaggaggagggggagaaag

SEQ ID NO: 38069 - DNA, 1308 bp, Bovine  19866880970430
taaattcctttcggacttgtttagtcttttttgaggcttgcattgaagtgtatttaagtcaggtctagaccagcctttaataaaggttggagatcctgaaacttaattgtcccaggacccattctctcagatttcataatattgtgctcactatgattgatgtctacaaatatttgtttcacacattttctcatgttttctagttatttacagtgagatggcaattcccacatcaatcttttgtaaatgtaaacagaagatcctgactttaattttaaataatcttaaataaattcctctcccccacccccaatgattgcatctcacattagtaacagcttagaatttgatttttttctcttccacattagcatattcaattttcatgcattaaaccaacacagataagtagaagtaactaagatatggagaacataaccatgatggaataatgatataaccaaagctctaccacagccaacaatatagaatctccagatcacctagctgaattactctataatttcagaggaaattagtcagatgcaagtaatactctataggacttattgataacataagaaccactgagataaagcaatataaaacaaataaaaacatatggagattattttagttctgtcttacaaatacctataaaggcttactataataatcatttacagtctagttaggatagtgtatcacatttccatcttcttgttaaagaagatttgtgtacagagttgagaggtttatgcctgtaatatatgacttggccttgagggtcatccttctagagcagcaatcaattgtgttaataattctggcagattgaggtgaatgtacaaaggctgttatattgtaggtttagcataagtctgttatcaggcaaaaataaaaagtgctcactattttttttcatctaaaataaaaaaaaggtaatgtgatcgtactggagattaatgatggctgttccaggaaggtgcttagagcctcctgacatttcttgtcattggtgttaagaaaatggaatagagtggactcatatcctacaagttgttccattggcgctccatcagcactcaacaccgcctcatgagcacttgtctaattataaggtggcctcgtgataagctgtctttgcttctgaacatactctacagtgaatgaattgttctggatttacatactcactgttttaaaacattttatatttctgtttagcactacaattctgattattgctatgatttgtgtggagtttcagtagataataatgcaggccaattcaagctaatgcacatg

SEQ ID NO: 38070 - DNA, 788 bp, Bovine  19866881043450
aaagaaataaaagagaattgatgcttgaaaaatacagattaacagggttgccagaaaaaatacagcacacgcagttaaatttgaatttcagataaacaagatatccattcttaatttttatttgtgaaatctagcagatctattgctgctgttgctaagtcgcatcagtcgtgtccgactctgtgtgaccccatagatggaagcccaccaggctcccccgtccctgggattctccaggcaagaacacccgagtgggttgccatttccttctccaatgcatgaaagtgaaaagtgaaagtgaagtcactcagtcgtgtccgactcttagtggccccatggactgtagcctagcaggctcctccatccatgggattttccaggcaagagtactggagtggggtgctatcgccttctccaagcagatctactagtgattctttatttctcctcaaaaactagggaaaccaaggcacagactgactgacagagaagatagcttcaaattgaatttgtagtctctgccttcagaccaatggtgcatcctgttcacctcttagccatgaagcttgttaactttaaaaatggagttaagtgtatatatcaagttggaatcaaaaatattttaaatctttacctgtatgtatacttaagattacattgaatggttttatctccaggacatgggaagtagaaagaaaataacacagacacatagacatgagttcaaaattgatagaaagaggaaggaagggagtatgtccaagaggccaccagagtcacatgggctc

SEQ ID NO: 38071 - DNA, 1325 bp, Bovine  19866881053792
agctgtcttataaattatagtggattcaggttatccctataataatgtcatgttcactgacttgtgtttgcttttcagagtgagagaggaagggctggaattataactaagtgagagcgctgagcttaattttaatctcatgcagtggccaggagcagagcacgtgtgtgacctttatccatgggatgggttaagacagggcaactgtcgtcctggatatcctgttctcttggtttgatgacatacaagtctatattccttcgtctaagtcctatgggtccccttcttgatttctctagctatgtttgtttttttttttaatttttgtatttcagatcctcctctacatgaacaggataaagatagtggaagcaagcaatttctttctatccttcttattcttatcagctcacaagtcagctcaaaaaaggcttgacaataactgtagaaagacattgcatggttaggttttcaagcaacttcacaaagaagataataaaatttgcaagatatgttggtaaaatttcattcgcaagagctgcttcttatacaggcaggatgatgtgttaactaacgaaagtggtgagcagtagtgctcagaaaataaatgtgtatctcctttcactgaagagtacaaaccttcttcagtttcagagtagtgatgggaaaggtcagaggaaaaatggagacactgagataaagctactgaatactctacatgatgtcattgttttggtgggtcagaaagttggtcaggttaagaaatggtgatagccttattatatgtccacagaaggtatcgtattgcatcacagaagtatatttttgatggtatttttcctattattattgtagaggtgtgtatatttttctaggcaatctgaaaactcatatcttttaaataaattcactgcaggactttgagatttctattcctctggcatcttgcaagtattgaaccactgcagaagtagacagtggtgatcaaaagggccataagagttacaaatgaaaagagaattcaaacaagccaacacgatgacttactatgttcaggaggtcctacaggcaaatccttttattgaactctgtaattgggggatatcctgtggtgtgagagctcctatacacattcattcttctttttttttttttttttccatagaaaggggcagaaagaaggagccgttctgtttctgctgcttcttagatttgccctttcgaattgctgagatgtgattttggtctgtaagctgaccatgaaggatgacacatttgaccaaggtcaaagagatttgaatatttcatatccctgcatgtgtaac

SEQ ID NO: 38072 - DNA, 1673 bp, Bovine  19866881059391
taacggagtggtgaatttgatgttccaaacccagaaaagatatgacttctacttggttctgaactgaactttgtgcttctaacattaactagctaaagggatagcatggagggtcatgggttacataaatggaccccattgtctacacaagaaagttaatgaaggggacatactggaaatctctgctatccctggcatctagcatgtaactgagcatggttgtagtttaatagtttcttcggttgattaattgattgcttgatatttagtgatcttttgttgttgtttaattccattctaccaaatgcctgcaactgtatgtcttttgttgttcagtcactgagtcatgtccaactctgcaactccatggactgcagcattccaggcttccctgtccctcaccatcccccagagattgcccaacttcatgtccattgaatttgtgatgccatccaaccattttattctctgttgccctcttctcctcctgccttcaatctttcagagcatcagggtcttttcgaatgagttggctgttcgcataaggtaaccaaagcattggaccttcagcttctgcatcagttcttccaatgagtattcgaggttgatttcctttaagattgattggtttgatctccttgcagtccaagggacaccaagagtcttctccagcacaacagttcaaaagcatcaattcttcagcactctgccttctttatggtcctgctctcacatccatacatgactactgaaaacaccttaaccttgattgtatggacctttgtcagcaaagtgatgtctttggtttttaacacactctctaggtttgtcatagcttacctgccaagaggcgatcttctaatctcaaggctgcagttacgggtcaactgtatgtctatgccaactaattagaaattgctggtatttttatcatatgcaacttactttctgcatttggccctactttgtaatatctaaaacactagatatttttatactaggattttttgaattttgaggagcaaaacattctgaatgtttcttacttctgccaaaaaattatataataacatataaaactgactatatgtggaaaataaatttggctcaattgaatattctgggcacaacttagtatctcctacacaaaaacttattctggcagatgttctgcaaggtctaaattggtcatttaaaaggatactttcaacactcgattcattaagtggcatagagactccatttgcaggtaaccccttctaacagatccatcaggatacagtcttcttaaaatcaatcattctccatgtgccattcttatctttctcttaaaatgtggagggtatagtaacaatgctgcctttttttttccctagtcacaagttttctctattctttataacacagagttctgatatcccaagtaaccacttgttcaagtgcttgaaattatgttagaccattttttgaggaagatttggcctggagggattccttgagtctacttttaagaaaagttaggatgactcagtttctcagtgagaaaacatattgtgacaataaatgtttctaaccaaatatcagccctgctgcctgagtttctggttttataacaagagcattgagctataaaacagtagacccagatttcaatttcaaacttccacaaacta

SEQ ID NO: 38073 - DNA, 1419 bp, Bovine  19866881197450
acaaatgccactgctgctgctaagtcacttcagtcgtgtccgactctgtgcgaccccatacacagcagcccaccaggctcccccgtccctgggattctccaggcaagaacactggagtcggttgccatttccttctccaatgcatgaaagtgaaaagtgaaagtgaagtcactcagccatgccactagacatactcaattctaagacacatatttcttcacatgttaaacctttgaaattgacatgcttctggtagtcaatggcattttatagtttgccagaattttccccttttcttagaggtacataaaataatatcactttcctttgatatcataaataaactttgtattttgaatcgaaagttgaaagtgaataaatgcagttaaaaagtcaataaccattcattgtgtgccaggaatatactaagcacttgaaatatattttctttttttaattttcatagctaccctatagattaagcttatacaacactatcataatgtgaatgagaaaatagaggcttagtaaaaataagaccttttgttctaaggtccttctgtgtagaaatggttgaaaaaggaattgtgcaaacaggctgagtccagaggctttattcttaaaggctagtttttgtattatgcttatttggctagtagagtttagagcaagctaaaattttctagtctaatgaacaagaaaccctgtgcaaaataacttacacactaacaagaagcttaataaagatgtgaaagcaatcaacagtagcttatttggcaggaagaataagcattttatttgacttctttctctttcaggggctgggaatagaagcagagatgaatttagtgtaacttgacacagagaaaggtatttagagatatttgaaggaaaagagagatttttttttcctttttgtcatattccactagttttatttttgagatttcacatataagttatatcatgcagcatttttctttttctgatttatttcacccagcataatacatatatgtcttctttatccattcatctgttgatagatagatacttagattgctttcatgtcttggcaattgtaaataatgttgctatgaaacattgaggtccatgtatcttcttaaatgattgtaccagtttaactcccaccaacagtgtatgagggttcccttctgagagattattttaagaaaaaaatctttgaagtttatttaatattcattataaggcaaattctcagataaataaagccaaaatctaggggaaaagtctaactgtaagaattttagaagcctaaaagctgctggagagggcaaccagaggggaggaagacaggaggtcaagacagataaaatttttaaaatttaatgaacaggaatatagtctgctttttccagttttggtgcttctttttaa

SEQ ID NO: 38074 - DNA, 1686 bp, Bovine  19866881220805
taccatggttatagtggtagggaagggaagtcaatgagggatttgtgataaatatatatttgatctttggtctctcactcctggcacactgctcctaaagcttttagaatctctgaagtgatgactgactgtgtttcgtatgatgatgaggtgactgatggctgggggcccaagatagcttcaaaatgagggttactcaccagaaacaccaaaagtgtgagtaaaagatggaaattttaaccacacaccctgacctccaatgaggggaatagggctagagattgagttaatcatcaatcacccatgatttaatcaatcatgcctatgtaattgttagatagttagaataggaaaaaggagtccataatggcggtggctaaaagacaaagaaaggaaaaagcccctgaaaacagaacaaaggaaggtccaaggaccagagtgagaatctcaggtaaaacagccctcctgactagcccaatttacagagggcaagctcagggggaggagaaaaaaacatacaaaaagaggagccaaaattgagtcaggagctcttcttctcttcacatcttttgggccggcctaccctcacacctctaggatgtcttttccttctgcttgccgattaaaactgagctgtattaccgatccatccatcacttcaaatttttgctgcagtgagacagaactgaggaaattacaaactcccctgacataatgatacctgtgtaaaagctctttaaatggtggatttggagggcttctgggttggtgactacatcaaagtgcttggagagtagcacgcctggagaaggcatggaggctccacaacccctcccacacttggcctatgcatcttttagatttgactgtccatgggttgtatcctttataataaaaaggtacatttaagtaatgtaactttctgagttctatacacccttctagaaaattaacaaacctgagtagggaatcatgagaacccccaacttataagcagtttgtccaaggtacacatggcaaccagggacttataactggcctctgaagtaggggaagtcttgtggcactgaagccttaacctttggaatctgtgctaatgccagatagttaaactgaattgtagcaatccccattggagtccagagaggtatggcaattattgtctaaaagttttgctaactttcccctttcctacttcttttgcaagagacagcaggctgtttgctcctattggagtctttaggttactggctctttgagcaacatgttctggatatatgactaaaagaaaactcaaggaattcaccaccattttgttcctcaagtgcaaaagttcctggactgtctgccttctctttcaaagccctcttatgtttcattgtacgtattatttccaggatttttagctatatttagagagaggaattgagaaaatgtgcctattccatcttcatctagagatagaatttccaagtcagttttgaatattaggatcacctttcctacatgagaacagtggttttccttctccaccttcgagtttttttccctcccagctttccattcctaattatgcaagattgactcagaaacaattttttcattaaataacctcatgaggtcactattaccagctgtgaatgtttccaccattctttcctttgctagtaagaattttctctgaag

SEQ ID NO: 38075 - DNA, 808 bp, Bovine  19866881224523
gtttaacacaaaaacactgtagtgtagtaattgtatccactctttgcatttcgactgccacatttgtcacgtttttacaaaatctgttagtggattcatcttttttttagtccatatgttgtttattatatgtgactatttttgtaaatggggtttctgttgggaaatagattaaaggacctcttaaacaggtatgccactgggggttatggcaatcacatggccctcccatctgcacaaagacatggtttgcatgagggcatgctacacttagagatcatgcatgaaaaaagtcacaaggaacacagtgagctcttaaattccatctatgtttctgggaggggtgattaggtgataactggaggtgctttgctgatcttgttttgtcaaatccaatccctagaccaagtatgtcattttagggggatagcccattaaatcttagcaggtgcaaacttcactcaaatgtcaggaatcttaagtgttacatttctgtttattgtatttaaaaaatactgaataatgagtattgcttctcccttaaagacggaattgaccaaaagaaccctttataaatttctgcttaatcctgcactttgtttagccatcttcagctcagtaaggttgacaatgtatatgttaatgaaatgctatttattatgtaaatagtcattttaccctgtggtgcacgtttgagcaaacaaataatgacctaagcacagtatttattgcatcaaatatgtaccacaagaaatgtagagtgcaagctttacacaggtaatataatgtattctgtaccattataaat

SEQ ID NO: 38076 - DNA, 1371 bp, Bovine  19866881250997
aactggtaagcatattgaatagaaagatagattttcaattttatactgcactagttgattttgttgacatgttcacatttgccttttatacttaaaaatctagtttacacctagatactaacattgtcacaacaagaaagacattcaaaaatatgtagaatgtgaatgccacatgatacatatttcctgtgtcttttgaaaatgatccagtcataagagctctaaaatgatctaattgtgagtcttcttcatcatctctaattcctccttctctgtgaacatttgccacatggctgtgactgatggtaatgtgacttcgagacttcagcagaaaggaactatttccatttgctttctcttatgattatgagctcatggagagatacaaagtgcaaaatgaaggggatatattctgtttgacagcagttagtaacaataagctgtcatcctttaaaaggaatacagtaaatatttctttaaagtagcttctctaataactcacagtaatggaaagcaacatgatgcctcaactttttgctacccttcaactgggtgacaaggaatctgacaaaaagaagcctctcacacgagcccagaaaattaaagaaattgttccttgatttcttctcttccattctacaaaagactttaactctgactattctgttgatatatatcatctgtagtccattcaatgagcaaaggcatttgaatgagttttcagtttataaatgttactttgctttcaagtaccctttgcatcatcttctcatgccatagtattttctttgaggtgaatatcttgtttgaggttagagcaagtgataaatctctgggactgattagtgcccagaagttgagacatattttattaaggcattaaagtcaaactcaaagagagagattaacaagttaaaaatgtgcaatttgacctgagtgatgcaaattatttataataaatttcattggatttacataagagaacagtaagaactatttggaaaggtggttcattttcttagttttcattaaaaataaagtgaaaaaaaaaaaaaagaaaggcccatagacatttaacttccttgtcaactagcagggattagagttacaaaaagtatttcatatacatatcctgtcattctgatctaagaaagtgtaagaaagtaatttctctacctctattggttgaaaaagtcaatcctatataggagaccagaataatttatttcattacatatactcaatactctttatattttacttgtttggcaggctttgtatttgtcagctatgaggttagggaaaatggtaaaaaaaaaaaaaaaaaaaaaagactaaacaccataagattaaatcacttccagccaaaaa

SEQ ID NO: 38077 - DNA, 676 bp, Bovine  19866881252002
ctttgctttcaaatagtgcactttttttttcctatggggggaagaaatagaacaaagcacctaagcagtactcaatttttcttagcaaactgaagctgcactgttttattctgataaatgatgctaatgaagcttagggacttttacaggtgtgtaattcttcatttcactacattattgttttcccttattttttggtaaagcacatacatgctttaaacagtttgttagacagccaactttttcacagcatttttttagcacaatatatttagaaaatgtgtaaccaaagatgaatctaccacaaatcctcttttttctcatagtgcctctcatccttagttttattgttgcagacaattcagtgaatcagggggctttgtctggtcctcttctagtttacatttgccaaaactaacaaatgtgaactagttcattgtaatactagagtccatcttttggggtgaaatcacctcttgggcttggaaaagggaggatatgaaaaaatatcatagattaacttaatctatcaaatgcagtttggtcatgcgggaatgttacttcttgaaactgaacaggctaccactttatggcagaaacatttcacaatgtcctattagtaaagtcagtctgtagaggcccaaatgtactcttgcctggaaaatcccatggacaa

SEQ ID NO: 38078 - DNA, 985 bp, Bovine  19866881260362
ctaagctttcttgcaaaggttctgaaaactgccagccaccccatggtttctgttgatagagatgcatccacaatgcttaatcaatgctctgtcttggttgataacctgcaaacatcttctctaacacacagaatgggagcttaatcttcaagatgggggactgagagagagagtaatggtaccaccaggaattgggtgctatagtcataagtgtgacaccatccatcagctctaggcttcctgtggatacaccctccacatagaagtagcatccacttatcaccaccccagtggtgaggcttgaatacattacctttaatgaaaggtcacttagggtcaagtgcaattatatgagtggatgccgtttaaaactggaaaacctcataaagtcttgaaattaatgttaagttatacatatttcagaattccctgcaagccccaaccaggagcagaaagacattgttttaaaatcatcctttatctttttaaatttctttgggatgctggttttgacattaagatttaactgggctaaaagctgccatgtagcccatgaaaaattatcttgctacctaagaagaaaaacatttgaaatgtacaggtcccattcatcatgaatgtggcttttttttaaaggatgaaaatagaagagtattgtgatttttaaaaaaaaaatacataattttaaaacttgaagagattaagatgcacttacatttagtctcatttattttgtacattgttatacaagttatacagattcacagatgggaaatatattcaaggtcatacaagaaaagaatatttaatggtaaaagtcagactccaagtattttattccagttgaaaatatatgtcacagcactgtagtgctttgcttcataatttcttgataagtataggatgataaaatactatcaattgatatgcactaggtaaaaatgtcaagtcatacatttagaaatttcaaggacactaaaaatgt

SEQ ID NO: 38079 - DNA, 840 bp, Bovine  19866881272289
tctaacaacgtggaaattcactgctgctgctaagttgcttcagtcatgtccaactctgtgcaaccccatagacagcagcctactaggctccccccatccctgggattctccaggcaagaacactggagtgggttgccgtttcctcctccactaggactgagatttagaacgtgacttggcaatgtgccccccctctttttcttcttgacacagcatctttatgttaagttgatatcttgaaatataatgggctctctttatccatggctttgcatctgcatgatgcaagggcttgagcatgggcagattttggtattttcagggactgccctggaaccagtcccccctgcatgtaccaagggacaactgtatagttcactcacttaatattacttaaaagttgtaatattaaatacacttactcatttatggctattttagactatgagctttacattcagagtctatcaatgttatatttacaggcaacatttaagggatggatggatattatgtatgcagcagttgattctgttaacgtaagtattggtaaacataacaccgaactctacagttttgaaaagcttctttgttgagttaggctgtttccaaacagcagctccaagaagctcttgctacgggcatgctcactgaagaaaatccacctggtagttgcctcggttacctgtgtggcatttggaaacagagcttgacttaaattctgtgactctactgtatcagacaagcttgcatctgacttgcagcgagccactttatctctctgagcctgtttattgatccataaaaagaaaataattcaccactacctcatggggctat

SEQ ID NO: 38080 - DNA, 1339 bp, Bovine  19866881283259
ttgctttttgatgttgagttgtatgagctatttatgtatgtagaatatgagcgacttatcactcttttgaggtttttttccctaatttactcatttcatagtaacattaagcttttcaaatagctctggatttgcctctgttcaacagaattaaagagatattgcatggctcttagttctacaaatactttccataagaaaattgagtagttctgctggattatcattttaggagaataaaatgcctatgaagtctgtggtattttgaaaagacatttttaaagctgaaaatatgccaaacataaagcatgatgtttgcctttaacaaatctcaaagacagctacttgctttgggctgatgaagtattaattgttgaatacaccaactctgtgaagggctgttggtatattatgggcttgccgtaaatctagttatattctagagtaagtcccatcactgcatgaagtagagtttttgcactattccccatacatcttactttctataatttagttacaagctatataatctactctttaaaaatatcctttatgaaaatcaaaaagaatttttaaaaaattgacggtagcttccaccatcatcactggcttgtttgtgtactgagtgcctctaactcttatgtactaatatgatcactttatagtgtcaggagccaagtaacttagtggcacacaaaatcaatggtggggctgggattcaaactcaactctgtttgaatcataatattaataaaagtaacttaaacatcatatcctatttcaccattctctctacaaacttctgatgtttttcccccagctttttatcttagataaccaccataaatcccatcctcccaatgctaaatcagtactaaattagcttatttattacaaaaactacactattattcagtgaattagtttagtgtctattaagtagcatatcctgtcaacataacagagtgatcaaagattcagtgttttggaattagtttataaataagacaaattaccttgaatgaaagacaaaaacatggaggatacttacatcaacaattaagaagtctagccaacaccaggcattggtgaaatatgtttgatagccatatgccacccattttagaagcatttccagaatgaaaatgtaagtgaaaaccttgtcagcatattccaacattgttttgattgtctttcgctggtcaatatatatatcctcaaatgcctataaagaaaagttacgcattttagttttctgaaacttttatgctacagctattataggctattttcccgattacatagtttttcctattttcatataataaaatacatttca

SEQ ID NO: 38081 - DNA, 1553 bp, Bovine  19866881300067
tcttaacatttgtgtatactttctaatagacatagacttgttttcatcagaggcatcagcggatctttcaaaatatctagtgtcagcaaaggatctgtgacttagttttagaaatgaaactaaatgtaattagaagtacaattaaatgtaaaaatattaattcaaggacagaaatctaaggaatataagcaagaaactacagacaaatggctacattttcagtaatggctgatagaaggaaagattagaatgataggaaagagaatggtgcctcagggtggggggaaaagagagagggaagagaggctgtggaaagggagtcaagtgtaaatgataaaggaaaaatacagagaaggcaaagacggagaatactgcattgagtatagctgctggtttacattttcataagagctttagtggaatgataggaataaaattctgaataaagaataaaggaacctgagaaaatggagattgctgcttatttaagtttaggcagtagattcatttcctagacttcctactctgaagtggttctccagagacactggttcagagaggtcagtgatttttgagaagcacagtgcccgctcagtgtttctttaaatagtcacttgccttggcttcactgatctagagtcttctggtcttccgcttaatttccctccactgtgtaggttaatcatccctgaagttagaatccccaagacttaggcctaggttcttttcactctcattttatgtgctttctaaataatctcatacatttatacgggttcacttgttttgcttatttctggtacaatataggagatggataaacatgttaaatcagtgaaataattatttatttgagtatttatactaatcagctccattgtattttaataattttagtgcaaaatttttgagaatatatgaatttttaatatatattttaaatataaattgttatttaggttattcaaataccagcaagtgacctattacatcttcaaagatggcctttttgttgttgttatttcaatatgacattacattaataaatattcccaatttgattaaaatactttcacatttcttactgaaagtttatatgtttgtcttttatatgccaggtggtagtgagagctttgattaaaacaactttacccacattgaatgtgtttctggtctgccttatgatctggctggcttttggcatcataggagtacacttatttgctggcaaattctatgagtgcattgacccaacaagtggagaaaggtttcctctatctgaagtcatgaacagaagtcaatgtgaaagccttgtatttaatgaatccatgccatgggagaatgcaaaactaaattttgataatgttggaatcagttttctttcactgcttcaagtagtaagtacctgtttgaatttttgaaatatgtttattcaaattgtaggtgaacataaaggacaaaatgtggatgcttaataaaagttagttttaaattatcttagcaattgttagtagatacaggttatgggacatagtatactaagctcatttaga

SEQ ID NO: 38082 - DNA, 1007 bp, Bovine  19866881387032
ccaatcataatgccattatctcatttgaatggggttcaatgggcagatctttttctttgctttaaaagtctcattaagttgcaagttggcacaattcttggacagaatattttattacaggaactctgaaagcattatatgttccacttattgcaataagtgaagtttatcttctgggaaaagtaaacgcagatcttggcttaagttaccttcagcacaacagacactagtcacaattttcttgttctacttgtttctcacaggtaacaaatattaagtaaaggcaaatgtcaagagggcattttaggtgcataaaagggaatttggacacaggttttctgctatagaaatgagtttaggaatgacatcacagtaatggtgagggagcattctctttgctcctcatgctggccctttaagggtcgggctgacctctgctccagcgttcacagaggctcacacatgggagattgatgagaactctagcttctcctctgctgccccatcctgtgttcttatctatggatgaagatgtatagagctcttcattgctggtttggattttggcctatatttcagaaaactgtatttatgttcttttttatttcccatctccctgtttctccaaccctattctcctcctgacataggtcctcaacctatttcttgctttattactgagctcatttagttcagacaatcttacagccattgaagaagacactgatgcaaacaacctccagattgcagtggccagaattaagaagggaataaagtacgtgaaacaaaccttacgggagtttgttctaaaagcattttccaaaaagccaaagatttccaaagagattagacaaacagaagatctaaattgtaaaaaggaaaactacatctctaaccgcacacttgctgaaatgagcaaggatcacaaattccacaaagaaaaagataaaaccagtggttttggaaacagcatggacaaatacttaatggaagaaagtgatggtcag

SEQ ID NO: 38083 - DNA, 925 bp, Bovine  19866881426942
acttacaaacatatcccagttctgtaccactcgtgcttcttacttccctaaagctctctgatctccttgagaaaagtctgtgggtcttaaacatcattgcattccaggaggaagaataatgcctggcatgtagtaagtatttactaaggtaactaacatgttgtcctttactggtcagagggattaatttttaagtaaaaaaaaaaaatgccacaatatttttaacttccaacacatttattaaaaataatgaccatccatttaagcattaggtgtcagatcacttaccagagcaccactgctgagcaagatcatgagaacaatgaagctttcaaaccaactgtgctcaactatcctgaagcaggttttcctgatgttccaccagatttttcctttccctgattctatgttaacttggcagcatgggaacctctgtacgcaacctggcaagaaagacatgcatgtaaaatctggatattcagaataaataaaatacttaagaaatattatttaatgcaaagtgctccctatgacaattcctcaaccaaatactttcaagcacatctgaagcttcaaataattttaacttgggtgttgctttttcttatctcctaaatctccatggcgttttcttaatatttgtcagtaatttctaacttggatatatttgtgttttctatatttctctagttcctcatcaacgtcttctacagtatttaaaccacatactgttatttattattgcagccctaatacaatcctaatcctgatacacaatgagcagtaaataatgattggtgaatcaatataaatctcaagataatattgcatttcatgaccttcttgatgtgaatttagtctataatctggtgcggcttcaactcctctgtaaaaaagcacttttgagaaacagcattctaagtaa

SEQ ID NO: 38084 - DNA, 837 bp, Bovine  19866881465661
ctaatatgctggtctttgaaaatatcctaggttagtcagactttcaggcaagaacacaggctctggtgttcctctttctagcacaatctgttcaagaccactctaagtaatttattactttgtaaaaatgttattacattcccgcagtgcaccctggtgaaactgggcttttcaaatgttaattattcattgaaaaatgatccctgtgacccagttttcctgatagtgttgttcctatgaggagaacaaatcctgtgcttgaatcttgcttagttggcgtactggaacgtgatgttcagtcatttaacctcagtttccattcttttatgaaaagggtaaaggggacatactgatcttgcactctgtagttctctcagtgagggacggcaactagctctactttgattccctctccctcacctctgccatcttcctgctcccttcttattcctcttccagacggggaatgtcatatctttttaatttggaatatttctctacctgtcaatttttctcttaagagtacattcaaaataggtgtatagagcacaggagaatttttagggcagtgaaactgtcattgtgtaatggtgagtacatgttatcatacaattgtcaaaacccatgttatatgtagttaaagaagtgaaccctaagtaaccatggattttaattaatagtgatcatcaatattggcttatcagttgtccaaatgtactacactagtgcaagatgttagaaaataggggaaatctgaggggccaagtgtatatatgggaactctgtacatttcactgtttttgtgtgtggtgtgtaaactgcttccaaaaatctatg

SEQ ID NO: 38085 - DNA, 3278 bp, Bovine  19866880371181
gaattctaaaacgctagtggtcctccgccctgggagaaacatgacggaggacaagtccgtcagagtggagtcagcaaactgaaccaactgctattaaaatatattacccctgcaaagcttataacagatgatcataataacatgtttctgcaactttccttagattctcacaagaagcctttaaatattaagcattaacttcatagtaaattttcttatcttcttatggattaaatatttgttcttatactcgctcattcattaactgagaagtactgaacctttaacatgctttgaccatatgaacacacatataaagcagcacccactctgagagagcatacattttcacagagaggtggacatgtatataaaaatcagtaaatccagggagtaccagatactctttgatatcagtccaataaacattcactgaatgatttctggtcttccctgacagctcaattagtaaagaatcctcctgcaatgcaggagaccccagtttgattcctgggttgggaagatctggtggagaagggataggctacccacttcagtattctgcctggataattccatgaactgtatagttccatggggtagcaaagagtcagacatgaatgagtaactttcactcagagtatatcttttttttttccctcctgagcagaagtaggattatgttgggcttccctggtggctcagcggtaaagggtctgcctgcagtgcaggaaacctgggttcaatccctgggtcaggaatatcccctggggagggcatgacagcccaatccagtattcttgcctggaaaatcccacggacagaggagcctggcaggctatagtccatggggtcgcaaaaagtcagacatgactgagttgactaagcagcagcagcaggattatgatgggcaactcaccctattctacaaaatcatattcataaaagcattgatggtagtcctgtttgctttgcctgtgattgactcaggaagaggctttggccaatgtaatgtgaggggaagtcagctgaggtgcttctgggaatgcttagtgaacaactcctcttcctcctctataaagaagctgcaatgggatgactggaactgtggcagctatactgcaaccagacagaaagctacactgaccatagacgggcaaagcagtaatatggcaagacatatgaggcatttttgtggggttggtgggcagcaaaattaatcaaccctagggctaacttatgcctggactgaaagtgctttaggaaacttagaactcaaaaagaaaatttttaataaattagaagcttcatattaaattgtcacaggttattcttttgccagctactctcctctctgtaaaattgcagttttatttctcattacttgaattctggtccacgtatgaaaagcaaatgaatacctcagagggtgatttgattatccttttatagttactacatctgcactaatgtattgagggttattatgctgtttattttctataatttttcccaattaacagttattaccaggagctatctttgttaagtgaatgttgctgcatacatcagagaaagtgtagtgatataatgtagacaactgcagaaaagggctttttatacaatggtcgggaactaaaacatcaccttaatgcaattaaaactgtacatgttcacaagagcatggtgtcaataaaggccgaattaactgacattaggagaattactcttgcctggcaaatcccatggacggaggagcctggtaggctgcagtccatggggtcgctggagtcggacatgactgatcgacttcgctttcacttttcactttcatgcattggagaaggacatggcaaaccacttcagtgttcttgcctggagaatcccagggacgggggaacctggtgggctgctgtctctggggtcgcacagagtcggacacgactgaagtgacttagcagcagcagcggcggcagcagcagcaggagaatttagcttaattaaaaattataattcagaagtattctaaggcatctttttttcttaaaggagaaacattcttctaatggtttctgactaaaaatgtagatacagaatagaaatgatatctgggaaaatactatagaagcttctataaaatttataagaatgcactcaacatagaagggaagattttgctgttattaagatgtagtcaggttacagccagctgctgacatttgttccatctgagctgaagctaggtggaacatcaccgtgtttataaattcttacagtccaatatgagagaacacattttgttttgaacaagtgagtagtgacagacaagctgtccatagagtatacagatgacagatcaagaggaaaatgagctctgagatagttttacagcatccttcactggaaaaatggccatgtgacatgcgtgctgtgcacagtgggcttcggtattagtgttcatgctgctggaaaatgtattgcttgaactaaatgcaccctctattgagcacaaatgattcaaccacaatttaatagggagatcattacttctgcaaaaggattttcaagattagctgtgaggaatcgaatcattgtctacagaggaaatggagatgttacttgctcagcattgtaaaattgtatggcaacatagacagacatggtctattatttatgtcaataagtagaaggataaattttttaaaaaagtgcatgcttcagttgagttgtaaatactaatacttctacttagccttattaatccccgaggattacttattttccttaagacatcttattttcagcttccaatggtactctgaaaagcaatctgttgagggaatggagttgagatatttcgccatcatgtactcctttcacctgtttaaagtgatggttttcatcacgttgttccccttccactgactgatcagagttgtataggaggactggctaagtgccttgtagcctaccaggtgatctaagtagtctatataagaagagaaagaatagatttaatttaaattattgaattagatgggctgcccaatattaaggaatgggtattgtggctgctgccagtgtctaatagtcagtgtgtgatgctgctcatgtcacataatcagtaattctaaactttcaacttcttggcatataagtattaagctggacaggctttccatgatagctatgacaaactttatggttattagaggccaaatacattttaaaagttacatgtatcatacattttttggtacaaaggattcaattatata

SEQ ID NO: 38086 - DNA, 2364 bp, Bovine  19866880499151
tcaaaccccatatctattatgtctcctgcattggcaggtgggttctttaccaccagcaccacctgggaagccctatctatctcctgcctcacttcaatcctgggagaacccagtattcaacaatcaatcctctcttcttactgcggccatcaatgaccattcatggattaccaaattcatggtagtagtcagtatcactcttatgagttccaaatatgtactagctggttgctcatatgcatttagatataaaaatcacagctcaaatgaattatgtccaaaacagaagtcacagtcttttttccaaaatatgcttcttccccaggattagcacagattgtttctttcccttactcttcacatgaaatccaggaccagtctgtattctctctaccctcctcactctcatatctatctcctccttttcatctccattattaacttggttaaatctttcatctctttcctgaattatagagaatcacatagcttgtatccctgcctcagcttttcctgtcctttaattcatcctacccactgctgtagtaattatatttatcaagtaaaaaaatagataaaataacacccctgcttcaaaatcttcaaattttttcacagattgatggacagagtccaagttctttggcaaagtattcaaggccccattgatctggcacttgcctcctttctaggatcagttttgctaattgctatgcacacttcagttctaatcaaccacttaacctctccagagcaactccttctgcctggaatgttcctctctctcagaggccaatactttctgtttttaggttcaaattaagacttccctcctctacatagtattataactccctcccccgccccaactcaaatttattttattaattacaaattgtattcctcttatttctattcaaatttccaacataacacataaaacatgatgttgcccttattgtcttctacacatttgtctccccaagtacctcataaagataggggttctctattatgtatttcaacatatggcacataacaagtgctcaataagtgtctgctaaattaataaacaaaagaaaaaataaagggataaatggatgagcaaatgtaattgtcaatattgaatgatccctaaagacccccagcgaagtatttcactagacagtaaataaatgcttgattctatatacattgacagtaattaaaagcatagattctccagtcaagttgcttggattctctgcttggtcacttatttaggtgactttgggaaagttacttcatttctatgcaaagaaattggaatgtaatagttccctcttcattgttttcttaggaagattagctgaacatgcttatgttattaagacttatgaggatgaaatgagaatatagtaaatgttacatacattgttaaaaatgctcttaaagagggcttcctttgtggctcagtggtaaagaatctgcctgccactgcaagagacataaattcaacccctggtccaggaagatcccacacgcaatggagcaaataagcccatgtgctgcaactattgagcctgtgctctagagcccaagagccacaactactgagcccatgtgctgtaagtactgaagcccatgagcgctagagcccgcactccacaacaagagaaaccactgccatgagaagcccatataccacactggagagtagcctccacttgccacaactagggaaagtctgcatggcaacaaagacccagcacagccaaaaatgaataaatgaataaaattataaaataataaaatatgaacaaataaagacatttaatcttaaagatataagattagaggcaagaatttgaaagaatattctttctgtttgtatatattgaaaaactctgaagttaaattgttataaatagtatttctgtagtttctgataattttcagcatacaggtaaaaatatacctatttattgaaaatagcaaatttctttcttgcttgtttgagcaaatgcttgctattatcagtttttacttcctaatgagttttctctatactgggatgcaggactagagagggattatgtaggtcactgtggcttttgttgaatcaaaccctggtgaattcaacataaaaatatattactttaatatgcagaatccattggcactggtgggctacactactgatttttattttgccctaactgtcaccaacaattttatgatttaagcccataataagtaaaatttttaaagttaaaataaatctgtaattgttgttgttgttcagtcactaagtcatgtccaactctttgcaacccatggactgcaacaaaccaggactgcaacaaatccagtccttcactatct

SEQ ID NO: 38087 - DNA, 1633 bp, Bovine  19866880592950
aactacttacaatgcccattctgtaagtcctttcttctcttctcttctgacttcattttggcctttatgtaccattgacacctttataagaggtaaagagaaccttatttaggaattatgctggataagaaccaatatcaattaaaatactcctcactcataggcaaaaattcttatcataaagatggcttttaagaacatctttatagaaaatactccatagaagtttctttttactatatcaatattagctccagagaaaaataaaatactctcaagtacattgattgatccaaatgatgggaggcctagaaaatatttaataacaagcagtgacaatcatgtctttccttatatggcctctaacagctatagttggtgaatagctttaaaagtcacaatggaaacattgttcttgattcagaaactcagaaatttagacaactgtattccagtttcagtggtgaacagtgtgtttcttttttttttttttaaattggaagtggtaaaagtgtgttctgttttctgtctcagaaaaatcatgtcctgaagaatggaggcaggaacttatctcctatgacttctttaacatgaaaaattcatcaacatccaatattacctgacagttcatcaaactgctaattccaaatggttaaacagaatacacctgtggtgcacaatccaatctttcaatgtgaatttggcttcagatcctatgacaaattgcatatttattcaaatgtcttaaaattttcatagaataatttccagtgaatgcttctgtagcaaagtgcttaagtcatgcttcagaataaattttttatcttatgtaactgaactttttttttttaatatagaaagttaaggaagtttctgatgtcatataaattggcaaacatggaaactgtactaaattattttcaactttcaatttttgtcattattaaatctttttttaaaatggtattcaaattctgtttcagaaatcctaaataaatataacagccgtgcctatctctcaggtttactaggccaatcttatttagcctataatgactgtcaggtcttcttttaagtttgtcatatttatgtattaaggcagtattttctgatcttttaaggaaatacttttctacgtgtgtatttaaatcatttgcttaaatactctgtggcaataaggcctttaactcatattctacaaatacataaaatataacttaaaattgaactaattatgctacatattgaataactataaataaaatataatttgagtgaacttccataatgaatttagaagcattctttaaaactgatgataaatgtgacactgctgtttaaatgaagtctgagacactatcagctgtaagagtgatgctttgtcataacaaactgtgtaaaaatataaatctaaggtttaggtggaagaagcactttgaccagctggttgggattcaagtctaggtcttttgctacattaaatttattgtcatttaaaattctcatccatattgcacttccacaggaaaatattttcacttgattacataaccaaattaatgcaattctaatatcaatatggttcagtattcaatgaataaaaatttttctatactattaagtttatacagca

SEQ ID NO: 38088 - DNA, 1866 bp, Bovine  19866880642800
ttgtgatacaccatgctgagtcttctgtctatggggagcaatgattgcttcgttgttattcatctggtaggagcctcactgtttctctctgtgaacaacacaaagatttcataggtgcatcatttctggcacaaaccagacagcctgtctcattaacatgctcacccagagttgctgtaactatcagtaagaaactgtgttaaataaatgattttgctttttcacctgctaggctctaatagcatctccaaagtaatcttggtctaacagcttgagtcttttccaaaagtgatcaagtgatcaattctttttaacactaaaaggtaaacttcaacactgtgcaaaattccaggtgcaggagcagttgccgtgaatagaagcaaaaatttaatatgagtcatgcaatttcatatgggtacctactaagaaattttttaaagtcattacactgtgtctgaaagagacaaggcagggtacctaaagtaaatcaggcagttgatctaaaaatagatttttattcattctgaaaatatttcttaaacatttaacatttgccaggatttgctaggcacagaagataaagtaacacataagattggcatggtcataacttgcatcaaaagtacatttttagtaaaggagagagacaaatacagatggaatcatttaattataatttgatgggaactgaatacaggagaaggcaatggcaccccactccagtactcttgcctggaaaatctcatggacagaagagcctggtgggctgcagtccatggggtcgctaagagtcggacacgactgagccccttactttcacttttcacttttatgcattggagaaggaaatgacaacccactccacagtgttcttgcctggagaatcccagggacgggggagcctggtgggctcccgtctatggggtcgcacagagtcggacacaactgaagcgacttagcagcagcagcagcagtaatataatagaacttccctgctggctcagaggttaaagcatttgcctgcaatgtgggagacaattatgtgatataatagactatttcagtgtgcgagatagcaagtaggttggaaatatagatgtgtctcattttcactgaaattaatgcttctaaataacttaccatagagtttgataaagatttatgtatataatttggtgtttaatattgtcaatgtgtttatttttgagcacatccacatgtatttttaaaagaattcatttaaactgtatatatatgacaaaataatgatatattacacctcagaagtgtttatgacaaataaaacccatcacactgaatgtttatgattaaaactcaggaaatgagaaagctaaattgttaaagcacttaattatcatttcacatttattatttgtttacatatttttagagcaaatagtaatttaagaacaggatttatctgttatgacaagatttcacttttaccatttcggattttttctttaattttgtagccttatcatattgtgttaattttatttaaaggagttatatctgggcatttgaaaaaatgttggtgtactttgtttcatgttattttatgaaaaatacagcaacaaacaccctatgggttaattgaatccacagttaagactcacatgttaattaattttaaagaaagcctaatacactatgcaaagtgccaagtctagatgtcaatttcatttttattttaattagatcatccaatttgtgaaggtacttatggtccagtaagtgaaggagacggaagggtgggaagttcattaagattgccatgatgcttctgggaagaagaacaaaacctatgtttgaaatagaagtacttcagttatttataggatt

SEQ ID NO: 38089 - DNA, 1348 bp, Bovine  19866880675219
tagattggatttgcctagaagaccaccaaatgcaagtagatgattgatatattgtttggatttcaaagaagtcagagtagagatgtaaacctgggcaacatcagctgccaccctcaatcaagacaaattcatcttatcaaaaaacttccagtaatattgaacctcaaaaggcaagagcttagggacctcgatccttttcctcctgagatcctccttattgtgaatgtacctgcaagctgtctagcttcatataccaagcaggacttagaggagccgtctttgccaggccacataggttctgtgtgccttaccccagagagtgggtacctggtgcccaaagacaggtgtaagtaatggaagtcactcaagggaattcattccaaataaaatctgttctgagctgactttctctctccacctcttgaagtagagaaaacatgactgaagtgacttagcagcagcagcagcagcaacaccaccaatgtaatgcggccgtgacaggtcaagacaaaaaagagcactccataatcctgtgtgaaaccagacaaaagcacgaatgttgtccacaccctagaatgagtaaacacccctgtattctggctaatgaatgctgccactccaccgacagcttcagcctccatccgtccctcccaccttctacagaagaataattaagataaacatagacttgtcttgcttcctgacagcatccagtccagatcaaagccctgcttccttcaactctcaccaaaaccacctaaaaacagcccaaatcccacaataagccctctccaggaccccctttctgaggcacttcctggttccccaggaggatggagctttctcacagccacgagactagttcaacttctactgtgtccctggtggtctgtggctcaagagctttgacagaaaaggacataaaatttcagcattcattactcatcataataaataagggaaaatattagtgaaacttccgatttatctatatctgaacgtgtttatatgtttgcaggcactggggcaacaggtaacactatttcttcagtgggtcatgaaggaaactgaaagccagcggaccagtggtcaaaagtaggaaaccagctcacagactcaactctggcctgagcctgactgtgtgccctttggaaagtggcttcacttcccttggccctggtatcttcattcatcctagacgtgttcgttgagtaccttccagagatgagcacactctgccttgctgtttcagctctcagacaagtggctttcatggtctatctggtgctatgtaatttgcatttttgtcccttttgttgctgatttttgctgtttaaaatgattccat

SEQ ID NO: 38090 - DNA, 814 bp, Bovine  19866880740310
ccttctccggggatcttcccacccggaattgaactggagtctcctgtgtctcctgcattgcaagtggattctttacctgctgagccattggggaagccactaacaggagagttcttaaagcagtacttcgtcttaaatgaacgaagcactaaagtagaacttacccacctgtcaggtcagcactggagcttctggggagcacatgtttttcagaaatatctggcagaaaaaaaaaaaagaaatatctggcaggtcatatacctccttaccaccacttagtcatatcagggtgccctacgtgcccccctccacactgtagaaatgacgcaagtccatctgatctctttattaaatcatctttgctaaaaataactctgcatatcaacatcaacgttaagggagaaataaaaagtttaaatactgtcagtttgaatttaagtttgcataaaaataaaaacgaggcgatggcctaggctacaaagagttggcctacagaaggtcttagggtttcaattcaattacagcaaaacatctgtctctgttgttgttgaatctgctccttatccctttagtgctttctttgcaaacccagtaagcttcttaagaaaaaaaaaaaaatagaaaaccacatctgtcgacattggaaagaggtaactaccagggaacaaaattaatcacagggtcagtggagatttttgtaatggtttaagctctccctcacatgtactgcctcctgtccactctgcttccgccctgaggatacccgctagtttacattcctttggcaggaagccagaagaacactcggatagca

SEQ ID NO: 38091 - DNA, 1705 bp, Bovine  19866880779595
ttatctctaaatggaatctttttcacaaatacttaacacgaaaacatgcacactgtcaatctacaaaatgaatgctgaacattggagtttttttctacttaccaaacatttatttaatacctacccgaccctatttacttagttccaccaaagttactaaagattgctacgggatacatacatttcattcagtgttttccactcaaccccatgtctggaagtatctttgtttataaattaagagcccacatcccattgtggatgttcttttccttcttttggcatgccttttgcagaacctcggaagcacagtacatatagctctactttaacatccattgcacttattattgactatagctgccatttcactgttcctactatgctgtgcactgactgatggcaggaatgtcagtttgtattcattcttttagtatatctaacacctaataaagtacccagtacatgtaggaggtcaataaacatttggtaaacaaaggcaactaattaaatacctccaaaaaggtatgaaagctacaagatgctattattgaaaattaatgtataatagcaacttagtattaggatgggaagactgacgtttagatttttttatcctgcttggtgtcaataatgcacgaaacaatagtaaaataggataaaagacttgattggagacggaagaaggaagctcttcaagaggatctcagctgtgtgagagtccatggtgccaccttgatgctaatattcttcctcagaagcatccaatgctgtcagggaatctgacagctggctagcactaaggaacagagttgccctgaataattggcactgaaaagtttttactgaaagtgaaaagtcagtcgtgtccgactctttgcgaccccatggactgtagcttaccatgctcctctgtccatgggattctccaagcaagagtactggagtgggttgccatttccttctccagaggatcttcctgacccagggattgaacctggatctccctcattgtaggcagatgctttaccatctgagccaccatgggcataggcaagcttaatttttcactcaaatgcagataatttacatttagaaagcaaggagagtccagataaagtaggtacaaagcccttccctatggaaattggttttccatattatgcatgcttgtgacccttactgatagagccaaattctcctaagaccttaaagtctttccttgaggtaaatcagtcaactttcacattttctttaggacaggataggtgattggctgactccagtttagtctggtaccatccaacttatagttaagagttggtggttttcgttggttgtttttaacataatctgactccaaacacattttatcaattgggatttcctcttcaaacataaatactccagtagaacaaattaaacataatgtacacagtgggaaataaaatccttgaataggtgtcaatgacatggttgttctccagaatgattctaccaacctgccctcctagggattttctcctctgtatccgaggtgaatctgcactgagactgcctatgcatctgccttgcaaggcgtcctcttctgagtgtagagaaaaggaagtctggtccatgtcagtcttacagtcatgataacaaccatcaaaggccatggcttgagttgcctcaatactgtacattctagaaatcaacaaaaaga

SEQ ID NO: 38092 - DNA, 1415 bp, Bovine  19866880793146
tgaattagtgtgaataactattttggaatacgttttataatcaatggtttggtataagcaaattttgcactgtttttgaagaaaatatttgattgttaatgtcataatttagtaaagcattcatttcttttataagtatcatcatcgtatcaagggaagaaaagaagatatgtaatttaggtcagaccaacacatcttaagcattaaaagatgtgtgtttgaaagatgtcagtctccacatgttctggaaataaaaaccagacaaacaatacaataaaacttcatgcatcccatagaagtctgaataaccaatcacttaaaatttcaccatctgctcttactgaagcagcaagattgaggcgttttctggccatgatgatcagaatgtaacagaatgagaaacactaacaggattccctccacacaccctttcttatttactgctgtggttcttaatgaaaacctgagctctacaaagaaaaggggaggatgtcccccgccccatctcctaattgagtgcgtatagccagtaatagctttttgctgccctgggcagcatgacattacctcatttggcctcgcacagctattatttcaggaagcagctagtgaagtgccccaatccatctgcttgcttttcatgggctgatgcttttcttgatgttgacagctgtcttaatattcctgggccacctgccacatagcaaatactgtgccgtaatgcacacacagaaatgtatccctctggtggactttttaaaacaaaaagcatttctaaaccatgcttgcatccttgttgaaagacttcagggtcagcactttgttctcatacttttgaggagtaatgtgcttatgctttgggaatggtagttcagttacagtgtgatgagcttgagcttttctcacatatcaaataagctattgaattgtactctttttgtagaagtcatggtggtcacaggaagcagaagacgagaataaactgacagttatctcctctagtgagccttcatggaaatttctagactaagttggcatgtgtgcatactaagttgcttcagttgtgtccaactctgtgagaccccctgtactgtgacctaccaggctccactgtccatggaattccccaggcaagaagcctgggtgtgggttgccatttcctcctccaggagatcttcccaacccagggatcgaacccatgtcttatatgtctcctgcattggagactaagttggagttcatcctatgtatgctcatagaaggactttctcttttcctatctgctttgctcatctgttcaccccatcagacttgcgtcttgagggaaagctcttggttttatcactgtatctctaagaatgagtgtgtttctgatccatagtcagcactcaaggacaaatccaggttttaaggta

SEQ ID NO: 38093 - DNA, 1854 bp, Bovine  19866880806816
cttgataagaatgccgggagaatttttctttgccattggagtttgggggaatacaaggcacttgttttggatccattcctggaaaagcttaaggtgagataccggctggttggtacttgttctagggagagaacaccagaatgtggttctaaaactgaatttagtatttagcgcaaatagaaaacacacaatatagtattataattagaagcatgcacagtagatctctgacaacccaggcttgaatcttagctctctctcgtctccagatactgtaactttggttaaatcaacatctctatggttcagttttttcatctgtaaaaatgtggataataatatcactcttcttttcttaggaaagttgaataagctaatacatgtgaataatgccaggatcataggatgccctggtggctcagatggtaaagaatctgcctgcaatgctggagatccaggttcgatccctgggtttggaagatccccccggagaaggaaatagtaacccactccagtattcttcctgaaaaataccatggacagaggagcctggtgggctgcagtccatgtgggtgcaaagagttggacacgactcagtgactaaacacacacacacacgctttcactaacagcagagcttgtctttgaatcacatatgtgccttatgggatggggcctgcttgggtatttttccaaaggcactttgtctaaaattttaagatgtcaacagaagggtgaatagctggaaacagagactaatgaaatgatcatgaactctaaaaggtacagactttgttagaaaattttcaggaaagagatgtgtactaactgggaggggtcccaaaagaagctaggaaagcaatgaaagagttagttttaattacccaggaagttcaaatcatcaatgacagatcaagggagtactgagtgagatctatccttctgctttcctagccttctttgcataacctatctgactctaaatgggtcagagaccttttatggacagtggtgacgaggaagttctagcttatatgatcatgatagaagaagcagagtcaagaaaaatgaagtgtttttttctatttgaaatccatggtgtctggctcttttaatctaatagtttggcgttagacattaacttgaggttttgaatataatatcgaaagttgtaagagaatcactgacaattttgcaagtctcttttgaatgcctaatttgtgtgcaagattctgtgaagaagaagatgctgaaacaaaagggatcaatttacatcctgaataaattagttgctactcaacaaaagttttatgatatgtctgtttggttcagtgacttggggcataatgcatatatcatcacaaaatgtcacctgtagactgtggatataaaaaataaccagtggtcttaggacagacagcttcttatgagatgttctcaaggctttccaaagataattaagtggggctaatctttgtcagatgtttgaagaaaggacaaaggatgatttttggtttatactaaaatatccactctgtctacaggaagagtatttaaattgacagtgcttttataacctcacctcgtggactcatctttctttaacttgttttcagtttcaaagtacattttaatataccactatacatgaattctggcactagaatatcatcaaccctattaatcaactgactctccttatgggtttccatgatggtgtcattttttgagtaatatgaaatcagataagctctcactgatgatgtatctcactaaatcactctctgagtgctgataatataatgacaataacatattagcataattcatcatcacatgtacctttgctctggg

SEQ ID NO: 38094 - DNA, 3210 bp, Bovine  19866880836169
cacagtactccccactgttagaatgagctaatgagcagttgcttcaggaccaaaaataagtcttaaggatcaataatttgattactttaaaattccataaaatccctcagctcatcaggttctggaactcctgcacgacaaccccctgggtgggcagcataaaacaagacaccaagacaccaggggagatctgatgtgtccattaatttaggggatacaacggtgtctgctgcataccacctggttttacagatctgaaaagaggccccgagtctaaaaatcagaacaaaagcaaatccaaacctaggcgagtatgaaactgagggaaaataagcataccaagaaatgtatagagagagccaagaataaaaattccttctttaatccctggagtctaaattactgctatattccttcctcctggtccttttctctttataaaataatcaactccaagtcactatatctgcctgactcatttggaattagaaacacattgctggtcatcctctccaaagcactttgtgacacagaccatattatccctaagggacatgtccaagatctgacctttgtagatccagagtgttccatatactagagccaggacatgagaagactgcattatgttatgcaacttttctacctttcatctgtttatttgatattatttcaacttatatctcaaaagcagtgctttactctttcccaggttagatacctttgagagtctatctgtctcacatcggctctgccagttaatcccactgtctatgacaaccccaagagctgttcaccctatgtctaacaataactgtatcatatatttaaaattttcaaagagggtagattttatgttgtgtcttatcacaaaaaaattaataattataaagagggcatgaggaaactctgagaggagacaagtatgtccagggccttgataagtctgatgggtatatacttattcccaaatgcctcaattgtatacaataaatacgtacagctttctacatgccaatcatgcttcaataaagtggtttttataaagagaacctctacccaattccatgctatgtctgaagaaaatatttcatctgaaaacatttgagtgaacataattttcagactgttttaaatttatgtaaataattctttactatacacgtgtattagtctgcagagtaactatatatttactgctacaaatgaaatgttaataagctattggctgaatgagattccagatttccactcctgaagtgctttttagtctagtcattctgtgacaaggaaaatgggaaacgtgacacgggctctacagtaagacagagtcacccatcgaactacagctctgcacctgggcacagtgcctacgctctgagaccctcagtttctgtatctgtaatgtgggagtcataaaactctctatctcatcattgttgtgaagattaagtacaagtatgcatgtaaagccattagtaagcacctgaagatgttagcaatatcataatgaggatgatgatattatctttacaagctaatcttaatttttttaacctaatttaaagagaatagattttctttgaaggaaattatgtgtattaaaaactatgtgttaacattttcaaaaatagccaaaacttctatttgcagcagtagtttaacatggcaatttctggcaatttttccaatgtatattctcatagactgtctatatcaagtatctcctgactttttagctatagtgtttttttcttttcacatttcctactatttgaagaattcaactagtgaaatcttggagttctgcctgctttagtcgcagtcaccttggaagataccatcacattttctgctgaacatttctagaagcaaacttcggctccacttttttttttaaatcaggagggaaattcttaaaatcattcagtactaggtgggagatgctctgaatcatgatgcttaacttcctcaatgcacgtggttatcatgaacaaaaagagaaaaagacgcaggctttatcatgttttgtctggcgtgccttttagtgctcaaggaagaagtggctagagaaaacccgtggcccttgtacattagaattgtgtactaaatacctcaaaagctacctgtccactgctcagacaacttagtacccaatcttcagttggctctgctacacttcttttaggtagaactggtttttcaactcagttttttattaacaaggatcactgtggacaaaaaaaaaagctcccttattccctgtgattcttctctcccattctggctcctgctgcccaaccaagtgaggcgttgcaacagtggtgcttgtgaccctgacagatagaaacttaggggacagagcacacagagcccacctggacccaaggatcacccttcactgcatcatcaattctttcaaaaggtggctttggaggccatgccagatagtttagagtttatatgggtaaagattattttggaaatatactgcagtggtataacttcttaactatgagaaaacatggccctctgaacacactaaagaagtctccagagctggtcagaaaagtgagcaacatctgataagcaagccctgatatcctgcagaactctctagcgtccttctatttcctcttccctgtgttttccagtcctggaacattctagacctcctgcctccaggctgacctcctttacctcatgctagttcttgatacattcaccaaaaaaataaaaacctttctaaaatgctaatctaatcacactcactaggcctaaaattcattccttctggtcaagtcaagaaaaaaagtgtgaacgcctcaacatggcatataaggcccttcattttctggctctggattcatcttcccaagctctaatatcctgattttactgcatttccaaaacatatcagtttcacttatatgagggtttctcaacttcagcaccagtaatattttaggctgatgattccttgctgtggaggctgtccagtgaattgtagggattgaacagcctccctggcctctacccactagctgtctgtagcctgacaacctcccaccctcccaaagtcataacaatccaaaatgtctccagacactgccagatgccccctgcatgagctcatccccaacactggctcccatccttgctttttaaaatgttaacctcttgctaaaacacccatctttcttcttcacc

SEQ ID NO: 38095 - DNA, 719 bp, Bovine  19866880859689
agctaaggagttctaaggaaagattatctttctcacgggcttctgtataatgttcatggatttttaaatttcaaataaaagtgatcgaagcaggttaaaaaaatgaaaggaaaaggaaataaagttctgatagacattaaattgtttagagagagaaatctcagctctttatttaaccatttgacttcaattaagttagaacttattatcattattatttatacatgcaatacaatgtttaatgaatgttgaattcagttttaatgttctttaatgtagaactttcttcagatggcatgatagtgaatttaattgtgtgattcaggaaagtgaaaataaatttctctaatgaatgaaataaaatatttctgaagtgtgacttatatcccaattaaaccttttatttctgacattttaacattattctggttttagttttctttttatttaaaatgccaatgctatcatgcagtgtttaggtttttctaataaaaatgtatttaattgcagtgccacttcaacctttaatacacttgtgacccagctgtaaaaatctccaatttgttttccagggtgggaaaattcccataaggtggacagccccagaagctatcgcctacagaaaattctcctcagcaagtgatgcatggagctatggcattgtcatgtgggaggtcatgtcctatggagagagaccttattgggaaatgtctaaccaa

SEQ ID NO: 38096 - DNA, 1176 bp, Bovine  19866880860398
atactggatgcttggggctagtgcactgggacgacccagaggatggtatggggagggaggagggaggagggttcaggatcgggaacacatgtatacctgtgatggattcattttgatatttggcaaaactaatacaattttgtaaagtttaaaaataaaaaaaattaaaaaaaactaggttgcaaaatagcttatcactaattttttcttaagacaattatttctttagtaaataaataaaagaaacatacactggttattttagtgatttctttttctcttaaaatttccataaataatttgacatgtttaaatgaaataaaaataattcaataattcattcaacatgccaataaggtaaaggacagctacagtgtataaaagaggtcagaatacttattcagcccacttttggagtgttcttgggaagtttccaatggaagcagtctggggaggaaggctggaggcactctattgtaagtggcagactggcacaatgattgctgggatgcagagcaccccacatcccattggttcagtcgggtatattagatgttctgaaaattgctaacacacctccaagccaaattgcacactgacatgttgataccaacttcatcatgatctaaccagtggatccctggaagcagtctgggacaggctgccctattgaaattgcacatataaatcagctgaagtaaaaactccttgcatgaccctgaaacatttcttgaggtctggaatgcattcaccttttaaggtttttactactgatgaagagatatacccatttgttcctagaagctggacacccttgtatctttttctttcaggttacagaaaatggcccttatttttgtagaagaatattaaagtaaggctctttctatttcaattatagccaaggcccaaaaggccaaggagaaaaaaaataatacaaagtaagtatcttacattacaaaactctcctccattacagcaaggctttataagggagattcaaaaacaaaggaacaaaattgctggttttgtcacctgttgcttagtacccagatcactgaagagacccggatggaagtaactattttgggagaatgtatcatcgttggagtgttggggcaccccctcatgtcaaatctagtgaggaaccttgataagaatgccgggagaattttt

SEQ ID NO: 38097 - DNA, 829 bp, Bovine  19866880985673
aactccgggggttggtgatggacagggaggcctggcgtgctgcaattcatagggtcgcaaagagtcggacacgactgagcacctgaactgaactgaactgaactgaacagtgtgcatgtgcttgtgtacatgtaaatctgtatgagttgtgtgtgcacacatgtgtgtatgagtgcgtgagagtatgtgaatgtgtgtgtgtgtatacatatgagtgtgcatgagtgtgatcgtgtatgtgtgtgtgtgtgcatgcttttatagagagtatagaaaggcagaagaaagcacttatgctgctgcccacttgggggatgttggatgatcctgtcacacagattcaagaagatgcaagtgtattcctgataatttaccataaataggactgtaaaactgcctttgttctctcattaaagaaataatgcaatgcaacaacagatttattggccctgtttctggttcaagccaagaggaataaatcttgattcttccttgatggagatagtctttgcgtaggacaagtatccaggtgctatcacagctgccttgaaacattcatggcttcctgaggatatgggtgattttgttcttatcattgatcaaatagcagagtaaatcacttgcataaaataacacctggtggagctctgtgatttgctctcattttctatagttattaattgttgtttacaaatcatgactgcatgtacaaaaaagcttgtgttttctcctattggctcctggctcataatttctacttcatgttctcatagtagcttcaaaagtatttagtgcatatgttacacttttattttatttatagtcactg

SEQ ID NO: 38098 - DNA, 1741 bp, Bovine  19866881126947
aaaataattttagatatatccttgaactggtgtaattgtagaagaaagcattggaaatctgatgagatttctaagaaatatgatttgcctcattgcagatcctctgaaattaatgtgagaaatgtctttatttgcattaaaattgcccaatcaatccactgatgcaccttagcacaatgttgtgtatcaaagctttatgaattgaaacaagaacttatatcagtaatttccctattacagagtagattttcagtgccaagtgaagagtcagtcttccaaatactgctaatgacactcttgccatcagactatcagactgttttttatgcagaagattgagcctagaaaagcttcttattgtcactttaaaattcagctacattttgaataaaccagaaaagttcactgctaaaagtaataagcagtatatttcactataaaatataaaaatactttgtgatgcaaccaacactttcctctattttatatttactaactgtacatttgcatattaagtgcaatttgtctatatcttcctaaaaaataattcagcaattgccttatttgaaaagcatttccagattcactttgaacatattcacacaagtaaagattccattgttaataggtgttttccttttgtttttaaacatgaagtgaaaatgaaaacagatatgaactaccttaccatttacatgcagtatgtcttaatgtaaacagagaaaataagtgatgactatgaagatttccacgtttattttgtaattattcattttccatttaataaaaacattaaactcattacatgttaaaataaaatatatttttaaagaaacatagctatttttccaaaataaacaaaagtttgttgaggagtgtaaacttgatatatattttaattgatatttctattaaaattactataatttacatgcaattataaggaataatacacagtgggttcttttataatccttacatactttatccattttttactcaatgggatcattttgcaaaactaaagtttattatcataaccaggatattgacattaatataatctaacaattttattcagcttcttcacttttacttgtccttatttggtgtgtgtgtgtgtgtttatgtatacatgtgtgttctatagactcttagcatctgggtaggtttgtgtaacaagattctgaacaatactaatcctgcaagaatcttttgttttgttcttttataatcacacccacttctctccatcccttttcctctggaaaatattaatctcatttctatttcaataaatttaatctttttaaaatagtatgtaaatggaattataccgtgtgtaaccttttgagactagttttttcattcagcataatttcccctggagattcatccaagttgtatcaatactatattgctttttactgctgagttgtatttcatggtatgtatgtatctcagtttatcttaccattcatctgcggaaaaatatcttggctgattccatttttagctattaaacataaaactacaatgtacattcatgtacaggtttttatgtgaacagtgtcagactttatttttttaggcttcaaaatcactgcagatggtaattgcagccatgaaattaaaacacgcttactcctgggaaagaaagttatgactaacctagatagcatattcaaaagcagaaacattactttgccaacaaaggtccgtctagtcaaggctatggttt

SEQ ID NO: 38099 - DNA, 1803 bp, Bovine  19866881134071
ttctatgcctcaatttctctgggtaatagggaatgtcagtttttaaaaatacatttttatttgttttaaaatatatttttagaaaataaatatgtttctctaacagcaatggtcaagatagatagaaaagcgcgactatgaaaagaacttgggcagacattgtaataaccaagattttctcttaacatccaataatctattatcattcaaactggaatactgagttcataatctttatatttacgtataaaaaggacctcttattctccccaccttgccaaccaagtgtttgcatccagctcctgtcttcaagctctctggaatcaatggccaaataaaggatttcatgacagattctcagatttaaagcccaaatcttctagatcccttcagtagtgctgacaattcatttgacctcaatattttctgataagtttttttttttaatatgtatttgggtgaaattaatgactttaaggaacattatagaaatttgccaaaatgggaaacttctttggattctaattctatgcatgataaatggggatctttattactacatttaaccttcagcacatttttctttaaaatacagattcaaatgtaaaatctagcatttgcagacattgtactaatttgttccagtcaccctttataacccttaaggctttgagttcataaaacggacatgaattacaatatgaggtctaatatttccatcactggtacacataatttctttccagatcttctttgcgctcctgaggaaaaactctgtgcatagtgcagattgaattgctaaaaatcccgatgagaaatgagaaatatagaagtaaaaagcaaatatgtcatacatgtttatttcagataaatataattttccctccctaaaacgaatttatcttttaaaccagggcaattgggcagaacaaatagattcttttctttgaaaaagaaaacagctatttatgttgaatgttctatctaatagaggtatattgggaactgtaacaattgcaaatagatatgataaaaaagaaataaatgatgttcaacttctgattttagcttctgcactagactatgaaatcagagttatttacttttcatgtaccgccatcatagttttgttgatctaatctatgtccaataaagacacgatcaagaactattacaaatcccaccaactttgtagcattcatcaatctactggcatttttctacttaaaagaccttaaaagtagactatgattgatgacttatactttcttaaagagaatttatgaatttcttctttctgctttgcttttaggagtattttggaaaggctaagtctaatgtaattctgccataattactgcatcactggatgagaagttgtaccacagctgccagagcagttccagtaactgcttaaactctgacttcagcttgttgattgtcttttaaggaaaagctcaggacaacataatctaaacaagtgattgcagggccttagaaaaggaaatgcttaattacttagtaattcatattgtaattcatgttctttttatgaactcaaaggaaataatgctataaaaatggagaactgtatatgtttaatatttatagaagcatgttggaaaatgaagttcctactaataaaatacaaataatttagctgccacagctggaaatctctaactgtagcacatatttctgtaattgctctaatccttatatattctcttgctcttttggcaggcagaccagtaatgattgtggtggaatatatgggagaaatggatctctagactccttttt

SEQ ID NO: 38100 - DNA, 1542 bp, Bovine  19866881179707
taaacatagtactgtacacaatctgcagggcagcggaacttgcagatgcagaggcccaactaggtgtttgctgagaaaagtacaggtgtaagtggaactgtgcagtccacacctttgtttaagggtcaactctgtaaggaaagattaggaaaatcaagttattttctgtttgcatgtggttttcattctcctacaactttcctaaacttgtttatgcagtcaatttttatttttctttgatcatttctcacaatttccagcaatcacgcaactttcatccaatcccagattttgctgccctgtacagtccatagggtcacccagagtcagacatgattgggcacacacacacacacacacacatacacacacacacagctggtttggagctaactactatggaaagtgaattcttttttcttataagtcattgctattatcttatttaaatttagttcccttttgttacttagagtttttgaaatcatcttttctggaagttaatttggatggttttcttctctcctttgtttttccccctttatcacttcaacctagattttcctttcctttaaatctcaaacagatttttacttttgttatgaacaaaatgatcagcagacttggtgcttacattaaattggatccagtaaaataaaatcaagggtttcatttaatacaccacacacacacacctctacaccaacaggcacacaggaatgtgtgcatgcacccacactataataaaataaactaacataaataactgtgattctctttcagaaacatgatggtcacttcacagtcatccagttggtcggtatgctccgaggcattgcatcaggaatgaagtatctttctgatatgggttatgttcaccgagatctagcagctaggaatatattggtcaacagcaacttagtatgcaaagtttctgatttcggtctctcccgagtgctggaagatgatccagaagctgcttatacaacaactgtaagtttatccatccttttcaaatatagtttgtttacttttattgtttgcaatattattagagtaattccagtttgtattatggtctaaagacagaaggaaagattgccccaaaataggatctagacaaggactgagagacattggttttccatgccaattctataaacagcctaccaggcacttcatgaggagaggttggcagggatgattatggaacatacctaatgatacatatacaattagcgatttgtagataatttaatctgcacaaagtttactgagtttagattgctctcatttgactacatggtctcatatctggttatacttaagtgctaagaaatctcttccttcactgaatctgacacacatttacatggacaactgttttatacccacttctagaggagggactctctctcatttgaatattgctaagcaacccatcttaaacttacatagaaaatcttatgcctctttgctctcaattatggaaatgaggtcatatttacctaaaaagaacattaaaagatatattaagagaca

SEQ ID NO: 38101 - DNA, 1294 bp, Bovine  19866881282974
ttaagtaaatgtatatatatttaaaccctttaaaaaactcccttcctcctcaaaattctttataatatacttaatcctcttagggatttccctggtagctcagacgtttaagaatctgactgcaatgtaggacacctgcacccctggagaacggaatggctactcatccagtattcttgcctggagaattccatggacagaggagcctggtggggtatagtccatgggctcacaaagagttggaaatgatggagcgactaatactaacactcttaggtgtgttttaaaaaagaaagaccctatacctttatatttgttcagtaaagggcatctgaaatgtagaaatatgaaattgcaatccagtgtaagttttcatgaaccttgattaatgttttacctttcaattctccactgcagtgatcagcctgagtggatatgatggaggcaaacaagactctggtgacagaatttgttctcacaggactcacagatctcccagggctgaaggtccccctgttcctggtgttcctggtcatctacctcaccaccatggtgggcaaccttgggctgatttttctcatctggaaggacccccatcttcacacccccatgtattcattcctgggcagcttggcctttgcagatgcttgctcatcatcttctgtgattcccaaaatgcttgtcaacatcttagacaagagtcaaatgatgtctctctttgagtgcatggcccaatactatttttttggttccagtgccaccacagaatgtttcctcctggtggtgatggcctatgaccgctatgcagccatatgcagccccttactttacccagtggtgatgtccaacagactctgcacttgcttgataagtgcatcatatgcaattggttttctgcatcctataatacatgtaggattattatctagattaactttctgcaggtctaatacaatacatcatttctactgtgaaatcttgccactttttacaatttcttgcactgacccatctattaatgctttggtgctttttatttttgccgcttttatacaggcttttacttttattaccatcatggcctcatacacctatgtcctctttgccatactgaaaaagaagtctgaaaagggcaggagcaaagccttctccacctgcagtgcccaccttctctctgtttccttgttctatggcactctcttcttcatgtatgtgcatcctgggtctgaccaggatcaatatcaggataaaatgtattcactgttctacacgattaaattcccctgctaaaccc

SEQ ID NO: 38102 - DNA, 742 bp, Bovine  19866881328003
aatatgctctatttttaattttaaactcatcagagtaagttgcttctatctgtcattgaaaacagagtcatttcagaaatggaaaaaagtgttttaatagatttgtttttattagtgattttcctcaaactacatttttggaaaaaaatttaaacatggtaaaacttaagacatattttttttcgccaaactgacagagttaatatatctctctgggatatctaataatattctactgttagaaacaaaagaaagcctaacaaatcccttttacttgaaaatcacatggatatttctcaggatttaggatttgtttgattatagatttagtcgctattttataagcattaaataacctgatctaggtcacctctgagttgaaagctggccacagtctattttaaaaatttgaaataactgtgtaagagctatgttggcatgccaaatgagatatcccagctcattcccactgcatcaactaacatctttcaatcgacaaactgcactttggcacaaacagaaggatggactcctgccacttttttggtccctagtaaaagagttatgaacatatgcagtgtgttgctcatttttagagcttgaggatagcaggtttaatgccaataaaagggcaatgaatggatggagacttgaaagccaaataggcttagcagggagatgtacaaggccatttagcaaggcctatatacgccaggttggaattctctgacatctcatattt

SEQ ID NO: 38103 - DNA, 1362 bp, Bovine  19866881368872
gtgttggagaagactcttgagagtcccttgaactgtggtgttggagaagactcttgagagtcccttggacttggagatccaaccagtcaatcctaaaggaaatcagtcctgaatattcattggaaggactgatgctaaagctgaaactccagtactttggccacctcatgcaaaaagttgactcactggaaaagactctggtgctggaagggattgggggcaggaggaaaaggggacaacagaggatgagatggctggatggcatcaccgactcgatggacgtgagtttgagtgaactcagagttggtgattgacagggaggcctggcatgctgcaattcatggggtcacaaagagtcagacacgactgagcaactgaactgaactgaagtagatgatttaacatctctattgtttacttccacatctgtaaaatgggaccaaaatggctcctacccaacaggaatgctaaaaagattaatttttaaatctataaagcatttagatagtgtgtaactcacagtaagccacattaaatggtagctgatcccctggagaaggaaatggcaacccactccagtattcttgcctgggaaatcccatggacagaggaacctggaaggctacagtccatggggtcgccagagtgggacaggacttaacaactaaaccaccacattattggtaatatagtttaccatttcactttcatggcaactctcatgcataccccttgaagctcagacaggttcattaacccacatgaagacctctaaatcatagtaagtggcatggctgatattcaaattgaggtctgtcttacagacttgtggcattttttgtttctttgctttttatttgctatatcacagggagtaagtcagactattacactttgtcttatctgaattaaatagcattacattaatgacaacctgaataaaataacacagtactctttaaaaatagggaaaatattttgctaagtggaataaatcacctcttattttgtcaaatttggagagatccagatatgccacaatacctagcaaaaatactaatctaaaagacagagaggaaacatgttaattatttattttatgttttctgacttccttgcattaatttagcatgaacatttcaagttattccttctgttttctatctctctctagaagaaaaaagatgattttgaagttggttatgaatctttgcaaagcatttaaaataatttaagtatgctgttgaagtccttgtatgagtatttatgggtgtttatatctggaaataagtgcccacaataaatttaaagaccagatatttattttttacctatgataaatcacactctgtaattattcat

SEQ ID NO: 38104 - DNA, 1611 bp, Bovine  19866881401627
aataaataaatcctagctcttggtggagatctattatttactggttgagagcacagcctttggagtcggaaagctccagaagcatatcttgattcctctaaaactgtgtgaccttggtaaagttactccccaactgctcctacttcacctctgtaaaatgaaggtgataaagtactgtcctcttcaggttacagtgagaattaagtaatataatatgttgggtggttagcacaaagccaacagataagaaacactcattaaacgttagctatcatcatccttgggcttccctagtggctcagatggtaaagaatctgcctgcagtgcaggagacccagtttaatcgctgggtcagaaagatctcctggagaagggaaaggctatccattccggcattcttgccaggagaattccatggatagaggagcctggaagttcatgggatcacagagagttggacaggtttgagtgactaaccacacacatacacacacacaccatcagcatcattcatctacatgaaaggatatgatttgtacatcaaccccttcttttccagggttaaagtcagtagaggggagcacattgtgagaaattcctcatacagaaaacctcctggcaaaactttcttttgcaatgccaaggaaaccagccagcgcagagcagaaagggtaaagttcaagattatttgtcataaacttgcattttgccaagttacacaaacttcatacaagggttgcaatactgccaggagagggcatggatgaggatagcctttttcacattccaaaaaggatccagtagtgaaagcaaggcagtaccttcccggtcttcttgaatcgtttccgctcttccactgtggtgaggtagttcacagctgcatactcaatgactgacaggaagacaaagagggagctgacccacaggtacacatccacagccttgatgtaggacacctggggcatggaggcactcaccccggagaggatcgtggacatggtcagcaccgtggtgattcctgccattcaagaacagtggtgaacatctcagtgacagcaccattcagcttcaggttccagagccagaggacaccaggggggacatttccaggtcgctatctgctgatcacaagtgtgtgagggccgggaatctcagcaagtcacccgagtacagcttgagcctaagccagaacctcccgttgggtttctcttcctgtgtctttttcttaccctcagccccactgtccatgatgttccccttccctccagctaaaagtttccagagtcagacatgtccctaaagattcatggctcctaccctcagctgggcctcttttaaccatcccagaaaagtaaaaacgtattccattttttaaaattctctgagattgtctataccaattttttcagatcctgcatatatgcattaatacacaatatttgtttttctctttctgacttacttcactctgtatgaccatctctaggtccatccatgtctctgcatatgacccagttttgctcctttgtatggctgagtaatattatattgtaaagagaagaaggggacaacagaggatgagatggctggatggcatcaccgactcgacgg

SEQ ID NO: 38105 - DNA, 1098 bp, Bovine  19866881495683
tcttgcctgaaaagtcccttggacagagaaactcgagggctgcagtccaaagggtcacaaagagttggacactactgagcaactaagcacaagcaattataaaaagcacctgatacatagaaggtatttaattaattggtggtaataatcatagcttgcaatttctgaatttactgtgagtcaattattttagattattgactcatttaatcttcaaaataattctctaaggttgatactatttttattcccatttatagataaaaggctttctagaaaatttaagcaacttgcccaaggttgtatgttaagtcacttcagttgtgcctgactctttgagaccctgtggattgtagcccaccagtctcctctgtccatgagattctccaggcaaaaataccagagtaggttgccgtgccctcctccaggggattttcctgacccagggatcgagcctacttctcttacgtctcttgcattggcaggtgggttttttaccactagtgccaccagagaagccccaacccctgatagaactgaagttggagacccctgttttccccaaagtgtgtgcttttacccctgagctatactgtagaagtcttaattttcaaaggagtctctataccacacaagctctatgaaatgagatcaaagcatctttaattatgtatgcctctgtgtcacagtagaagtgtttctattatttcctatcagcaagaatgtggattgactcactgttgtttgaaagtataaatcttttcagcagtactttttgtcttgatgttaaaaatttataaaatgtactgtattatatttcttaaaaatgtttaaggcagtagcttaaaataaaattctaatggtccacatatttagcctattaccaaaaacatgccacaggcacactgaaggcacaaatttcctcgctattttctaagatttttaacttttttttaatgtatcacagtataatgttttatgttattttcatccgagttcaaaataactgttgtttactacataataggagtacattgtaatgctaggagctatactggctccaaagatgacaccaggggtattgcagttcttccaaca

SEQ ID NO: 38106 - DNA, 880 bp, Bovine  19866881600803
gaagggcctgagttggaggtgaggtcaccttggtcgccactgggaaggtccaggctcacctgttctggggtctccagagctcctctctcaggtggtgtgtcaagtggtacacgaatgagtgtcccattctagactgcagctagagtactgctttgagttcatgtcacagtaaaagatcagggtattgatccttgtgaggtttgtcacaactgttcagaatctgaggggtttgaggaagaggactttgggataatacagcagttgctgatgtcacgtgtagatggacagctcaggtcacgtcaaaccgcctgagattctcactttgtagcctgtgattgaactgtaattatggctctcgttttgggaacaagtgataggaacaggaagtaaatcagcttccaggtagatagaaaaattataggagagggttgacattatggggaaagaactgtcagaagctctaagacggcaaagccatggagcttcatgatcatatctattaccctcctccctgctcctagtttctctccaaagaggtctgacattgagacaccagatgtttgggctaaaatgcatgctgtttgactgtcttaaaagtgcagcttttacttaccttttaatttgaaacccagaaatagccataaccacctgttttatattctgctaatggtcattaaaaaaaatacaagtactactctactgctggcagtcactgtttatgaatggacagttttccagatggttgtttggaaattgtcagtgtggaactctgtttttatccctgcagaagcagggttggagatgctgggtggggctccaggccagtagatgaaagtcagtttaatctgtaatgtactgtaccttcagttgggattccctg

SEQ ID NO: 38107 - DNA, 939 bp, Bovine  19866881689361
agagcttgctctcttttaatcatgtaagagcacagtgaaagggtggttttctacaggccaggaagggacctctcaccagggaattgaataagccaaagccttgatgctggacttttcgccttcggaacttggagaaataaattcctattgcttaagccagtcagtctatggcattttgtcatggcagcccaaactgattaacagagtcaggtgaagaaaatttctaataggtattttagtttggatgtctgaaaatctgattatatgcttaaaaattagaatttgcggcttgaaaataaaagttttataaactatatctcagtaataggtcttcatccatcataaactccatgttctatgaagtttctttagtgttagaatccactggaggagctcttaaattatgttaacatctttcttaagatgaacatgagggcttgagatacctccaagtaagctgaccaacatcagggagctctgtctttacaattctttttgctctgaacttcttttgataacattgtaccaaaaaaatctttatcaatattttccatctatatgaaaaatgcagctcatagtatgagggctcagaaatactgtcagtgctatggcactacaaaaagagatgttatttttggatttacaaagatggcagggaaccaatattttccactttcttataggaagtaactcatcttagaaattcagtgaaaaaggctgcatctgacatgaactttgagcaagtatattgatagaaatgacaagatatagaaaggagtcactgaaatctggaaaaggaactcagattagaccaaaacagacaattatcttagatattttttatgaattctttactgagaagaaattagaatttaatattagaatactattttcttgtattgagtagacttacgattaatgtaatgtctgataaaatgt

SEQ ID NO: 38108 - DNA, 848 bp, Bovine  19866881759234
tttacaaattgtataattaaaactttcatcactgacaaatgcagtcttccacttttttttgttttgtctttttagttagaggtacttatgtgaaatagtttctgagtctgttaccaatggtttgtatgactagaaatactgtctcattgaggcagaaaattttggaacaccagagttgacataagggaggcttttgtttttgttttagtaaatttatttagctaacatgtaagaaataattatattaattttaaatcctcttttagggaagtaattatcttctccttttcctggaacaaattcagaaattctgctaggcctcacccttaaatcttcctctttttaagcagccccccttttatcccttgattttctccagcccccttatactttgtatccagagttgctttccctagggagtatcctggaatttgttgcagtgagatttaatctatatgaaagaaatcattaaatcacataaactctagctaatggaaggcatttttttatactttcattcagtgtaatggaatacttcagtaattaagtatatgaaatagtgacaaagtcacaaaggtgctatagctttttgtatttatggatttctgtaccaaatacaatagtgtgtcccatataatatatggctatgccaaaatgaaaactgaccttatttcaaaaggatcatgccattaatgtttaggggaaaaggtcaatgcattattttcaggcctaagaatcctaaaacagtcattgcatctgaatgaaaaagataaaaaaaaagtcactgatgtctttggctgacatttgtgaggagtggaaaatgaataaattcactcacagtgattgat

SEQ ID NO: 38109 - DNA, 2619 bp, Bovine  19866880187830
ggtgtacatgtgtcccccatcctgaccttccctcccacctccctccccatcccatccctcagggtcatcccagtgcactggccctgagcaccctgtctcatgcatcaaacctggactggtgatctatttcacatatgataatatacatgtttcaatgctattctctcaaatcatcccaccctcgccttctcccacagagcccaaaagtctgttctttacatctgtgtctctttcgctgtctcacatatagggtcatcgttaccatctttctaaattccatatatatgcgttaatatactgtattggtgtttttctttctgtttcatccacctcattaggactgattcaaatgcattctgtttagtagctgagtaatatcccattgtgtatatgcaccaagtttcttgaaaggggctgaaaccatcacatgcgagtaaggaagcctcgaaaatcaggaagccttcaacacaagcagtgctgggagaagagagcgaggggttgagcagccctgcccccgggcgccacgcccatggctgtagtctcctcctgacacacaggagggttcccgtgtctgctgtgggatctgtctgcccacctggagccagagccccgagggtggaggggcaggcactcaggtgaagttcagcaaacaccactggacacgttagtggagagggagctttgggaaccaggcagggaggtgttcaagcaggagcggggctggaagtgccgctgctgtgggtcaatgcaggcttggccggccctggagtcagtgacccatgatgccagagtggagactgcagccccttgtctgagcgtcagcagaagaagcctgatcaggagacttgagagaggcagtgggggcccgggctttgctgggacagaagccccggaagaggggtagatgaatcaggaaggtacaagtggtggtttagtcgctaagtcgtgtctgactcttgcggcctcatggactgtagcccgccaggctcctccgtccctgggattctccaggcaagaatactggagtgggttgccatttccttctccaggggatcttcccaacccaggaatcgaacccagatctcccacactgcagcagatgctttaacctctgagccaccagggaaacccaataaaatatgttttaatctaagataaatcttgggcagcaggtgagtgtgcacataaacgaaatgaaagttttaagttaaaataaataaaaatcagctattttgtcttaatttaatgaaaatatagacaatgtataccaaacaaatttatgattattggctaatgtgatattctatcttctgtatctatcaattgttcaactcaatatcacttcagttcaagaaatattaaacatttattaagggaagagaccatttcctaagttcatatgtttctataacctatgttgagaagcaaaattgatgctcaaaaatgttatgttggatttaatttcattttttaaagttcaggattgaaatgaatatctagcatttgttaatgactttaattccaaacagaaaaagacacatgattactatgtattcaataagggctctgaatcacagtagtgggaaatactagcataattcaaaactctagtttcccactggagagaccagacctctggccaaaaatgagtagcaaggaaatacaatctgcttgcttatgacagaagtgcttgaacaagtaatgtctgttccagcagtggacataatagcctggtgtgatactgataaatgttacggtgattttcccatcagcttagtaaagacatatcattttcagcatggatcataacatagtttaattcatgctgcaaagcagaatcagtatgaggatttgagcattgggagagctgttatagaaaggcttaattccccattcaaaattttgagcctaaatattattgaaatccagatggctgatttaaagcataccacaaaggataattgtagaatgtccctaaagtgttgggatgtaattgaagtatcatttgacttttcatttgcaagataagcagtttttcatggcatccttcttatatttgtctaaaaaggatttcttagtgggaccagaaagtttagtagtgaaatagaacttttgaagcagttgcagtcaagttgagaagtagttttccagatgagacaagaagaacaaaacatgatagataagaggatgaagacctctagcaaaataaatcagtttcttctactgtagagggaatttgttcagtgaagtttaattctctgatgactattaattcatataattttgcagtgtgtatgacatccatgcttcattgtgtcagtgaagccattgaatatttgagtgataaattgaaaatattagagattgatgatccaattaatgagattagcagaagcagagtagagagcaaaaaatttaagtgaaaggagacaaaagttctctacctgttttaaaatctattaatttttgtgggcattaacaggtgaaaaactttgaaaatgcactgaaagttttatatttaccagtaagaaaaataaagccattttaatggctgtctttttattattttattttcaataaaaaagtcatagaagcaatcactaggctacatatcatatt

SEQ ID NO: 38110 - DNA, 1261 bp, Bovine  19866880511966
tcaaggctatggtttttcccagtggtcatgtatggatgtgagagttggattgtgaagaaggctgagtgccgaagaattgatgcttttgaactgtggtcttggagaagactcttgagagtcccttggactgcaaggagatccaaccagtccattctgaaggagatcggccctgggatttctttggaaggaatgacgcttaagctgaaactccagtactttggccacctaatgtgaagagctgactcattggaaaagactctgatgctgggagagatttggggcaggaggagtaggggacgacagaggatgagatggcgggatggcatcactgactcgacggacgtgagtctgagtgaactccggaagttggtgatggacagggaggcctggcgtgctgcgattcatggggtcgcagagttggacatgactgagcgactgaactgaactgaactgaagctccttatacatgccattattttgaaaacatttagaatacttgagtcattgaaaaaagacacacacacacaaattccaacatctacttgatgatgaatcaataaagcaccaggaaatctagttttattgtatgctgcttccaccaacaaatgcaatttgtaggctgtgaatgagttgtggtgcattggctgcctaaacaaattgcagaggcaataatccgaagttcacttttgaagctggcggtgtttttttctgaagttaaatgcaatgacgactattacatttgtgtcttattaaccagcttcaaatagagctacaaagcagtttgttcccactttaagggaagccctagagacattcttttgctatgaaaggatttgtctttgccacactgtttgataaatttccacgtactgcaatgaatgaaagaaggggaattttggcatgtgtttaaaaggaaaagaaacatttgtgtagtgtattttttcccctaattggatagtaagaaatggatcaaaatataaatgttatgggtctatttgcccctgagatgcttgggatttagaatggacaattgggattaaagactaaaactctgtaaatcaaatgcaatttttaaaaaatgaatttgcttcagatttggtaaacagaagttaaaatatgaaatggtctatataactgatgattatctataatacaaggtagagataataatatatttacaattgtgccattttaaaataatatttgattgaatattttctgaatcagcaatgaaaacactcattccatgcccacaaaacaa

SEQ ID NO: 38111 - DNA, 2118 bp, Bovine  19866880794111
agctgctttgtgcagtatgcctgtaacagcttctccatgaaagccctggctgctatggctctggggctatattagtgtggcatcatggttatgttagatgaggttatgtcatttctatgttatggctatgttatggttatgttgtggctgctgctagggctgctgcatcagacagaagagaggctatgttatggctgctgtgccatccaggagagaataaatgtgtttgtagttcctttgactcctcaagtctccttccagcctcttagctcacgccttgcctaccctgggttcagcaaacagtgtggacactgtgaacagcaagacaattggtgctatgaataggatgaagagttatacaatgagtaacccaaagtctgaggaactgacttcattagacttccttcatctgttactgttttgttattattatctgaaagaagttttaggataagtaaaggtaggtactgaaatacctcatagtgattctaaaacaattgtggacatatgacatacacataccttttggaaattctcactaatagtaatttaacatttgcttcctttttcttcccagctgccttatctctaaactgtccgtttaaaaatctccttgaaatctctattgcctatccttttcattttttttgcccttgaaatttatattatctacagatttagagctgtgaacatgaagatttcttcccctgaaatagtcttgctgatggatattgtccaagcaatttgtgtaacactaccaacccactcatgtaagagtgcttttgcttttctgttccaggtcattgtagaacatactccaaatcaataaaaagtgtggagaaatagtgccttaaggaaaaaagccctgttaagcaatgtttgaatatatgtttcttcacagaagagtccataaaaaaagtggatattatgttttgcttatggaagtttaaagctgttacagacaaagactgttatataaacattaaaggaatactattttgaaatatgttaataccttgaatgtgaaagttttatttttaattattatttatgtctaactgaaaaaatattgtttaattgagatagaccagagttcaatagttcacagttagatgttagatgcctggagtatctacagtagtgaatcatctgaaaacattactacttttggcatttgactttagaaacagttatagctcctataattactcttgatatataaaagaaacttaacactcgtcccaaagttgtttaactataaaattaatctctagtgtattacctcatgaagacgagttaaccctgtttatctttctgtgccgagagataacatgagtgagtagccaactgaatgttaaagatttaaaacagttgtcaaacactatattcccctcatctggttagggattgctgaaacatcagcattagagatcatagatcatttattttgattttaacattcatctgggatagcattcatgattgacaatcttataattgctgaccatgttctcagttttcttcctacaaccagaatcacatcattgtgttaacagatatcaggcaaatcacttactttgtagacttggtcaaatatcattaatgcttcaggtataatatttttacagccaatttccttgtaatccctgggatgtaccctatctggtcttccatatttttagccacacaatattgtagtatcaaatccctcttcctaaaaaaaaaaaaaaaaaaccctcttccttttacattttagtgtctgtaacaaacatatgctactatgcccttttgttttatatcaagtggtttgagtttgtttagtaaagctttagatgtgattttttttcatagaactaaaatagtgctatatattatattacatattagatatcataatttctatatgagctattttaaatttcgtttgaaaattaccattttgtattgaatttggggttttttccttccccaatgttcttatctattttcaggtttcctagcaaaagtaagtctaagacatcattttcactatatgctgggaattaaatgtatacataagatgaaaaattttggggtaagtttaatttgtcaatttttctcatatgattactataacat

SEQ ID NO: 38112 - DNA, 839 bp, Bovine  19866880928157
atcaattctagttttaagagaataaaagtaaaccattagctgcttaaaataaatgaaaatatttctatttaaaattaaataaaaatactgcagtccctcaggagagattcttagattttacttttccaagtgacctactttttaagcagttgtaattacttccaatcatctttctattcaatttattaaatgaaggctttgctttttaatggataatctgcattctattaaagattgaaagcaatgcctatggcttagttattcttcactgaagcaaactctttttggggactcaatgcttatcttatagttaaaatgcacatttcaggaaattaatttcaggcttgaaagacaagaggcatgcatatatccaatatggttacagcacaagaaagcaagcaactttgatttctaaagtactaattgtcacgttctggaactcccttgagataatgtaagttagatcctaattttcaaagaagcctacatagaaataataagtacaaaataacagacccagtatgtgtgcttgatgtcattagaatgctaataggaaatgcttcagttaatgaaaggcaagagttcacatcatatttaaacaaaggcactgtgaacaattaaggttttgaaatacttaataaaataattgtattttcttattttctttttaaatctgaaatagttatcatatacttagataaatgaaggagatttgatggcacatcgtttcttttcttatcaagtctaaattgtgaataggtaatggtcatgactggggcttccttggtggctcagtggtaagaattcacctgccaatgcaggagaccccggttcaatcc

SEQ ID NO: 38113 - DNA, 1214 bp, Bovine  19866881013803
aaacaacccacctgccagtgcaggcgacttaagagatgctggtttgatccctgggttgagaagacccccctggagaagggaatggctactcactccaagtattcttgcctggagaatcccatggacagaggagcctggtgggctgcagtccatgggggtcatgaagagtcggacatgactgaagtgacttagtatgcatgcattgatacatgatctttacctagagatctttagatccttaaattttcagcaaagtcaatgattagattaaaactttattttaaaaaatatctcatcacttattttaaaagtttctatgtcacactatttataggaaatcatgtcgttaagataatgcttcatttcaaaacatactggagcccatggggctttatatgacatgtttaaggaatgtataattttcatcatcccccacactataatgtgcaacattatttgcctttgagaagaattaatgaaaacataacttgacattatgattatggacatctgtctttgtttatattcatctcggcttaatgcagaaatgtcaaagaaagtatgtagggtgaatactgtgtatctttcagttttactctcattgctcagcacaaagagatgaaaaaggcattgtgcttcttgtgtggtaggaatttagctaatggatatataaagcaaacaaagctggaaggaaaagttttattgctccatcctggaccatatggatttttgtggtttttgtttttactttattggatgttgttgttgttgttgtttaaaggatgcttaatttgaaagatctggaacctcactaaaatttggattcataccaacacaaaacttggtcttaaaacatactaaaactttgcttattctcttgccaaggaaaaggagtcacacatgtttggatatctctgtagaaatccaaaggactgacaataaggaggaaaatactttctgcttaagctattgcaaatttttccctttacaacaggaaaaaaaagaaaatatttgatgataaacatgactacataatattaactatttttactaatatttaatagctaatactgttttaaccaaggctactaatgatataaatatcccaggattcatattttgttttagtcagatttaactgcccaatagttgttttcttgatatatggacttacagaatcaaattgccttttcactagctccttttattccagg

SEQ ID NO: 38114 - DNA, 1169 bp, Bovine  19866881135023
ctgtgggtgggcttaaaccaatctaaaacctgaaatcttttatcatcaatgctgactgtcagaggctctgtctacatgaagccaaaatagccagatggaaagtgaaaagcaacatccatcatctaaacatttccctttcccattgccaagcctgtagatacttggaaacaacgtcacggttgcctggatgttttacttttaatctagaggttttggtattgtgtagatacaatctcagcatgtaacttcctgtacaaaattcccagatcggcacaatgctagatacattagaaaaataacacacacacacacatattacattgaactgtattatcttaaaccatgaataatgcattatgttcagtactatagcagatattgtgctgaataaccacaattgaaaacaaaaaataatcacatacatgcacatattagtgtcctaaagtgtaagtgttagtcgcccagtcgtgctcaactctttgtgaccccatggactgcagcccaccaggctcttctgtccgtaagattttccaggcaagaatactggagtgggttgccatttccttctccaggggatcttctcgactcagggattgaacccaggtctcctgtattgataggcagattctttattgctgagcccctctatgatcatatctaattttacttctcttggccttggattcctgttccttaatgtccgtgtcttttacttccttgtctcttattttttctcattcttcttctctacttttttcctttctgccttcctctgagggctgctttcctgtccacctgctgcctgcctccgccctgccagttggtgttatctctatgccgggggtgtcttgtccccctcctggccagtaacctggccctggcttggtcaagccagagagcgccacctagaggccatcccaggacccacactccaatcatcccagtagccctccagtgctcataacatccaggaccactcctcagacttcatggcctagactttaggacattccaaacccacagcccccgtctcaccatgactcacctactgaccagtgacttcggccattcacatctgttctgggttccctcagctcacagggcaggagcaggctaggctgttctgtctgccaaacctcatcacagctgccttcccactgggctgagga

SEQ ID NO: 38115 - DNA, 717 bp, Bovine  19866881192141
tctaaaaaatgaatgcatattttagacctgtttccaaatatatagcaaaattatggcaaacagatattttttttaaaaaagagagaaaacatattgatgaggggtaaagataaatagtcattcctgtttgttagaaattttccatataaatatcatagtagctaatactaaattcaactgattatgaaaataatctcatttattagctgtaaacaagctattttgactcacctctcattcttccctctcacaatttccttcttgagcttattttaacgagatggatggcatatggtgatctctttccaaccctaagcttcagcaggaaactggcttgcagctggaattcataatgtgctgatgcatcccaggacttgctttagttacatgtggcacttcaaagaaggttcaaagggaccaatagagagaattctgggacagactcagaatggcaaaaggatcaacatgtgaggtgctgtctttgaagaaccacatgtagcagtagacgcagagcctgggtgcatgttgtacattttacttgaagtgccaacttaatgtacaaagtgggacctgggaagaattagagcaccaatgagcctgcttcactaagacggaaaataacattccttgttatttaaacatgcagaagaactctttatgacatctaaatttaggaaatatagcaaagacagaaggaaaggaaaagagaagaaaatt

SEQ ID NO: 38116 - DNA, 1746 bp, Bovine  19866881213189
cagctgagccactaggaagccctgatttatgtttacattgattataatacagagaccttcttctcattttctgttgcaggtggtgtttcactgtcttttttggtaaaatatcacgttgccaattcctataagagccttgatttatctgtcttgtcttagggtcctcatgatatcagtcaatcaaccaatgtctcagtttattctcaaagttcttggtattttagaaatactaccctttcttgattgggcttccccagtgtctcagtcagtaaagaattctcttgcaatgcaggagatcgcctacaacacaggagacccaggttcaatctctgagtctggaaaatgccctagagaagaaaatggcaattcgctccagtattctaggctgggaaattccagagacagaggagcctggatggccacagcctatggggttccaagagttagacacgacttggtaactaagccaccaccaccagcacccttccttgattatacctgtgctgtcagttgactcagagcttgaattcttggtagggatttcagagaaagacactctcataaattgctgcataacatataaactttttaataaaaactcctggttccttttgtcccagactggcttccccttacctaaagtaattttatcttccttcccaaatgtacaacacatttaacctttgctcaggtacacaaagagtcccatccagtcacttcatctggctaaaaatgtatcttactcatgaggtcttcttgcttcctctgatatatcgaataatagactaaactttcttttcctgtcctctccttcaaatttgtataccaaacacacaatggtaaaatagggacaaaacttttctttttattaggaggaaaaaaaaaaattgatgaaagatacagcttaaagcaattctgaaatcccaagagaaggaaaatgccattcatgactttaccaatcacctttaaaacaatttctaatttatggtactgccacatcaactgtatttatatgtgtggcttatctcagttttctgcacattaatttggattccactttttgatatgctgtttaaaatggagtatttattttgataaatttgataaatcttgataattaagaaaaaaatgttggcataactaccctgaaatgaaaattggtatttatactaattaaaaaaaatgatattgagattagaagttctgagatgcagagataatttatgatatatactcattttttgtgaattttaaaacttctatttctgtatcctcaggtatagttgctcatttcttggtattcagttgaatctggaactaaatcttcacaataaatgaagaaaattaatatataaaataacattttcctcttagaatgaactttgcagacaacacaattttatatgttatattgttattctgaattcttaatgtttttgtttaatattttggtgaaaagaaaaaataaatattccaatataagaagaaataaaataataaaagtaatgcttggaattgctatttctaacacctatccagttaggaagagaaagacaattcaatgtgtgctccctgctagaaaagctaatctaatagttttgatacagatgcatgaatattgaagtcaatgtgtgtgtgtgcatgcactcagtcatgtctgagtctttgtgaccccattcactgtagcccgccaggctcctctgtccatgggattttccatgcaagaatcaatacatacaagttaaa

SEQ ID NO: 38117 - DNA, 1518 bp, Bovine  19866880556764
atacagctgtcttacaaggttgggtctataaaagccatctttagaatgaaaaagaaatcttcatttcatgacaaagaaagtcccagctcatctgactgttgtgcaagatcaatgattttgtgtcccagagcctgacattcctcaataggtaggacgctgatgactcggcattttggtaattgtgcacatacactcagaagtttttgagcaagggaaatggaaatgcttttaataaaaaaaaaaagagaagaaatcagtaacatacgagtgtcccagcagcatggcaaactagttcaagttgtataattccccttggcattttctaagagcacagaggcgcagcttgggggagtgaagagagaagaaaaattctaagcacagggcaaagaagtctaagaggcgacggattgggcagtgatgcatgaaactgaccacaggatccctcaatagggctcaggccaagctgttgacatctccctcgcccatcttgctcttacatcatgctctcaatttgggtggagaagtgtggcaagctcaatcctgcagacttcacgtggtttgcctgtaaggtacatctgtcctggatggcaagttggagttactgaggttgggtggagaagacactggggtaaaatcgggttgtggtgagagaaggggtggaagaggattttaaagagaagtcagggctggatggaatctcccctcattctgtacggataggcaggggccctgaaaacctagacacacctctgcgactcttgctttactcgtgacacctgtgcccagagctctcacaactctatcccaggaacaggagccacgcacagaagaacgcttcattctccttttcagtctggggatgtgagaagaggtagggttcatcagctgcctgcttacatctttccaagtctcactgagggacagagaggaacagcccaatttggtcatcgtcactatgccacaggccatctgtgctttctaaactggatgcgggaatttaattacacaggcttataagagtacaaactaggattattaaaattcatcattctggggtactattcaacatcagaaaaccaaatgccaaaagctctctgtcaaagctacaatgtgaactctgcaaatcagcccaagttaggagcccagatgaactcgctcacattacatggagctttaatggttcccaaatgttgactatgcaagagccgacccaaaggaatatttccacttaccacatttcacaaagtaaaaagattatttttaggttcttcctttatattctggggaaaaaactatcctcactgatctcaaagtacattacaaatgcaactgggctttgaacaaggactctcgctcgcggcctctctctcgcttttgttctttcatggattcagaaggactgtcatggggaacttgaaatcatctccaccatcaggagaagaaaaaaggaacgaatccggggagagggaatggtaactgtagtgcggctgtgtactctcagggttttaaataaaaacg

SEQ ID NO: 38118 - DNA, 2446 bp, Bovine  19866880581881
gttaaaatttaataaaatttgtaatttttattactctatcaaaggaattattaagtaaaactgacattttgttttaagtatgtgacttgaccaccagcatggtttgatgttcctgccttgatctgtattaagctcttgggctcattgttgcttttgtaccatcagtccaagtgtcaagcagttttcccagtacaaaccatgagagtcaaattatttaacactatttaatcaccctatgtatttagtgccaagcatttgtgtttagtgacaatacaccaggcgtattttactgtcagtcacatgaaagaatttatttatcaatgattagttggtgctgatgttggatagatacaagaaaaagctatgtctgtagatatgagatattaatatccagagatgttaactttgtcttcatgattgcagttaaacttttaatttaatgtgtgttgttaagaaatagcctgggctgatttcttttactaactttaatgacttttcatctagcaggtattcagcaatgtcagcctctatgagtcttctggctaccttgcgtatctttctagttggtgcagtatgaaaacctattctttaagatgcttttctaaatttatgtatacacttctgtattttaaatagataaccagcaaggacctactatatagcacagggaactctgctcagtggtacatggcagcttggatgggaggggagtttgggggagaatggatacctctatatgtatggctgagtccctttgctgtctacctgaaactatcacaacattgttaatcagctatactctaatataaaataaaaagcttaaaaaataaagttatttttgaagacttctctagattttaaatttagacaagtcttaaataattttgaaatgctatttgcaaaataagacaaaaaatgttcttactttcatatatgcctaagaaaaacattagaatttcaaaataacttattggatgattttaaggttacacagatgatagcaggtaaaataaaaatagcttgtaataatacagtagaagtattgagaacaaagtgagttaacctgtgaaaacatacatatctataccccaaaatatcatagaaaaatctagaaacaagaataaataagtacatattccattatgtcagggcaatgacattgtcacatgttatatagattcttatgagaaagtgagagtgaaaatggcaaataattgtcatcatgttattatgaaaatagctttgatctcatggacttccagaatcttggggactcccaggtgtccctggaccatactctgataaccacagatgtagagtgagggtaggcatcagagagtctggttgtttctcaatattcttgtttccagccccttttctcccctattctcaaaggcacctggtgcttccagcttctgaaactttatagggttccacagcaagaagcagcctgcttttgggtttccctgaaaggattcacaggtgtaaaattcagcctcctccagttagctaagtcagttaccactcttccttctgttttctaatatcaacatttttactgtggtattttcctgtcctgttctcttagaccttctgggttaatacctttctctctctctctctctttctttttttggtcccattgccattgtttcagtgggattttgggagtgagcttaggaaatcctgtttttaaacaccatatttgacttgaaattctgctatctgcttttttgatcttctaggattatttttaataacagaaaatttaaagattaatttaaaaatatgaagttaatgttaatatttagccacttatatatgaacacatgtgtgctcagttctgtctgactcttttgcaaccccatggactgtagcccaccaggctcctctgtccatggaatttttcaggcaagaatactggagtgggttgccatttcctactccaggggatcttcccaacccagggagagaacccacgtctcttgcatctcctgcactggcaggcacattctttaccacttgcgccacctaagaagccccatttatcaagttaggcaaacccaaatattctctctgcttaggcctcatcagagacaaagagaataaaaaattatagctatgtagcccagacatcaggattttgaaatttattacatgcttctgacatttagtgaggactgagaactactgccctggattcttctgattgagcaggtagcctgtgagcacttgaactccagagagcacactcagcatacagcttctagaccaccaccagcagcagcaccacctgggggcttgtgagaaatgcacattctcaagtcgcattccagactgactgaatcaaggcccaacaatctgttctagcacaccctccacataattctgatgctctctgaccttgagaaccacagaggatgactgccgctctctaagaagcatt

SEQ ID NO: 38119 - DNA, 1326 bp, Bovine  19866880608223
aaagagaaaagaaagtttttctctttttggtcttggtctgcacttatatacctcacttctgctgttgtaagaaaattaaatatgatgcatataatatagctgtaggcttaaatagatcaattttaagagatcaagtgtataatttagacttttggctatatttaaaggcataaaaatgaacatttaaaaaagtcatcgcaagagcaactatgggtttgcacacaatgtaagtaaatgtgagcaaaatgaccctgagaatagcatctatttgaaaaatcatgaacatttccagaggtgattggacattagagtgactttgtaagcaacaattctgcttaaaggaaaaagctgaaagaatctcacataggtaatccgttttagagaaaagagtgctaatgaaatgcaagctttatttaccaaaaaaaaatggagaaaaaagcaatgtgattcacaggagtgttaaaacttatttaaaacactattttggaagtgaagaacttctagggctgcatcttatagtttggaagaaagaacaagaactttgaagtcaaatagccttgggcagaatccctctgattcttagtaggttgtggccttgtgaagaaacaatctttcagagctgtttcccatctataaagtagggctaatgtctacttcacaaaactgttattaaaattaaatgaggtaatgcatgaaaagcactttgtgcagtgcacacaacaacatattgagtcctcatgaaatgttgagttcccttttccttttcccttctgtctttctgtgacccttcctaatctctctgtttctggaagtgtcttgctatataatatacagatgtttaggacctattctattactgaacatttttatattggattggtcaaaatgttagcttgggtttttttttaacatcttacagagaaccctgacgaactttttggccaaccccagtagcactgtgtggacgcttcaagtcttttgcttatagtcttttcaatcaaaggaagaaactgagtggttctgtgaggtaaacctgttgtgttttgtttattaattcattcaagagatatttatcgagcatgtattatatcaggcattgtgctagatcttaaagatagactcaggagaaaaaatgagacaagagccttccccatgaggagcttagtggtcttctagttagcaaagagtttatccctccagtgatcacttctataagccatacctattcttctggaagaaaagatagaaaggggagaggtgctcctggtagaggaaataagaatgacaataggaagcaaatctttgtgggccccagagagagctatg

SEQ ID NO: 38120 - DNA, 1393 bp, Bovine  19866880610789
ctgccatggcttcctttcaagacaataacaagtcccatgctgtttcttctcactgtaggtcagtgcagctgaacggccagcccctagtgatggtggacgatgggaccctcccagaactgaaggccccgccccctgcgggccggccggacattggtcatgcctccagtcaccatgggcttttatgtggtcaagaacgtcaaacgctttggcctgccgctaccgataaatccccttacactcacgagtcaccagcaggcctgccagactactttccactcttctgccctaatggtatcagtattttttcaggcatcttctgagcaaccaaccagtctctgccagcccatcctgctggaatcaacactgacatgctctccaaagagacaaataccctagcatgagcttagcctaagtaggtcactcccaccctaagggaagaagtggacgtccccggcacctgtgttagcacgaatgcatgtgtgtgaagctgtctgcagccttgtccatgcaccatgagaacgagctgacggtgcgtgcccaggacagatacaactccccacaatcctgctcgcgtagcagagtaactacagaccttggcctgtggctgctgccctcggcagaagatgaggaaggaaaaaaccctgtggacctttgagagtccagtcccgcctaactcctttcctttgtctgttccctgctgttgccttgggtttcatatcacctctcctcccataggggagcaagtgggtgagtcagtgctggcctgctgggcgagctgtttatgtaatttcctggctgatgtatgagtgtgtgcatctgggtttctgacagtggcatcaatcactagctattcctctgggaagcgggtgcttctaaagtaaaattgcaatcatactccagattttgcaagaaggttctattcctttgtgaatccagattcccccagggttgggacgggagtcaggtaacagtattcattgagtggagagcaatgtattaggcaccagagaaagcaatcatcatctgtcacgtagctgcaagggagagttttagagaaagcacacccaaccaccaaacacagacacacagacacacacacacacatacacaccccaactgaaccaagaaaatagacctatctcaactttgagagaatattaagggcttgatagggcaagcctttaatggtttggttgaccaaaaccatctttaaaaaaggtacaaatcaaaggtcatcagagctgtaagacacaactgaatctaacaactttctgctgcttcccaagtagctgagtgctctcaatagcttatattaggcagaagactaatgtgctcataaaagatgaccagatccatgctctcccagaccagcttatttgagcacaaaaaaaca

SEQ ID NO: 38121 - DNA, 922 bp, Bovine  19866880781815
aataagaaacctgggctctaaacaaccatcaggtgatttaatcaatgtgtaacgtgacacacttaagcatgtataactacactaaaaatattgaaaaagaaaagagcctgacattctgtataccagattgctatcagcggctttctttgggtaatgaaatttatagttaatacttactttcttctttgggcttttctccattttccaaatgcttcagtaaacagggacttcttttgaatacatcaactgttaatacacaccactgtaagagtggctctgaaaaggcagttaccttcatgacggaggcgatctgcttccactgctccggagtcgggtcagtcccagtcgggttgtgcgcacaggcatggaggacaaagatggagaactcgggagctttctggggagaaggaagccatgtcagctctgacgccagcagggacgtggtggggcagagtcaggggcacacaggacaggcactccctcctaagtgccatttcagaaaagagcaccggcttggggaggatgctcagactcttcacttatcaactgatccaaagactgtcccccactctgcctgaaaccttggcattctgtccactttttctcttctaatcacccacctccaaatcattcaggaaaccctggaggtctagtcctctcttcgctgcatcccaatagtgataggaccgaatgtctttaaatccagcagcaataaagacaccattatgattctctgcaaacaaaggggtaaaacgttaaatgaacactaggaggcataaacggaaaggacacaaggcagcttccagggccgtcacaggctccacgtctactgggggacacgaggtgagaggttaagatggagaggaatgactgtaaccaagaacaagttcaaccagttgtcgtcatgctgatttacacccca

SEQ ID NO: 38122 - DNA, 1143 bp, Bovine  19866880794676
attgactttctgaatgtacaaaatcccagaaacaatataatcaacctggcattttattatgctatcatatgatggcataatgtaccatcaccttttttttcaatgcaatattggcttactgcaatatgtgctcactcaacaatatcaatatttttatctcaaataactcattcaggaagataagcaatttaaataagccatgaattgaaacatgcttcctccaccacacaccacatagtatctttgtgatttttagcccattgagaagcgggttggactttttccccttcactgttctaaatactgtttatacatgcactgacctctgtctagctttctgtgccaccttaagtcagagactgtaatgaaggaaatttcacacaaaagctatgtaacccacacctttaagaaaagtgacaagaactggtagttagcccctttagcatattattagtttaaatatagaaggaagagaggttcaaagtgagctagaaagtgaaagagccattttataagcacaaggagataaacactggctccctttctttctcaaacaaaaagcacagtgcaataaccctgtctagacaacaacagtgtgactacagaaatactgcagccttggctctaacatagaagagaagcaaagtatttttatgctaattggtaccattaagatatgctgatcatttcaacggaagtgttgttttgtttgtttcaagataatacactatctttgtgaagaaatgacagtcagcatatgtgatatgtggagcctttggactaaatgttcttccaaggaagtctctctcctgtacatgctttggagaagcaccagggaagtgacaaaaaaataatacatgaggtataatatttggccacattgtatacagggttagaagtaaagatgcaaaaaaagtctagtggaactgacttcaaaaggcctaggaagatagataaactgagtgtgtaggaaagcataacagtagttttttctggaaaacaggaattttgaaaatgttttaaaaggcttagtgtctagtagagtcctttaacctcataggaatcctgcacgctgttattcatacttgtaagctccctgcaggtaggaacagaacattatttatctatgtatttccaagtatc

SEQ ID NO: 38123 - DNA, 1876 bp, Bovine  19866880852158
atgagacacatagcattagcaccatccttctcagatgaggagagtaagcttccgagagagcaggtaacttgtctaaacaccacaagtaaaagggtgatgcaggatttaactgaagtctctccatagagcccaaactctttctactacattctttccctcacgagttctttttaataggtatatttcatagtctattttatacagaaaaaagtaaattagcttctatttgaacctactttgaaagcctctgcctagacagtctgagataaacaactggtccaaagaagcaagcctagaagatgataattgagtttgtgtgtggctgcgggcggatgagtcacacgctctccggctcttaagaggtaagctgcctctctgttgaattaggaaacccaagtgtaattgttggcaggattctccccaaatcctgttctgatgagcagaagacaagagcaaatggagaaaggcagaccatagcctgaggagatgaacaatctggcgaacgagtcagggaatgtctttttttatgagcaaggaggtatttatatggtttgccttgagtcagtcgcctctgatgctgggaaaacagactgggaacagctggaccacactttggaccagttgccacaacaacttgatacatttgtctctggtgtcatttgatcactttgaatgctgttattacctctgtgtggatgtttgactttcaggcttacttcgtgcagtgagcacgtctgtttgattgtgttcctcagattacatggagtgttgattatatcttttgggagtttgggttctaggattacaggacatggcaatctcacaggtgcctggatccgaggctcccatagaaccactgttgtatttaccattatcagaactctgatttccaagaataaatcacacctgatggtatctgggaaaatcgtacagatattcaaagtcatctccaaaatttcagtttctcctcgccgatgatttttgtgagcaacaccttgcaaacttgatctcagcacagaagtgatggttgttactcttatttagtatttacctttttcttggacaagttaggcaagacccagtttgaaggtttgcaaagtaaattgaatgcatttgtgtgatttaaagagctgcttaaatctttcctccaaagaagtttagaaatgactggtctcttgataaattgaaagtgagcccagctactgtcacaagaagaaaggctgaaggttctgcatgaatcatttaccccaacagacatttgttctccttaagaaaattggctgttttctcttttctgataagaaatgatcccagctcccaaatttatggcagctgaaactgaaggatatatttatattaccaggccagtgccccccaccacaacattctctaaatgtcatagttgggcttctttctaaggaacaaaatctcagagaattcaagtaagcaaagagaaaaaaaaaattatgtcattagaagctagggaggatgattttgagcatgtgcaggatgtaatttcattattgtctagagttacacggctgtttctggaatcagggagtttcctaaacagaatatattgttgttagatggcagcataactgtggttttctgctggtatttttagtgcggaggtggatagctgtttcctgtaatttccaccccccctttttttctctcttcccacttcattttgtataaataaaaggaatcaaaagagtaacaaaagaaccaccaccaacaaacatttctgttaaagttctaaacttggcctaaaattcaaggaattcaaattttctatcatttgaaaaaattcatttatattgtgtgtaattaacatagattttcaatgcttgttcaacttttacataagacg

SEQ ID NO: 38124 - DNA, 1027 bp, Bovine  19866880865212
ccctccaaagtctaagagccactagtctagatgcttgaagatcctgccagttctaatatttgatttttctagtcttaatctcagcgtctctcatttaagtgcttcctggtacatagtctatgtgtaactagagatacatggaagaatacatttggcgagaggctgtgtgtgacagaaagtagtgtgatagagattatcagtgttataggaatccagggagagagactggtggagtctggaggtggggcttgagctgaaccttggggaatgagaccagggctcattctggttctgtactctgactctgttacctaggtggttttaaaagcatactggtggcaggatcccataccaggcttgttatcccataccaccctcttgcccttttatttcctttccctccaattccttcccttcaagggtatttttaaaaagctcctccttgtgactccaaaggacagccaacgttgagaaccataaagtgcagaggaagagaaaggaatatttgtctagaacactaggagtccagggacaaaggttggaggtaaacaggtctggtgctgctgctgctgcgtcacttcagttgtgtccaattctgtgcgaccccatagacagcagcccaccaggctcccccgtccctgggattctctgggcaagaacactggagtgggttgccatttctttctccaatgcatgaaagtgaaaagtgaaagtgaagacgcctcttagcgaccccatggaccgcagcctaccaggctccgccgtccatgggattttccaggcaagagtactggagtggggtgccattgccttctccgaagcaggtctaggttgtaaaaagacctacctgagtagagctgggaacatgttggatagatcaggcaggctgatttggcagccagggcaggggaagccccttgagggtttgcgcagaggagttacccaataagggtatttgaagaagatagacctggttggagtgtaggagggggatgagctcaggtttttgcaaagtccaattaggtat

SEQ ID NO: 38125 - DNA, 2365 bp, Bovine  19866880867526
aaatcttaatgatctctccttaggtcctagtagtggaaaaagggtagatttcctacccaaacaaattcatgcaagattggtttatataagacagtggtgaggctgtttgaagaagagataggagacaggatttgaagtctagtggcttgagttttatgaccctcagccattcacttaacctttctgattttctttcttcacctgtaaaatgagattgctaagaacagagctctctctatctgtatctgtgtgttctgcatctatggattcaaccaaacactgattgaaaatattccagaaaaaaagcactttagaaggttaaaaaaagcaaaacttgaatttgccaggtactggcaactatttacctagcattttcattgtattaggtattataagtaatctagagatgatttacagagaaggcaatggcaccccactccagtactcttgcctggaaaatcccatggacggaggagcctggtaggctgcagtccatggggtcgctagagtcggacacgactgagcgacttccctttcggttttcactttcatgcattggagaaggaaatggcaacccactccagtgttcttgcctggagaatcccagggacgggggagcctggtgggctgccgtctatggggtcgcacagagtcggacatgactgaagcgacttagcagcagcagcagagatgatttaaagtacaatacatgggaagaatgtgcctgggttatactataaacactacacggttttgtatatgggccttaagcaactgcagactttgatatccacaccagttcccggaactagtacttggtagtaaccgttgtatatcctccttccctcttaaggagattaggaagatcacatgagactctgatttgttcattgctagtgaatggtagttcttattgccataattattgttgtttcagttattatggttgttttttaataacaattcattttactggagaagcttcatgttacctttattctcaacttgttctttgctttcttcctctttcctctttctttgaaccctggagaatagataggtgatatttttggcacctgaaagacaatgactcaattgctaaaaacagctgtggtttccaaatttggactgccacttaagaatgtttagttttctgagcagtgggtgaattctggttatatgaaaatctccatgatgcatttgaaaaccaaacagagacagtgtttggacaacccactcatctgggtgattcacacactcgctcctttcgattagaatgagaataattgtctgtactttgagagatgagggaaagagttgagaatctcacaatgcagccaatagtccgatgggaaagtgagagatgtttaggatacagtgcagatggtatagtgtggatagctgggcagactccaaaacaataacataagaaccaagatgaaccattttggctcaagtcacttggactctatgatttgtatcttcatttcctagaggaatcagaggaggaaataacactttttgatattattttcagcaattcaataagcacaggaaggagttggtgaaatcccagtcataagggaagtattttcaaaaatactgtccttatgattgtattttgaatactaaataaactgaacaattggcttccctactatttgaatatttccttccctcctcccttccttctttcttccttcatttataaactataacattcttgtgtattccaaactcctgaggataaaacaatgagcaagaaggatatggtggttatactcacagactttatggtctagtgggaaaatagttaatgaaacaaacaatgatagtaagatgcaatgactcacataacagtggaattcagggtgcttcaggagcccatggtgggatatatctactgtagtttgtaaaggaagggaaatttcagatattagggaagccaatattttttgttaatatcatcatatttatgattgcttataataataaagagtaattcttttgaaatcttaatagatacagtaacattatagcactttttccaatatatcttagtggcaggatcatggacataggtaaggcagagaagtatttaatcctttggaagtaatgaacagattaaaaaggaaacttttttctcaatcaatctctggtttacctactagttatatcaaagtatatcaaaggggaagagagtagaagaataacagttactcttaaaggtcatagaataactggatgcacaattaaaggaaaatgaggacaatgacaatgttaaccttctctaatgaagaaaactgaaaatgaaaacacactagtggttaagaatggttgtattaccacggaaaaaaatcagtgt

SEQ ID NO: 38126 - DNA, 1632 bp, Bovine  19866880900982
ctaaaggttctctcttgataaacatttagctagcatactctcagtgactcatcggtggttcaggctggggcatcttgccatgccagcccctggggcacacacagcaacacttgggccttgtcctgaccccctttcacactgttcattaaattaagccagctctgagaacctcacaggaaaatatgatggctttggacaagagccacttactgtagaggtcagtttcatccaggatctctgacttgatgatctcctctatgatgtcctccagtgtgacgatgcccatcacctcatagaaggggtccccttctccctcgttattcacccgctggacaatggccaggtgagactttcctagagacaaaggaagtcacagttaagcatctgggatattttcagagaaatttccttttgagaaaatgatactaaattgctctctgaccaatcttgggactgaaccactgaacccattccaggatctctttaaaacatgaagtctgtatacaacctcttataaatgcaaactttatacttttatatcactatcgcttttgaagcaagttacttggacttccctggtagtccagtgattaagaatttgtgtgcctaacagggcacatgggtttgatccatggtctgggaagattccacatacctcgaaacaactaagcccatatgccacaaccactgagcctgtgctctagagccctcgtgctgcatctagagaaagcccatgtgtgggaacaaagatccagtatagccacaaataaataaataaatagaaagttatctgatatacacaacgccatttaatttttttttcctgtaattttcctatattaagaagtatatctaagctgaaggaggatgaataatctaattgagagaattagaatttggagttagaagaactaggttagaagcctgcaaacctcctcgcccccatccctaactatcttagtgactatctgtgcaactcaccctggacaaaccagtatgttaaacctgtactgaatctcaagcttctcatccagcattagaagataatactaaaatggtgattttcaatatggctcccagaggctttgatatgcctcccattgagaagcatggtctaatcaactccctcgggcttgtggctgcttcaatcaatcgagaacagggaaagtgaaagtgttagtcgctcagttgtgtctgactctttgtgacctaatggactgtaacccatcaggctcctctgtccatgaaattctccaagcccaagggatcttcctgacccagggatcaagcccgggtctcctgccttacaggcagattctttaccacttgagccaccagggaagcccagagaacagagaaatgtctgcaatgaggcttctgagaatgcatcataaaaggcatatagcttctgctgcagaaacactctaaagaagtctgacaactaccgtgaggccaccatggtgaaggggacccatgtcggtgcttaggtgacagtcccagctaagcctggcctttccaccatgccaccaaagtgccggacaggttagagaagaagccttctatggcggtggatcctgccccacctgctggcattctcctcaatcatctagacgtttcaaccacgggcacaat

SEQ ID NO: 38127 - DNA, 3782 bp, Bovine  19866880914818
ttttcctgtggtctgtatggatgtgagagttagactgtgaagaaggctgagcaccgaagaattgatgcttttgaactgtggtgttggagaagactcttgagagtcccttggactgcaaggagatccaaccagtccattgtgaaggagatcagccctgggatttctttggaaggaatgatgctgaagctgaaactccagtactttggctacctcatgtgaagagttgactcattggaaaagactctgatgctgggagggattgggggcgggaggagaaggggatgacagaggatgagatggctggatggcatcactgactcgatggacgtgagtctgagtgaactccgggagttggtgatggacagggaggcctggtgtgctgcgattcatggggttgcgaagagtcggacccgactgagcgactgaactgaactgaactgaacccaccaagtctgtgataatttgttatgcatatgtgctaagtcgcttcagtcatgtccaactctttgcaagcctatggactgtagcctgccaggctcctctgtccatggatttcccaggcaagaatactggtgtgggttgccatttcctcctccaggggatcttggattgaaccctcttcacctgcagctcctgcactgcaggcagattctttatcgctgagccaccagggaagcccaacaaaagcttagtaggaatcagcaaatgcaacacaaagcagcacagctccaagtctaaactctctagcaggcagcagcacagctcagagagcttgctagctagcagacagcaactgtacagtaaagtgcacgcacaccagcagtcagcagaactagttagcaagctagcagaaggaaggaaagaccctcagtggctgtggtcatcatctgaacattctactcacagcaccagttgtattatggtaccctgtgagaggcaggatcaacctctttcaccaaaaatttcattaggatgttgagattgattttaccacagatgaatcaagaggataaaaaaggctttattattcatggaatgaggctttctggaggtgagcagggcaggctcccaagcaggtccaagaatagcttgagagagtgaggaggagggactagctttagctttcattgtggaaataggttagggtgtagatggggtgatagtggcccatgatagttaccatgggccaaggctactgtgttttgaaacttaccaatgccaaagtgggtagcaggcaggctgtcttgctggcttgcccatttgtggggcacaaaggtgaacaggggcggtaaggcttgaaagctgctggaaactttttattccagtggatctttgatcagttgtaggaaatcctccatcattatctcttcagatgctgcttctgccttgttctctctctcttgttcttctggagctgtaactacatgtatgttagatcttttgactgtgtcccacatgtttccatgttctgtttattttctttctcttcatatttttttttctcttctctactacctctagcagtcctttttctttttgtgcttcagtttggatattttctgttgatatctctttgagcttacttcctgtctttggttaggtcagtttatttttatatatgtccattgggttcttaatcttatattttattttcagttttagaatgtccatttaattctttatataaatttcacttgcctgttgaaattttgtatctttttatctctatcttttcctttcttttgtttaatgtatgaatcatttaaagtccttgtctgctaattccagtatctagatcacctgttttgctctgcttttattggttaccagtcaagtggttatatttttgtatacctagtaatttttgtttgaatgtcagatgctttatattaaacacacatactcacaccccaataacaactttagaaggttcagataatggaatttttttttttttttaccagagaagtaagagtctaagaaggttgaatagcggccaccttaatcctgttgcaaacttatttaggtcaagactggttttaagttttggtgagatctagtccatctttgttttacttattccgaggacatggtcctttatggtttttcactgacagcatgagaagaagggggaaatcctatgtttagaaccaatattaagttttcactctactttccagagatatttgaattattctttcaccttttgaaatttcaaaatatctcacatcttttggggaaagactggctgtaggcttgaaatcacaactgccaagactactggttactctatttcctaagagcagctttctgaagcctaaattcttagtctctggctgtgtccatatcggaaaatgcaatgaggaaaaaagtgataatagatggtagcattaatctgtcattccctccaatgctttcacctcccactggttatattcaagaccctttatctcctaaatatccatagactctagaaaattctactctactttctggaagttttggcttaccttcagaatttagcgaatactttgaggaagaaactgatcttgtgtttgaggcttttcaaatcctcagttttgtcactccatcccaagcagttatcaaagatatggctcatttctctgccctatagtagcattcctgtgcttgccctgacttcaaatctcagctactggcttgtgccccaaaatgacaaatgtctcccaaaccctgtgcattctaagattacttctgaatggttctctgctctctggaattttgcctctgatatttcttattgcctttgctgctcttttttctttttcctcactgcatggcatgagagatcttatttcctgaccagggattgaatcatggcactgtgccccctgcagtggagggtccagcacctaccactggactgccagggaagttccacatttgtagctctttgatggttttaaatatgtgatttttgtaatttatccaaattttagttgtttttcagtctgcttcagactacttcatcctacatggaaacataagtattcatgtccatattaaaaaaaaatcttttggaaggttgtggagcaatgttttgaagaccactaaactagaaattgattaaatagataattctggtaagtatttggcatgtttaaggaaataagtgctatgaaagtcaaggttaaagaaactagttttgggagtacactttctgaaggcactgttgtctaagatgattatctaaatgttaagcaggaattagttgggcattgttgagggtagattttttgaaaaaattttggactctcttagctagcagactgcatctggccaattcctcatgctttccagatagtcggtcctgagcatttggaaactgtgtactgtgctttctggtgttctgaggtctgaatgtgcccatatcatacttcctatttgcccttcatgttaacccacctttcctaaaatccttattatttcatgtaaatttagatgttagattcttggaaacagtccttttcaaattggatctgccaactggattcaactttgggttctaattgcacaagcctagggtagcattgttttaaaggaactttactttccagtggagtagttcacttttctaggacactggaatgaggaaaggaaaggtttgttaaggtcccttacctgtgctatgtcagagaggagtgcagcttctttcaggagtctgggagagtgaaaagtgttttcacaagtctttgaggctgtgaaagattactttagttaattcttcaggactacaacaattt

SEQ ID NO: 38128 - DNA, 1499 bp, Bovine  19866880989815
ttattgtgttaacctgctgttggtcaggagaaggcaatggcaacccactccagtactcttgcctggaaaattcccatggacggaggagcctggtgggctgcagtccatggtgtcactaagagtcggacatgactgagcgacttcactttcacttttcactttcatgcattggagaaggaaatggcaacccactccagtgttcttgcctggtgaatcttggggacgggggagcctggtgggctgccgtctatggggtcgcacagagtcggacacgactgaagcgacttagcagcagcagtagcagctgttggtcactcaactcttaattagcacctttagaggcatacatgagtgactcagaggctgaggtgtgctctttctgcagaggatgatattttcctctgggctcagttgacttcgagtttcttggaactcgtccttttaaggcaggataaggccattttttctactttctctcattaacccatccagagggggccctaagggaccccttagaaacaaagtcctttttcctacaagagagaaggaaatcattgcaatcttgttgacaatgctaaaggctgttgcgtacaagcatgtagttctctcaggtttctgaatgtcctgtactggtttagaaggattccgaaacagtgaatagttttataatcatggagtagatacaacagcaaaagtagaaatcaaaaaggttaataaatttgactacctaaacgtttttaatttttgtacatcagagtacaatgtaaacagacggaattagtcaaagaaaactgggggaaattttgcaatatacctgaaaacaaaggatcactatctttaataaataaatagttttaaaaaatcaatagaaaaacaggtaaagggcatgaacagtcagttcacaaaggaagaaatgaaatggcaaagaggccaataagaaaaatactgtgcctcagtgtgaattttttaaaaatacaaattaatacaacattgaaatccaattatcacctcttgggtttgggaagtgatagtttaaaccttaaactgtaaccttttaaaaggttattattaatatctgatgttcttagggatatgtggaaatgggtgctctcacgcataggtgatcagagcaaactgatgcaagctttctagataatatcagtattatcaaaatgtattagtcaggataggcgaggttataccgtgataacgaaggaactgcaaaattccatggctttcactaagaaaatgtatttctctttcacactacttatctgtcacggctcagctgtagctctgttccatatcattctcattccagatcaatagagcagccttaatcaagaacattgtcagacttctggcagaggggaaagagacgtggcaaaatatggactgcttactaaagcctcggcccagaggttttaacatgtccacccacattgcgttgaccaacaccagccatgtgatcactctaggctcaacagagcagggacaaa

SEQ ID NO: 38129 - DNA, 1363 bp, Bovine  19866881029115
tgtttttttttaaaaaaaaaaatctgttgatgcttacatacaagtaactcaaaccagctgaccttcaaaatgtcaaacttcacatgtggtcaagcttcagacagactctaagctaaatttggaaaaaaaacagttcaaataatgaactggtaaagcaaataaagtaaaatatttggatgatgattcagttgagtaaccactagtgaccccaaactgccacttgttatggatagatgccttgtaagatttttgagttgggagagttcagaaacaacccaattatggttgggtgtctttccaaattgaccagaggatagaagtgagatgaggaggagtgcctgatccactaacgattgaaattctgaggcctttgggaatactctaaataagtctatcacacacacgattcataaactcttggattaaatgatgaatttttcagattagagactaaaacctttgcaggactgagaattatgggctctcctctccctatacatcttccactatataattcaaaataaaaacgatgccaacctgtataaaaaaaaagtgtaagaaagtcaaagaaatatctaattttccccatgacaatcacttcaatgctttcaaaaaataatattatttttttaaatctggtacatctattttccctagaaccctaagcatacgattagtttgcctttggagtaatcagcactctctgaatcccagagctatattgtttgggtttcttatcattaaaaatccctgactttcatagagtgactactgtggaaactctcagtaagtactttttttttccttggcatacaaaaagtcactttacattactagacaactatctacaattaaaagagacagagagaaaatatgacttctcagtgagactcctgttgagtcttttcatccctcacacaacagactactcaaggataagcaagacacacatgttatgcaccatgaaaaatttatcttggcttatggaaaaccaaaaagccaaatttacataagtcaagtcttaacaaccaaggaccttccacactaacctttccttttaccacttcagtatcagaataaaaattccactgttcatttataggttatttgaggttaactaaaaatgagcatgatgtagtttctagaaagtagccttgattgaagacagaatacactgtgacattctgaagacagaataatgtctattgccttcagtccctgaccagtgataggagagtttacattagagtgatctcaaagaccctttgcaattcttaaattttgtaattacaggatctcctctggctcaataaagtcaaggaaagggttatattagtgtaaaatgaatgatttgataaccctg

SEQ ID NO: 38130 - DNA, 2233 bp, Bovine  19866881104778
taaatacatgatacagtcatatgtaaggcaaggctatcttttaaaataaatgttagaagtgacaaaaataaaatttaccgtataagtattttattgttcccttgggcttcagaggactggaatatccccctttcctttaactttctgccttctttagaatcaattttataatttaaaccattgttttttcacagtaagcattttacaatagaacttctttagtaataactctctaaaagagccaaaataagacatattaaaatagaaaatgctaatgtattccagaacactggcatgagattatgttgctgccagtcatttactggagagatctgtaaggaagctgaagccaatgagagttttatttctaaaaccaatgagagttttatttctaagtcatagcccagcctctgtgttggatgactagagtacagaaatatttaattcaattcaataaatttttcattgagcacctatcatgtccaaggctgtgctagatctacagagtgaagataagaaaattctttcactcaaagaccttattaaacaagaaagtatatacaagaaataatgatgcctgttacagaggcacaaagcacttaaggaaaggagtaacatccttcttccctacaagtattctccatgatagtcaagtatagagtaaaataaaatgtgattcaggagtcaaaacatcttcatattgcactgattaaaagctagggtttgaagttagactgcaaagagttacaatctgactatagttctttgcagctatttgaccttggacaaattaacttctctgagccttagctcacagtagggatagtagtttgtggtgggaattactacaagttaaccaatattcagttttctagttctgggtacataggaggattgtactttcctgttcctgtttttatctctttgaccacaagatctgccatctagctatttaccagtaaaaaataggctgtatgattgcctaagaactgtaattggaactaaaatagaaaaagttacaagaagcactgagtagagaataactgacttcctgaaaatgctgggcaaggcttcacaaaagaggtgcttttcaagttgagtcttttttttttttttaatgagcatggtgtttctgctttcaagttgagtcttaaaggatgaagatggctaggcatctgagtgagacagcgctgcttatacaaccaaaaaaacaacatcatattctggaaaagacaagttgttcaggcatatagaatatcctaggtcagttttcattccaatcccaaagaaaggtaataacaaagaatgctcaaactacttcacaattgcactcatctcacacactagcaaagtaatgctcaaaattctccaagccaggctccaacagtacatgaaccatgaacttccagatgttcaagctggatttagaaaaggcagaggaaccattcaaattgccaacatccgttggatcatcaaaaaagcaagagagttccagaaaaatatctacttctgctttattgactatgccaaagcctttgactgtgaggaccaaacaaactgtggaaaattcttcaagagatgggaatatcacaccacctgacctgccttctgagaaatctgtatgcaggtcaggaagcaacagttagaactggacatgaaacaacagaatggttccaaatcgggaaaggagtacatcaagactgtatgttgtcaccctgcttatttaacttccatgcagagtacatcatgtgaaatgccaggatagatgaagcacaaactggaatcaagattgctgggagaaatattaataacctcagatacgcaaatggcaccacccttatgacagaaagcaaagaactaaaaagcctcttgatgaaagtgaaagaggagagtgaaaaagttggcttaaaactcaacattcagaaaacgaagatcatggcatctggttccatcacttcatgatgaatagatggggaaacaatggaaagtaagagactttattttcggggactccaaaatcactgcatatggtaactgcagccatgaaattaaaagatgcttgctccttggaagaaaagctatgaccaatctagacagcatattaaaaagcagagacattactttgccaacaaaggtccatctagtcaaagctgtggtttttccagtagtcaggtccggatgtaagagttggactataaagaaagctgattgctgaagaactgatgcttttgaa

SEQ ID NO: 38131 - DNA, 1673 bp, Bovine  19866881421639
ggcttctgcctggcctcccattgtctgagacagggacaaaccactcgggaccacagactgaccaggtgacctgtttctggtccaatctagtctggggtcctggtttttcatctgaacaaagttctcctaagaactgcagctctgccctcaactacacatttcactactaacagccacttctaattatacagctatagttcctctccattaaggcagcttctttattacatttgtgaagggcaaatcaggctggtcaagcaaatatcttttaagatggaatcctggcagatgcagatgaagataatgagtcagtggctacatgatatgcctggggtcttccagccccatgtcctcacatggagcggcacagagaggttgttcagtgttgctgagggttttctttcaaaaatactctgctcagcaggtttcactgtgacagttgggttggctgctggaggccccttgaatcagaagaatatggcctttgcttagtggtctcagaactcagctgcagggcctagcaagtagtccgtttgtactgagtgttttcatgaacattcttcccttaaagagtgatgtgaaatgagaaataacacagaccatcatggagagagctagagagagacttgccttttcactagcatcagctaaatatccatagatctccacagtcacttttgtgaacacagattaacatcgttgtttagattttggtgtagttcagatgttccatgcttggttgacagatcaaatgaaaagcagctcattctgctcctggtcttctctcttaccttttcatcatccactggctgtaagctcttctggcagtacccagaaacatgttccttgagtccaattttccaaggggtataaattgcttccaggagaaaaaaaatgtacagcattctaggaagctccagaaggctagcaaggagttggaaagaaggcattttacagccctttttcaatatatggcataaatataagcttaccaggacacattcacatgcatgcataaattagaattctctgctgccaatatgcaagggtagttttcccatcaggactttgagattctttgatgccctacccttggcatactgctgtgtctgcagcacctacatgtctgtcatgtaatagatattcaatagtgttttgtggatagaaaataatagccacagaagtatccttggtgagatgtgtcaattatcttgccacttttcgctaattaagtataaaagggagacatggaacaccatttatttctccttctcaggagacttattatcacagaggaagatgaagacaattccagaactaaccattctattctgaaaagctatggagaagcaggggctctggccatagtcatttgttaatgccctagacctgggatgtgcatataggatgtgggtttaaagaggagaatgaatattcttccctctctctttaaagttccttcaagaaactacccatatgctctcaggagaaaatccaaaaaactcagattcacaagttagtgtttatcttgttgaatatatattctttatatttcactgtgctaggctctgtagaggtcacaaataggaatttgataacattcttgtaaatgtgtaggtacagctacatacccggtcctttacaaatgacttatgtggtctcacaggcatttt

SEQ ID NO: 38132 - DNA, 773 bp, Bovine  19866881431395
gcttagtggattctaactgattattccttcttcagaaatgttttcctttacaccatcttattggcaaaatgtgaacactggataactaactctggatgtggggagataggaaacttcttgcacactgatgggagtgtaaattggttgacccattctggagagtgatctagcaatatttagtgaaattacatatgtgtattccctacaacctagcaaccccactctgggaataaattcccaaacaactcacaaaaggctcatcaaaggacctgaatgaggataggcagtaaagaattgattttaatactaaggaattaggcacctagatgttcagcacagggaaatgaacaggtaaaataaggaaggcagcagttagatgcaacaaactaaatgtacatacaacatggataggctttaagtagaatgatacatgagaaacaaacaaaaaaacaaaagcatagctatagcattataaccattagcacaaataaaatatacacacatgaaacaatatattttataaggataaaaaatatcaaaggacatatatcaaacacattagaggtgatgcctataaggtaatcactgaaagaagaaaattaaacaaaaggctttaaagggaccaatgctcataaacactttcttgcattcaaggcaatacttaatccattttctggaaagtgaaaggcagaaatatttattggggtgtgctgattacaggctagatagtgttggtctgcctctccaccttgggaggcaaagaatatctatcc

SEQ ID NO: 38133 - DNA, 870 bp, Bovine  19866881783487
tgatatttaatactctcagattcagaagctacaggataatacaggacaagattacacgcatgtgttggagagttagtgtgaaagaatacagcatatttaaaacagttctatcactgaagttctcctggaattcctccatcaccttcatacaaccttaagagtttacttcaaaaaccttctagattagctaaggctaacattatttcccataccatgtaaatcattcacatgaagatattaagacatgtttagcatcaggcaaaaatacaatccattttttaaaaaatataatgaggtctacttgtttctattgactgagttgtcactaggaccgtaaggttgtttagaagatcctcagagctagaatatcatctgccgtcatctgagggatggctgtttaagagagatcgtgagctagaatgcagaatatgagggcatacctcatctcaacgctgtcagtatgatcaactaagatggaatacctaagaatgagggcttatttgtgaggtaggggcaatagccatcatttttagtacacttttaagcagctgtcatttccatcactttattaatttcttactatactgacatttgaatcactttattaattttttcctctactgttatcttagttgtccaatttaaaaataaagactataccaataactgaccactagcaggaaacaattatcatacactgctacccatatacatgaaattctgtaaacagttggggagagaggttgagtgatctatttctgagattttggaggcccagtttcctcatcctattcccacaaactttcatcgcagacatttcaaacattattccacagtatacaaaataagtaaacatcaccaagcagaaat

SEQ ID NO: 38134 - DNA, 930 bp, Bovine  19866881894935
atgaaggtcaggaaagatccctctagcacctttatataaggactttagttaagctccattaaatgaggacttgattccagaaaatggatggatttataaattactgtgtacacaggactcatcaaggacacagacactgtgtaaatacacatcatttgaattctcttctgacttgcaggaagatttggaaggagaccaatctaacacttcttataattagtgaggtagaaattgattagcagttagtggtctgcacacacattgcctgggtgtgaatcctggtttcatcattgacgcactgttgaccttgctgtgccttaatttccttagctgtaaaattagaataataaatgtgcatttttaaaaatatttgtgacctaatatttgtaaagcacttggaaaggtgtctggcaaatgataggctcttaaagtaaagcaaatgttacctagatcactctctttgtccaaactacatgagattgtgattggcaatctaacattagaattggttgcttttatttggatatgtttgtggtggtaggtaataggccagatgtgtgctaagcagtagggaaaggtctatttagaatttaaaatctacatgggtagctcacgttaatgtaattagcattcagagtagtttgtttatccactcagcacaggagcaattcttgtcattttctagagaagctattaatacatgaacaacaacaaaaaaacacagggagagtgtgctttgatacaaaaccaagccagttatatgaaatgttatatggcagagaaattcctagaaagtatctgtgttagaggttctgggagtagttggtatgagtcagcaaggattttctgaacatttactgtttgggacatggtgagaggcttaatgaatattgtgtctactgtgagacaagaagaggttatcatagtcat

SEQ ID NO: 38135 - DNA, 1452 bp, Bovine  19866880363689
ctcagatggtaaagaatctgcctgtagtgtaggagacccaggttcagtccctgggtcaggaagatgccctggagaagggaatggctacccactccagtattcttgcctggagaatttcatggacagaggagcctggagggctatagtccatgaggtcacacagagttggacgtgactgagcaactaacactttcctgcttataaataccattcttgtagagctgcattatgaatattaaaattcacttgtttctctgattttattataagtaagcaaaaagaagctacattaattagaatgactttgcagaacaaaacttaggaatttgttccagctcttattggccacagaaaagtatttgtgtcttctggaaagcatgatctggtttattatcaaatgtgttagacatccaaacctaaaattgacaaatctgagggttttgtttttcccacttccttccctttaggcttgaaacccagcattcccaccttgccttgccatactataagatgtctggtttgtctatggcggaagttttgaaccgagtggactgggcagtagaggatggatcacagaaatacgagcggggattaatcttctacattaatcattcactttatgaaaacctggatgaagaattaagtgaagtgaatacaacttcctgcttagttagatctagtatttttaacttttcactttagctttttatgcaattctgttttaaaaattaagttccaagtattttcattggtagtatagtcttttttttctaaaaaaggtaactagggtgcactttttcttcattaataatactcatagaattacagcttgaaaaagaacttagaatcatcttctcatactttctcattacatagacagggagatgcgggccactgtggttgagtgacctgcccatgtgacagtggcatgtctttagaagaatggcagagaacctgggccttgcctgccttctcatccacagccctttacaaaaccctagttgctcctctctccaagtgtctaaaacttttttataaaatcctggcccagcaaccttcagacgtttttaaggattgtttttagcccctcatgtattttttatttttcggttgttctgggtctttgttcctgtgcaggctttctctcgttgcactgtacagaggctaccctttgttgtggtacatggccttctcatggtggtggtttctctcgtggagcacaggctcttgggtgcccgggcgtcagttgcagctcttggtctccggagcatgggctttagtagttgtggtacatgagcttttagttgctccacagcatgtgggatcttcccagaccggggattgaacctgtgtcccctgaattggcaggtggattcttatctgctgtaccaccagggacgtcctccctttcatgtatttttaaatagttgaatacaaatatgcagaattggg

SEQ ID NO: 38136 - DNA, 2593 bp, Bovine  19866880374416
tctgactttttgactcccctgacagtatttcttggctcttagaatctaccctccccttcattttatgcacagatagattactcttcctgatcagctcggaaacctccagtgcttcccactgcctaccaaataaactcttaatttcttcacgcgcgcgcgcgcacagacacacacacacatacacacacacacacacacacacacacatacacactattcccattgagtaaaacctctggctgttcccttagctcacccgatgaaagctgctatcacagctggaataccttaagaggctttgtgtttccatctgccactgcctgagaggaccaggtcctggctggctcaaacaggatgagacccgtgtctccgtggagcagagccgcccagcaacccacagacagcagcatcaccatggtggcttcagcacagaggcagagctggccagagccactgatccccagccagcctgcacatctgtgagaataaatgcttattgttgtctgccaccgtgattttttaagtacttattaagcaatgtttttgcagcgatagcaagccgacccacctggctagctacctctctcctcacctgaaccctgcagtcttttcagtgtctctttcagagtgtgaatcacttctacctttcctggtggttcagtggaaaagaatctacctgccgatacaagagacacggggtttgatctctgagtcgagaagatctcctggagaaggaaatagcaacccactccagtatttctgcctgggaaatcctatggaaagagcagcctggtgggcaacagtctgtggggtcacaaaaacagtcagacacaatttagcaactaaagaacaacaacaaaaaagccttataaatccccagtgtaaatatataaaattgagtgtatattttattttaaaatatggctatgtatttattagatcagatcagtcgctcagtcgtgtcctactctttgcgaccccatgaatcgcagcgcgccaggcctccctgtccatcaccaactcctggagttcactgagactcacgtccattgagtcagtgatgccatccagccatctcgtcctctgttgtccccttctcctcttgcccccaatccctcccagcatcagagtcttttccaatgagtcaactcttcacatgaggtggccaaagtactggagtttcagctttagcatcattccttccaaagaaatcccagggctgatctccttcagaagggactggttggatctccttgcagtccaagggactctcaagagtcttctccaacaccacagttcaaaattatatagcctcatatttttacagtacatataatttttctattttatccaaaaatataaatatgtacatatatttcttcagaaaccctaaaatacagactttctagaattgaaaacattttatttaacttactttttacaaagcttccaagataagccactataaacatctgtgattatagtgtttagttttatggagttaagatatagggggtcccctagagtaagagctttacatgaaaacagtggtagagatttctcccaacttcttagttctgcgataaatctattcactgggattcatacatttgtataaaaagtccataagtggggaagttaattgatcagtttttccaagaacatacaaatcccattgcatgggaaatcctatacgagggccaaccatttgactagactttggatatgtactatgcatattttgtgtctgtttattttttctgttctcatccacagaaaggaatagacaaagaattttacctacttgccacaatatttgatgaaaatcgaagttatctcttagataaaaatatcaggatatttaccacagagcctgaaaatgtggatacagaggatccaaacttccaagagtctaacaagatgtattgtaagagaacacttaacttaaatgtattaagcagtttaatttcactaggcctaaagaattacagattttttaagagaaacatattttcccctcaatggttggctaatatgtttcatgttttctttaaatataatttcccaataaaaatagtgcctacttgggtgattatgttacattctatcaaatgtttaccaatgcttttttggtgcaatacattattttagctattactaaatatgatacagaaaagacatatttctctattgccaaagtaatggagtggataggtggggtgtttcttgagttggttggttggtttctgaagacttttaagtgtggagggaaaaaagaatggtctagaatctggagacttggactctggtctcaacattttcattcattagcttcatgacagtgaacaagtctctctgaccttagtttcatcaaatctaaaaaaagggggttggcttgggtaatcttgatatcttacatgaatgaactgcttaatgaatagtccttggttgactccaagagatgtcaagtaccaataaattaaacaatcttttctttgtcacaatatcttgcagcgataaatggatacatgtatggaaatctgcctggactagatatgtgccttgggagacaatgtttcaggcaagttcttag

SEQ ID NO: 38137 - DNA, 1206 bp, Bovine  19866880418897
ccagcctgatgcaggcccgtgatgggttttgtagttgagcccacccttatggttttgttttcttcacttggcattgtttgcgtgtgtgtgtatatacccatagcctattttaaaaaaagaggggtgggggaaagcaagcccaggacacagaaaaccaagccactgaacttctccccggccagagagacgtttgtcaaacattccaggaggctcgctgggcagtctgattccctggcctccctcctagtctgcagctcctggcttggggaagctgccaaaatactctgtctatgagctgtcgctctcagttcctggtgctgcaaaaggcaaaaagttcagaagtgaagccttaacctttttctggtctgcttcttatacagcaaatgacatgctggcttaaaatggagtccagggaccttcctggcctcgaatcttgggggcctttgtagacatgaccgagtggtatgtttgctggagcaagttagagggtgcatcactgtcccagtgggcattagacagagggtcatgggtaccccccatgcacctctgcacaccccattcccatgttgaccatttacttcacagtcattgactcaaaagagtgttcctatcttaaatgctgtggagtttgtttttcttggtgttttcttttatattgaataatagcagtgaaatatgtctggttacgtctgtagagcttggttatgtttgatggccaaacactcaagagaaagtcaattattgaaggaaaaaaaaaaggcggggtggggggaaaggagatgaaaacagtgaaaaagataaatgtggatttgaatttaaattctgactctcttggaagggaaaaaagagaagtctctgctttagttttgatgcattcctgcttcagtggagaacgcttctgtttggggtattcctttctgtgggggcaggcaaaaagtctagacctgactaggtctttagcatttgtaaggcatttaatggtagtctgtgcttacctggtttggcctcagatactgcatttgagatactgtacgttttgttttctttttcttttcttaaactgaactattctctccctaaaatgttatgggatattatcccaagaagtatttcgtttgttgcaaatctagatgttttccttcctgtattctccggaagacttcctctctgtttatctctgtcttgaaactcttctgcccccctttg

SEQ ID NO: 38138 - DNA, 1182 bp, Bovine  19866880450223
acctaggaaatttacctttaaaatgtttaaaacgtgtattaaggaaagttttaatttagcttattagacaagctttaaaaacaatttactaaaatataattttgtattcttttcattttgtaaattacagctttagggttcagtttggaaagtggttggggctctggaagagctggaccaagctacagtatgccagttcatgctgcagtacagatgacaactgaacaggtgttcttttttaaaattttgtaacctgaaagtgaattttaaatgttgaagattgatgtttaaaaatgagataagtatgcatgtgctagtgttagtgatttatgctttgatgtttttgtattacttgaaaaattttaagtgtccataatttttaaaaaattgaagcttgaaacttattccttcagtaagattgcaaattcaatgctacaaaaaactagttccaaatcttaggccttagtctttttcttacttttgtctactttgtgatccaggatactattacattgggttatgtgaagtatgtgaagtcactcagtctgactctttgtgaccccatggactgtagcccagcaggctcctccatccatggaattctccaggccagaatacaggagtaggtagctgttcgcttttccaggggatcttcctaacccagggatcgaacccaggtctcctgtattgcaggcggattctttaccatctgagtcaccaaggaagcctgagaaaacttgagtgggtagcctatcccttctccaggggatcttcccaacccaggaatcaaactggggtctcctacattgcaggcagattctttaccaactgagttaccagggaagcccttttaatctagccataagcaatccttctgttgtctgaaattctatattatctctgacacaacgctgtattgtcttctgttccaattgagaaaaaatttatacccacttcatgctaagtcctgttccaagactcttatatgcatttttctatttatttttcaaaataaccttgaatggtatctttattctatttttcacatgagtaaactgaggtttgttgaacttagataactttctcacagtcatatacccaggaatgggcatggtttaaattagattacctaattctggaggctgcgctcttatcacagaacttcagtctgacctccccagt

SEQ ID NO: 38139 - DNA, 2625 bp, Bovine  19866880502587
aatttatttaaaagattctattgtaggacaagttattatctgttaggggtcgacatgggtcctcttgaaattttttttcacttcacttgaaaaaaaaattaaatctctgtgccatgaatctccacccgcagtcttaacatctttctacagaatgcctagtactatctgcttgtttgagtatttggcaaatcatgggtaataattctaagccttggtcagaacttttcaattagtatcccgtgtgactactgggctctgttctgctctcagctccagaattaaaccctttcttttttggcagtgcttcagaggcattttttgaacagggtcctacaagaatcggagggtcgtataaaaagctggtttatcgtgagtacacagatgcctccttctctaatcaaaaacagagaggccctgaagaggaacatcttggcatcctgggtaagtctgcacagaatacataaatactagcgtactcttgggctttcccggtggctcagcggttaagaatctgcctgccaatgcaggagatgcaggttctatctctgggttgggaagaccctctggtgaaggaagtggcaacccactccagtattcttgcttggggaatcccatggacaggggagcctggggggctacagtgcatggggccacaaagagtcagacacaacttagcaactaaatgacaacaatgtactcttcctctaaactacaaccaacttaagaacagaagcttcagaacctgaagcatgatttctacatacaaactattcatggaggagcaaacatcaataaaatgcagtagccaatcactttcccaatgtaaatttactcacagtaaatcttcaatatgaaaagccaggctgacttcaattgagtgtcttttttctttcttcaaagaggtaaggggtgactttgttttactagacagtgaagctattagcttctgcttttagttaaaggtacattcccttagaaataaaatccagctgctactaatgagacaggtgggtttgttttagagcctccttctccccaggcagaacccagagatcttttcttgcgaaggcacatgggcagaatagcaagcgcgtggattcagtctgttctcactgtctgtcctcacctattagccatgtgacctttgaaatactcaactctctgtgcctgccccctttctataaaacgagaatgatagtaacaacagtatccctacctcataaagcagtcataaggattcaatgagttaattcatataaatactcaggagaacatataggaaactctcaataaatatcattttatatattacataaaatacttgtgtactatgtatctgtttttattctttttttagtaataatattaattttggtgatggaaaatacacaacagtgttgcttttcacagccaagacaaatttaacttaccccctttgggtggtcaatgtttatggcattctcttagaggtccgtctagtcaaggctatggtttttccagtggtcatgtatggatgtgaaagttagactgtgaagaaagctgagtgtcaaagaattgatgcttttgaactgtggtgttggagaagactcttgagagtcccttggactgcaaggagatccaaccagtccattctaaaggagatcagtcctgggtgttctttggaaggactgatgctaaagctgaaactccagtactttggccacctgatgcaaagagttgactcattggaaaagaccctgatgctgtgagggattgggggcaggaggagaaggggacgacagaggatgagatggctggatggcatctccgactctatggacatgagtttgagtgaactccgggagttggttgatggaagggaggcctggcatgctgcgatttatggggtctccaagagtcggacatgactgagcgactgaactgaattgaactgaacttggctcttgggaccaaatagcacacgtctggtccacagtaaactaggatgaggagatgcaggtactgagtagttttatagatgtgtgaagcttgtgaactgacttggttaaacatggtaacacatttcattacttgaagttaactcaaaaaacccttctcatctctttccagactccccatgtcaaattgataatggactttaaaaaaaccaagctttccatttgccacaataagcatgttgcttccagaggttctttttagagtacaagacagaggaatcaattgtcttatgtattctgtaggttagatatcagggaggataataattctctctttatccccaggtcctgtcatttctgcagaggtgggagacaccatcagagtcaccttccataacaaagcagcacatcccctcagtattgagcccattggagtgagagttgataagaaaaatgagggcacatactattcaccaagtggaagtgagtacaatgtttggtaatcaagcaataatgtttataacccactgtgctggtcacctcaggaaaacggccctgaaaaaaccaaagtcaggaacttctgagcaatcttctcatataccatcctcaggcatcatgccaggaagcaagtcaatctcctctcctaccatttgcagttggtttgtagaattctgtcctatcttaatcg

SEQ ID NO: 38140 - DNA, 2012 bp, Bovine  19866880524864
ccaggattcattctcatcaaaaatcaggaagaggagaacacggtgaactatgttttctttggtgtcttttcgacatacaatcaaaggacctaccagtccactattaagatcctggagagacaaagcaagatgatgaactgtgtccacagctaaaaaactcccccagacaaggaaaagagtgggaacaagtttttgtttgagtgaggttagatcctgagttttgaatgattagggttctaactctgagcataaggaacaatatttgacttgctaaattctcttccttttttctttttttcaaatcagaatttccacaaataacttgctaaattcttgattggaaaaaaaaaatcatcatctcactcattagagttgaggtccaaagtgaacaacaaactcttgaaagggattttagatacattcctgagtagatttagctttatctttgaaattttaattaaaaaacagaacttcggttttaattagaattcccttgcattggagttggttgacagacttgtctaaaggtcatggatcctcccccaccaatgatacatttgttcttgcagccactttcagttgggattcctggttcgtttgtatttattttcttttggggttgaatgtctgtgtctgctcttggttttggtggaaagcaggccaaaaataactaaaaggccagaaaatgagctctttttttttttaatacaaatgaactggacctcaagttgagagtttttaaaagataaatactgtgtgtccattaatttgtaactaattacagaattttaaaacttcatccttaattttctggaaactaaatcttattcaatgaaacaaagaagagggtattatcatataattatacatatatatgtgtttatcccatatatatatattccatatatatatatgtacttcaatccacagtaacatgttggaaaatatcctaaatctaagtaatcataatgtaataattttttgctcttgaaaaatgcaaacttgtatagaattaaaacctaagcagtatttagaaagtttacataaaactgagattttaaagaaaaataaaaccttgcttttgtcgtaatttctaagtataaaaactggaatttgaagcttaccttaaccatgtccacggtcgaatagtaaaaccaaggtatgcactcaaagtcatttgaggtaggaccagatctttcaggaacctgccaaacgtatgttcggatctctcctgaaataggtaaatgcaatgggtttaaacagaatcttttaaatcgcatttctttacggaaaaccagaaaatgaacaaaccctaaagctatacagatattaaacagcatagtccctcgttttcactcctggctccacagcttctggctttgtgatcttagtcaatgtgtttacatggtttagacttctgtttcttcatgctcagtcaggaagatcccctggaggaggatgcaaccaactccagtgtccttgcctggatgatcccagggacagagaagcttgacaggctacagtccatatggggtcacagagagttgaacatgactgagcgcctaacacttttacttcactttgcttttcctcatgcacataaaatgggaatttagggattagacaagacggtgaagggaagcccttggtgttacgtcatctgacccacagggcaaggttgatgtcactgtcagggttggttgttagattctcagcattacaggatcaaaactttataatgggggcttctctgatgactcagcagtaaagaatttgcctgccaatgtagggaacatgggttcagtccctggtctaggaagatcccatgtgccaagggacagcaaagtccatgtgccacaaatactgagccagtgctctagagctctagagcaacaagagaaaccatcgcaatgagaagcccgtgcaccgcaactagagagtagcccctgttcactgatactagagaaagcccagcacagccaaaaataaacaagtaaactaaaaaaaaaaac

SEQ ID NO: 38141 - DNA, 1273 bp, Bovine  19866880627433
aattctgtcctatcttaatcggggtgattattgacaatactgaaagtaacttacttggattgtatcaattacacatttccagagttctatttgggtaactgctaaatttgaaaaaatattcttatagttataagattagatgtacattttagaatgttttaaaaatataaaatttgtagccaaacattatatccatagttctatagccaaccactattatatttttgtataaatccttcactcttccatctgtgcacataatattttgatatcatagtatttaaatatgaaaaagtgaaagtgttagtcattcagtcatgtctgactctgtgaccccatggactgtagccctccctgacccaagctcctctgtccatggggttttcaaggcaagaataatggagtgggaagccattcccttctccagggggtcttcctgacccagggattaaacccatgtctcctgctttgcaggtggagtgtctatagtctgagccagcagggaagccctagtatataaatatacttattgctataattttgtacccagggtttggtttcttaacattataaatattttataggtataattttaacgatacaaaatattccactatatggaagtatttaggtatttttgtaggtcaaggctagccaatgaagacactcttctgggtctttgatttcttatatcctcacatgtaggaagaggctagggagttttgtgggatctcttttgtaagggcaataaccccattcagaaaggctctactctcataacctaatcacctctcacctcaaatactatcatattggacattaggattcccatatatgaattttggagaaacataaacattcagaccatagcaggcaccaatctcagacagaggtgtagagaagacttcctgggggaaatcatacttatttgtgacctgacaccagtgaacaagtaggattctagtctaatttataaaggagcacaaaagtgggttgtcctagactaaacccagtctactccatggctcaaatgaccacatcagaaagcaaacttaacctcccccatgtgacctttcttataggtgggcctcctccttcaggctcccatgtggcacccaaaggaacattcacctatgagtggactgtccccagggaagtgggacccacctacaaggatcctgtctgtctagctaagatgtattattctgctgtggatcccaccaaagatatatttactgggcttatcgggccaagaaaatatgccggaatggaa

SEQ ID NO: 38142 - DNA, 1731 bp, Bovine  19866880714126
ccctgagcgactgaactgaactgaaacctccttaaggtcctggtaatacaaaactacccacaaaagcccttaccatgagcttcgaactttcagtgaggaggtatattaatccttccacaccatgttggacagtgtcactactcacactgagttttcctgaaaaagagtaaatattatccattactccatgttttcaaacactgcaataaaaaataattttggtaataacctcctgttcattcgccattcccaggcaaatgccttcagttatttcccaccatgtaatcttctttacaaaacacagatgcgtggcgacaataccaggtgtactatctctctcctgagcgcgcagctacttccagcctaacagaagacacaatatcgaaaacctcccctcatccattgggggaaaaatagttcagtaaaagcagatgtctgagcaacgaacaacagccaaacagttgcgtatttatggttcaccgaactattccacacacttggatgcatataaccatcatagtgtatctggcagatggtgttatgtccattacacgccaaaacccacaagctttaaaaaaaaactcagtatttagagcacgggcaggatctgcgccctgacttaagaccccttctgcttttattatgccacaacgggggagggggggggggaggataaaaaacccttgtcccaagaaccccgtcctctccagggagatagagaacggcccacacttccccgagaagattgcaccgctgtgcctccccgtttcttactggcagcgccttcgtagatcttggggttcgagccacgcctcaggaactccaccgcaattcgcccaaactctgcgaccactgcaacggaagccaggagaccctgagcgccaggcgctcccccgatcccctccccagaccgcagggaaccaccctccgccgccgcgcgccctgacccgcgctgtccactttcggcaggaaggccaggtgctccttatgctcctccgacaggtccagcagcatcttccctgggtagccaatttcactgtgcagcgacaaccccaccctcgcgacttccggggcctgagtccaagcgtaaagaggctccggagcttccgcgcccggaggtttgggttccggctgaaagccgtcctacactcaaatgccttcctaggagcagactgggagcaggagatctttcagtttgtaaatcagatgtcgcctgcggggctcagaatgccttgatctgaggaagatgaaaataagtttaaaattcgactcgcccccttgcggagcttacattaataatgttgctgctgctgctgctaagtcgcttcagtcgtgtccgactctgtgcgaccccagagacggcagcccacgaggttcccctgtccctgggattctccaggcaagaacactggagtgggttgccatttccttctcccgtgcatgaaagggaaaagtggaagtgaagtcgctcagtcgtgtccgactcttaccgaccccatggactgcagcctaccaggctcctctgtccatgggattttccaggcaagagtactggagtggggtgccattgccttctccgtacattaataatgttagtagctaacatttatgaagcactatgtcaagaactgttcttaggtttattaacttgtttagagctcacaagaaccttatgaggtaggtacccttactgtccccgatagagataagtaaactgagacaggtcaagca

SEQ ID NO: 38143 - DNA, 1258 bp, Bovine  19866880794722
attaatccttcactattagatatttgctgctgctgctgctgctgctaagtcgcttcagtcgtgtccgactctgtgcgaccccatagaaggcagcccactagggctcctcccggtccctgggattctcaggcaagaacactggagtgggttgcccatttccttctctgatgcatgaaagtgaaaagtgaaagtgaagttgctcagttatgtctgactcttagtgaccccatggactgcagcctaccaggctcctttcattcatgggatttttccaggcaagagtactggagtggggtgccattgccttctcctattagatacttagccataccattattgttgagagttgaaaaacacaaagactatagaaatgagactggttttcgtatgtgatttgaggtactagtttctgtcccttattcatggagaattaacacagttctctctaatttcctaagtttctaatttctctaataacctgttacctcccttagcccaaaccatacctggaatatttaattataaagaattcttttatttccaatgaataattgaaaaaatgcagtgcattaaaaatatttcacaaattatttgtttgtgattatgacattcattggaactaaaagaatgagcgtagtttaaaaccaaactcaaggaattatctttttaaatgataaagtatgaggagatgttcatattgttttacaaaaggtttaatagagttagagtaaattttttccagaaatcagaacatttgcagagcagaaatgcagagaaggatggagcatgtttatcaaataatgcaaataaagttatcagtggtttgtagcttatgaaaacagcataacaaactcttccattaccgaagccatttcaaccatctgttcaaaaaccacaattccatacaagggcaggtttataaaggtaaaaagctgaaaggaagttcttggcttaaattctcagttccccagtgtttaaaccctatgtgcttggatggatgttaatggccacaggaccatctcagcaagtagacctgaacagctgcctgttttttttttttcggacttggagagtctgggaagtgtttctgtaatgaacagaagtggtacccttgagaataacttactaaatataaaatagaaaccattattaaaataagactttttttagaaacttggtattataatcaacattttcatatacagtgtatatgaccccagctgtttataaatcttttgacatgtatttggcatcttaa

SEQ ID NO: 38144 - DNA, 1452 bp, Bovine  19866880820108
acgtgaaacagacttacccgatttaccacagattgggacttgaacccatgtggttgtgccctgcccctttctttccttcctcttacacagggacaactttgaagtcaatatgagaaaaaaagcaaagtgaaatggcttgaaaattatctcatgtatgattcagcctcagaacaatctcataaaacatcattttaaggacgtgacatttttaaagactttgccaaagtatgacatgttttagttttctgctcccacctgaaattttttacctcatttttataaactgttcatttttcaagtactttctaaaatacctggagttaagaaaaacagttatgtgtctttaactgaatttagttctatagtgtgatgccacatatccaccctcctccccctttggggggcatttttaaaaccttttgattcttgtgtgactttttatctctctttgtatattttcaattgttagattaaattgtatgatctggggaaaacattacactagtctgggaatcaggaaatgagagtttagaccataggtcttttgggataataaatcctcagtgatgatgaaggaaaatgtgtcatttttttgtgtttgttttgggacttccaaccacctcaaggatagaaatctgaaacagcaatatgtgtaatgctttccttcctctttgaagggggatattttgtgaataggtagctatttgtatatgatataatcctactgggacaacagtatcctagctatacagttgtataatggtaggatttttagtctgatgtggacttttattttttggtttgcatggtgtttaatgtgaggggtgaaagaagggtgaggtagcaaggaagttattagcaaaagaaaagaaaggattatttttaggcccatctttcttgggtgtgggcttgggtggagtgggtagggaaccacaagggttttatcatgcagattgcctgtttctctggaggattgagaaggccagcacagataactggtgcttgagcgaaatttccagactggttgattaagattacattatgggagaggttaaaactgcagttaaatcaggtattaaaactaggattggtatcataggttttttttagcgtgagtgacaccatttggggactatggttttctttttcacagaccaaagcgatgctttcctgaacctgagatgaggatcctgggcaggaggcaaaggcggagacagatcacagggcaggcctaatgctttagccactctggtcttccggcacttaggagcacaaactgagccaaggcctaaaggaggaggaaacaattatctcctgggaaaggcctctgtaatctggaacaccacagatttctcagagtgggagttgagaaaagaatgtctcccggttcttgatgaaacttttcagtctgtttcaaggacttgcacctgggaaaaagcactggtttctgga

SEQ ID NO: 38145 - DNA, 2054 bp, Bovine  19866880841189
ggttgcatggttgacgctaacctgagtgttctcaattaggtcattgtaaaaaaaagggggaaaggatattcttggactccctgatactactgtgcctcatcgcctggggaccaaaagagctagaagaactcaaaaacttttcagtctctcctaagaaaatgaagtccgccaggatgttgtaagaaagcccctgaacaaagaaggtaaggaacctaggaccagagcactcaagttcattgtcctgttactccatgtgttctgcagcacaaacgtggatgtgctgctccaaaggaactgtactaagaaatataaggaagaggctgcaggatatcctaagcttttggccaagagaatgaagaaggccaaagaaaaacatcagcaacagactgtcaagagacagaggctgggcttcccaggtggctcagtggaaaagaattcacttgccaacacaggagacatgggttcgatccctgatccaggaagatcccacatgctacaggacaactaagcctgtgcaccacaactactgagcctgtgctcttgagcccatgttctgcaactactgagcttccatgccgccagctactgaggccctgcgtgccctagagcccatgctccagaacaagagaagccaccgcaatgagaaacccttgcagcccaactagagagcagcccctgctcgctgcaactagagaaaagcccgcacagcatcaaagacccagcacagccaaaaataaaaataaataaataaaaatatttgaaaagagagagagaaagagatggaggttgtcctctctgagaacttttacttctgagtctgaatccagtcaaaaatgagatgttctaagagtcacaaataaataagatcagacatcaaaaacaaaaaaaagagagagagagagacagaagcatagcgggtataatgttgactatgttgactacgggtaaatctatgtggggaatatactgtttttatttgtactattcttattcttgcaacttttctgtcgatttgaaattatttcaaaatagtttataaaaatcatcagggataagtagacagctgtcactcttagaaaaggaataaagatccccacaggacaataccacaagtgctgtggtgcactaggaccatctgttaatatttcaaagaagtgtgagacacagacatacgatctgagatttctttccgctccatttcatgattctcttgccagggttcaaagtaaaggtcgaaggctatttatgtttagactggctaatcaattcccataggagagtgagtatgaataagggagtcttattttagtgatgggaatttctcttagatcctcaaatgtcatgagctgtgaaaacaagaaggtgaagatatacagtcctctgtaagagccttgaagctggctggttgtggcattctgactgtgtgatacttagaatcaatttctaaccatcaattagactctaaatttctacaaagtagaagtctgaaaggaataccatttctttgtacagttgcaccggtgagatcgtattcacaatatacaaattccacccagcttcagctacaggaggtgtcttgggattaacactggtaccttttctagaactaaaagcaaaacaaaggacaagaattgtaagacaagacatattattaataaaaggcaattttaaatggtaaataccagatacctaaaatattgtaactctgataccattttcatttagtattttctttggtgatttatgcgggagacccaggttcaatccctggtttgggaagatctcctggagaaagaaatggcaacccactccagtattcttgcctggaaaatcccacggacggaggaacctggtaggctatagtccatggggtcgcaaagagttggacatgactaagcgacttcactttcactttggtgatttaactacacagtagatttttagagaacattagtgtataacactatgtaggcctaacagcagttaacgttctacactcacgtggactggtcaaccaaccacttccaattcattccacaagtattcttaagtgg

SEQ ID NO: 38146 - DNA, 2072 bp, Bovine  19866880874310
aatatataattagaagtttgcccatcttttttttttttcttttctcacagaattgttaagccctaataatgcacaaaagcagctggcttgctacatacctctcactggcagttttctttcctggctttgttcccttgcctttgagtattgccttcagagttccaaataaactacttgcattcaaatcagtatttcagtcctcttctgggaacccaaattaaaacacgaaagatgttatttaattttcatgaagctctgtgaggttgatcacaccataatggtgtgatcactcacctagagtcagacatcttagagtgagaagtcaagcagaccttaggaagcatcactatgaagaaagctagttggggtaatagaatgccagctgagctatttcaaattctagaagatgatgctgtgaaagtgctgcactcaatatgccagcaaatttggaaaattcagcagtggccccaggactggaaaaggtcagttttcattctaatctcaaagaaaggcagtgccagagaatgctcaaactactacacatttgcactcatttcacatgctagcaagttaatgctcaaaattttcatagctaggcttcaacaattcatgaaccaagaacttccagatgttcaaccttgattttaaaaaggcaaaggaaccataaatcaaattgccaacatccattggaatatagaaaaagcaatagaattccagaaaaccatttatttctgcttcattgactatgctaaagcctgtgactgtgtggatcacaacaaactgtggaaaattctaaaagagatgggaataccagaccaccttatctgcctcctgaaaaacctgtatggaggtcaagaaacaacaattagaactggacatgaacaacagactggtgccaaattgggaaaggagtacatcaaggcctgatgttgaggctgaaactccaatactttggccacctgatgcgaagaactgactcattggaaaagaccctggtgctgggacagattgaaggcaggaggagaaggggatgacagaggatgagatgattggatggcatcaccaactcaatggacatgagtttgggtaaactccaggagttgatgatggacagggaggcctggtgtgcctgcagtccatggggtggcaaagagtcggacatgactgagaaactgaagtgaactgaactgaaatttggagatactaagactcacttgaggcccttaccccacagttaaagtgcattgaatggaatgctcactttaaaaaaatgcctgaaaaaaaataaaaataaataaaaataaaaaaatgcctgagagagaccctgggaaattgaacaattttctgtaatttcttaagtgttatgtgattctcctaaaactaacacacactgttaatcaactatacttcaatataaaataaaaagttttaaaaaactaattcaaatattttggaatgatagactgatttgaggataatcctaccatcataattaaatgaatttaaataatctgaacttacattcagtttccattcatttaggcctttgttatctaagattattctacatctcaaaaatactataaatatacaaagacacacatatattaaaacacatatatatgtctacatattaatatataaatgtacatatatacatatataagtttacatatataaatacatatatatatacatacacacatataatcttagaggaaatatttctgagatcaaagaattacagacatgacaatataaaatgatttggaggttgtcattattgtaaatagtccaacaaaataatattagcttttaggtaatactcaagtgtaggaaatggtgttgtgtactaaagactaaagataaatcttcaataagttcttaaattttaacttttatgaaaaagtcaaaggaaaaggacaaataaaatcattagtacactgagacaatgtcaagggaggaaaatcagttgattaaacattcagagtcttccagagcatgcatattcatctgtgggaccccaggatgagcccattgatgaacatacgtttttcttgatggtgtgttag

SEQ ID NO: 38147 - DNA, 1385 bp, Bovine  19866880885844
taacacctcactgttctgtctttttatcagagcactggagttacacaagggaatttagccatgacctcatttcagtcttaatatcactcttgctaaacctatcctagatgagctgactgtctgtgaaactttaagactggtgggtagtgaggggagtaggaaaggaggccagtggagaagccaagactgggagcagttcaggtagagtcttgacagagtacttgggatttctacagggatggaactgaaagtctgctaaggaataaaacaaaaagtggtaataaaatggttctgtactgtgctttgtggtagcttctgaattttctacattaactcaaaggtaagacaaaagcatttccaaaaggattgtatattcctgctgaaaccagtgctaggtgagaagtcaaagtgggattgagacctgggaaccaatcaattgttggacaccaaactgctgatcttgttcatttcaggctatttacaatccagaacttagaacaggcaaaggttataataaagtctgttgtttctactctctaatccttcattacgtgaacattcctacccgctctgctaatgattctattccaataccttccatagatatgtgagcagaactctaagaaaagccagtaaaaactaaatccaagggaaagcccaaggtgtaacaaaggttgggaatgccaattgaaatagctgtgtgccacactctttgaaaataatttgtctgttgaaaccttaaacttttcttaagtctgaggcaatatagccttcatttgcattaaagcattttcaaatagagcaggaataacgactgtggttggcccttacctggtattggaagctgtggccatggaaatgtaccgagtgcaagtctacttcattgcccattcccatcagataccagttgacttcatctcccacatgcatcgtgaggccttgcaggttcccaaacattcttccattaatagctggggaaaaatacacgtttttattgccttccaggatattttaaaccaacagctatttcacagaaaagaggtttttgaggttaatgtgctgtgctgtgctaagttgcttcagtcatgtccaactctttgcaaccctatggaccatagcctgccaggctcctctgtccataggattctccaggcgggaatactgaagtgggttgccatgccctcctccaggggatcttcatgacccagggatcaaacccaagtctcttacgtcttctacattggcaggtggattgtttaccactagtgccacttgggaaaccccatttggttaatatatggggatctttttttatgtaatagaacttatttcactacagataagggaaatgggtactttaagatcaataacaccacactgctttt

SEQ ID NO: 38148 - DNA, 590 bp, Bovine  19866880896721
cttcctgtagtttcaagctaattccctattgttgcaactgtggtggcttttgagaatagcttgcaaagatgctacttcccatggagtgacctgcagcagcttccccttccctctgctggtcctgtgggcagaggacttactgatggaaaacagtttcagagtttcctagaggagccatgctctgcttacctttgatagtgatctctcaggcagctttgatttttcccagtctgtgaggagcacaccctcagatatagataatgaagaagggggctcacataggtgccctctgctctgttttgggcagtgacagggagcagccattcagggaatgtgctctgaatactcctaccctttccatggcaaaactataggatggccttgtctttcccatacacttttctccttcacagcaactccagattttaattttgattttgttctactctaataaaaatgtggaggcacaatacttgcacttttatttaacaaaaaggtatgtaggcaggtatgtctgcaaagcgctttacatatattgtctcatgtgacttatttcataagcttatgtttgaatccagaggggtgggggg

SEQ ID NO: 38149 - DNA, 810 bp, Bovine  19866880953878
aatgttgagcactgaaagtgggtgatgatggacatgtgggaatttattatactactctctgcgcttttatgtattatttgaacattccccatactacaaagttttttgttggtttttttttttcacttttttaaaatcactgtgaatatactgttcctattgttaacaaatccttcacacccacttcattggagttgtttcagtggagtgtgcccgatgctggtcctagcacgtctattcctcatgacccgcctgtgggtgggtgttactggtcccaagttgacatctgaaggaactaagacccaaagaaacaagccacttggccaaggactcaagacaatgaagatggggaagaacagccacaccatggaggtgtctgctacacatattgtttggtgcctttctaactattattgtacgtgagcatgtctgtttcattgtcacttgcagtattttagtgcatcctgtttttctagaaaaatgaatcagccagcccctctctgtttatccaagataacaaaacaaaacaaaaaaggcctgagaacaatattggtctgatggaggccatcctgactgtaaaaggaaacgtccctgagtcagtatcctcagtgagagacatcccttcataaaacaaaccagaaatattccaacagggttcaaataagcgtaaacatccacacagttcagtggaagctactctgaactcaacaggaattctggctgctttgggaaggcttttcccatctcatcgcagattcattccacgaactctattccctcaaaggcttgggctttaaagccttcagaaag

SEQ ID NO: 38150 - DNA, 1178 bp, Bovine  19866881044766
tttcctctttttttttccgagttagtcattatgtgcctaaattcctgccttcacagatgtgctttctgcttggtcacttttgataaatctttcgatagcccagaaatcagatggaatcaagtagcactttctggtgctgctttaggtggaagaaatatgatttctttatagctgaaggacccagaagaaatgaatgccagaaagatgtgattttttttcataggttgttctagatctcttacaacgatgaaaactgatgttgaaatcttttacatgccagtaaaatatacattttataatgtctatttaaaaaaattattgtttcattgtaaaatatatattcactgttcatgcatttattttcattagacaggagagagtttattgtagatgatgcatttgctatgctgggctgtgcttagtcgctcagtcgtgtccagctctttgtgatcctgtggattgtgaccagaggacccactaggctcctctgtccattggattctccaggcaagcatactgaagtgggttgccattcccttcttgaggggatcttcccgacccaggtatcaaaccctggtctcctgcattgtaggcagattctttaccatctgaccccccagggaagccctgatgcatttgctaggaaaacataaaaatccatgttataggcttttccatctttacacctaggagaacagagttgcctggatgtttgcactctggtttgttgacttgattactgtttggatggacacacaggatggtaggtaggaaaatcgttggctgctgctaaaattcagggattcctgtgaagtaaatgtaggttgggttacaagtctaaaaccagttgagccgggggcatctggagaatctaagatccacctgtctgattctgggggcaccttggaagtgctgttaaggtttgaagtcgggaaagtgtgtctgaacgtacatggatcccagaattttgtgtcttatcaactaagccggctgagaaatttccttagagttattctcacccagaattggaataaagagctcagtgtgaagttgggatagtgcaacttcttggtttaatactttacagatttttggaaccgaatgcaccctgaagtgaaaagctgcttttttttttttgctgaccttgttggacggctaatactgtttctgggaaataa

SEQ ID NO: 38151 - DNA, 1654 bp, Bovine  19866881068291
tgttaacttttttgggtttttttggcgacactgcatggcatgcagaacttgcctgatcatggattgaacctgtgctccctgcagtggaagcacggagtcttaaccactggaccaccatgtcaggcccttattaacttttttttaatgtaattagcttaaaagaagtattaccctttttgttagacactgtctctttgcacccttttgaaagttaaaatattaggaaatatttagtaaagatttgttcattaagaagcaccaaggctgaaacatttcccaggggaatacattctcagactttcctcccattcccaagaaaatgtataactaattttgagacacagcagaaagttggagactgcttgctttttgtgggatagatgaagaaaaccttgttttattgtactttgtttataataaatttcttttacattttagataaatacctgtagtcattatggcttaatcaatccatgggttaatgtcttaatctcatccgaatccttagtcgacaaaaattatatggaagacctttcaaaattacaggtaaataaagatgcttctttttcttatcaatttgtatagtataatatagtataggagttaaatttggtacgctccccggttgtcctgttaactgagagtgtatagtttgggtgacagaatctacagtgaggcatcctcagcagccctgcagggaattcctgctgcttctgcctgaaactgctgacgggaaggctggttttgttgctggtgggtgggtgaggagcttcaccgagtcctgtgacagtcttgcctcattttcaggatgtgcttgaaaatgctttgtgaaatgaaagtatggcaaatgcttcgtggtgttttcattgtgattcactttttttttttaatttaattaattaatttttaaaattttagcgttcactcatacagtttaggcctctagcccaagccaagcactcctacctatcttataggaaatagattaaagtggccagctcatctggttccttaaaggatttttttccccaaatatttattaatttatatattgggctacatggatcttagttgcagcacgtggtatcttcagtcttcttgtggcatgtgggatctagttccctaaccagggttcgaactcaggctcctgcactgggagcttggagcttagccactggaccaccagggaagtcccagatttttttttgtaattaattaatttattttaattggaggagagtcacttcacaaccctgtggcggcccctgccacacattgacacagatcagccacgggcacacatgtgccccagactttttttaaagtaagaaatatgatcaagagaatgtagcccatgctgcaagaattctgacctcgacagtgttttgactgaaagtgagaaatgaagtccacatctgacttggtgggtggggctgggctgcaagtgtacgggattgtatttgatggagtcagtggcctgaggactgaacataatgctcacatctgttgtgtttggtctgcccagtgtacctgctaacatgtgaaagttgagatttcaaatgaagaagtgttgagtttcaagtttctctttgaaaaactcagcagcactttgattcagctgtaatcctgggccctcactgcctgaggcctgtgg

SEQ ID NO: 38152 - DNA, 1002 bp, Bovine  19866881136216
tatgttaaagtcgtgcctcatttcctcgggcaaggaaaaactctccagcatcagacacacccatgaaagggtggcttggtcatgtttaacagcgtccttaggctagcttgaaaaccctcatggcctctgaacacatcatggtgctttctataaggtgttttttaaaaaacattatttcaaatcctggtcgaatataacaaactgtgtccccctctccacccacagcaattaacggaagaatgtttgcaaataaccaaggcctggtatttcacgtggggagtgaagtgaattggtatctgattggcataggggatgagtctggcctgcacacagttcactttcacggccacagctttgtcttcacggtaagaggcctgggcagctcctcttaattactaaagtaccttgttattggggtagcatagaaagataacaggataagaaaggaaatgaccacaccagaacgcaagttcattacatacaatctgcagtatgtctgatgcaatagttatacatttagctctttgtatcctacagacattcaatgaatgcttctgaatacatgaattgcacttcttcctctattctgatgtttctcattaagtaaataaaacatctataatcatcttaattttacccctctttcccaacttatctttttaattttcaaactctcagtcacataaaataaaaataccttgaacacgcctatatatttttgctgcatttgctttctctctgtttttttttttttttttctgaatccaacggaaagtaaattgcaaacatcacgactattcactcctaaatactaaagcaggtgtatcctaagaatgaagacaatcctgcctcaaccacaataatattatcataccctttaaattaacattcattgataatataatctaacatacagtccattcaaatatcactagttggccccaaaatgctagttgtaatggtttttcttttaatcccagatctaaccatttatacttagca

SEQ ID NO: 38153 - DNA, 1482 bp, Bovine  19866881174053
tttttaaaaacattgcttttgtttgctcaaaggaagcatttgtagaaaacatgaattttcatttaaccttttgcccctccttccttgcaaacatataacctttattatatcacctttgaattctgattttaatttaatacataaggaaaccctagtaaatgatgtcaagctcaaaagatcagtcacaagtaattcaaacatgttagcccaaaaggcaataaataaaaattatgatatatcagtcatcctgttttccccataaatcttaaaaataaaaattggtcttagcttctcatttttaatgtgatttactcctttgagttctgtaaaacttccaaagatattaacatctctatgtacaaagaagcagtgcagcagtacatgtgttcttatacatttttcattcttagagaaaaaattatgaaacatttgctttgaacctgttcttcaattataaaaggaagctaattggaaagattcataaatattccttaagtggtcaaactattttttttatctgaaactaacataaaattctaagttgcactgagctggttggaaaggagaagaaataactctggcctgcctaagctttgtcagttaggaagcaggtaggaactggcaactccaagaagggaagaattaagtttaatatatcttctcacacgccgtcaatttacaacagctcatcatggaggtttagactggcccatctccctagaagacagaaaaaattaattaattacatcatttgtgtgtgtgtacactttccccctcccatcacccctaggagtcttaatttgtttgtgtgctcaatcgtgtctgactctttgtgaccccatggactgtagcccaccaggctcctctctccatgggatttcccaggcaagaatactggagtgtgataccatttccttctccagggatcttcccgactcagggattgaacctacttcttctggatttcctgcactggctgggggattctttaccattgtaccacctgagaagccccccttagtcttgattacttctgcccttactggtcacttactgaatgttttctatactcttctgactttggttcagatctttgtcacttacctatgtttaggctagaaatgtggaagcttcactttattattaaaattcatttttaatgagtggaactgagggctcaagtgatgtatctgaagccattgttaataactagagaagccaggaattaataagtagagaaccctaggaggtggaatccagaaactgtgttccttttcttgaacttaggctgctacacagatttccatcctcttaaggaaataacagtacagtgtactgagccttctagttactgacatggatgcattttttctttttcctgctgtgccacgtggcatgtgagatcttagtttatcaaccaagaattgaaccctggacccctgctgtggcacaaagtcttaaccactcgaccaccaaagaagt

SEQ ID NO: 38154 - DNA, 1358 bp, Bovine  19866881217246
aataagaataatgtatacccatcaccagagtcaacattatgaaatttggcataccttttaagctattttttaaagatacagtgttagcagcaaatggtcattgggttcatttgtcaccattaacttgcatttttaagtatcagtattaaaacacatttatcaccattaaaatacactttcaccattaaaatacatctttgctgctgctgctaagtcgcttcagtcgtgttcgactccgtgcgaccccatagacggcaggcccaccaggctcccccgttcctgggattctccaggcaagaacactggagtgggttgccatttcctcctccaatgcatgaaagtgaaaagtgaaagtgaagtcgctcagtcgtgtccgactcttagcgaccccttggactgcagcccaccaggctcctccgtccacgggattttccaggcaagagtactggagtggggtgccattgccttctccgaaaatacatctttaaatataatgaatatgggtttgagtaacaaattttaatttggtgttaaatgtttaattaacattattaaaagtgatgaccttcatatagatcatcttccattataaaaatcttcaaggagaacctgttttttttgtgtgatgaactttgcttgaaataaggggcttttcaactgaaacaaagaaaacctttaagaaagaaaactgtaaagaaaacctgtaagttacatagagcttttttgcacatgaatgatgtgccgagcactgtaagaagagctttccaggcaccactcgttaaacagccctatgaagtattcttattgtctttgtcaacagattaggatgctgagtctgagaaagatgaatgtaattatctgtccagagtcatccaacaagtattaggtggagtcatattaagattgtatttgatatataaaataaatatttttttgaaggattaaaaaagcctttaatttttacctctaataatcagaaatggaatagtaaacagaaatttttatgcagtcattctttggatgaaagaactcctgcataaacagacaaaaagactgaaccatgatgggagatgtaacgaccagaaggggttaaaagaaacccacacagttcctcaggaccaagtgggaaggaataaggcagcatcccaaaaaacaaacaaaatcccaggaattagagatttattagtgtccagagtttcaagttcatattttccagtttttgtatataacaaattaaagaaatatttcatcttattggctttattttttaattgataatttaggtttggtctataaagaagaaaaagcaatgacttacgtgtcaaccgaaataagcttcttttccccgtagtcagagg

SEQ ID NO: 38155 - DNA, 1255 bp, Bovine  19866881341718
actgcgtgttgtatttactgagtaaaatgtggtccacggtttcttttctgaaaatctcagtctccatgaggatttatattaaaataaaacaatgggtactcagagctcagagtcacaacctgaataaaggccagctttgcggggcaagggtcttgggggcaaaagttggagatgttgtgatggtggacggtttcaccaaacccaaaatgacctccaagagctggcagaaggctatggacaaggactcacaaggaggcattgagagcaaactgccgcccctcagggagcaaactgtgagcaggaaacttgcctgtcctttggcagttgcacagcaggacacaagagaagagatagtcagatttcctccactggtagatgcaaacacattctctgaattacaaaaaagacaacaaagccagaaaaaaactactgccacaactaggaaaaaagaaaagctcattaaaaatacatatatgccccaagtccctctccctccaatttcaagagtgggctattcacacccatctttttactatgcaactcccagtgctgactttttactcagatcttcctttgcatctttctcagagcatagtgggaggactccaaggcagaacgccatctactgcttagctgtggccaggtaagcttttctcttcaaacaaaggtgaactttaattgggcagctctagggaacaatcttgtggttcagatggaaaagagtctgcctgcaatgcaggagatctgagtttgatccctaggttgggaagctcctctggaggagggcatggcaatccactccagtatgcatgcctggagaatcccatgggcagagaagcctggtgggttacagtccatggggtcccacagagtaggacacgactgagtggctaatacacacacacacacagggaacaaatggtccatgaggccctaacatgccatatggtgtaatacaggttgttccaatgcatcagtccccagcttcaaggtcctcagcctaacctcatattcaggacaaaatgaactgattttattggcccatctgtgtagtattctactcaccaaattttcaggaagagaagagttgtatcaatgaacaagttcccttgctgctgctgctgcattttctttgaactaaaaggaattgctaattataattaaaggggagaagggggaaacttgcaatctgggagaatcaaaagtgtcaatggaagcctaaatggtagtggaaagttggaagggaagaaaagaa

SEQ ID NO: 38156 - DNA, 1402 bp, Bovine  19866881458037
tcagtactgtccagtagggaagtggaaaataaaattatagtgtgtcctcccatagggtgtcttaaatgtcctcatgtggcagctggcctctcccagacagagtgatcagagagagaagctgactagacagagggagagggcatctgagtcagaagttgtgtcttttataacaatctcagaagtgatacactatcatttctaccatatcctgttggtcatattgttgttgtttagtcgctaagttgtgtctgactcttcgcaaccccatggactgtggcgcaccaggctcctctgtccatgggattttccgggcaagaatactagagtgggttggcatttccttctccaggggatcatatacaccaagtctagttgaatgtggaagggggctatacaagattgtgactttggggaagtagataccatttgggcccatcttggagtctgataccacattaactatagtacaaattcagaaaactgcataaaacaaaatttaataactatgaataacctaaaaagtattaggagatattccatacttcctccctataccctttctcagtcatcattctctacattccccataaacaatcactattcagatttttagttgtataaagtggcaagataaaatctagttcctgatacttcattatggttagaaacagaagttttttttggttctttttaattactcctaatttctcttcatagaggcacatttttgacatatctttattgacttcatgtatgtttgagaaaaaactgctgaaggatgtgtcactgattcattctttcaggagcgtctgcagtggagagttcaaagaaaactgatgttgaagataaaccaagaacgacactgatcatctgtccactttctgtattaagcaactggatggtaagtctttacagccctttaaaaatataatttatatttgtcttacactataagagagtcattcattgggagaaatatggttggtcagcactttatagttaaattcaaataattgttaattgacttggggttatttttactgaattgaagtaatttttctgtgaaaatgtatagtagagaaagaaacattgtcagttgctattgtaagatttgacttgtacttccgcctcttttctttctgtctcctgaagtaggaaaggtgtataatttaataccacatcatatttatgaactgttgaaatctctttcttaagcacaccactaatgataacttgtttattttaacaccttattacaaacatttaatgagctgttatgtgctcagtttttcctaaactcttttcatagattttctcaatgaatcctcacaactagtattctcattttccaagtgacgaattaaaacacagagaaattaaataactgccgaggtcatccagc

SEQ ID NO: 38157 - DNA, 1062 bp, Bovine  19866881961714
agttctttctggcatctttttgctgtaagatagataaagattcgtgtagaaaattggatgaggttggcagaggtagctacactagtgccattgggagatagagaggcaaaaaggtgtgttatgtattgttatgtattgttatgtccctttgatagggaaaggacaaaaagtattactttataataaatggctattttttcaaaaaattctctaatgtgggtataatattcaaagataagtaaaacgtacatttacaaattatattttaaaattaccgtaattctttaagattgtaaaaaatgttaagtcaaaggtgcttgtgtatttttaaatcattattttgattgaaatctagtttctcccacaattgagttagtagacaagctgtactatacccactccagtattcttccctgggaaatcccacagacagaggagcctggcggggtagggtcacatagagccagacaagactgagcaaccaacacacactataaactgagaactactttattatgtagctaaaacagaacttcatctccatgagttaagtaggtattgactaacactgtttacttaaatgtccaaatctgtgcaaacagttacgcttttgaaatactagtttcattttaatgttaatccatgtttataatttaaaagatatttttgggcatcaggaatgaatctatcatataacttattttcagagacaaagccccagaacttactgttgcttctctgcttgtcttataggtgattttacagcgagatgctgctctccatagggatgctcatgctgtcggccacacaagtctataccatcttgactgtccagctctttgcattcttaaacctcctgcctgtagaagcagacattttagcagtaagtaaatttaaacagtaaaatttattcatgtctaaaaacatcccttaaagaaagttttttttttaagttctaaatgatagagtgaataatgaaataatgaaatcttaaaaagtgtttacctacaaacatgtaagttcgtacacatatttgttacttgcgagtgtaagtgctcgttt

SEQ ID NO: 38158 - DNA, 1594 bp, Bovine  19866880418360
gtagtgcagcaaggtctcgcccactagcagaggtgggaagtgggtacagagggctctgacaagcagggaggacttcacaggggaggtgattgtttgaattccaagggaaggggagggagcagtgttctgctcaggaaaggcctgtataaggacctggagacaaggacagaagcttagggtgtgcaaagaagagtgagtaggccttggccgtggcacagcaggcttagggctttctcctaatcgcgatccaggtcaggacaacccacgggcatctggactgtgctcagatactgtcttggctgcagaggctgtttgggggtcagcaaacactgcctgtcacttttgcaggctcaggatccacaggacctttcccattgagttaaactcctgagaccctttgtttctactcctctctggactctcgtgggagtcagtgcttccatccccctgtctccagactaaattgcttcaaccaagcctatgccaagagggaactgtatttcacaaaccccagaatgacagatgtcgtctttgtcatgtcactgctcaggtttccatccgtccctctgattatctaactgcccaggataaataagctcatagctaccattcagagagcacactccagggaaggtaccaggcaaatcatccacctcttcccatttaactctccagcagtccaaggtagatgtcattgtcccccagttcaccagtaaagagtatgaggctcagaataacttggccacagtcacactggtaggaagtgcgtggcagaggcactatgcaaaccaaagtgtttcctaaacctctactcttcaaagggactttgcagtccttggcccagacttgtcactgtataggtgagcacacggaggagaccgagaaggggcagtgacaaggccaaggtcacaccactccctctggcgagacgcccacccatctctgactcgaactcccagggcctcccgcctccatcctgctgcctccttgacctaccagtggacaaggaaccagcttctcactgtcctcaggagacttcaacaggagaccagggtgtccaggccccatgcaggaaagctgtgaatataaattccatctctgagccagggtgcacaggccactctacccgggagcccttgacttgggctccgggggccgtgggaaggagaaacgtgcgtgtggagaatttgcagcctgtagctgcactagagaaatgtgcaatgatatgaataaatttgaataataatgagggcaatgactgaattaataataccggctgctcacctgacccacctctcccccaggatatcagcacctgccaccctaatcccaggaaatatgggtgagccttttcctttccccttagaagacatagatgggctgtcagatcaggagagttggggagctgctgttttaacttcctgacaccctgaagacccaaaaaactggatttacacacttaaccgagagaggctgcctggtcgtagtaaatcatatgcgggccatcagtccactcctagctctgcccctttctcacttggtctccttgatatgcaacgaccaatgtggatgccaaatgtccagggagattcag

SEQ ID NO: 38159 - DNA, 717 bp, Bovine  19866880578020
gagacgtgaaggagtggggaggcaagggaacacggcactcaggcacaagcgcaaagacagtgggttcaggaacaatcggagtggtcagaggaaaaacagcttgatgacttggtgtgggcatgggatggaaggctgtaggcatatggcgatgtgagtgcacgctcgtcccaccctcaccaccccagcctggctggctcccacagcccgctcagcactggctgctctcctgtcctccagcccgtgtctcgggccaatgccactaattgttttctccactggccaactggtgggaatgagaggccataaaggaagcaaacagcacatgccgtgcatccagcaattttactgctggcagtttgatgcagaaaaaataaaacagggacagagctgcagggtcagggaagggaagtctattttcaggtgattttcccttgtcatgtggagcagtcaggactcctctttgtgggcaaatctactgaagcaaggcacaggcattgtcaccatagtccaaacatttatgatgcaagacagggcaggctgggcctggagagaggtagtgacagcatggcagagtctcagcgttggaagggacagtgaaggtcgctctgcccaccatttctcaatcagaagttcccagtctggtatgcccagcgtgtggtcagcctggctcatcctgaaccctcctgggttgcggggctctctgcctcctgaagcagc

SEQ ID NO: 38160 - DNA, 1920 bp, Bovine  19866880591108
ggattttccaggcaagagtactagagtggggtgccagtgccttctccgataggtctctgcagagctgtagaattcagccttctctagtgcatcaccccagccactccaccctcctgtgcagcattcactgaccaggtatcttgccacagcagcggctccactccggccccctttccccctcccacccacaggtcactgtccctctcactgccactgaagcagctagctgtctgccaaggaggggtggggttgactgcaagcaccgtccttctcttccaaatccagagaacttgggaatatctcaggttcaacttgaaaaagaatgctgtgccccctgcgcccccctcttcccaaccagtggccaggctcctactgcccagtgtccaggagaggcggagagcttcttaccatgtttgagtcctttttagtccaggtgagggtgaggggggggattcccaacccagacacaggtgagggtcacatcagagccaatgtctgtggtcgtgggtttagggtcaactacaatccgaggggcaactgaggtagaaagggagaaacagatcatcagggtcctgatctcatcggggcggggaggggaggggcaattccaatcttcctcctgccttgtctcctcagccccacagccttccccatcccaccccaggtcccttaaagcccttgcccctgcagctactcacagtggacattgactaaagtgctgacattggtgctccccactttgttgtgaacctcacaggacacgggctccgtgaagaaggaataatcgacattggtttcatagcgactctcatgggcatcttcaatcaggaagccccccttggcccacctggaggaggcaacacagagcagggtcaggccttggagctctctcccccacatccagaggcctgtcttccccagtcccccactccggatctcaagggcctcccagtatccctccccagggtgtgcccctgccccgcccctcccctcctacctgtagcccaggatctccgggttggccgtggcctgacacgtaaagatgacgcgctcaccctcctgcaccgtctggggctcaatagacagggtcactgtaggagggtctgcaaagcagaggacggcaggtcagggtcttttctgtccctcaaatttctttttctctgtctagcacatacactgagacctcacccatgtggtgatctgggaatttgagtttgcagtgtaccagctccagtaaataagctttcctcacctttattccaggagcctctaggggccggctagggtgaggaccaaggatgataccaaagggacaaattaatcagacggtgtagtgaccaactgtgaccactaggcgtcagtgtgggttcgctaggctcactagccaggatgggggtggggcgtttctccagttgctgcccacacttccactcttctgggcagtgggaatttattgagcacttacccagtagcatactccatgtgagatgctcttacactatatctcacttaacgctcacaaccctgagaagcaggtataggtcatcacaatcccttatctgaaacccctggaatgagatgtgtttcagaatttggaatttttcaaatgttagaaaggttatggtgaccacagaccatttattgtgtaagacccccagaagaatctgggcaacatcccatagaaacacattaatatatctgctgtgaaatatatggctattccaactgagttattaaataaaagactacaaaaagcttccgttcaggttttgccacccaatcacttttggtttggaatttccgataaggagctgtaggcctgcattttattttctgcacatattcagaattagaaactacggctcagagagattacgtcattgcccaaagtcacacggtttaaacccgggaacgccggct

SEQ ID NO: 38161 - DNA, 810 bp, Bovine  19866880605110
tttgcatgtaacatcagtgtgacttagagcaaatttcaagccctctatgtcccagcgtctgtgccaggaaatcaaaaacgcggccctgcaaattcagtctaatgatggggacaacaatgaacatatgatgtgaccgaacccatgctagagggatagttatctcagctagagaaactgcaggccttcctcttggatccagaaggtccagcatgaatgtggggggaggaccctcagctgcccttcgcttccccagctttcccatcccagcttccccatctgtgtactcgcgtgagatcataagtcacagtaccataaaccactccagagtgtgtaataagtgaattatttaccaatgaccctggctaaatgttcagagggataaatgattaagccgcagatctgtcaaaaagttctcataaataagtaattctgtgccgctttaatgggctttgtaaattactcattcatgccatttcgggatcactctgtggggtaaattcctcacacgtactgatttactgcttcagtctggataggatgggacaaattctgctagccagctgggtagatccccaggtgccaggccacctggcagagtccccagagatgaggacatcttccggtgttacctcacaggaatgtggggtcagagataggctagacttcttggctacctggagtttcaggataactgcagtgcccagggttcttttcctacaaacattcgcccagcgagaatgtccttaacacccaccatgtcccaggctctgtgccaggaaaccaaaaatgtagaagtgtgccctgcaagct

SEQ ID NO: 38162 - DNA, 1002 bp, Bovine  19866880647085
taaagaggaggataaacagaatttaggagggcaccctagactacagtttagtgacttagggttccttaagtagtttgagtaatcacttcttcctcttttctaggaaacagttctaaatccaaacatctcaccctctagcttcttattatgtgtttcaaaaggttgataaagagtagaaaactcaaatacaggtgttgatacaccagaaataggaggggaaaaagagttgggctcaccttgtttttccagttctgccttccctgcttcaaggactcctgccagaaaccgaggacaggtgtcactgagaagcctctgcacaatttctttaataactcggtagtggttgagcaccttacagacattctcagctcgacttcctgcttctggagatgacttccaggaattttcttggaaactcaggaaatctaatccttgatatgctccatttaagaaggtttccaaagccttcccagaatgaattaaacatccaaatgatacctggagctcaaaggggtctgcgggtagataaggaagagagaatcaatatggaaagaattacagggaaggaaagtaaacaacctagagatttaaaggaaggaaaacttgctgggggatcacatggaaggccagaggtgggacaggaaaagggaagtttgtgggaagaaaattttgagataataaaggtattttgaaataattaaggggaagggctagacggaagtctgttagagaaataaaggacattaaccggaagagcagactggggagtggttaggtacaagcagaaccttgtaaacatggaagaaaggagggcagaatcttggttgggaaaggctgactctgaggccagggtgctgggcagaagatcaagaacagacagttattcaaggtctagaacctgatggtatgtttagaggtgtgagagctatgtgtattgggtgggagaatagagtgggagtggtggtaagggtgcagcagaggagggacaggcccaaaaggaga

SEQ ID NO: 38163 - DNA, 2217 bp, Bovine  19866880651230
ttttttaattttattttttaactttacatactgtgttggttttgccatatatcaaaatgaatttaaagaaagttgtgagaggagaaatagaaacatcttggggagagcatgagactaaccttgcctctgcagttctgccttccctgcatcgaggacacccagaagatatcgaggacaggtttctgagagaagtctctcaatgatatcagagatgccttgatactgagtcgtgagtgcacaaaacttctgccccctgctaccgctgtctggtgcaggcacacaagaatgattctggatactcacaaaatccagtcctcctaaagctcctctcaaagagctttctatggcctccccagaatgcagctcacagcctgctgtgacctggatcacaaaggggtctgtgtaaaagaaaactgagacaagttattaaaaagcaaacaggaaagaaagagacgagaaaaaggcataggattttttactttagtggcaacaagttgagaggtgaaattattgacataaaaccaattacagtattcaggacttttcagaaagagcactggggagaggtatgcatattatcagtcatggggttaggctgttttaaggatgtagagggggcaagaggggagaggggcaatgtgtgatggagtcagaagtgcagcattccacggtgtagggaatggttacgtgtagagaagggatcaggcagaagatgcttgacaacatcaattggaggagtaggaagtcaccttaagttcactcaagcacagagtaggaaaaggagattcttccttgaggttttagagaagcaagttacatagatgcaaacaagaaataaccacaagagtggtcatgtacacagaagagagcaagaaacaggaagaatctcagatactggatggaggtatggagtcggggttgaaggctactctggacaagtgtgtacatgcagttggataaagaggagggaaagggaccatcatcagagggagcagtagcctgacacaagagaaagaaaagtcattgagagtctttccagatcagaggactatactcacattccaactggaactcattgactcgatcctgcacttcccgagtgaatccaatgaagtaggctcggaagaggtccaccagctcagtcacctcatcatcactaaagtttcccttggaccagggcttcaggaaaatggcagtgcccgagtcactctcccagccatgaatctgcaagtcatccaaccagcctgagccttgattttgagcccatgtgctattgacaaaggttgaaatctgcatgagatggaaggaggttggcccctggaacactgtagtggtggaaagataagaagaatgagggggaaatgtggaatcaggatagtatgaaaaagaacccagagtctgaacaacaatacagaacttgaaatggtcccctgtccccaaagcttctggctccatccccagcctccagaataggggaaagggctggagacagcagagcccagacccttagtgataggtgcagcatgcttttatccagaacccctatacctgtgctgggagcagccagagttattcttaccatcctcattgtcaccacctgggaggataactccaagtaacagaaatggtagaagcagcatttcactgggaagtagaacttctgactctcagagctggtatttgatctctaatttcagcattttttttttcagtactctaaattgacttcctctcttccccaactgacaaatctttgacccacattgcacatctcagaaaaactgtgcctcccacagctctgaactcccactccatctcatttccattctttggtcttcatctcttttatatttactaccctggaaaagctcccttgtgatgctgaagagttatttcaccttcctcatcctttattgccacatctatttaataagaaggtaatactaaacaattgctcaacttccagtctcttttaatctagaagtattcctttggtttgtccacctatctcattctctcatacagcaaatataacactgtcagtgatgtagcagtaacagagaggtagtgcagggagtcttggagagaataccaaatgggtcagtatgagtggccacagtaccttggtgtacattcacagagagacctcctctgagaacgaagacacaccatagaaagggagattctgagaaccctagccccatttcagggagtcag

SEQ ID NO: 38164 - DNA, 3915 bp, Bovine  19866880661080
gagaagcctctctggttaaaaaggaaatcaagctattccaatacttcagtgggaatgctcactatctccagattccctccaaccctcaagatatttgccttttgaggttgagagttgctagttgccaattccctcctccccccgcttcacattcccttcaaacaaagcttttcagtcaggtttttgaccctgatgaagatttttaactggaatctttttttttgctttccccccttcctctctaattctgaaggatcttttgtcttttgagcaaaagaactgagagactgggagggctgctgggttttttttttttttttcctcttgcaagtaattgggaaagagttttttttttttaaaaaaaaaaaaaagaagaagaagagaaggtggggggggaaaacaatataaagctattttctttcttaaaataaattattttaatagaaacaaaagagaaagatcttgaaaagtgtgaaaagaactttgaagagaaaaggaccctggaacggtaacagagaaaaggagggagggctggagagaaacatgagaaagagcttaaaagggacttaagcaatgcatgcgcagaaagggggaaggaggaatatgacgagtgattggaggtgctcatttcaggactgtgtactcgctggacagtttctccaactcataggaaacagaaagagccagaaggccactctgaggccataaagagaactctcctctccttgcatactgcgcacttagcagtgcctagcatgtagtaaatgctcaataaatgcagggctgaacaaaacaaattggttatgggtgaccgttttttgttgcttgtgtctgtgctttcttcttcctccaggactcaatgaaaggttgactgggggaaaaaagggccagcctcacatgacagagatcaggttgcgccaagctcataagcagaggtcacgttttgtcaacctctccttgtcttaccctactaccttccctgggcttagtcctcaccctcttctggctgggcgtcaggcatccaatgaaacgctatcagctctccattactcgcatataggcttctcactctggggattatccatggaaaaatcttaatcccaggcaggttgattccttttgccacccagaatgtctcggtcgccagtcttggtgtgagcagggaattagaaactcatttaaatagccatccaagtcaactctaataagcaaagtaaatctgattattatcatcatgagcaccaccatgatgcatcccaaagttaaagaaaaaaaaaagaccaaaaagaaacggtggctgagtgttatctctgtcaaggctctccctctactgggtcaattgggagttaactgtatttacagacagactttaatctgggggactcagctctccacagcctctgctccatcatcatagcacctctaaaaggaagattacagacaacttatattatttgttacttaaaatagtagctgacatttcagtagctgctagcttattgtgtgccaggcactatgttatacgttttatatattttaacttatttcatttattcattacaaaaaagacctgaggcagcacacacagggtcaattgtgtaaacaataaactggaacttccctggtggtccagtggctaagactcagcattcccaatgcagggggcccaggtttgatccctggtcagggaactagatcccacatgccgcaactaagagttcctacactacaactaagatccggtacagccaaataataaataaatattaaaaaaaaaaaaaaaaaaaacagtaaacgaagaggtgacatgagacactgtgcatagatggtggtacttaggcaaacagggaaagagagtaagcactggagaaataaactgaggggcaggtagagttatatattaaatatttgccacaagatcctcagcccctcatcagagatgaactgcaagattagccttgagcttccaagcagcatgtgcagaggaaaaaattcaaaattagtgatgcaatgtacagcacccataaaataaacactaaccggtaccttaggaaagtgccactacagaactctcttctgtggatccccacacaaggctcactgtgatgtgcagaaccatgttctgggtaacgtccctaccatgaataaaataaggaattgcacagggctgccccttagaacgttcctcagtgcgggctgatggcacagtgccagaggctcagctcagtaaaagcagttcttcgaggagcccaaaccgttcagtctcggtttgccactctctgacgggctggcttggtctaaggataaaattgagagtatctggaggaatggactggaggtgggtgataacagtgggtggcaggctgggggaaggctgtcgatataaaacaggactcttgcaacttagctattttggccttcagttcagaactgcattccgagatgagaggaaggaaagaacatcacagtcttctctgatatccaggatttcttgggaggcatctgaaggtagggggaggcagaactcaaaagattatttccctgaggagacggggtaaagggacagccagttgttgtgatgtctagggtgggagtgaggtgaatgagtgagactcctttaaaatacaaaaaaagtactttggcattttctttcttttttatttctgccgagtatacctaaccctcaaaatatcagcttagcttttggccatcttgatgcttgggaagattaagcctgctgggaaaaaaaatcctaaggagcattcagagaggaattagaggtagaattaaacacagttaaacagccccagcaaagctcccagacttcccccctctgaaggaagagcccaggcactccagcatttcagagacccacagggtgacagtcagcacagaggtcagcctgccggtgacatctgcatcccttaacctcgaaagtcctccaagggaataaagtctgcaacttaattgtccatctagcaatttagcgtccacaagttcttctatctgaccaaagcggttttttggctgtttcccctacaaagactgtatttttcctaatagtggaggacagaaatcttgtccagccttggtccagggagctggcactggagtgagaggggcagtccccagttaaagggaataaggttggaaggagggtcggggctccctagctgctgcttggacatcctcttggtgagtgaggacaaggataaaggcaggggaggagaggtagagcaagctggcatctcaggccaagtcccccgacaatgggcaggagtctggaacctgcagcctgttacttaattatctctgaatggtttttgttcctggctttaaacatttacccctattgggttttcacggcttcacaagctctctatctccttttctttgccgttgccatggcaacgacaccaggcgtacaactgctctctgattttaaataaaagttgaggtttctctctctctctcttccctccccgcccctccctccttctctcttaggatggatgaggtttctctcatcccctcccttcctttcaccttcctctctgccctgctctccccccaccagactaggtttccttatcatcacctcattctctcatttcctccttccacctgactctcctctaagccctctcccctgtcattgggcttcctagatggccctaatcccctggttgccatgacagcaagacaaggccctttaggagggatgggggcagaggttgaaggataagggaagttggctggggagggggtggtgtgtggtggggaggtgatttattggtagtcccagaagcagtgttacccaagattctctggggaccaccaccttcctctctggacctcaactcttctagcaattaatgggcaatagattccttatctattccccaccccaccccc

SEQ ID NO: 38165 - DNA, 1188 bp, Bovine  19866880717861
tatttgaaattttgaaaaaaaaaaagtattttgtacatatatacagcagaataatatgggaaacttttaaaaagagtgctgaatgaattacattaataaagaacacatacaatacttctgttgaaattagagttgaactttaatagctacagaaatgcaaattaagataagatctcattttatacaatttaatgtgcaaaattaaaaagctgcagcagcccagtgtttgcagggatctgaaataattgagttgaccaaaatatttttttggtcataataatgtcatggaaagcctgaaagaacattttggccaacccagaaagtgtaaattccaatgaactgatggtgatgaggtaattctggagagtttgctgtagtaacttgtctaatgacattcatattgaccctgaaatcctacttctgattatgagtaatggaaaatatttacccagctccaagaggaaacatatgtaggagatgtttatctcagagtttttatggtagtgaggtgttggaagcatattagatgttcatctctattacgggattctatgtagcaagtagagacaacagactcaacacagagtagtacggggaagatctttaaaagagcgctgaatgaaataatattgatagggtgaagtatatacagtgtaataccatttgtggaaattaaagttgtacatatcaaatatagtacattttataagaatacctaacaggataacatatttatatattagaatgtggggaaagagaaggctatggggataaacagatgaatcaaatatttcacagagaaagactgctggaccaaatgatgtccatgaggccataatggaggagaatgattaactcaacaatctgtacttaagatttcaaaggcaaaacacagcacagaaaaataaacattggaaaatatttaatgaaagagttaggatgatgggttacaccatgagtagtttcttctcagggaaaaatatataatattgtataaagtacttgtatgtctaagaacagaatcaaaatatctgcaatatcaaaacactggttgaaaatgtcaaggtttttgtactcagcaaagctacagttagagaaaagtttctatattttaccaccgggtggcaatagagattaaaacagcttcagcatctagtattcaaaaattagaagttttaggctcagaga

SEQ ID NO: 38166 - DNA, 1891 bp, Bovine  19866880760113
ctcctaaaaactcaccagctggcagagggactacaggattctgggctagacaccttggttactacactcacattttagacgattaattctttaaattatagaggtaatacaaagttgttatgaagcatctgaatagcatgggacaagtacaactgaaaagtcaaggcctcactccatttatctcttctgtttgcagaggtatccactttcattttcttttgtgtttctctagaattcttttgtggttgtagaagaaaagctatatatagagttttattgaatgggctgaacttgaaacaagaaacagcttcttttttctcttagctctgctgctgctatccatcacattatatagaagctctctgacttgcccctggagctgacacaatagctttctgaccactttcaggcatgaaaaaatagtctagtttagctcaatttaaaacttaagtgtcacatccagttcaaagcttctcctttccccaatcattgacttgacctgtggcttggaaacctgcagtgaaaaagagggcattcattctccttccgtctcctcctcctcctagggccagaggaagagcgataaagttcttttcacccagtgactactctttgtagtcctttcttggctgttacggttgctctaccttctccactacggcagaaagttgctgggaggcctgtcccaggggcctcctcactgtccagtctcctgctggctgactccttgtgagcctcacttaggtcatgctcctacaggtataaagcagagcctcttactggtggactcccttcaccccagtgggcaatcttcttggatggaatcgcatcaaagtggttctactatggttactgttcacagcttccactaggctcattggaaattcatcaaaaccagccttgactcattgaatggcggaagtgcagcttgccaaaccactgaccccctctcctcttccttctgtcatgtccagctccagccagtggttcttaggcagcagtcatttgcccagaactctcacacgacctaggtaactctcttaccttggtcctgctgtggtgcacctaggtaagcatatgagaagctgcaattcagtaggttttcagtgaggcagtgagcaaccagcctccctttcctgtaggcacttctgatcttgtgaattattcttccagggtttcacctattggcttgtttgagaggaaaagaaaagcaccataaaactgtactcatatgagcaacctaaacttccctttacgtttctagtcctttctctggctggggtggggaggtgggggagaaggggaaggcgggtggtcagcagctgggtgaaggttgaaggacaagttttgccatgcttccacaagttcagcaagttgggtttggcacttccctttagaatgtagtcttcagctttgggacttgagatgaaatttgaaaacagtccatataatctaattaatcagaggggattattctacgtatattattctactgtttgcttttcctgctaagcagtatacagtatcctgagcatattttcagtcattacatgtagatctacttcttttttcttttcattgcactttatttttcctcacacatttctcttcttttcttctgtcgtgtgtgcaaccatttcataaaccagtatttttagaactgcctagtgtagcaagcaatatttcttcatttttaataaaggttttgcatttttcaactgtcatggaggggcttaagaaaagttggagaatttgaatatgcctgtattccttagggatatttgattttatccaaagtagcacagatctttagaaacagtttattatgtcattgtcatgatgtacaatgatatatttaatcggttctctgctggtgcacatttaactgttt

SEQ ID NO: 38167 - DNA, 3232 bp, Bovine  19866880783531
tagcaagaggaagaatggaagttttttgaccctaagtctttcccaccagaacttgtttccttcatacttggcatggacttagtgcaacatctctgacgcctgggcctccataatcacagggaagaaaaagaaaaagcaaaaagtcaactcactcctatttaaagactcaaatcaggagttatctcttctgggaagacctccactcctatgacaaataagtgatccttgcttgtcatcccgaagcaccccctaatacactcccctccatttgtgcctctgccatttttattacacccagcacagcttaccaaagtatcaacacttgaaaaaggaattgtggtgccagccattaaaaaaaaaaaacaaaacttcttactttccataatatggtgccctccagctaatagccaaactctttccttccattctcagctaagtttctggaaatccaaggctggtactttcctgcttttatcacttgaccctctgaacacactacagtctatcttctgatcctgccaaatggatcttgctctagtcatcagatccaatggtcacttttcagttattttcttctgttatagtgtcactttaaaagttttgtttatttggctaccctgggtcttatctgcagcatttgggatctagtgccctgaccagggatcaaaccccagcgcattgcattgagaatgcacagtcttagcaactgggccatcagggcagtccctaggatcatttttttctacgtggctgccttggatcttagttgcagctcctgagttcttccttgtgtcatgtgggattttttcatgccactctccagttgtggcttacagactcagtggtcgcagcacttgggctcagttgcttcaaggcatgtgggatcttagttccccaaccagggattgaatccactcctgcatagcaaggtggatccttaactactggactaccagggaaatcccactagaatcattttttttaaacaaaaattcatcatgattttcatacaaatacaaaattaaatgtgtccaaaactgtatttaatcattaatgagagatacagttagatgtttcaactgctttaaaggaaaattcaaaatatcacacttagataggtcaaccaggacttctgaaatgaatttttgtccacgaggcactaatcaattgcactctaccatacacaacttgtttgcatttcgatggacaagaatcatttgaattattagctttccacaacttagaggggataaaacagcaaatagacagtgaagaacagagataagcttgataggggaagttaggcaggacatccatctgtctttttttctcccttttaaagcctttcccagtacctccttggcctgtctactaacgaccatgcctaaaactctcccttttgctctgcggtgtcacctcaaattctcctacacctgactactctttctcagcagaagtaggctcttcctctatctgtcccttaaatgcaggtagtatccagtgtattgtcttggacactcttctccctctactcaggcttttgaagttaatctcatctattcttttgtctttaagtcagtagagttacactgatgactctcaactttctatctccagcatagcttccttcagagttgcaggccctacattgtaaaaatattttcccagaacctcaaatacaacatgctttacctataaatccaccttttcttccttggataaagtcacctgttatccgcttcgtgtcgtgaagtcgtgaagtcactcagtcgtgtccgactctttgtgaccgcatggactgtagtccaccaggctcctccatccatggaattttctaggcaagagtactggagtgggttgccatttttatccacttacttaatctaaaaccttgggaagcaagcttatttttcccccttccttctgcctcatatccaatcagtcaccaagacctgcagatcccgcttccttgctggttctgagtcttgctccccattcccattatgcttgccttggttcaggctttcttcacttgtctgaattaatatgggagacttccatctgatctttctgtctccagcctgattccatctaatccatatttgacttggttgctaaagaatcgtctaaaatgcaaatctgatgtgatactcttgtccctgaagtcatcccatgcacagctccctgttaaggtcagaacaaaattaagcccattaacaagtcagtcgagggctccatgaactggccctctctgttgagcctcatgtctggttcagtccatttctagggttttagaagaacacttgtgagtctacttagagttccccatcatgtgggccatgtcatttcctgcctcctttaaatgggttctctccttgaaagagagagagagaactctcttgttcatcccccttcgccttttctaagctaagccctgggctttgcctcctgcctggagattttctcacctcctgcactgtcttgatgtgggttcctcatggtgctcttttcctgcccctatctctggacccagagccacagacaggtttgtgattgttggcctatctcaggaaaaactctggcttccctgcttttttctttctatgcacttggcacattggcttgtcactgtttatttgagtggcttcctcatgagaccgggagctccttgcaggcaaggactaggctccatatgcacccctttccccactcaatgtcttcttcctacacagtttctgaggatggctaatctcctctgaggaggtttcgaaatcatgtaactcacactgggacttgaatccacagtcttttaactgagatcacacacctcatctcaggacctgttgaaactcaggttcttgatgtctcatcccagaaagagttcattgagagacaagtgataggtaagaagtcaatctgtgtagagagagtcatttcaaaaggtgagaggcccccaaatgcaggagacataagagctacggatttgatccctgtgttggaaagatcccctggaggagggcatgacaactcactccaatgttcttgcctggagaatcccatggacggaaaagcctggtgggctacagtccatagggtcgcaaagagtcagacatgactgaaatgacttagcacacacacaatttcataggctaataataggtaggaggattattccaactatttcaaggaaggggcagagatttccaggaattgggccactgctcatgttttg

SEQ ID NO: 38168 - DNA, 1559 bp, Bovine  19866880795150
cccaagggaacccagcaaataagcggcacaaagctggaatctgaacccaggcaccctggtatctcaaccacatcagtggagagtagtaccagtaagagccaccatttgctagacatcttcagtgtaacaggttctttgaacatgcatgctgtttcatcttcatgagaatactatgaagttagtatgattatccacactttacttttgagaaaactgaggatcagagagattaatctatgaagatcatgcaatgaataagtggtggaagtgggtggggactcccctgtcagtccccttcccatcactcctgctgtcctgagtttatctggaaatgaggaaggaggaagatcactaagggctgtggtcattagcaaaggctaatgagtgtagaggaagtgcaagttggaattttcacagcattcaggagcagggtgatcctacctgagggccttcagcatgtaccctccctgataaaaaaaaatacttctctacctaaacatcccaccagctccgcccgccataatgctcagcaggtggtaccagcctcccctccaggccctcacccttctgcacctgcagaggagtgtatcttcaagtcccataaaaagtgcccctgtccaacatcccagccccatcctcctcccatcatgccctcacctgtcgtcctgtgttcacacaggaatcccggtgtctggagtgcttctggagacacagccccagagggaccaggtggttaaaggggagacgctcgtccttgtctgctctgtggccaaaggcaccgggaaaaccaggttctcttggcacagagaaggcacaagagagagtctggggcagaaaagtcagcgctcccagagagcagagctggagatccccgttatccgggagagccatgccgggcgctactactgcacagctgacaacggctacggcctcatccagagcgaggcagtgaacgtcactgtgagaagtaagtagctagttctcctaattagccggagagtcccaactgcaattggtttccttctgtgacagtgaggatgttccaaggataagaatcagggccgtgaagaggttaggaaaccattaacatgctaggattgttattgcaacgatggtggcagcggtagcagtgacaacaggggcagaagagccgaaggacgatggcaaggggagacaggaagaaggctatgaggctcggtcagacgtatggtctccagaattcctccccggaaattgtcaaagcgccatagggaaccgtctctgcagcgttagatcagaaggtgccatagtgggaagaaaccccagggcttgagaggtactgtgtggataccgtgagaatagagagagtgggttataagtctgggcccgcacaagagaccttctctgatgaaccgccctttatcagttccagtgtcacgtcctgtcctcaccttcagtgttcctggggcccaggccttgactggggatgtggtggagcttcgctgtgaggacaagagagcatctccccccattctgtaccggttttatcatgaaaatgttcccctggggcacactcggcg

SEQ ID NO: 38169 - DNA, 1094 bp, Bovine  19866880826183
cctggtgggctgccatctatgaggtcacacagagtcagacaccattgaagcgacttagcagcagcagcagcagcagcaagagtctgaactgctgcagaagcttttggagaaagtaagctcttgcccactatatgtccatatgcctgagcttgtagctaaattaatatgtaggtattagtggggagatatgagatgcttctgtgcatccagttaagagaaattggtttggagactgaacatgcagggcctgaaaaaataatttgggaacataaaagtgttagtctctcagtcatgtccaactctttgtgatcccatggcctgtaaccagccaggctcctctgtccatggaattttccaggcaagtatactggagtaggttgccatttcctactccagggtatcttcctgacccagggctgaaaactgggtcttctgcactgtaggcatattctttaccatctgagccaccagggacttttgggaaaataaattcatttggtaaaagtgggggaaggtgttgagctatcttaggggcctagttgagtgagggctgaatgaggactgaagcccacagacagatggttctttgagaagggaaacaagatgaccattaggttgatggtgtaggaaacagggagatccatgaaaatctctgaaaggagttggcatgacaaggatctgggtcaaggatgggtcactagcaggaatccagaacttaccaatgacagagaggttaatggtctcactgctctgagggccaaagccattgtcagctgtgcagtagtagttcccagaatgctctgcagccacagagaagctataggaccttgttctccatgaagtagcttctatccttgtgagcaacacatcttcatgaaaaaactggtaccagatgggcgaagaccctctctgaacttcacactgaagtctcacctcatttcccacaagagtccaggttccaggagggctgagggtgaggacaggttgagacacgggcactgagggagagaaaaacttagtcgacagttgcttctgccactgcctggaactgttaatcagtgactagtgaaatactccagtcttatgtccaccgg

SEQ ID NO: 38170 - DNA, 1748 bp, Bovine  19866880827968
cattgcaaagcaagttgaaatgacttctgggattatctgcactgctgctgctctccatttgtgcagaaaattgagagaggagcccatatctaagggatttggtttgtgcatgttgcctttggtttcataccagggtcgtgtcctaagcctggtctctttccacacacccttggaactggataacccctcaagtgccctgggacctcctgaccagagggccaatgggaaagccagagaggctgccacccgcgtgagcaggaccaggtcatgtcactggagcctcagttttctcatctataaaatggagacaataagacctacgttagaaggttgctgtgaggactgaatgaaggaatcgatgttaaggaacagtatttggaacacagttggttttcagtaaatcatattgcacagtgcctgctgtttttttacagctcatagtccaaggcagatcagtaggatgagtgaagaacaaataatggtgcaaatacagataagtctatgtgaaccatgccagtgatgttggtaatccctgaatttatggtctctggagtgccgtgtggcgggagctttgagatggcagcaaatagaaagcaccctgctttagaattaggtctaatcctggctctgaagattcagcaggctcttcatctttgtgagccttagtttcctcatctgttaaatggagtgatagcaaccatttacctctactttaagccctgggaaagcactccttgggcaatgcacagtaagcaggaccagaaggtttaggtttaaatccctctctctccacaaggtttcaactcaggatgttagaacagtgattctcaaacttgaacatgcttgtgaagcacctggggaatctggttaaaaagtgcagattctgattcagaagatctggggtcagacgggatttctgtgttggcaccaggctcccaggtgatgccaatgctgcttgtccttggaccacactctgaagtgttagaggatgtgtttcctctagggaaatagagcttcagcgttctaatgggaagcaagaaaaaatagaattcatttacctgaattcacttttcagctggcttggttgtgtaacggagcctggatgggtcattgattcaggaccatcgatgtgtttgttttagagaagcaggttgtgcgacaggagaaggggcagtgcatgctggcctgcccatcttcggccccaagactaacctgcccagccttatccccagcacctcccacgctcccagccacctctactgtaccccaccaagtgttcactcatgccaacagttgccggctgcagagttgaaaagcaactagccagtatgttggtggagacatgcctccatgcgcgagccagtcagtcctctcctttctttttttaaatgaaaagagtaactcctcataacccagctctcaattggtggggttttgaggggaaaaacatgttgactgagctgctagccagggcctaggctttgttggctttggcttgaaggtatgatcatgagcaaagtgagatctgggaaggaaggtggattgtagacctacttggggtcatggttttcagggaggaatggaggaccacccctgggcagatcattttctcacactcatgtagacctaatggtttgtcaggcaacgtgatgagctaactcactctctcccttccttcgtgatctgggtgcagagcctcaggctgtcgaggcaggtccacaggccagagaagagcacctctgccctca

SEQ ID NO: 38171 - DNA, 703 bp, Bovine  19866880916867
ctgggtcgtcccagtgcaccagccctaagcacccagtatcgtgcatcgagcccaggctggcgaataatggaattaaatgggcttaaaggaatttacttggtatactttctcatagatattttaatttgaagatttaactagagtgactccccaaagctggagaaattaggattttttagatcacaaatgcaatgtagagatcacatttaaggctgattataaccatgggaaaaatacgggggaattagcccaaagtcagataaaagtctccacttacagaaaagtcttactacaaagctccccacattaatgaactgatagttaattacacggtaccaaagtgagtttgcctgctcttcttgaagtggtgggttaaaataagtgtcccaacagatgaatagctgtcactgaatgtgtctgtctacatcaggtactgagcttttgattcagaatggagtgaaactaggctacatagaatttactgaggaatttccttttagacaccattaaaagctgtaaactgaatcttgtgaatgttcatatttcaccactagatgtcactgggagataaacagttactgaccagactggtgtattgtaagttttcctacgaaaaaaattgattgatcttgtgaatatattttttgtttgctcagaaaaatcagatcgtgtcagacccttcttatgcttcacatcttctcag

SEQ ID NO: 38172 - DNA, 1407 bp, Bovine  19866880944637
agtcagttgtgcatttaatgtcttgaacacttttaaattacttctcttcccatatcgttttggtagaattatttcctacagcaaaccactttttgatcttggctgtcctggtcagaattttgtgcactatactataacatctttggtcgtggtagtccagttttcctagtaacttggttaatgtgctgtgaacgattgacagtttgggtatgtagtgtatatgatattaaattgtgaatcagtgggacttatgatgtaacaacgtatcaatatttgaagatattggtacttgatttcctgttaaggaaagtttgctccaaattttaagctggaaagtcactggaataactgttaagaatcacaactacatgatattttagatttctggtacatatgtgaagaattgtgtacaaattgaaatgtctgtgtagtgatcctcaaaacaaccaataaaatctcagttagaaaaaaaaaaagagtttgcctctttatgttctaggtatttgggatacatcagtgaacaaaataaagatctttgtataagtggaggacatcgctgctggttgacccaagagctagacctcgacaattgaaagcgccttacttcctgccctgtacttggaatattttgggttgaccaaaaagcttgtttaggtttttgtaacattttacagaaaaatctgaacaaactttttggccaccccaatatgttctacccacaccatcccatagttaaggccatttcaaagatgaagccttaaaaatgtaaggttttttaagaccatctgtctgaattgtgtatgtggctgaaccccattaaacctctatgtaaactttgaaagttctggtactgtgagttgacattgggttagaattccttatcacctgactcgcataagcacctgctcagactggtatactgtagagtggtgttattggttataaggaattaatgttagctcagcatttgtggccaacattccccaaagatttgggggtatttttcaggtaaatggcttgcagcccacttgagcaaagtcatgaaattgaaaggttttgatactagagtattctggcttatataaagtatttgtttgtaaaattcatatttttctgtctttgtaataagagtcactcaaaactctaaattttatccttggaaaccccatggtctatatgtcagagttaggcatctctgagcatcaggccactgattactatatcagatcagatcagccgctcagtcgtgtccgactctttgcaagcccacaaatcacagcacgccaggcctccctgtccatcaccaactcccggagttcactcagacttacgtccatcgagtcagtgatgccatccagccatctcgtcctctgtcgtccccttttcctctgccccaatccctcccag

SEQ ID NO: 38173 - DNA, 1231 bp, Bovine  19866881256297
tcgtataagtaggatattctgataactttccttggcatcttcatctttagagctgacctttccagctgaatcatctcagagctgtgtcttcacttctagagtagacagttgagatatgctggggtggaaaaaagatagaagaagaactggaaggagagggaatgtggggtgataggtagtagtgggagagaaaaacagtcaggaaatgaaactcacctggtcctctagagatgttctgaaggtattggctgaggagaaaaagaaaaccacaggggatgaatgtttggatccacctccaaacccagtcttctagcttatttcccagaatctgggagtcattgggctgtctgcattgattctcattttctcttctctgccacctaacacctcctacaacacacatgatcttgttttaccatttctttacccaaccctctggatgttctttgcaagctccattgatctataaagttctccctcaataccacaaagagaaacctcactccctttctttacagatgctaagagataatttctctcttagtttcaattattgcctctcttaatttacagcacctccatctcaccaatcgcaaagtccaacccctgctttttctgcaagttcacactagaatcctttaaatgtattccctgagggaaaaactgtcttatattatcatgttctggttttgatttgattgccaaagtttcttggaggtggaaccacagtaagagaaaactttcagttcagttcagttcagtcactcagtcgtgtccgactctttgcgaccccatgaatcgcagcacgccaggcctccctgtccagcaccaattcccgcagttcactcagactcacatccatcgagtcagtgatgccatccagccatcctctggcgtccccttctcctcctgcccccaatccctcccagcatcagagtcttttccaatgagtcaactcttcgcatgaggtggccaaagtactggagtttcagcttcagcatcattccttccaaagaaatcccagggctgatctccttcagaatggactggttggatctccttggatgccacaaaacatcagagttaacatatagtgttgacagtgctttcctgaagtcagatctcaagagaatccaggttatattaatacagtaaaaatgcttaacaagttagtcaactattccctagataggaagcttattcacttagacggattaggcattctcactac

SEQ ID NO: 38174 - DNA, 959 bp, Bovine  19866881286964
cgccttagcagcagcagcagagtctcttctcatccccaccctggccccaagcctaaagattaggctacctgggaagtaccacagtccactgggcagtccaggacggtgtgtgtgcatatgcacatggagtggaggagaaagaaaggaataaggaggaaggaatatgaaggcaaaggaagcaggaggaaaagtatctgctgtcaaaggcatggcgctggaagccaagggaaccttcctgcatatcattttgtattacgggagacaccctactgtttgtttcccatcaccgtcttcaattccctccacagtcaggagacctgaagcacagaactggcttgttgattggtttgagtttaatccatttgtgtaatatccctgttcagaatgatatctaattaacacttttgttggggggaataaaacctcccataatcattagtgaacgggggaggggaggggaagctttcccaggcagcagccttgcgtctaccaggctgtttgcggctccatcttacagatgtctcaactgagacatgtcttaagagtgggattatcactcattctggaccaggacaagcagatggagctgaaatttgatgatgggatgctgagagctacatgagtcagcactcacacctagttctaaggacctcgattctgagtgccaactccatagggggcagaatagctagacagcctccaccaagcagaacgggcactttccaagtcagtgggtgaagttccaagtatgactctactttctggttgcggcagttcctccaggccttgcaaggagaaataatacttagatttgtgtataatttcagtttgcaaaatgactttaaagtgtcagtagccaactcactgggagcagagaataccaacctcatttaatagttgaggagagtgaagctcagagaaattaacagacttgtctaaggtcactaaggcatacatag

SEQ ID NO: 38175 - DNA, 536 bp, Bovine  19866881378599
gctaggtttggggttggtatctctgtcaacagtcacaggtttctttattgctttggtggccaccaacctcatatgtggcatgcatttttgtggcccaaacagggtcaaccactatttctgtgacatggcaccagttattaaattagcctgcacagacactcatgtaaaagaactagctctgttcagcctcagcatcctggtaatcatgatgccttttctgctaattctcgtatcctatggcttcattgttaacaccatcctgaagatcccctcggctgagggcaagaggaaagcatttgccacctgtgcctcacacctcactgtggtctttgtccactatggctgtgcctccatcatataccttcggcccaaatccaagtctgcttcagacaaagaccagttggtggcagtgacctacacagtggttactcccctacttaatcctcttgtctacagtctcaggaacaaggaggtaaagactgcactgaaaagagttctgggaatgcctgtggcaaccaagtaacctaatgaaaaat

SEQ ID NO: 38176 - DNA, 768 bp, Bovine  19866881384499
cccttgcttttgaaagttccagagacagacatgctgtctgggagcagagctaagaccttcagcctataaaaggacattgaccaagggcacagatcaaataagtcagtacataatgacatacaggcaaaggggaaaagggggagaggagggcagggaggggcagattggaaggggaaggaaaaattgctgaggcaaagtgtggctcctgactcctctcctgtgatgggggaaagcaaaaaaaaaaaaaaaaaaagaaggagcagagttactctgggacagttgcagaagaacaggatggatttaggaaggaattaactctatatgtcctgtgttattatggctacaatttaaggtgggccaaggaaaggaggcggagcattttggaagggactctttaggtgattgggagggactgagggagtcgatggcaatggggatgactctcggggtgacgttcctgtggtacagagacgtcctagactgagctccacgtggcccccttagagcgagctcttcactcagggtacttcatatgggtggaggaaggcaggagtggaaactccaggcctaattgctaggtctctctcagctcttccagggagcacagggcaggaaattcctcaaattccaggcttgtaggatcattgctgagcgtaaccgcagagcaagggaaagaggcagagaggcagagagggcgtcctctccatcttttttcctccccagttttaaagcagcagcaaattagaaagggtttagcggggctgatag

SEQ ID NO: 38177 - DNA, 789 bp, Bovine  19866881391525
tggtgttgaaagtatgtaattatgagcagaatttatatgtcgccagggctgcctgggcaccctcccttcatctccttccaggcactgcaaatattgaaggctgccttagaaaagaatcaaacccacccacctttatatctttgcaccccgtagataaggttttaattgaaaatcggtttgtctgttccccgtgcctaatgacaagccgtgtgcatggctaatggagcacaccggcaggagcccagcaccctcatggaagaccagggtgggtcctgggatgggggaatggcagtcactttgacatcttctcccctcccacactcactttgggaggtcctctggtttcttactgatgagtaggtgctggtctttgcaggcaggattcctctcatccccctcctccccccccatttcatggcccgtgaatctccaataaggacaggatgcagctcactgcctgcttcctcccttctgcccgggacacgctcctcccaccccccatcctgcccactcgtttcttcccagcccaattgggcgaaacacctccctgtttgtcatcatggctctctttttcacctctgggactgctgggagacctctcaccctacccaggacactcgtcccaaactcctcattgcactccttcccccacctgccctgggccctcttgttccatgaagcccctgtagtgatgacttagggcctgtcgtccttctagatctgcccctgtgtgtccatcctgagtacttgcctcatccattggactggagcatcctgcaccctctgtaa

SEQ ID NO: 38178 - DNA, 1178 bp, Bovine  19866881676117
tgtattgctggtaaagtttctagatttctgtttgtataaaacaatggatttcaaagtatacactatagaactctggggaagccaagatactttcagaggattcataaaactcttttcataaaaatactaagatcttatttgcattttctactttactgacatttgcacaggtgttgaaaagcagtgttggttaaaacttctggctccttaggaatgttttgatgaagcagtaaaaattactaatttgattgtattttaacacttgaaaacatgttttttattattttttttcaaagaagggaaaatatgcataaagcattttacatactaaaaagtacataggttgtccagggccggcggaggaagggaagcattcatccaatagtttgaaactgagatgaataaactacttttcatggaacacttcttttttataagaacaactgtcaggcaacctatcattatttaaatttaggggacttggcagaaaatttatcttcaacaaaaatgtaaacctgccacttcaaggaaaacagtcagtgatgttctgataaatgtttaacaactagccctcaggggacaaagaaagttcccaatttgtagattaatagccaatttctgtggtgtaaatactcccagtgtggttgattataactactgacttgatgtcactgaacacagtgttaagaataggtaattgggtctcaaaccattgcaaactaactattgcacactagagaaatggtgccagtgatacaattagagattctaagtggaaattgggcttccctggtggctcagacggtagagaatctgcctgcaaagaaggaggcccagggttcagtccctggtttgggaagattccctggagaagggaatggttatccactccagtattcttgcttggagaattccatggacagaggagcctggcaggcttgagcctaatagcttaaggcatgagcctaacagcttcccaatagataaagacttttctggaaagattgttagagatattaacaaatataatttttatattgtgtaatgaaatgtgtcaacatttagaaggtctaaataactcactgatccaatattttccaaacgaccaatgtatgctattaccacatcttacctggataaaagatttattcaaacttaaagatagacaaatcacttta

SEQ ID NO: 38179 - DNA, 1581 bp, Bovine  19866880385797
acatatcttcaacatttagggattaaaaaatagaccagtaaaaagaaaaaaataataatatatacctgtagaacaagcaaaagaagcacgaactttgtccttgcagtttaaaggaaacacaggtcaccatgaaaactctaaagagaacatgaccatttaagatttgtcacttccttccaaaaatgatttaaggtattaatagaacaaagactccagaagtaagatgataaaaatggaaataaaaacagatctctagaactatgggatcacatcatgatgggtgatgtttaccatcaagtaatctaacaggaagaagtgaaaacctggagtcaccaggttttaagaaagcactgtggagtaagtgaggaagaattatttcctaaatcccgaatagagaatattctacgaagaaatcaggaggttcctgcttcccggcacatactacaagattccagtagtatgtaaacacagtcaaagaatataaacacgacaaaaagaggcatttccccaacccaactccaacctcaattggtaccaataataaaaataattgctttgagaacgagaatactttttttagtagttttccggcagaggctcttaagtacacatgacctccaattatacatcctacacatcgtagagctccctatgtataaccattcagaccttttcccattatttcctggaattttaaggattcgtttgaaaataagcgcctgcactacttttagtcaagtccaaaagtacaataaacattcctgcccaagacctttttcctccctaaaacaagtgaaacacgagccctccttaaaggcttgaggtattcctaatgtatgtataaaagtccatggacaggccactcatctggaggaaaatgatttaaaatttgccaaagttgccaaatcacatttggagacaaaaaacggaccaattttacttcataagacaaatcattttcaataaacgaacgtgacaccaggaaagtaagtttaatgatccgggcaattattgctggaaagaactttagggacaaagagaatcactcatttagcttatatttatgggacgtctttcttctgagtggctttaattttactaccattacttagcagtaaacagagcactttatagaacttacattatacgtaggaggcgtaaatctaaaggtttacccaagttccttcagaggccaaattaaggaaagccatggtttttcccacctctgagaggaatgaaggggaagaaaggtcaggaccccctcctgtccccttgtttagctaggaaaacaagtgtcccaaatgcgcacaacctggaccgaagctccagtctgcggcagcgtggaggagccaaaagcgatgcgtggagcctagtctgggtccttacctcctggatgcgcttcctggcccgctggagcacttcttcgtagcccttctgccgcagctcgctcaggctttcgtaatactcctccgggtcgtcggtctcggtgaacagtacctgggacaggatcttccagccgcaggtgtccaggccgtggcccaggtaaatctggagctggtaacacagcgtgtcgatttcctg

SEQ ID NO: 38180 - DNA, 2456 bp, Bovine  19866880406908
tgatttatatatttgttatagtgatatatttccttatacttgttgtaaggacatttcttaagcaggataaagagatagcaatttatacttctctagataattttgaaaagagacttgatttggctcatccaaatcacccacaatctcactaagtatcaagaaagcaaaaaaaaaattaaatatatgcttaaaataattatgaactatttgcataaactgtgtattcgcttaaccagttccagtgtgtgactacaactgttattttgagagctagagatactgtttacaagacttgaaactatatgaagttcttttggcatttggagggaatgatgctgaagctgaaactccagtactttggccacctcatgcgaagagttgactcattggaaaagactctgatgctgggagggattgggggcaggaggagaaggggatgacagaggatgagatggctggatggcctcactgactcgatggacgtaagtctgagtgaactccgggaattggtgatggacagggaggcctggtatgctgcgattcatggggtcgcagagtcagacacatctgagcgactgaactgaactgaactgaactgagagcttaccatttaccaggcattgtttccccctgacatctaccagctgatttttgctttagcgactctattttaccagtgagaaaaccaacctgcacacaggagttaaataaggttgtcacactgcaacagactgcagatttaggatacaaactcagtcatctgaccccagtacacactctgttattggactttacttctttaatggttcttcttttttttttctgccaagacacacataacagaatttatatccttggcagactccttgggcatagccagggttgtgctttggtttcgtgcggactcaccaccagaccatcatgttctttatctttcaacaatggcatatgagtaaataaatagggcagagtgctgttgcttgaggcgaatcctgcatataatctatttatttatttttatgttaaaatgtgtttattttttttaaaaacttcaagctttttattttatcctggggtatagctggttaacaatgttgtgacagtttcaagtggacagcgaagggattcagtcatacatatatatgtatccattctcccccaaatcccctcctatccagactggcacataacattgagcagacttccgtgtgctatacagtaggtgcttgttggttatccattttaaacatagcaaaaaggaaatttccacaaactttagccctacaaccctcattaagttatatgtaaaatctcatacaacacatctgctgagatggatgaaacatctattgaaagcccagagtggttgagagtgaaatgcatagagcaagagagatctgggtataattcttgttctgccactaccagctgtgtgaccttgcaagttgcgtaaccaccctgagctttagtctcctcatgtgcacactttatgacgctggtggagaattaatcgacatggcattttaaagcatatagtaggcaagtgatacacgggggctgttgagtccttgtataaccaacaacagagtatgcctctgcccagtggataagattttcataaggaagtaatgtataacatggaagtggaagggaacctcgatgaggaaagaagagttaggcttttcttctatgtctagcatttatctgcagaacccattattacatggcccagctgctatgccttctgagtgtttgtgtctgcttttttataacaactgttaagctgtcaggcattacatcttacagcactctcctgtctttaaatttgctgtttgtaatctgttctaagccaagataaccagattcagttcagtacagctcattaaacatctggggagcactgtgttagttgcctagaagcaggagaacttgctatatttgggacaaaaagtaaaacagctttgactagggtaatgaaaatgagcactggcatatctgtagacagtttgcaaatatctattctttggactagaataacagacaatactgaagtgtaatccctgggctcctctccagactactgaatcagaatctataggagggggttgtatgtgaatatgtttgcttgttggttttcaaattcaacatgtctttcatggattctaatgacaaataataggaatttcataggtaagatacaaaggaggatgaaacacacgtgcaactaagaacagagttgagactttgctttttaacaaggccggtggctcagtggtaaagaatccgcctgcaatgcaggagactcaggtttaatccctgggttgagcgacttcactttcacttttcactttcatgcattggagaaggaaatggcaaccccctccagtgttcttgcctggagaatcctagggacgggggaggcctgttgggctgccgtctatggggtcgcacagagt

SEQ ID NO: 38181 - DNA, 1343 bp, Bovine  19866880410136
aggctccttctaaaccttgaaaaccaggtaaccaaacggagttctgcttgtatctctgggacaagcaccatctaatcaacacctcctcagagtcttttccaagtagaagcaggatgaaggtctaacttatgccctgatgatttgtcagaattatctattgttaattgtttatctggcccctttcagcataaacttgttgggtcatttagtttcagttcagttcagtcactcagtcatgtccgactttttgcgaccccatgaattgcagcacaccaggcctccctgtccatcaccaactcgcggagtttattcaaactcacgtccatcaagtcggcgatgccatccagccatctcatcctctgttgtccccttctcctcctgcccccaatccctcccagcatcagagtcttttccagtgagtcaacacttcacatgaggtggccaaagtattggagtttaagcttcagcattattctttgcaaagaacacccagggctgatctccttcagaatagactggttggatctccttgcagtccaagggactctcaagagtcttctccaacaccacagttcaaaagcatcaattcttcggcactcagctttcttcacagtccaactctcacatccatacatgaccactggaaaaaccatagccttgactagacggacctttgttggcaaagtaatgtctctgctttttaatatggtatccaggttggtcataactttccttccaaggagtaagactctcttaatttcatggttgcagtcaccatctgcagtgattttggagccccaaaaaaactggttaaagttggccaaatcaacttctccttcagtaaaacaggtgtaaaacatcacttgcctcaaaaaatagtatcggggatgaagacaggtaatgtgaagtacccaacacctaaaatagtgccaataaatatttacattcccttgaaacaacactttctggacgccacacactttgttaggcactttttcataatgtcttaaatcttcagtaatcctttaagtatttcccccatttctctgttttaaagaggttaaataactaaacaggtcacagaaatgatgagcactcacctaaacccacatccttctgaccccaaacacaaggtagtctctgtctactgtgtgccttacatggctacttttgaaaacacatgcttctctcagtggtttcaactggaaaagttagaattgagcaattctataaacataataaatttcaaagtgagcactgatttttagattttaatcaactctatcatcatagttaaggtttactatttaaaggaccacaatgatttcaatagttgtccttat

SEQ ID NO: 38182 - DNA, 2347 bp, Bovine  19866880411459
tgctggctaagtagttgtcatctggagtactggaatttcttgcattttgatgtttgctcatgtgactcctttttgctcctagtcctcttcccatgactccctactcatccaattccttgaaagcttctcttgacttaaaccacagatgaaccacccgagactttacccataagagtgagtgggtagaacctcacatgggtgacattaaaccctgattcctccatctgatataaaattatttgccacttatgttcttggtcttttaaaaaaataattattcatttgattttgactgcgctgggtcttcactgctacatgggctctttctctagttgcagcaagtggcagctcctctagttgtggggcacaggtttctcgtcacggtgcttctcttgttgaggagcatgggctctagggcacacagacttcagcagttgcagcttcaggctctagagcacaggctcagtagttgtggctgtgctgtgctgtgcttaatcactcagtcgggtccgactctgcaatcccacagactatagcccaccaggctcctctgtccatggggattctccaggcaagaatattgcagtgggttgccatgccttcttccagaggatcttcccaacccagggatcgaacccaggtctccccctttgcaggaggattctttaccttctgagccacccagtgggcttaattgctctccagctctgcataagattcccagatcagggatcgaacctgtatctcctgcactggcaggtggattcttcaccactgagccaccagggaagcccgtgtttttggttttaaagtatcttcatgtggatatagacaagctaatcctccacaccgagtgactcattggttgcaaaatacaggagccactgtttctccccttcttccccacaagtccctgggtgactgcctctttgtgtgcctctatgataatggcccaagtccttgtacagagatcgttgctaaagggacctaaactaagctgagtctgggaagggatgggtatgccacaccagtgtgcagatatttctcttgcaagattcatattagtgagaataatcatagctcaagataaggtaccaagcacatctgcctgtgtgcttccttgcctctattttcctagagcgagatccttactagctaagagtcataggctattttacagacatgcatctcttgaaactgtggaaactaactagttatcaagtcaggcacatttaatttggatgcttaaactttttttttttttgaggaaaaagatgatagtataaagattatgttgattgtgtgttctgaatagcatagaacactccagctttgaggccttgtgaaatatttggacatgtttcattgctggaaagtaatatgcgttaataacagggtatttatttctatatttgaaagatacggcataatccatgctggtggtgtcgggaaatatctcagtgactggatcctgcacagagaaccaccttttgatctgatagaattggatcccaatcgctatggcaaatggacgacagctgagtacaccgaggccaaagcaagggagtcatatggattcaacaatattggtaaggtgcaaatttactgttgtctgtgaagtgtgttcagaattgacttacagcacctctgactttagatgctttttattctgtgcatcattggggaatggttagggagtctaaaaagcatatgcttctaaaacaaaaaaggaatctatgtgaatatatgcctttaatgtgaggaatgcatcagtgattttaacttttaaatctatttttactttacctttgatgatcattataaatgatggttttggtttcttgaaaatataaatttaatatgtattatatatatgcttatgtattaagcttatatatgtttattttacatatattctgtgtgtttgtgtgtgtgtgtgtgtatatatatatatatatatcttctggattttaagtactgtgtttgccattttctgaatcccttcagaatactttgtagttttggttctgtgctattagagtatgggttttcctttttcagttggttatcctaaagaagaacgatttgctgggaggccaactcagcgagtcagtgggctttatgaaaccctggagtctaagtgttccatggggttccattcaggctgggagcagccacactggttctacaaaccaggccaggaccctgggtacaggtaaatgagtgacttaatctacgcgtggctcagactgcaaagtcaactttgggagtgggatggagggacccagtgaagccccgtatcccccacacggctctacaaaccaggccaggaccccgggtacagcta

SEQ ID NO: 38183 - DNA, 1424 bp, Bovine  19866880468223
ctttgctttgtgtaatttgctgtgactactcaagacagattaggccaatgcaggaaagagttgcaaggattttcactttgcaggttgggcactatgcctggaagagatgaaatttaggtcttcctgttaaatggatacccagctgcctagtcttaagactcaaataaagaatatctactagaaagagaatcatccctaaatatgggccagagaattcaagatttcaaggatagcttcctcagtgtgtgagtgagacactcaaagggacagaagatgaagtgcctccctgagttcagttaaggacacagcccaataaggaaaagctgcggggcttatgattgctttataaaacagtgtgaagagaactgtttggcactcgtttacacatgacaggctcacaataattcatttctttaaatatgaagccccaagtcaccccatctaaaattatgtttcctaccaacattgcttagtaactacacagaggaatgagcactggcctggaggcagcatccacatatctcctgagataatgacaccctctcgcctttacaaaagtcctgctcaagacacttgggttcttgtcccatttctctggcactaattagctccaaggctctcacacagtctcagttcttcacatataaaatgagaaggctgtagttttttaaggctttaaatttccttccagttctaaattctttgatttgttcctgaatctctgccggcggattggagtgttaagtcacctacttggtctccagagtcacaggagcattgtagaggctccctggtctttgagagggttggttcacaggaggaatttactggaaggactgatgctgaagctccaatcctttggccacctgatacgaagggccagctcattagaaaagatcctgatgctgggaaagattgagggcagaaggagaagggggtggcagaggatgagatggttagataacatcaccgacacaatggacatgaatctgagcaaattccaggagatagtgaaggacagggaaacttgagatgctgcagtccatgccattgcaaagagtcagacacaacccagtgaccaaacaacaaccaccagtgaagtgagcagaggagaaacctgttctttccccacaggaacgtaagcagcctccaacctgggctgactgaagggctggggtgggaggaagaagcagacaggacacagccgccatgatggtgagcaggaattttgcccccaggaggcactggccaggtttcccttaaccactgctctaatctcagcaggtctgccactggcttcacaggcctcccctctgcagctgtgcctcacaggactcactcgaagaatatcaagtcttccatggcacattgtcatgtttactgagcagctgtacctgcatttaaagaaaaagaacatgtgtcct

SEQ ID NO: 38184 - DNA, 1130 bp, Bovine  19866880628359
tcttgcatttaaactaaagtcatataccagcttgtacccaaaaaatgctttacatggacaaagatttctactatcatcaccaagctaaaaaccctcaccaaatcctcttcagaatcaactgatgaataaaacagtgatgtgcaaaccaataggaaacagaaaagagaaaacagcatgctcttttgtaagaaagaaaaagggaagggaatcttttggtctagtccaaaagagtttcccatcaaatataaactcctcagcgaggtcctcatgtctaatacttcctgggctggataccactctcaccccaacacccatgacattttctttatgccaccatgtctcccttctcatgccgcacacccaccaacctggtgagtatttcccctgaagggtctagaccaagacacggggttgtccccagagtatgactcctaaatcaggaattgtgtgggagctgatggggccatataaacatcacatgccagccccacaggaaaagggaatctttggcctctgctccagcttctcccattcaaagaagcaaatgaagtcttactgatctttcaaagatgaaggaaatcaaggttagattgcctatctcaggaattatggtattccttttcccgtacccacttaaaacatcaaagtttcactatgactggacaagccagggattacacacaatctaagagtcgtcatgtggatgatagcctgaacggggcagactgttttctgtcagtaactaattgtatgtccggcgaatctaaacttctcttgatcaggggaagggacctctgtgttgggtcaggtgagtgggaagggccatgagttggatgaggttatagagagtttggggagttattttcagagaaacagtttactaaaaaggaagaataaagtctctttaaagaccatgatctctgctgtcatttggcctgggctgcagtcctcctctcagttctgcgcttcttattggcataatcttgggaaggttcccatttaacctgtgtgcctcagtattgtcatcaataaaatgggaatggcaaaatacctacctcttggggttactgtaaagattacacgatgcctatgaagcacttagcacagcaaactccacatagtaagtgctc

SEQ ID NO: 38185 - DNA, 1703 bp, Bovine  19866880730227
tgccagataaaatgaatgactttcccccgctgtattccaatctcaagttgtttgaactgcttttagagttcacatatcatgtgtatactgctgaggaagagtactctttacattgtattccaattcattttagcagtatcagtaatttccttcatcatgagtccataacctgtttttataaaaaaggtgtattggcacacagccatccccatcctttgacttactgtctgtggctgccttagcacttacatcatgaaatgttaattggattgtttagaaagttgactagtgtgacacagactggatagccacccaccctgccccccaaaactgagatatttatctggtcctttacagaaaaagtttgccaactcctgtcctcgatgtttccttaaagggattcctagaacttaacccaaaacttcgcgcataataggtgctctataaatgttgatcaaattgtctaggaagataacaaataggctcaagaataagagaatactacccagacataaaaaagaatgaaatcatgccattgacagcaacatggttggacgtagagattaccacactaagcaaaataagtcagaagggaaagatagataccatatgatatgacttatacgtggaatctaaaatgtgatacagatgaactcacccatgaaacagaaacaagctcgcagacagagaacagacttgtggtggcccaggcagagggaggtgggggagggatggactgcgcgttccgcgttagcaggtacaaactgttacggagagaaaggataaacaacaaggtcaaactggacaacacagggaactacattccgtgtcctgtaataaaccataatggaagagaattaaaaaaaaaaacagtaagagaaaaggccaggaataaaaagaaagccttattttaaaataataacacaaaagccatggggaaaagggagcctgtcttcatgtaaggaaagaacttacattttccccaactttattgagatattattgatgtacaacattatggaagcttaaggtgtataatgggatgatttgatacttgcctatattgcaaactatttcccccaatagggttagttaacacattcttcacctcacataactaccattttgtggctgttatggtgagaacatttaaggaaaatgctcctggtgtttttgaaacagaagaacacaaaggaatgattctctaactgtgggtaaagaagttgggtttggcctttccttcctttgaaaaaggaaaaaattgtgaatttttctgtttcagtagaaaagaaaatctggaattctggaagattagagtaagcattctgtgttgcatgacctacattgggtcaggcttacacctttgagagaccctctagctcatgagtctatgagtaaaggcatgtatgtgtttctatggtacaatcctgggagtttccagtgtaggtccaaggaggggacgggtgagccctgcagtggcagcctgaaaggtctctttgtctttcctttgaatgtttagataagtaatctgaaaattacattaacaaaatgttttgcatgaacctaaaaataactcaggggagcacactcaaagtctttgtggtggttttacatgcgaacgttaattatgcctacatgcaaaattgactggtaaaagattttactgtcaggtaacaaatacctcaaactgtgggcctcgtgtt

SEQ ID NO: 38186 - DNA, 888 bp, Bovine  19866881429528
aactgtgatacaaatcccttggaagctggactggaatcttttgtaaaactaaataaggtatgtttacattccaaagtgtacttgaaataaatcttaaaactatgctgtttcatgacagagccatgctttaaaatttaaccaagtgttactttagggcaaatgagttgaacataaatagtaagcattgcttaagtgcttcatgttaagctttgtcaaaatttgatatcagttcaaatgattctaatgtatgtgcctgttgatgcaagaatccatcaacattgaaaaccaaatctaaattctaagataaaaatcagtaaggataagatgtcagcaggctgtcttgtaaatcctggtgacttgtgaagtcacaattagctgatgagacatactgcattaattgactcttcctgggtgctcagcagcatgaagcagcctcacccagcagatctgtccatctacttattgcgcattgtgctttgcaacatctgtgtgtgagcaactgacacatttcaaatatgttcagcataaaagttattactgaggagacaacacaggcccacagagtcataactgatgctgacattctaaagtgaacctgcatcagtggttctcagatagcatcagtatcatctgggagcttgctggaaatacaaatccttagttccctactaaatgaggaactgactcaaacctcaaacctactaaatgagaatccctagaggtcaagccaagtgttctgtgttttaacaagcttcaggggattccaatgcacctaaagtttgagatgcaccagcctgtacaatcattgtggaaaagcctattatgagaccagtttattacagtctagctcacctattgcaaatcctacaaatataaaccaggttatcc

SEQ ID NO: 38187 - DNA, 2030 bp, Bovine  19866880362991
ttttggtttttagaacttcctggaattttttccccaggaatgtcatctatatgaggttggttgaatctgtggctgtggaaccggtggttgcagaggactggttgtacctttagtcaaaatgggctttttcagaaaggctgattgtgtaagttagatgataaactgatctactcaatagtaaggcaagaatcacctgtttgccagtgtaaaaattccttccaagagtacatatatacctggtgagggtgtaattatgatctctgttttctagatcaggaaaatgaagcttggagtgattaactagatctgttcaagattgatcccacagctggaaaatgagagtgccaaggttcaaatccagggctgacaccaaagcctgtgctcttaactactgtgcttatggtgtgcagcaagaaaatcatgaacaggtgagaagtcacactcctacctataagaaggcacactgcacagctcaacctcccagccttcctgcaacacagcctcccctcccattcaccagcacccagacggaaaggcagaaaggaactggaactgcttctcataaaggctgcccccaactaagacgggcaccaagctaagtctttggcagatatgtttacacagaagaagaatgccaagggccatgcttcctgccctcagaaagcttggtctagtttatacccaaagatcatgtcctccaattgcccacaatatatggtgtgctcagggactgtagtacatgtgcacatatacatcagcgtgtgtagtggatgtaatagtcatgcaaatgcacatgtatatggagagcactgtagatttttctctaaaaatatcctagcagctccactctacttaataatttaatacttcatatagctgagctaaatggactcaacctagctatgagaaaaataaaaatggtttactaaataagagtatacctaagctttaagggttactggttaaactattaaggactctttcaaagtaacctcaagcacttagaaattttccatttacatgtaaaaccaagactaaagaaattgcaaattccttaaggatcatgctaggtaatatgtgatttatgttttttatatatacatatacacacaaatgaaaatataacagtctttgaaaaacactgtatttaagattttaagctagttagtttagtcttctctctacttcttcaaatattgcaagttagtatggatttattacacatgatgaaatttaagaaataatcaaaattctaagaggtaagcaatgatgaaaagtgggagatcagcataatggagataattagttgtcagagcttaattctaagatcatctgccacaatttaaatatgaaatgtggaaataatccaaaacaaataataaaaacaaatatctattttaatcagtgtcttactttcttccattaattatttctatcccattttagctacgatttcacaagggagacaaagtgataaaaagggaccactcctgaaaaattagaaatatcccaggaccagagtgaaaaacataaaaaatttggtctatacggggttcagaacaagcatcccccaaatgggctactcttcagttcagtaactcagtcttgtccaacactttgcagccccatgaattgcagcacgccaggcctccctgtccatcaccaaatcctggcgttcacccaaactgaagtccatcaagtcggtgatgccatccagccatctcctcctctgtcgtccccttctcctcctgtgcccaatccctcccagcatcagggtcttttccaatgagtcaactcttcgcacgaggtggccaaagtactggagtttcagctttagcatcattccttccaaagaactcccagggctgatctcctttagaatggactggttggatctccttgcaatccaagggactctcaagagtcttctccaacaccacagttcaaaagcatcaattcttcagcgctcagccttcttcacagtccaactctcacatccatacatgaccacagggaaaaccatagccttg

SEQ ID NO: 38188 - DNA, 2322 bp, Bovine  19866880389344
tgctggatgacgtgcccgtccgggcttttttggcagtgccggggccacctttaagctgaaggatggtactctggcctatgctcgggtaaggagtctctttgtttcatcaggttctcatcaccagaaggacttcggggacatgggttctttttgcttccttcatccctgagtattagtttcctatttttgaatttccctaaacgtggcagacagttaataaggacttgaataaggtctgtttgttatattagagtaccttgaaattggcttgccttaataccaaattgatgataggaacaaatatgagttgggatctacaccagggcttggcgaaggtgttttaaagggccagatagtaaatattttaaactcatgtaccacatggattctgtcctgattactcatctttgttgtagcctgaaagcaacaaggacagtatgtgaatgaaagggcatggctatgttccaggcaaacttttactcacaaaaataggcatttcattgtgagctatgatttattgacccatgatctagactcttctctaacttcattgagactctgtggtagtaaaaaaatagttttttagttagagcaattattttaacaggtaattagagtgctgtttttatggtaggtgacaaatgttctgagtcatttgcacatctgatttaatgtctggttgtctcagatctgttgcctctgacttgtccttaatcacttggtactctgtagcgcaaccatctctccaattctaagaaaactttcaaacctgaggccttcaagccagggaacactcacaagtgtagaatcatcgactacagccaaatggatgaactggccttgctctctctgcggacgtaagtctgtcgctcacctgtggggtatggaggtgcgcggctgtggtgcgtgctcacggcgttgcctgtccttggtgagggtttcttttcctgccagtgtgattttggtagccctgagttttaggcagcctctgccctaatgtatttaatcttgtatttgccgtttgttctaggtctattattgaagctcagttcctttggtatcatgacatcaaacctggggctttggttaaggtaagacctcaagcatataattagacgctctcccaccttcagacagtctttagttcacaggttaactggcagctcattagtccttagatgaacacatttaaaggcttgctccttccctctgcctgctaactaggatttcttttccttctcttgggtgacttgaaattaatttcacggtaaagtcttgctagcaccatgccactacacagaggcagtagatcatcagtcttgggaattgatggtgtttgttagaccaggtcaaaagttagttctttggtaatttagccacctgggatattagtaaggagtcagttccagttgcctttcctgtctagccacttagccccagtggagcagctccactttatgtagagttcattccttagcagacatagtcctctccattggagatggaactggtaagacagacagaaagatgctcacccaaaaaggtgtgaaagtttcataaataaactcttactgcatccagcccagtgtggggcacgtgcttggcccctatgagatctggaataacaggagaggtgtgagatgctttgttgttaagaattgtaggaaagacattcttgaggcatcatggcatcttttccttggattcttagggcaaagtgctgaccataaagccacacggaatggtggtgaagatgggcaagcagatcaggggcctggtacctaccatgcacctggccgacatccttataaagaatccggagaagaaataccacgttggggatgaggtcaagtgccgggtgagcctcctgaagggttgctggtggggttggccagataggaagagagcagtgcttcgcaggtgaagttctgcctttttccacaaagtgaccacataatgtctgcagtgctgtgcctggcactgggaagagaaaaatgggtccctgcctttgataattgtatggtataattgagagttaaaatatccattcctgaagagtgcaggccacgtggctcggtgcaggctgtatgctgaggtcacatctcagaacggggagatgagggtaggctggggcagcaagcatcattgagaatcagtgatgatcaatagcagctaccatgtaacatgtattctgtgccagttactgagctcggcacatcataacatttcatttcatccttaaaatggccataagaagcaagtgctgttttcctcctctttgcaggtggcgaaataaaggctaggaatgtcaagggtcttgcc

SEQ ID NO: 38189 - DNA, 1010 bp, Bovine  19866880396376
caccagggaaatggactaaaggcaacaggttagccttttacccatccctggaaggccctcaaggaacagtggaaaccaggcttggggagacagttatgtgttcgtgaggctgcaggcatggctttgcagggcaggctctggagtccatacccaccactcaagtctctgtgatctcagatcatttgcccagcctctctgtgtttctatccctgaaaagcaggaatgccggactcctggacagtccaggggcttaccgagatgacacgtgtactgagataacccggccagtgctactggcccattggatgggaggttgtggaacagaatggaacgtggctccttgcacactccacctctgcagatcacagcctggcttttgcagggaggagtcataaggaatttagtctccaggtttccatggcaacaggggttatctgcctcttcttgaggtggtaccggccacctgggccaattcacatctcgtctggcaagagagggcctgagaacagaaccactccagcacgagtacaggtatgagggtcaggaggtgggtttggccccagagttacagttttctcaaccctggcccctctcggcctccaggacctgcaaagagagacctgtgttccgtgcagagcgtagctcagacccaagggtgacccgcgctgatgatctgtcagccaagcgtttgcatccctccctctcaggactgcgcgcaccatccctccctctgaggactgcgtgcaccatcccagaccaccatacacctcccccctccatcctgaaacataaacacgggattgagtaacagcgtattttgactctggggcgactgtggagtggcttatcaaattatcaaagcctgtggatttaattggaattttgcagataaccccagcctctttcaagtgcgctgctgcgggacctctgagcgctcaaggggctggggtgggggactgtggccctttccatcttgcaaggaagacaaggttgcaaaacagcccagctcg

SEQ ID NO: 38190 - DNA, 2110 bp, Bovine  19866880402268
ttttagcattttaagtggcatttagtacattcacaatattgtacagctaccactctatgtagttccagaacattttcatcaccccagaagggaagcctgtgcccgtgaagcagtcagtcctcattactccctcgcctgaatccccggcagccactagtctgctttctgtctttatgcatttgcccacactgggcatttcccttagatggactcatagtacatttgtccttgtgtgtctggctcctttaacttagcctagtgctttcaaggttcgtccatgtcctaatgtgtaccttctttcctttttgtggctgaataacattccactgtgtagatttgccgcattttgttcacgcacgtcccagctgatggctattgagattgttccgctttttggttactgtgaattttgtgctgtgaagatttgtgtttaagtttttgtttgaacacctattttcggttcttttgggtctataccacggagtgagccttccatctttttaaagctggtgcttttgaattggacatttgataaagccactggttgtgacggatgtaggggggatcatccccctccggctttggctgggggttgtacccaccagacatctgttgtcttcaaaggcttttttctgtggtggccgaggctcctggcaggcagaggggggagtatctgaggttgaccgaggagctttgactctttgaggtggaccagagtgagctacaggaacttgtctgtcagactcttaacctcctcactgctctggggtggggttggggggtgcatttgcctaggacaaggtcctagccatttttcagccttcagagccttgctggtactccccctcatctgggtccccagtccaggtattgcagtagctgacccctctgcctctcattcctcctttgatgctgcgaaagggatcctcctaaagtattcctttcatctgcccctctcctatcaatagtcttcagcgtcatgacccagactgccatcatcggaaattcaaggcctccattctttgcttgacccacagatattcccacagcccttgtctgggctcctcacttggctgtcatgacacttgcatgttgggttagctcatctgtccaccccccagccttgcagcagacagagttggcgttgtgaaggggtgggggctgggggcctcctctgccacaccaagacttcagagagctgagttgagacagcccctatgctgaacctggagcatctgtcctgcacaccctgttgggtttttatctagtctgacctttgaactctgtactgttagccatcacagtaacataagagcagccacatgtgttgggtggttattgggtgcctagtgcttctgtgtagattatttctgagtgaggagctatcgttgtcaccattatagatggggaaagagaggctcagagaagttaaatagctaatcccagaccacacagtttgaaactgatggaactgggattcaaacccacgtctctctgattttagagttcactcttgcaaccactatacattttgccaccatagaattcactctgggtgggccctgtcttccattgtgttagagaaactggggagcagtctcctggcctctttcccagaagagggaaagagagtaccatagggttcttgatgctcctttccaacccccgaccccacccctcccacctcctctgcagacccatcagccagtcatcggacactttcaagggaactttatgttcctttgggccagtgtttctcaaagtgaggtttttctctcgccagcatcagcatcaactgaaaacacatctaaaatgcaggttcccagcccccaggccagaccaactgtctcagaacaccttggtgatagaactcccaaacctgcatatttaacaggagccccaggtcattctgcctcattatgcctcagagtctgagaactatcaaggctgtggggcctcagaacacacccattctggtattcttggagttggtgaaatcaggcttcccagaggagaggagcctgaagttggatggagatttggaatggacattcaagggcaccttggtgagggcatggaggcaaaggcacagaagcaggaaaatacaagg

SEQ ID NO: 38191 - DNA, 1953 bp, Bovine  19866880457242
attcattggaaaggaccctgatgctgggaaagattgagggcaggagaagaagggggtgacagaggacgagatggttggatggcatcaccgactactcaatggacatgagtttgagcaaactctgggagacggtgaaggacagaaaagcctggtatgctgcagttcatgggatcgcaaagagctggataggacttagcaactgaacaacaaatgataaaggacacagatgaccagccaaatgaaaagacacttaaagcgaggtctgggagagtctgagtacaaaagtttttgtcccagtgaacttggagtgtattagccacctagcacgtggatgtgttcaccaacctggacgctccctcagctccaaacctttgagatttttatgaaggcttcatcatgtaggcacgattgatcattaactccatttccagcccttctcccttctttaagaaaattggaggcagggatgaaaattccaagcttctaatcctggcttggtctctccagttaggtcatccaggagccatccaggccccaccaagagtctcatcattagaacaaaaaacactcccatctccaaggaaactacaagagtttggggagttccatgccaggaaccagggaaagagaccaatatatgttttgtattacctcactctggatgcacagacacagtgagagagaccaggatggggagtcaggactcaggggctgtcatgctggccctgctgccgacccaactgtgtaattttcagtgcggttctcaaccatccagaggcttgtttttctcttctacaaaatgggagctgtaatgcctgccttgtatttctcaaggttgttttgggactcatataagtaaaggctgtgaatatggtgctgaagcaccagaaaggaatgcatatttgtggcttctcagtccccacccccttctagtcagggccccaagcttccccaccaagtctataccaaggatccttccctccaccctctcctccagaccaagtaggactctacagtacaacaccctagggttgcctccaaggccttgggttagagcagtggggtaaggagaaaccaattttttcttactcagagtcctggtcccccaggtccttcctgggaaagaggaagctgccaagtattaaacattcaggaatccacagtcactcttggaattccagcttagtgagcctgttcaaataatgcttcctgctaaactaacagtgatagcagaagaatgctaggagacattccatccctctggttccagacagtcccggcagctcaacttgttatatccgtgtgttatatctggaagaaactttagatctgtggttcttacttctggctgaacattagaatcaccagggaagcttttaaaaaatacccgtgtctggctgttcctcacactaatgaaatcagaatctttgggagagggacctagacatccgtatttttaaagctccccagatgactgcaaggtgcaacctagtttgagaactactactatagaggttccaggtcaaacacctcactttacagaaggaaaaactgccgctgtgggagtttaagatttttgtccctatttaagatagggatagaaaagggtcgttatacaggtagttgcagaagtcccagtaagggactatagagagggaaacctaggaaacgacgggagacgactgtaggttcatgatcgctcaagaatgctattggcacatggtagaatgaagcaggctcacccataaagccataaagaaaaccacgagatatgccccaggttattaggtgaaagaaaaatatcaccacccttctactgatttaaaaaggactatgacagtcctagtttgatctcatcgggtcagacaacctcctgaccaatataaaggaggagctagtgaagtaagtttgacatctacttaagaaggcggtctttacccctcccccactttc

SEQ ID NO: 38192 - DNA, 2942 bp, Bovine  19866880489339
catcgcagatttggggcttggtcctgggagctacatttttaggaattgggcatagacccattcatttctctgcctttcattttttttccttaagcccttagactgtggatccagccccaggggaagaaggatgtgcagctgcagtatggacagggtcttctcaggccagtcccactgtagaattactggtgttgggcagttcagggtttgaatcttggctctgactcttcctgggtgagcagcctggagccagccactctgggtctcagtttcctcacctgtaaccttacaaggattttagaaaattgatctgagataatttgggggcaaagcttctacttttagtgtcttacctcgtggcgctagtggtaaagagtccccctgccaatgcaggagacagaagagatgtgggttcactccctgggtcgggaagatcccgtggaggaggacatggtaatccactccagtattcttgcctggagaatcccatggacagaggagcctggcaagctacagtccatagggtcacaaacaattggacacgactgaagtaagtacctggcgcccatcatgggtactcaacatactagcatctgtctggtgctccttatcactgaaacccatgagtacatttagaatctgataggcgaagctgtgagagaagggaagactgaggcaaaaaaggaaggccagctgttcacagtctgatgggaaagtgggctacatgccccgtggaaaacactcaacatacaaaagaagcagataaacaaggagcagctgttcagacctggagggcttcctggagctgtccaagtgttggcttgctggtgtgttgggaaggaacatgtgttgggggagcagagtagagaggtgctgcaggtgagggcaaggtcatataggattccagctccaaagtcagtgccacacacggggtcagcactcttccctgctttcttttgggctccccaggtggctcagagggtcaagaatctgcctgcaatgtaggagacatgggttctatccctgggtcaggaagatcccctagaggagggcatggcaacccactccagtattcttgcctgggaaatcccatggacagaggagcctggtaggctacagttgatagaggtgcagagttggacaccactgaagcgacagagcacacgtacatgttttcttactgtctgtctgtctgtctctctctctcacacacacataagttttttctcctgctccaaggagggaagtgatctaggggtgattcacgggtctgacaaagattcctgctcatggaacaaccgaccacatccttcaaggctgatggaagaaggaacacagtcagccatttatcatggtcctctttagagccagccgagtgagggcttggggggacaaatcgggattggaatcaccatgtgtggtggcaggcagaggggaggcaaagggaagggaaaaataaacctatttgatgtcattggagaccggttccagatccagaaatataagcgccagctgctgcattttccaaagagatattccgaggccagcatgagttaatcgtcggtggaggcagtgaattagaggagtgttgttaggacttctgactttggggtttgcaccacggtccctggaaattgccttctaatttcctcagcctgagtcactgaccagactatttcttggccagaaaaagcctaacaggcaactctgttctcttttgcctctttattaaatgaaataaaacaagtaatagagttatacatacggtagtcacacttactcctcttgagttctcagagtccaggaacaggatcatgggtgaggacagggatcccgggaacaggaaggacaaggggtgtgtgtgggaaatgaggtggagactctggctttggaaacagtttctgagtcagggccagaggtgttctctgccgtggctattgccaacaataacggaagagtccaggagggtgatcagcatttcaggaggcgattcccagggctgcgtgtgacttctcgcctggaccgggttgcttcggctgctgctctgtgtagtggagtcaaggacaggagggagggaagggtggcacactgggccacaaggaggcccccaggagcctccaggtggctcacattagcagcgggtgctgagcagaatccagtgaggacgtcgagatgcagtgagaaggaggagaaccagtatatgagtgcctgctatgtgccaggcagtgcagaagagacctttcagaggggatttcattttaacatcataacctccccatgaagtaggtcagtgtttttatccccactttacaggtgtagaaactgaggcccagaaagtttatgcagctctcactcagagtaattcagtgtcagggctgggatccttactctggcatctgataccggagtctatgagcttgtcactttcttccccattaaagccaggtcaaatgtgaggagtgtgaaaggaaccaaggagtctgggccacacctcctgagagtaagatgtgtgtctggaaggctgtattgttggagagttcctggtctctgctatccccaggccagaatcctgtctctaccacttactcccctgggattcggtgcaagttccttctctctctgtgcctcagtttcctcacctgttaaaaacaaaccaaaccaaacaaacaaacaaaaatgagggggaaataggaactagctcaaagggctgtggtgaagagtaaatgagtcgataaatgtaaagagcttagaacagtagctggcacatattaagtgctgcataggcatttgtactaatattgagacccacttccctgggggctcagatggtaaagaatctgcctacaatgtgggagacctgggttcaattcctggattgggaatatcccctagagaaggaaatggcaacctctccagtattcttgcctgggagaattccatgg

SEQ ID NO: 38193 - DNA, 1303 bp, Bovine  19866880507047
aaaaaggccttgtcttacacttatgccttttaagaatgctaaatgtagattatcttatcaccaggacacaatgctcctgcccaaaagtaaagagtcccttctggtcaatcaacaccacagcaaataaatataaaaaagaaatcttgatcttctaacagtcttgcccaacagatttcctgttgctgcatagttggtggggtcttgctcccctgctggagaggaagagactctcagaccagagaaggggcacagatgtcctgctcgcacgctaggaaataggttctaggaagtccagttttcatttgcccagctgtgtagcacctgcattgcccagtcttccacatgtgccaagtttgatgcagaattaattctctgtcagagtcacttccacagatctgaagagttgccatatctgtgtcacacatctccatttccgtggtgaaaaggacatgatgcttttactcaactttctgatcctagcacgtgctttagccgttcaaggaacttgaaagaatacgtttctcttcttcctttccctcactccattcctgtctttactccttacacttactgtaaaacattagtaaaataagaattaaaagtcacacgaatcccatcaacataacttgtgttttgtggtttctgctgctttaactgagagaagaactgttttggttcagtgaacaattgcaccccctgataattcagaaatcgtatgttctctgttctgtgcatccttgtttagtgtttcattttttttttttttcccctgtcaaagcctcagggttatagtctgcagactgtctggtctgaaacataatgcactaagtgggcagttcatggcaggaaatggggaaatcaaatcaatcaaatgatgaaagacaatgtattccatgcctggataatgatttaactagcttagcttgctgaagatttctgagaatgaactggcagaaggcacatgattaaaaagttcttcaaaacagtaagaatcttttccttctttgaaaatgaggttctgcttctgcagaacccacatgcctaggtagaacatgggcagcagtaatagcatcttcctctagtgtagtgattcttaacctttttttgggattaaaaaggcttctcccccttggagaaagctatgggtcctttccctcaagaaaatacatgcataaaactatacaggtcgagggacctgtgactccttagaactatctactcctggtatacagaaggctatggatgccaagttgagacctcctaatgccaggccaggttccaggatagagactgccaatgaggg

SEQ ID NO: 38194 - DNA, 1130 bp, Bovine  19866880591492
tggttaagaatctcaactatgtacaattttaatgagaccatgttttgtgtgtttcccatcctcattaccaatatatttggatgaccttataccaaaggcttttgtacagatttttttcaccacacctttattttctaagtattgttggagatgatctggttttttccttggaaggcagccgtccttcctctctgttgtctgtttctcagaccagtctggtattcttcataactcatctccttgggaagaaattaattcacaccaaatgccagtcttgcttaaaggtcttctgtaggtgctcaaggaagtatcagggacatgacaggggccaaactcttcctgtgggtgaaggactttataatgtattaacacatcatggaaaactgctcccagtcactggtggtaatgtttcagatgtcgtttttaaaacgaaactgttgccaaacccaggtttgtgtgccgcttgcacagcaagaccaaagaaaccaaaatgttggggtttggagcagagaaaggtttattgtaagggccaaggcaaggagaacaggcatctcaggctcagaaaacctgaactcccttcttggttttcagggaagagttttgaaaagcaatatttggaatgagggctacggggtgtatgcctttcttctgattggttggtggtcaggtaacaggctgctattaccggaatcgcaatcgtcagtctcctggttttgaccagtctgggcactcagcttgtagttaccatcgtcctgggtgggggttcttagtgcctgcagaagaactcaaaggtgtgaatcaggttgttaggtattccccttaagggggaactgggagtctgttttgtttgaggcactattgtttcttgactgcttgggctttgcttctgcatcccccactcccttaattagtaactgcttgaatctgccctttggaactcagggaaggtctaagaggctgaaacctttttttctacaaaaaaaaaaatcgacacagacacagaaatgcttttgtaccctggagagcccctgcagggccctgcttggtttcaaaacttcatggttggtgttcaacccaaccagcttggtttcaaaacttcaggctgaagaagtcattaactaatttcacag

SEQ ID NO: 38195 - DNA, 1173 bp, Bovine  19866880596009
tattcttttgtctttaaaatccagcgcatatctcacccttagagaaccccttagctcagactaggtacattcagtggcagtagtcaatagccactcctgtagtagtgcaggtcagttttgcaattacctaccttaggaggcaaactctaaattcactcttagctgtgtgaatttaaacttaggaactgaacaagattgtaaactcacactagtggctacctctcccatcacactcaaccctagagatggcactgaaattgatagatcagtaaaaactgaaaactctgaggatgtgtgtgtgtgcacatgtgcacgtatgttgataaatagggagtgatggggctaatggggccaacacctcacaggttttcttgttttgggtgcatccttcgccttttaccaatgctgggctttagcctctccctctgggtatataaggtagctgataccttccgggaaatacaaattcatagagaaaagtaatgggatgcagagggaggtgcaactgctagtaaagcaagaaactgaacaacttaaactagatgaaatagattaaatgcatcagatgctacccagttctcgctcatctcctccccactctctgcccttgcccctccctacccatgtttcataatcttacattaagtcaaattccattagttttatatttcagtgttgggatcaccatgaacgtcatgaaaaatagctggtctgcaataaacgtaactattatccaatgcaaatgcaagaggctgtctccacgtcccacttcctgcctttttgccactcacttttgaaagttgctcttgctgcgattcctttttctcattctttatcgcccctcctactgccgtaaattgccccccagagatgtcgtaaaatgctcctccccgccctccatgtggcgaaaacgcaatcacgcttgacggcgcgaggtggctcagccgcaagatggcggcgctggcagaggagcagacggaggtggcggtgaagttagagcctgagggaccgccgacgctactacctccgcaggcgggggacggcgctggcgagggtggcggcggcacaaccaacagcggccccaacggcggcggcgggaacgttgcggcggcgtcgtcggccggcggagatggtgggacccccaaaccctcggtggctgtctccgccgttgca

SEQ ID NO: 38196 - DNA, 3122 bp, Bovine  19866880612129
ctacattttgagctcggatcaaaaggaacatccttaaactccaaggagtcctttcatggtaaatgatgacttcaggggcagtctgtccctgggtatggggccacacctaccaaatggatgtggctgtccccaaggtcattaataagcttggagtcctgaagggccttggtttctagcacccaacccttaagagtcataagagtcattcctaaaatgttgggctctgcctacactcaatagtgattttcttctcgagttccaccctgggacagatgtgtgcagtcagaaatgtcacccaacctgtctttccccaccttacaagtcagctggaagcactcatcctaccctactcatattgggtgtccttccttgaagagaacctccccctattagaaaagtacttctcttaattaaacctcaatcttgatagactcaactgttcatcacaggggatgctcttctttaccaaggattctgttttttagcttcttcagtggccagggatgtaattaaatgccattgtttcaatgacacacattttccgttccagctgcttgaagctccttttctgctaaatagtttggcagttatctctttggccaccacttatctcccgtaggcatggccttccagcatgacctgtaccctttctgccattttacagagtccctgtaagttaggaagaactcttgccatctcaagcaatgtcatgatgtggcttatttatttatgagagtaacatagctatcttttctcacttttaattggggatacaggggacaagcaccatcaaggtggccataatttaccaaaatggcagtcttcaaaagtcttaaacgcacaacattctggagtacacacagaataagagcaaaggagacaaaatttgtcatgctcttgcaaagaaggctagtctctggcagagccaaggcctcacattcactcaagaactcgagtttaggtaccaacattatctaaagtgagactgtatagtatcaaagagtgggtgtgttagtaaatcatttatcaagtgtaaataaatatttaaaataccacaatgtaaccctgcttttggtattgctttatttgttcatttaacatatcagggaaagaaaaaagtctgacccagtcctaacctcttggaggtcatgggtcagggtcccaccactaagttgggatgaaagggggacttaagaaggcggggattgggcagcaggagttttagggccagcttccaggcctcggagatttgggttctgcacttccgcggagactcaagaaagtcgctgctagaagcaatgggccccgcgcagcccttgccaaggccggccaccacctggaaaggagcacctggctaggccgcagcgggatgcaaaatggggcgcggcctcgttgggaaggggcggagccgcgggcggcaagaaggaagggcctgggcggggacacagtggtaggtcccgcgcgcgggagggtgtcgggcccaaccccccaactccttagctgggagcacgggaggtgacttcgacctagcgcttctgctccgggcggggttggcggcgccgcctccaggctttgggcgcccgcggcctctgagcgccggacgggccgggcatgcgcgttccgaggacctgtgggccgacggcgcgggtgcggcgggaggggccgcgaccgggtctgtttttcgtttccttttcctccctgtctcagtctcatccccaacaccggaagatgcaggggcctagctacaaacggtcccaacccactctaccccctctcgtgtctggccacgagggtgcccattcctctctggaacccacgtattaaagcggtttcggggtacgcatatatggtcttatgtcccccaagtgaaaagttggtgtttagccatttagaaatgggtaccttggagaaggagaaacactgccgtggggcagaagaaaaagccttgaggaactcaggggccctcactggaggaatacctccttcctcaagcccttggcgcgcagtttaacaggcccggggccctgggtttacccctcccagagttcgggatgcctgcccagggaacagcttaggggcctgcgtgacgatttcaatacccaagttaccagctttgcgtcctggtttttgtctcccatctagatctcggctctagatgctgagcttttcagggctgactggaagccacagcccagtctccagatggagtctaactccagccagtgtgaagacgaaactccttccctcttgtggggtttggatcctgtgtttctagcctttgcaaaactctacatcagggacatcctggacttgaaggagtctggccaggtacaaggtatgtggctggtcacccaggtggctactctgggctgcatctgtaccccacccttccttcccccaaagctgcagaaatttggggcttaggggcttagaagaacctttccagttgcagctttgaaactgaccctaacctgcatccttagacaagttcatttctgtgcaagttcaaaacaatctaaatcttttttaaatagatgtttggggcagtaactttgtactgaagaatgtttttacttgggtttgaggtctttcatatttaaaaatgctcagttgtttttctctggacctgtttgtggtagaaaacttaggccttacttctttttctaaccacttacctggcctgggtatgggtatgtgactcacctgtaaagcttaagagttttctttgtaaagagaggattaactgtgcctgattttcttgtggagtttggttttgtttgaatagatcagaatcaagatcagaatcaaaataatataaactccccaagaggaaagacatcatctgccttgttcatctatgtaatcccagcttttaaacagtgcctggcctctaatgggctctcgaatcacagtaactggagcaacaaagcattataaagttagaaatcatttttaaaatcagagtggtggtcgctaaaggtaggatcttcatacctccaagtatagcaaatacagtttaggataataagtaattcacatagctgtggatgaatcttcacatgtttattatgctatctgagaagtttgattaaactctctttgctatttgaatgaatagcaag

SEQ ID NO: 38197 - DNA, 605 bp, Bovine  19866880612924
caccaagttttgggttcctcatcactgaacagacttctttcttgcttggcttcttcccggccagtgtcctggcacactatcagagggggaaataattagaaagaactgtcttatagggatgagaagcactgggcgcttaccagatggggataatcaggagtcttcaaacaaatccttgaccagacagagcaccatgtgtcttttcgcttacgttaactataggcagtgttcctggctcctgaaatgtgtgcatggaaagggcagggggacgtctgctcagtttccctcattcccagggggacccctgggttgctcttcggttcgtgagcagtgacccaactgtagccccagagagttttctaggagcttccctgatctcactgtggagggaaaagtctcattgcattcttggttcactgagtgtggggtggggagcgagagacagctttgttatttctgcatgacacttgggactctcctggtggtccagtggttaagactctgctcttccaatgcaggaggcacaggtttgatccctggttgggaaattaagatcctgcatgttgcttgctgtgcccccaatttttttttttaattaaaaaaat

SEQ ID NO: 38198 - DNA, 947 bp, Bovine  19866880689344
tcatcgggacaagaatcggggaagaccctccccaaggactgaggagaggctgcgtggatctgacagggctttgggcctcccagcttgcctcaccgttcacctcctttatgcctggccctgtttttatccagaaaagctgaggacattctaactgtagaagaacctgtctgggctggctccacgagagccccccctgcccacggctcggctgcctgctccgcaatgggagccgccgccgtcgccgccgtgtagtttttaaaaaaaaaagaagaagaacctgtctgctcaggctcttgtttcccagggaaaggtgcagacatccagagtggggcttgggcttgcctgttggtggtcctggtgaagggaggtgatgtagcccccagggttacacagcaggggcgagtgccgtcaagtggtttggcctgaagtcatggtttgaaatggacatttatgaggcttgacctccctctggcttgaccatcctctccctgttactgttagcgctgtccagagctgacaggacttcaggagaaggtggggctgggctcttcaggcgatgtcctactgacaggtccagagtcacattcttacaaagagttgttaccacaggaggtcttcccaggtagcgcggtagtgaagaatcctcccaccagtgagggagatgcagcagatgtgggctgatccctgggtggggaagatcccctggagcaggaaatggcaaggggctccaatattcttgtctgggagattccatggacagaggagcctggcgggctacagaccatgggctggcagagtctgacatgactgagtgactgagcacattatcacgggagagttaggggtgagggtgggcaaagggattagaggtatgtgtgtaagcctttttattcctttaggacgaacccagagacgaaaagcaaaataacagatccagagattaactc

SEQ ID NO: 38199 - DNA, 806 bp, Bovine  19866880707974
tatatattcctgttcttgcctgggaaatcccatgggacagaggagcctggcagtctacagtctgtggggttgcaaaaagtcggacacaacttagtgattaagcatgcatccttgtaatattctaagtgtggtcagatcctcaggccagtccccaaaacctttctcatccattgagtaggtgcaattatagcatcaagaaccagatgtctctagttcacctgtatcacgggctagcttagtccatgtgtaatatccagggaagctgtcctccactgttcagtgagaaggaaacttccaggctaattgatgacgatggtgatgatgatgataatactactactaataatatttggagcatgaattatgtgccagtcattctgctaagcactttgctcattgaatccttacaacaacttgatgagaaaagcactcttacagtccttactttattgatgagaaaacagagacacagagaggttaatttaccaatggttataagctaggaggaggcaggcctggggttctgagccaggcaatggggatacaagcctcttgtatcttatgtcctggccttccagggaatcctgccagccagtcttgccactgcctaaggttgtccatagaccttagataccaagtatagaagtcagggaacagagaccactggtggcaggcaggagcggccctctttgtccctgaaacaggaaaaaccatttgttcctggaacctgacacttcagggggtgggtttgctgtgtgccattgtcttcctgggccatttacaagtccagcacttggggctgggga

SEQ ID NO: 38200 - DNA, 1178 bp, Bovine  19866880768643
ccctgtggcagcacataacatccatgctctcactcagtccataaaatccttcaagcaggattttttaaccccatttcataaacgaggcacccagttcagagaggttggataatctggccccactggccccgggaggagacatcaccaggtggtttgagctgatacctgtcaccttcctctcaggcactcaggtccctgaattcccttctgggctctgcctctcctcctgtccaagcctcacagcctccaccaaggggcacaaggtaccacggagctgaggcagaggcaaggtccagagatcccataatctagaaggttcggcctgctcccaggaccctgctgatcaccccacccacacccacagttgggccaagagcccgccagggccacagtaggatcctgactccagggttgtggggagtcggccctccgttctgctccagggacctcccacaaaggagactctcaggttccctggggacccagaagcctgctgcctgcaagcactgagcagccccagaaaaggaaaaagatgaaacaaattggttcttaagacaagcaaaaaggaattataagaaatctcaaattcctttttatcttgacgggattaccccaaggatgctgcagaaaaagcagcacttaaatagagccctcaggcaacagtttctcaactgcccaggcgcctgagggtcccacagtgtcctggagccagccggcccctagtcgtccatcatggagctcttcgcctccacgtattccagggcctttgccttgactgcctgcacatccttctctgagccgtgttgcttctcatagtccaggtagcgcttgaagaagaatttcattcgcttgggggccaggctcaggtgaatgacccgctcgaagatggccctgggagggagagcagatggcgtttgcctcttggtccctagccacgtgatttctggctgaccttcactcactgctctcaggctctggagcactcccacttctacctttatttttattcctattataaactgtcacgtccgtggacagagagaacaccacccctgctttccagaggagcagactaagatgctacagggccggagtgccctgaaggcacacggggaatcaggacagagctaatgggacgggacaccagtaagggggtgggatctgtgaggacagctctg

SEQ ID NO: 38201 - DNA, 1507 bp, Bovine  19866880774443
ctgagggacctgccctccaccctggctgaggcaggtctgcagacggggctccagaggagctggagatgggcccagtgaacccacgttgagtggtgattcctgggctgtgtcccgtcctgtccctcagctgggtggctttctccagaggacttcttgagcacaaagaacaccagagagtagctcagcggggcctccccaagtgggttttgggcctccatccttcccgcctcttctcattgcttcatggacaccctggcccctggtctgggcatggaggggctggaagtggggctgtccagagtgcatcctctttcttcttgtgcccaggaggtgggtggcaaggtagacaggctgatcccaatccatggaggaggagaggccggggctttcttcatgaacctgggaccagccaggttcgtgcctcccccctcactgctgtccccgtgtccccaggaacagcccccaattcaccagtgagtctgcccgaatcaccagtgaccccaggcgggggcccgtggagcgatgagtgcaccatttgctatgagcacgcggtggacacggtcatctacacgtgtggccatatgtgcctctgctatgcctgtggcctgcgcctcaagaaggctctgcacgcctgctgccccatctgccgccggcccatcaaggacatcatcaagacctaccgcagctcctagccgtcacggacccatccgctccccagcttcctccgaatccggcccggctccggctgaggcgcaagtcaacggggccccttctcttcttcctcgttttggaaattctttccccttctcattaaacttgggaaacagcccctgaggtcctggggaggaaggggagtcaggctgggaggtgggggcagaagcaagtctcagctcttccctgcaggccgaggggctaaagcggggggagggggggtctcagcctgtcctggtcctttcctgcctggggtagattcccaggaggtctctttagcctgtgtggcacctttgtgaacgttagaaagtgtgtcccatcctctgggcagatgcggccctgagtccagacacgtggcctggctagtggagtgtggccctggacttcagcctctgttttctccctcagccagctgcccttgagcagtgcacagcctgggctgctgccttactctctgaccttcccccactgtctccttccttctttcccttccccttgggcctggcagccaagggtaagacggccagtggatccctctcatcccaggagggctgccgcctctgtgctgtgcctgttgcccactcaccctggatgggtggacagacaggccacggaagcctctgggttctgggttgctagccccctggcctggttgagacgtggaggaccccttcctggtcgtggcctgtttgcctcagtgggctcggggatgctcttgcctgggggcagccccttggcgtgggctggagagcaggggaggtcttctgtcaggcttagcatccctggagaggccagg

SEQ ID NO: 38202 - DNA, 924 bp, Bovine  19866880783048
gctgagggtggggagcgggggtgatggcagaactggttataaagcaggatgcaggcacaagcaaggaaagctgggatttctgttctacttggcagtggttctgctgatgtaatataagaaacggaaagaagactgagtccgaggccatgacctgccttcaactggtggggcagatcccctggggttgaccagttatctctgctgatgtgtgagcccccagatgttctttcatgtgatcttcacaaccttccctgtgggccagctcgccttggctccatactccgggaaactcttgtgtttttgactcttccttgcaatctatcctcccttgtggaaagattgtattgggagccccaattaaagcatccagagttatcattctcaaaaaggaaaaaaaaggcacttgaccccaattgtgtttgacttcagtgctacatgccactgtgggcacatgaagcccccagaaaagagaccctcactcagcatggagcatttgccccgtcttcctggaagcctgatctttaaaaaggaggctgagtgtgctgtcttgtctccgccgtactgttcttgtcccaggagaaaggtcagtggcagtttcattcccaacatttggggtaacactttctgatagacagtgatgagaatgaggctgcacttttgaaaggaacatagcaaagtagtttagagcaggaccctggaaccagattgcctaaatccaagtttcccctcttccatttatttccgtatgaccttagacaagtcacttaacttctctgttcttcagtctcctcttctataaaatggggataataacagtgccatcctcataggattgttgggaggattaaatgagataatgatgataaaggcacttagaacagtgcctggggcaggttagtgctgcctgagggtccctgttgtcag

SEQ ID NO: 38203 - DNA, 1480 bp, Bovine  19866880796521
gcttccctaaacctgcccttggatgagaagacccccatgcccctgcccagattctactgtgctcaggatctgtgtgggtggaaggaacgagcactcacgctctttcttaggcaggcactcgagggctcgctgcatcacacggtgactggcctccgcctttcccctccgcagaaggaaggcgccgtatttgacccagacagctttctcctgcctgaaacgcttcagcatccggttgtagagttcgccagcttcctgtgggaagaatgatgtaagctgagagagcggatgagagcagagggggcaacgacagagacagatggctacgctcgtgggaagctagccctgggctcaggggctccctcagtgaccaggccctgatccactatgtgaggggaaagggcaggcacccgggatgacgagagcatgtgctggggagtctccctcctaatcccatgccgcgaggaggtcgagactagaagagcgcgtgagcacgatgagggcgaggagagacgaaaggggcgactgggctacatcacctcccgtctgtgacacctctattggtggctcaagggtgggggaaacgacttctcccacctgaagacgagcaagcctcgggcaggactgggcccagaggcaggggtttccccctctccgagacgtccccgctgcctcagggacttccaggagcttgtctctgagtggctgaggcccctctggaagccggctgcctggcccagacccctacctggaatttctctgacttggtgtaaatgtcagccagatggagaaagaccttcagaggctcattgtactgcacggcccgctcgaagaccttggtcagcgactcctgggagccatacatgttttctaggttcagcagggccacccacacgttcagcttctcctgctcctctctggagggagaagagtcagcacatgagtccatcctctcagccccatgagcccccactcccaagtggggggctagagccacggcccctccccaggctccacccatgtcctcagtccccaaccccacaagccggcactgagagcccccatccccatgcagctcatgtagaagcaggaaccccgatccatggctgcggggtctgaggctcccctgatttctgcctccactcctgggaaggaaatctaccaaatctcaaactggcctgaggtctgggctggatggggcagaacctgtggtctgaatctcccctcaaactacgataatgatgcacaggagcaccatccctgttcactagcttttgggaaacctgctagaacctcggcctggaagatggtcacaccaggattttcacccaggtatgtggagaggcaagtttttcctcttctacttttctccaagtggggcacctgaagtgtagggactcatggaaatgtgaccctagccctctcagtgaagaggaccatgaaatataaatgagcagatctatgtcacgaccggcctctgaga

SEQ ID NO: 38204 - DNA, 942 bp, Bovine  19866880805655
cagtttccacacttgtccaatggcaaggagactggtacctcgcagagtgtagccgtgaggatgcagtgaccggacaggcgcaaggcagccgtgcagagtgtccgcacagaggaagcatttgatggatgctggctttttgttattattattacaacacccaaacaattcagtgttatcacggggcactactggcttttaatggagatggaatttcctagttaagtgaaaactattgtggagtctgactcaagaatcttgaggagaagcaagtggaggataatgttttgttgtgagtgctggtattagagtgagaagagctggggttgaatcccagtgccccactgactagctgtgtgaccctggcaagttgctatacctctctgagctcgtttcctgatctgtaagatggggggtaaaaataactgtctcacagggttcatgaaggggttgagcaggagaatgtatctcacagtgtttgtaacttctgaaatgttctgtccctacatggagttgttaccataaggctcctttctgcataaatattttgtaatttggagtacttgtcaataataaaatatttaaataagaacctagttgctcaattatgtaactgtgttcccaagaggacggagaagcaagcactcccaaatattcttccttatcctaagtttgaattttgtgactgtgcaaattatgctcagtcactttttctgcctttaaggtaaaaggatgccctgttgatgaatttccttaagctagaagtttctcttcttcagatcaatattcatttttctcttttgagggcaatcgccaattccagttaaattgatggctgcagcctgcgtgtttatttctctttattcctgtctcaagcagttaaacaaatgggcagagctatttgaggaagggcacagggcaggaggaagccttttgccactggga

SEQ ID NO: 38205 - DNA, 1744 bp, Bovine  19866880812367
ggtacctaagttattctaggaatcaatatattaccttctcttttctcaggaactacctgctgtcctcttcggaggatggaactgttagattgtggagtcttcaaacatttacgtgcttggtgggatataaaggacacaactatccagtgtgggacacacagttttctccatacggatattattttgtatcagggggccacgacagagtagctcggtaagaacattatgagcttaggactgggcctattcaacgaacagaatggtttcttgttgggaattacaaactccagccaaacttattttcacttctgttattatcagctttttgagaatgtcagcatttgtaggtcatctgaaaactaatttgggacagaaatatttctgtcggcaatcatgtctacaccaagagtccatgccctccccttccccaagtggatgctaaaccttgtcttttgcagccactgtgagctcttttatttctgtcatatctttaaaagttcaggatgaggtagcttgggtttgaaattatttgtggtcgcccccccactgggggcttccctggtggctcaatcagtaaagaatctgcctgcaataccagagacccaggtttgatccctgagtgggaagatcccttggagaaggaaatggcaacccactccagtattattgcctaagaaatctcacagagaggagcctggtgggctacggtccacagtgtcacagaagattcagacacatcttagcaactgctgctgctgctaagtcacttcagtcacatctgaatttttgtgaccccaagggactgtagcccaccaggctcctctctccatggggattctccagactctttgcgaccccatggactgtagcccaccaaggctcctctgtccatgggattctccaggcaagaatactggagtgggttgccttgccctcctccagaggatcttcccaattcagggtcaaactcaggtctcttgtgttgcaggcagattctttattatctgagccaccagggaagcccttttgtatttactgcctcactattttaaagtctcataacagagccctgctttactatatatacagaacaccctagcaggtttctcctaaagctgaggcatatgatgatggctaagcaatttttttttttttgccactctgcatggcatgtgggatcttagttccctgaccagggattgaacccgtgtcccctacatgatgacaatggctaaatgttttacagaaatcttattaaaagcttcactgctctgcaccccctttctgataagtctattgctgtcaactttgagctaagagaattcaacggtatgctggtgaactaattacagtttattatgataaatactcatttggcagcgtgcatcaagctttataaaagaattgcctgagattcatgggatggtttgtgcatttttgctgagtaacaaacttgagagaacaaatcctgacagtacccattaggattttttagggtcatttaaaccttacctggttggttttaatcccctcctcagcgtaagggccaaaacagcacaaacagaggatggctgacatcaagaggtacccagcaagctgctccatttagcatcatctaaatcctcctttaatatgattaacatctgatattcctctctttgtgaatcatatccacttccagccaggccacctctcctttatctgcagtgtctattttaagactgcttcagcgcaaagagtatgg

SEQ ID NO: 38206 - DNA, 1650 bp, Bovine  19866880841811
gcacagctttgattctgacataagaatgatgcaagctggttttagacacagctagaatcatagacaaaaagacactttgctggtatcagtcactgctaaaggtagaaagaaacagacccagctagataatccacccacttctttctcgtccagaagagagattaacctgtattccttatcacatttttaaggatacagagatcatactattatccttaggcattgtccatagaaattctgggaatgatatatatcaggaataaaaaatctgttgtttctgcaaaaataatcattgctaaatatccattaaatcacactctttcctttgactaactggtcactttattcaatcaacatgtttgtcaaatgcctattacgaagcaggtaccattttatgacatacatcctagaagctgtcctttagggagtagctaaaactagtaagattttttagatgtctaaaattagaaaagatgcttttctatgaaaccaaatatcctttatcttttcattttcatttaaagtaagtaccctcacctacagaagcaattcctgagcttaaaaaaacaatcactcctgtctcccctataacttatgaaacaaaagaaaaacctcacatatattctcaccactccttttccttccttaatttaagctacaacatggcagatgggggcaatagggaattaaatctaattcatgcatgaatacctaaagtgcataagcaaagctgtgatgacaaaagggaacagctgcattatagataactgcagtagtatacatgccatgatttataaagataataaacatccaaatgctgaaagtatgcactgacttcagctgagaggcagccttgagccagaaataccacgtctccagaatatagccttaaagcgaaactgatctcctggcgtcaaactaataaatactttttactattattatataaaagaaagtgctaggtgctctatcaattaaaaggctgattcatcgtctcaccacacttttaaaacaaaaatatcattatctgccttggggaatccaaaattttctattggtcccagaaccttgactgtatcttcattaatgcctgttaacttgtgtcacttttctaaattattaaccagtggaacatactccacatctctatcttcaagagcctgcatatatttgtgaaattttccaaagcttactttaaataaagcacaaagctgccaccctagaaagcatgactgaactaagcaaccaacattaaaatgtaattatcagcccaaaattcctattcctatgtactaagttatttgcaagatatagatttgagcattaaaacaacaggcacaatcttcagcagaaagacccagaaacactataaaactgagcacagacgtcaacacaaagacaaatgtaacagcttttactatcgtacggcactgcagtaaggcataaaacttgaagaaatgctatccaaataaatacagacgttaaacaaaagaaataagactattaatgtgctttaagaacaggaatctagtattctcacactaaaggaacatgaacatgcaatttactaaatttggaattttgtaaatagcaaactcttaatggttttgcgatttaacttgtaattcaaagcagcgttacctcatctgt

SEQ ID NO: 38207 - DNA, 1407 bp, Bovine  19866880850255
acaaactgtccccgccaagactgctttggattcggggtttacagtgatctttattccttaaaaaagaaaaaagaagttatataaatagaatcagagaagaggggctttccttgtttatgtttctgaaaccaaaagaagaaatattttggaaataacctgcatattcattcttgctataaatcacttattcagatctcttccccatcagatggtgagtctgtgagttccaggctctgtaaaaccaggaggaaagaaactcacctgcagaagactttgatcgaccacatccccctcagccctgacgactgggggtgaaaacttttcactgtatttcttcagttctgagaaatattttttccacgtcctaacgcctctgaaatcaggatgtgcctttagtaactgtctgagggagcagtcagggtgcactctcagggccagctctggtactacttgatcacaagtgcttatacggtcagcacttcaactcaggtaggggcatggttttgtaagacaagtgcaagtttaaatgccattgaaatgtcttcaaaagacattccctggaggtccaggggttaaggctttaccctgtaatccagggcatgtgcgttagacccctgcttgggggaactgagatcccatgtggctcctggccagaaaagatgaaacataaaacggaagcaatattgtaacagattcaataaagacttaaaaaaaaaaacttacaagaaaaatttaaaaataaattaaagtggtgaggattaggtcaaagaacccaatgggaaactgttagcctgtgcctggcaggagtaaccacctagctcctattatccctcactcctcctctgacccctcaacgactgcaccccaacatgcatcttaggactgtgaagggagcagccaccaagacccggcccttcagtctccagatgagaatgcacaggccctggtgtggaggggcctgtgcacacagccagcctgccgctcgggcacgacttgagcccaggactccagctgagtgcccctcaacctctcagcccagcccagagtggcaggaagaggggcctccgctcacaggctcaggccctattgggctcaacaggtctcttctctgctttcaggaatgagttaatcctgaggtctgtctcaggtcctgagtgtaatcttccttacgatgcttatcatatttctggggctgcatctgcctggctttgaaggctctggcaggggcctctcctggccttgccgtaaacgggctgaattacatttacaagaggcctttaatgccccgtgaacccgacttccttaatggggatgttcctcctcctcctttctctttctctcccttttaatatggtcaccggttggccttccaagtgggttggattcctaacagagaagtcaagaccg

SEQ ID NO: 38208 - DNA, 1155 bp, Bovine  19866880852575
gttctccctagcaaatcctccaagtttctcagaagtccgtgaagactggctgaaaaggtttcctctttttcttaccatctccagctctcgttccctgaaagagaaagctacatctgatttggcagctcactggacagagccagggagatcaatggtcttccctggcggaggcggaggcacaggagctggaggcagggcccccgaaaaatgaccaaggaaggctccacacaggggccagggagccacctgctcacaagggaagcagaccttcccctgctaggcccagccgggccacccttccctctcaccttaacaaactggagatcggagagggctcgcactgagtagtcagggatgtagacctggaggaatgcagagttgagctgattgttgctactccccagcgtcggcgttaccgcatcaattcggtcgctgcgactgagagagtctgagtgattcaagccacacgggcgaggaggtgacttgttttcacctggaaaaggaggaaaaaaaaaaacccagctgccttttaagtgaggtcagatgtcactcaaagtcagctctttattttccaagtaaagtaataaacaagctcagcttcagggtctctgacagcgtgctcacggcttctcctgcaacagattcccagccccatccacaagaacacaccgagtctccaataagcaaagacccgtggccgcatgctatgtcaggggaggcgaggccccagacacaaaagctacttgataaaggcctgggctgcaggaaggcagcacagcatcattttgccaggagcaaaaacgcttgagaatgttcctaagtcagtacgtgtttttaaaggatcaaaataggtctatctgttcatacttcccagccaaacctgttatttttgcctctgaccccagtaaaatccctgaaagggagcctcaggacatctcgggattttaagcaccctcagttcagttccggagaagacaatgacaacccactccagtactcttgcctggcaaatcccatggacggaggagcctggtaggctgcagtccctggggtcgctaggagtcagacacgactgagcaacttcactttcacttttcacttttgtgcattggagaaggaaatggcaacccactccggtgttcttgcttggagaat

SEQ ID NO: 38209 - DNA, 741 bp, Bovine  19866880892517
tgaatttaaactgatggttatctttgcaagaggccgggtggatccccccaacattcccccagcctgggacctctggctcagccaagcctcttccccatctgaacctccagagcgccgtcatcccaccccacccccggccttgctcttgttaacccaagatgctgctacacagatgccaaatggaaatcttccacagggccctcaagtaaactcgaggtgtgtcgtccacactcctgcccttcctgctgggtcggtatgtggttgttagaaaagcagtcagaccttccagctgtgctctgtgccccgccgagaaggcgcgtccagacccatgtgtctcacggagggaactctggggactgccagcccctgcccccccgtccagggagccaactgtccctcttcccctcagccctgggcccacggggcccagcagggttgggctctgtgcctctgcctcggactcggcccatgccagagaggctgcctgtaacagccagggtcagtttggccccaaacagggattcagaaaccaaatgtgtgtcatggccatttcatgtgtgtctctgtcttattttaataccagattcatcacgtgtagtgagattaatgtcaggaggtatttcttgaatgactgaattcttaactcttagctgtgttttaagtgttaacccaagggatatgtgcattttgggggcaacattcatacactgaagtgacttcctactgaccacagtttttaag

SEQ ID NO: 38210 - DNA, 1437 bp, Bovine  19866880908420
tccagtggttaagaatctgccctccaacgcaggggacgtgggaacgtggtagggaacgaagatccctcaagcatggggcgactaggcccgcgctctgcagctactgagcccgcgtgcggcaaggaaaaatcttcggagccgctagtaagatccaatgcagccaaaaataaatattctaaggatttaaaaaaaatgcttccaagagatgttgatctatggcaaggtttgagaaccattcatttaggaacaggtattggacttcagtttctgtctctgttgtttttacttgtgtgatgctgacttactcttcctaagcttgagagtttttttccttctattaaatgggttattgtgagattcatatgtcaaatgtctgccactgacaagtttatgccaagtacctatacctgacacttgaggctcccccttcccctttttcttcagcaactgttgtcacaaagtccatgcagtaaaagccatacacaacataaagtttcaaagatgatcctgagccagtaaaaaatgtttattgaattaaattacccattgtagagcctcttgccaaattaacctgtgtttatgagacctaatcttggcagcattgccaggagtgaagtatgaataggaagcactgtaacccataagtagaaatgtgtacaaatgtgattgagaggaatcttttttaaatctgaatttggggatgaactataagatggatgaattatgttgattattttgctataatctctcatctctttagaaacttgaccttcagattgtaactcagaaaccggtacaaagaaaaagaggccatcatagtaaccaaaaaaactgaaaatttgtgcagtaaagagcataacagtactgtaattacaacttaaaaatttttcccacaaaccctcatttgattgacagatgtatggttgtttggtattgaaatattacaaataaatactcatgctttttgccttgaaatggtggttgttttaagcatataaaatagatttatcttttggaaatataaaaggcaagtttttcccaccagtaacatggttttattttatagggagtgatagatgtacatacgtgaagttaacacgggataggatgtgttgctgaaaagttataaaatactcaggtagctcagaaagctgggaatattactccagggcatggcttggtggtggtgagtgccatttgcattgagccttgagagaagagtaataccgttgtttgatttgcacataccatgttttataaaatttgtttttaaaatagggtagctctaggaaaaatgctgaatctttttgctgttgatttgaaaatttttaagatgtggacaaaccaaaggagtgttggatgggtaactgacccaaactgaatcccattaaaagattttgtgattgtgtcagggaagagtgtttgagaggagaggga

SEQ ID NO: 38211 - DNA, 962 bp, Bovine  19866880925585
aggacgcttacagaagcttcctttccaagcttgagaatctcggctgaggctggggatcttaagtcaatgcttaagtctgcaagagacactgcaaaatctccccacagaagttctgccaacctgccacctgccgcaggcaccctgggcagcacattctggtctgccaggcctgaagcccactcatctccagtccctcccaggctccaggcttccagaaaacataagccagcttgtctgtacaaacaacttctggtttcagcctccaaaccaaacctcctggaggcaaggctggcttcttgcttggaagaagaaattgaagacaggaaatacaaatcccatgctaacagctcaatatattattctgccaccaaatttatattagaataatcattcacaaatttcagtacatcagaacactgtgtacttctcacaggttacttgtgccacatatcactgcttgtgtgacaccactgttgctctgctctaaagtaaagctaaaaaaaccaaaaaagaaaaacagaagcattttctgtcttcacccctgctttctttcctccattcactgactgtcctcagaacaaaactaaaaagccttctccctgaggatgcaatttccagccaagaagattatccaaatgggtgttgcccagtgccccatgaactgtaccaaacctggtcaatgatgaaaatgcaagatcaccttattatgataattaggctatgctgattaaagtggaagcatcattaaggccatttctattactaaacctatcttctccacttaattagcactttcttaaaaacatctttagtttcttacagtttatctgactggggacagagtcactgaaccagagttgaatggcgtctggtttatgagaggactgagtctataatacggtgattggtttttaaaagattgctgccttcatgtattatataacatttgggcaggcatgtgt

SEQ ID NO: 38212 - DNA, 1481 bp, Bovine  19866880963118
cccatttcccatcctggctaatgggctggacctcaggaggcaagaaagaggaagaaagaattatcgttttaaagcaaaagtatgggtcgagcacgttgaaagtaagtgagaggcatgtcggcgagatgaatgtgtgagagactggggtggctgggttttccatcccttccccgggaaggtgactcccagaagaggatgtctgctaggcagaaagggaaaagagtgaggaggttgagtcaggatttagagtctggagttttgtctttagtagaaagaagaaaggagtgaattctgagtgtttcagagggaagcgagccagtagggaggaaacaatgattcaacacccaagggcccagacagaataggctgggaaagtctcaagatttggctgtagaagaagctgaccagaggaaactgctagttgctggaccacaagctgggtcgccagcatgttcttaacggtcactgatttacttagtagaaagccaaagttgccagcaacaaaccaatctttggagaacattcctccatctcttagcttccaggctgattttgcccacctttctttgtccaatctagaactggcctctcaaattacttgaaccagagaccagtaaccagaatggttcatgcagtagggacccaccatccccagactgaaacctcggggtccagacaccatccagcatatctggggggaaggcaacctcatttgctcttctgttgacaccagttattcttgagtatctctaacgatgtctatggtgtttcagtttgctgagcctgcctcactagtgtgactcagaagacggtgcaatgcagtcatcatgttagtggcctgtgagcaaggcatactgctcttgagcatttcaaagaaaggtcaacagagcctccattcttggatctgcaacttggtctctgtaagaggtcttctttaaatccaggacccaggataggaaaagggtttccctgacagtttacaggaaacctgcaggaaggcgacttctgaagaaggcaggtgtgagtggcaggtttgtgaagcatgggtttgtggactgcatggttgcacgtaagctagctggatgtctttggggcgctcctcacagtgtccacgcaacccctcccagctcctagtgggacctgtggggctgacggaggtcattcccctttctcccctcagcagagaaactgaagaaaaggacattgaattccagtgcagttcgagtgctaaaaaatttccaggctcaatggtggtgctaaactgtctccatgtttctaatatttttaataatgggttggtttttttttcagttgttctcatcacaaaaatgcagtgtccttgggggaagggacccagccccttgacctgccactttccaggtgtcctttatccttttgacgggacctctggtctgcagaaaatgttctgtcttggcatgcttctagactgtaagatttggggttggtttggttttggattt

SEQ ID NO: 38213 - DNA, 776 bp, Bovine  19866880966762
ctaataacagcatcaggagagaatgaaaacttctggtctagccaggggcacaggaaacactctataaatacaagccaaagttgaacaccatcctgaaacaccatcctattcctcttaacctgccttgtccttcaaggctcagcatgttctattcctaccagtcactgcggaactgtctcaggtcagagtgagtgaagggtgggggaggatggttttgagggattggatatgatccggtcaactttccctgccctggtgcctggccctgctgttgtgagcatatgcatatgtggccctggtcccagcccagcgtgacccccagcctggtgggagtcagccagacctcgctggaaagagcagatctgcctctatgggctctgctcttggtaggtgtggaaggaatcaccccattcttgccaaaatcaagtctgcctgaaaatagtcagtggggctgagagagatgggagaaggggagccaggggcggggggaaacaagacagaaggtccactggggctggtggccagggccagcacggtcccatctccagggcccataccttcaaggtcctgtttacagaagggccaccattccagcgactgctgctatccccctccccagggcttaggtcactgatcacagtaaatcttgctgctaagccctgacatgactgtggaagccttgtcccccagcacacagagctgacagaggacatgaaaagctgatgaccagccttctacacacaccacctcatcccatcctcaaacagccctaaggg

SEQ ID NO: 38214 - DNA, 746 bp, Bovine  19866881000741
aatcaatttctcttttaataaactaaaagaacaaaaatcccacaacttgatttttattctatcacgggttcgtataattcacttatggaaaactgcaagtttggaataattacatacacagcttaacatgcttagagtccatgtatgcatttttgcctcagttatcctctttcttatttattagtgataaaccaaagttttaagtgattatttaccactaattctatcaaccctgacatctgacatgaagatgaagattatcaaagcttcaccgatcaatatggactaaaagtgacccaaaggttaacccaatccatgacacctctgctcccaaagaaggtctcctatggtcattttctagacccaagcagaactgttttcttatgaaaatagcttaactccccaaagttagattccatcccaaactcttttcatggaaaggtcatacatatttcaaacatgtgtaaacacaggaagagaaactttgagaaaacctatgtagttgctttctctgaagaaacttaggcaaggtttacagtgtgataaagtaggccctgaaaccataagcaccttctcttactgaatgaaccattccaaaacaagactgccacttgagatgtaatgtcctatccagactcttcagaaacaccaatccttgccttactatcaatctcactgcattctaactctgaaaaccagtaatccatctagtgctgtaaagtgagtaaccctgtatcactcaaaag

SEQ ID NO: 38215 - DNA, 853 bp, Bovine  19866881109845
tggaaatcgcagcctcaggagatggggagggccgtatgatgagtttgttatgtatcatcagtggggtccaccttatcatgaactgaaaatgtcaccctctctgcaaccatcatgcatggtgaccagctggacgtgacctggaccacaggcaagcgatcagagaggatctaacctagaagaccccaaaccacctgagcagcgagtcttctcccaacatgaagaagcttgaaaaggcctgactcatccagcagccagcccagcccagcccagcccagcgcctcaggaagagtcagcaaacagcctgtgtggtttccttccagtcccagcttgccttgacctggtggaaggcaagaagtagacacaccactcctgggaacaagagccagcttgggaatggtggtgtcagcactccgtcgagggctgggcacaagccccacacaccacaccctagggtgagcctgagggcgagatgaggaggcatctgccattcctgtccatttgttgtggacccaggtaacgaggaaaaataggaggtggacaggttctgaacctatagccagcggaggtcttggacttgaccgttcccatgtattccctcagaggttgcccacatcacagttcacttggaattctgtgacagacccagcagtagggacagaatggtgcttaataaatgtttcagtggatttggccagcgcattgtacttattgagtgtcaactgtatgctaggcatcatgccatgttgtagagggggatgccaaggcaaagctgcaaccctgtctccaggacacttgaagtagagtggatcataagcacatgtctatatacttacaacccatggatacatatggt

SEQ ID NO: 38216 - DNA, 1806 bp, Bovine  19866881113978
ccctgctattgagggaatttccaaacacacagatgcagcaagaataatagcagaaatccacatgtaaccatccctctgcttaggcaattatcaatattttgccccaattatttttatttaaattttgtgccaaccattaggttctacactgtgagagatacagaaaagaaagatatccttagtagcctatggtcaagttgagggtacatgataaacattcaggaagtgctaaagcatataattctgactgtaagtttcacaagagttcagggaacagagcgtctgtgttgactggggtggtcttggatagtgtgagcctggagctgagattgccttagacctggtaaaagcaatctgtataaataaggaagaagtgggcaggatttccaagtagaataaccagcatgaccaggtcatattcactttgctctatataagtttctctccattgaaagcactcatcccgcatacttcacactttaatcttcagggtccacagcagctgtcagccatcaggctaatagacatcaagcactaccgcaaattacatcatcagaaccgattagctcttgaacatgtcagcacaatggctattcaatcttctccgggtgactcgttaattaacctctgcaatatgctgtctttgacatcattgggggagttcaatttttccttgattgaaagtcgccctgggggagaattataaatcgataacagaaacaaaattctattccattggccagctttgtgataatgattatgaaatgctatgactacctgagcctataggcacagctcaaataattaagaaaagtgaaggctgatgttgtctgtatcttatcacttgaattacattaacattaaaaatggtctatttttctacacaagtgacagtaacacaaaatgtggggtcttataatttaataacttttcacgttttaattcctctcaactttaaatgcaattaattcaaagctaaggatgaaaaaattgttaatattttattgaaataaaatatagatgaagaaacattaaatgaccagtatcctcagaagaaggcttcccaggtggctcagtgataaagaatctacctgccaatgctggagacccaggtctgatccctggaacagaaaaatcctgtggagaaggaaatggcaacccactccagtgttcttgcctgggagatcccatgaacagaggagcctggtgggctacagttcatgggatcacaaagagctggacacgactgagcgactgagcactcacacacacatcctcagaagctcctcatggttccttctggaaaggcaccaccctcccccaaaaataaccactatcctgacttcaagcaacatagaatacttacacttggtttgcattttttgtaaataaaacatacggtatacactctcttttgtatctggcttgtttcactcagcatcacatttgtgaaatttaagggacgctaattttaaaatgacttttgttattaaataatatatactcgacagtaaaaaattggaaaacacaccatcatttttaattcgtttaatgtctgtacataatttatttgatcaagattataagcttttacgaaagtcttgcgttaaaagttctcattttttaaacttttaaagatggcatatctccatcttcttaaaattgaagtatacttgatttcagtgttgtattaatttccactgtatagcaacatgattcatttatatatgtatataatatatatattctttttcagattcctttccattataagttatcacaagatatcaaatataattccctgtg

SEQ ID NO: 38217 - DNA, 1464 bp, Bovine  19866881123832
ttcaacaggggactaaaaataagaaagaaatcccactttacctttatttttctatgtaaccctgaaaccaggaagttttcatttggagcaccaaatagaaccttaggaaatgtcacttggtttgacttgttcattcataaaactgggttagagagaaattctgagcctgctttgctgtccacagtttcttgtgctgtgcctgacggctcttccaacattgagatggtttcctgtgtatggtaatggatgtccctttattcagaaaggaatcagacctggctttagtcccagcagtgtgtgacttagggcaagtcggaaaatacctctgaacttcagttccttcttccttggtcatggggattttgaaaactgaagtttttgaagagcagaaaccacgtcttattcattcagatccctccccccgccacgaggacaggtcgtagcccctctgtaagcccgaatttctccacctgtgaaattactggacttgatactgtctgggttttctcacacacagtctcaacattttgtcatctaatagccattaagaccaaaagaacaagtgcctaatggtgaaatatcatgcaaagggaaaaaacattttagaggaatagaggtcttctaggcccacctcaaaatcctactgtgttggcagaatgcggctgtctctgtataaggccagctttgtgtcctcccccaacccccatttcctctagaaagcgtagaaagcccccttgtcttgaatgcttccccatgaagagctcctgctgaaaggctgcacacacagccaaggctttgaccttcacctttgccctgacacaactggtaaaagagttcttatcctctcctttctgggggtgggggagtggaatctagctagggtgagcagaaattcaatgaaactataaatagaaacatggcctataaataatgctgcccccaaatatctggaggcacaaacgctgcccagcagtagacagtcacaaatcacggtggcctggaagtgagcaagccctgttcgtctgcttgatgtctcttgggatacttcagacttgttgctggggcctcgtttctctttctgggctctagaaatgccctcgttgtttgctgccctggtacccgtcttctgctaaatctttttttgtgaccaggcacattcactgaagcaaagtaacagtgcctggagtcagacctggctttagctccaggactatgtgacttggggaaagtcagaagatacctctgagcttcagtttcttcagatcttccctgggttggaaagatccccagaagggaacagctgcccactccagtattctggcctggagaattccatggactgtatagaattctgtagaatgtatagaactgcatagaatgtcgcaaagaatcggactccactgagtggctttcaattttgctttgtgagtgtttttaacatagataaaagaaaaagaaacaaag

SEQ ID NO: 38218 - DNA, 749 bp, Bovine  19866881184143
atctgcttttgctcaccaataaaccccacccagagcctggcatcatgcctgggacatagaaggtaggcacttaagactggatggattgaggacggacggatggatggatggatgaatggatggacacatgaagagcaggcagacaagcagacataaatgaaaaaaatatgacataagttagggacacattttaccccaataactataaatctcaaaaagcaaccaaatcccctcaacctggagtgggggtggttggctctttcgctcttggcttctgtcaccaatcaaaaccatatgtgcatcttcttagctgccccctcccaagaatgttctttccttcctctccatccctcagcatgttacttgtacctcaatctagtattcatttcgtctatagtggacttaattgcttaaaagcctatttcccctatcagatacagacctctaaaagacaggaccttgttctcaactgagtgtccctcagcctgggccacttctgctctgcaaaagtgcacatgtggtggaggccttgcttgcttgctaagtcacttcagtcgtgtccgactctgtgcaaccccatggactgcagcccaccaggctcctccgtccatgggattttccgggcaagagtactggagtggggtgccattgccttctctgggtggaggccttaccaaaggccaattcactccagccttggcttcctcgtctttatacttccactgtcaccatgcacagtcagcctaagg

SEQ ID NO: 38219 - DNA, 1113 bp, Bovine  19866881185025
tgtgtctctttccctacccggcatgtcacatggcggatggtagcatgggtcccgcagctccagtgtagacacctcccttgatgtcagttaatttggctaggcttctttaggtcacaagcaacagtttcgcactcatactggcttagatgaaaaggagacttggttggaaagatataccagggaagcttatgcagtcaaccagatggtggaagggaaagtgagacagtggctccaagaatgcctgaaacaaggctgtgctccctctgtcttgtcttgacttctctctgggcactgtcctcagcagtttggcagtcagtggctcccaaatttcctaccttgtggtttccaacagcagagactgcctctctcccagttctaaattgaaaaaccccaggcaagactctgattggcctgacttagatcaggtgccctctctgcaccaatcattacagccgaggctggaggggcatgaacaccaacatggccactagcgggcccacccctgtttatcagaagctgagagcttccagactcttccttagggccatgagcctggtttaggcctattaaaaacacaaagaagggacatccaccgctggccctcacaaccgagttccacttcttcctgtggtggtgagtcatcttggagatgccaggcttgcacgtttacctccaagtacttgattttatcccattgtccttatggctctgcctatgagatgagccagaggtgagccagcttcctgcattacaaatcctctcttaatcgacagtatgggattgcgagccactccttacccttctcccttcctcctcttccctcatcaattcctgtccagtctccttgtgtccttctggtgtaaactgttggaatttgctgataccccctcaatgggtatagtgtgctggacaggaaatgatcacttagttggggagagggaaccctgaaaggactcattgatgagccagaaggggtctgagagccagcggaaactctcaaatcaaaaacttttcttccccccttttctgttctactcccccaccgcctccctagttacagaatctcacaaggaaggaatgctgctccccccacttctccccttgcctggaggg

SEQ ID NO: 38220 - DNA, 731 bp, Bovine  19866881220258
ggcccatttcctcttactgaaaaacctgacagtaagaactgctggaaactcaactctcttgctgagtgtcccctgtgatacacacacatatctgcacctgtgcacacccactctcctcaagtccacaagccatccacagcctccccacctaacccccttccctgaaggatcttttccccaactgagtgccagttccccatctctgtgcccatgcacacccctcctgtctggcctacactgttcctcctcaagaggtccattcttcccacctcctctagttcctgacttaaaactcacctcctacaggaagtccttctgattgctccccagctgcacctccatagttttattcttcagccacacttttatgcagtattggatttaggtcacttcagagcagtcatatggtatgtcccccagtgtaaaaactctttcaggtgaggggctgggtttccagttctagtgtcccctctgaccactgcacagcacctaggctgcaggagcatcctataagtggaatccgggctcaccagcttttggccaggacccacagctactcttcctgagtcaacacatctgagaggcgcagggagaccttgaaaactggtttaggaacttatctctccaagtattaatcaccccataaaacttgtgtttatttagttgctggcaggtccttcttccaggaggtaggaagctgttattcttggagataccagccagggcttggg

SEQ ID NO: 38221 - DNA, 913 bp, Bovine  19866881242549
tatgtcagcattcgggttttatttcttcccccctgtttctggatatctttaagttagtttgtaaaatctattttgatgctgcataaaatggtacctccttaggtggcttttatagaaacattttcatgagtaattatctcctgctttgtaaaagcgggatgagttatttatttatactggctttcttattcacagtgcaaatatgacttcaggtggggtgggaactcatgagatgcatacttcttatatttgcagagtagatttaccagcctctagaggaaggaagtccctcaggactctctttagtgtaatagcaaaggaaattagaatggcctggctaaccgcatcaatatgcataattgacaagttactcaatactcctaaagataagtactttccactcttttcttttcgctatcaaatgtaaccgtatgtattattcctaggctactgttttgttctagaaattaacatgtatccttaatgtgtatatgctaattaagagtggacagcttcatggaacttgaaaaaatactgtggtgcctctaggcaggatggtctttaaaatatcagtgtgttggtgataggtgatatatataatctccagcccctacaaggataaagtaggtgcccaggttggaaaggaagaagtaaaactatgtttgcagatgacatgatcttgtatatatttatagaaattcctaaggtatccagtatagaactataagaattagtgagtgagttcacctggatatcagggagggtagcaatagtataggaaagtcatttgtatttttatgcatttacaatgaacaattcaacaatgagattaagacatttctatttatagtcagaatacttaggaatctatttacaaaacaattgcaaaacttgttctgtgcaaacgacaaaa

SEQ ID NO: 38222 - DNA, 735 bp, Bovine  19866881401897
atacataactatgaaaagagaaagaattagcccacgtattaccccaaagcctcttcctgtgctcacaaggtgcctgcacaatgttttggaaaatgtgaataataataaacggtacatagctcctcagatctggattcaaatcagtctcctcatctgcgaaatgaggacagttgtagaatctgcctgatggggtgagtgagaggattcgatgagataatgtgtgtcaagtacttggcacagagcgtggcacagactagcggcccccacacgtgagctattattatcaccgctgtcatcagcatcactcttggtatggcgctagcctgtatccccagtgccaggaaaagtgcttgggaacctacagccctgaggtcacggaggcacagagcccatgagggacagacgggtctgggaggtgtctgtgagcctctaggggcccctggggagctgcccagctgttgtgcgtgggctgtttggggaggagacctctggctttcccagcagctcattgggtgcgtgggagctggctgggatgtatttgacattaacgtggtggggcctgcaacacccacagagagatgcagagtgaagaagcagggatgtgcacaatggccttatcctagaaagtatccaaccagaagaggccctgctttccccgtgaaactacaaagggggctccttccacacacctccaccatgcagacccacaacctttggagaaaaagcatggggtgg

SEQ ID NO: 38223 - DNA, 1568 bp, Bovine  19866881414421
caagttggtggctgaggactgagaatccaggtcactggactcccactggacttgagtgtgtgccggcaagcatgtgtgtgcctgtgtgcacagactgggcacaggccaacccaggaggagcctggatgaacctcagctttcccatctgtacaatgggtcagtaggaagatgaaacccaattaaagaggctgtgagtaatgtgtccagcctagtcctgggtaccaagtcaatgctcagccaacacttgctcttgtcacctcccctcccttcaccatctctctgcctgcagagaaagctgccatggaggtggtgggaaaatgttttttttttttttttttgtcctttctgacttcagagcctagaaactgaagcttttctcttctagtcagtttatagtggggggtaaaaaaaaagatgatgaaagtaaaaacaaatgagtaaacccttctctgagagggagggatccatgccttacccaccaggttcctctccggagtggaatcttgggcctggtgtgtggagcatgctgaggatatttgcagagtgaggaggggaaagtgggggatagatggtgacttgttagatgaaggaaagggttgaggggtggctgagggagacccagccctgctcacagacagccccaggctcactgggaaacaaagcaaacacaactccagacacgatccaggcagagcccaagcgaggacagtaaatcgctggatgctgtggtcgcaggatctcgtccgtctgcccagatggttccttccagttaccttattcaccctttcagcccctggccctggagggagtgattattatccccatttggcagggagaaaattgagggctatggaaggcctggcttgtgtgtgtagggatgtggcagagcggagacttgaactgggtattctggtgcccaaagcggtacatttcacattacccactggggggtttcagcaggaagtcagtggagggtgaaattagtgaggacaggtagagttcaggagggcttcttggtggaggaggcctaggctgggcctacagctctgcaagggtgaggacaaaacggacacaccaggtgagatgaggcttcctaatctgcagggctgagggagaggcctgaagagcgatcctgaagggccgcacccagggcagagcccaggcactgacctggcctctttgactataaataggttttcacgcagtaatttcagttgcatttgaatttcccgtcaggctcctttctgtacaccctgtaaggccaaagccctagctgattcccgtcacagctgtaaatcaccataatccctgggcatttttaaacactgattatggcccctaaaatgaattagcagattaaaatatgtcctcattttgttcttcctaaattgattttttttgttaaaaaaacagagagagagagagagtgagagagacccatccaggttatcttcggaggtgggcctgctgctctgtgcctgcatcccacacccctgcccccgggacatgcccactgcccgtgggtactcagggtctacttccctccccgccctcttccctctgctccc

SEQ ID NO: 38224 - DNA, 1415 bp, Bovine  19866881518602
ctgttgtgacatcttagcagcgctgattgagatgaaaagccgccttccccacagtgagattcagccattgttttcttgccctctaacccctccccctcccctttcactgcagtgatgggaggctgttctctttcttctgcttcagagattagtggtaggcccattttcctttgcaggtttgccaccctcttaaaggcagaggaaggccccattaaagtcacgttttccctgccccagagagctgacagcctatttgaggaaagaaagcttatcacacttttgaaagggtgaagaatgattcaaggtgacatattaatagtgagtataccgtggtgtatgcaagggttgaatcaggcgacacgaaaaattaagaggtgctaggactattgtcctcagaagccaaacagagccatcctctttaactaaaggctttccatttctgacacagggtgattctggttcctgcttcaccaccattagagtccctgttctgccaaagatgcctaaggacatttttggacggtactgggggccctggccctgtatgatggtcaatcttggaaagctgaagctttccttgaaagaccttgcggaacaatcaggatcacaccatcagttaatgctctccagggagatgagccaagtctgccctcttctctccagtatgagattgaaatgtagcctaattaaacagcaggaaggggctggccccttggagattgggggtggcagtggctgcatataaatctataacctgatagatccatttctgaaattagaattcaagaaaaaggtcttcatttggtccccttctctctcttttttttcaactcttccatatgttttttgctttcttttgtgctgtttttgtcccctctacctcagtatattagggcttccctggtggctcagtggtaaagaatctgcctgccaatgcaggagatgcaggtttgatccctggggatcaggaagattcccctggaggaggaaatggtaaccttctctagtattcttgcctgggaaatcccatggacaaaggagcctggtgggctaaagtccattgggatcacaaagagacatgacttagcaactaaacaccaaacataccacctcactgtattattgccacctggcccaccctgatagagcccttacagaaaaactagtggttcctaaacccattgacccgccaaggttacttgggggcttaacagaaagagtctcaggcttactcccaaagatatggattcagtagtttgcaggtggggcccaagaatatgcagtttcaataaaagcactgcagcctatcaattcctcagactgatttgggggtgcactgacttaaaccacctttcccagtgtaaaccagcctatagaaatacttatagtgcaacatttttaaagtattggagaaa

SEQ ID NO: 38225 - DNA, 1864 bp, Bovine  19866881818394
actgtgtaacttgctgaaaatccccagtgttggtaaatgaaagagttcagattcaccctcagatctgtctgagaattttttcttttattctgacactttgtatactactttaaagctcccagaggatttgatagtgttttgggtttctgtttctttttttaaacgataaaagttaccagaattatgagaggaaaagaaagatactggagccattctgttatgatgctgtttaggccaggctgggaaaaagcttggtatctgaaacaggttacttccttggtttctattattgctgattccatttcctttgtaccctgacatgctgaaaaaatacagatctcaagttcaggctgaattaggcagtttctttgtggacttcttaccttcttatccctgttgcacttaaggtattaattagtaaattacttctccgtagatctttgtagactcttaagtgccaaaactgggtgtgatgaaaccaagggggagttgaaggtttttttttttttttaatgtatttgcaaataagataggtttccccttgacagtgctttaaacatagctggtgctaaaggcgtgtgtgtgtgtgtgcgtgcgctggatgaaaaggtgtgtgtgtatgctggataaagtccaagtctttggccttgaaattcaatatttattggtctcaatgtcatgaagaaactgtgaaatctgaaatctgaagtctttctgaaatgaataggggatggatggttaaattctttcagaagttgcaagttgacttcctaagagtttttctctgttggatttacaggaagctgctggaaggcgaagagacacgtttcagcaccagtggattaagcatttcggggctgaatccacttcccaacccaagctatctgctcccacctagaatcctcagttctaccacctccaaagggtcagccactgggctgtctcttaagaaagaggaggaggaagaggaggcttctaagatagcctcaaagaaaacctcccagataggggaaagttttgaagaaatattggaggagacagtgatatctactaagaaaaccgagaaatcaaatatagaagaaaccaccatttcaagccaaaaaatataattctcttgcttaaaaaaagttaatgcttaggaggggataatacacacttgacttgtcaaacagcctattcctgatacaaaacacctgtcgccactccacattgtcttcaaggcttcagtctcatatttagcatcgaatacttactttctctaataagaaatccacaccttagattggagcaaaccgcagtcctagagcaatcacagaggagttatctaagaatgcagctttctcacctaaagctcaggcttcacagctatagatgattcaggtacagaggaagtacaaacgaaggtgctaaatctgtgatcatcaccatcttgctgtgaactgaaattaaaacctatattcactcaccatacccagccgttacccagctatgtaatctcactctagatacctaaaacataaaatcactgccagagataaacccacagtccacacccaacaccactcgatagaattgtttcacaaatgataggtgtttgtttaatgggtattttccctctcaccccgctgcaattccatatatcctttcttccattcaggaaaaaaaaaaaaaggatagtgtagtatttgtccttttaaaacacatttaggttcttctcaaaagaacttaacccctttagctctctctgctcagtaagtagaattagatgcatgttgaccatttctatgattcgtgtaatgacttctccctgtccatttcatgtccttttaattatatactttaaaaaaaaaggcagtgataagtt

SEQ ID NO: 38226 - DNA, 1278 bp, Bovine  19866881969485
cctgcccttcctcttccactgtactgccctgtggggctctcctagccctgccaaggaccccgtctccttaatctccagtgctcttaagtaatagagtcattataagtgaccttcaggatcacttcatgccataccctcctgttaactgcagcccaaagacaggaattagctttcccaaatcacacagttgacagcagaccttcccacccccgttagagtgtatagtgtggtcatcatgtttacattgtgacatccagccctaaggatggctggggctgctcaggcatccaggaaaagtggagagtgctgccacctagtgacagcatatagatttgggcagtgaacagggattgccatgccccatcttcaccccttgcccctcgccatcaccccgactctcagcacagcacaaaccctgcaaacccaaagagaatattaatacttgaagcaagaagggtgcatgccagtccctctcagtcatggccaggggatgccagggcttgcgcccctggactcctagccctgcccagggcaagagggcttttccctagagctactgagctgctttgtgatgttggagggtactgctggcagcaggtagaggagggaaggggcctggggctctgacccatctggaggaaaaccagatcggactaaaaaaggaaaaaaaaagaaatctcagcagtgtccaaacctagttttccattagttgcgattgaaaatgtgaaataacgttgtattgctgtatactgcaactttaatcataatgagcccttctgaggtcattattgaggtttatataatgcctgaagatgcatcctttggtgcttttttctttcagtttaaagactttattacaagggaagaaagatgtcttcatctctctcccactttgtaacaggggcctggctggggtctctggcagccatcatgctattcccactaggccaagggaccccaagggcagcaagagggagttggaagggacaacctgaactgcaggtgtgccagctgtgaccgggccccctcgccagcccttggccccctccacccccaagcctggccccatgggcccctctttcttcctccactgttctccatcttgacgaaggcattatatagaatcgttttaatcactttcagatgttagagcagcatattttacaggcatttatatccattgctttcctcagcaaggcatgttactacttttatcatctaagaaaaaaaaaaaaaaagacaagggaatttcggtcaagcattatttccatattagta

SEQ ID NO: 38227 - DNA, 592 bp, Bovine  19866882023441
tgagtcggacccgagagcttaagtgactgccggaatcttacaaaatgagttggcagggacagaaggccagtccgcgccacgagcaggcagcgcaaggagaggcgagggtggactccaatgccaaaggatgcagcggcgagcggggacatccggcccggccctaacggcggagggccggcgtggtcaaacaggggctatcaatacctcctcttcgtcctcggagtccggccggcccccctccagcctcagcgagaagtggctcatctcttcctcctcttcctcctcttcttcttcctccaggtcctcatcttcttccaactcctcgtcctcgtcctcgaagcggcccctcaagcggcccaggctgcgctccggctccagctcagggggccgggagcccgagcagccgggatcccccgcctcgggtaggggcggcgggccctcctcacccgctgcgggtgccggagtgagggcaggcggggagacgggaggcggcggcggcatggtttgcggctccctcggccttggcagcgcccgcgttgcctgcggttaccgccgggagcccctccatgccgtaggtagagaacagatgagg

SEQ ID NO: 38228 - DNA, 1459 bp, Bovine  19866880511996
acataatgacacttctagcagagtggtttatgaatgttgtgaattcaaggagtatttaatgttagccattgcacaagagaaattttaagttccctgttcacacttgataaattcagagcagctttctcaaatttgacaacaatcctgaaatatagtatgacattatcagtaatgaattatgaagcagaaagaaacttctctaaactatcaataacaaagaacaatttcacatgaaccttgctagaggaaagacttaattatctttctattctccatagcagatgatatagcaaaatatctatcatatgaaaaagcaaatagagtttgctgccagaagtgtaggaaaaaatgattatagatgtctgtcagaaatttcattaatgaatatattaggatattattctagattttgtgatgattgcggtatgttttagcattttataatttgtaatttgttatgatttctcatattaaaatattccctttattttcctatccaaatttatagtcataattttgtcatcacttttcttgaggacaagtaaaatgatatgagatttaatcttcatgaaactgggatctggccttccttcaactcctttcagggttcacatcttacagtgggtaacagtgtcccatctttacattacaatgatactacaatatttttgtgttgttctcacctcattcctagaggccactcttctccactactttcctattgcattcatgggttaattccatttgaaacacttgaacctgaacttcaaataaggatttgaacctaaacttcaaattcataatcaggtctttttcatccaaacacataatccacattttgttaacaatttgtcatttaactctaatgtcgtttgtattattgtctctaaatctctataaaaagggcttttttaaaaaatagggaaaaataaattataacacagaatagatatcaccagctaatccataattgatttaatactcttatggctgaagaaatattgtaatacaaataatgacagtaagattttgtaacactcaactccaaagagaagaggggaagatatgcaaagacattaattcttcttcccctttgtcttcttgctcttataaaattcacaataagcagcaaatagttaaggtttgcaagatgacatttttgacaatgagtgaatagctgattgaatagaattcaatcactgttgccttgacttggctagcaaaatgctttaaacatgaagaattagattattatgcagttattttaaatgatatttacacaaaaattatgacagaaaaatagtcaaaataaattcaaaagattgttatagaatgggttgtaccatataatactagtgtttatctttaaattattctgctgctgctgcagccaagtctcttcagtcgtgtccaactctgtgcgaccccatagatggcagcccaccaggcttccccgtcc

SEQ ID NO: 38229 - DNA, 1825 bp, Bovine  19866880535346
ttctgggaaagaatgaaggcgggaggagaaggggacgacatacgatcagatggttggatggcattactgactggatggacatgagtttaagcaagctccaggagttggtgatggacaaggactccttgtgtgctgcagtccatggggtctcaaattgttggacatgactgagagactgaactaaagtgaactgactgataatgggcacataatatgcacgtttgtggaattagtgaattttaatgcattaatgacaacaaaaaataaaaatatgataaaatttacatattctctaattgtgtctttcatgtaagtggacaaataggtgtaagtttctaagcacaaaccaaattcacttaataacacagcaacaatatccaaccaaatttacctgttgagggtgagtgttccagtaagtagtgaccagtactggtcttcaagtcaagcatattaattgcatactccacgtctaatgatgacttagaagtctatgttttcctaaatgagtacttatattttcaaaacaaaggcaatgaaactttaaataaaaatactaattctcatgtagaatacatgaataaaaatggccacagtaaaaccaaaatgcttggttcatagttttaatctctaccttccctcaaactccatactctaccacaattatggagaacctgtcagaagcctgaatttgagtttaaaaaccatatttccttaaatattgaaatagagataagacctctttctacaaaatgctcacacaattcttgattggtttttataatgaatacaaaatgattatcaaagaagatgactttgttctcagatatccacctataagtttatttcctctgctgaagtccatatacccaaattgtttttttttacacattagaactagataatattccccatgaacttttatctaataggaattctagctatcttggactgtgagatatccacttttcctcaacatatcaaaggtgggggtggtgcttctatgatgttcacagacttgcctgcctagggttgaagtggcttattagaaattccttactgacttgtattaatataaattagtaggtaaagaatataatccagcacaaagtacaatttttattcaaatatttctattagcataattatcttttttgaggaaattaaatgtacattattatacttactatgccacaaattatagaagcaaaaaatttcatttgtaagaatctgcagttctcaagtaattagccacattgcaccctggaaactaaaattaaatacataaattaaaccagtgggggagatgataacatagtaaaaaggttctggatataatacagtatgtcatacctgaagctcagccttaaaatagtcactctaggcatgctcagacatgaacttgatcgggtctcctaaagacctgagcatttgaataaagtgatcagttggaaagtctatctctgatgaaatagcatttacacaaataggtttccttgcctactttctgaacattcagttcagttcagttgcttagttgtgtccaactctttgagatgccatggactgcagcacggccaggcttccctgtccatcaccaactcccggaggttgctcaaactcatggccaccaagttggtgttgccatccaactgtctcatcctatgtcatccccttctcctcccaccttcaatatttcccagaatcagggtcttttccaatgagtcagcttttctcatcaggtggccaaagtattggagcttcagcttcagcatcagtccttccagtgaatattcaagactgattaggatggactggttggatcttc

SEQ ID NO: 38230 - DNA, 2275 bp, Bovine  19866880555613
catcagaaatgtcgataatcacagaagtttttcaccactggattccatttatgttagcactaagtttgactctaggtggtagcctctcagacccttgggattttaggattgtgaatagactttgtcctcataggccttaactttgtatttccattttcatacggaaccagaaatagttaaaaattacccaggatgagctggatattaggaggagggaacagggaaagtgctatgctgccttgccttcttcttctgccttcacctaccccatcacagactgtgtttagaactcagtggtaccacactcacaacagtttacatttttcacgcaattatcatgtgcccagtactaggtaagtattcttatagaaattacttcatgtaaccttcacaacagtgtaaagaagattatcattatcatctcattttttttccatgagaaagtggggattaattcacttgtctggaattctatagccagtacatgatagattatgtcagtctgacttcagaacctgtacttcaagagattgtgtttcactatcccttggatgcaactatgcacatttctattctgtggaacatttgttcttgcagatatctgagagaaaaagttgtgtggttcaataaacctaagaaatgaatgaactcagacaattcatcatgtagctgtatataggaaaggctctgagaagtattaaaatacaacagttttcaagaattattggaccatcaaatccttttcctattcaaatatcttttaacatttcaaggacctagggaaaatttgccaattgtgttcaatgaaacatatgtcctctgttcaaacttgcaaactattgtgtcttatgtgatctagcactgggaaatgggcctacagatgctttttgttggttttggtaaatagattgaggtattttatcagtcaaagttttccagcctttccacttcacctactaggatagctatcctgcatttccaaccttgatacctgagaaaatatgattttgctaactgtaagaaatgaatggatgagatggttggatggcatcatcaattcgatggacatgagtttgagcaagctccgggagttggtgatggacaggggagcctgatgcggtgtccatggggtcgcaaagagtcagacacgactgaatgactaaacagaactgaaaaaacgaataaaatcagcaatgttaaattttaaaagaagctaccacatcaactgagttgtaagaccaagtaccagaaataggctgctaatactgatgactagttttcagtgaacatttgaatgctctggttcctggtacatcttgcctttagagtaacaataccaaacaaaacatgagtatgtagagaatggcaaccattttcctctaagctctgtcctatactccttgagtttattctggaattctgccatttcttttgctttgaaaacttcagggtgactctttcagactaatttgagctacgaatgatctgtttattggctttattttaaaatagcatttgttatgtaaggaagtattcttttgatatactcaacacattaatttcatcttcttacatttatacccacagttaaatgttaccattatgttatttgaaattcacatttactcatagaaggaactttctttaaaagactagaggcaactaaccaagtcctagataggtcacacttacatatttccatttgccaaacatgagattctgaggtacatcaactcggcaaggcatgataatggtatctccatatgctgagtttacagtataccatccaagacctttaaaggaaaggaacaaaagagagacagaagagttcaaatattctcttgaagcagcaaagcaaataactttagtacaagatgcaagtcttagcgaaggttttgtattataattttatcctatatgaaatttgtatttcattaaattatgcagttagaacatatttcctatttaaatatcaacagctcttatttaactactaagcctttgaatgttatatgattcaaatccataaatctcagttttaccagggaatagataagtgcatgggtgcatggtaagtcatttcagttgtgtctgattctttgcggccctgtagtatgtggcctgccaggctcctctgtccatggaattctccaggaaagaatactggagtgggttgccatgccctcctcccgggaatcttcatgatatagggatagagcctgcatctcctgtggctcctgtattgtaggtggattctttatcactgctgctgctg

SEQ ID NO: 38231 - DNA, 1038 bp, Bovine  19866880588954
cttggcaggtggttaggggctcctcatcttgcgttctgcctcacaacagactgtctattctgctcttccttctgctcagtcagacataccagcagagacaatggcctaacagatgctgatacagccgggatcagcctatgttgattttatgcttattagtctgagctagtcacagccagctggttgctgtttgccttgaatgagcagtagaaatacacacaactgcagtggtcccttgggtacatagacacccagggtgctggttgccataatccctcccattgcatgaggaatatttttggattatttaatgttttgtttttagtcttagaacaagcacagagagggaataagaaggaccaaatttataagacaggtgtactaaaaagaatccctgatatttgacactgtggtaactagagaaataacctaaagtttaaagcttgcttattagtttcctcctaacaacgctgagaagctagtacagattttaaaagacccataagcaagcttcctttaaggcatagcaggtgaaatgttgcttgggcagccaggtgtcatgctgactggtgctttagcattcacaacttactcctttattggtcccaggagtgaaatgttttgaactggccataagcactgggggcttgctgtgacctgcttcacttcagaactagaagcgtcctgaatgcttcaggcattgtcctatcccatagtgaaggaaagtgggaagtccttatcagggttgaaatttagcttttctagtctagctgatatttttgtcttgatttataaaatacttaaactattttttatttaagtttttaaatagtctacctaactagtaatataatctccccaccaccacgactgtccaccattagtaatgctttacctccttcccctaaaatgcttactcatccttccttttatcccattttattaactaaataatagtatcttgaaagatatatgtgggcctcccttgcgcctcagctgataaagaatccgcctgcaatgtgggagacctgggtttga

SEQ ID NO: 38232 - DNA, 1758 bp, Bovine  19866880791353
cattttttgtggcctcctagagagatatggtgccccctcagaatttctctactttttatcaatcaacctttttgtcagttctgctatctttttgcctccaggtttttccctctctttcatttacctgcaggagtttggtctgtaccacaatatcccttctgattgtcacgctaggactagggagctcttgctattcatctgccatgcagcctctttgtcacgtagcccttgtattgtatctgtcccagctgcgtgtttttctttctttgtaatgctagtgatacttaggagttggtttaagtgcccacagtcacattccaaagctactaagaattacatcttttcctcagtctgaaactccatttgacctgagtagagtataggtgatttcatgcttctaaacttgttccttaggttttatcagagccgagtttgcagggccagcaggtttcattcaatattatttgaaggggaagattttttaagaaataataaattattctttttgaattatgtctttcttagattgtcatacactgattttaataatatttgtgcaaaaattatgtaaaaacaaagtatgtgtaaggcatgggttaaatgcttcaagaattaaaattattcataggagagtcattctttcatttattaactgtttttgtaggggtggaagtgtatttgggatcatggagccactatgttaccaatgctacagttgtttgagagtggtatataaaatggataatagtcccacttacggaactgtagctgttccgtaacagctaagtgaatttcccacttatctgacttgcttaaatcttttgcttctcctctgtaaaactgaatataataatacctatctcatgatattgttaaagattttaaatggggtcacctatgtaaaatacttagtgcttccaagcacttaatagaggttgctatgtttattttgtgcttgtagaggacacttgctcttttggctgcctagaaatcacatatttttcttatttggaggagatctctaaataaaaactggaataaaggccaaaaaatctggactaagtggaaagaaaggggaaataattgttttgcctgcctctagaagttacaacattatctcctggtcttgaaataaaagcccatactgtgtttaaaattggtatttgtaatcatcatggggattatggggcagcaaagtgaaacaccagccctagtgatgggtactgtaagattatacctttgtaggcagataattaattggcttccccagacttgactgctttttcgactcaaagagctcctggttctgtctgagtttctcatacctgcatggacactctcaacaggcaataaacgtgtaatgatagagctcatctcattgttttgtctctaaggaattgttgtcttttattgcctattgtctagtatcttgagtgcctttttttccccatgtagtttgtccatttgttttagatatttcatgtgggagggtgaatcttttctctggtactttcttttgactagaagtggagtctgtaatctagtttttgtcaagcacccagatccaaatccagtaactttgatgagacagattgtatactgatgccctttgttcctatctatgatctgctatatatatatatctattcagttcagttcagtctctcagttgtgtccgactctttgcgaccccatgatttgtagcacgccaggcctccctgtccatcaccaactcctggagttcactcaaactcatat

SEQ ID NO: 38233 - DNA, 914 bp, Bovine  19866880796928
aaacattattttcccaatagttttaatctcactctggttaatatcatattaagtgttatattaattatactattatatatcattatattaatgatatttcaaattgataaattttgagttttatcttttctcacctcagataattttctagatagatatttagagatttatccttaaaaattaaaataactgagtggtaattacattttccacagcagtgtttagtagtcaaacaggctgaacttccaaatgagtttgctacaggaatggcaggcagaaataaaaataaaatatttaaccaaacctctccactccccacaaaataccatcaaacaaagcccagaaacagttcaaacataagatcatcctttacttttttgtggttatttactttgccttctggaaatattgcacaatctgttagttttttctctttagatgtttgcaggatatgggatgtactactaagttttttaaaaatgaattgattctcacaacagtacctgtgtgtacttgttaaccacataactacattattaactatagttgcttcacaaatagtaaaataaaatgaaaaagaagctaagaaaacagttatatacttcactaactttattgttcaatgattaaactagaaaatatttaatagtgagtgtttgtttatcattgttaaatcagtaacagtaaccaggatcgttgtggcgttgataacagtgaccaggagctttcctacttggtgaggcttgactgccagtgatcaatggcagagtgatgtaggagactggaaaggaaatacgagccccaagtttcagttctgtcctgggattttgttgttttctgtttctttggttgctcaatgatgatattaggccagaacatgtgactgattataagtggggtgagtttccttccat

SEQ ID NO: 38234 - DNA, 2269 bp, Bovine  19866881037902
tcatcttttgtgtcctcccagatgtttctagcagatatttgcaaaaactttcccaaatacaaatggaataataatagaggcactggagatctttccaaaaactttagtagaagctttctctatattttcaactcagttatttttaacatgatataatcattaggcatttgaaagcttacatctggtatcagttaatgatcaccggcatctttcatatttaacagtaattccttttggttcaatgagctgaccttggaatagtataagtgtagctgtacaggcttccagtgatttttcaacagttgcattttcaatagctgtacttctaaaagataaatgtaaacacatggcagtaggttacaattaattatccattttcttttcatagaataaaatgaacttagaaaaatgccattaattatgtaaagttaccaactcctctaaagaaaatttttgaattgttagtatagtaactttcttagaaatttgcatcaatgtgctatttaaaattatatataaatactaaaactaaaagaaatatagtatacattttctcctctttttaaaaagataaggagtattgagttgttagtactgtatttatacacaataaaattcacccttttaagcctacacaactatatgcagttgacttggtggtatcgtgaactaaatgaaaataaaaacatgtcaaatagcttaaactataaaaaacaaaaatttatataattttaggcaactatgttatataattatggcagttacacagttatatacatttgatgaatgatagccaatgtacggttgtgtaacttccaccacagttgtcatgggtgaagtgtgcctcatccaattcatatgttaaaggctgcctattccccagcacctcagactgtgactatatttggagattggacctttaaagaggtaattagggttaaacactattccagtatgactagtatccttataagaagacaaaatttagacacacaaagggacactgaagttgtccctgcacacagaaaagaccatgtgaagaggaagcaagagggtggccatttctaagcttaggagacagacccagaggaagccagcactgccaggagtttagacttcccacatccagatctgagagaaaatgaatttctgctgttcaagctacccagcctgtggtatgctgctgtggcagccacagtccactcatgtttatttgctaagttgtgtctcttttgcaaccccgtcgtctgtagcccaccaggctcctctgtccatgggatttcccaggcaagaatactggagtgggttgctgtttccttcttcaggacatcttaatggcccagggatcacacctgcatctcctaatacaaacagtcagaatatagaacctttccattacactctcaaaaatctctcctgcttcttagcattcactcccttcactgtactctcacctgctagtaatcactaatctgataactcttgctacttttttggcttttttcagactagaatgccatttaaatgtagtcatacagtatgtagggcttttagagtttggcttatttaactagataaagttttagatattcattcatgttattgtgtgtatcgctagtttaactttttattgctgagtagtattccattgttcagtcttaaaggtttttctgatccaaggttacatgctaatgaacttgggtttctgatttttgtatcctctgcttttacaataaagtgatttggtagaaaacaattgagttaattctttgctgtatgtgttcactctatcagtggtgtcctactctctgtgaccccatggactgtagcctgcctggctactctgtccatggaactttctaggcaatgatactggagcagactgccatttcctactccagggtatcttcccgacccagggatcgaatctgtgttggcaggtggattttttaccgctgccccatcaacctgaaaaacctaactctaattacctgaaaaggcatgcattttatctaacagttatttggttgtttctagctgtttgataatattgatataaataaaattaccttaactatatttgtgaatatcctttttgaattattagtttatttgataaatacagatttggagaagggaaattcattgttcaaaagttctatacattgcttgatcattgtctttaaaaatatatataacagcagtgttttagggttaatttgattttaaatccactagcattgattactcaaagttttaaaaatctttg

SEQ ID NO: 38235 - DNA, 3283 bp, Bovine  19866881118229
gaatcttatgcctatagctttatcagtgtatttgtgtagcctatgctttatattaaaacataaggattcatctgaattcatttaagtttatagaacaacataatctgctaattaatgaaagccttatgtttcatgattttttatcaaaatctggggctaagtcttttgctgtgagtcattaattttgtaaaacagaataggtcttttaggaaaaaaaatgtgcccaagaacatctaagcagtcatggctacctggggagcagaaaagccaaactggtctttgtggaaaccactgaatttctttttgttaaccacccaaagtgaaaagaaaattcgctcagtcatgttccgctttgcagccccatagactgtagctcaccaggctcttctgtccatggaattttccaggcaagaatactggagtggatagtcattcccatctccaggagatcttcccaacctggggattgaacccgggtctcctgcattgcaggaagattctttaccatctgagccatgaggaaagcccatccaaatttctcccctacaaaatctgaagagattagtagaaaactaaatagattataaatgagtaagtaaatttattcattacctagatttttgttctttagaaagacttcctcacaccccagcttaggtgacctcttatatatgacttttcttggaacatcatacatcacaaaaatatgtctttatctttctccgtttgctagacagtgagctaaatgaggataggaacgatgtcttagtcgtcattcatttgttcattcttgttctagtcattcatccataaaaacttataaagcacatattatgtgttttcacaggcattatatgaactgtggtagaatggagagaatgaggacaagacacatgacagacatccatataagatgttaggaggactttgtgtttgattaagtgtggggaactgagagtggtagagaaatctagagtgacattcacctgcccagtttggttgcttgtatagattgttgaattagtaaccaagtagaaaatataggagaaaaattatttgcctatggatgatagagtgaggaaagcaaggaaatagttgttcatttggggccatattaagttaaagatgtgtgtgaaacattcaggtgaagaagattttcacagaagcatggtcagggctgattatactgaccgacagatcctggcaactggatgcagttgatacaacataaacatccaggcagatactgaaagtaaaggataacccagagaggatagaagagtatcaggagagcaagataccatgaagtcaaaaaaagaaatatgtattttaaaatgcatgttaccacaagtgaaaggggtgaaatgaagtacatgtggtaatgaataatttttttcagatttatagtttgctttattctgaatgtcagagcttagcctgactagcgttttacaaaacccaattaagttacaagtgctttttaacaagctgagtgttcttaaacaagtctcaatgagtctttatctttttcttttatttgtaaactttagggacttaataaagtggttcttcaggagccaatattttatgtacagtattgaaagtaaacaagtaagcattcttgaccagaagcaatttcctaggggatagaagtagacaaatagagccatcatatgtcaagttcatgtcatatatcagaatatcaaccatggaaggaaatgttgaaataatataaagagtaaagtttgagagcaacttttgctgtgtttgctctactagatgaattgtattcattatatcaactgggaaaccatatcaagaatatcaataatctgagcaatgacgatattttcctttaccagcttaatccaaatgacatcttacatgtttgtcacacccagatctcaaggaaaaaattgttaaatttaaatgtttccagatgaacaaagatcagtgagttatattattattaccaagtcaatattaatacatactcccatgggaaaaaaaaagaaatatctatttattgagttatacacagttaactgaagaatatttaccggaactcaagctttcttaaccaaaatcaatgtggatgactttcaggatgttagcagtaccacgatgacacaaagatattatttcttaataacatcaggtttcagacaatagagaaagggcagaagagggatcattaacatccaaagacatttgtacataatgataattatatccaggtgctcagattaatatgttttcaacataaacatgtggaataaacagctgttgtggaaatgtgccaccaaaatgaaaacagctcaactagagaaactattcagaagctagtgaccccgtacatgctcatactttaggaaagcaaataattttcattaagcctataaacaaacttaaaatcaggatggatttctttggaaaatagtagaaatcttgaaaacattctcagtatttaccaaacatcccctaaatatttgctcaaaaattaaaataaatagcaatcttttattcattgtccagtgtttaatgatcaaatttcaaattaaaaaaataaattccacttagaagacaaaaataaaagatattcttgcaaaaccaaatattgcatctctaatgtagtatgaaaagaagcctgtggatggtgcattcagttgctagcattagcactcacacacagactgcttctggtcaaaaaatgcctttgtgttttgccttgaatacttcactgatttatatttgaagaactatttggattaaacagttctttcaataacatttagcaaaagcattgaaagagttaacctatttgtagcaactttgaacctttctaaatttaatatttttagatgaaagcactgatcttcctatgctttataaaatagtatcctgctgggcagtgtcattacaatgataatcctactgggagagataccaatccaatttattgaatgaagatattaatattgtgatagatacttctaaagctcagtttgattctttaaggattctttcatgcttagtggatgcttactgtactcagttatttgagatgtagcacttactgaatttttgcatgaattgcaattctccaaataagacttatatcagcttgtaaagcctgatatattttctacctttgaagtgggcattcaacaaacttcaattgtgtctttatactatacttagctgtaactcagtaattcttctttaagggagaggccagggagagcaaaatgcgaaacaaagtccatattaggggaattagtat

SEQ ID NO: 38236 - DNA, 1582 bp, Bovine  19866881292126
tttaacattttgtattaattcacttaataaattaatttcagagatagatagattacattttaattctgggtgacacatttttaagactgcttagtccagattttatttcaaatgctgtataattaagtggatcatccacatagatccacatgaatccacagtttactcaaaggtcactggactcttaagaacacaaaataagatacaacatcaccagcacaggaatatctgagccttggtaagcctcagaaaaattgagaatgttattcactcactgtgatgttaaaagactatgatctcattttaggactatgtagatagtggccagacaaagaaagaaaaaaaaaaaagagctgattcatgctgaagaaagaaaatcctaaataataaggcaatggctacaaagcagtgaccaggaaattactttctgagtaagatgctccggggcaaaagtctttctttaacaaatattgtttaaagcagtgaaatctgtttgccatcactttttcttctcctaggtgattaaatgcagaagaaaaacagtcatttgatagccacagaagctatttactgaaagtatattcaatcaccataaacattatttttacagcaagactagtgaaagatactatgggggatcccataaaacattttttaaaagaaaaaaatgatagtaccatatatttttatgagggtttcagagtgatctgtatgcagctgtttcctccaagtactgcctgacattgcaagctctgcttttggagccagatggcataaaattcagttcccaaatgggagagatttcagaggctaaagaataggttcagggcttgttttattttgtgactaaggatgattcctaattatcttctgtatatttctcatctataaaatgagataacctattgtaatacaggggatctttattcagggcctgttttattttgtaactaaggatgattcgtgattattttctgtatatttctcatctataaaataagataacctattgtaatacaggggatcttcccaacccagggatctaacccaggtctcctgcattgtaggtggattctttaccagctgagccacaggggaagcccattgtaatataagcactagataattataaagtgtttcattgccatacattttaaagacagaaagaaacagaaaagcctgatatgttttcaaattgaaattttcttttttgtttttcccctgtctcctttcgaaaatgtgacataagtcattctgtaggaaaagactatgaaatttattctcttggatttccaagtagaagctgcaggtttagtttgaaagagaaaggacagactcaaactctcaaggtgtagaaaggctttatctaggaaaagtgtagggtgctacaaaagggaagttgccaatggatgtgaatgggacaaaagagctaatataagctctggtttgagtatggggctcacttatgtggagctgggaccttttatctaggctgacttaaatgactacacagtcctctgatgctgggacaatactccttacattgccctttgactgtggcatagctgtcttgtcctctttt

SEQ ID NO: 38237 - DNA, 1295 bp, Bovine  19866881319765
tcttatagctgtgcattagcgataacactttctgccttgcctacctcacaaaactttgaggacaaaatataacaacagaaagttagaaagttttacagacatacataagtttttataacatcactgagataattaaagtgggctgtaggaccatacattacctagtccttaacttaagctgtttcttgtagaaatttattaaactccattctgtatttacttcaccatcaaaacacacagccagtgggccctctagcagcactggctgatgataatttggatacaccattgtctttcatcatggcaaaaatagaatagtaaagaaaaatctaagcttattgagtgtccactgtccttaactgactatttatatatacagaagtgttacaaaattggaatttgcttttagtagcttacattttcttttttgaatatagaaaaaatgctttgagttttatgagcattaatcttagtatgaattgtttactggttgtttatgattatctggtaacttagaggatagaattttatataagaagtttgatgttagggtagaaatggaaaatgtagctcatttgtttatttcataggatgcctgtcattatctgtattggtgacattaagtgtcagtgtatcaattccaggctgctttcaacatgagctgtgtattcttttaatggctagctttattcacacctctatttttagtagatatcatttaatcttgaagtgtaaaaaaccataacacagtcatcattcttaagtacatcttgaaaacacattcttctgaaaatactcactttccactagagtatactttggacactgaaacgttgacttgggaacagattgataattggcattgttttgcccttacaaatgattattttgaaactaaataaaaaataatgttgattgtgttgtataaacacagcaggttcctaaagtctcagttttattttgtatcaaaatatttgtcagtaacttgactaataaatatttttaagtggtataatagtcgatcagtataataatctgtcaagcatatctattttagatatgcacaagcatacacatatgcacgtgcgtatatgctggacacatcataaaatgctatgatatgaaagttaaaaaaaagaaaactataaagactcaaatactctgtcctttgtgtcattaaagattatgtttttggaacttgggaaatggaccagttcttagagcaccttctttatctttatcagaaaatataaatcacataggtctattttaaactctgtttcctgttaattcta

SEQ ID NO: 38238 - DNA, 3185 bp, Bovine  19866881387513
cacccctactaactacctttgtgtcacttctgtactcgatatcagaagtaaattagacgcctgcttcatatggttgcgcagtctaagttcatttatttgctcagaactatttattgagtgcttgctatgtgcaaagaactgttctgggcactgtattctttccttcttccttttaacttctccaaacatgtccttccctgcatttttggctattcacactactgactctcatagaatgtctggattcctgctccatgggaacaactcatttccttctgtttattctccatcaaaaatactgccatggaccaactttttcttaactgcagattagttaaaacaggtttctcaatcttctgataatgaaaacctttcttattttcctataatgctatttgaaatttcaaattaagtaatctaaaaaatcagagctacaagacagcatactacattgtttataaaacagtcctgaacttccctggtggtccagtggtaaagaatcccacctgccggtgcaggggacacaggttcgatccctggtctgggaagacttcacatgctatggtgcaaataaacctgcgagtcacatctactgagcccatgctctagggcccaggaaccacaatactgagcccatgcacttcaactactgaagcctgcatgctctaaagcctgtgctttgcaacaagagaagccactgcagtaagaagcctgtgcattgcaaccagagagtagccctgcttgccagaactagagaaagcccacaggcagcacagaagagccagtgcagccaataatgaaataaataaattaattaaaaattaaaaacccatatcactcattaaaaataataataataaaacaaaatagaccctcaccacccaccattaagaatcactgacattagtcatggaaataattaacattttaaaagaatatggccaaatttagaatattcagttgatcatcaaaatgatgagtaactttcaagatttaaactatattttatttagccatataccctatgttttgcataaaaattggaattcactttcaacagttcagttcagttgcttagttgtgtctgactctttgcaaccccatgaatcgcagcacgccaggcctcattgtccatcaccaactcctggagttcacccaaactcataaacattgagtcggtgatgccatccagccatctcatcctctgtcgtccccttctcctcctgcccccaatccctcccagtatcagggtcttttccaatgattcaactctttgcatgaggtggccaaagtattggagtgtaggacatgtaaatatgagcactactttgttaatttttctagcctactttttgaaaagtaatttaagtaatctataataaaatgcaaaagctgtttcaaataaaccaccacaattttccacatgaaataaagatacactcttactttcttaaaaacatagattttcatcaaggtttttgtaccaagtatatgagtcattaaatcattttcactggttgtgatttagagtaacttgtaagtagaggaacaacaaatgcatttgtctttggtgttttcctgatgtgctgctaaaagactgtgctctgtccaaacaaggtcatggccagctgacctggaagcaggctttgctgagccacaaggtcagagatcatcatggattgctacataagcaacaatatataaaagtaagaggaaaataaagaggaaaagaaccctgatggtaattaccctataaactagccatatacagttttgtccaaagataaaagaaattctgtattggacaagataactttcagttaaaaacagaaaataaaatatatttatagtgagtttacctagaatacttatgttattgctgtcttaacccatcaggtgtatcattttaataacattgaaatgagcaaggcttcgtagtaaggttaagaaataattttgaggggtgagcagggcgcggcccaggtcagcgggagcaaggttcgtgctgcacactcagaaaaaaaaaaagaaagaattttgaaattcagcttttaagtcttgagttagtcataattaccaggaaacagagagcaaattttaggaaaaattaattgcacctacagagaaggcaatggcaccccactccagtactcttgcctggaaaatcccatggacagaggagcctggtaggctgcagtccatggggtcgctaagtcggacacgactgagcaacttcactttcccttttcactttcacgcattggagaaggaaatggcaacccactccagtgttcctgcctggagaatcccaggggcgggggagtctggtgggctgccgtctctggggtcacacagagtcagacacgactgaagcaacttagcaattgcacctatagaaactcttagtaaattactacttcagattactacacataaatattaatgaaatacctaaacatgtttaatttagtagcaagatgtacttgagacatggtaagattctgattcctatgataataagcactaagaatgtacatggaagcagcctccaaaatctttaagctcagatgcaatcttgtagtttgacatggattccctcataagggataacccagcagacatcatgtgtgagtcactgcaatgattaacatttcatattcatattcttatagctggcatgttggtagttctctttttccctttcattttcatatcaaatattccacattgttaatatatggtattatgtccattaccaactcaagttcaccaaaaaaaaaaaaaaaaattcagcaaaacttgcagatctttttcttatttgatagtgctgttctcatataatggcttgtttaattaccttcacttgaaattattagtacagtaaaagatttcattaagcccctctaggtaaaaaattagtggacataagaacaaaacagtggacataaacagaatttatcattttctcaggcttaaaaggctcctttcagatgtttctatcagtgtagatgcagagagtaatccagcagaaaataagcccttgagttaaggacagaaaaatcaacacaagaacaggtatgaatctaatgaccattaatatacatataagtggatgaagtgaaataatcaatccatgttcaagaaatgaattctgtggcaatgctcccaacttatcatttgcaaga

SEQ ID NO: 38239 - DNA, 1404 bp, Bovine  19866881625927
aaaccatcagcggcattttgaactcctacaaaatccatgactatgtaccagggttgagaattaacagaagaaatcagactaagttagagaatacagaggagatgattataaataacaaagtagagacttaaagctatcataagatgggtgagcatttattctataggtcttgcaaaaaggaagatattacttgggtactatggaatagggatgggaatttggaaatagattccaaagaacttatgaattgggacttaacattggaacattttttccaatatattaaaattgtataattatattgaggtacttacagtaaatatcaaaaactgcttgttcagagtaaactgttttctggccagatggtccataatatgtcacagagcaggtgaatggcatttgtatgtcagccttggttgtcttgtactccagggatgaagtcatggtatagagctgagttactgagtccatttgctttctaaaaattatgaccaccgctgaagaaaataaagaacactaatggtaggatctttcatcggaaaatcacagcccttaattaactgtcataaaaactttgagaagtggtttcgtccttcttactgcatttaacaggagggaaaattgacatgtagtgaggtagatgtcttttcaaaagcatgaatcagagacatggacagaaatagaatcctgggaattttatctcccactcactttaattaacttctagaacatgccatatacagagataattttctctgctcttgattcttctgcacaaggtctaaaatgacgggttttaaaaaatcccttactgatttaatggatacttaagtaacaaagaatatagagtcataaatcaaaagagggcaatgcatttagactcaggatagactaaagaatgcttagacaagagaaaggcaaaacaggtcacctgaatttattgcccacttcttacccaccttcttcaagaggttgcagaacttttccattcctgtaccatgtgatgttgccatctggataactgtcttttgaaatgcactcacccaactgcaatatagagaggaaatattacaaccttggttccatcacgggttgtccatttgaaagccccagactcctcaagggatgcagagttactccaatgatttcttgatccattcattttacaagtcccaactaaggactgaatgaatgcactcttacataaaaacaatgtcttgtgtttaaaattatagtcttgcccattttaaaatgtgcaggagatgctgccaccattagtaaaatcacattcatttaaaagcattacccaattcattttgacagtcttcatttttaacgttaactaaataatataactgcattaacattggctattaccatgggtgatagatctgcatttgaaag

SEQ ID NO: 38240 - DNA, 5651 bp, Bovine  19866880256159
aatcagtcctgaatattcattggaaggactgatgctgaagctgaaacttcagtactttggccacctgatgcaaagagctgactcattggaaaagaccctgatgctgggaaagattgaaggcgggaggaaaaggggatgacagaagatgagatgtttggatggcatcaccagctcaatggacatgagtttgagtaaactctgggagctggtgatggacagggaggcctggcatgctgcagtccatggggtcgcaaagagtcagacctgactaagcgactgaactgaactgaaagagaaaagataccttgtgtattaagaagcaaatacaagaggcacagcaggcttctcaactgaaacgacacaagtagtgaagaacgtctctaaattattacagaaatatctatcaatgtagatattttcaaaaataactctcaagaacagtggcaaaattctttttcagaaacagatgagctgaattattcccaccaggcctgcttaccccacaagaaaagctgagcatgttctccaggcagggaaaaaagggtgggagtccacatctacacaaaggaataaacaccagaagctggaaaggggtgggtgggcgttaaaactttttcttaatttaaaatctctttaagagatgttgacattaaaaattaatagcaatgtgtgatggggtttacagcattatataaatggaacgtgtggggcagcaaaggctgggggtgagggtcgtgtgctgaccgaccagtgaccagcgaccagcgcagcaactgcacacagaggcagaaacgcacagctagtaaacgatggagaagatgaaatagactcatgaagcagcaggactggtcagaagaggccaggaagaggggacatggagcaaagcagacaggacaaagagaaacaaaacagcaagatggtgtgtttgcacccgaacacaccaataatcagtctccgtgcaaggtcaaaacacccagatcaaaacggagaaggtcccctccctgaatggagatgcagggcctggccccaaacgtgcttctttaaggcaatcagctcaaatcaaaggacactaatgggccagaaattaaggacggaagagagtgcgggttcctggcccactcggagcaagagcaggagtggggtgggcgggcagagcctggaacaagccccgcccatttcacattttatgggctgtttgatgccttcgtgagaatctgttctagtttttcgccagtgtttgccttgggttttccaggttttgctcgttaggtctgcatacattttccgatcacttgtctaaactgccgatctccctcaagctggtctcttcactcctgtgcctggtacctctctgtgaacaaagtatttgaatatagcccagtgtatccatcttctcgtaacacctcatgcttatgaggtcttaaaataagacatttattttcttacctgaagaccatgaagatactctgtgacgccctctgtctccttcgttcacctttcatgctcttgcctaccttccatctgacgctggtttttgtgtacagtgtgaggtgaggtttagttttctcttttctgcgtgaggccccagctgtctgcacaccattattggagggccttcctgtctgctctgctctgcattgccagcgttgtctggaagagcagatcatcctacgggcatccggcggtgacgcaggacaacgtcccagagatgtccctctcctgatccccaggccccaagaggacgcggcccgacaagacaaaagggccttcggggtgtgattagtgacagaccctgagatggggacattgtcccgattgtctgggtggccccgtgccatcaccagggtcctgaaaacaggcggggggcgggcacggagggactggaagaggcagggtcgccgactgtgcttggagcctcgaggaggacccggccctgcccacacctcggttttaaccagcgggaccccttttgggctctggcctctggagctgttgttgacgcccctgcgttgtggtcctgtgttgctctggcctctggagctgttgttgaagcccctgcgttgtggtcctgtgttgctctggcctctggagctgttgttgaagcccctgcgttgtggtcctgtgttgctctggcctctggagctgttgttgaagcccctgcgttgtggtcctgtgttgctctggcctctggagctgttgttgaagcccctgcgttgtggtcctgtgttgcagcagcggcaacactcgtgcaaactcgcaccgtaaagtagcgagcacaccgcgtgagtgtgagctgtcttccgaagcagtgccgagtggggatagaaagaaggattctgcacaccccagagtgaggaacctcagaccctggagccctcaggctgcaggagtgctctttgtatgttaattattcagggcaaacctttaaggctaaccagaaaagaagacaactggtgtataaattccaaaccagtaaagaggggaaatgagtaagagaacaggtgacccaagacctcagtcaagttacgagcggccagtgacggagacccacacacggaacacgggggtgacggagacccacacacggaacgcggggcgaggtgccgggactcgtccgtggatcatgagccaaaaaggtgcgtgggccccacctgccactaagggcagagtgagccagagcatgccagtcaggtgctgtctgagcgagagactcctgaccagagaggagccacggcagcaggaaagcagagcaacagacaagagcagtgccgcgtgccactgaaagggccaccttctcactgtgcagcggagccacctttgtagcctcgggcccccgcagggcagggccaccactcagtgaccaaagagccccacacgtgggaagcacaagtagcaagaacctggggcaagactgtggggcccacgctcgagatgggagaatccagcccgcatccaccactgcaagtcggatgagcagaaagagcacagacaggctttgagcaacacagttaaactcagcttcgcggacacgtggaccttgtgtctagaaattagagaaacaggctgaggccatgtgtgactgggtcagatatcaactcccaaaagatggattttttttaaatccccatacttttagaaattttataacagtgacttctaaatagctcatgggactcagaagaagtgaccatagaaatgtcaaaaagactggattatagcagaatcgagaaggatcttttacctttatgttaggagaagggctggaggctttatgctgagcatctaattcgggaagttagagaagaacagcaaaaacaaaaaacaaaagaaaaaatgaagaaagcaaagggaagcctacaaaaaatacatgaacagacaccaacaaaattagaagcaaagataaacatggttgtttgagaaaacaaaaaacctcataaaatagacacattcttgtgagaatgatccagaaaaaataaaggcacaaatatacaacattagaaataaaagagacaaattctaaagagcatcagagattgaagataatagaatactgtgaacaactttgtgcaatatattcaaaaatttatgcaaattttggacaacatcctagggagaaagaactcgagactcaagaaggaaagaaaaccccgacagccttatagccaagaaagaacaatcaacagatttatattcccccacaaaaataccagttttaccatctttttctgttgaattctaccaaaattccaagaaaccattcttgtcagtctgtacatatctcccaggtagaaggaaaaaggctatcttctgctggtcagtggcgaacctgacacccgagctgctcaggaataggaaagaaaaatacaacatttcatcaccccatgtgaccttaaaacctacagatgtcacaggtgaagagagtaaagggaaaatgaacctgtaaacatctcagatgatgcaggtattcacaacagaaattcttagaaagccaggagcggagtgaacgcctcatcttgatggaggaattgatctgaatctagagcaggctgcctcctgtgtgccccataaagtcagggctcggctgagagcccccacgtcagcgcttccatctgtgctcagctggaggcctccaccagaagagggacgggcagggagcggacggtgtgcattctcaggaggcagagcagccagcaagcagtgccccgcctgcggtgagtgcgccaggcggcaggcacgctggcaggtgcccagcgtggtgtgtgaatggtcaggcgtgcgggcctggcgcctctggcaactgttccttcttgagaccccctggcccaggtctttcccagccctgggagcctttccactggagaaattactgccattttggatttaccaaaattaaaaccagctcttctcactacttgtttctacactgaggtgagagtcacgtgatataaaattaaccactttcaagtgaacgatgcagtggcgtctggtgcagtcagtccttgtgcctctgtctagctccgtgaccccacttcccgttactgtctcaacagaggggagcatgaagaaggagagcagaggcaaagatcataagaagagaggcacaacacggaaggctgggaaggtaggtggcccaggccccaccaagccccgggcctggggggcccaaggcccggcccctggatggagcgggtcagctctgcctgcaggctgcaccctcagggactcctgcctgtcttcacagggcagcataccccggatcgtcccctcccactgcgtcctcgtcgactcggacagcttcaagtgtatcctttgatgcttcacccgcctgccccagacacggatcctgcggcctagttctccttaaccaaggcccagttgtcgtggacccctacgaggaggcccaaggcccaggtgagtgctccctgccagggaccacccacagcactgggaacatccaggcctgggtgctggcctcagcctctgccctgcctccatgtggccctgggtcagctcttgctgcactgccccggggaaggggggcggtggccgtgtgctccgggacctgccctcactctcgtctgcagccagggcaggtcaacagcatttggcagggacccctgaattgggaaggtgccgcccccgggtgtgggcctgtggcagagggctgcgcccgcggctctgggacaattccttggctctttggctgagctggttttcatatcttcacggaggagggaaggagcgccacccctcccctccccgggcccccttgcccgtgaggagccaggccccgggcgcccgccacaccaagggccccccgtgtccgcaccctcgacgcccgttttgtcaccatcccattctggttgcagaaatgctgactcctgtctccgtgacccgggaaattttggaaagattccgagacacgttcactgcgaaatggacgggacacctgggcaataagcagtttcccaggttggcctctgggctgcgcccacgggagaccccttcccctcccgcgctgaccccttgtttcctcagtcccttcctcactgcccggaggcgcctagagccccagcgccgggcgggtgcgcgcccacccgctcggcttcaagggcctccaggccgcgcctcgccgaggggcgtgtcggggg

SEQ ID NO: 38241 - DNA, 1279 bp, Bovine  19866880434739
ccagtgctcagggccatgtccccactgtaggcctcggcctgggcctgctcccggaactgctggaccctggccagcaggcgggagaagtcggcggggctcacggccacccgagccaccttgcaggagcctgcggagacagaggcacgtccccacactgggcctcgcagactgcccttcaggccgagagcactgcggacggagccctgtgcaccaccagacttgatggggggtggcaagctaaaggcaaagctttgggaccttccccaggagtcagcgccagaaccccgctgaaggggggacggccagagaggttgggaaggaaggcggacagaaacttggcctctgcaatgtgccaagactgctctgcagacacagtgaggggccagcagggaacggggggtcggtcccccggcaggggacaggtgggtggtatcactcctgttgacgttcaggagccgggacaggccctcggggcaccaggaagtagccagggggtcctgggacagagcaaatggctctctatctgtgcttgtaaatgaatgggcaggtggaatgaagtgctgaggctgaggaaggagctggagagggaatgttggggggggtatccccagtgggaggcacacgggccaggctcggctgcttccacctgatgccccctccctacctgggaaagatgcctggatgggggctggcaacctggggaggggggcggtggagaagtctcgggtctctgtgtgtcccgccctcccagggacgccccactccacagaggacggcgctctggcacgactcacgccctgtctgcagtgttctgcccttggcggcagggatggagttgggtttgtcgtaggaggcgccgtacagatgggtcctgttggcgggacgggtggggtcccagaggagcccagaagaggcggactctgtgccaccccccggacatgaggcccttccttgaacctcatacaagtcaggacacggagtcacacagcaccccaccccccgccctgctacccaaggctggcagaccaggggttctgctgcacttcaaccgtgccctttatgccagggctgtgtgctggcaggacgcggcactgtgcccggccccccgccgtcatacccgtcagcctgggcaccctggcagagggacggtccacccaccccatcccaacgggcggcccaccctggccagtgccgtgtgcacagcgaccgccggagcatgatgcagggtcctggggagcagctgggggacaggggagaaggcctcacccgtccctgctgt

SEQ ID NO: 38242 - DNA, 635 bp, Bovine  19866880512534
cagacagagcacgtggacagacctccacagtcagatggaggctccagaacagtcttcagcacagaaggtccctgcctccatcctagcaggggcctggggggctgcttctgggggaggagcccccacaggtgcggtgggcccggcaggtgtggcctcacctggaaggccaggtacgcctctgacagcagcagccgcgcaggctggtacaggtccatcgccagcaggacttcggccttgagggtccacagcagcgggaaggatgttccgtccaggcccctgccagtctcttcgtttaccttcaggatctgtaagatgcgcaggcccagaggggccgcgttgggtgcagggcgggcaccgttggcgtggctgaccccggccccgcatgcccgagcccagtccctgctctggggcccatggccaggctgtcctctcgggacgcctgtccctgctcctggccaggccactgagtagcgccaggtgcaggggactctgcacaccctggggtcccggcactgcccaccacaaagggagccccagggacggcactgccacggtgaccagtgcccttggagcacacgtgggacggtcacttcctttacaggcaagcccaccgcgcgcggggagggcggggggcg

SEQ ID NO: 38243 - DNA, 1903 bp, Bovine  19866880797275
ctcaaagataccactactgtcatcttgatggccctaagcctaatactcggggcgagctgttcctagggctgagacaggccctcccatggctgagtgagaccacctgggccccctgcacaagctcccagatcttcctcactgagctgccctctgcacccagacagcctcagtcctgcacacggactcaaaaaacctgagacaacaacagagagctgtgtgcctgacagacactgcccttccacagccctaggaccaaagaaccaaaataaaatcctgccaaatcccagatttctcttcagctgtcttactggcaggtgccccaagcaaagcaactccagggacacaagggagcggatacacagacagacctttgtgggcagagatccccggagggcgatttgacctaagatgagaaggtgatgagaaggtgctgggctgagggcatggccagcaccacggctgacagtctggccacttggagctggaaaggagccggtggcaattctttaggcatgcacacactcctccagggcccacacgcgaagcaggacacaccatgcagcccgaggtccgaggaggatcaggagccactgaccttcgaggtgggcaccaggccagggggccccatgcctgctgtgtggagtcccagcctctgcagctccctgcttccctctgcaggccagccttcagctgtactgcctccggggacagtcctggaaagatgcccacactctgccgtggcagctgtgagactggccattgccaaccccacctgaggcctctgacctttccttggctgtgagatgggggccatgcagccgcttccctgggacacttcaaggaggcagtgaaatgagatggggacagctgagcacagcaccaggccccccaagggctccccacatttatgccaacacttcccagggcaccctgttcctctgtacccttcaggcctcactgttcacttcctccagaaaaccctgagcccgcagatcagaacagggtgccccgtgccctgtgaactcccgtctcccacttgctgaccctcacccggcccacagggcagccagtacctggtgaagggcccgtggactcacaccaggggcgcctaccagctctgctgccactgcggtgagaactccgggacccgggaacacacccagggtcccgggtatccgagggaggtaggcccgcgtgctgggggcacagagccctgcagtgaccagggctggggcaagacgagaacagagcggcccaggctgcagctcggaggcataagtatgactcgacacagactgttttacacactttatgtgccatcaatggcggcggcagcagcatcccatgtctccgtcctccaggaagactgcactgagctcaagctcagccctgaccggaatccagcaacctgagacatgagggagctgacccccggtgacaacatcccaagcccacctgaacctcatccatcacaggacaggatagggccagcctcctcaaccctagcactgggagcgcagagccaggctcagagcctgggctcgggccactgggccttgggggtcccacagcgtcatgagccggtcagcctccctccagccagacagcagagccccgtgtgtggtggaataaaacgtccggtgtgtggcttcccctgcgaacagtacctggagctggaaagaaggggggcggtcagcttgggtgccaggcctcggccaccagccccacacctgttgcctgggctgcagaagtgatggcaaatgtggtgctttgctgctgcctcaacccagcaccctgatgcagttgggcaacaaggaccggcacccggccactgccacgggaaggagcagcaacagtgagggacccctcagagccagcacacccggaaccgagcacaatcaca

SEQ ID NO: 38244 - DNA, 780 bp, Bovine  19866880942662
cttgtctcatcgtgtaattctatcattaaaaccctaaactttatcatatttccttgccccgctccttctgccgtaatggcccgcgcccatcaataactgcagcgtgggcgcgagatggagcggctgtccgccgaggcaattgccagagagcgggcgaggcctacgcttttaatctcaatatagcaccgttcggaccagcaggaaaaagagttgttttaaaattaattaccttgtcagtagctattatgattaaaaagtgtgcccacatcaatacagcgtgcctaattcaggagcagagtcacaagaaaggccataaaaatcaatgggttaggccttgaagacagaggctctctccactgacgggtgagctcaccgcgtgatgcccaggctgtgggcagggtgccaggcggggcagggcatgttgggcccaccagcccggctggacgctggggccctcttttggtagttttaactgctgaacgtggtagaaaccaaccttgggctcgtctcggatctgggggaggccatgtgctcgggtagaacaacctgaacagcaaaatacggtgggagcttctgacaaccaggcttccctctgagccgccttcaacagacccaccttcctggaagccactcttgggactgcacgcttactctgccccgcgtggcgtgctggcccccagcatgggctgcgggggcctcagccccggggacagtcactggcgtgggctgggggtccacagccccggggatggtccctggcgtgggctgggggggccgcaa

SEQ ID NO: 38245 - DNA, 728 bp, Bovine  19866881251369
acagtgggaggtgagactgggggtggggaccagggtcctggaggggacacgtaagttaggggttagcagtcctgacggtaatagaggtgggctgggctcggctgtgcctgggcgcttcccacccccagcggtgttctgaggtgggacagtcctttcttttcatggcttctgtgtttcccagttttgtacatgagcacacattagcttaacaatcagaaaccaactctcaggacagcagagagccttggagccaaacccggcaggtctgagggcagccaagagaggcctctttctagaccccactaccatctcagggggtcatctccagggcctcctgggatcaagaaagtggcctgggtgcccctcctggtggacacgtgtttggggtcaccaccaacggcctgcgtggaagagtgaaggtggggtggtcaggggcagacagagacgggccgtggccccggcggggagactcagtgtgacctcggtaagcgtccctgggcgggcagctcgtgcccggtgtctgaggccgtcctctgcccccaggcctgggcatcccccagctcctagaggccgtgctgcagctgctgcccctggacacctacgtgcagagcccggtaaggctgctccgggctttggcttgccctctgccagaacacagggggaccacttgccctgatgggggtgggaaggacgtgtgtttcccgaggccctaaccaaccagaggagcc

SEQ ID NO: 38246 - DNA, 1754 bp, Bovine  19866881267359
actcacagctgactccgaggttggggtcttctcactgccctgtggccttggagccgggtcaccagaggctcgaggccggggactggagcagtcctcagagcaggtcatccatgacggtcaccgcgtcctcctgggccgaggagccccgtggacgaggccactcccctgcagggaggcctggcgcccgacccagagcctctgcaagcccagcccgcctcctggcctgcacccctcccaggaccatggcctcttctgagggtgcccgcacccctcaccctcttgctgtgctctgcagggcaccctctccaggcccagagtgcctggggtccccccgtttctctcccgccaagccccgggggtgtgatgggggctaaggcgggcggctggatgggtaggtgcgtcaggggctcagtcgtggtcccccccccgacatgcacacccttccgagggaggggctagcagtgtctgcgggctccgcggggcccccctgcccgccacaggcagagggcagagcgtctctgggggaaggaggcggggtgcctctgtggggacccagatttctgcatcgcggctctgtgtcgcggctctgtgtcgctgggacgaggtgaccccagcctggggcccccgctccaccccacggaagcacctgcgtctgtgctctgctgggtctgacgtcctctgagtttctaggacttgttcattttcctttcgtcttgacgaattaacgggaggaaaatcttactgagaaaaacgcatgtgcttctaccgttctgtcgatagtctgggatttctcagttgtgagaaaccccagggccacgtgtctagtggacgcccccgcccttggggtcctgtgggggtggctggcccccggcaggcgctcctgctgtgcaggcaggcccgcccctccgcttcgttcacacacactttgggggagggaattagtgtaagactgatttctttttcttttattaccaccgcttaaggataatctaaatgtaattaccatgatggaggcataatgccattccaaataattacagcccaccgtgtttaaaactaacagaactctccccgctgatttacgggttcttttggctcaacacgcgtttcaaacactacctctgggagcagcacttcagataatgcgagaccatttttaaaaagcagatttgtgtagtcgattggggccgaggcggttttttttcctcaagcccgtagtgagaaattggttgttgccatagatcacggggcccgctccgagctcttatgaaagatgaattaatcccgctaatgctccgaggcgggcctttcacgggggctgtgtgctgatagcctcccgcagcctccctcttctcaccgagatttatggtgtcttttagtagatgaagctgcttgtgctcacaatccgtctgctggtaaaggaatcctattaacagggtacctgagcgggcacttgatattgtctgctgaacgacgtgcccccacccccgaccgccgtggtctcctctccagggctgagggcctctccgagagtcggggtgggcaccagggggcagcgggccagccccggacgccacgggcctggagaaggcggtgatggccagggcgcccagcagggtggacgggacggtgggaagggcagggggagaccccagccccgcccgcgcagccttcctctgtgtgcagcaagcatctgtgtccagaagcttgtgcacagataccccggccccctccacgtgggtatggaccgcagg

SEQ ID NO: 38247 - DNA, 1446 bp, Bovine  19866881410576
cactgccatcagcctgcagccccacgagtcgggaaacatggcgactgaggacaaccagctcccccagccggggcctgacggacctgggcacctcccagctggtctgacctgattgcatcaatgcctgctgctaccgggccctcacccaggcccccagggctcaggaggcactcagggacgcgggggcgcctggcgtgagccgctgaccagccgaatcctcactgcagcctcctgcccccgcttcgtagcgccccccgtgactctgcggccttcttcacggggcgttcctgcagtaagcaaaccagcgagcgggagggcgggaacgtgcccgtcgagggccgccagctctgctgtttacacaacacgaccgaacgcacatgacttcccacggcgcctacctccaccacggacttggaatccagccggaagttgaaatcgccgaagacaaagtaggacgccttctggaaccgctggtcgctgatcctggaggagaggagggaaggggtcacaggtgcagccacccgccacgcccaacctcagccctgcgccagccgcccgccacacccgacctcagcctgcgcccgaggccgtgatcccgccagcagagccccggccacgctggccttgtgggtgaaggaagtccgcgccggtcacctctggctcaaagcaagatgggagctgtctctagcaggactgcccgcaggcagacaggcgccccagcatggggaaggtaggctcggtgaccgggcccccaggctcgctgcccagccgcggctgcacagacgcccccactgagacggggcggcggggcccctgggcccagggtggggggcgccccctcagcccgcggtgggctctgagaaagcacgtgtcaccagcaggcagagccagggagcaccactcacccccgaccaactcagaaatgtccgcccggttaccccgaaccgggccccagtgtgcagagcgagggcagccccctggagccgtccttcccagggacttgttaaggaagagctgaccaggatcagtgtcacggccgtttcatggtgctgggcggggggccatcatctggtgggcagctctgcccaaccatccgcccatccatcccccgtccatccgtccccctacagccgggaaggccgccggcggctcctctcacacacgggcccatgctctccccgccagggcccctgcctggctccttgcctcctgtgctgagtcccaggggtttccctggaaagagcacctgagccctgtgctcccggcactgccccggggccttgagttccttgcagaaaacacgcccccgttcccccgctgggcctccggcattctcccccaagctggctcctctccaggcggagttggcggcctttaatccatctggaattgctctggaggactggatttgagtccatgggtctctccagcagtgattgatcctaa

SEQ ID NO: 38248 - DNA, 4403 bp, Bovine  19866880415653
atctggtaagatgaagccgcaaatcccagcaaagagagacatgaaaatatcttgtccttggggcattctctagctgctgaatcatgcctcgcttgacactagcactacccagcagtaatgataatcaggaagagatatttgggcatcttgacaattagtgtgacatctctgagcttttcctcccagaaaatagatctttaaaagttctcttcttcatcacaataatgctttgaaaaataaataaaatttaaatccatattcaactaatgcttacaggtcaaatttatgaaaacaaatgttgctatctttataagtgaagggttttattaattcaaagtattactgtaagtggaattatcagcgttgacttgattactcatcttccttcttgttcagctgcaggtctgcaatgttgttgaaatatgaagctaatgcatagaaaagtggtttattttctacaaaatcagtatccaaggggaaaaatattaagtccatgtgatctaggaaaaactaccctaagaggcacttattgttaaaattctagcttgactatcctatctaaatctttcaaaaatgtttctggctctacagttttggttaagacccaggttaacacaggcttgtcagaattgctttcttcagtagtaagcagttagatcaggaaataaaccacaaaaattccttaattgctattcatctaagtcaggtcttacactttggctgaaaaaaaataaaccaaaggaaagaaatgcctagcagtctttttctgggtattttttttccacacaagctaacaaaaacaccttaaccagcaaaggagtcaaagaatagaaaagagatctctcttcaaaccttcctttctaggtagaattagccatttaagctttgtccacattagcattaagctagcaaggctggagagtgacttaattcatatcactttgccaatttgtttacttaatattaatcccatgtgttttagaaattggtctgaaccaaattgcattggaattgctccgaaaaggctaagtcacacctcaggagcatctttaactatttattataataatttattcagtttttaagacttataatgagttgatttgtaatgaatttataattccaaatttataggatgttaatatatcattgggtggttgaacatgggccatctctcttgtgtccttttggtatgaacactgctgtttaatatccagtcttaaataggagaaatcttttagagaatttcaaacaagtagtttgtgtgtgatgagttcatggttcagacacagacctcaacaaggttaaccaattaacaaatagagactaaaaatgacaataatgcaattgctatttatccctccctatgggccagacactggagaaggaaatggcaacccactccagtgttcttgcctggagaatcctagggacaggggagccttgtgggctgctgtctctggggtcgcacagagtcggacatgactgaagaaacttagcagcagcagcagcatacttctggttgggccaatacacaacattcagcttgctattggcttttctgtttgccaggatttgcttctttgttttccttttattataatgtgtataataatgtacatttaggtgtgtgaaaaaattagcatagcaattcaatattagcatagaattttaaattagcatagaatttcaagcacaacactcaagaattattgatgaacctgggactttcttcagattacagttccaggacagaaccctttcactgaatacaggacagaaatgaggcagagaagagaatacacactccttggctagccatggggctcactagctgcaaaggtgaagtttgagcggctcaagaaggtcatgagaaccctttggcctgtgcagctgctcctctgagatgaagcgtgtcaactggccacaggtattccatgacagcaaacggtgactgtatataggatgtgatttctaagtttgcaatgcattcatcctggggtatgtgcataatcccatatgatcttcccagtggtcacgtatggtagtgaaagctggactgtaaagaaagcagaactccaaagaattgatgccttcaaactatggtgctggagaagactcctgaaagtctcttgaacagcaaggagatcaaaccagtcaatcttaaaggaaatcaaccctgaattttgatcggaaggattgatactgaagctccagtattctggtcacctgatgtgaagagctgactcattggaaaaatccctgatgctgggaaagattgagggcagaaggagaagaggccatcagagggtgagatggctggatggcatcaccaatgcaatggacatgaacttgggcaaactccaggagatggtgagggacagagaggcctggcacactgcagtccacggagtcgcagagagtaggacattactgggccactgaacaacaacatatgcataatcattatgcttacagtgcggtctgagtttttgtatccttagagataatcaaagcctgactttcttctccactgagtctgctgcaggggaatgacagtgctaggaagcacagaaagcccatgttttaaggtatcttctccaggttgcactgaccgttctaacaagggtggaggtggactgggaaacttttgaagggttaagatctcagcatctttcagctgctttccttttgctcaaatttctcagggccagggcatttgcctttcagtatgactgtgctgctctcgtttgggctagacgtcaatagacaagcatcaaccgattccaggggaagcctcttctgctactgagaaaattctctgtaagtttcctcacctctgtttcaatgccaaacaagattttttactgtgaacacttgggtatctttcctaacaaagctagcttcctgtatgaataagaatacctctgactcagaatgagatataatctttcaatgccctttctatcagggatcttagtactggagctctgacgatcattagtgaaatgaaatttgtcttgagaataaaaaccgtcgcagagagaaaaattatgcaatctggtaaaagagaggcctagggagatgagtttattttctaaaatgtttcagtcaacttaaagaaaaaattgaaaactacattaattcaaactgtgataggactggaacttgtgggaagtatgagaaatctcagcaactttgtagtctatcggcctggacatcatgccctgaagaggacaaggtgaccttctccacctaactctgaggatggggaggagagagaggacattgaggccttggcaggacctgtgcccactggctggaggtgctctgcttttatttacaggttgtgattctacactagatttattggcataaaagagcttttgttgtcacctaagaaactggtggctcacacagtaaagaatcctcctccagtgcaggagacccagatttgattcctgggtggggaagatcccctgaagaactatccactccagtattcttgcctggaaaatttaatggatagaggagcctgtcgggctacagtccatggggttgcaaaaaatcagacatgcctgagggactgagcacacacaggagagacttagaattaacaaaattgatttgcactcatgattagtgtgacaccctaattttatacctggggcaactgagaccctagaagatgaagtggtatgttccagggtctccccactaatagatgacagaggtttcctgacttcatctattactttccacctgcctatatgatggagtgttttgctcataagtcactttttttgtgtatttcagcctttttaagattttaatatttttccacttttattgagataaattgactgcagcactgtataagtgcaagctggccagcgtaacaacttgacttatctgaactgtgaaatgatcgccatatgaagtgaacacccacaaccttttatggtgtacctcagtcctactgcagcctcttgggcctcacaggcttatggacccatgtttagatccaaagcatcaatgcagcaggggattctcctcatgtgaggaggaggcgcctccctcatgtttgtggtactgaagttaaccaaaggtcgatgctccctgatgtaacatatactgccaagacattctttgactgaggaaggtacattcagtcaatcagactctctggcaagaaggaaaatgtgcctcctgtgtcaccgggcttcttgtaccagtggatgacagtgatgtatttacaccagaaccttgacaagcggctgacagggcttcagatctcagaatttgttttagaaggacaaacctattaagagcactgtccttgacaacctggatccttcagacttttaggtctgaatgggttaacccaaacggacttgttgctg

SEQ ID NO: 38249 - DNA, 1293 bp, Bovine  19866880418917
tatatatttgccaacaatgaatattaatattcttaatttttaccaaattgatgataaaaatttgttacattaatttgtatttccctgattactagtgagattgatcatcatttcacctatttgttgcccatttatgtttgcattaattagaataagcagtaattatgggaatctaaagactagattttagttctaggtttgtaattagcttttcagactttgatgaactaaatccagctttctgaacctcagtttcttaacctgacagatagaaataacaatcccagtcctgtctttctccacaaagttaatatgatggtttggtcatattaaataatatggtaaatatatttaatatttatggtaaataatatatgaaaaagcaagtggaaaactccaaaatactagacaaatgatgggatttcttttagttttaaaaaatatgtgtaatattgaatagttctgtaattgggactcttttctaaatagaataaagctagtatgttcagcagctaatttacctacaaacttcaggatctccccagacaagctgtgaggaaggtagaaggcacagttattggttcagctccaacacttcttcccattgcaccctggtggggtgaccacaaaagaaaacctactccttgtgaaattcctaatccaagtttgttatttcaaggagttaggatagggggtggatcctctcccacaacttctctggttcatccatcaacaacaacagaccatctggttaccggggaccagtgaggcataaaatgcctagaaaagcagctgtctttccctttacctgtgtcagaattactaattaagtaacaaatttgcctttagctataagtgaaattttgtgctgctgaaactagtgcagcttttttacatgttattaactactcctttttgtaactacaactcttcctataaaagaaacttatacttcatgaaaccaggataaaaattctcatctggtcatctcagtttttagggtgatgtattcaatcattcatagaagcctctaattgttatcttacctcttgctttttaccttgaagtgaggccaatctgcttgtttatgcttagtttctttctcccagtatgggttcctaacatgtacataacaaaattttcatttctaatttttccactaccaattcaaattgctaatatatcatataaaccctagatgtgagagcactgtgactgagttgtattacccttcacatactgtaaaactttgtagaaatataaataggccattctatactcctaaaatgttag

SEQ ID NO: 38250 - DNA, 2112 bp, Bovine  19866880421921
acacactagattaactgttaatttatagacttccattacctttatcaaataagtaataaataaactacatctcagaattataaaatgtttgccaattttgtttctatgtcaatttaaaccttatccttaaatcttacaaaatgaaaacatcaaactggcacatggaaattcaaattaactctttcaagaggaagggagcagatattttgagaagtggtaactatataaacatgacgtttctagggattttttaaatttcttgtcatgtttatccaataatactgtttttctacacctagattttaatatcaaatcagatctagttgaagctattcccttagagtacaactttacataaaaatcaatttcacagagaaagttgtaaaaagtaggaaagcactatacaatttttattcaaaaatttcatgccagaagtacatgcttcactcctaaacatatccccttcctttgaattatatatcctttaaatactaccaaactctacaaagatgactgtaacaatctgtttcacacataacttggtttgtacatacaaaatgcttgcttttggatacttcttaggtatgttaaaggaacaacatactttaataattgtaatcatcccatcagtcaccaagtacctgataagagtggcttacctcaatttaatttttaccatatgcagaatcaaacaaatttgctgctttttttctgtttataattttgtttatttttttggctgtgctaggtctttcactgctgtgtgggcttttctctagttgcagggaacaggggctcctctccagtgcatgggcttctcactgcagtggcttctcctattgcagagcacaagctctagggcagtcaggcttcagcagttgtgattcctgggctctagagcacaggcttagaatttgtgatacacaagcttagttgcccatggcatgtgggaccttcctggatcagggattgaccccatgtctcctgatttgacaggtggattctttatctctgagccaccaggaaagccctaaatttgctttcttatgaaaattactttcgcaacaataaatcttactttggaggagaaaacttctgaatgacttgggaagaaagcaagcaacataaaatatttcatacctgctttatggcagtaactgttattacaaagaacaacggaagtccactggtaactggactggtaggtgtatcaatcataagctgcattaaaaaagaaagaatgcagagtattatattttatattgtacatatcactattaacatgtagaatcttataattattgggaaatctgaaaacattatacaaaatatgtatcatagttcagatgaaaaagtaacttgagagagattatgcagtgaatgtagtttacttcacagtttcacaagtatactctgttagccattatatggggttagtagactatctaaatctattgcatacccacaaatactgctagagtggactcagtttctctgctttcttaacacatagagtacttaaggtcttcctcagtatttgtcttggaggggagctacagctattcagaatttcaattcacatttctttgcccatccagagaaatgctaaaaaaaaaaaaaatctgtcaatttttattctgggatccagaataaactcacactggagagaaaacaagaaatgggactagggaaacggtttccttctacaagtgattttgttacagctagtagagccagaggggtacaacttggaaaacaaatgatgctgcaattatctaaatcatacaactgatgtttcaataaactgctttagaagaaatatttgcagtaattatatttggttatttagaacatgggtctaataatttattaatattggtttactctggttaggccaattaagtttgttctattccacagacaggctgaattcctgatcttaggcagtaatttcacaaatgcatgttacttgtatgtaataagtgtaaatttctcatttttttgactaaacaagctgatggtctactgattaaaaaacaaacaaacaaaaaaaaacccagaagttccttttccgctcacaaagggaagcaattaaagaaaagcttcctcaag

SEQ ID NO: 38251 - DNA, 690 bp, Bovine  19866880578427
ttaggtgatttttgagattctgttttattcttgtcctctttgcatgtccaagtatgtctatttcttagctagtgatacctacaaaatatgactagtttcagaactatttccaacttcttcgttttgtcttgtatttctattgtggcactaattactagcaatatgattaatgcactacttacccgtggctttgttcccttttgtttttccgataatgctaattaatccaattttgaaaaaaaaatttttcagttctgctcacacacgtcagattgcaggtgcctttgaaatcactttttcccctttggttttacattaaagcaaagagtaagagtagaccgattagtgatacggctgaaaatactcctatcaaagttgttcatcggggaatgaccaggaccggtagtgttggggatggctctgaagtaagaaagtttccatttactaaaaagttattttgccctttacttatcttagttactgtatgtgtatggttacctaggtttgggggcaacagacttttaatatttccaaggggaagcacagctgaggatggctgccaaagacatggtcatcaatcagattcaagcagaatccactcagcctcgcccctctgagtgccgtcagtcatcctgccgctctgtcctcaccaggtgctcatttggcttgccgttgggagaccattttaag

SEQ ID NO: 38252 - DNA, 3501 bp, Bovine  19866880615646
tcttttccaatgagtcagttctttgcatcaggtggccaaagtattggagcttcagcatcagtctctccaatgagtattcagaactgatttcctttaagatggactggttggatctccttgcggtccaaaagtctcctccaacaccacagttcaaaagcatctgttctgtagcactcaactttctttgtggtccaactctcacatgcacacacgactactggaaaagccacacgtttgaccagatggacctttgttggtaatgtctctgccttttaatatgctgtctaggttggtcatagcttttcttctaaggagcaagcatcttttaacttcatagctgcagtcaccatctgcagtgattttcgagcccaagaaaataaagtccatcactgtttccattgtttccccgtctatttgccatgaagtaatgggaccggatgctatgatctcaagttttttaaatgtttaaatgtttaagccaactttttcactctcctcttttactttcatcaagagttaatgagttcttcatcatgtagtataccttataccttctcttgtttttaagtttacaactcagtcccttgttttcttgtttttttccctcccctcctaataagcttttcctgaaactctgtctgcaggtttatgaagatagattacagtctgaacttggtgattgagatcatatcggtcttggctaaatattgtaccataacagacatctttgggtaaaagtagaagcagtggtgaggcaacattaaagacagacttggcaacgcaaaaaatttcagagaaatttgattcctgtggcgctaccctggaaagctagttccaaatgatttctttcattgcttgctgaaatgaaatgtttgccatgaaatactagttcccacagctaatttgtttgtttctcttttgcaaagtacatcccttcaccaagttttaaaccataacttgttttattacattttttattgacattttgcgtaccagtatctcagaatgctgctttgggtattgctggacagttattggcttctagaaggtgtataacttataaaagttatgatttttgaactgtctccgtgtaataagggccttcttcatttctatgataatcagattgtatttaaatagactattgattttgtttcactctattaagcaagatagctacagacagaggcaaaaacataagtaggaagagtctgttttggagacactgatctttggccacgttcttctggtgactcctttatttcaagtatattagtttcccagggctttcataacaattgccacaaacttctgtggcttaaacaacagaaatttatcatgtcacagttctggaggctcgagttacaaaatcaaggtggggattgtttccttctgaggatcatgagggaagattctgttccaagcctcactctttagctggagacagagttctccctgtgtcttcacttcgtcctcactctgtatgtgtctgtctctattcagatttctccttttataagaacaccagctatattagattagggtccactcgaatgataccaccttaactgattacacctgcagtaaccctatttccaaatggggtgacattctgaggtacttgggatcaggacttgaccatttgaattgagggggtgggagggtacacaattcaacccatatcatcagttttccttttttattctcttccttcctcatcacaccaaaatctgcaacacattcaggaggtgataaatcatagcttgaggtgttacatctccaagaatacttacattctcttgaagtcttacattttaataaacctggtagaagaggacatgaggcagggtttatttcaaattatttgttttttattaattaattgaataattacttaattttgtagggaaggggtcaagtataaggtataaggaatgtggtaactttgggagaatcttattaggtggtcacttgcctatttcacccaggcactgggctattcataataggaaactttcttcaactattttaaaggaataacatagtgattagaaagtacatttggaaatgtacattggaaagtacaaagcagtatttcttaacatgtagaccttggactacctgctttaaaatcgtcttttaaattgcaaattcctgggcctagtccaggcctaaggaaccaaagtttctgaaggtgtggtccaggacctttctaataagtatcccaatgaagtttgagagctgttaacacaacaaaacaagacagattgtacaaaagaatctggttaatttacaggcatactatatatgtatgtgaccatgttgatcaattttctaatctttccaaagttcagagactggagttggaattcataatcaataaggacttgctcattaccttcaccttttgttcagtaaataaggcaggaaagactgtgcaaagttgtgaaaaaccattattttctttcatatgcacttttgtcttacaataaagaatctgtgaagttggctttctgacaaaggagagaggattgtgatcctgaagagcaaatggttgctttctacatcatttggaagtgatgttttttccctaatcaactcagctttaataatccaagtgaccactatatctgtgctagactgcaatacaaattagtatatataccgactacacctttgaatttaattttccttttaacacacagacaatatgtgttgttttctccttacataaaatttctttatttttgctctggggtgaaaaaaatccctgaaaaccccaagtatttaggggaaaaaaaacaagaagcaatttaggaaggattaaaagcaattgttctgttacccttggcaacagaatctagatgcagccaatcaacaaagttgatatattgttttgacacacgtgcacatatttctaacataaatagcaacagagacctaataacagtaggttttaaagctggaaactgatgtcatttcaaatgtgtcaatcaaagagaacctatgaaagtgtttttttccttcaagctgacattaaatatatgctgtaatggcttcttaagtgatggtagacttctgtcaggccatacaggagatgctcaatctataattacactcttgcttcttggaatctgtcctttaacacacctcaaaagagagaggaaaaaaaaaaaaaaactttaataagaaaaagtctgagtcctacagtaaaattcatctgttcatttcaccataaagtatgcttataaaggatgagcaaaattagattagaattagcttgtttatccctaaaatagatgcatttttttagtgtctctgtctgttgaatttatgatcaacttgtgccagtaattctgctatttaaattttttaagtgcttcaaaaattagcatttgaatagaacaatagaagagaacaatagtactaggctgcccataggaaaataaatagggtgattggtacccaggactgagacatttactgctcaatataaaagag

SEQ ID NO: 38253 - DNA, 923 bp, Bovine  19866880632849
cacatgaggataccattcctgttcaatatttatttgagcttgtattccagaaagacttattcctctgttaggtttatgcacttccccattcctttctctctcttttgaaggttagatgaggagttccttgtcatttgtcctaaaggaccggtgttttcttccttgaaatagtagctggagcctgaaaatggtggattcagagacacacaaattaaacataaaagtttaagtcatgaaacaaaccatatcttacagtcataccctcagctcaccattctgcaaccttatctttttttttaacttaccatttttaaaaaagcaataataaaatacccaatcagattttgtatcactgaaatctttctcaactggaggaacatttgcaatgaacttttttcccccttaagattaaattctttaaaaacaaattcacttttaatatgaatgttatgattcacagcacaaaaaaaactataggcacgttatagttgtggaaattattcaagaatgaactattcttagaaacatagaagtgatgcaaacctgagcttttagaaaatctgtaacggcactttggcagggatctctagtggattctactgaccaaagaggataaataaaggtcatatttctgcccagttcattagaatttacctttaattttatagcaaactataaaattgtttgctataaaaactaggtgtgtagtggctaccagataacagggacctctgtcataaactctggtcatttaatccttagagtaaatctataaggaaggtattattattctcagtttataaatggaaatactgaggctgaatgatttgtcagagttttactgccatgaaagtttcagaggatgtaaaatcaggttttctacctctaaatttggcattcttttcactacttaacacctctta

SEQ ID NO: 38254 - DNA, 972 bp, Bovine  19866880645335
ccctgtcagccacagcagtttgtgtgttgtctgtaggcgtatgtaaatgcacatgcaaagggtaactgagaataattgataactctttagaatatttgtcaaggtagattagctgggtttatggggaaaatatgtccaggaaaaaaaatgtcactatgggtagtgacaaagcaaaatgtggtgctagtgctgtgacatttcaaacatttcagaaggcagttgaaaccgttaagccgggactcaagtgtaactaatatagtttttgatgagattgatttctcagctgtcttgttgccctaggtctttactcctcccacagatttcacagtttgtgcatatcaggttcagtcatttatctcgtgaagtagttatcatattccactattccatggctaatcatggcataagcagttagctcttttcatcttccaagctcttaatagcagttaatgaatataaacaaccccccttaggagataaattaatcacactgtaacagtttccttttcaccaattgagaagctgaggtatagagactaagtaattggcccaaagtcattgagaaaacaatatttgaagatggtggtgacccaaggagctctgagatttcaaacttgaataaaacgtttgcttttccatttgtctcttgtacatcatggcctagtggtaaagaacctgcctgccaatgtagaagaagtaagagatgtgggtttgatccgtgagtcaggaagatcccctggaggaggaaatagcaacccactccagtattcttgcctggaaaatcctacggacagaggagcctggcaggccatagtccctgggactgcaaagagctgaacatgagtgactaacactactacttatatcatatataaaaccattgactaacactactacttatatcatatataaaaccattaaaccaatagcccagtgggaaatatgcttgttctgctacctacactaagagca

SEQ ID NO: 38255 - DNA, 1038 bp, Bovine  19866880646632
gaagtccttaaaaaaaaagaatgtgaaaacacatgtgcattaaataaataagattgcaaatctggtgagattagaactgagcacttagagaaactgacattaaaggaacacaatctataattcggaatatgatagaaatgtctcaactggcattgtgggctgattgttgtcagtatgacaagtgtcctcatctgaagaggagattataatacagacatgtacagaggagagagcatgggaagacaaagagaggaggccatcgattagccaaggaaagaggcctcagaagacatcaacccttgacctcagatttctagcctccagaattctgagaaacaaatgtctagtttttaagctaccagtttttaagtaccagtctgtggtactttgctatggcagccctagcaaattattactattataccctttgacactcttgctttgtgttggaagacacgagcgttgtttcaacttcttgtactcaatttggctctgcaaatgacatgactcagaataactgacaagccacaagagcctcatttctgtctttcagtatgagctgagtcaggtttgatgctgagagaccttgcatatatcttgaagtttatccttgagtgggaaaaaagaaaggatgcttattatatttagatagcaagagaccagagagcacagtcaatccaaatcatcttgattagttgaacaaagagctaaactgaagtagaggaaaattcaaaagatttaactataagttcttgaacttggactttaaaatgtcaattgcacaagtacaggggaggcgagaagttgttaaacagtggtgtgtattgaaagctcataatgagtcaactgaatggtgagaatgcccccaaattcagtgtgtttataagccatcatttatgggatccttattttcaggggttcctgacaagataaagagctgcctcatgaagtagtgagtctcccattgctgaaggtatccaaggaatgacccagtgaccagttttcacttatgtggcagagggcacatagttaacttga

SEQ ID NO: 38256 - DNA, 1688 bp, Bovine  19866880652666
cctcaagtcagtgatttaattattattattatcacattatagttaatgtgaggaaattggaccacaggaaatgaacccacctaaattaacacaatctgtgaactgggcagacagagtttaaatttggttccccttggtagcattttctgcctgagtctctgtgtattttacataggtgttatcacagtgcatggtttgttcctttttccctattatgttacatatatttaataatcattttttgataactacgtactgtttcatgagtggttacatcaccatttgcttaacattttattattgttaaactttaaacattttcaaattttggaaagatttttttatgtgaacttccccgtgttcttatgagtcaatccataggagaaaaaggatatgaaatctcttacaagctatgttattaaattctcttttgtcaaagatatgaggatacttaatttatcacattcctgtcagcactggggaagaattatcaaagcaaacaaacaaataaaaaaacccaaacccaaaaaacatagatttgtaggcaatagtaagcttcctgtgttaatatgttttgatcttaaattcgttcgtttgttaaaaatatgtttattgagtgcctattaatcttgggatgtatcagtgggcaaaatagatagtgattatctgtttgacaattttactcaaagatttttattatatataccactatagcaacatgtagaaggcagattgattagaggagagaaagatttgaggaagggagaccaggttcggatgatatactaatagaataaataaaacaaatatttagcaacttagccattaaaaaaagacaaaagtggataggacatgacaaaagtaaaaaaaaaaagtacaaaagtaggatatgtagtatcacaagctccatgagctgtttacatccttagtaatagtgggatcttcttataatgaagatgttgtataaagtgcccatcccagggaattccctggcagcttagtggttaggactctatgttctcactgttaaggccccaccttcaatctctggtcagggaaggaagatcccttaagtctttcgatgtggccaaaaagaaaaaaaaggtgcccataccaaatagtgaaatttaataagaaccttgtaggttgaagggagagattgtcagaagtcactttcacacatatttctcttcctacttttaatcctgtggctcttgggttgtcatgttttatagcttcaaatgaaggtagcatttcaagcaggagggatttggtggtggtgagagatgttgaaatttgagtttggtagcctaacaataaaactgagacagtattgtcccatggcaccctgaggtaggagggaaggtggttattcatccacccatttctggctacagcgtagcatcctatagccagagagttggttctttattttttggccatgcggaatgtaggatcctaattccctgaccaggtaaggaacctgcgccccctgcattggaagcctggagtgttggcagagaggtggttcttgagtgtaagtgtcgcacagttaaagtctgcttgaaagtggtcatatggtaacacaatccactattgtcatcttagagggtgggctgagaagaaatcaaccatagcctgtgtttccacagaccacttattatttgagacaaaaatagcttgcaaaa

SEQ ID NO: 38257 - DNA, 1298 bp, Bovine  19866880689062
ctgcctagaatgctaaccagatttccatttcattgagagtacttctgggcacatttgaactatatcccaagtctttaaatctgcagattctaactaaaagccaggacattaaaatggtacagctgggatagggcaaggaaaatgactgcaactcaaaaatcttcaatgcctcccccattccctacagcaaaaaatcaaaatttcctcatcaagcacatggtagctttccagatttatcccacccactctcttcaaagtgacttttgtatcaacataacataccaataccctgaaaggtggctccctgcccctaaatcatacgtttgactgtagtaatccatttttcattaaggagatcttaaattatctatacaaactggataaacttccctctgaaaccaagtaggaaacttcaaagtaggaagttctgatgtggagaacattctaaaacattctgcatcgaggaaaggacttacccttgagcaaaaaggcagttaatcatgaaaccctgaaaaaacactttgttttcacagagaaatttctaccaatatctctttctagaattttcttagaatcctatgagaatggaatatagggctgctcatatacctgctccttctgacaccaacctcttcttcatccctaagctccagactcaggactaaaacatcctgaagtatttaatgagtttttaaggcctttataatatttgattctaggcgtctaagtccccctacctaagggtacagtcacaagtgtgtgtgaacctgtatatgtgtgtgtacctgtatgtgtgtgtgtacctgtgtgtgtgtgcatgtgcacatgtgtttgaacaggcgtgtgtgtgtatggatggttggtcagtgcgttttcatgttttgggccagatcatcatgatctgtatatgccatattgcctgctattactaatcctgggacctaccctaattcttggagttcttgtcccatttttcatttaggataacaagtatcttgactgtaatctattaattgaataattgaataaacttgtttccctccagcgtgagcatattgtttgcacacagtgtcatcctgggccctccagctatggaaggcctgccagatatgtttattaaaccccctgtgcttggaaagaacacagaaaactgtcatctagagcaatacaaaagtgcctatctcagctggagatctcgcagttatgaataaaggaagagtttgtggtacagttttgagatgtaaagagaaaaagcttccccatggtgcaaatgtgttgtaaccctccggcgagaaaaa

SEQ ID NO: 38258 - DNA, 904 bp, Bovine  19866880690012
tagtccatctctccccagaatcagcacggttctgtggcaagactccatcaaatcagtgagtgagtgctgttcctgttctgcgggatgggggctctgagtcagatttcagtgatttagggaaaataaagaaatatgatatttcctgcgtggctgtttgtgaactgaaattcattcccacaacagataggtatctgggatgcgtgactactacaacctgactctgccaatttgggtgtccaaaggggataaattcagataatcatcccctcttacagaacgaggttttatttttacatgagtaagtggggtggagaggtttcaaaaaattacttattgggaacagttatcccatttctggcaagttagggaatgttgtctagtgagttaagcttcaaagtatggaaaaatgataatagaggaaaagtttggtaaattggaatggtttattaacttttatagttacaatattacaatctagtcaggacttccctagtggctcagacagtaaagcgtctgcctacaatgtgggagacctgggttcgatccctgaatcaggaagatccgctggagaaggaaatggcaacccactccagtattcttgcctggagaaccccatggatggaggagcctggtgggctacagtccatggggtcgcaaaaagtccgatatgactgagcgacttcactttcttttactttcaggaggaaaaaaactcattttaaaaaaactcacaaaggaaacaacacaatcacatgctggattaggagccaccatcatttgaaactttgcttcatttaacaggatgaaaactgaacaatcacttcatgtttgtggaatattttatcactgtttattaactgccaaaatgtatgtcaatatcaaataaagggcaaggaacccagaa

SEQ ID NO: 38259 - DNA, 2282 bp, Bovine  19866880692645
atgctgctggtggatagttttgaattttggcttcatgtttggttcaatgtcatttttgaaaagaaaataattctttggtgttgttatttacaataccactactatcattccaactctaccattccctattaatgatcagtcccaagctgatactgttactttattaacaccaatgacactgccaatattcaagttatgttcacttatttcatattcttctttccttcctttcctcttcctttctttttttaatttttacttttgttttttaaacagtccacaggaacatcataactgcattctcctgggcattttcctgtgatcaccgagccagaggggagtacatctctatgacatcaagacttttagaggtaggtgtggtctgtcagctggatttcctggccctggctcagtgataaagaatctgtgtctgcaggagacttgcaggagacatgagttcaattcctgggtcaggaagatcccctggagtaggaaatgacagcttactatagtattcttgcctgggaaatcccatggacagtggagcctggcaggctatagtccatggggtcacagaagcatcggacatgatttagtgactaaacaaaaccaatcaaatgaactgtaggtgttagaaggatctttgctttttttactctagttgctctgtgacctaacttttcacttcccccccaactttactgcccttcagacttctacatccattgtctgatggtcaaatgtggaacctggggggtcagagaagaattaaacccttttctccccaatgtccttcttcttcagggagaccatcaaaaaagccaatggagaactgtgtcctaggaataacgtcagactttatgaaaatcatggggatcaaggacttcaaggagggtgactgctgatttctctggcactctttttccttcaggacttttaggaaatggactgagtagtatgtgcggttgtgtctgccaggacatagagactacagccacaagctacaagctctgtagagaaccattgactggggaattggttgttaaaatattaagtgaaacaggcagttgaacatgcagtgagttcacttacaaaaggaggaatatgtgtaggtaaaagatctgaaataaaatgaagtattcacagctgcatgtgaaattatagttgatagttttcttctttgttttttaacatttgccaacccacaaagagcgtggtaatttttatcaatagagggttaaagaaaaagcctttaagaagaaataatgtagaggtaggaattgtgcttctttcatttcaccttgtggttaatgaatcctacagtggacatctagtcttgcacctgggttgtgatttatcagtgtggagtctggagcctgctctagtgctcctggggcagcagaaatcaggatatcttggagacctggaaatgaatccctaacttatggagtccaggggcttgtcatggtaatcaagttagttagccctcttgctcatttcagtaacaggatcataaagtttcagacctaggaggatcttgaggaatcagctatttgggttttttttttttttttcatttttgtggcagaaccaggatgagagtttgatagtaataatgtctacgctttagtaatcatgtaccaggaatgatactaagtactttacatagattactctttaatcacagcatcaaagtaagcattatccctaccttgatttatagacaaagtagctgaggcatatagattactccaaattatccagttagaggccatggctggttttgaactcaagtttgtctggttctaaaatgggctcttactaggcacagttctgtctctttatttgtaggatgagctaccggattcccagtcttagatctttacctcttgtctccacatagaaaacgcaaggtctgttttaacctgtgtggagcagatcaaccccccaaaaggacattgtccttgctgcggtagcctgtatggtcacaaagaagctcactctgtagtttaaaggcccatgtttgctattcttcaaagcagtgtggcctcaggccttcagcctgagctcagacttgctttcctttactcacgcagttccctttcattgtgagagctcccattcacagatggtggcagtgaccagccagagtgagggtgtggtgaccaggagatagtcaccagtgccccagctggagggagggagctgggagagaagtcttaaggcttcttaaggctgtagcaccctgaggcctctgctggtggtgactcaggccaccccct

SEQ ID NO: 38260 - DNA, 691 bp, Bovine  19866880700815
atattggtctctcctcctccccgttaatagtactaagttacatagaatttttcaatttacaaagcacttttctttaatatatcctatcatttatgagttccttctttgtggaatgactctaagactctctatggaattgttgttcatgcttccctggtggctcagacagtaaagattctgcctgcaatgcaggagacccaggttttatccctgagtcaggaagatgccctggagaagggaatggctacccactccaggattctcttgcctggagaattccaagcttttcatactggaagagctggaggcatgcagaaaacaccaccctaactggagcagtttcaagcacaagatggactgagacttcaactaccctcttcaaaagagagaaggaagaacccagcagcagtggaggaaatctgggaaagcttatgggctataagactggctccgtcaggacctcagttatccaatacatggtgtacatagagtcactatttgatccaaggcagtactctagcagatctaatttggtggatggaaatcagaaattagagtcttaaggacagttgtcaatcaaagtcatttcaggtgacagcactcaggtcatcagcccacttaaaacatatgccatgaagaggagaccaaagcagtagggtccttggagccaagagctggaatactttttaaa

SEQ ID NO: 38261 - DNA, 1684 bp, Bovine  19866880712966
tgccctttgctcctgccccactccgttttcttgcctgggaaatcccacagacagagaagcctggcgggctacagtccatggggtcaaaggagtaggacacgactgagcgactgaaccaaccatccatttgctcctgctctgtacaagcacaccagggtcaactctggctctgaccacctactcatttggctccctgccacataagaatctacactatctcattacattcctccacaaatatctcccattttcctcacctctctctactattctcaatacacctctctacttttcggtcattccacatattttaaacaaaattccatgagagaagagtgtctagctggtacatcttacttaataataactgagttttaggtaataagtgctgttacatgcctttttttttttttttggcatatggttttgttattcttagaggatttcttcatgaatatttccactgtgcaggagaaaaaaggaaaaagtcagagtactttgttcagtgtaatgtggagattacaacccatacctgccagattacaagtgctgtgcacactttttaatattctgagaatattttacatctagctctccagaaacagtgttgtttaatccttcagtcactctaaagaaaacaacaatagagtttaaagaagggtaaggatgtaaattcagccttgaaaaatccagaggccatcaaatattggcctattccttccatgcaaaagaccactctgctaataactttggaattggctaattttaaatctactttattgaccagtatccactgaaaaagattacatattctattttttgtcaaaagtatgtttatgacaagggctgctcaagtggtgctagtggtaaagaacctgcctgccgatgtaagagatgtggggttagatccctgggtcaggaagatcccctggagaagggcacagctacccactccagtattcttgcctgggaaatcccatggacagaggagcctggtgggctactgttcatgtggttgcaaaagagtcccatactactcagtaacaacaacagttgtatttaatatgtgtgtccacttacattgacttctcgctttcatgcattggagaaggaaatggcagcccactccactgttcttgcctggaggatcccagggatgggggagcctggtgggctgccaagagtctatgaggtcgcacagagtcgtacacgactgaagtgacttaacaacaacaacaacttacattgaagcctcccaaagaaaggatttttgtattgcaaacaaattacaaatatttattgataaccacttttactgtcatccttacctgtaatgtggctatagctgaacatagttatacagcagaagcagaaactttcttttaacccagtgaacattatagccttgataagtttcagtccccccttcctgatacttgtttgctgtaatcattgccatttctaatgggcccttcataataaagtattcattgatcttccatcagggaaagagagaacagggtcacagacacagctctcctggttgctctgccaccctaactatttcagagtggggaggagagggagctggcacccacaaaaggtttcagcccagctgctttccttcacctgttcagcatgtgggccccaggtgagcaccagactcctaggttcggcagagtca

SEQ ID NO: 38262 - DNA, 876 bp, Bovine  19866880718788
tttcttaaaagaagttgtgagctgttaattttaggagactgttcaaaatgctgaattttttagaatgacacatttgttgagaagaaaagtgctaagaagaaggaaaaaaagctccagggggaaaaaaaaagctagccagggaactgcaagaaactcaagccaatatgtagcttgcatctgctggcaataccctcatcaaagaaggaaataagatacaaaactgaaattgctattcaaagaaacttgataaacaaaataatccattcaatttaacagatggctgtacaatagtgtgtgccatgactaaaatatctgacccacccacctacccactggtagtgctaccaaaaacattaatttaaactgggcaacctgaaatgtaccaaataaaactggctacaactacaacatcagcaaaattatattcatgctgaaaaaaactggacatattccaagtacatcatctaaacagcatacttccagatgctttattccctctgcttggtccaggtatatattctgtgcttatgacatttttacccctagtttagttcactggctctgtgattctaataacataatcaaagctatgcccaatctcttttatctcaagagatattcccattacctctattgtgttccaagccctgtggtagttgctagagatataaggtaaatgacacattgtcctagatcttgatgtttacattctggggctatctgtttgcttagtaataaactgaagcaccactttggatatatttgagtctctattaactctgaaattgctaaatgaatgattcatgttcacctgtcactcagcactttctggactagcatgcttctattaagaatgtacatgtcacctagtttaaa

SEQ ID NO: 38263 - DNA, 1700 bp, Bovine  19866880763557
atttcaaaaagccttcttgacaatactttatttttctggagaaagaaaatgtcttgttagatctcataagatcatcattaattttttctttgtgatatagtcagcaaagagtttatactaggagtagaagtatcatctctgtcatttccttattgtctacatgtacttatttttatttttctatttttaaactttacataattgtattagttttgccaaatatcaaaatgaatctgccacaggtgtttggatccacagcttatttacagaaaaactttaaaagctacatgtccattttgagatggttaacttcaaccagaaattataatctggaaatgtactgaactgtgtatatgtatactgtagtaaattgcagtgtccagtcagggagaaaaagagagggtccactgctaattctccatactgtgaattgttttctcttcctttaggatatccagattagttactgatatgtgtccattttcatactaaacactagtaaatattaattccttttgatttttaagataaaaatatttgtcaatgaaagttctagtaatttcttcctgtatctcaggggataaacttttgcactcttaagaggtatgcacatctcatttagagaccctagacttaaaagatcaacacaaatatcacacatctatcaacttgatattaattctaaagagggctaagtttgtacaaaatattaaaaggccataatgatgataaagcctttggtaagcttttattccagaggttcaaagcttgttttactttgtgcaacatcaaagtgtttggatactgaattataaagctcctatgggattttctataacaaaaatgatacccaccttaatatattttgatgtatttagatctaaaacatttctgacaacaaaaattaaggaagaaaatatatgacagatcttaaagtgctgaaggacagatttcatctcctacttactggaaattcattatagcttccacatctagtagtattgccacctagagatcttggctgactctcttgtttaaatatatgctgtacaaaatatattaaaaatatttttaaaggtactgatgagatagtaagagataaagattcctgaaagatcaaacactaaatgaaagaagaagaaactcagagaggcaagcagaacaccctgaagccggttgaacctcagtgactttgagttttaattttcacactgtggacaggagacaaaacataggacctactcaaagagagggatttaattaggagacctctgacataaagccagagtctcaaagagttatagcttcagattaagagtaaaaatgtaaaaacctgaattccctggaaatggtatgaaaaatgacctctttcaagtcttggtgatgagaagaggagaaaaaaaatctgagtatccttggaaagcattcagctctctttatggtccaactctcacatccatacatgactactggaaaaaaaatatagctttgactatacggacttttgttgacaaagtaatgtctctgctttttaatatgttgtctagggtttgtcatagcttttctttcaaggagctgagtaacctcagctacttgcccaagttttgaagtcctacccatactatctgggttggctgcaagcctaaaagccaataattacgtgttaagaggtaccaggtaagccagcccacatatctagg

SEQ ID NO: 38264 - DNA, 1188 bp, Bovine  19866880797315
gaaaaggggagggatgagtagatggaacacaggggatttttatggcagtgaaactattctgtatgacactggaccggtggatacatgacattgtgtttttggcaaaacccataaaactgcacaatgcaaaaagtgcattccagtgtaaactatagattttagttaataataatgtatcaatattggttcataagttataacaaatatactacagcaacacaagacattactaataggggaaactgagggaggttgagagggagtattatgggaactctcagtactttctttttaatttttatgtaaatttaaaactgccccccaaaatagagcctaaaattttttttaaggagagagataaagataaaccaacgggggactataaaatctaattgtttatctgttttggcatcattttaactgttttgtataagtttcctctgtcctaaaccctctattttttctctacacaactcccaacctgtacgaatgaggctcacatctctctgcacatctccattggttttttttatttaacactcacttattgagtaataactttgtgccaagaactatgataattgttagagatatgaaaagaggaataagatcagacttgaggatatcacagtcgagtgatagagacatgttaattacagtggaacaagttattaagtgccataaataaaggtaagaaaaaaatctcttggaaccacaactcagtactttgaactctatatggcattattaaactataataaagtcacatcatctgcttttgatactgccctatcttacttttgccaatatgtcacatttaaaatttattttaagcctctccctcctgttcttattcgtcagccttttgcttcttcctcaaaatggctaatttttgccgatttcccaattcagtcaaactaccaggccaatgaatatgtatattcattctacataattatactgattcttccaccagccggaaaaaaaagtgaaaaaatgaactttactgaaagtttcagggtcattaagcaagggaatcaccactatgcaatctcaagactacattccaggaggagggtggtatggagagaagtgaaatgttgatgtggaaggagccagccattcccctcccacaacacaaccctgcatcaggaaccaagctccaaggtgagacaaggagaggggaag

SEQ ID NO: 38265 - DNA, 3958 bp, Bovine  19866880801334
ataaaataaactgaaagtaatgctattagcaaaaaaataaataaataaagcaagaaatctgcttgctttgaaagcaatgaaaatgatatataacagaaccacatttatttataatgtattccaatatcaaacagcaaattttaacaatgcaaaaccgcaattacttttgcaccaacccaatactttgggaatgaaatgaaatgaattaataatattgatacatacagcaatattgatgaatctcaagatcatactaagtgaaaaaagcaagataataaaagagtaaatactactatgattacactttactacaaacactctagataaaacagctaaatctatagggaaagaaagatcagtggtttactagagatgggaggggtgagatggaaggggagaaatagaggaattacaaagaggcagaaaacttatggaggcaatggatatattcattattttaattgtgatgatggtttcatgggtgtatatatatgtctaatttatgaaattgtaaactttaaatatgtgcagtttattacacataaattaaaacttcagtaaatatccactgaatcattgaaaaagcaagagagtttcagaaaaacatctacttttgcttcattgactatgccaaagactttgactgtgtggatcacaataaactgtggaaaattcttcaagagatgggaataccagaacacccgacctgcctcctgagaaatctgtatgcaggtcaaaaagcaacagttagaactggacatggaacaacagactggttccaaattgggaaaggagtacatcaaggctgtatattgtcaccctgcttatttaacttctatgcagagcacatcatgcaaaatgccaggatggatgaagcacaagctgaaatcaagattgtcggaagaaatatcaataacctcagatatgcagatgacaccacccttatagcagaaagtgaagaagaactaaagagcctcttgacgaaagtgaaagaggagagtgaaaaagttggcttaaaactcaatattcagaaaactaagatcatgccatctggtcccatcacttcatggcaaacagatggggaaacaatgcttttgagctgtggtgttggagaagactcttgagagtccctaggactgcaaggagatccaaccagtccattctaaaggagatcagtcctgggtgttcattggaaggactgatgctaaagctgaaattccaatactttggccacctcatgcgaagagttgactcattggaaaagactctgatgctgggagggattgggggcaggaggagaaggggacgacagaggatgagatggctggatggcatcaccaactcgatggacgtgagtttgagtgaactccgggagttggtgatggacagggaggcctggcgtgctgcaattcatagggtcgccaagagtcggacatgactgagcgactgaactgaagatcacggtatccagtcccatcactcatggcaaacagatggggaaacaatggaaacagtgagagattttattttggggggcaccaaaatcactgctggagaaagcaatggcaacctactctggtactcttgtctggaaagtcccatggatggaggagcttggtaggctgcagtccatggggtctctgggagttggacacgactgagcgatttcactttcacttttcactttcatgcattggagaaggaaatggcgacccactccagtgttcttgcctggagaatcccagggatgggggagcctggtgggctgccatctctggggttgcacagagtcggacacgactgaagcgacttagcaaaatcactgcagatggtgactgtagccatgaaattcaaagatgcttgctccttggaagaaaagctatgaccaacctagacagcttattaaaaagcagagacattactttatcaacaaaggtccatgtagtcaaagctatggtttttccagtagtcatgtatggatgtgagaattggactataaagaaagctgagtgccaaacaattgatggttttaaactatggtgttggagaagactcttgagagtcgcttggactgcaaggagaagatccaaccagtccatccaaaaggaaattagtcctgaatgttcattggaaggactgatgctgatgctgaaacttcaatactttggccacctgatgcaaaagtcttttcattgtaaagtccctgatgctgggaaatattgaaggtggaaggagaaggggacgacagaggatgagatggttggacagcatcactgacacgacggacatgagttttgagtaggctcctggaactggtgatggacagagaagcctggcatgctgcagtccaagggggttgtaaacagtcggacacaactgagcaactgaactaactaactaaagttatttttaaatagagagaggtctgatatttcctataatggtagtttcttagtctctcagagttaagactgacattgagataatcagagttggcattaaagacgtaaaatagcaccatgagacttgactattttccaacaatttccctagaactgacccttttattgctcttctcctcatgtcctaattcaacccatcagcaaactctgttggtttcacttccactacatgccttgagttaattccctttactatgtgctcacaatactaccccaattcaaataccatcatctcttgcctgatgaatgccctttgtctttgatatgaggtacatgttttcccctgacttgtctcttgtctttaaacttgtttatgttttgatgttttctttcttttcatacataagtgttttatttttctgtactcaaatttgttactgtcttcctttgtgatttctggactgttgagtcatatttggaaaggtcttccctaactactgatttcaaataaagaaactcacgagcctgaacaggatctagaaaggggcttgcatctctattaccacccccagtgaatgctgtgagtcatcctcaaacttggagtttacatagagctttagtctaagacttcttaatgcacatagctgctccaaaggaatacacctatcttccaatctctcaactttcaagctagactttagaaagcaatattcaaatccagtagaccctataatgtatgatactcttttacaggtggtcaaaccttaggctgccacaataaatctttgaatttcagaagtattttaaatagtaagtgaataggcatttgtctacaatatagagggaaaaaatactagtattaaatacatcaattaaaaacatttccaaatccatgaacaaaataattgatagtcaattttacaaagaaaaggctactataatttgattcaaactgttcagataattggaaagatgtgaatataaactaaatatttgataatatgaaggaatttttgttaatttaattttgggatatagtggtaacatggctatattttctttttgaatagttcttaactgttggagatatatactgaaatatttatggataaaatgctataatgtctggatttgctttcaaatatccagagatatttttaatgatagggatatatatgaagcagtattggctatgagttaatgtttattgaaaatgggtaatgggctcattaggatttatttatatcattatctgtacttttggatatgtttgaaactttttattacatattttagagataatatgttaattatattgtttttttttttaataagatttgggagtgcatctatgaggcaaatggactcagcacctcttccaacctcttctcccttgactatatagaggctgaaacatgttagtgctcatttccccagcattctttgcagtattgagtcacaacttggaacaatgaagtgaagccaatgtctgataggacttctcagaaaactttgctttttacaccatgtgccggcttccacctctctttttccct

SEQ ID NO: 38266 - DNA, 1608 bp, Bovine  19866880825328
agggaatgactgactatgagtcctgggaccaatgtgggagggggagatgatctaagaaacctgcatggtaaccatttttataaagtgaaacatccttttgcaatgtgaatgtaaaccatccctacagactgccacgtgaaaacagtttttagtgtctaggattttgtacctcagcttttcttaaagtcagactcaccattatgaataagtcaaatacagaagccctagccctctgggtgatggcaaaatttctttttgcatggatgttgaatcatgtcttggtatgattaaacaccatcagtgaagcaataacccctctgggaattatgaggacaaacattttagtgagctctcagattctcccatctaacctggatacacacaggcccctatgctgagtagtgctgagccccatgaagcagctaagaactgggcagtcctgtcccctcttcaggctcaggccctggccctgaagtccagggtgtgacagctgtggttgggcaccaagcgggtattcactgagggccctgcactggaagactctgcagaaaccaagcaggggcctggctcctgagccgccctctcttggaaaagtacattttactgccttctgattttgtaggtgggtggcttcctgggaacttttccccctccctctttgctaaatttctcatctttctggatcagtatctccctactcgttagttttacataagctttactttccagttcatccactatattacccttgtttctcacaaaagagcaagaatgaccttttcattttcagagggctcagtctgattttgagggaaaaaattggactatctccaaaagatgactctgatctttaaattctcattgtgctctctctcaggttttttttaaattaaaaagtgcaactaaaatgtttatgttttctagtgatcaatcctagtttcactaatactaaccacctgtgtcttgaaaattgcaacatgaagtgtctagagccacctatttttttccttttattaggctgttacttatatgctgtaaaactcaaggtagttcaaagagttttgaaaactctgagcacccaggttatcaagccaagatatagaacttttccatcatccagaaaattccgtcctaccctttatagtcagccagtttccccgtgcccacagttaaccactaacatcacagatgaattttgtaggttcttgaacttcaaataaatgagatcataagatatgtacacttaagtgaatggtttctttcactcagaaaaatgcctttaagatgtatccatactaatgtatggattttttatttctttttaattccttttgaagtgctctattgtatgaatatcttgcattttgtttattcactcttttgttaacagatactcacttctaatttggagtgattctaagtaatgctattatgaacattcttataatgacttttttggtggccatgggctctcatttttcttagatgtatatggaggagtggaaaaattaagtttctatgaaatattcctgctgaaaaatatttcaattaaatttagtcagacctctaagcaaaactttcctttcacaggaaacaacagagaataga

SEQ ID NO: 38267 - DNA, 743 bp, Bovine  19866880829153
actgtatggaaaagagttattctgtatttagcctgaggttctctgaatttaaaataccaatagtagaagatagtgaaacagtgataaaacatttaagaagagggcaaatcagatgatgaagacagcagaagcctgacctgcattaataccactctaaggggagcaagggagacttcgtttgtaaatgagaaagaaagaagttgtgatgtgtttgtgcaaaacttcaaatcaattaaccagacaaagcaaagtttaacttagccccaagaacgctatgaatcactggggtggtagaaggcgaaactctgtttgatactcataattataaaactgtgaacagaaattgctcatgtaaaataaactttccgttgtgttgcaacatgttggagaaacagatagagatggcttgaaaaatcttaatggttgaaattcctgcagctttttgcaaagggctggctatatgaattgaaatctaaatttatcatcatgtctgtgctccagcacactggataatgatctagtctaaggaattgtcagttttgctgataatattttaaattgtgcatttgttaaatgcaaacttactttaagatgtcggcaccccactccagtacttttgcctagaaaatcccatggacagaggagcctagtagccctgcagtcatggggttgcgaagagtcggacatgactgaggaacttcgctttcacttttcctttcatgcattggagaaggaaatggcaa

SEQ ID NO: 38268 - DNA, 1629 bp, Bovine  19866880903908
ccagacacacacacacacacacacacacacacacacacacacacacagcactggtgcgtctctagtctggcctatgctgcctggggggtttctgcggcagctgtgatatcctgaagggtgtgtgaaattgaagacaaacatttttactaggagtttacagccttaacaaagtaaactgcaagccctccaggtgtccttgatggtgggaacaaaggcctgtggtgcagcaaaaagagacctgggttttgaattagaaggagctgcgtttgtattcctgctccaagttcatgggctgggtgaacttgggcaatcactttctctctgagagtctaggtttcatcatgagtcaaatgggggtgcagactagattgtttctaaaagcctttatccagtcctaggggtctatagttctaatgtttgcattaccttttatattttattagttactttcccataatttttttttaaaatcttaaatgcctaggaaccaaagaataaaattacatttctgtcgtacttactttgggtgacttttttacctccttattttaagaaattgaacatggcctttaaaaacaagcaacaaaaatgagacagaagttgctgttaggtatctcttctcaagaagccaaaagatggtggtggtattttggtactgcttcagagcaaaggaatttttatttccttattactccaagataatttatttttcaaatattcaaaaaaagtcatcttaaatcctagaggcttcataaatgaatcattattaattatgaaattttgtatcatgcattttagtttataaaacctgcagtttacctgcaggatctcatgacctcccctaacactggtcccactctattagactgatgttgttaagacatctgctgagccgtgtccatcaccttggaacccccatggactgcagtacaccaggcttccctgtccttcactgtttcctggagcttgctcaaactcatgtccattgagtcagtgatgctatctaaccatctcatcctctgccacccccttctcctcttgacttcaatctttcccagcatcagagtcatttccaagagaggtactaacctctccatctgactggtgggaagttgaggctcagagagttgctgaggctccgcagagacccccagagccagggtctgaatgcacatacctcctagtgtagggtgtcatgtaaatgttcatgtgattaaactaaaattattcatttcaaggctactacatacatcaggtggcatttcacctggattaagtcaagaactttagctcatttctagtctgaagcttagattccttgaatgcataaaatggctcaaaaattggccagggttcagattggaaaaaaacaggtgtatcaattcaaagataatatcctttgatgatcagtatagaatacaaaaagtaattcatagggaaaataggaaaaaagaataaagcacatttcttcagagttttggagcctttgtcttttatcgaagaatctggatgtcagacgtgatcagggaatgaacttggacttcattgctgtgcaggtccaagttgaaatcctggatctgcctcttcctgactcttacacattcgacgattcatcccttgcagactcca

SEQ ID NO: 38269 - DNA, 2105 bp, Bovine  19866880923508
tgctctagtacttctttatcttatacctggaagtttgtgtcctttggctgccctcatttcttcctcctgcttctgatgaacacagatctctttttctatgagtttgtttttgagatatcaatgacctactacactatgttagttcctgttaaacaatataatgatttgatatttctggacatttcaaaatgattaccacagtgagccgagttacaatatgtcagcatgctaagatattgcacagttactgactacattccccacactgtacatttcatacctgtgactcatttattttgcaactggaagtttgtgcctaatcttccttacctatgtctttcctccctccacccacttccctctctgccaaggatattttaaatccaagttcaagtggccccaaagtcacctcacaaaaagaatgtatgaaagcatgtatttatttaaaatctttcacatgcaggctgagtgccacaaagcagagaaatcagagaccaaggtgaacactgttgggcacagttcttcaacataacatttgttctgaaaagcacagttgattatgagaagagtctagacagggataatgaccttttacttagacttgcaaaaaaatggaggagggagggaggagaggaaagaaggaaggaggaaagaaagtaagggagggaggaaggagaaagaaaaaatgttaacatgataggtgcctgagccaagtactttcagccagtctacacaaaatgtgcactcagttaaatctaggttggcagctaaaaatgtgatatcacagtacattcaaatgccttcagaatttgtgagcttcatgacagaatcttgggagggagaaggaaattaaccaaagttgttattgtcatttacagaaagtcagatgttagagcccagcacaaatctctcaaaatagactggatttgcttaaaagcaaatggtttttgttaggggtttatttttcttgtgtcaaaaacataaagttacactgtaaaaggaagtggtaaaacctacatcactcaaagcattggagatgtatccacgtgttcccacatgctcaacagttatttaaagtgtgattctcattttacctgttaatccaatacttggaagtattcaacaaggagcttagcctttttctcagttctgatttctgagcaattgcagagaacacattctactgggggaaaaaccctgaaatgtttacattccagaatccattttcagatcaacagtattttatgaggttgattaaaggtgtttaccatcagaatgaagcaccaatttcagtataagaactatgttcttttcaacataagaactatgggctgaggtttgtaacattgtacaggaggcagtgatcaagaccattcacaagagaaagaagtgcaaagaggcaaaatggctgtctgaggaggccttacaaatagctgaaaagaagagaagcaaaaggcaaaggagaaaaggaatgatatacccatttgaatgcagagtttcaaagaatagcaaggagagataagaaagccttcctcagtgatcaatgcaaagaaacagaggaaaacaacagaatgggaaagactagagatctcttaaagataattagagaaaccaagggaacatttcatgcaaagatgggcacaacagaagcagaagatattaagaagaagtggcaagaatacacagaactatacaaaaaagatcttcatgacccagataatcacgatggtgtgatcactcacctagagccagatgtcctggaatgtaaagtcaagtgggccttagaaagcatcactacgaacaaagcctagtggaggtgatggaattccagttgagctatttcaaatcctgaaagatgatgctgtgaaagtgctgtacgccagcaaatttggaaaactcagcagtggccacagaaggggaaaagatcagttttcattccaatcccaaagaaaggcaatgccaaaaatactcaaactaccgcacaattgcactcatctcacatgctagtaaagtaatgctcaaaattctccaagccaggctttagcagtatgtgaactgtgacttccagatgttcaagcggatttagaaaaggcagaggggaccag

SEQ ID NO: 38270 - DNA, 950 bp, Bovine  19866880944427
cctgaagttgaaaattgaatcactccattctcaagggcagaattgttcctaagttcatggttgtctcccaacaaatggatcaagacagccttttatgtgtctgtcagttgtgaccttgccctagctctcccagctggagtcactaatgttctctacagcaggctcagccagtccccatcccaccccctgtccagtccctgggccaaaccagagcagggcaagcctcggcctgtccagatggctggctctaattagagggtgaggacaccatggccaagctggaagtaaatgctgcagataccttttccaagagtggcaggtacagctttaaactaagtgcatgtatgcagagtcaaaggttgcatctaaatgtgcatatgtatgagagggctaagcctgaaaaggcagtttaaaagggttattcgaagatggggcagaaatagatatgcacagctggaactctcaagcatatagagacagggaggaaaaaaaggtaaatgagagagaagtctgggacattcctgagttaaagactactgcctattaccttggctggtactttaagccaaggttaccaggtggtcagctgcttgcaaaaggacacaggcagaagaaagagaacagggcccaggtgaccagctggtaggacctgaaattagtcttgttaccatgaatttactgtctggtctgcctaccaagagcctagggacacatctggcctctgagtccttctgagccttttctggtcttcatcaccttggccatgctttctgctgctgttatcttgcaaatggggctctagatcccagagcttttgtctggtgcccagatgatgcccttcttaaattttccaggagaaatcaacacaatattgtaaagcaattatccttcaattagacagaaattaattttaaaaagtcttccagctctaggctccaaggaccctactg

SEQ ID NO: 38271 - DNA, 744 bp, Bovine  19866880987107
atgatatttttataaacatgtattagacttgaatttagttagtttccttgatggaaatgggtggagctcttgcttctaagaatggacacccaaaccacactcactgggccaacaccacccaggacagcaggggctccccgagccaatcttgctctgtcttcaggaggagccttccccgggaacctttgcttatagctctttgaatgccacaggactcttatctgtgacacttataaatccatcattttagaaactatttagtcaaacaacttcattttacagcttaaaaatgaaaacctagagcagttgagatcaaacagtttgtaatcaagttggacttaggaaatagtacctgatctgatagtaatgaaggaccactcaagatgtttatgtaggaaagtatgcaaagaattgactcattggaaaagaccctgatgctgggaaagattaaaggaaggaggagaaagggatgacaaaagatgagatggttggatggcaccaccgacttgatggacatgagtctgagcaaactctgggagttggtgatggacagggaagcctggtgtgcagcagtccatgcggtcgcaaagagttggacatgactgagtgactgaactgaactgaatatgataaaagtcatgagcgtgcatcactgttttctagagttttggatttcacagtctaaaaaaattctgagaaactcatagacctcctgacgtgtgcacatacatgaaactaaagatg

SEQ ID NO: 38272 - DNA, 1657 bp, Bovine  19866881082734
attaaaaaaaaaaaactgccaattattcctcaaagtgcttatttcattttacatttctaccagcaatatatgagggttcctgtttctccacttcctcattaacacttggtattgtcaatcttctttattatagctcatctaatggttgtgcaatggtagcacagtgtcattttaacttgcattttcctaataattaatgatgctgggcacaactaatgatgttgggcacagtaaagccattcttatatgttccatggtaaaatgtttaattaaatcttttgtccattttttaaaaagccaggccgtttgctttttattactgtaatcttttatagattctgactataaaccatatatatatttatatataatatgatttacaaatattttctcccaactatgacttatcttttcatggtttttagttgtaactttttttctagatgtgactttcgaagaacaaaaatatttaatgttgatgaagtctgaattagtcaactttttctattgtggattatgctttgggtgtcatatctaagatacctttgcttaacttccactcacatagattttatcttctgtttttttctagaagtttggttaaaaaaaaaacaaggtgattttataagttatttaaaagataaggtgaagctaatgttctataagcccttcctagggtgaaatcaatgggccgatggagttaagtctatatagggatctttcctacattttcaggactgcctttcaaaggttggttatattgtgtacccacagaagcagctaagtgttccttattactgatccctcaaaatcttttcccaaggagaaaatgagatcatgctcatttaaagggatctggaaaggttttactttgaggaggtcatatttatttcctataccataactaaaatgttcttggtgtgttatttcatttagcaagtataggccaatatctttcaaaaccaaagcaggaaagagtcatttcctattactaatggttttgacatggacttagtttcacttgcttctctttattcctgtgctgtgcttagttgctcaattgtgtccgactctttgcgaccccatgcactgacagcccgccagggtcctctgtccatgggattctccaggcaagaatactggggtgggctgccatgccttcctccatctctttattcctagtaactcattttatttctctaataatgagacgttctgtaatgtattagacattgaaaagttatttgaacttgtgtgtgtgtgtgtttgtgtgtacatgtgcacaatcaagggttacattgctcttgattattgggggaacttacacctcatttctttcaaatcttcattgatcatagcatatacaggtcctcattccttatttgaaacactcaaagtcaaaaatggtttcaaatgtgtaggtttttaaactttagagagacactacaatgaatattctgaatgaatctaatttttccagagtcaagatgactagtatttcctaatatggacatattcatattttgaaacatactgaatatttacaatatgtgaaataataaagcccataagaagtgtcaatcagttcagattttctaccatttgagttcagttctgggggcaaatgagttgtaaaacctttccatttagagcattt

SEQ ID NO: 38273 - DNA, 1031 bp, Bovine  19866881129537
tgatcatactaggtaagtgcttcatttttatctcaattggtttgattttgggctttcattatattattgcatttaggttttgcatacttaggggtttgctttaaaaaaaaaaaaaaaaaaacagtctttaatcctacctctgatgagcacctgactaagcttagctatatctttaattgatgctctcttcaactctatatgctaaattgcaattccatgatctacctaaagagatagacagtttaatcaatgtacaagttactctacttattttaaataaatgcctttcagacttagtaaacaccattaggggaaacatgggtggtttaaaatcaggtaagtgatttatgtttcctcaaatgaagcccttaaattcatttaagtaatgaaaaactcatatgacccttagaaaattgattttgtgtaaagtcttttgtttgcaaaattctctaattgagcaggattcctttaagacagattgaaaggtatacctttgttggcagctgttaaatcttctagtaatattctagggttctaaatttaggatgctaagatagaccttccccataatatttgttatatcccaaaatatatttatcaaaggggaagaggttaattaatattatgactagcattataaaattaaagctctctaggatttttaaacatataagtatagtgagtgacaaataattactgagttttatggataagcctaaatgctttaattaaacttcctgagctacctaacttttagccataaatgaatgcagatactgagagtaagtttcatcacacttgatttctgcgtgataaccaccctggtgaccatcaccgcttcatcccaatgagaaggtgataactttgtgttttcctgttttttgtgtgtgcctaagttcttattcctagctggtacagcgtcagaattaaaactcagatcttctgattcctagcccagagatctttccaaaactgtgcttttcttgaatgctctccttcagcacagatgctaaataaatcaaacagaatat

SEQ ID NO: 38274 - DNA, 1363 bp, Bovine  19866881185864
tgaaagtgaaagtgaagtctgtctgactcttagcgacccagtggaccgaatggactgcagcctaccaggctcctccatccatgggattttccaggcaagagtactggagtggggtgccattgccttcttcgagggtttcactctgtagaatgatttaattatattttaggaagtttacacatgtgatggtgaagacaagggattagattctacagcagtggtctcaaagtgtttcctggaccagcacctggaggttaaaaatgcaaattcccctgcccagacccctgcctagacttccagcctaaggaagtagcccaggaaccagtggtttaacaatgttcccagtcagttctagaactgtttcagtcaagcttgagaaccagtagtctggaggcaggatgactagatttgacatatttcaaaagttcaggtgctgtgtctaaattactctgcaccagacatggagcaggtacttgatgcatatttgctgaataaattgatagagatgatgagagcccagcctaataaagaagcaaaatataatatagaaaccaagaaatattttagctccattagcaattcagtcaagagcagaatcaactcttaatgaatgtgattgtataaataatttatgaaaatttcccttatttgacagttttcttcctttttttctatttgctcattgtaaactcaaaaaatgtattgcactttcttaagaggaagcacaataaataaaagggggagagttcaataacttacacctgcttctggaagtcccttttctacttacttgaaagctaaacaagtgaccaaggaaatggtaatagcatgtcagaaaatgatgacccaagacctggggccatcagaaaatatgacattgctaactaggcaggcagtccaggttggagaaagatgggatggtgaggaccagaaggaggggccaagtattccagaagctacattggcattgtttttgaggaaattccaaacttgcagcagaaagaccagtaactcaatcattaatgtctttgaatgctaaagggaatgaaaaagtggaatgaaaaatgtcagtgaaagagaggtgtacccaagtatctacactctgccaatcattctgttgaaactcgggaagcatatcttatttaatcctcaccacttcaccatgtattaatatgtccattttataagaaggaaccagagggagtaatttgcccaagattgcacagccacaaagtagtaacactggaatacaaatttaggcattcttactctgaagcctacatttaatctcctgttattaaatacaaggcatggaggttgttacaggtttctgtcctttggaactttatagagtatatatttg

SEQ ID NO: 38275 - DNA, 1872 bp, Bovine  19866881209726
aaaagaatgatacaatacttgtttaaagggtgtaagagaggttaattttaatgttcaatagtctgcatgaaacaccaaagacctcaaaaaaggacattcagagcaagaagaaaaagacgcacaaatttgggaaagaaaatgtaataataataaaagttggaaagaagcaagatatattcaactcttttcatctattaaggaacatgatccccagattctgaaatgtagggttaacactgtagacaaaggtacatttaactaggctagaataagaattttaagtccatagcttcaaatagattcctgcctccatttttgaatgacatatgcagggagcttacaggtctacagatatgaccaccaatccactgctgataatgagtgagacattgagtgagacatcaaacttaatgaaacattgttgacaatgtgagcagagccagaagataggaaatggacatatgctattgctgtcaacaaaggaaaaacatttggactactaaactgtaatgctggtcctgggcaataattgaaaacaaatcataaagctaatgatttctaagtacctaaaagaaaaagagagctattcatagttattgatttggttgaagaaccaaatgcattgacaaactgtatcttcttttcagcaagatgatagctctcatgaaaatctagatgataggagagttggatggattaacggatgcctctgtgaccagagagagggattctttagaagaaagaagagtcctaatcttaatcttgttctgttcagtgtctttattaatgacttaaatggggcatatattatgttcatcaaatttgcagagaggttcagattgtgatggggtgagttaatagaagggtgtaaaaagattactgatgcctggaataatgggcttaaactgacatgatgaaaactaacagagattactattaaggtctggattgaggtaaacaaaataaaaatcaaagcatacaggaaggggctggaagtccagcacagcaaaagtttatatgaaacactgatagagcacctcagctgctccattttctgtctcatgagaaataaaaagtcatactacactatgttggtcagaaagcacattttgattagaatgttcactttgggagcaaagtggtgaggatgattcttacagttaactaaaactgctgcctggttgaatggttcgacctaaatctaacaggccagcttacctgtgaagtgtggaacaggcaaaggtttttgaacactgcagtaagatccagaaacaaatcccttgccacactgttgggtgtctgtgttttcaaagaaatttcataaattccatgagactcagtttccttggctgaaaattaaggataaaaatacctcctttgcagagttttcttgaagactgtagatgtttaagggacttagcccagggcctgtcacctagtatctgcttggtcagtggtagctgttagtgtgataatgaccatgtaaccagtgcttgcagacagaagcatgtgtgtattttgcccattaagatactggtctccaggaactggatattcataacaaaattagggagagtgtgaggacactgtctttatgaaaactatgctcaaaattagatgattgcattttgatgaaaatggtctctaacagaagcaaatgttatttgatatgtacatcttgaaggaagatgactcccaagctctgagctttaagattgcaaatgagagagactgatttgaggctaggtgctaatgccaagaggatttcttaaggactgttaatgtttttattaatgttctgttccaaaggtctacagctgtggagtggcctgccttaccccatttcccctataaatttcttttaaaaaatat

SEQ ID NO: 38276 - DNA, 869 bp, Bovine  19866881218862
ttaagtctcctaaaaatcagtatttccccaaatgcaagattgaaagccagaatttctgaattggtggcattcccttcagctctcaaagttttgaatttgttgcttactctgcatttgcaaagctttcggttcagttgcccaaaaatgcgttgaaaaaataaatcctttttataagttccgttaggctccattatgagtctctcgaaacagagtcagatttccctgagagtgcatttttccattgttttagggagaaatggataaaataagaaattggaggggaaaatcaaaataactaaaattagctttatgaaaccataatttttagaatgcatttccaaaaactttgcaagaaacatcaattcttcacttttcaatttaatgagaaagagtaaatctaatatagtcttcacaatttgaaggtgtcattaacgatactgtttactaaggcagactttctgccatccagattctgtactttgtgttcattgtgggatgatggtgtatcttgaatgaagaagacttagaatctgcagttaaccacttatattgaaaaattaggtctgtatttgtgagatctgacaagtagctttaagaataaacatctccttggagcaagaactgtgctttattcataactgtgtccctatccttaacttctagtccaggatcagactcagagcaggccctcaatagctatttgttgagtgaatgaatcagtcttgtttttatttataactgtatatcagacatctaaacctaattattagagctaccctcttacttgaggatatatggatatatttttcctttaacattttacacaaatttcacattttcttggcttgggattaaactcaaaagtctaa

SEQ ID NO: 38277 - DNA, 1625 bp, Bovine  19866881247626
atgaatggataagaaattgttgtacatatagacagtggaatattactcagccataaaaaggaatgcatttgagtaagttctaaagaggtggatgaacctggaagcctattatacaggtaaagtaagtcagagaaagataaatatcatatactaacacatatattcagaatctagaaagatggtaccaaagaatttgtttgcagggcatcaatggagaaatagagaccagagttatgaacatggagagaggggagaagagggtgagatatatggagccagtaacatggaaacttacattaccatatgtagaatagatagctaatgggaatttgctgtatgtctcaggaaactcagataggggctctgtatcaacctagaggggtgggatgggaagggagatgggaggtaggttcaagagggaagggacatatgtatacctgtggctgattcacgttgagttttgacagaaacaacaaaattctgtacagcaattatccttcaattaaaaaataaattttttaaaaataaaaagatttacttgccactttggaaaagagtgtaatattgtaggaatgaagtatcagtattcttgtcaccaaggcaaacctttccactggagatgattactaaatgtaccttaattgaatgtcttctaaatttgaagccagaattataacatattaatatacccacatgtgagagagtcgattgataatgtaactagcatgaagaaatgcttgtatggactgaatctgggctatacagtgcatttttaagttctctgggaacaaagctctttgaaaccaagttgatctgggtgtaaaataaaatgtaagcctttgtcatcagacatggtaggtgctgactaggccttagctacactgggcttctgcatcactgactaggaatcagaaaaagactaggaaaagagaaaagcaaggaactaggaaagagaatagcaaggaaccccaggaatgaaagagaaggaaagaagccttcacgaacttctgtagatcttctgtatgattattcttttcttgtggttgcatctctgacaaagaatggactgtttttcattaccagaggttattgcctagttagtttatatctaaagaaaatgtacctgtttactttgaaaggggcttccctgttggcccagctggtaaaaaatcctcctgcaatgcaggagacctgggtttgatccctgggttagaaagatcccctggagaagggaaagactacccactccagtattctggcctggagaattccatggagtgtatagtccatgggatcgcaaagagtcggacaagagtgaactctcactttttttgaaagaaaaagaaatggcttaaatacattaaccctatatacagttcaaggcaagtgataggtataataggatcaattaaaaagtaccaccagtaaagaatcatgacaactaacttttctgacaattatttttcttttgctttgcttttagggttttgacccaccacatcaaagtgacacaagaactatttacatagccaacaggtttcctcagtatggccattatacacctcagaaatttatagataaccggatcatttcatctaaggtaagaattaacacttctattatta

SEQ ID NO: 38278 - DNA, 2544 bp, Bovine  19866881283508
agtgcgtcatccctgcctctaggaggcacctttgaatacctgataacaatatatcaaggacattttccagtggattttccatttctgattttacttcaagaaagtacagaacaaattctcagccagaagtgatcacagcacctattgtagcaatccagagaaatgcaaacctgcacatcaaaacacgtttgtgtacacatgtgtcaggcttttggttctgtatgtgttactacaattttaaagattatttggtatatttcttgcaaggcaactcactcacctgtcccctaagaccaggttttctgttgcttcctgcacatgtgaaaaaaatgcctttctacatctgcagaaacaagtagttgttgtcatcactatacttgccctgtgaaaccttagccaggtggtagggttacgcattccgttcctttaagagaagcacagcatttcagctccatcgctgggagctgcctccagtggacccgataaacttggctttggagttttgtggatttagacactcaattatttttaaagacaaaataaaacccaaaatgcttttcaaaaacaaaccaaaaaaaaaagatgaaagggaacggaaggtgttagaatgctctctgctgatgaaaaccaattcatagggaaacgttgcattggttgtttttcttttaagctattacataactgaatgcagtatgtggtacaggaaataattttgcccacacacctgcacagaaaaacccacatcaacaagtttgctttggccatcaatctgtgggaccaagagctaagcctgaaagcaaaggtgaaataaaatacgaaaattgtacagcagccacagaggagtcagctatccagaggcccctgctgaaatcccatctttagggtaaagtttcagacacattttgatgttttggtcacctgacccaaaccctggagcccaattggcctctgagtttacaggctaagtaatgatgtaaccagagtgtgtgggaaccagaaggatgagacagatacaatttttcccagtcatttattagacttggctactaattctgcttgttcttcgatttgactgctggttatcaggaaattcgaactacttaaaggacataatgagtttatctatacttggggtagaacttagtcacattcatgtaagattaaaccacaattacagagaatagtaatttatgaaattcaattatttatgtttgaatttggtagatctattttaatacatctaaaattttattttacctgtacttttttttaactaaacatctcttacaatagcattcttatgttgcctgaaaaacagaattcatcaaaataaatgtgttattttagccatgatttttctattccttttctcaatcttataaagtttttacctaaaaagaataaatgtttatactcctataatttgtcactatggcaacttttggcctttaaaaatgctgacactgtatcagagaaccaagagaagaaattatccttgtttgacaagaataagcagaaccagtttggcaaacttcagataaaccaaacagcagggcaaggatgcctaaggataaaaagcatttgttgttctactcatatgacttactgtcaaggaaaactagagcatgttcaggtttcacggcaaaaatgagagatctaattaatgctcacagcaaacttaaagggaatttttttcctcaatttcccataaccatccctctgtgcctcctccaccaaataaatcattcaagtaatttctaacacacactatattatctttctgatgtgttggcatgagtttgtaaaaagtttgccaactcttatttctgaatctcttgaggagagtcttgcagtcgtatttcacaagatcttaccaacagtttcacaacagagagaaaatatcataggtttcaaaactgatgatataataaacaccctgtgtgattttttaaatttattgatattgtattttggtggcatttatactcatagaaagtacttcacattctcaaaatacttagtctggttagcaaaaatgtcttcaggaaagaaatctctaaaaacacttctttatcattcttcttgtgcatatcatgcccaacacataagcaatagatatggtgtctgacatctacttaaacctgttgagaactatatcaaacattaatggggattagtgttagaaccggtgtaaacatagcagacaatctgctggcaagtccatactcacatttccatatgttatgcagtaagcagggtcatttaagaagtgaaacaccaagggagatggtgttcaggtagtgagtgtatgactggtgagaattaaacatatcctggatatatttacttcataacaccagcatatatacatacctatccaactctggcccttacccttctcctcaagagacaggtcaagttcaagacatgcaattttattatgaaaagcttctaaaacatagataaaaatgatttagtacttccaggtgcactgtaattctggcagaagaagttaattccaggtgtgtaatctcctaaagaaat

SEQ ID NO: 38279 - DNA, 1413 bp, Bovine  19866881378621
gtattacagttacccagcacatggccatctttttgtaggacgcccatagatgagaacacagaagcactattggtaggtagtggtcaagagggccagacctagagacaaatgccttggagagtataatcaggttgcttgaactctttctgcctcagcttcctagcctacgacatagaggtaacaatggcaatttagctcttatcattgtagtcaggattaaaccaaaccgtatacttaaacctctcagcatagttcttaacatataatgtacactccaaattattatctttttgttatgattaatctcttcatactacctagctgcaataccttaaatcaaccattgttaaagtatggtcttaggggatatcagaagattctgaaaccctcttagagggttcataaggtcaaaatgattttcacacaaacattattgtcataatggtaataaatgcatgatttatatttttactctcagtctttcacaagagtacaggagggttttccagaggttatgaggcttgaggttagtaaattaaatgcaaaagtaaatgtgaaaacccagctctcttctgtgaagtcagacattaaagatgttggcaaaaatgtgaaacaatgcagctcttcccaccgaatgtttttgttttaaaaaaatagtaatttttttcataaaaatgtgttagcatgcaatgggtttactgtgttattttaaataaattaatacataggtattttataaatctcttagtttaaatttctaacttaataaatataaagaacccattaaaataaaaagtgctttagatgtctcaataatttttaagagtgtataaaggggtccttggaccaaaatatttcaaaatttctgtcttaaattacatgggtaatcactaagataaattgttatctatttataattttaatgtgtatttttatttttcttaaaataaagaaaatttaaagtataaaaataactaaagaaaaggattaaatgtgccataattaaaccttccagtggtagccattatcagtattttagtgtatttccctctggtgcttagtccactgatatatagaattaaactgatatgatatacataatatataatattttgaaactttttttacttaaaatatatcaaaacatctacccatatcattaattgctctataatagcctttataagccttatcacatttcattaagctcctaattttagacttttatgttgcgtacatctcttcatgttataaataccattatagtgagcacctttttaaataatacttgattatttcttagaacaaatccctagaagtgcattgttgtgtcaagggtatgcatattttaaggcagggtgctgccacactggatttcagaaatagtatatcggcacatgttagcagtttacg

SEQ ID NO: 38280 - DNA, 817 bp, Bovine  19866881423987
taagtgctaaggaaaattgagtgcaccgagcaaataataaagtgactctgatgacccaactcttcttaacattccagccctggcctcaaagggagtgaaatccagacaatccccatgaggtaggatgggttacagataatgttggtcatttatatccctggaaaccagattccagagaccttccatgaaatctcttggaaaatgtctcttaggtcagaaggaagccatatgtggtagtctgcctgtttattcccaacctatgcctgttgttctggcacatgttattaacaatataatgccttctctcactcactaatagtgttccaatttgggcaataatttatatgaacactaacttgtagagttaccgccaccctcctctctaatccatatattagaaatgaggtttactctgtattggctccttcatatctaagatttttttcttccaagttgagatcttattaatgaatcaactgctctcttttatgaaaagacaacatttaataagactgagaatcaaaccattctcatgattagatcttcctggccagtgaaaattattatttttacttttttttaaagacacttgcagttcataaaccagttaagatgtgctctcttttccttattactcccaggaagataaaacaaatttcaagagatcttctaaacactctgtcacaaaaagttctgcaaaaattgcattttcattgctataaaagcttccacttaacattcacctattataaacaattagcttttttattttcagtatgataactataattggattagtatctccattcaggatctt

SEQ ID NO: 38281 - DNA, 638 bp, Bovine  19866881433262
agtatgaataaaccgatgaagaaggaaaaatggagcagccaatcttctttaatagctagcaagaattataatacagaacaaaaaacagaatacctcggatttgaaaaagtttacatttctctgcatcttagttcggttagggactgaaatatgaaaacatgtagtataccttttgttgcctaaataatatccaatagaatcctgactcattgtaaatcctgactcactgtacgataacctgtttttatagtaccttttcccttaactgaaaacatctccatctatcctatgttgaataaaaatttacattcctgatatgtggattatctgcctgctgtggatacctgattaagcttcagaattgattcaaaattcaaaacgttgctaagacaatgaaaactgccagatgtccacttgaattgacttctatagaataatgtctgttacttagtataatgagggtgcaaggtgtttcaaaaagtggattgctttgtaaatagatgaaattcaaatctttaaatcattttcactctgaacgttcctcttcagcatccagggctcaactcaacattgactttttcgaaaatctttccctgatctctgtgtcagtccggtcagattttagcactctccccgct

SEQ ID NO: 38282 - DNA, 1102 bp, Bovine  19866881500048
atttattcctggaacagaaaatgtgttttttagggcattcaaaacaagagaaattcaaaaaaaatttcaaaaaaattcaacaagaaattcaaaaaaattcttgtttaattcaaaacaagagaattaaagataaattaaataaattcctttaaaatattttgttatttcttttttacaataagagaatagaaattttatccatatgttcaattaacctcagccttgagaaggtggtatagtgagtgagggcatgaaccctggagccaggctgcctggatgaaattctaacccttccgcttactcactcttagcacgggaaagttacttaagcctcaccaccctcacctgtaacatgaatatattagtatctacctcttaggattgttgcaaagattaaatgaggtcagcccttaggacaatggccagcatgtagccagcactcagtcttagacattattattttttgttaaaaacattaataatcacaaaaacctataaggcatctgctattatctctgtttacgcatgaaaaaaatcaagatttgtccaagatcaactggcaaatgatggaattgagatttttgcccaactcctgcttctgctgtaacgtctgttataaaacgtaatcttatgtggaaattgcttgtctccccaggaccaagggcatgtagcagtgggggattggaattcctttagagaactcagtcattacacagttcttttctcatgctaatgaatgtggcaaattcaggcctagtctaggcaaacacctgaagtggcggcagacagaggaccaggggaggagcagaggcatcaggcagttcctgaagtcagggcatcagtggcattctgattctgagccatctgcccaggaacagcaggatgccagcaagtgacaggttaggttagggcaaccgtctttgagggcagaggcttgtcttctccaactcctgtgacatgcccaatagagcataataaatactcaataataactgtttgttaaattgagttgtcttgaactaaattgaactggccagccatcctcactggtattacttgagaaacatgaaagcctccacccccaaccccaaaaccacacatg

SEQ ID NO: 38283 - DNA, 1647 bp, Bovine  19866881626212
agtgattccgttttacatatatataatctttttacattcttttccgtttggtttatcacagaatactgactattgttcccagtgctatacagtaggacctgattgttaatctgttctatgtataagtgttgcacctgctaatcccaaactcccaatccttccctcctccatggcattttttctcatgttttttacttcagcatttgttgaccttatatgagaagtctgatttgtgtaccactggcaggaaatttttgttttctttgaacataacaagtctgtagcattacttggaattcttctgtgacagatacttgtatagacatttatcaggtgattatgatggtcattttgggttactagacagggaaagagccctctgtcaactgttgtttactttctaaaacgttttcttattttcctcttcaaaagagaatttttttattcatcaaagattactaagctcttaaggggaagtataaccgattattaatgtcagtcttttgtaaaaatattagtttctaacattgtgcctttcggtaactaagtaatgttatataaggcaattttccctgatgtacttaaatttataaagtgttaataaaatgcagttttattatatttttttgaaaccatagagcaaaaatagctcccacatggacaatgggattcagcctaaattccccctaactggtgttcagggcatatttaatgttaatcttgtggaaaatcaataggctccctccttgtaattctcctactccactcccaggttttctaccttccctgccacttcctttaccattctgacaaacactgtgttaaaaccatcatctgaaattctaagaaataagaatgtagcaataaaataagtaaaaaatctacagtaaatgtcaatacttaagagctctcagagaaggttaataatattaatgatgttttatcctctaacttaaatgattggtccccatgtttttcaggttttataccatatatgttatccgtgtctgtttatatgtttacatgaataaaaaccataaagtggtaatataaaaaaacattgggaaaattctctacggacagatttttaagagtgaaagttatctgaaacattgtctaaatgctttgtaattgaaattagacaagtcttagaactctgaagacagagagtaagctataaataataatatcaccatttattgaacacctacttcgtgtcccatgccaccataggtgctccatgcacttcggagccttgccagcctctaaggttagtgttatgaactccattttatagattcaaggatgttagagagcttgttcagagccacagctagtaaactataaagctacatcttaaacccaagtttgttttcctttacaaatgcagttaatataatacataaatgatttagtgttagaaatatggattgttaatggcaattataatctacttgtgagcatatgatttttttaagggaaaagtggaagaaatgtaattttgttttcttctcttgatttccaccctgtctagtctttgagcgcggagatcatttttacttatctttatatgctagcctttggaacataataaggattctcataactaggccatgtcatgaattgtgaactggctctaaatacaat

SEQ ID NO: 38284 - DNA, 726 bp, Bovine  19866881818253
tacagttgcagaatcagttgtttacatcttcggatatttaaacagttttagaaaattaaagctttctaccaaggagtgacattggaacaaggtttctttttgtcaactgtacattaatttcttattaaccaacatcgtagttttcacaaatttcagagtgaccagacccagaggattgtcagtgaagtgggtgtcagagatccaattactaatagttaaaatgtctacgtgagattttgaactcttgactcagtctttttccttcttcctaaatggctcctaaggagagtgacatattaaggaaaaatccagatattagactgacataagaaaggtggaaaaaacagtaccatgcatcaggggtgaaaaaagaagtctctacgaatgtgtcagacataaaagaaagtgaaggaaagttaaaaattaccatagggcaggcaggacacctgctaaagaacctaccgctgccagtcacagctggaaagaaaatgaaagagatgcaaacaactgtcctggaaacaaggaatcatccttttgtctttttgtccccttatgaacaattacagtatgcaaaaatgggagggggatctcaaagtattgggatgaaaatttcagcaggctctgcatataaatagcgaagggcctggaagtgtgcctctttgaaaacaggccgtgtttgggagctcccagtgcattgaagagaatggtaattaatgcatagcgaat

SEQ ID NO: 38285 - DNA, 1035 bp, Bovine  19866880483743
tgccctactgtcgagcacctgaattggatgcttccacatatttctagcactgacttaagccagagtaagacaatgagtggctaggaatcaaaatacagtgttgtaatgtaaactgcttagaggggaagtaagttttcatctgtgaccatcagtcatctgtacttatcttgctgtgtgccttaggcagactgcaaggaagggagtgagatatgaacttgtaaaaaaacaacttgtgataaaatcttcttacctgattctccatcttgggcattacagtctttaatgcaataggcagagtccaactagtccaaatagctatctgtaacaagggcaagagtttaaagaaaaattcagaaattctcagagatgcttaattactcacaggtgatgttgctaggcaaccacttcaccttctgattctgccttcacctaagtgtggtactcagtttgctctattgttacagaatgttaaaagagatggagaagtgaagtataaagaattttaaaccaggtgaaaatagagaggggaaaaaatcttacaatgtagctctgaattaaaagatatgcaaacacagtttaaaaaaaaaattccccatggcttgagaaatcattcttaatgaatagaaatatgagacggaatttcaaaaagaacagaaaaatgtcatatttgaagtcataaattactttaagctaatgtgctgggggacaggatcaatgagctatgccattggacagacccaggagtacgcacagttgtagatccctgctatatttcaagagaatttccaaggacaacaacgcttaaagatattacttcaaactttctgaaactaattactgttctcaccttgccgttagtttgcaattaaccgttctttacctttgatacagaaccttgaagttttcctgataagaaattgctttttcttgttaaactatgaattttagtcatggccatggctctgattttgcttttataggctatataaagttttagtatcatttctcagctgtttcagcatgttcttttgggtt

SEQ ID NO: 38286 - DNA, 1983 bp, Bovine  19866880724201
agaataatggacctttattgttgagcaggtatttctgccactggggacatctgggttcacacgtgatgcacatgcagaatgcaaactgcaagtgaagaaggagaccaaagggcagagaaaaagttttacatttgcagttttcttgtcttgcttaaaacatgaatttttatttcatcaattggaaatgtcaatgattttctacaagttctttttatacatatataaaacaaaatctaagaacaatgaaaaaattaggtggaatggtgggaatttaacaatgtaagtacaaagtgaaagtcactcagtcgtgtccgactctttgcaaccccatggactatatagcccatggaattatccaggccagaatatggagtgggtagcctttcccttctccaggggatcttaccaacccagggatcaaacccaggtctcctgcattgcgggtggattctttaccagctgagccacaaaggaagtctgtaagtacaaacataatctggaaaaaagtaaatgtgaggtagaatgatcattatgaaacatttatcctgaaaatataaaactagtggaagaaaatataccaaaatacgtctctaatcttacagaacagaacttcttaaaatgttaaaagaagatataaacagaaggagaaataacttttactatttttttttttttttgctattttgctgttatatataaaatatacatatatacatataatattgcaattaaaaagaaatcagaataacaaaacatttcaaatgacataaaatcaataagaaaatatgaagacaaatttagacaacataattgttgttatgattacaaaatcatgatattatgattttacctattcacatggtaggaaataattttcatttttgagatatgataatgtcatctatttctatcaactattaaagctctcatattctttctattcttggagcaatgatagctttcaatatttgagaatggcattatagtattaatagaaagtgtcaaattgtattgattgtgcaatgttataattctaacttacagttttagagagttagtgcaaatgaattttgctgttcaatatttttaaaagcattcaaaagacaccctcttcatgtcaagtaatttttcaaaatctttaatgttggccacaattccagcagagttattttgagttgctcaaactcagcaatttcatactctctctctctcttttagacaacacacataatttgggctttaaataccacaggggaaaaaaattatgaaaactagaacgaactaatatatacagaaatgcattgttaattttatctacaaacaggccactccatctgttcaaacataatgttccaaaccaaggaatatgttccaaaccaaagagcatgatatttgacagatggaaaggtctgtaagcctgtctggagcacagaatactatagagtttgtaccagggtccaattttccagctaaatgaaatctaatagaaatttcttcccaatacacatgaaaatcagcaccagttttaccaattgctatgcgtcatagacccaatcatttaatttattttctttctcatacgcaagaaacccatatctactctctgagtcaattttctattttcatggttgttctcctatataaataaatccaaatgccaaacatatttcatgtgaaataaaagtcactaatgagtcaaacaccggatgacctactgtttagcataaaacacatgagggttgtttttagaaaaattcatcatttaaggatcatgtcataatatataagatttggaaaaagctttcataggattttgataaacctcttcaatttattgaactgaacaacagataagaaacataggatatttgtacttccctaaaagcgtgtagccagtgagagaaaagatttctttgctgttgcccggtgttctattctaaaatctagcattctaatttgggttattgcctcattatcattaaa

SEQ ID NO: 38287 - DNA, 2624 bp, Bovine  19866881191232
ccaaataactgattaatgtgttgtgcttagccctcagttgtgtctgattctttgtgaccccatgaactgtggctggccaggctcctctgcccatgggaattctccaggaaagaatactggagtgggttgccatgccctcctccaggggatcttcccaacccaggagcaaacgcaggcctctcatgttgcaggcagattctttaccgtctgagccaccagggaagcctgactaattcatagttcattcaacaaaaacagaataaaaatttaaagacaagaataaagtatttgttcagttaacagatcacaatagcattttgattattcagagagaacttgtacttgactacaaattgggctctttacttacaaactataaacaatcattataagatataatatctaaatgtttaatccttgacatctgcattttatatttgagatgtgtatgcctgtgtgtgtgtgtgtgtaaggatgaaatttggcacattagctagctgaaaaccgtattcacttctatttctattgtattaacagaaaaattggctgcagctggcaataatttcttttgaaaaggattcaatgacacattatttcaaatacaaatgtatatagttgagtaatgattaaacaactgtaccactctacccactgaaaaaagtatttattgtgaacatcaagcaaagagaaatatatgtatatatatactagaattctgaattttatctatactatttgataagtagttaaatttgtgtggaatctgtatacaaacgaatgttaacactttttcaaaacttcatgctaataatgtgtatacaactttcttaaaagaaactagaataggcagaacaatcttgaaaaagaagaaagtttatgaactcacactagtttatttcaatattactattaagtgactaatccagatagactaatgttggtgaaagatagatatgtaaaagagtggaacaaaatataaacttcaggaacactcccaagcaatgatcaagttgactttttctaattaataaactttacttttagaacagattagatttatagaaaaagtaaccaaatagtacagagaattctgatatctcttctatcttccccacaccatagagtttcatctattattaagatcttttaatagtatggtttattttttataattgaagaaccaatattgatacattagtgttaacttaaattcatgatttgcataaagtctcatcttctaaagtcttgctatgaggccattaataccctggtaacaaaagcagacaaaatcaatagatgtaacaaaagtacacttatagatgaatatcccttaggaatatagacacaaaaaaataacaaaaattaaaaaaaaaaacaataaacaaaaaaattcattaaaatactaccaaagcagatcctgcaatgtataaaaggaatttatacaccatgaccaaatgagcttcaagtgaggaattcaagagtggttcaacctaagaaaatcaatcagtgtaatataccacattaacagaaaaaaaaatcaaatgatcatctcaattttatggaaataaaaagctggattgataaaaacactaaaactaaagtaggtatagaagggaatttttcaacctgaaaaaaaatttatggaaagtccataggtaacatcatatttacttatgaaagactttgatttcctcctactatcaagaaagaacaagtatttctactcttgccacttctactgaaccttatactgaagttcctcgccagggtaactaggcaaaaaaagaaataaatggcatctgataggacagaagaaattaaaacattctatggtgtgagtttatatatagtaaatcctaaataatctatgggaaaaaaaccctatatgataaattaattcaacaaagctgcagtatacaatgtcaacatacaaaaatttattacatatctaacattggcaaaaacaatcaaaactgaaactaagaaaacagttctaattttagtagaatcaaaaccaataaatcctcagaaataaatttaataaaataaatacaagatttatacattgaaaactataaaaattgttcaaagaaactaatgaagaccaaagtaaatggaaagatcctgtattcgtggatttggaaacttaagttttgctaagatgtcaataattccccaatttatcgacagattcaacaaaatccatatcaaatccaagcttccttttttgcttaaatcgataaactgttcctaaaattcatatttaggagaagggggcatcagaggatgagatggtgatgctgtcaccaatgcaattaacatgaaattgggcaaactctgggagatggtaagggacagggaagcctggcgtgctgtggtccatggagtcacaaagagtcatacacaactgggtgactgaacaacaacaacaaaattcatatggaatttctgagaacattgaaaagccaaagcaaccttgaaaaaaaaacgagttatttaatccacagttcctgatcttaaaatactattacaaacacattatgatcagtaggatgtggtatttttatacaaatagacatagattaatggaatataattgaaatttcagaagcagacccctatat

SEQ ID NO: 38288 - DNA, 857 bp, Bovine  19866880244626
tcacttcagtcgtgtctgactctgtgcgaccccatagacggcagcccaccaggctcccccatccctgggattctccaggcaagaacactgggagtgggttgccatttccttctccaatgcatgaaagtgaaaagtgaaagtgaagtcgctcagtcgtgtctgactcttagcgaccccatggactgcgggcctaccaggctcctcccatctatgggattttacaggcaagagtactggagtggggtgccattgccttctccgtcggtcacactggctcacagtaaactttctttataataagtacttattttattgctaaatatttgagtgaagtttcaccaactgtctaaagcatactagcatttatatttttaaacatttgtgatagcttttccttattagctagtaaggaaataaccagtcttctgacatttgacaatttttttttaaagttttttgactaaactttattgaatttttaaattactgaaaatttccatttttatgccgttaactttcacagtaattcccttttaagtattatgtcatgctttgaaatgctttctccaaaaataggaaaaataatgaactttattctagcatttctatggtttcaaaaatcctttagaacatatttctagattagctgattcatggcatgtaacacttgtgaagtaaaagaggaagagtgaagtacattgagtaactataaatattgcaacatatctgagaggcatacaatggatgcatagtagaagaggaattgcatggcatggcccaagttctgaccacagccctgttaataataacaataataggttttggaatgagcagcccacagtcatatttctcatttc

SEQ ID NO: 38289 - DNA, 529 bp, Bovine  19866880643566
actttttaggagcaagaaaaagttcttcaggataattgcttgtaaaaagtaagacagtctcacaaagctttagcagctgcaatgcaccctgtgtaaaaggattatgacatcacaggcgtttgtactggcattttagctgatactctgttcatctctaagaaattcccttattctctccattaagcaataagtaaagtatcctgaagatatgaaacttaatttgactactatcaaccaagtgcagacatgacagaaacaaaaaaaactagtaaaagcacagagtaaaagtggagtaaacaaagggccagagcctaggagccttgtcatgattctacctctacgtatttgacccggtgacccttggccagacaccaggcttctcagagcctcggcatgctctcccagaaaacgggccaatgttcagtgtcctttcctgatccctccttctatgaactgatgcttcctggtgaatgaaaggtcagattgtcctgtgttcatgaggattttaggctcaattttctgtgaaaca

SEQ ID NO: 38290 - DNA, 1888 bp, Bovine  19866880749237
ctaaaaaaaaaaaatctatgatgaaatcaaagaggaaattaaaaataccttgagactaatgacaatgaaaatataaccaaacaaaatctatgagatgcagcaactgcagtcataagagggatgtttatagcaatacaggtcttcctcaaaaataagaaaaatctgaaacaaagtaacttatctagaacacactcacaccatatacacaaaaatagatgcaaaatggccttaaaaatctaatataaggaacaacaccataaaactcctagaaaaggacctaggcaaaatattctctgacataaatagcagcaacgttttcttagatttttttaccacctgagccacaagggaagcccaatcacataaatatttaatctatagaagaaagtagctctgaaaatgacttcaatataactgctccatagtaattttgaaacaaaaattattttcagaagagtttgaaaacaaaagtaaaaatagttcatacccaggtattgagccccggtgtgttataaaatgggcttccctggtggctcagacagtaaagcatccgcctgcaatgcaggagacttgggttcgatccctgggttgggaagatgccctggagaaaggaatagctacccactacagtattttggcctgaaagaattccatggacagaggatcacaagaactgttttctagggaattaagcaagaattctaacaagattatatccatattttctaatttaaagcaatactataaattttaaaataagaaaaaaaaaaaagaatctccagaatgaagttgaggttccccaaatgaagctctttcttatctgtgtttaggtcattttacgctgtgtttggagccgaaattaatctaaaaggaatccctgtgtatagatttgttcttccatccaggatttttgcatctccacttcaaaatccagacaaccattgtttctgcacagaaaaaattatctccaagggttgcaccttatatggtgtgctagatattagcaaatgcaaagaaggtatgcaaaagttctcatgtcacaattcatggcctaatctgcaatactctttaaaatgtaaacttcactcaggattccttttctacaagaaatctaaagtgagaaagcagtaagggcagaaagtaaggataatagtaggattttgttttcatttttgtcccactttcaaggccccagttgtttctgtgttgcaaaatttcatttagataaaaccacactgatacttccctgagctactttggaaaatgtctctttaggtcctctgctcattttttaattgcgtgattttttcagttgtgtgaattccttgtatattttggatgttaatcatgtgttttgtgaatattttctcccactccataggcagcctttcatttttgatggtttccttttctgtgcagaatctctgctccttttagatatagagcaaaatgaaaataattcccagaatactctgagcatcccaacttatctatctgacatttttctaacttttttaccctaggaaatggtaaataaaagtaagcatatttcaagatgtctctgaaacaaaagttgattcaatcaataaattgggagtctcattttgctcatcttcttcatgtcggagtaggtgagaataaagaaagaaaagcctagtaggtgataataaacaaagaaaagcctcttaaataaattctcaaagacatattactacctgaaacatgaaggtatatgggttgtattaataactatgtgttcagtagctaagctttatatactgaaaataaacacttaagggatgcacaatagaagtttatgttttatttctgatcaaaagtgatcagatgtgatacttttccctcacccttatccctcaatttctattca

SEQ ID NO: 38291 - DNA, 1608 bp, Bovine  19866880764539
aaaattagtgaatcatggtttaagagtgtgccaggaactattcctcacttgcaatgtttgcagcttttgttgtgaacaaatgtgaacgttggaagacctgctgaaaggtgacttctagccttaaaccggagggaagaagttcaacttcatagctgctgctctgccatggtaaattattattaaacaagttttcttctcacaaaagcccattcaaatggtttcaattgcttttatttattctacaggatttcagctccacaaatgctcctgctgttactatgtacagagttctgcatgggagatgtgaggaagaaaacaaaatggcatctttcatacgcaggaggaatattaatgaggtagagaagagggaagggatcattatggtaagcttcctttctgtttgccccctaagattagaatttactttttccttgcctaatcctggttttcctgacttcatccggtaaaacatagaattttgctgaactgctataactgaacgatatagtatgcgaaacaaagtttggataacaggagacaaactcttaatgaggtcaggacgcaactctgaccaatgaattgagaaagaaaatagagaatgatgtctgtatctctccatttgctgtggccattacatccgcctcaagggagggctttggaggtatgtgtggttaggctaacaaagaacatctactatgctatggtttcccatgaagtaggaagtggagaaatcaaaacctgtactttccctgttcagttcagttcagttcagcactcagtcgtgtctgactctttgtgaccccatgaattgcagcacgccaggcctccctgtccatcaccaactcccagagtttacccaaactcttggccatcgagtcggtgatgccatccagccatctcttagcaaatcttaaaaatgaccattggacccagagtggaactggctttatctaaaaactttggtaaatgtactgtagacacctaagaaactgaacacagaagcaaacatatctaagctctgcacatagaatgggaaataggataagattttcatggcactgggtgagatgaatgagcttcatggatttggttcattgaggaattatcagtgtctgtgaatttgcatacttagcatagcatgaaacatagaatatttctgttaaattttataattttaatagatgatctaccctacacagggagagagagagtaaaaaacaaaacaaaagagacatgctgagaaaggtgagggtggtactggtgatggtaatattccgtgaaactgcttacctgagaatttctcactcacaaaactgcacacatctatgtattactttatggtagagatttatgtcaagttggatattttttaaaaaatgctaagcataagaaatggagataaaagattttaaattgttttacatggctaaaaattcttaagatctagtttagacctcattggaaggtgaaccttttgggttataaaagatttacacctatttttgaataaatatgtactatctgtttattaagtgcttactatgtatccagcactagatattgctgatactaagtcacaaatgaaacccagccttcatggagttcaca

SEQ ID NO: 38292 - DNA, 3713 bp, Bovine  19866880798056
ccttaagaactcttaatttatccgaaaaattttagcatttcagataaagggaaattattttaaggtacattaaaattatagacaaaagaccagaagcatctgtaagcccatagaaggatttactatttactattcaagtcatgcaaaaaggtttttaaaaatcatcatttgtgccagaaataattggcagaggaactaatcaccattcaagaaacatttagtaaatactaatgcaagacatggtattaatgctgctcaacacaggtttagtttctcttcaagagtatgcattatcataacttattcatagtacaatgtaggacacattttaactgaaagcaacaataaaaagcctgaatggttaatgtattcatgttaaccattaatacagactgtattttaacagctcattcaattcaacaacaacaaaaacaaataacccaatcaaaaaatgggcagaagacctaaacagacatttccaaaagagatatgcaatcacacaaaaagattttcagcatcactaattattagagaaaggcaaatcgaaattacaatgaggcaccacctcagaccagtgagaatggacagccttaaaatgccgacaaataacaagtgctagagagggtgcggagaaaagggagcctttctactatgttggtgggaatgtgagttggtgcagccactacagaaaacagtatgaaggtttcaaaaagccagagttgccatatgatccggcaatcccagtctcgggcatatacccagacaaaaccataattcgaaaagacacgtgcaccccaatgctcacagcagcattatttacagaagtaaatacatggaaaaaacccaaatgaccatcagcagagggatggataaaaaaagatatagtatatacagacaatggaacattattcagctataaaaaagaacacaataatgtcattttcaataagatgaatggacctagagattatcatactaagcaaagtaagtcagagagaaaggttaatatgattatcacttgtattatatgatatcacctgtatacgaaatctaaaataagacacaagtgaatatatctatgaaacagaaagaaacagactgacagatatacagaacagacttgtggttgccaaggggaagagaagttgagagagggaagggctgggagttagggattagcagatgcaaactattattgatacatcgatatgtaggatggattaacagcaacatcctactgtacagcacaggtaactacattcagcatcctgtgacaaaccataatggaaaggagtatgaaaaagaatgtgtgtgtatgtgtgtgtgtatatatataataaccactttggtgtacagcagaaatcaacacattgtaaatcaactatacttcaataacattaaaaatatatatagactgtttttacaataaagaatacttgactaaaagtagacattgagttaaaactgaacatttttgtatattattaactttgtgatgttttaagaatttaaatgttttcatctggaagcaaaatctaaatcagtcatcttgtaagactgttcaagaatgtggttatccttttaaaaatatttaggaaaaaagtaataagtttgtaagaagtggatcagagtatgaatgaaatatttatagcactcctctttctcttacccctttgttttgcaccaaaagggtgcaaaattgagataaaattttatcaaattttaaaattgaaatatctgcctctagccaatgcagtaaatgatgtggtcatcagaaggcccaaggaaaatcataaaacattggaagtagctatgtgtacaggttgataaatacccaatttcatcaaaacactttagaacaggaagagaaattagagataatcttgttccacaccctcatctaccaatgaataaactaaacccagagttaataggactctttgtaggtatccatttcccaagttgtgctggcagtatagctagcacatctggtgacacatgtggtctaatgtggtctactataaactagggggaaattggtggctctcaaaattttggggtgctggtgtgtttgttgagcatgccccatgctcagagatccaattcaattaagtctaaacagaggctagatgtctgaaattttaacagtgactgataaagtcatccttggttagtttgagtcagagtgagaaatataaaacctacaatgccaagtttttaaaatggatgttaatgctgagtaagcaggctttccaaacaagttacagctttttttcattaaatataactgtttttcccttccattgacactataaggaaaagggaatggtgtttaaacaaggaactgtagagaccacaaagcaatacttgaccaactttccacaaatgcagactcaccagggatacttgttaagactatacacattgatggcggactttcttggtggtctggtagttgagactccgccgcctatacagggggcaccccctgggtccctggctggggaggctgggaaactaagatcccacatgttgggcagtgcagacaaaattatatacatatatgtattcatggggccttttcctggagaatcttatttaccaggttgatatgtggtgggacccaggaatgtgtaattttcagaataactcctggtaattctgttaaccaaacccagtttgtaaactctgtcacgatctgttgtattaataccagtttcgacggttctcaatcagggaactcaggaaaacgcttacctccagagcttctggacaggtcggtctgcagtaggtcagagaatttgtactgtttcaggctcccaggtgatgttcattccttgcaaacctctgggctagactgtgctctgcaaactgaggcagaagattcacaggaagacgcccagaagccgctgcaatttctctactgaaacctgggcttctgctcctgctgcctcaagtacaagaaaatggtagccgctgctgttttcaagcctggagcaggtgcttccaattcctgaaacctggacgcgaacctcctgggagagattctggcccatggaacgcccaggcctctgaggggagaaggggcagccggccagagtggagaggggctgggggtgggaagcaggagaggggaaatcctgctaattgcaaacacaaaaggtaatgcaaatatgcagataccttttagtagtagtttgcctccaaattgtataaactagttaatccatgatcgtgttggaaacagacacagggacttccttagtggtcatgtaactaaaactgcgggtcccggggcagggggccctattcagtccctggtttgggaacgagaacccacatgccacagctgggttcgcatgtgataatgaagatccggaatgcagcaaagaagatagaagatctcgcaagccacaactaagacctggcacaaccaagtgaataattttttttaaaacacaaaattacctcatctttcatggaagttatgtagtgaacgctgtaacatgctacccagatagccctcagaacaggcacacttacttcctcgctcctggggttgttgctgagagtgctgccaggaattgcatcagttgatgtgagtcacctggcctcatgctctgtacaaccccccccctccccttcaggaatagccagcatccagtgactagacatctgaggtccctgccaaaactctgaaaggatcttataag
